(12) United States Patent
Barts

(10) Patent No.: US 7,323,308 B2
(45) Date of Patent: Jan. 29, 2008

(54) METHODS OF GENETIC ANALYSIS OF E. COLI

(75) Inventor: Jennifer H. I. Barts, Palo Alto, CA (US)

(73) Assignee: Affymetrix, Inc., Santa Clara, CA (US)

( * ) Notice: Subject to any disclaimer, the term of this patent is extended or adjusted under 35 U.S.C. 154(b) by 242 days.

(21) Appl. No.: 10/933,982

(22) Filed: Sep. 3, 2004

(65) Prior Publication Data

US 2006/0051769 A1 Mar. 9, 2006

(51) Int. Cl.
C12Q 1/68 (2006.01)
C12P 19/34 (2006.01)
C07H 21/02 (2006.01)
C07H 21/04 (2006.01)
C12M 1/34 (2006.01)
C12M 3/00 (2006.01)

(52) U.S. Cl. .............. 435/6; 435/91.1; 435/287.2; 536/23.1; 536/24.3

(58) Field of Classification Search ................ None
See application file for complete search history.

(56) References Cited

U.S. PATENT DOCUMENTS

| | | | |
|---|---|---|---|
| 5,143,854 A | 9/1992 | Pirrung et al. | |
| 5,800,992 A | 9/1998 | Fodor et al. | |
| 5,994,075 A | 11/1999 | Goodfellow | |
| 6,228,575 B1 | 5/2001 | Gingeras et al. | |
| 6,344,316 B1* | 2/2002 | Lockhart et al. ............... | 435/6 |
| 6,821,724 B1 | 11/2004 | Mittman et al. | |
| 7,115,364 B1 | 10/2006 | Chee et al. | |
| 2002/0025552 A1* | 2/2002 | Legrain et al. ............ | 435/69.1 |
| 2002/0032319 A1* | 3/2002 | Cargill et al. .............. | 536/23.1 |

OTHER PUBLICATIONS

Affymetrix, GeneChip® E. coli Antisense Genome Array.*
GenBank releasse history.*
Genbank E. coli genomes.*
Affymetrix, GeneChip® E. coli Genome II Array.*
Affymetrix E. coli Genome Array Product Insert P/N 700388, Feb. 2000.
Affymetrix GeneChip E. coli Antisense Genome Array P/N 701109, Oct. 2001.
Rosenow, C. et al. Prokaryotic RNA preparation methods useful for high density array analysis: comparison of two approaches, Nucleic Acids Research 29(22), E112, 2001.
Schembri, M. A. et al., Coordinate gene regulation by fimbriae-induced signal transduction, EMBO Journal 20(12), 3074-81, 2001.
Lockhart et al., Expression monitoring by hybridization to high-density oligonucleotide arrays, Nat. Biotech 14:1675-80 (1996).
Zheng, et al., DNA microarray-mediated transcriptional profiling of the *Escherichia coli* response to hydrogen peroxide, J. Bacteriol. Aug. 2001; 183(15):4562-70.
Wei et al., High-density microarray-mediated gene expression profiling of *Escherichia coli*, J. Bacteriol. Jan. 2001; 183 (2):545-56.
Oh et al., Global Expression Profiling of Acetate-grown *Escherichia coli*, J. Biol. Chem., vol. 277, Issue 15, 13175-13183, Apr. 12, 2002.
Frey et al., Gene Expression Arrays: Highly sensitive detection of expression patterns with improved tools for target amplification, Biochemica 2:27-29 (2002).

* cited by examiner

*Primary Examiner*—Jehanne S Sitton
(74) *Attorney, Agent, or Firm*—Sandra E. Wells

(57) ABSTRACT

The invention provides nucleic acid sequences which are complementary, in one embodiment, to a wide variety of *E. coli* genes. The invention provides the sequences in such a way as to make them available for a variety of analyses. In one embodiment the nucleic acid sequences provided are present as an array of probes that may be used to measure gene expression of at least 20,000 *E. coli* genes and at least 500 intragenic regions. As such, the invention relates to diverse fields impacted by the nature of molecular interaction, including chemistry, biology, medicine, and medical diagnostics.

14 Claims, No Drawings

METHODS OF GENETIC ANALYSIS OF E. COLI

FIELD OF THE INVENTION

The present invention provides a unique pool of nucleic acid sequences useful for analyzing molecular interactions of biological interest. The invention therefore relates to diverse fields impacted by the nature of molecular interaction, including chemistry, biology, medicine, and medical diagnostics.

REFERENCE TO SEQUENCE LISTING

The Sequence Listing submitted on compact disk is hereby incorporated by reference. The file on the disk is named 3700seqlist.txt, the file is 31,216 KB and the date of creation is Sep. 2, 2004.

BACKGROUND OF THE INVENTION

Many biological functions are carried out by regulating the expression levels of various genes, either through changes in levels of transcription (e.g. through control of initiation, provision of RNA precursors, RNA processing, etc.) of particular genes, through changes in the copy number of the genetic DNA, through changes in RNA processing such as polyadenylation and splicing or RNA stability or through changes in protein synthesis. For example, control of the cell cycle and cell differentiation, as well as diseases, are characterized by the variations in the transcription levels of a group of genes. Gene expression is not only responsible for physiological functions, but also associated with pathogenesis. For example, the lack of sufficient functional tumor suppressor genes and/or the over expression of oncogene/protooncogenes leads to tumorgenesis. (See, e.g., Marshall, Cell, 64: 313-326 (1991) and Weinberg, Science, 254: 1138-1146 (1991)). Thus, changes in the expression levels of particular genes (e.g. oncogenes or tumor suppressors), serve as signposts for the presence and progression of various diseases.

Arrays of probes to E. coli have been available, for example, the Affymetrix E. coli genome array, described in U.S. patent application Ser. No. 09/956,604. Probe selection for earlier arrays was based on the genome sequence information available at the time of the array design. The E. coli Antisense Genome Array was designed using sequence information from the M54 version of the E. coli Genome Project database at the University of Wisconsin. Over time databases of genomic sequence are updated and refined to reflect new information. As such, our understanding of the genome changes over time, for example, sequencing errors are corrected, polymorphisms are identified, transcripts are mapped more accurately, new genes are identified, exon-intron boundaries are mapped, and transcription start sites and polyadenylation sites are mapped. Arrays containing collections of probes designed using updated genome sequence information that reflects changes in the genomic sequence and annotations to the genome, may be used to obtain more accurate information about gene expression.

SUMMARY OF THE INVENTION

The invention provides nucleic acid sequences which are complementary to particular E.coli genes and ESTs and makes them available for a variety of analyses, including, for example, gene expression analysis. In a preferred embodiment an array comprising nucleic acid probes where each probe is one of the sequences listed in SEQ ID Nos. 1-224,976 is disclosed. Each probe sequence may be present in a feature of known location that can be distinguished from other features that comprise probes of different sequence. For example, in one embodiment the invention comprises an array comprising any 10 or more, 100 or more, 1000, or more, 10,000 or more or 100,000 or more nucleic acid probes containing 9 or more consecutive nucleotides from the sequences listed in SEQ ID NOS: 1-224,976, or the perfect match, perfect mismatch, antisense match or antisense mismatch thereof. In a further embodiment, the invention comprises the use of any of the above arrays or fragments disclosed in SEQ ID Nos. 1-224,976 to: monitor gene expression levels by hybridization of the array to a DNA library; monitor gene expression levels by hybridization to an mRNA-protein fusion compound; identify polymorphisms; identify biallelic markers; produce genetic maps; analyze genetic variation; comparatively analyze gene expression between different species; analyze gene knockouts; or, to hybridize tag-labeled compounds. In a further embodiment the invention comprises a method of analysis comprising hybridizing one or more pools of nucleic acids to two or more of the fragments disclosed in SEQ ID Nos. 1-224,976 and detecting said hybridization. In a further embodiment the invention comprises the use of any one or more of the fragments disclosed in SEQ ID Nos. 1-224,976 as a primer for PCR. In a further embodiment the invention comprises the use of any one or more of the fragments disclosed in SEQ ID Nos. 1-224,976 as a ligand. In another embodiment each of the sequences in SEQ ID Nos. 1-224,976 is synthesized on an array as a probe and the array is used to monitor gene expression from a biological sample isolated from rat.

DETAILED DESCRIPTION OF THE INVENTION

The present invention has many preferred embodiments and relies on many patents, applications and other references for details known to those of the art. Therefore, when a patent, application, or other reference is cited or repeated below, it should be understood that it is incorporated by reference in its entirety for all purposes as well as for the proposition that is recited.

As used in this application, the singular form "a," "an," and "the" include plural references unless the context clearly dictates otherwise. For example, the term "an agent" includes a plurality of agents, including mixtures thereof.

An individual is not limited to a human being but may also be other organisms including but not limited to mammals, plants, bacteria, or cells derived from any of the above.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as *Genome Analysis: A Laboratory Manual Series (Vols. I-IV), Using Antibodies: A Laboratory Manual, Cells: A Laboratory Manual, PCR Primer: A Laboratory Manual,* and *Molecular Cloning: A Laboratory Manual* (all from Cold Spring Harbor Laboratory Press), Stryer, L. (1995) *Biochemistry* (4th Ed.) Freeman, New York, Gait, "*Oligonucleotide Synthesis: A Practical Approach*" 1984, IRL Press, London, Nelson and Cox (2000), *Lehninger, Principles of Biochemistry* $3^{rd}$ Ed., W.H. Freeman Pub., New York, N.Y. and Berg et al. (2002) *Biochemistry,* $5^{th}$ Ed., W.H. Freeman Pub., New York, N.Y., all of which are herein incorporated in their entirety by reference for all purposes.

The present invention can employ solid substrates, including arrays in some preferred embodiments. Methods and techniques applicable to polymer (including protein) array synthesis have been described in U.S. Ser. No. 09/536,841, WO 00/58516, U.S. Pat. Nos. 5,143,854, 5,242,974, 5,252,743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT Applications Nos. PCT/US99/00730 (International Publication No. WO 99/36760) and PCT/US01/04285 (International Publication No. WO 01/58593), which are all incorporated herein by reference in their entirety for all purposes.

Patents that describe synthesis techniques in specific embodiments include U.S. Pat. Nos. 5,412,087, 6,147,205, 6,262,216, 6,310,189, 5,889,165, and 5,959,098. Nucleic acid arrays are described in many of the above patents, but the same techniques are applied to polypeptide arrays.

Nucleic acid arrays that are useful in the present invention include those that are commercially available from Affymetrix (Santa Clara, Calif.) under the brand name GeneChip®. Example arrays are shown on the website at affymetrix.com.

The present invention also contemplates many uses for polymers attached to solid substrates. These uses include gene expression monitoring, profiling, library screening, genotyping and diagnostics. Gene expression monitoring and profiling methods can be shown in U.S. Pat. Nos. 5,800,992, 6,013,449, 6,020,135, 6,033,860, 6,040,138, 6,177,248 and 6,309,822. Genotyping and uses therefore are shown in U.S. Ser. Nos. 10/442,021, 10/013,598 (U.S. Patent Application Publication 20030036069), and U.S. Pat. Nos. 5,856,092, 6,300,063, 5,858,659, 6,284,460, 6,361,947, 6,368,799 and 6,333,179. Other uses are embodied in U.S. Pat. Nos. 5,871,928, 5,902,723, 6,045,996, 5,541,061, and 6,197,506.

The present invention also contemplates sample preparation methods in certain preferred embodiments. Prior to or concurrent with genotyping, the genomic sample may be amplified by a variety of mechanisms, some of which may employ PCR. See, for example, *PCR Technology: Principles and Applications for DNA Amplification* (Ed. H. A. Erlich, Freeman Press, NY, N.Y., 1992); *PCR Protocols: A Guide to Methods and Applications* (Eds. Innis, et al., Academic Press, San Diego, Calif., 1990); Mattila et al., *Nucleic Acids Res.* 19, 4967 (1991); Eckert et al., *PCR Methods and Applications* 1, 17 (1991); *PCR* (Eds. McPherson et al., IRL Press, Oxford); and U.S. Pat. Nos. 4,683,202, 4,683,195, 4,800,159 4,965,188, and 5,333,675, and each of which is incorporated herein by reference in their entireties for all purposes. The sample may be amplified on the array. See, for example, U.S. Pat. No. 6,300,070 and U.S. Ser. No. 09/513,300, which are incorporated herein by reference.

Other suitable amplification methods include the ligase chain reaction (LCR) (for example, Wu and Wallace, *Genomics* 4, 560 (1989), Landegren et al., *Science* 241, 1077 (1988) and Barringer et al. *Gene* 89:117 (1990)), transcription amplification (Kwoh et al., *Proc. Natl. Acad. Sci. USA* 86, 1173 (1989) and WO88/10315), self-sustained sequence replication (Guatelli et al., *Proc. Nat. Acad. Sci. USA,* 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. Nos. 5,413,909, 5,861,245) and nucleic acid based sequence amplification (NABSA). (See, U.S. Pat. Nos. 5,409,818, 5,554,517, and 6,063,603, each of which is incorporated herein by reference). Other amplification methods that may be used are described in, U.S. Pat. Nos. 5,242,794, 5,494,810, 4,988,617 and in U.S. Ser. No. 09/854,317, each of which is incorporated herein by reference.

Additional methods of sample preparation and techniques for reducing the complexity of a nucleic sample are described in Dong et al., *Genome Research* 11, 1418 (2001), in U.S. Pat. Nos. 6,361,947, 6,391,592 and U.S. Ser. Nos. 09/916,135, 09/920,491 (U.S. Patent Application Publication 20030096235), Ser. No. 09/910,292 (U.S. patent application Publication 20030082543), and Ser. No. 10/013,598.

Methods for conducting polynucleotide hybridization assays have been well developed in the art. Hybridization assay procedures and conditions will vary depending on the application and are selected in accordance with the general binding methods known including those referred to in: Maniatis et al. *Molecular Cloning: A Laboratory Manual* ($2^{nd}$ Ed. Cold Spring Harbor, N.Y, 1989); Berger and Kimmel *Methods in Enzymology,* Vol. 152, *Guide to Molecular Cloning Techniques* (Academic Press, Inc., San Diego, Calif., 1987); Young and Davism, *P.N.A.S,* 80: 1194 (1983). Methods and apparatus for carrying out repeated and controlled hybridization reactions have been described in U.S. Pat. Nos. 5,871,928, 5,874,219, 6,045,996 and 6,386,749, 6,391,623 each of which are incorporated herein by reference The present invention also contemplates signal detection of hybridization between ligands in certain preferred embodiments. For example, methods and apparatus for signal detection and processing of intensity data are disclosed in, U.S. Pat. Nos. 5,143,854; 5,547,839; 5,578,832; 5,631,734; 5,800,992; 5,834,758; 5,856,092; 5,902,723; 5,936,324; 5,981,956; 6,025,601; 6,090,555; 6,141,096; 6,171,793; 6,185,030; 6,201,639; 6,207,960; 6,218,803; 6,225,625; 6,252,236; 6,335,824; 6,403,320; 6,407,858; 6,472,671; 6,490,533; 6,650,411; and 6,643,015, in U.S. patent application Ser. Nos. 10/389,194, 60/493,495 and in PCT Application PCT/US99/06097 (published as WO99/47964), each of which also is hereby incorporated by reference in its entirety for all purposes.

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, for example Setubal and Meidanis et al., *Introduction to Computational Biology Methods* (PWS Publishing Company, Boston, 1997); Salzberg, Searles, Kasif, (Ed.), *Computational Methods in Molecular Biology*, (Elsevier, Amsterdam, 1998); Rashidi and Buehler, *Bioinformatics Basics: Application in Biological Science and Medicine* (CRC Press, London, 2000) and Ouelette and Bzevanis Bioinformatics: A Practical Guide for Analysis of Gene and Proteins (Wiley & Sons, Inc., 2nd ed., 2001). See U.S. Pat. No. 6,420,108.

The present invention may also make use of various computer program products and software for a variety of purposes, such as probe design, management of data, analysis, and instrument operation. See, U.S. Pat. Nos. 5,733,729; 5,593,839; 5,795,716; 5,733,729; 5,974,164; 6,066,454; 6,090,555; 6,185,561; 6,188,783; 6,223,127; 6,228,593; 6,229,911; 6,242,180; 6,308,170; 6,361,937; 6,420,108; 6,484,183; 6,505,125; 6,510,391; 6,532,462; 6,546,340; and 6,687,692.

Additionally, the present invention may have preferred embodiments that include methods for providing genetic information over networks such as the Internet as shown in U.S. Ser. Nos. 10/197,621, 10/063,559 (United States Publication No. 20020183936), Ser. Nos. 10/065,856, 10/065,868, 10/328,818, 10/328,872, 10/423,403, and 60/482,389.

I. Definitions

The term "array" as used herein refers to an intentionally created collection of molecules which can be prepared either synthetically or biosynthetically. The molecules in the array can be identical or different from each other. The array can assume a variety of formats, for example, libraries of soluble molecules; libraries of compounds tethered to resin beads, silica chips, or other solid supports.

The term "combinatorial synthesis strategy" as used herein refers to a combinatorial synthesis strategy is an ordered strategy for parallel synthesis of diverse polymer sequences by sequential addition of reagents which may be represented by a reactant matrix and a switch matrix, the product of which is a product matrix. A reactant matrix is a 1 column by m row matrix of the building blocks to be added. The switch matrix is all or a subset of the binary numbers, preferably ordered, between 1 and m arranged in columns. A "binary strategy" is one in which at least two successive steps illuminate a portion, often half, of a region of interest on the substrate. In a binary synthesis strategy, all possible compounds which can be formed from an ordered set of reactants are formed. In most preferred embodiments, binary synthesis refers to a synthesis strategy which also factors a previous addition step. For example, a strategy in which a switch matrix for a masking strategy halves regions that were previously illuminated, illuminating about half of the previously illuminated region and protecting the remaining half (while also protecting about half of previously protected regions and illuminating about half of previously protected regions). It will be recognized that binary rounds may be interspersed with non-binary rounds and that only a portion of a substrate may be subjected to a binary scheme. A combinatorial "masking" strategy is a synthesis which uses light or other spatially selective deprotecting or activating agents to remove protecting groups from materials for addition of other materials such as amino acids.

The term "complementary" as used herein refers to the hybridization or base pairing between nucleotides or nucleic acids, such as, for instance, between the two strands of a double stranded DNA molecule or between an oligonucleotide primer and a primer binding site on a single stranded nucleic acid to be sequenced or amplified. Complementary nucleotides are, generally, A and T (or A and U), or C and G. Two single stranded RNA or DNA molecules are said to be complementary when the nucleotides of one strand, optimally aligned and compared and with appropriate nucleotide insertions or deletions, pair with at least about 80% of the nucleotides of the other strand, usually at least about 90% to 95%, and more preferably from about 98 to 100%. Alternatively, complementarity exists when an RNA or DNA strand will hybridize under selective hybridization conditions to its complement. Typically, selective hybridization will occur when there is at least about 65% complementary over a stretch of at least 14 to 25 nucleotides, preferably at least about 75%, more preferably at least about 90% complementary. See, M. Kanehisa Nucleic Acids Res. 12:203 (1984), incorporated herein by reference.

The term "genome" as used herein is all the genetic material in the chromosomes of an organism. DNA derived from the genetic material in the chromosomes of a particular organism is genomic DNA. A genomic library is a collection of clones made from a set of randomly generated overlapping DNA fragments representing the entire genome of an organism.

The term "hybridization" as used herein refers to the process in which two single-stranded polynucleotides bind non-covalently to form a stable double-stranded polynucleotide; triple-stranded hybridization is also theoretically possible. The resulting (usually) double-stranded polynucleotide is a "hybrid." The proportion of the population of polynucleotides that forms stable hybrids is referred to herein as the "degree of hybridization." Hybridizations are usually performed under stringent conditions, for example, at a salt concentration of no more than about 1 M and a temperature of at least 25° C. For example, conditions of 5×SSPE (750 mM NaCl, 50 mM NaPhosphate, 5 mM EDTA, pH 7.4) and a temperature of 25-30° C. are suitable for allele-specific probe hybridizations or conditions of 100 mM MES, 1 M [Na$^+$], 20 mM EDTA, 0.01% Tween-20 and a temperature of 30-50° C., preferably at about 45-50° C. Hybridizations may be performed in the presence of agents such as herring sperm DNA at about 0.1 mg/ml, acetylated BSA at about 0.5 mg/ml. As other factors may affect the stringency of hybridization, including base composition and length of the complementary strands, presence of organic solvents and extent of base mismatching, the combination of parameters is more important than the absolute measure of any one alone. Hybridization conditions suitable for microarrays are described in the Gene Expression Technical Manual, 2004 and the GeneChip Mapping Assay Manual, 2004.

The term "hybridization probes" as used herein are oligonucleotides capable of binding in a base-specific manner to a complementary strand of nucleic acid. Such probes include peptide nucleic acids, as described in Nielsen et al., *Science* 254, 1497-1500 (1991), LNAs, as described in Koshkin et al. *Tetrahedron* 54:3607-3630, 1998, and U.S. Pat. No. 6,268,490, aptamers, and other nucleic acid analogs and nucleic acid mimetics.

The term "hybridizing specifically to" as used herein refers to the binding, duplexing, or hybridizing of a molecule only to a particular nucleotide sequence or sequences under stringent conditions when that sequence is present in a complex mixture (for example, total cellular) DNA or RNA.

The term "initiation biomonomer" or "initiator biomonomer" as used herein is meant to indicate the first biomonomer which is covalently attached via reactive nucleophiles to the surface of the polymer, or the first biomonomer which is attached to a linker or spacer arm attached to the polymer, the linker or spacer arm being attached to the polymer via reactive nucleophiles.

The term "isolated nucleic acid" as used herein mean an object species invention that is the predominant species present (i.e., on a molar basis it is more abundant than any other individual species in the composition). Preferably, an isolated nucleic acid comprises at least about 50, 80 or 90% (on a molar basis) of all macromolecular species present. Most preferably, the object species is purified to essential homogeneity (contaminant species cannot be detected in the composition by conventional detection methods).

The term "ligand" as used herein refers to a molecule that is recognized by a particular receptor. The agent bound by or reacting with a receptor is called a "ligand," a term which is definitionally meaningful only in terms of its counterpart receptor. The term "ligand" does not imply any particular molecular size or other structural or compositional feature other than that the substance in question is capable of binding or otherwise interacting with the receptor. Also, a ligand may serve either as the natural ligand to which the receptor binds, or as a functional analogue that may act as an agonist or antagonist. Examples of ligands that can be investigated by this invention include, but are not restricted to, agonists and antagonists for cell membrane receptors, toxins and venoms, viral epitopes, hormones (for example, opiates, steroids, etc.), hormone receptors, peptides, enzymes, enzyme substrates, substrate analogs, transition state analogs, cofactors, drugs, proteins, and antibodies.

The phrase "massively parallel screening" refers to the simultaneous screening of at least about 100, about 1000, about 10,000, about 100,000 or about 500,000 different nucleic acid hybridizations, preferably in a single reaction or experiment.

Mismatch: The term "mismatch," "mismatch control" or "mismatch probe" refers to a nucleic acid whose sequence is deliberately designed not to be perfectly complementary to a particular target sequence. As a non-limiting example, for each mismatch (MM) control in a high-density probe array there typically exists a corresponding perfect match (PM) probe that is perfectly complementary to the same particular target sequence. The mismatch may comprise one or more bases. While the mismatch(es) may be located anywhere in the mismatch probe, terminal mismatches are less desirable because a terminal mismatch is less likely to prevent hybridization of the target sequence. In a particularly preferred embodiment, the mismatch is located at the center of the probe, for example if the probe is 25 bases the mismatch position is position 13, also termed the central position, such that the mismatch is most likely to destabilize the duplex with the target sequence under the test hybridization conditions. A homo-mismatch substitutes an adenine (A) for a thymine (T) and vice versa and a guanine (G) for a cytosine (C) and vice versa. For example, if the target sequence was: 5'-AGGTCCA-3', a probe designed with a single homo-mismatch at the central, or fourth position, would result in the following sequence: 3'-TCCTGGT-5', the PM probe would be 3'-TCCAGGT-5'.

The term "mixed population" or sometimes refer by "complex population" as used herein refers to any sample containing both desired and undesired nucleic acids. As a non-limiting example, a complex population of nucleic acids may be total genomic DNA, total genomic RNA or a combination thereof. Moreover, a complex population of nucleic acids may have been enriched for a given population but may include other undesirable populations. For example, a complex population of nucleic acids may be a sample which has been enriched for desired messenger RNA (mRNA) sequences but still includes some undesired ribosomal RNA sequences (rRNA).

The term "monomer" as used herein refers to any member of the set of molecules that can be joined together to form an oligomer or polymer. The set of monomers useful in the present invention includes, but is not restricted to, for the example of (poly)peptide synthesis, the set of L-amino acids, D-amino acids, or synthetic amino acids. As used herein, "monomer" refers to any member of a basis set for synthesis of an oligomer. For example, dimers of L-amino acids form a basis set of 400 "monomers" for synthesis of polypeptides. Different basis sets of monomers may be used at successive steps in the synthesis of a polymer. The term "monomer" also refers to a chemical subunit that can be combined with a different chemical subunit to form a compound larger than either subunit alone.

The term "mRNA" or sometimes refer by "mRNA transcripts" as used herein, include, but not limited to pre-mRNA transcript(s), transcript processing intermediates, mature mRNA(s) ready for translation and transcripts of the gene or genes, or nucleic acids derived from the mRNA transcript(s). Transcript processing may include splicing, editing and degradation. As used herein, a nucleic acid derived from an mRNA transcript refers to a nucleic acid for whose synthesis the mRNA transcript or a subsequence thereof has ultimately served as a template. Thus, a cDNA reverse transcribed from an mRNA, an RNA transcribed from that cDNA, a DNA amplified from the cDNA, an RNA transcribed from the amplified DNA, etc., are all derived from the mRNA transcript and detection of such derived products is indicative of the presence and/or abundance of the original transcript in a sample. Thus, mRNA derived samples include, but are not limited to, mRNA transcripts of the gene or genes, cDNA reverse transcribed from the mRNA, cRNA transcribed from the cDNA, DNA amplified from the genes, RNA transcribed from amplified DNA, and the like.

The term "nucleic acid library" or sometimes refer by "array" as used herein refers to an intentionally created collection of nucleic acids which can be prepared either synthetically or biosynthetically and screened for biological activity in a variety of different formats (for example, libraries of soluble molecules; and libraries of oligos tethered to resin beads, silica chips, or other solid supports). Additionally, the term "array" is meant to include those libraries of nucleic acids which can be prepared by spotting nucleic acids of essentially any length (for example, from 1 to about 1000 nucleotide monomers in length) onto a substrate. The term "nucleic acid" as used herein refers to a polymeric form of nucleotides of any length, either ribonucleotides, deoxyribonucleotides or peptide nucleic acids (PNAs), that comprise purine and pyrimidine bases, or other natural, chemically or biochemically modified, non-natural, or derivatized nucleotide bases. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides and nucleotide analogs. The sequence of nucleotides may be interrupted by non-nucleotide components. Thus the terms nucleoside, nucleotide, deoxynucleoside and deoxynucleotide generally include analogs such as those described herein. These analogs are those molecules having some structural features in common with a naturally occurring nucleoside or nucleotide such that when incorporated into a nucleic acid or oligonucleoside sequence, they allow hybridization with a naturally occurring nucleic acid sequence in solution. Typically, these analogs are derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

The term "nucleic acids" as used herein may include any polymer or oligomer of pyrimidine and purine bases, preferably cytosine, thymine, and uracil, and adenine and guanine, respectively. See Albert L. Lehninger, PRINCIPLES OF BIOCHEMISTRY, at 793-800 (Worth Pub. 1982). Indeed, the present invention contemplates any deoxyribonucleotide, ribonucleotide or peptide nucleic acid component, and any chemical variants thereof, such as methylated, hydroxymethylated or glucosylated forms of these bases, and the like. The polymers or oligomers may be heterogeneous or homogeneous in composition, and may be isolated from naturally-occurring sources or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states.

The term "oligonucleotide" or sometimes refer by "polynucleotide" as used herein refers to a nucleic acid ranging from at least 2, preferable at least 8, and more preferably at least 20 nucleotides in length or a compound that specifically hybridizes to a polynucleotide. Polynucleotides of the present invention include sequences of deoxyribonucleic acid (DNA) or ribonucleic acid (RNA) which may be isolated from natural sources, recombinantly produced or artificially synthesized and mimetics thereof. A further example of a polynucleotide of the present invention may be peptide nucleic acid (PNA). The invention also encompasses situations in which there is a nontraditional base pairing such as Hoogsteen base pairing which has been identified in certain tRNA molecules and postulated to exist in a triple helix. "Polynucleotide" and "oligonucleotide" are used interchangeably in this application.

Perfect match: The term "match," "perfect match," "perfect match probe" or "perfect match control" refers to a nucleic acid that has a sequence that is designed to be perfectly complementary to a particular target sequence or portion thereof. For example, if the target sequence is 5'-GATTGCATA-3' the perfect complement is 5'-TATGCAATC-3'. Where the target sequence is longer than the probe the probe is typically perfectly complementary to a portion (subsequence) of the target sequence. For example, if the target sequence is a fragment that is 800 bases, the perfect match probe may be perfectly complementary to a 25 base region of the target. A perfect match (PM) probe can be a "test probe", a "normalization control" probe, an expression level control probe and the like. A perfect match control or perfect match is, however, distinguished from a "mismatch" or "mismatch probe."

The term "primer" as used herein refers to a single-stranded oligonucleotide capable of acting as a point of initiation for template-directed DNA synthesis under suitable conditions for example, buffer and temperature, in the presence of four different nucleoside triphosphates and an agent for polymerization, such as, for example, DNA or RNA polymerase or reverse transcriptase. The length of the primer, in any given case, depends on, for example, the intended use of the primer, and generally ranges from 15 to 30 nucleotides. Short primer molecules generally require cooler temperatures to form sufficiently stable hybrid complexes with the template. A primer need not reflect the exact sequence of the template but must be sufficiently complementary to hybridize with such template. The primer site is the area of the template to which a primer hybridizes. The primer pair is a set of primers including a 5' upstream primer that hybridizes with the 5' end of the sequence to be amplified and a 3' downstream primer that hybridizes with the complement of the 3' end of the sequence to be amplified.

The term "probe" as used herein refers to a surface-immobilized molecule that can be recognized by a particular target. See U.S. Pat. No. 6,582,908 for an example of arrays having all possible combinations of probes with 10, 12, and more bases. Examples of probes that can be investigated by this invention include, but are not restricted to, agonists and antagonists for cell membrane receptors, toxins and venoms, viral epitopes, hormones (for example, opioid peptides, steroids, etc.), hormone receptors, peptides, enzymes, enzyme substrates, cofactors, drugs, lectins, sugars, oligonucleotides, nucleic acids, oligosaccharides, proteins, and monoclonal antibodies.

The term "solid support", "support", and "substrate" as used herein are used interchangeably and refer to a material or group of materials having a rigid or semi-rigid surface or surfaces. In many embodiments, at least one surface of the solid support will be substantially flat, although in some embodiments it may be desirable to physically separate synthesis regions for different compounds with, for example, wells, raised regions, pins, etched trenches, or the like. According to other embodiments, the solid support(s) will take the form of beads, resins, gels, microspheres, or other geometric configurations. See U.S. Pat. No. 5,744,305 for exemplary substrates.

The term "target" as used herein refers to a molecule that has an affinity for a given probe. Targets may be naturally-occurring or man-made molecules. Also, they can be employed in their unaltered state or as aggregates with other species. Targets may be attached, covalently or noncovalently, to a binding member, either directly or via a specific binding substance. Examples of targets which can be employed by this invention include, but are not restricted to, antibodies, cell membrane receptors, monoclonal antibodies and antisera reactive with specific antigenic determinants (such as on viruses, cells or other materials), drugs, oligonucleotides, nucleic acids, peptides, cofactors, lectins, sugars, polysaccharides, cells, cellular membranes, and organelles. Targets are sometimes referred to in the art as anti-probes. As the term targets is used herein, no difference in meaning is intended. A "Probe Target Pair" is formed when two macromolecules have combined through molecular recognition to form a complex.

II. E. coli Array

An array is disclosed that allows for simultaneous measurement of relative gene expression levels for more than 20,000 genes present in four strains of E. coli. The four strains are K12, CFT073 (uropathogenic), O157:H7-EDL933 (enteropathogenic), and O157:H7-Sakai (enteropathogenic). The array also contains more than 1,400 probe sets that are complementary to intergenic regions. These regions are typically between annotated open reading frames and may contain shorter expressed sequences that have not yet been identified. The array may be used for detection of novel transcripts. The array may also be used to optimize culture conditions to improve yields of recombinant proteins in industrial microbiology.

Probes of the array are designed to be complementary to 25 contiguous bases of a selected genetic region. Mismatch probes may be included on the array for use as controls to measure discrimination and specificity. Antisense probes that are derived from the opposite strand of the gene may also be included. Other control sequence probes may also be included. Control probes may be included to assay for manufacturing defects, problems with sample preparation and problems with hybridization. In a preferred embodiment the array is a single solid support so that the expression levels for the target E.coli genes may be simultaneously analyzed in a single experiment using a single hybridization. See, for example the U133 Plus 2.0 Array available from Affymetrix. This array allows analysis of over 47,000 human transcripts on a single chip. In another embodiment the probes are divided so that they are on two or more chips or solid supports. The arrays may also be attached to pegs for high throughput analysis. In a preferred embodiment a plurality of the disclosed arrays are attached to pegs in a format that allows hybridization of the arrays in 96 or 384 well microtitre dish format, facilitating highly parallel analysis of a plurality of different samples. In a preferred embodiment sample preparation and array hybridization, staining and washing are performed in an automated manner.

In a preferred embodiment some probe sets of the array are complementary to a genetic region that is unique to one strain, for example, the array comprises more than 600 probe sets that recognize a transcript that is present in K12 but not in the other three strains. There are more than 125 O157:H7-EDL933 specific probe sets, more than 200 O157:H7-Sakai specific probe sets and more than 1700 SFT073 specific probe sets on the array.

Target sequences were chosen to include more than 20,000 genes present in four strains of E. coli. These sequences were chosen as predicted coding sequences. Target sequences were selected using the computer based methods described in U.S. patent application Ser. No. 6,309,822 incorporated herein by reference for all purposes.

In a preferred embodiment an array is disclosed that comprises each of the sequences listed in the sequence listing attached to a solid support in a different determinable location. Each sequence in the sequence listing is present in a location, or feature, that is preferably distinct or distinguishable from each of the other sequences in the sequence listing, features may overlap to some extent. A probe set may comprise a plurality of different oligonucleotide probes that are complementary to the same transcript but to different regions of the transcript. Each probe in the probe set may be present in a unique feature. In a preferred embodiment a probe set is comprised of probe pairs and a probe pair is a perfect match probe and the corresponding mismatch probe. The mismatch probe is identical to the perfect match probe except for a mismatch at the central position, position 13 of a 25 mer probe. Mismatch probes may be included on the array for use as controls to measure discrimination and specificity. Antisense probes that are derived from the opposite strand of the gene may also be included.

In preferred embodiments the array comprises a plurality of control probes. Control probes may include, for example, hybridization controls, poly-A controls, manufacturing controls and housekeeping control genes. Hybridization controls may be from an organism other than the organism being studies. In a preferred embodiment probes for the E. coli bioB, bioC, and bioD genes and probes for the P1 Bacteriophage cre gene are included as hybridization controls. A mixture of the transcripts that are complementary to the probe may be included in the hybridization. Probes for B. subtilis dap, lys, phe, thr, and trp genes may be included and used for sample preparation controls. Other control sequence probes, for example ribosomal RNA probes, may also be included. Control probes may be included to assay for manufacturing defects, problems with sample preparation and problems with hybridization. Probes for synthetic sequences that are not present in the genome being assayed and are preferably not present in other known genomes may also be included, for example, tag probes such as those disclosed in U.S. patent application Ser. No. 09/827,383.

When measuring expression one of skill in the art will recognize that the probes of the array should be designed to be complementary to the sequence to be detected. This may vary depending on which amplification method is used. For example, one method of amplification calls for reverse transcription of the mRNA using an oligo-dt-T7 primer. Double stranded cDNA with an RNA polymerase promoter is then generated and antisense RNA is transcribed and labeled. The antisense RNA is then hybridized to the array. The antisense RNA is complementary to the mRNA so the probes on the array should hybridize to the antisense RNA and should be identical in sequence to a portion of the transcribed mRNA. In another method the amplified nucleic acid to be hybridized to the array is sense, meaning that it has the same sequence as the starting mRNA so the probes should be complementary to the transcribed mRNA. In other embodiments the amplification product that is hybridized to the array may be cDNA that may be in the sense (same as) or antisense (complement of) orientation relative to the starting mRNA.

The present invention provides a pool of unique nucleotide sequences complementary to E. coli sequences in particular embodiments which alone, or in combinations of 2 or more, 10 or more, 100 or more, 1,000 or more, 10,000 or more, or 100,000 or more, can be used for a variety of applications.

In one embodiment, the present invention provides for a pool of unique nucleotide sequences which are complementary to approximately 20,000 E. coli transcripts and probes to detect expression from a plurality of intergenic regions, formed into a high density array of probes suitable for array based massive parallel gene expression. Array based methods for monitoring gene expression are disclosed and discussed in detail in U.S. Pat. No. 5,800,992, U.S. Pat. No. 6,309,822, and PCT Application WO 92/10588. Generally those methods of monitoring gene expression involve (1) providing a pool of target nucleic acids comprising RNA transcript(s) of one or more target gene(s), or nucleic acids derived from the RNA transcript(s); (2) hybridizing the nucleic acid sample to a high density array of probes and (3)

detecting the hybridized nucleic acids and calculating a relative expression (transcription, RNA processing or degradation) level.

The development of Very Large Scale Immobilized Polymer Synthesis or VLSIPS™ technology has provided methods for making very large arrays of nucleic acid probes in very small arrays. See U.S. Pat. No. 5,143,854 and PCT Patent Publication Nos. WO 90/15070 and WO 92/10092, and Fodor et al., Science, 251, 767-77 (1991), each of which is incorporated herein by reference. U.S. patent application Ser. No. 5,800,992, describes methods for making arrays of nucleic acid probes that can be used to detect the presence of a nucleic acid containing a specific nucleotide sequence. Methods of forming high density arrays of nucleic acids, peptides and other polymer sequences with a minimal number of synthetic steps are known. The nucleic acid array can be synthesized on a solid substrate by a variety of methods, including, but not limited to, light-directed chemical coupling, and mechanically directed coupling.

In a preferred detection method, the array of immobilized nucleic acids, or probes, is contacted with a sample containing target nucleic acids, to which a detectable label is attached. Target nucleic acids hybridize to the probes on the array and any non-hybridized nucleic acids are removed. If the label is fluorescent, the array containing the hybridized target nucleic acids may be exposed to light which excites the fluorescent label. The resulting fluorescent intensity, or brightness, is detected. Relative brightness is used to determine which probe is the best candidate for the perfect match to the hybridized target nucleic acid because fluorescent intensity (brightness) corresponds to binding affinity.

In a preferred embodiment the probes are presented in pairs, one probe in each pair being a perfect match to the target sequence and the other probe being identical to the perfect match probe except that the central base is a homomismatch. Mismatch probes provide a control for non-specific binding or cross-hybridization to a nucleic acid in the sample other than the target to which the probe is directed. Thus, mismatch probes indicate whether hybridization is or is not specific. For example, if the target is present, the perfect match probes should be consistently brighter than the mismatch probes because fluorescence intensity, or brightness, corresponds to binding affinity. (See, for example U.S. Pat. No. 5,324,633, which is incorporated herein for all purposes.) In addition, if all central mismatches are present, the mismatch probes can be used to detect a mutation. Finally the difference in intensity between the perfect match and the mismatch probe (I(PM)-I(MM)) provides a good measure of the concentration of the hybridized material. See pending PCT Application No. 98/11223, which is incorporated herein by reference for all purposes.

In another embodiment, the current invention provides a pool of sequences which may be used as probes for their complementary targets. A number of uses for nucleic acid probes of defined sequence are known in the art. Some of the uses include: to screen cDNA or genomic DNA libraries, or subclones derived from them, for additional clones containing segments of DNA that have been isolated and previously sequenced; in Southern, northern, or dot-blot hybridization to identify or detect the sequences of specific genes; in Southern, or dot-blot hybridization of genomic DNA to detect specific mutations in genes of known sequence; to detect specific mutations generated by site-directed mutagenesis of cloned genes; as primers for extension by a DNA polymerase, and to map the 5' termini of mRNA molecules by primer extensions. Other uses for probes derived from the sequences disclosed in this invention will be readily apparent to those of skill in the art. See, for example, Lodish et al. *Molecular Cell Biology*, 3$^{rd}$ edition, Scientific American Books (1995) p. 229-233, incorporated above, for a description of the construction of genomic libraries.

In another embodiment, the disclosed arrays may be combined with known methods to monitor expression levels of genes in a wide variety of contexts. For example, where the effects of a drug on gene expression are to be determined, the drug will be administered to a culture, sample, or a cell and the gene expression levels will be analyzed. For example, nucleic acids are isolated from the treated culture, sample, cell, or a biological sample from the organism and from an untreated organism sample or cell, hybridized to a high density probe array containing probes directed to the genes of interest and expression levels are determined. Expression levels may be measured relative to the expression of other genes in the sample, for example, genes that are constitutively expressed may be used as normalization controls. The types of drugs that may be used in these types of experiments include, but are not limited to, antibiotics, antivirals, narcotics, anti-cancer drugs, tumor suppressing drugs, and any chemical composition which may affect the expression of genes in vivo or in vitro. Varying growth conditions may also be analyzed for variation in expression.

The current invention is particularly suited to be used in the types of analyses described by, for example, pending U.S. applications Ser. No. 6,309,822 and PCT Application No. 98/11223, each of which is incorporated by reference in its entirety for all purposes. As described in Wodicka et al., Nature Biotechnology 15 (1997), hereby incorporated by reference in its entirety for all purposes, because mRNA hybridization correlates to gene expression level, hybridization patterns can be compared to determine differential gene expression. As non-limiting examples: hybridization patterns from samples treated with certain types of drugs may be compared to hybridization patterns from samples which have not been treated or which have been treated with a different drug; hybridization patterns for samples infected with a specific virus may be compared against hybridization patterns from non-infected samples; hybridization patterns for samples with cancer may be compared against hybridization patterns for samples without cancer; hybridization patterns of samples from cancerous cells which have been treated with a tumor suppressing drug may be compared against untreated cancerous cells, etc. Zhang et al., Science 276 1268-1272, hereby incorporated by reference in its entirety for all purposes, provides an example of how gene expression data can provide a great deal of insight into cancer research. One skilled in the art will appreciate that a wide range of applications will be available using 2 or more, 10 or more, 100 or more, 1000 or more, 10,000 or more or 100,000 or more of the SEQ ID Nos. 1-224,976 sequences as probes for gene expression analysis.

The combination of the nucleic array technology and the E. coli specific probes in this disclosure is a powerful tool for studying gene expression. E. coli arrays have been used by researchers in a variety of studies. See, for example, Arends et al. Journal of Bacteriology 186(3), 880-4, 2004, Brokx, S. J. et al. Journal of Bacteriology 186(10), 3254-8, 2004, Bulyk, M. L. et al. Genome Research 14(2), 201-8, 2004, Hansen, E. H. et al. Applied and Environmental Microbiology 70(3), 1749-57, 2004, and Kaldalu, N. et al. Antimicrobial Agents and Chemotherapy 48(3), 890-6, 2004.

In another embodiment, the invention may be used in conjunction with the techniques which link specific proteins to the mRNA which encodes the protein. (See for example Roberts and Szostak Proc. Natl, Acad. Sci. 94 12297-12302 (1997). Hybridization of these mRNA-protein fusion compounds to arrays comprised of 2 or more, 10 or more, 100 or more, 1000 or more, 10,000 or more, or 100,000 or more the sequences disclosed in the present invention provides a powerful tool for monitoring expression levels.

In one embodiment, the current invention provides a pool of unique nucleic acid sequences which can be used for parallel analysis of gene expression under selective conditions. Without wishing to be limited, genetic selection under selective conditions could include: variation in the temperature; pH levels; aeration, food (type, texture, amount etc.), carbon source, presence or absence of drugs, inclusion of varying amounts of amino acids; variation in an organism's surroundings; etc. Arrays, such as those in the present invention, can be used to determine whether gene expression is altered when an organism is exposed to selective conditions.

Methods for using nucleic acid arrays to analyze genetic selections under selective conditions are known. (See for example, R. Cho et al., Proc. Natl. Acad. Sci. 95 3752-3757 (1998), incorporated herein in its entirety for all purposes.) Cho et al. describes the use of a high-density array containing oligonucleotides complementary to every gene in the yeast Saccharomyces cerevisiae to perform two-hybrid protein-protein interaction screens for S. cerevisiae genes implicated in mRNA splicing and microtubule assembly.

In another embodiment, the current invention provides a pool of unique nucleic acid sequences which can be used to identify biallelic markers, providing a novel and efficient approach to the study of genetic variation. For example, methods for using high density arrays comprised of probes which are complementary to the genomic DNA of a particular species to interrogate polymorphisms are well known. (See for example, U.S. Pat. No. 6,300,063 which is hereby incorporated by reference herein for all purposes.) Pools of 2 or more, 10 or more, 100 or more, 1000 or more, 10,000 or more, or 100,000 or more of the sequences disclosed in this invention combined with the methods described in the above patent provides a tool for studying genetic variation in the E. coli system.

In another embodiment genetic variation may be correlated with variation in gene expression pattern. Much of the genetic variation between individuals is the result of single nucleotide polymorphisms (SNPs). The presence of SNPs in or near a gene may result in differences in gene expression, which may result, for example, from changes in the rate of transcription, the stability of the mRNA, splicing of the mRNA, or translation of the mRNA. In one embodiment an array comprising SEQ ID Nos. 1-224,976 and probes to genotype selected E. coli polymorphisms may be used to monitor genotype and expression changes that correlate with differences in genotype.

In another embodiment of the invention, genetic variation can be used to produce genetic maps of various strains of E. coli. Winzeler et al., "Direct Allelic Variation Scanning of the Yeast Genome" Science. 281(5380):1194-7. (1998), which is hereby incorporated for all purposes describes methods for conducting this type of screening with arrays containing probes complementary to the yeast genome. Briefly, genomic DNA from strains which are phenotypically different is isolated, fragmented, and labeled. Each strain is then hybridized to identical arrays comprised of the nucleic acid sequences complementary to the system being studied. Comparison of hybridization patterns between the various strains then serve as genetic markers. As described by Winzler et al, these markers can then be used for linkage analysis. High density arrays created from 2 or more, 10 or more, 100 or more, 1000 or more, 10,000 or more, or 100,000 or more of the sequences disclosed in this invention can be used to study genetic variation using the methods described by Winzler et al.

In another embodiment, the present invention may be used for cross-species comparisons. One skilled in the art will appreciate that it is often useful to determine whether a gene present in one species, for example rat, is present in a conserved format in another species, including, without limitation, Drosophila, human, chicken, zebrafish, E. coli, mouse or yeast. See, for example, Andersson et al., Mamm. Genome 7(10):717-734 (1996), which describes the utility of cross-species comparisons. The use of 2 or more, 10 or more, 100 or more, 1000 or more, 10,000 or more or 100,000 or more of the sequences disclosed in this invention in an array can be used to determine whether any of the sequence from one or more of the E. coli genes represented by the sequences disclosed in this invention is conserved in another species by, for example, hybridizing genomic nucleic acid samples from another species to an array comprised of the sequences disclosed in this invention. Areas of hybridization will yield genomic regions where the nucleotide sequence is highly conserved between the interrogation species and the E. coli. Preferably the interrogation species in a prokaryotic species.

In another embodiment, the present invention may be used to characterize the genotype of knockouts. Methods for using gene knockouts to identify a gene are well known. See for example, Lodish et al. *Molecular Cell Biology,* 3$^{rd}$ Edition, Scientific American Books pub pp. 292-296 and U.S. Pat. No. 5,679,523, which are hereby incorporated by reference for all purposes. By isolating genomic nucleic acid samples from knockout species with a known phenotype and hybridizing the samples to an array comprised of 2 or more, 10 or more, 100 or more, 1000 or more, 10,000 or more, or 100,000 or more of the sequences disclosed in this invention, candidates genes which contribute to the phenotype will be identified and made accessible for further characterization.

In another embodiment, the present invention may be used to identify new gene family members. Methods of screening libraries with probes are well known. (See, for example, Maniatis et al, incorporated by reference above.) Because the present invention is comprised of nucleic acid sequences from specific known genes, 2 or more, 10 or more, 100 or more, 1000 or more, 10,000 or more, or 100,000 or more of sequences disclosed in this invention may be used as probes to screen genomic libraries to look for additional family members of those genes from which the target sequences are derived.

In another embodiment of the invention, the sequences of this invention may be used to generate primers directed to their corresponding genes as disclosed in the Genbank or any other public database. These primers may be used in such basic techniques as sequencing or PCR, see for example Maniatis et al., incorporated by reference above.

In another embodiment, the invention provides a pool of nucleic acid sequences to be used as ligands for specific genes. The sequences disclosed in this invention may be used as ligands to their corresponding genes as disclosed in the Genbank or any other public database. Compounds which specifically bind known genes are of interest for a variety of uses. One particular clinical use is to act as an antisense protein which specifically binds and disables a gene which has been, for example, linked to a disease. Methods and uses for ligands to specific genes are known. See for example, U.S. Pat. No. 5,723,594, which is hereby incorporated by reference in its entirety for all purposes.

In a preferred embodiment, the hybridized nucleic acids are detected by detecting one or more labels attached to the sample nucleic acids. The labels may be incorporated by any of a number of means well known to those of skill in the art. In one embodiment, the label is simultaneously incorporated during the amplification step in the preparation of the sample nucleic acids. Thus, for example, polymerase chain reaction (PCR) with labeled primers or labeled nucleotides will provide a labeled amplification product. In another embodiment, transcription amplification, as described above, using a labeled nucleotide (e.g. fluorescein-labeled UTP and/or CTP) incorporates a label into the transcribed nucleic acids.

Alternatively, a label may be added directly to the original nucleic acid sample (e.g., mRNA, polyA mRNA, cDNA, etc.) or to the amplification product after the amplification is completed. Means of attaching labels to nucleic acids are well known to those of skill in the art and include, for example nick translation or end-labeling (e.g. with a labeled RNA) by kinasing of the nucleic acid and subsequent attachment (ligation) of a nucleic acid linker joining the sample nucleic acid to a label (e.g., a fluorophore).

Detectable labels suitable for use in the present invention include any composition detectable by spectroscopic, photochemical, biochemical, immunochemical, electrical, optical or chemical means. Useful labels in the present invention include biotin for staining with labeled streptavidin conjugate, magnetic beads (e.g., Dynabeads™), fluorescent dyes (e.g., fluorescein, texas red, rhodamine, green fluorescent protein, and the like), radiolabels (e.g., $^{3}$H, $^{125}$I, $^{35}$S, $^{14}$C, or $^{32}$P), phosphorescent labels, enzymes (e.g., horse radish peroxidase, alkaline phosphatase and others commonly used in an ELISA), and calorimetric labels such as colloidal gold or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241, each of which is hereby incorporated by reference in its entirety for all purposes.

Means of detecting such labels are well known to those of skill in the art. Thus, for example, radiolabels may be detected using photographic film or scintillation counters, fluorescent markers may be detected using a photodetector to detect emitted light. Enzymatic labels are typically detected by providing the enzyme with a substrate and detecting the reaction product produced by the action of the enzyme on the substrate, and colorimetric labels are detected by simply visualizing the colored label.

The label may be added to the target nucleic acid(s) prior to, or after the hybridization. So called "direct labels" are detectable labels that are directly attached to or incorporated into the target nucleic acid prior to hybridization. In contrast, so called "indirect labels" are joined to the hybrid duplex after hybridization. Often, the indirect label is attached to a binding moiety that has been attached to the target nucleic acid prior to the hybridization. Thus, for example, the target nucleic acid may be biotinylated before the hybridization. After hybridization, an aviden-conjugated fluorophore will bind the biotin bearing hybrid duplexes providing a label that is easily detected. For a detailed review of methods of labeling nucleic acids and detecting labeled hybridized nucleic acids see *Laboratory Techniques in Biochemistry and Molecular Biology, Vol.* 24: *Hybridization With Nucleic Acid Probes,* P. Tijssen, ed. Elsevier, N.Y., (1993), which is hereby incorporated by reference in its entirety for all purposes.

Fluorescent labels are preferred and easily added during an in vitro transcription reaction. In a preferred embodiment, fluorescein labeled UTP and CTP are incorporated into the RNA produced in an in vitro transcription reaction as described above.

Protocols for target amplification, labeling and preparation, including prokaryotic target preparation methods, protocols for target hybridization, washing and scanning, data analysis methods and detailed information about useful controls and methods for array analysis are provided, for example, in the Affymetrix GeneChip® Expression Analysis Technical Manual, Revision 4, released in 2004 is available from Affymetrix, Inc. (PN 701045). This manual is hereby incorporated herein by reference for all purposes.

CONCLUSION

The inventions herein provide a pool of unique nucleic acid sequences which are complementary to approximately 20,000 full-length *E. coli* transcripts and intergenic regions. These sequences can be used for a variety of types of analyses. In preferred embodiments the sequences are assembled into an array of probes.

The above description is illustrative and not restrictive. Many variations of the invention will become apparent to those of skill in the art upon review of this disclosure. The scope of the invention should, therefore, be determined not with reference to the above description, but instead be determined with reference to the appended claims along with their full scope of equivalents.

SEQUENCE LISTING (224976 sequences)

SEQ ID NO: 1 - DNA, 25 bp, S. cerevisiae
cagaccagcattgcggatagtgcac

SEQ ID NO: 2 - DNA, 25 bp, S. cerevisiae
cagaccagcattccggatagtgcac

SEQ ID NO: 3 - DNA, 25 bp, S. cerevisiae
tacccttataatgggtggaatattt

SEQ ID NO: 4 - DNA, 25 bp, S. cerevisiae
tacccttataatcggtggaatattt

SEQ ID NO: 5 - DNA, 25 bp, S. cerevisiae
ataatgttgactatggtgtgtcatg

SEQ ID NO: 6 - DNA, 25 bp, S. cerevisiae
ataatgttgactttggtgtgtcatg

SEQ ID NO: 7 - DNA, 25 bp, S. cerevisiae
tataacctaaaagcgtcggctgtag

SEQ ID NO: 8 - DNA, 25 bp, S. cerevisiae
tttgtcgcaactgtagagatggcac

SEQ ID NO: 9 - DNA, 25 bp, S. cerevisiae
tataacctaaaaccgtcggctgtag

SEQ ID NO: 10 - DNA, 25 bp, S. cerevisiae
tttgtcgcaactctagagatggcac

SEQ ID NO: 11 - DNA, 25 bp, S. cerevisiae
tgtctccattatacattatatagcc

SEQ ID NO: 12 - DNA, 25 bp, S. cerevisiae
tgatctttctaaatgtgtctatggt

SEQ ID NO: 13 - DNA, 25 bp, S. cerevisiae
tgtctccattattcattatatagcc

SEQ ID NO: 14 - DNA, 25 bp, S. cerevisiae
tgatctttctaattgtgtctatggt

SEQ ID NO: 15 - DNA, 25 bp, S. cerevisiae
tcatccttgaaaatagtagcaaatg

SEQ ID NO: 16 - DNA, 25 bp, S. cerevisiae
tctacagaaatcatagacggaaaag

SEQ ID NO: 17 - DNA, 25 bp, S. cerevisiae
tcttgttttcgctacgtcaaaagga

SEQ ID NO: 18 - DNA, 25 bp, S. cerevisiae
tcttgttttcgcaacgtcaaaagga

SEQ ID NO: 19 - DNA, 25 bp, S. cerevisiae
tctacagaaatcttagacggaaaag

SEQ ID NO: 20 - DNA, 25 bp, S. cerevisiae
tcatccttgaaattagtagcaaatg

SEQ ID NO: 21 - DNA, 25 bp, S. cerevisiae
ccagataaagcagctgaaattgcag

SEQ ID NO: 22 - DNA, 25 bp, S. cerevisiae
ccagataaagcacctgaaattgcag

SEQ ID NO: 23 - DNA, 25 bp, S. cerevisiae
cctgcagtaattccagaagaagcgt

SEQ ID NO: 24 - DNA, 25 bp, S. cerevisiae
cctttataaagcgcagcagcacctt

SEQ ID NO: 25 - DNA, 25 bp, S. cerevisiae
cctttataaagcccagcagcacctt

SEQ ID NO: 26 - DNA, 25 bp, S. cerevisiae
cctgcagtaattgcagaagaagcgt

SEQ ID NO: 27 - DNA, 25 bp, S. cerevisiae
gaatcgcataatttccattagctag

SEQ ID NO: 28 - DNA, 25 bp, S. cerevisiae
gcaactctagggacagcattctttt

SEQ ID NO: 29 - DNA, 25 bp, S. cerevisiae
gaatcgcataatatccattagctag

SEQ ID NO: 30 - DNA, 25 bp, S. cerevisiae
gcaactctagggtcagcattctttt

SEQ ID NO: 31 - DNA, 25 bp, S. cerevisiae
gaaacggactatgtgggaaaatatc

SEQ ID NO: 32 - DNA, 25 bp, S. cerevisiae
gaaacggactatctgggaaaatatc

SEQ ID NO: 33 - DNA, 25 bp, S. cerevisiae
ctgtttgcagcaaaagtcttgtttt

SEQ ID NO: 34 - DNA, 25 bp, S. cerevisiae
ctgtttgcagcataagtcttgtttt

SEQ ID NO: 35 - DNA, 25 bp, S. cerevisiae
gttttggagaccttgtgcttgtaat

SEQ ID NO: 36 - DNA, 25 bp, S. cerevisiae
gttttggagaccatgtgcttgtaat

SEQ ID NO: 37 - DNA, 25 bp, S. cerevisiae
gtgacgcattttatgagttttctaa

SEQ ID NO: 38 - DNA, 25 bp, S. cerevisiae
gtgacgcattttttgagttttctaa

SEQ ID NO: 39 - DNA, 25 bp, S. cerevisiae
gagccttagcaccctcttgttgaat

SEQ ID NO: 40 - DNA, 25 bp, S. cerevisiae
gagccttagcacgctcttgttgaat

SEQ ID NO: 41 - DNA, 25 bp, S. cerevisiae
cacatacaccaaatgttctttaaaa

SEQ ID NO: 42 - DNA, 25 bp, S. cerevisiae
cacatacaccaattgttctttaaaa

SEQ ID NO: 43 - DNA, 25 bp, S. cerevisiae
agcttgtgtcatctacatttttctg

SEQ ID NO: 44 - DNA, 25 bp, S. cerevisiae
aactcaatatctatgacttaaaatt

SEQ ID NO: 45 - DNA, 25 bp, S. cerevisiae
atactgtatttccagcgtttctaaa

SEQ ID NO: 46 - DNA, 25 bp, S. cerevisiae
agcccgacgtaaagaggaatacata

SEQ ID NO: 47 - DNA, 25 bp, S. cerevisiae
tttcttcccctaggaaatgtagtga

SEQ ID NO: 48 - DNA, 25 bp, S. cerevisiae
agattcctgggaagaataaattctt

SEQ ID NO: 49 - DNA, 25 bp, S. cerevisiae
acttacatgttaatggtatgtaaga

SEQ ID NO: 50 - DNA, 25 bp, S. cerevisiae
agccaaatgaacctcaaatctacat

SEQ ID NO: 51 - DNA, 25 bp, S. cerevisiae
atactgtatttcgagcgtttctaaa

SEQ ID NO: 52 - DNA, 25 bp, S. cerevisiae
agcccgacgtaatgaggaatacata

SEQ ID NO: 53 - DNA, 25 bp, S. cerevisiae
ataacaatagcaattgggaaaacct

SEQ ID NO: 54 - DNA, 25 bp, S. cerevisiae
attaagcagactataattagtactt

SEQ ID NO: 55 - DNA, 25 bp, S. cerevisiae
ttcaattgaaactaattttgaaaat

SEQ ID NO: 56 - DNA, 25 bp, S. cerevisiae
acttacatgttattggtatgtaaga

SEQ ID NO: 57 - DNA, 25 bp, S. cerevisiae
ttcaattgaaacaaattttgaaaat

SEQ ID NO: 58 - DNA, 25 bp, S. cerevisiae
agcttgtgtcatgtacatttttctg

SEQ ID NO: 59 - DNA, 25 bp, S. cerevisiae
attaagcagactttaattagtactt

SEQ ID NO: 60 - DNA, 25 bp, S. cerevisiae
agattcctgggatgaataaattctt

SEQ ID NO: 61 - DNA, 25 bp, S. cerevisiae
tttcttcccctacgaaatgtagtga

SEQ ID NO: 62 - DNA, 25 bp, S. cerevisiae
aactcaatatctttgacttaaaatt

SEQ ID NO: 63 - DNA, 25 bp, S. cerevisiae
agccaaatgaacgtcaaatctacat

SEQ ID NO: 64 - DNA, 25 bp, S. cerevisiae
ataacaatagcatttgggaaaacct

SEQ ID NO: 65 - DNA, 25 bp, S. cerevisiae
ttaaaactacttgattttgcgagta

SEQ ID NO: 66 - DNA, 25 bp, S. cerevisiae
tattcgaacaagtaacagttttttg

SEQ ID NO: 67 - DNA, 25 bp, S. cerevisiae
tattcgaacaagaaacagttttttg

SEQ ID NO: 68 - DNA, 25 bp, S. cerevisiae
ttaaaactacttcattttgcgagta

SEQ ID NO: 69 - DNA, 25 bp, S. cerevisiae
tcggcagtgcactcccgcaagaaaa

SEQ ID NO: 70 - DNA, 25 bp, S. cerevisiae
tcggcagtgcacacccgcaagaaaa

SEQ ID NO: 71 - DNA, 25 bp, S. cerevisiae
ccaaaattcaactcaacaagtggcc

SEQ ID NO: 72 - DNA, 25 bp, S. cerevisiae
ccaaaattcaacacaacaagtggcc

SEQ ID NO: 73 - DNA, 25 bp, S. cerevisiae
gacaggggtcatcaggttgaaacaa

SEQ ID NO: 74 - DNA, 25 bp, S. cerevisiae
gacaggggtcatgaggttgaaacaa

SEQ ID NO: 75 - DNA, 25 bp, S. cerevisiae
ctttatttgcaacatactaaaggtt

SEQ ID NO: 76 - DNA, 25 bp, S. cerevisiae
ctttatttgcaagatactaaaggtt

SEQ ID NO: 77 - DNA, 25 bp, S. cerevisiae
taatgctacaattctcctaaaatat

SEQ ID NO: 78 - DNA, 25 bp, S. cerevisiae
taatctggatattcagcagctattt

SEQ ID NO: 79 - DNA, 25 bp, S. cerevisiae
taatgctacaatactcctaaaatat

SEQ ID NO: 80 - DNA, 25 bp, S. cerevisiae
taatctggatatacagcagctattt

SEQ ID NO: 81 - DNA, 25 bp, S. cerevisiae
aagtgtgaccagagctcattatatt

SEQ ID NO: 82 - DNA, 25 bp, S. cerevisiae
aagtgtgaccagtgctcattatatt

SEQ ID NO: 83 - DNA, 25 bp, S. cerevisiae
accagaaggttctgcattcgtattt

SEQ ID NO: 84 - DNA, 25 bp, S. cerevisiae
ataaggaacattcacattcatagaa

SEQ ID NO: 85 - DNA, 25 bp, S. cerevisiae
atacaccggatatggagctgtagag

SEQ ID NO: 86 - DNA, 25 bp, S. cerevisiae
agatattattgttcgcgtgacccat

SEQ ID NO: 87 - DNA, 25 bp, S. cerevisiae
ataaggaacattgacattcatagaa

SEQ ID NO: 88 - DNA, 25 bp, S. cerevisiae
acttattgtgtactagttgaagtgt

SEQ ID NO: 89 - DNA, 25 bp, S. cerevisiae
acttattgtgtagtagttgaagtgt

SEQ ID NO: 90 - DNA, 25 bp, S. cerevisiae
atacaccggataaggagctgtagag

SEQ ID NO: 91 - DNA, 25 bp, S. cerevisiae
accagaaggttcagcattcgtattt

SEQ ID NO: 92 - DNA, 25 bp, S. cerevisiae
agatattattgtacgcgtgacccat

SEQ ID NO: 93 - DNA, 25 bp, S. cerevisiae
acttgcgatggactgtactgagaat

SEQ ID NO: 94 - DNA, 25 bp, S. cerevisiae
acttgcgatggagtgtactgagaat

SEQ ID NO: 95 - DNA, 25 bp, S. cerevisiae
ttggtgctggtgatgatacatagac

SEQ ID NO: 96 - DNA, 25 bp, S. cerevisiae
ttagcgtatgcaggatttgatagca

SEQ ID NO: 97 - DNA, 25 bp, S. cerevisiae
ttagcgtatgcacgatttgatagca

SEQ ID NO: 98 - DNA, 25 bp, S. cerevisiae
ttggtgctggtgttgatacatagac

SEQ ID NO: 99 - DNA, 25 bp, S. cerevisiae
tgaagtagtattatcttgtgccctc

SEQ ID NO: 100 - DNA, 25 bp, S. cerevisiae
tgaagtagtattttcttgtgccctc

SEQ ID NO: 101 - DNA, 25 bp, S. cerevisiae
tcgctattggatatacagtgggcaa

SEQ ID NO: 102 - DNA, 25 bp, S. cerevisiae
tcgctattggatttacagtgggcaa

SEQ ID NO: 103 - DNA, 25 bp, S. cerevisiae
tcgtatcattattggtgatgtttaa

SEQ ID NO: 104 - DNA, 25 bp, S. cerevisiae
tcgtatcattataggtgatgtttaa

SEQ ID NO: 105 - DNA, 25 bp, S. cerevisiae
tagcgaagtttttgtggtcgttggg

SEQ ID NO: 106 - DNA, 25 bp, S. cerevisiae
tagcgaagttttagtggtcgttggg

SEQ ID NO: 107 - DNA, 25 bp, S. cerevisiae
tattgggggaatccctggtaataca

SEQ ID NO: 108 - DNA, 25 bp, S. cerevisiae
tattgggggaatgcctggtaataca

SEQ ID NO: 109 - DNA, 25 bp, S. cerevisiae
cttgtatgcagatgcagaagaattg

SEQ ID NO: 110 - DNA, 25 bp, S. cerevisiae
ctcttgttgatactgatgatgttga

SEQ ID NO: 111 - DNA, 25 bp, S. cerevisiae
ctcttgttgatagtgatgatgttga

SEQ ID NO: 112 - DNA, 25 bp, S. cerevisiae
cttgtatgcagaagcagaagaattg

SEQ ID NO: 113 - DNA, 25 bp, S. cerevisiae
ggtgcctgagttagtgcttgtagca

SEQ ID NO: 114 - DNA, 25 bp, S. cerevisiae
ggtagcagagctagcactattatta

SEQ ID NO: 115 - DNA, 25 bp, S. cerevisiae
ggtgcctgagtttgtgcttgtagca

SEQ ID NO: 116 - DNA, 25 bp, S. cerevisiae
ggattttgagcagttgccatggcat

SEQ ID NO: 117 - DNA, 25 bp, S. cerevisiae
ggattttgagcacttgccatggcat

SEQ ID NO: 118 - DNA, 25 bp, S. cerevisiae
ggtagcagagcttgcactattatta

SEQ ID NO: 119 - DNA, 25 bp, S. cerevisiae
tggctgcatactcgatacgggaagg

SEQ ID NO: 120 - DNA, 25 bp, S. cerevisiae
tggctgcatactggatacgggaagg

SEQ ID NO: 121 - DNA, 25 bp, S. cerevisiae
caatttgctgcatctgattgcgttc

SEQ ID NO: 122 - DNA, 25 bp, S. cerevisiae
caatttgctgcaactgattgcgttc

SEQ ID NO: 123 - DNA, 25 bp, S. cerevisiae
gctttaagacgtttttgtaactatg

SEQ ID NO: 124 - DNA, 25 bp, S. cerevisiae
gctttaagacgtatttgtaactatg

SEQ ID NO: 125 - DNA, 25 bp, S. cerevisiae
aactcttcgtaaaaggaactgcttc

SEQ ID NO: 126 - DNA, 25 bp, S. cerevisiae
aactcttcgtaataggaactgcttc

SEQ ID NO: 127 - DNA, 25 bp, S. cerevisiae
acaatatcattgacacatgcgagtt

SEQ ID NO: 128 - DNA, 25 bp, S. cerevisiae
actctctgcctttcttatggtttgg

SEQ ID NO: 129 - DNA, 25 bp, S. cerevisiae
acaatatcattgtcacatgcgagtt

SEQ ID NO: 130 - DNA, 25 bp, S. cerevisiae
actctctgccttacttatggtttgg

SEQ ID NO: 131 - DNA, 25 bp, S. cerevisiae
tccattgatacatttagtagaagcc

SEQ ID NO: 132 - DNA, 25 bp, S. cerevisiae
tccattgatacaattagtagaagcc

SEQ ID NO: 133 - DNA, 25 bp, S. cerevisiae
taataactcatacttcgtgctattg

SEQ ID NO: 134 - DNA, 25 bp, S. cerevisiae
tcttcatttaaccagccaatttttt

SEQ ID NO: 135 - DNA, 25 bp, S. cerevisiae
tcttcatttaacgagccaatttttt

SEQ ID NO: 136 - DNA, 25 bp, S. cerevisiae
ttattgagtcatctttcaataattg

SEQ ID NO: 137 - DNA, 25 bp, S. cerevisiae
taataactcatagttcgtgctattg

SEQ ID NO: 138 - DNA, 25 bp, S. cerevisiae
ttattgagtcatgtttcaataattg

SEQ ID NO: 139 - DNA, 25 bp, S. cerevisiae
ccaacggcatcatattctattcttg

SEQ ID NO: 140 - DNA, 25 bp, S. cerevisiae
ccaacggcatcaaattctattcttg

SEQ ID NO: 141 - DNA, 25 bp, S. cerevisiae
gaagatagcagcgtgtgttaatttt

SEQ ID NO: 142 - DNA, 25 bp, S. cerevisiae
gaagatagcagcctgtgttaatttt

SEQ ID NO: 143 - DNA, 25 bp, S. cerevisiae
cgcattggccaatagacgatcattt

SEQ ID NO: 144 - DNA, 25 bp, S. cerevisiae
cgcattggccaaaagacgatcattt

SEQ ID NO: 145 - DNA, 25 bp, S. cerevisiae
cctcgtcaatgtccctacttacaac

SEQ ID NO: 146 - DNA, 25 bp, S. cerevisiae
cttcatagatggacagaatgtcttt

SEQ ID NO: 147 - DNA, 25 bp, S. cerevisiae
cttcatagatggtcagaatgtcttt

SEQ ID NO: 148 - DNA, 25 bp, S. cerevisiae
cttcgggcaagaattatgcaggaaa

SEQ ID NO: 149 - DNA, 25 bp, S. cerevisiae
cttcgggcaagatttatgcaggaaa

SEQ ID NO: 150 - DNA, 25 bp, S. cerevisiae
cctcgtcaatgtgcctacttacaac

SEQ ID NO: 151 - DNA, 25 bp, S. cerevisiae
gttacgcatactcttcctttatata

SEQ ID NO: 152 - DNA, 25 bp, S. cerevisiae
gttaagtctgctaccatgctaggca

SEQ ID NO: 153 - DNA, 25 bp, S. cerevisiae
gttacgcatactgttcctttatata

SEQ ID NO: 154 - DNA, 25 bp, S. cerevisiae
gatttccatttcagtatacctttag

SEQ ID NO: 155 - DNA, 25 bp, S. cerevisiae
gatttccatttctgtatacctttag

SEQ ID NO: 156 - DNA, 25 bp, S. cerevisiae
gttaagtctgcttccatgctaggca

SEQ ID NO: 157 - DNA, 25 bp, S. cerevisiae
gtgccttcttcgggaggtttgcatt

SEQ ID NO: 158 - DNA, 25 bp, S. cerevisiae
gtgccttcttcgcgaggtttgcatt

SEQ ID NO: 159 - DNA, 25 bp, S. cerevisiae
tcaatgcggtcatattgttaacaat

SEQ ID NO: 160 - DNA, 25 bp, S. cerevisiae
tcaatgcggtcaaattgttaacaat

SEQ ID NO: 161 - DNA, 25 bp, S. cerevisiae
caacctcatgacccctgtcttgact

SEQ ID NO: 162 - DNA, 25 bp, S. cerevisiae
aattaaagtctgcttaatacatata

SEQ ID NO: 163 - DNA, 25 bp, S. cerevisiae
caacctcatgacgcctgtcttgact

SEQ ID NO: 164 - DNA, 25 bp, S. cerevisiae
aattaaagtctggttaatacatata

SEQ ID NO: 165 - DNA, 25 bp, S. cerevisiae
cactagtatcgtatgaatattctaa

SEQ ID NO: 166 - DNA, 25 bp, S. cerevisiae
cactagtatcgtttgaatattctaa

SEQ ID NO: 167 - DNA, 25 bp, S. cerevisiae
catttcgtaggggaagaaatgtaga

SEQ ID NO: 168 - DNA, 25 bp, S. cerevisiae
catttcgtagggcaagaaatgtaga

SEQ ID NO: 169 - DNA, 25 bp, S. cerevisiae
tactcgcaaaatgaagtagttttaa

SEQ ID NO: 170 - DNA, 25 bp, S. cerevisiae
tactcgcaaaatcaagtagttttaa

SEQ ID NO: 171 - DNA, 25 bp, S. cerevisiae
atttagaaacgcaggaaatacagta

SEQ ID NO: 172 - DNA, 25 bp, S. cerevisiae
acctttagtatgttgcaaataaaga

SEQ ID NO: 173 - DNA, 25 bp, S. cerevisiae
ctctgggtttgcaactaatttggta

SEQ ID NO: 174 - DNA, 25 bp, S. cerevisiae
acctttagtatgatgcaaataaaga

SEQ ID NO: 175 - DNA, 25 bp, S. cerevisiae
atttagaaacgctggaaatacagta

SEQ ID NO: 176 - DNA, 25 bp, S. cerevisiae
gaaggttttcccaaatgctattgtt

SEQ ID NO: 177 - DNA, 25 bp, S. cerevisiae
agctgctgaatatccagattaaaaa

SEQ ID NO: 178 - DNA, 25 bp, S. cerevisiae
agctgctgaataaccagattaaaaa

SEQ ID NO: 179 - DNA, 25 bp, S. cerevisiae
gaaggttttccctaatgctattgtt

SEQ ID NO: 180 - DNA, 25 bp, S. cerevisiae
ctctgggtttgctactaatttggta

SEQ ID NO: 181 - DNA, 25 bp, S. cerevisiae
tatgtattcctcattacgtcgggct

SEQ ID NO: 182 - DNA, 25 bp, S. cerevisiae
tatgtattcctctttacgtcgggct

SEQ ID NO: 183 - DNA, 25 bp, S. cerevisiae
ttgaaccttattcatactttatata

SEQ ID NO: 184 - DNA, 25 bp, S. cerevisiae
ttattcatcccacgaatctcactac

SEQ ID NO: 185 - DNA, 25 bp, S. cerevisiae
ttgaaccttattgatactttatata

SEQ ID NO: 186 - DNA, 25 bp, S. cerevisiae
ttattcatcccaggaatctcactac

SEQ ID NO: 187 - DNA, 25 bp, S. cerevisiae
tgtacatgacactagctgagggtcg

SEQ ID NO: 188 - DNA, 25 bp, S. cerevisiae
tgtacatgacacaagctgagggtcg

SEQ ID NO: 189 - DNA, 25 bp, S. cerevisiae
gccatctccttccattgattaaaat

SEQ ID NO: 190 - DNA, 25 bp, S. cerevisiae
gccatctccttcgattgattaaaat

SEQ ID NO: 191 - DNA, 25 bp, S. cerevisiae
gcaagagggcttcgccggcttttac

SEQ ID NO: 192 - DNA, 25 bp, S. cerevisiae
gcaagagggcttggccggcttttac

SEQ ID NO: 193 - DNA, 25 bp, S. cerevisiae
cttgcgggtgtggactgccgaaata

SEQ ID NO: 194 - DNA, 25 bp, S. cerevisiae
cttgcgggtgtgcactgccgaaata

SEQ ID NO: 195 - DNA, 25 bp, S. cerevisiae
gttcatttggctggtgagaacgact

SEQ ID NO: 196 - DNA, 25 bp, S. cerevisiae
gttcatttggctcgtgagaacgact

SEQ ID NO: 197 - DNA, 25 bp, S. cerevisiae
gtaaaaagcatcattcgcaattgtt

SEQ ID NO: 198 - DNA, 25 bp, S. cerevisiae
gtaaaaagcatctttcgcaattgtt

SEQ ID NO: 199 - DNA, 25 bp, S. cerevisiae
ggacagtacctggtgctgtggtaac

SEQ ID NO: 200 - DNA, 25 bp, S. cerevisiae
ggacagtacctgctgctgtggtaac

SEQ ID NO: 201 - DNA, 25 bp, S. cerevisiae
aattgcctcatttttcaaagatgct

SEQ ID NO: 202 - DNA, 25 bp, S. cerevisiae
aattgcctcattattcaaagatgct

SEQ ID NO: 203 - DNA, 25 bp, S. cerevisiae
cacgtttatgtctttactgtcgttt

SEQ ID NO: 204 - DNA, 25 bp, S. cerevisiae
cacgtttatgtcattactgtcgttt

SEQ ID NO: 205 - DNA, 25 bp, S. cerevisiae
atctacgacgaaaaataacgtattt

SEQ ID NO: 206 - DNA, 25 bp, S. cerevisiae
atcatctttactttcagcatacaat

SEQ ID NO: 207 - DNA, 25 bp, S. cerevisiae
atcatctttactatcagcatacaat

SEQ ID NO: 208 - DNA, 25 bp, S. cerevisiae
atctacgacgaataataacgtattt

SEQ ID NO: 209 - DNA, 25 bp, S. cerevisiae
actgcaagcgtggaaaattggaagt

SEQ ID NO: 210 - DNA, 25 bp, S. cerevisiae
actgcaagcgtgcaaaattggaagt

SEQ ID NO: 211 - DNA, 25 bp, S. cerevisiae
tatccattccgaatcatatcgtttt

SEQ ID NO: 212 - DNA, 25 bp, S. cerevisiae
tatccattccgattcatatcgtttt

SEQ ID NO: 213 - DNA, 25 bp, S. cerevisiae
tatactagtactttcatcattcaca

SEQ ID NO: 214 - DNA, 25 bp, S. cerevisiae
tatactagtactatcatcattcaca

SEQ ID NO: 215 - DNA, 25 bp, S. cerevisiae
ttttcaatgtgtaaacacaatattt

SEQ ID NO: 216 - DNA, 25 bp, S. cerevisiae
ttttcaatgtgttaacacaatattt

SEQ ID NO: 217 - DNA, 25 bp, S. cerevisiae
ttcaagcctctgaaaactccacttc

SEQ ID NO: 218 - DNA, 25 bp, S. cerevisiae
ttcaagcctctgtaaactccacttc

SEQ ID NO: 219 - DNA, 25 bp, S. cerevisiae
tgattttcggtagcaagatttgaaa

SEQ ID NO: 220 - DNA, 25 bp, S. cerevisiae
ttcaaattttggtgggaagattcta

SEQ ID NO: 221 - DNA, 25 bp, S. cerevisiae
ttcaaattttggagggaagattcta

SEQ ID NO: 222 - DNA, 25 bp, S. cerevisiae
tgattttcggtaccaagatttgaaa

SEQ ID NO: 223 - DNA, 25 bp, S. cerevisiae
tgaacgtacgtatcaaaaatatgga

SEQ ID NO: 224 - DNA, 25 bp, S. cerevisiae
tgaacgtacgtaacaaaaatatgga

SEQ ID NO: 225 - DNA, 25 bp, S. cerevisiae
tcagattttatctacactattttta

SEQ ID NO: 226 - DNA, 25 bp, S. cerevisiae
tctatttagtcgaaagcagttaatt

SEQ ID NO: 227 - DNA, 25 bp, S. cerevisiae
tcagattttatcaacactattttta

SEQ ID NO: 228 - DNA, 25 bp, S. cerevisiae
tcagatgcttcggaaccgtaataac

SEQ ID NO: 229 - DNA, 25 bp, S. cerevisiae
tctatttagtcgtaagcagttaatt

SEQ ID NO: 230 - DNA, 25 bp, S. cerevisiae
tcagatgcttcgcaaccgtaataac

SEQ ID NO: 231 - DNA, 25 bp, S. cerevisiae
ccaatctgtagaactcacttttatt

SEQ ID NO: 232 - DNA, 25 bp, S. cerevisiae
ccaatctgtagatctcacttttatt

SEQ ID NO: 233 - DNA, 25 bp, S. cerevisiae
ccatgtttacatcctggttattaaa

SEQ ID NO: 234 - DNA, 25 bp, S. cerevisiae
ccatgtttacatgctggttattaaa

SEQ ID NO: 235 - DNA, 25 bp, S. cerevisiae
gatgttcatcaacctttcccttact

SEQ ID NO: 236 - DNA, 25 bp, S. cerevisiae
gatgttcatcaagctttcccttact

SEQ ID NO: 237 - DNA, 25 bp, S. cerevisiae
gtcccgcgagaagaaactctccttc

SEQ ID NO: 238 - DNA, 25 bp, S. cerevisiae
gtcccgcgagaacaaactctccttc

SEQ ID NO: 239 - DNA, 25 bp, S. cerevisiae
tcacgaatatcgtgtgatgagaaag

SEQ ID NO: 240 - DNA, 25 bp, S. cerevisiae
tcacgaatatcgagtgatgagaaag

SEQ ID NO: 241 - DNA, 25 bp, B. subtillis
aagagagcgcctatctcattcagaa

SEQ ID NO: 242 - DNA, 25 bp, B. subtillis
aagagagcgcctttctcattcagaa

SEQ ID NO: 243 - DNA, 25 bp, B. subtillis
caccgaaagagagcgcctatctcat

SEQ ID NO: 244 - DNA, 25 bp, B. subtillis
caccgaaagagaccgcctatctcat

SEQ ID NO: 245 - DNA, 25 bp, B. subtillis
actatgaggctgcgaaggcagatgc

SEQ ID NO: 246 - DNA, 25 bp, B. subtillis
agacgattacaagcggaggcgctgc

SEQ ID NO: 247 - DNA, 25 bp, B. subtillis
atagactatgaggctgcgaaggcag

SEQ ID NO: 248 - DNA, 25 bp, B. subtillis
agacgattacaaccggaggcgctgc

SEQ ID NO: 249 - DNA, 25 bp, B. subtillis
atagactatgagcctgcgaaggcag

SEQ ID NO: 250 - DNA, 25 bp, B. subtillis
actatgaggctgggaaggcagatgc

SEQ ID NO: 251 - DNA, 25 bp, B. subtillis
tttacaggtgcagtcaccgaaagag

SEQ ID NO: 252 - DNA, 25 bp, B. subtillis
ttaaagaggattttgtgcctgtgca

SEQ ID NO: 253 - DNA, 25 bp, B. subtillis
tttacaggtgcactcaccgaaagag

SEQ ID NO: 254 - DNA, 25 bp, B. subtillis
ttagagacgatttcaagcggaggcg

SEQ ID NO: 255 - DNA, 25 bp, B. subtillis
ttaaagaggattatgtgcctgtgca

SEQ ID NO: 256 - DNA, 25 bp, B. subtillis
tttcacaaatgggagacttgaagat

SEQ ID NO: 257 - DNA, 25 bp, B. subtillis
ttttgtgcctgtccagattgcaata

SEQ ID NO: 258 - DNA, 25 bp, B. subtillis
ttttgtgcctgtgcagattgcaata

SEQ ID NO: 259 - DNA, 25 bp, B. subtillis
tttcacaaatggcagacttgaagat

SEQ ID NO: 260 - DNA, 25 bp, B. subtillis
ttagagacgattacaagcggaggcg

SEQ ID NO: 261 - DNA, 25 bp, B. subtillis
gcttttaatgcgcgagctgcgattt

SEQ ID NO: 262 - DNA, 25 bp, B. subtillis
gcttttaatgcgggagctgcgattt

SEQ ID NO: 263 - DNA, 25 bp, B. subtillis
gcagcttgaacgactaaagcagaaa

SEQ ID NO: 264 - DNA, 25 bp, B. subtillis
gcagcagttccgctttatctattac

SEQ ID NO: 265 - DNA, 25 bp, B. subtillis
gcagattgcaattgactatgaggct

SEQ ID NO: 266 - DNA, 25 bp, B. subtillis
gcagcagttccggtttatctattac

SEQ ID NO: 267 - DNA, 25 bp, B. subtillis
gcagattgcaatagactatgaggct

SEQ ID NO: 268 - DNA, 25 bp, B. subtillis
gcagcttgaacgtctaaagcagaaa

SEQ ID NO: 269 - DNA, 25 bp, B. subtillis
ccgcgcagcttgaacgactaaagca

SEQ ID NO: 270 - DNA, 25 bp, B. subtillis
ccgcgcagcttgtacgactaaagca

SEQ ID NO: 271 - DNA, 25 bp, B. subtillis
gatttcggtttctcaaatggcagac

SEQ ID NO: 272 - DNA, 25 bp, B. subtillis
gattacaagcggtggcgctgccgcg

SEQ ID NO: 273 - DNA, 25 bp, B. subtillis
gattacaagcggaggcgctgccgcg

SEQ ID NO: 274 - DNA, 25 bp, B. subtillis
gatttcggtttcacaaatggcagac

SEQ ID NO: 275 - DNA, 25 bp, B. subtillis
gagcagcctttcgagaaacgttcat

SEQ ID NO: 276 - DNA, 25 bp, B. subtillis
gagcgcctatctgattcagaatatt

SEQ ID NO: 277 - DNA, 25 bp, B. subtillis
gaggcgctggcaagcccgaatcggt

SEQ ID NO: 278 - DNA, 25 bp, B. subtillis
gagcagcctttccagaaacgttcat

SEQ ID NO: 279 - DNA, 25 bp, B. subtillis
gaggcgctggcatgcccgaatcggt

SEQ ID NO: 280 - DNA, 25 bp, B. subtillis
gagcgcctatctcattcagaatatt

SEQ ID NO: 281 - DNA, 25 bp, B. subtillis
caatcgctctgtgtcttctaaaagc

SEQ ID NO: 282 - DNA, 25 bp, B. subtillis
caatgcgggcactcgctcttacagt

SEQ ID NO: 283 - DNA, 25 bp, B. subtillis
caatcgctctgtctcttctaaaagc

SEQ ID NO: 284 - DNA, 25 bp, B. subtillis
caatgcgggcacacgctcttacagt

SEQ ID NO: 285 - DNA, 25 bp, B. subtillis
aagccggtgcgcagctgaaaacgat

SEQ ID NO: 286 - DNA, 25 bp, B. subtillis
tactgccggtgaggctgaaacgctg

SEQ ID NO: 287 - DNA, 25 bp, B. subtillis
tacaggcaggtggtggcattgttgc

SEQ ID NO: 288 - DNA, 25 bp, B. subtillis
tacaggcaggtgctggcattgttgc

SEQ ID NO: 289 - DNA, 25 bp, B. subtillis
tactgccggtgacgctgaaacgctg

SEQ ID NO: 290 - DNA, 25 bp, B. subtillis
acacgctcttactgtcgatggactt

SEQ ID NO: 291 - DNA, 25 bp, B. subtillis
acacgctcttacagtcgatggactt

SEQ ID NO: 292 - DNA, 25 bp, B. subtillis
aagccggtgcgctgctgaaaacgat

SEQ ID NO: 293 - DNA, 25 bp, B. subtillis
tatgatgatggcagcggaaatgact

SEQ ID NO: 294 - DNA, 25 bp, B. subtillis
tatctcaacggcgtcggcaattgtt

SEQ ID NO: 295 - DNA, 25 bp, B. subtillis
tatgatgatggctgcggaaatgact

SEQ ID NO: 296 - DNA, 25 bp, B. subtillis
tatctcaacggcctcggcaattgtt

SEQ ID NO: 297 - DNA, 25 bp, B. subtillis
gaaaacgattcaaattgcagaagac

SEQ ID NO: 298 - DNA, 25 bp, B. subtillis
gaaaacgattcatattgcagaagac

SEQ ID NO: 299 - DNA, 25 bp, B. subtillis
cgctaagcatgggaatcgctctgtc

SEQ ID NO: 300 - DNA, 25 bp, B. subtillis
cgctaagcatggcaatcgctctgtc

SEQ ID NO: 301 - DNA, 25 bp, B. subtillis
cttgtattacgattcgcacgatgag

SEQ ID NO: 302 - DNA, 25 bp, B. subtillis
cggtgttgcatcgatacaggcaggt

SEQ ID NO: 303 - DNA, 25 bp, B. subtillis
cttgtattacgaatcgcacgatgag

SEQ ID NO: 304 - DNA, 25 bp, B. subtillis
ctgatgaacagatttctacaattgt

SEQ ID NO: 305 - DNA, 25 bp, B. subtillis
cattgttgctgaatctgttccggaa

SEQ ID NO: 306 - DNA, 25 bp, B. subtillis
ctcggcaattgtagcctcggcagct

SEQ ID NO: 307 - DNA, 25 bp, B. subtillis
cattgttgctgattctgttccggaa

SEQ ID NO: 308 - DNA, 25 bp, B. subtillis
cggtgttgcatccatacaggcaggt

SEQ ID NO: 309 - DNA, 25 bp, B. subtillis
ctcggcaattgttgcctcggcagct

SEQ ID NO: 310 - DNA, 25 bp, B. subtillis
ctgatgaacagaattctacaattgt

SEQ ID NO: 311 - DNA, 25 bp, B. subtillis
gttgcctcggcagctggtgcgaaaa

SEQ ID NO: 312 - DNA, 25 bp, B. subtillis
gatattgtcaattcttgctcatcgg

SEQ ID NO: 313 - DNA, 25 bp, B. subtillis
gttgcctcggcacctggtgcgaaaa

SEQ ID NO: 314 - DNA, 25 bp, B. subtillis
gatattgtcaatacttgctcatcgg

SEQ ID NO: 315 - DNA, 25 bp, B. subtillis
gttttgtgaagggaatgcgggcaca

SEQ ID NO: 316 - DNA, 25 bp, B. subtillis
gattcgcacgatgagtgtaaagaac

SEQ ID NO: 317 - DNA, 25 bp, B. subtillis
gattcgcacgatcagtgtaaagaac

SEQ ID NO: 318 - DNA, 25 bp, B. subtillis
gttttgtgaaggcaatgcgggcaca

SEQ ID NO: 319 - DNA, 25 bp, B. subtillis
tggacttcctgatattgttgataca

SEQ ID NO: 320 - DNA, 25 bp, B. subtillis
tggacttcctgaaattgttgataca

SEQ ID NO: 321 - DNA, 25 bp, B. subtillis
agctgacaggctgtgaaatatggaa

SEQ ID NO: 322 - DNA, 25 bp, B. subtillis
atcaatagagacgatgtcacgtatt

SEQ ID NO: 323 - DNA, 25 bp, B. subtillis
agctgacaggctctgaaatatggaa

SEQ ID NO: 324 - DNA, 25 bp, B. subtillis
atgagacaaactactcagcgtaaag

SEQ ID NO: 325 - DNA, 25 bp, B. subtillis
atcaatagagaccatgtcacgtatt

SEQ ID NO: 326 - DNA, 25 bp, B. subtillis
acgatgtcacgttttgccaagagct

SEQ ID NO: 327 - DNA, 25 bp, B. subtillis
atgttgacggctttgtgattgattc

SEQ ID NO: 328 - DNA, 25 bp, B. subtillis
acgatgtcacgtattgccaagagct

SEQ ID NO: 329 - DNA, 25 bp, B. subtillis
atgagacaaacttctcagcgtaaag

SEQ ID NO: 330 - DNA, 25 bp, B. subtillis
atgttgacggctatgtgattgattc

SEQ ID NO: 331 - DNA, 25 bp, B. subtillis
ttaacatttgtcaatgaacatgggg

SEQ ID NO: 332 - DNA, 25 bp, B. subtillis
ttgattcatctgtaaaagggtctag

SEQ ID NO: 333 - DNA, 25 bp, B. subtillis
ttgattcatctgaaaaagggtctag

SEQ ID NO: 334 - DNA, 25 bp, B. subtillis
tttgcagcttgccgcggaatcacag

SEQ ID NO: 335 - DNA, 25 bp, B. subtillis
tttgcagcttgcggcggaatcacag

SEQ ID NO: 336 - DNA, 25 bp, B. subtillis
ttcagcttcacgctgatgaaaaacc

SEQ ID NO: 337 - DNA, 25 bp, B. subtillis
ttcagcttcacggtgatgaaaaacc

SEQ ID NO: 338 - DNA, 25 bp, B. subtillis
ttaacatttgtctatgaacatgggg

SEQ ID NO: 339 - DNA, 25 bp, B. subtillis
tgggaatgtgtggcggaatatcagc

SEQ ID NO: 340 - DNA, 25 bp, B. subtillis
tgccggaatatcagcaggcggctat

SEQ ID NO: 341 - DNA, 25 bp, B. subtillis
tgccggaatatctgcaggcggctat

SEQ ID NO: 342 - DNA, 25 bp, B. subtillis
tctcagcgtaaagcaatccatgctt

SEQ ID NO: 343 - DNA, 25 bp, B. subtillis
tctcagcgtaaaccaatccatgctt

SEQ ID NO: 344 - DNA, 25 bp, B. subtillis
gcgagctgtacttatcggtgaatca

SEQ ID NO: 345 - DNA, 25 bp, B. subtillis
gcgagctgtactaatcggtgaatca

SEQ ID NO: 346 - DNA, 25 bp, B. subtillis
gcgcttcaccatcaagataacacaa

SEQ ID NO: 347 - DNA, 25 bp, B. subtillis
gcggcggaatcacaggctgattacc

SEQ ID NO: 348 - DNA, 25 bp, B. subtillis
gcggcggaatcagaggctgattacc

SEQ ID NO: 349 - DNA, 25 bp, B. subtillis
gcgcttcaccatgaagataacacaa

SEQ ID NO: 350 - DNA, 25 bp, B. subtillis
ctcgacgtcattcagcttcacggtg

SEQ ID NO: 351 - DNA, 25 bp, B. subtillis
ctcgacgtcattgagcttcacggtg

SEQ ID NO: 352 - DNA, 25 bp, B. subtillis
gtattgccaagagcttgaagctcga

SEQ ID NO: 353 - DNA, 25 bp, B. subtillis
gtattgccaagaccttgaagctcga

SEQ ID NO: 354 - DNA, 25 bp, B. subtillis
gtcactaaaggatttgcagcttgcg

SEQ ID NO: 355 - DNA, 25 bp, B. subtillis
ggatgctgctgcacttcgcaagctg

SEQ ID NO: 356 - DNA, 25 bp, B. subtillis
ggatgctgctgctcttcgcaagctg

SEQ ID NO: 357 - DNA, 25 bp, B. subtillis
gtcactaaaggaattgcagcttgcg

SEQ ID NO: 358 - DNA, 25 bp, B. subtillis
tgggaatgtgtgccggaatatcagc

SEQ ID NO: 359 - DNA, 25 bp, B. subtillis
gagcttgaagctggacgtcattcag

SEQ ID NO: 360 - DNA, 25 bp, B. subtillis
gagcttgaagctcgacgtcattcag

SEQ ID NO: 361 - DNA, 25 bp, B. subtillis
aaggcagcaaggacgtagctgtgtt

SEQ ID NO: 362 - DNA, 25 bp, B. subtillis
aaggcagcaaggtcgtagctgtgtt

SEQ ID NO: 363 - DNA, 25 bp, B. subtillis
aagatccgaacagagcggtcgacat

SEQ ID NO: 364 - DNA, 25 bp, B. subtillis
aagatccgaacacagcggtcgacat

SEQ ID NO: 365 - DNA, 25 bp, B. subtillis
cagaaccaggttcttgcgcgtctat

SEQ ID NO: 366 - DNA, 25 bp, B. subtillis
cagatatttgaagctgaccgtcttt

SEQ ID NO: 367 - DNA, 25 bp, B. subtillis
cagataacctgatctaccaagtggc

SEQ ID NO: 368 - DNA, 25 bp, B. subtillis
cagaaccaggttgttgcgcgtctat

SEQ ID NO: 369 - DNA, 25 bp, B. subtillis
cagataacctgaactaccaagtggc

SEQ ID NO: 370 - DNA, 25 bp, B. subtillis
cagatatttgaacctgaccgtcttt

SEQ ID NO: 371 - DNA, 25 bp, B. subtillis
acgaagccgacaagctgttctctgt

SEQ ID NO: 372 - DNA, 25 bp, B. subtillis
atccttcacgcatatcagctgatcg

SEQ ID NO: 373 - DNA, 25 bp, B. subtillis
acgaagccgacatgctgttctctgt

SEQ ID NO: 374 - DNA, 25 bp, B. subtillis
atccttcacgcaaatcagctgatcg

SEQ ID NO: 375 - DNA, 25 bp, B. subtillis
actgatgatgaaatccttcacgcat

SEQ ID NO: 376 - DNA, 25 bp, B. subtillis
actgatgatgaattccttcacgcat

SEQ ID NO: 377 - DNA, 25 bp, B. subtillis
tatcagctgatcgcccgtgtagaag

SEQ ID NO: 378 - DNA, 25 bp, B. subtillis
tatcagctgatcccccgtgtagaag

SEQ ID NO: 379 - DNA, 25 bp, B. subtillis
tgaccgtctttgaaagcgacaaatg

SEQ ID NO: 380 - DNA, 25 bp, B. subtillis
tgaccgtctttgtaagcgacaaatg

SEQ ID NO: 381 - DNA, 25 bp, B. subtillis
tgctgttctctgtcactgttcccgg

SEQ ID NO: 382 - DNA, 25 bp, B. subtillis
tgctgttctctgacactgttcccgg

SEQ ID NO: 383 - DNA, 25 bp, B. subtillis
tgcgcgtctatcgcaggagtgctga

SEQ ID NO: 384 - DNA, 25 bp, B. subtillis
tgcgcgtctatcccaggagtgctga

SEQ ID NO: 385 - DNA, 25 bp, B. subtillis
tcggaatggcgcacagcagatattt

SEQ ID NO: 386 - DNA, 25 bp, B. subtillis
tcggaatggcgctcagcagatattt

SEQ ID NO: 387 - DNA, 25 bp, B. subtillis
cctgtcacattgccgactgatgaag

SEQ ID NO: 388 - DNA, 25 bp, B. subtillis
cctgtcacattggcgactgatgaag

SEQ ID NO: 389 - DNA, 25 bp, B. subtillis
gctttgattcagacggaatggcgct

SEQ ID NO: 390 - DNA, 25 bp, B. subtillis
gcggtcgacattacagaaatcaagc

SEQ ID NO: 391 - DNA, 25 bp, B. subtillis
gcggtcgacatttcagaaatcaagc

SEQ ID NO: 392 - DNA, 25 bp, B. subtillis
gctttgattcagtcggaatggcgct

SEQ ID NO: 393 - DNA, 25 bp, B. subtillis
gacagcatccttgaatatgtaaaag

SEQ ID NO: 394 - DNA, 25 bp, B. subtillis
gacagcatccttcaatatgtaaaag

SEQ ID NO: 395 - DNA, 25 bp, B. subtillis
ctcctgtccatgagaaggtgtggag

SEQ ID NO: 396 - DNA, 25 bp, B. subtillis
ctcctgtccatgtgaaggtgtggag

SEQ ID NO: 397 - DNA, 25 bp, B. subtillis
gtaaaggcagccgaggaatccaatg

SEQ ID NO: 398 - DNA, 25 bp, B. subtillis
gtaaaggcagcccaggaatccaatg

SEQ ID NO: 399 - DNA, 25 bp, B. subtillis
tcagaaatcaaggctgtcacattgc

SEQ ID NO: 400 - DNA, 25 bp, B. subtillis
tcagaaatcaagcctgtcacattgc

SEQ ID NO: 401 - DNA, 25 bp, B. subtillis
cacttccgctgcagcggcagcatat

SEQ ID NO: 402 - DNA, 25 bp, B. subtillis
cacttccgctgctgcggcagcatat

SEQ ID NO: 403 - DNA, 25 bp, B. subtillis
cagcccgtgctatcatgaaatgcat

SEQ ID NO: 404 - DNA, 25 bp, B. subtillis
cagcccgtgctaacatgaaatgcat

SEQ ID NO: 405 - DNA, 25 bp, B. subtillis
catgagaaaaaccgcacaggccttc

SEQ ID NO: 406 - DNA, 25 bp, B. subtillis
catgagaaaaacggcacaggccttc

SEQ ID NO: 407 - DNA, 25 bp, B. subtillis
acacctcttattgacctgccgaagc

SEQ ID NO: 408 - DNA, 25 bp, B. subtillis
acacgattatgtgcgcgtcaacagg

SEQ ID NO: 409 - DNA, 25 bp, B. subtillis
acacctcttattcacctgccgaagc

SEQ ID NO: 410 - DNA, 25 bp, B. subtillis
acacgattatgtccgcgtcaacagg

SEQ ID NO: 411 - DNA, 25 bp, B. subtillis
tgtgagaaatcaccgattgcccttg

SEQ ID NO: 412 - DNA, 25 bp, B. subtillis
tgtgagaaatcagcgattgcccttg

SEQ ID NO: 413 - DNA, 25 bp, B. subtillis
tgcattgtcatcttcccgaacggaa

SEQ ID NO: 414 - DNA, 25 bp, B. subtillis
tgcattgtcatcatcccgaacggaa

SEQ ID NO: 415 - DNA, 25 bp, B. subtillis
tcagtcaacccttaccgcattgaag

SEQ ID NO: 416 - DNA, 25 bp, B. subtillis
tcagtcaaccctaaccgcattgaag

SEQ ID NO: 417 - DNA, 25 bp, B. subtillis
gcgtcaacaggtaacacttccgctg

SEQ ID NO: 418 - DNA, 25 bp, B. subtillis
gctggaaacatctctgcgtactgga

SEQ ID NO: 419 - DNA, 25 bp, B. subtillis
gcggcggcaatcctgcgcaatgaag

SEQ ID NO: 420 - DNA, 25 bp, B. subtillis
gcggcggcaatcgtgcgcaatgaag

SEQ ID NO: 421 - DNA, 25 bp, B. subtillis
gcgtcaacaggttacacttccgctg

SEQ ID NO: 422 - DNA, 25 bp, B. subtillis
gctggaaacatcactgcgtactgga

SEQ ID NO: 423 - DNA, 25 bp, B. subtillis
gaaggcaatgactcgattatgtgcg

SEQ ID NO: 424 - DNA, 25 bp, B. subtillis
gaattgagcttcttgtcaaaacgga

SEQ ID NO: 425 - DNA, 25 bp, B. subtillis
gcaatcgtgcgctatgaagtgattg

SEQ ID NO: 426 - DNA, 25 bp, B. subtillis
gaattgagcttcatgtcaaaacgga

SEQ ID NO: 427 - DNA, 25 bp, B. subtillis
gaaggcaatgacacgattatgtgcg

SEQ ID NO: 428 - DNA, 25 bp, B. subtillis
gcaatcgtgcgcaatgaagtgattg

SEQ ID NO: 429 - DNA, 25 bp, B. subtillis
ctgtaacagatcaaacaccggcgct

SEQ ID NO: 430 - DNA, 25 bp, B. subtillis
cggcagcatatgcagcccgtgctaa

SEQ ID NO: 431 - DNA, 25 bp, B. subtillis
ctgtaacagatctaacaccggcgct

SEQ ID NO: 432 - DNA, 25 bp, B. subtillis
cggcagcatatggagcccgtgctaa

SEQ ID NO: 433 - DNA, 25 bp, B. subtillis
ctgctgccttcgtagtgtgcgaaca

SEQ ID NO: 434 - DNA, 25 bp, B. subtillis
ctgctgccttcgaagtgtgcgaaca

SEQ ID NO: 435 - DNA, 25 bp, B. subtillis
gtccgttccatcagtgagaaatcac

SEQ ID NO: 436 - DNA, 25 bp, B. subtillis
gtccgttccatctgtgagaaatcac

SEQ ID NO: 437 - DNA, 25 bp, B. subtillis
gggatcatttaaagatcgcggaatg

SEQ ID NO: 438 - DNA, 25 bp, B. subtillis
gggatcatttaatgatcgcggaatg

SEQ ID NO: 439 - DNA, 25 bp, B. subtillis
ggaaaactcgctgaagctgtcatgt

SEQ ID NO: 440 - DNA, 25 bp, B. subtillis
ggaaaactcgctcaagctgtcatgt

SEQ ID NO: 441 - DNA, 25 bp, B. subtillis
catgtccaaggaatggccgcttgtc

SEQ ID NO: 442 - DNA, 25 bp, B. subtillis
catgtccaaggattggccgcttgtc

SEQ ID NO: 443 - DNA, 25 bp, B. subtillis
agtagagcacgtggccgagatgaag

SEQ ID NO: 444 - DNA, 25 bp, B. subtillis
agtagagcacgtcgccgagatgaag

SEQ ID NO: 445 - DNA, 25 bp, B. subtillis
agaaggacacccggacaatgctggc

SEQ ID NO: 446 - DNA, 25 bp, B. subtillis
agaaggacaccccgacaatgctggc

SEQ ID NO: 447 - DNA, 25 bp, B. subtillis
agacgcgagagacgtgcttccgaag

SEQ ID NO: 448 - DNA, 25 bp, B. subtillis
atatggaacggcactcagcggagca

SEQ ID NO: 449 - DNA, 25 bp, B. subtillis
atatggaacggctctcagcggagca

SEQ ID NO: 450 - DNA, 25 bp, B. subtillis
agacgcgagagaggtgcttccgaag

SEQ ID NO: 451 - DNA, 25 bp, B. subtillis
tgtcattcctttttatgaagtgctg

SEQ ID NO: 452 - DNA, 25 bp, B. subtillis
tgtcattcctttatatgaagtgctg

SEQ ID NO: 453 - DNA, 25 bp, B. subtillis
tgaagtgctgacaagagacgcgaga

SEQ ID NO: 454 - DNA, 25 bp, B. subtillis
tgaagtgctgactagagacgcgaga

SEQ ID NO: 455 - DNA, 25 bp, B. subtillis
tgctgtcagcaatatcctcattgct

SEQ ID NO: 456 - DNA, 25 bp, B. subtillis
tgctgtcagcaaaatcctcattgct

SEQ ID NO: 457 - DNA, 25 bp, B. subtillis
tgccgatgccgttaaagcaagtgct

SEQ ID NO: 458 - DNA, 25 bp, B. subtillis
tgccgatgccgtaaaagcaagtgct

SEQ ID NO: 459 - DNA, 25 bp, B. subtillis
cctcattgctgcgatcatgtccaag

SEQ ID NO: 460 - DNA, 25 bp, B. subtillis
ccaaatgatccgcgtcccgaatgct

SEQ ID NO: 461 - DNA, 25 bp, B. subtillis
ccaaatgatccgggtcccgaatgct

SEQ ID NO: 462 - DNA, 25 bp, B. subtillis
cctcattgctgccatcatgtccaag

SEQ ID NO: 463 - DNA, 25 bp, B. subtillis
gctcgcgcttcaattccctcattgt

SEQ ID NO: 464 - DNA, 25 bp, B. subtillis
gctcgcgcttcatttccctcattgt

SEQ ID NO: 465 - DNA, 25 bp, B. subtillis
gaaggagtttccttatgccgatgcc

SEQ ID NO: 466 - DNA, 25 bp, B. subtillis
gaaggagtttccatatgccgatgcc

SEQ ID NO: 467 - DNA, 25 bp, B. subtillis
cccgaatgctgacattgacgtagtc

SEQ ID NO: 468 - DNA, 25 bp, B. subtillis
cgcttctctcgtcggcggacttgtg

SEQ ID NO: 469 - DNA, 25 bp, B. subtillis
cgcttctctcgtgggcggacttgtg

SEQ ID NO: 470 - DNA, 25 bp, B. subtillis
cccgaatgctgagattgacgtagtc

SEQ ID NO: 471 - DNA, 25 bp, B. subtillis
cggagcaggccctacgattctcgtc

SEQ ID NO: 472 - DNA, 25 bp, B. subtillis
cggcggacttgtgatcggcctgcat

SEQ ID NO: 473 - DNA, 25 bp, B. subtillis
cggcctgcatgaggatgacgagacc

SEQ ID NO: 474 - DNA, 25 bp, B. subtillis
cggcggacttgtcatcggcctgcat

SEQ ID NO: 475 - DNA, 25 bp, B. subtillis
cggagcaggcccaacgattctcgtc

SEQ ID NO: 476 - DNA, 25 bp, B. subtillis
cggcctgcatgacgatgacgagacc

SEQ ID NO: 477 - DNA, 25 bp, B. subtillis
gttccatcagccctaccgggcgatg

SEQ ID NO: 478 - DNA, 25 bp, B. subtillis
gttccatcagccgtaccgggcgatg

SEQ ID NO: 479 - DNA, 25 bp, B. subtillis
gtaccgggcgatgcttgtgcctgag

SEQ ID NO: 480 - DNA, 25 bp, B. subtillis
gtaccgggcgatccttgtgcctgag

SEQ ID NO: 481 - DNA, 25 bp, P1 bacteriophage
atcgctgccaggttatacgtaatct

SEQ ID NO: 482 - DNA, 25 bp, P1 bacteriophage
atcgctgccaggatatacgtaatct

SEQ ID NO: 483 - DNA, 25 bp, P1 bacteriophage
ttgggccagctaaacatgcttcatc

SEQ ID NO: 484 - DNA, 25 bp, P1 bacteriophage
ttgggccagctatacatgcttcatc

SEQ ID NO: 485 - DNA, 25 bp, P1 bacteriophage
tctgtccgtttggcggtcgtgggcg

SEQ ID NO: 486 - DNA, 25 bp, P1 bacteriophage
tctgtccgtttgccggtcgtgggcg

SEQ ID NO: 487 - DNA, 25 bp, P1 bacteriophage
gccggtgaacgtccaaaacaggctc

SEQ ID NO: 488 - DNA, 25 bp, P1 bacteriophage
gccggtgaacgtgcaaaacaggctc

SEQ ID NO: 489 - DNA, 25 bp, P1 bacteriophage
gctgtttcactggttatgcggcgga

SEQ ID NO: 490 - DNA, 25 bp, P1 bacteriophage
gcactgatttcgaccaggttcgttc

SEQ ID NO: 491 - DNA, 25 bp, P1 bacteriophage
gctgtttcactgcttatgcggcgga

SEQ ID NO: 492 - DNA, 25 bp, P1 bacteriophage
gcactgatttcgtccaggttcgttc

SEQ ID NO: 493 - DNA, 25 bp, P1 bacteriophage
gcaaaacaggctgtagcgttcgaac

SEQ ID NO: 494 - DNA, 25 bp, P1 bacteriophage
gcaaaacaggctctagcgttcgaac

SEQ ID NO: 495 - DNA, 25 bp, P1 bacteriophage
cggaaatggtttgccgcagaacctg

SEQ ID NO: 496 - DNA, 25 bp, P1 bacteriophage
cggaaatggtttcccgcagaacctg

SEQ ID NO: 497 - DNA, 25 bp, P1 bacteriophage
gatcgccaggcgatttctgagcata

SEQ ID NO: 498 - DNA, 25 bp, P1 bacteriophage
gggattgcttataacaccctgttac

SEQ ID NO: 499 - DNA, 25 bp, P1 bacteriophage
gggattgcttattacaccctgttac

SEQ ID NO: 500 - DNA, 25 bp, P1 bacteriophage
gatgttcgcgattatcttctatatc

SEQ ID NO: 501 - DNA, 25 bp, P1 bacteriophage
gatgttcgcgataatcttctatatc

SEQ ID NO: 502 - DNA, 25 bp, P1 bacteriophage
gatcgccaggcgttttctgagcata

SEQ ID NO: 503 - DNA, 25 bp, P1 bacteriophage
aagatatctcacctactgacggtgg

SEQ ID NO: 504 - DNA, 25 bp, P1 bacteriophage
aagatatctcacgtactgacggtgg

SEQ ID NO: 505 - DNA, 25 bp, P1 bacteriophage
atgatccgaatatctacctgttttg

SEQ ID NO: 506 - DNA, 25 bp, P1 bacteriophage
ataactacctgtattgccgggtcag

SEQ ID NO: 507 - DNA, 25 bp, P1 bacteriophage
ataactacctgttttgccgggtcag

SEQ ID NO: 508 - DNA, 25 bp, P1 bacteriophage
atgatccgaataactacctgttttg

SEQ ID NO: 509 - DNA, 25 bp, P1 bacteriophage
aaaaaatggtgttgccgcgccatct

SEQ ID NO: 510 - DNA, 25 bp, P1 bacteriophage
aaaaaatggtgtagccgcgccatct

SEQ ID NO: 511 - DNA, 25 bp, P1 bacteriophage
aacgaaaacgctcgttagcaccgca

SEQ ID NO: 512 - DNA, 25 bp, P1 bacteriophage
aacgaaaacgctggttagcaccgca

SEQ ID NO: 513 - DNA, 25 bp, P1 bacteriophage
tagctgatgatccgaataactacct

SEQ ID NO: 514 - DNA, 25 bp, P1 bacteriophage
tagctgatgatcggaataactacct

SEQ ID NO: 515 - DNA, 25 bp, P1 bacteriophage
ccagctatcaacacgcgccctggaa

SEQ ID NO: 516 - DNA, 25 bp, P1 bacteriophage
ccagctatcaactcgcgccctggaa

SEQ ID NO: 517 - DNA, 25 bp, P1 bacteriophage
cgctggttagcagcgcaggtgtaga

SEQ ID NO: 518 - DNA, 25 bp, P1 bacteriophage
cgctggttagcaccgcaggtgtaga

SEQ ID NO: 519 - DNA, 25 bp, P1 bacteriophage
ctgttttgccggctcagaaaaaatg

SEQ ID NO: 520 - DNA, 25 bp, P1 bacteriophage
ctgttttgccgggtcagaaaaaatg

SEQ ID NO: 521 - DNA, 25 bp, P1 bacteriophage
gttaatccatataggcagaacgaaa

SEQ ID NO: 522 - DNA, 25 bp, P1 bacteriophage
gttaatccatattggcagaacgaaa

SEQ ID NO: 523 - DNA, 25 bp, P1 bacteriophage
ggtcgagcgatgcatttccgtctct

SEQ ID NO: 524 - DNA, 25 bp, P1 bacteriophage
ggtcgagcgatggatttccgtctct

SEQ ID NO: 525 - DNA, 25 bp, B. subtillis
caatagactatgtggctgcgaaggc

SEQ ID NO: 526 - DNA, 25 bp, B. subtillis
caatagactatgaggctgcgaaggc

SEQ ID NO: 527 - DNA, 25 bp, B. subtillis
cactggagacgtatcagccgaagca

SEQ ID NO: 528 - DNA, 25 bp, B. subtillis
cactggagacgtttcagccgaagca

SEQ ID NO: 529 - DNA, 25 bp, B. subtillis
tttcaattacagcaccgaccgacgt

SEQ ID NO: 530 - DNA, 25 bp, B. subtillis
tatttaatctgcttgggccgctcag

SEQ ID NO: 531 - DNA, 25 bp, B. subtillis
tttcaattacaggaccgaccgacgt

SEQ ID NO: 532 - DNA, 25 bp, B. subtillis
tatttaatctgcatgggccgctcag

SEQ ID NO: 533 - DNA, 25 bp, B. subtillis
ttagagacgatttcaagcggaggcg

SEQ ID NO: 534 - DNA, 25 bp, B. subtillis
ttgaattaaaggacggagagcgccg

SEQ ID NO: 535 - DNA, 25 bp, B. subtillis
ttttaatatctctacggcctcggca

SEQ ID NO: 536 - DNA, 25 bp, B. subtillis
ttgaattaaaggtcggagagcgccg

SEQ ID NO: 537 - DNA, 25 bp, B. subtillis
ttttaatatctcaacggcctcggca

SEQ ID NO: 538 - DNA, 25 bp, B. subtillis
ttagagacgattacaagcggaggcg

SEQ ID NO: 539 - DNA, 25 bp, B. subtillis
tgctgattctgtaccggaagccgaa

SEQ ID NO: 540 - DNA, 25 bp, B. subtillis
tgctgattctgttccggaagccgaa

SEQ ID NO: 541 - DNA, 25 bp, B. subtillis
gcagtcaccgaatgagagcgcctat

SEQ ID NO: 542 - DNA, 25 bp, B. subtillis
gcagtcaccgaaagagagcgcctat

SEQ ID NO: 543 - DNA, 25 bp, B. subtillis
cgttcatttaaggaggcgctggcaa

SEQ ID NO: 544 - DNA, 25 bp, B. subtillis
cgttcatttaagcaggcgctggcaa

SEQ ID NO: 545 - DNA, 25 bp, B. subtillis
taatgcgggagctgcgatttacacg

SEQ ID NO: 546 - DNA, 25 bp, B. subtillis
taatgcgggagcagcgatttacacg

SEQ ID NO: 547 - DNA, 25 bp, B. subtillis
caagctgtcatgtacggagccgaga

SEQ ID NO: 548 - DNA, 25 bp, B. subtillis
caagctgtcatgaacggagccgaga

SEQ ID NO: 549 - DNA, 25 bp, B. subtillis
taaaggcagccgtggaatccaatgg

SEQ ID NO: 550 - DNA, 25 bp, B. subtillis
taaaggcagccgaggaatccaatgg

SEQ ID NO: 551 - DNA, 25 bp, B. subtillis
aaatgatccgcgacccgaatgctga

SEQ ID NO: 552 - DNA, 25 bp, B. subtillis
aaatgatccgcgtcccgaatgctga

SEQ ID NO: 553 - DNA, 25 bp, B. subtillis
tatgaagtgctgtcaagagacgcga

SEQ ID NO: 554 - DNA, 25 bp, B. subtillis
tatgaagtgctgacaagagacgcga

SEQ ID NO: 555 - DNA, 25 bp, B. subtillis
tatcatgagaaaaacggcacaggcc

SEQ ID NO: 556 - DNA, 25 bp, B. subtillis
tatcatgagaaatacggcacaggcc

SEQ ID NO: 557 - DNA, 25 bp, B. subtillis
ttgaatatgtaaaaggagcggcccg

SEQ ID NO: 558 - DNA, 25 bp, B. subtillis
ttgaatatgtaataggagcggcccg

SEQ ID NO: 559 - DNA, 25 bp, B. subtillis
tgtcaaaagtagtgcacgtcgccga

SEQ ID NO: 560 - DNA, 25 bp, B. subtillis
tgtcaaaagtagagcacgtcgccga

SEQ ID NO: 561 - DNA, 25 bp, B. subtillis
gacggaaactttgacgatgcgctta

SEQ ID NO: 562 - DNA, 25 bp, B. subtillis
tctaccaagtggctaaacggaccgc

SEQ ID NO: 563 - DNA, 25 bp, B. subtillis
tctaccaagtgggtaaacggaccgc

SEQ ID NO: 564 - DNA, 25 bp, B. subtillis
tcactgcgtactcgaagggcttcaa

SEQ ID NO: 565 - DNA, 25 bp, B. subtillis
tcactgcgtactggaagggcttcaa

SEQ ID NO: 566 - DNA, 25 bp, B. subtillis
gatgttttagcgatcccggtcggaa

SEQ ID NO: 567 - DNA, 25 bp, B. subtillis
gatgttttagcgttcccggtcggaa

SEQ ID NO: 568 - DNA, 25 bp, B. subtillis
gacggaaactttcacgatgcgctta

SEQ ID NO: 569 - DNA, 25 bp, B. subtillis
caatcagcttgacaacacaccggaa

SEQ ID NO: 570 - DNA, 25 bp, B. subtillis
caatcagcttgagaacacaccggaa

SEQ ID NO: 571 - DNA, 25 bp, B. subtillis
taaacggtttgctagacagatgcgc

SEQ ID NO: 572 - DNA, 25 bp, B. subtillis
taaaatggacatcccggaggctgcg

SEQ ID NO: 573 - DNA, 25 bp, B. subtillis
taaaatggacatgccggaggctgcg

SEQ ID NO: 574 - DNA, 25 bp, B. subtillis
atttaacagagcacggacagcgggc

SEQ ID NO: 575 - DNA, 25 bp, B. subtillis
atttaacagagctcggacagcgggc

SEQ ID NO: 576 - DNA, 25 bp, B. subtillis
tatggtcattaaagttccgccgggc

SEQ ID NO: 577 - DNA, 25 bp, B. subtillis
tatggtcattaatgttccgccgggc

SEQ ID NO: 578 - DNA, 25 bp, B. subtillis
tgattgaaggcggacaccaaggcgt

SEQ ID NO: 579 - DNA, 25 bp, B. subtillis
tgattgaaggcgcacaccaaggcgt

SEQ ID NO: 580 - DNA, 25 bp, B. subtillis
tgatgaagcactgagagaacgcgga

SEQ ID NO: 581 - DNA, 25 bp, B. subtillis
tgaagtagatgaaggtctccgcacc

SEQ ID NO: 582 - DNA, 25 bp, B. subtillis
tgatgaagcactcagagaacgcgga

SEQ ID NO: 583 - DNA, 25 bp, B. subtillis
tgaagtagatgatggtctccgcacc

SEQ ID NO: 584 - DNA, 25 bp, B. subtillis
tccgtgaagatgtattgcccgatgc

SEQ ID NO: 585 - DNA, 25 bp, B. subtillis
tccgtgaagatgaattgcccgatgc

SEQ ID NO: 586 - DNA, 25 bp, B. subtillis
cattccggagtgaatagatgcagcc

SEQ ID NO: 587 - DNA, 25 bp, B. subtillis
cattccggagtgtatagatgcagcc

SEQ ID NO: 588 - DNA, 25 bp, B. subtillis
tggcatgtccaataaccagcacggg

SEQ ID NO: 589 - DNA, 25 bp, B. subtillis
tggcatgtccaaaaaccagcacggg

SEQ ID NO: 590 - DNA, 25 bp, B. subtillis
taaacggtttgcaagacagatgcgc

SEQ ID NO: 591 - DNA, 25 bp, B. subtillis
caatcgtttcatcattcggcgtgcg

SEQ ID NO: 592 - DNA, 25 bp, B. subtillis
caatcgtttcatgattcggcgtgcg

SEQ ID NO: 593 - DNA, 25 bp, B. subtillis
cacaggtggcatatgcgagcaaagc

SEQ ID NO: 594 - DNA, 25 bp, B. subtillis
cacaggtggcatttgcgagcaaagc

SEQ ID NO: 595 - DNA, 25 bp, B. subtillis
taaaagagatgctcgatcaatggcc

SEQ ID NO: 596 - DNA, 25 bp, B. subtillis
taaaagagatgcacgatcaatggcc

SEQ ID NO: 597 - DNA, 25 bp, B. subtillis
tatccggaggagtgctatatacggc

SEQ ID NO: 598 - DNA, 25 bp, B. subtillis
tatgaaatcgcgcttcttgaagacc

SEQ ID NO: 599 - DNA, 25 bp, B. subtillis
tatgaaatcgcggttcttgaagacc

SEQ ID NO: 600 - DNA, 25 bp, B. subtillis
tatccggaggagagctatatacggc

SEQ ID NO: 601 - DNA, 25 bp, B. subtillis
tgttcttcttcggatcacgcccgga

SEQ ID NO: 602 - DNA, 25 bp, B. subtillis
tgttcttcttcgcatcacgcccgga

SEQ ID NO: 603 - DNA, 25 bp, B. subtillis
tcataacggacaaactgaacgggcc

SEQ ID NO: 604 - DNA, 25 bp, B. subtillis
tcggcgtgcgaaataagaaaggtct

SEQ ID NO: 605 - DNA, 25 bp, B. subtillis
tcataacggacatactgaacgggcc

SEQ ID NO: 606 - DNA, 25 bp, B. subtillis
tcggcgtgcgaattaagaaaggtct

SEQ ID NO: 607 - DNA, 25 bp, B. subtillis
gactacattacatcgggccaggaag

SEQ ID NO: 608 - DNA, 25 bp, B. subtillis
gactacattacaacgggccaggaag

SEQ ID NO: 609 - DNA, 25 bp, B. subtillis
ctttaacggaaaggcgctgtggcag

SEQ ID NO: 610 - DNA, 25 bp, B. subtillis
ctttaacggaaacgcgctgtggcag

SEQ ID NO: 611 - DNA, 25 bp, B. subtillis
gacgcaggcacatctctttatacgg

SEQ ID NO: 612 - DNA, 25 bp, B. subtillis
gacgcaggcacaactctttatacgg

SEQ ID NO: 613 - DNA, 25 bp, E. coli
aattaaagccagcaatggatggccc

SEQ ID NO: 614 - DNA, 25 bp, artificial sequence
  synthetic oligonucleotide
aattaaagccaggaatggatggccc

SEQ ID NO: 615 - DNA, 25 bp, artificial sequence
  synthetic oligonucleotide
cattagccctattgagactgtacca

SEQ ID NO: 616 - DNA, 25 bp, artificial sequence
  synthetic oligonucleotide
cattagccctatagagactgtacca

SEQ ID NO: 617 - DNA, 25 bp, artificial sequence
  synthetic oligonucleotide
ttaggaataccagatcccgcagggt

SEQ ID NO: 618 - DNA, 25 bp, artificial sequence
  synthetic oligonucleotide
ttaggaataccacatcccgcagggt

SEQ ID NO: 619 - DNA, 25 bp, artificial sequence
  synthetic oligonucleotide
tccacagggatgcaaaggatcacca

SEQ ID NO: 620 - DNA, 25 bp, artificial sequence
  synthetic oligonucleotide
tccacagggatggaaaggatcacca

SEQ ID NO: 621 - DNA, 25 bp, artificial sequence
  synthetic oligonucleotide
tcagtacaatgtgcttccacaggga

SEQ ID NO: 622 - DNA, 25 bp, artificial sequence
  synthetic oligonucleotide
gacaccagggataagatatcagtac

SEQ ID NO: 623 - DNA, 25 bp, artificial sequence
  synthetic oligonucleotide
gacccctcgtcacaataaagatagg

SEQ ID NO: 624 - DNA, 25 bp, artificial sequence
  synthetic oligonucleotide
gacccctcgtcagaataaagatagg

SEQ ID NO: 625 - DNA, 25 bp, artificial sequence
  synthetic oligonucleotide
gacaccagggattagatatcagtac

SEQ ID NO: 626 - DNA, 25 bp, artificial sequence
  synthetic oligonucleotide
gatctgacttagaaatagggcagca

SEQ ID NO: 627 - DNA, 25 bp, artificial sequence
  synthetic oligonucleotide
gatcaccagcaaaattccaaagtag

SEQ ID NO: 628 - DNA, 25 bp, artificial sequence
  synthetic oligonucleotide
gatctgacttagtaatagggcagca

SEQ ID NO: 629 - DNA, 25 bp, artificial sequence
  synthetic oligonucleotide
tggatggcccaatagttaaacaatg

SEQ ID NO: 630 - DNA, 25 bp, artificial sequence
  synthetic oligonucleotide
tggatggcccaaaagttaaacaatg

SEQ ID NO: 631 - DNA, 25 bp, artificial sequence
  synthetic oligonucleotide
tcagtacaatgtccttccacaggga

SEQ ID NO: 632 - DNA, 25 bp, artificial sequence
  synthetic oligonucleotide
gatcaccagcaatattccaaagtag

SEQ ID NO: 633 - DNA, 25 bp, artificial sequence
  synthetic oligonucleotide
gaggagctgagacaacatctgttga

SEQ ID NO: 634 - DNA, 25 bp, artificial sequence
  synthetic oligonucleotide
gaggagctgagagaacatctgttga

SEQ ID NO: 635 - DNA, 25 bp, B. subtillis
caaggctacagtcccgacaagggta

SEQ ID NO: 636 - DNA, 25 bp, B. subtillis
caaggctacagtgccgacaagggta

SEQ ID NO: 637 - DNA, 25 bp, B. subtillis
caaacattggcgctatccctgaggt

SEQ ID NO: 638 - DNA, 25 bp, B. subtillis
caaacattggcggtatccctgaggt

SEQ ID NO: 639 - DNA, 25 bp, B. subtillis
cagaccgcggcctaataatgagtga

SEQ ID NO: 640 - DNA, 25 bp, B. subtillis
cagaccgcggccaaataatgagtga

SEQ ID NO: 641 - DNA, 25 bp, B. subtillis
taaattagtcattgcgggaccgcgt

SEQ ID NO: 642 - DNA, 25 bp, B. subtillis
taaattagtcatagcgggaccgcgt

SEQ ID NO: 643 - DNA, 25 bp, B. subtillis
tatgctttgagatacggtaccggga

SEQ ID NO: 644 - DNA, 25 bp, B. subtillis
tatgctttgagaaacggtaccggga

SEQ ID NO: 645 - DNA, 25 bp, B. subtillis
tattacatgtcagcgcggaagcgga

SEQ ID NO: 646 - DNA, 25 bp, B. subtillis
tattacatgtcaccgcggaagcgga

SEQ ID NO: 647 - DNA, 25 bp, B. subtillis
gaatcatgatctttacgcaaccgga

SEQ ID NO: 648 - DNA, 25 bp, B. subtillis
gaagaagcgatcatttccgccggaa

SEQ ID NO: 649 - DNA, 25 bp, B. subtillis
gaaggatatttttgcccgctggcca

SEQ ID NO: 650 - DNA, 25 bp, B. subtillis
gaagaagcgatcttttccgccggaa

SEQ ID NO: 651 - DNA, 25 bp, B. subtillis
gaaggatattttagcccgctggcca

SEQ ID NO: 652 - DNA, 25 bp, B. subtillis
gaatcatgatctatacgcaaccgga

SEQ ID NO: 653 - DNA, 25 bp, B. subtillis
gacgttcttgcttttggcgcccaca

SEQ ID NO: 654 - DNA, 25 bp, B. subtillis
gacgttcttgctattggcgcccaca

SEQ ID NO: 655 - DNA, 25 bp, B. subtillis
ggtattcgcttgcacaggcttcaga

SEQ ID NO: 656 - DNA, 25 bp, B. subtillis
ggtattcgcttggacaggcttcaga

SEQ ID NO: 657 - DNA, 25 bp, E. coli
caataccggagaacatgcaagctgg

SEQ ID NO: 658 - DNA, 25 bp, P1 bacteriophage
caataccggagatcatgcaagctgg

SEQ ID NO: 659 - DNA, 25 bp, P1 bacteriophage
taaacatgcttcatcgtcggtccgg

SEQ ID NO: 660 - DNA, 25 bp, P1 bacteriophage
tacggcgctaaggatgactctggtc

SEQ ID NO: 661 - DNA, 25 bp, P1 bacteriophage
taaacatgcttcttcgtcggtccgg

SEQ ID NO: 662 - DNA, 25 bp, P1 bacteriophage
tacggcgctaagcatgactctggtc

SEQ ID NO: 663 - DNA, 25 bp, P1 bacteriophage
tgaacgtgcaaatcaggctctagcg

SEQ ID NO: 664 - DNA, 25 bp, P1 bacteriophage
tgaacgtgcaaaacaggctctagcg

SEQ ID NO: 665 - DNA, 25 bp, P1 bacteriophage
tcttctatatctacaggcgcgcggt

SEQ ID NO: 666 - DNA, 25 bp, P1 bacteriophage
tcttctatatcttcaggcgcgcggt

SEQ ID NO: 667 - DNA, 25 bp, P1 bacteriophage
gaaaacgctggttagcaccgcaggt

SEQ ID NO: 668 - DNA, 25 bp, P1 bacteriophage
gaaaatgcttctctccgtttgccgg

SEQ ID NO: 669 - DNA, 25 bp, P1 bacteriophage
gaaaatgcttctgtccgtttgccgg

SEQ ID NO: 670 - DNA, 25 bp, P1 bacteriophage
gaaaacgctggtaagcaccgcaggt

SEQ ID NO: 671 - DNA, 25 bp, P1 bacteriophage
cattaccggtcgttgcaacgagtga

SEQ ID NO: 672 - DNA, 25 bp, P1 bacteriophage
cattaccggtcgatgcaacgagtga

SEQ ID NO: 673 - DNA, 25 bp, P1 bacteriophage
ggtaactaaactggtcgagcgatgg

SEQ ID NO: 674 - DNA, 25 bp, P1 bacteriophage
ggtaactaaactcgtcgagcgatgg

SEQ ID NO: 675 - DNA, 25 bp, P1 bacteriophage
tggcccgcgctgcagtttcaatacc

SEQ ID NO: 676 - DNA, 25 bp, P1 bacteriophage
tggcccgcgctggagtttcaatacc

SEQ ID NO: 677 - DNA, 25 bp, P1 bacteriophage
tcactcatggaatatagcgatcgct

SEQ ID NO: 678 - DNA, 25 bp, P1 bacteriophage
tcactcatggaaaatagcgatcgct

SEQ ID NO: 679 - DNA, 25 bp, E. coli
acgcaacagtaattccttacacctt

SEQ ID NO: 680 - DNA, 25 bp, E. coli
agcctgcagctgcattacgcaacag

SEQ ID NO: 681 - DNA, 25 bp, E. coli
cttacaccttcggagaacccacttc

SEQ ID NO: 682 - DNA, 25 bp, E. coli
cttacaccttcgcagaacccacttc

SEQ ID NO: 683 - DNA, 25 bp, E. coli
acgcaacagtaaatccttacacctt

SEQ ID NO: 684 - DNA, 25 bp, E. coli
agcctgcagctggattacgcaacag

SEQ ID NO: 685 - DNA, 25 bp, E. coli
cctctggcagcgaaaagaccccgga

SEQ ID NO: 686 - DNA, 25 bp, E. coli
cctctggcagcgtaaagaccccgga

SEQ ID NO: 687 - DNA, 25 bp, E. coli
cctgcagctggattacgcaacagta

SEQ ID NO: 688 - DNA, 25 bp, E. coli
cctgcagctggaatacgcaacagta

SEQ ID NO: 689 - DNA, 25 bp, E. coli
gaatcattggtattgagcgccggat

SEQ ID NO: 690 - DNA, 25 bp, E. coli
gcagcaggctacgggacggcaggtt

SEQ ID NO: 691 - DNA, 25 bp, E. coli
gaatcattggtaatgagcgccggat

SEQ ID NO: 692 - DNA, 25 bp, E. coli
gcagcaggctaccggacggcaggtt

SEQ ID NO: 693 - DNA, 25 bp, E. coli
cgcaacagtaaaaccttacaccttc

SEQ ID NO: 694 - DNA, 25 bp, E. coli
cgcaacagtaaatccttacaccttc

SEQ ID NO: 695 - DNA, 25 bp, E. coli
ctggcagcgaaaagaccccggaagg

SEQ ID NO: 696 - DNA, 25 bp, E. coli
ctggcagcgaaatgaccccggaagg

SEQ ID NO: 697 - DNA, 25 bp, E. coli
gtaaatccttactccttcgcagaac

SEQ ID NO: 698 - DNA, 25 bp, E. coli
gtaaatccttacaccttcgcagaac

SEQ ID NO: 699 - DNA, 25 bp, E. coli
gggcagaccgattgaatcattggta

SEQ ID NO: 700 - DNA, 25 bp, E. coli
gggcagaccgatagaatcattggta

SEQ ID NO: 701 - DNA, 25 bp, E. coli
cacaggtaatacaacacgccggact

SEQ ID NO: 702 - DNA, 25 bp, E. coli
cacaggtaatactacacgccggact

SEQ ID NO: 703 - DNA, 25 bp, E. coli
acttttgcagatagggtaacacagg

SEQ ID NO: 704 - DNA, 25 bp, E. coli
acttttgcagattgggtaacacagg

SEQ ID NO: 705 - DNA, 25 bp, E. coli
aactcggctgtattaatcacgcgat

SEQ ID NO: 706 - DNA, 25 bp, E. coli
aactcggctgtaataatcacgcgat

SEQ ID NO: 707 - DNA, 25 bp, E. coli
acaacacgccggactgactctggcg

SEQ ID NO: 708 - DNA, 25 bp, E. coli
acaacacgccggtctgactctggcg

SEQ ID NO: 709 - DNA, 25 bp, E. coli
aacaactgccggtgatactggtagt

SEQ ID NO: 710 - DNA, 25 bp, E. coli
aacaactgccggagatactggtagt

SEQ ID NO: 711 - DNA, 25 bp, E. coli
ttctgacactttgacttttgcagat

SEQ ID NO: 712 - DNA, 25 bp, E. coli
ttctgacactttcacttttgcagat

SEQ ID NO: 713 - DNA, 25 bp, E. coli
tgacactttcacatttgcagattgg

SEQ ID NO: 714 - DNA, 25 bp, E. coli
tgacactttcacttttgcagattgg

SEQ ID NO: 715 - DNA, 25 bp, E. coli
tgctgggagagatcccctggcttgc

SEQ ID NO: 716 - DNA, 25 bp, E. coli
tgctgggagagaacccctggcttgc

SEQ ID NO: 717 - DNA, 25 bp, E. coli
gccggtgatactcgtagttggtgtg

SEQ ID NO: 718 - DNA, 25 bp, E. coli
gccggtgatactggtagttggtgtg

SEQ ID NO: 719 - DNA, 25 bp, E. coli
gtcacgctgaatatatgaccacgct

SEQ ID NO: 720 - DNA, 25 bp, E. coli
gtcacgctgaatttatgaccacgct

SEQ ID NO: 721 - DNA, 25 bp, E. coli
tcacgctgaataaatgaccacgctc

SEQ ID NO: 722 - DNA, 25 bp, E. coli
tcacgctgaatatatgaccacgctc

SEQ ID NO: 723 - DNA, 25 bp, E. coli
cacggcactccgcgagctgtatcgg

SEQ ID NO: 724 - DNA, 25 bp, E. coli
cacggcactccgggagctgtatcgg

SEQ ID NO: 725 - DNA, 25 bp, E. coli
aggatgccgcagaccattatctggc

SEQ ID NO: 726 - DNA, 25 bp, E. coli
atggagcaatctggcagtgcagtgg

SEQ ID NO: 727 - DNA, 25 bp, E. coli
atgcagatctactgcgccagagtgc

SEQ ID NO: 728 - DNA, 25 bp, E. coli
atgcagatctacagcgccagagtgc

SEQ ID NO: 729 - DNA, 25 bp, E. coli
acgttcgatcttgcatggagcaatc

SEQ ID NO: 730 - DNA, 25 bp, E. coli
atggagcaatctcgcagtgcagtgg

SEQ ID NO: 731 - DNA, 25 bp, E. coli
aggatgccgcagtccattatctggc

SEQ ID NO: 732 - DNA, 25 bp, E. coli
acgcgggttgtggacctggctggat

SEQ ID NO: 733 - DNA, 25 bp, E. coli
acgttcgatcttccatggagcaatc

SEQ ID NO: 734 - DNA, 25 bp, E. coli
acgcgggttgtgcacctggctggat

SEQ ID NO: 735 - DNA, 25 bp, E. coli
ccagaaggatgccgcagaccattat

SEQ ID NO: 736 - DNA, 25 bp, E. coli
ccagaaggatgcggcagaccattat

SEQ ID NO: 737 - DNA, 25 bp, E. coli
gcatggagcaatctcgcagtgcagt

SEQ ID NO: 738 - DNA, 25 bp, E. coli
gcatggagcaatgtcgcagtgcagt

SEQ ID NO: 739 - DNA, 25 bp, E. coli
cgccgccaatgcatgttcaggcacg

SEQ ID NO: 740 - DNA, 25 bp, E. coli
cgccgccaatgcttgttcaggcacg

SEQ ID NO: 741 - DNA, 25 bp, E. coli
ctgccgttagcgtctgcgacgttcg

SEQ ID NO: 742 - DNA, 25 bp, E. coli
ctgccgttagcgactgcgacgttcg

SEQ ID NO: 743 - DNA, 25 bp, E. coli
gtaaatacacccacgtactggacgc

SEQ ID NO: 744 - DNA, 25 bp, E. coli
gtaaatacaccctcgtactggacgc

SEQ ID NO: 745 - DNA, 25 bp, E. coli
cacgctgtggtttgatgatgcgctc

SEQ ID NO: 746 - DNA, 25 bp, E. coli
cagcgattgcaactggcctggccgc

SEQ ID NO: 747 - DNA, 25 bp, E. coli
cacgctgtggttagatgatgcgctc

SEQ ID NO: 748 - DNA, 25 bp, E. coli
cagcgattgcaagtggcctggccgc

SEQ ID NO: 749 - DNA, 25 bp, E. coli
agtgccatgcgttcgctgaaaggca

SEQ ID NO: 750 - DNA, 25 bp, E. coli
agtgccatgcgtacgctgaaaggca

SEQ ID NO: 751 - DNA, 25 bp, E. coli
accgccagatgatatcgaacagtcg

SEQ ID NO: 752 - DNA, 25 bp, E. coli
atcaacatcatattcagcccatcac

SEQ ID NO: 753 - DNA, 25 bp, E. coli
atcaacatcataatcagcccatcac

SEQ ID NO: 754 - DNA, 25 bp, E. coli
accgccagatgaaatcgaacagtcg

SEQ ID NO: 755 - DNA, 25 bp, E. coli
tattaacgcgttcgcagttgcagcg

SEQ ID NO: 756 - DNA, 25 bp, E. coli
tattaacgcgttggcagttgcagcg

SEQ ID NO: 757 - DNA, 25 bp, E. coli
tcatattcagccgatcacgctgtgg

SEQ ID NO: 758 - DNA, 25 bp, E. coli
tcatattcagcccatcacgctgtgg

SEQ ID NO: 759 - DNA, 25 bp, E. coli
gaacggcgtgcaatatcaacatcat

SEQ ID NO: 760 - DNA, 25 bp, E. coli
gaacggcgtgcattatcaacatcat

SEQ ID NO: 761 - DNA, 25 bp, E. coli
cgctggtgcaggcatcgttacccga

SEQ ID NO: 762 - DNA, 25 bp, E. coli
cgctggtgcagggatcgttacccga

SEQ ID NO: 763 - DNA, 25 bp, E. coli
cggtgccacgcaacttcatgaaggg

SEQ ID NO: 764 - DNA, 25 bp, E. coli
cggtgccacgcatcttcatgaaggg

SEQ ID NO: 765 - DNA, 25 bp, E. coli
gtggacgagcgtccgcatgctaatc

SEQ ID NO: 766 - DNA, 25 bp, E. coli
gtggacgagcgtgcgcatgctaatc

SEQ ID NO: 767 - DNA, 25 bp, E. coli
caatgcttgttctggcacgccagaa

SEQ ID NO: 768 - DNA, 25 bp, E. coli
caatgcttgttcaggcacgccagaa

SEQ ID NO: 769 - DNA, 25 bp, E. coli
atattcagcccaacacgctgtggtt

SEQ ID NO: 770 - DNA, 25 bp, E. coli
acgccagaaggatgccgcagaccat

SEQ ID NO: 771 - DNA, 25 bp, E. coli
acgccagaaggaagccgcagaccat

SEQ ID NO: 772 - DNA, 25 bp, E. coli
aggcacgccagatggatgccgcaga

SEQ ID NO: 773 - DNA, 25 bp, E. coli
atattcagcccatcacgctgtggtt

SEQ ID NO: 774 - DNA, 25 bp, E. coli
aggcacgccagaaggatgccgcaga

SEQ ID NO: 775 - DNA, 25 bp, E. coli
ttcaggcacgcctgaaggatgccgc

SEQ ID NO: 776 - DNA, 25 bp, E. coli
ttcaggcacgccagaaggatgccgc

SEQ ID NO: 777 - DNA, 25 bp, E. coli
tcaggcacgccacaaggatgccgca

SEQ ID NO: 778 - DNA, 25 bp, E. coli
tcaggcacgccagaaggatgccgca

SEQ ID NO: 779 - DNA, 25 bp, E. coli
ccaatgcttgttcaggcacgccaga

SEQ ID NO: 780 - DNA, 25 bp, E. coli
gccaatgcttgtacaggcacgccag

SEQ ID NO: 781 - DNA, 25 bp, E. coli
ccaatgcttgttgaggcacgccaga

SEQ ID NO: 782 - DNA, 25 bp, E. coli
gccaatgcttgttcaggcacgccag

SEQ ID NO: 783 - DNA, 25 bp, E. coli
cgccaatgcttgatcaggcacgcca

SEQ ID NO: 784 - DNA, 25 bp, E. coli
cgccaatgcttgttcaggcacgcca

SEQ ID NO: 785 - DNA, 25 bp, E. coli
cttgttcaggcacgccagaaggatg

SEQ ID NO: 786 - DNA, 25 bp, E. coli
cttgttcaggcaggccagaaggatg

SEQ ID NO: 787 - DNA, 25 bp, E. coli
ggcacgccagaaggatgccgcagac

SEQ ID NO: 788 - DNA, 25 bp, E. coli
ggcacgccagaacgatgccgcagac

SEQ ID NO: 789 - DNA, 25 bp, E. coli
cacgcacttatcaggaacgcctcga

SEQ ID NO: 790 - DNA, 25 bp, E. coli
cacgcacttatctggaacgcctcga

SEQ ID NO: 791 - DNA, 25 bp, E. coli
agatcgcgccggattattgctgcaa

SEQ ID NO: 792 - DNA, 25 bp, E. coli
agatcgcgccggtttattgctgcaa

SEQ ID NO: 793 - DNA, 25 bp, E. coli
aaaagatcgcgcgggattattgctg

SEQ ID NO: 794 - DNA, 25 bp, E. coli
aaaagatcgcgccggattattgctg

SEQ ID NO: 795 - DNA, 25 bp, E. coli
tgtatgacgctgggcacgttgagtg

SEQ ID NO: 796 - DNA, 25 bp, E. coli
tgtatgacgctgcgcacgttgagtg

SEQ ID NO: 797 - DNA, 25 bp, E. coli
tgccgggatcaatgtctgttctggc

SEQ ID NO: 798 - DNA, 25 bp, E. coli
tgccgggatcaaagtctgttctggc

SEQ ID NO: 799 - DNA, 25 bp, E. coli
ccggattattgctgcaactggcaaa

SEQ ID NO: 800 - DNA, 25 bp, E. coli
ccggattattgcagcaactggcaaa

SEQ ID NO: 801 - DNA, 25 bp, E. coli
gctgggcacgttcagtgaatctcag

SEQ ID NO: 802 - DNA, 25 bp, E. coli
gcattgtgggctaaggcgaaacggt

SEQ ID NO: 803 - DNA, 25 bp, E. coli
gctgggcacgttgagtgaatctcag

SEQ ID NO: 804 - DNA, 25 bp, E. coli
gcattgtgggcttaggcgaaacggt

SEQ ID NO: 805 - DNA, 25 bp, E. coli
ccgggatcaaagtctgttctggcgg

SEQ ID NO: 806 - DNA, 25 bp, E. coli
ccgggatcaaagactgttctggcgg

SEQ ID NO: 807 - DNA, 25 bp, E. coli
cggaaagcgtgccaatcaacatgct

SEQ ID NO: 808 - DNA, 25 bp, E. coli
cggaaagcgtgcgaatcaacatgct

SEQ ID NO: 809 - DNA, 25 bp, E. coli
cgggatcaaagtctgttctggcggc

SEQ ID NO: 810 - DNA, 25 bp, E. coli
cgggatcaaagtgtgttctggcggc

SEQ ID NO: 811 - DNA, 25 bp, E. coli
aagccgagcggtagatggaagttga

SEQ ID NO: 812 - DNA, 25 bp, E. coli
aagccgagcggttgatggaagttga

SEQ ID NO: 813 - DNA, 25 bp, E. coli
catttcgatcctcgtcaggtgcagg

SEQ ID NO: 814 - DNA, 25 bp, E. coli
tttcgatcctcgacaggtgcaggtc

SEQ ID NO: 815 - DNA, 25 bp, E. coli
tttcgatcctcgtcaggtgcaggtc

SEQ ID NO: 816 - DNA, 25 bp, E. coli
ttcgatcctcgtcaggtgcaggtca

SEQ ID NO: 817 - DNA, 25 bp, E. coli
ttcgatcctcgtgaggtgcaggtca

SEQ ID NO: 818 - DNA, 25 bp, E. coli
tcgcgctacaaatccgggctggaag

SEQ ID NO: 819 - DNA, 25 bp, E. coli
tcgatcctcgtctggtgcaggtcag

SEQ ID NO: 820 - DNA, 25 bp, E. coli
tcgcgctacaaaaccgggctggaag

SEQ ID NO: 821 - DNA, 25 bp, E. coli
tcgatcctcgtcaggtgcaggtcag

SEQ ID NO: 822 - DNA, 25 bp, E. coli
gctggatctgctgtttgaagcgcag

SEQ ID NO: 823 - DNA, 25 bp, E. coli
gctggatctgctctttgaagcgcag

SEQ ID NO: 824 - DNA, 25 bp, E. coli
cgcgctacaaaaccgggctggaagc

SEQ ID NO: 825 - DNA, 25 bp, E. coli
cgcgctacaaaagcgggctggaagc

SEQ ID NO: 826 - DNA, 25 bp, E. coli
catttcgatcctggtcaggtgcagg

SEQ ID NO: 827 - DNA, 25 bp, E. coli
ctggatctgctgtttgaagcgcagc

SEQ ID NO: 828 - DNA, 25 bp, E. coli
ctggatctgctgattgaagcgcagc

SEQ ID NO: 829 - DNA, 25 bp, E. coli
cggcaggatcgaggcgcttctgtat

SEQ ID NO: 830 - DNA, 25 bp, E. coli
cggcaggatcgacgcgcttctgtat

SEQ ID NO: 831 - DNA, 25 bp, E. coli
gagcggttgatggaagttgaacagg

SEQ ID NO: 832 - DNA, 25 bp, E. coli
gagcggttgatgcaagttgaacagg

SEQ ID NO: 833 - DNA, 25 bp, E. coli
caacctcttacgtgcgcctttctgc

SEQ ID NO: 834 - DNA, 25 bp, E. coli
caacctcttacgagcgcctttctgc

SEQ ID NO: 835 - DNA, 25 bp, E. coli
agactcaggcgatgtgctttatggc

SEQ ID NO: 836 - DNA, 25 bp, E. coli
agactcaggcgaagtgctttatggc

SEQ ID NO: 837 - DNA, 25 bp, E. coli
actggggctaaaaccgcagcaaact

SEQ ID NO: 838 - DNA, 25 bp, E. coli
actggggctaaatccgcagcaaact

SEQ ID NO: 839 - DNA, 25 bp, E. coli
acaacagcaacgacttgaacaggcg

SEQ ID NO: 840 - DNA, 25 bp, E. coli
acaacagcaacgtcttgaacaggcg

SEQ ID NO: 841 - DNA, 25 bp, E. coli
tatggcaggcgcaaactcgattttc

SEQ ID NO: 842 - DNA, 25 bp, E. coli
tatggcaggcgctaactcgattttc

SEQ ID NO: 843 - DNA, 25 bp, E. coli
tttctacggttggaaactgctgacc

SEQ ID NO: 844 - DNA, 25 bp, E. coli
tttctacggttgcaaactgctgacc

SEQ ID NO: 845 - DNA, 25 bp, E. coli
tgccaacctctttcgtgcgcctttc

SEQ ID NO: 846 - DNA, 25 bp, E. coli
tgccaacctcttacgtgcgcctttc

SEQ ID NO: 847 - DNA, 25 bp, E. coli
gcaaactggggctaaatccgcagca

SEQ ID NO: 848 - DNA, 25 bp, E. coli
gcaaactcgattttctacggttgca

SEQ ID NO: 849 - DNA, 25 bp, E. coli
gcaaactcgattatctacggttgca

SEQ ID NO: 850 - DNA, 25 bp, E. coli
gcaaactggggcaaaatccgcagca

SEQ ID NO: 851 - DNA, 25 bp, E. coli
gaacagactcaggcgatgtgcttta

SEQ ID NO: 852 - DNA, 25 bp, E. coli
gaacagactcagccgatgtgcttta

SEQ ID NO: 853 - DNA, 25 bp, E. coli
gggataacgaactacagcaacgtct

SEQ ID NO: 854 - DNA, 25 bp, E. coli
gggataacgaacaacagcaacgtct

SEQ ID NO: 855 - DNA, 25 bp, E. coli
caacagcaacgtgttgaacaggcgc

SEQ ID NO: 856 - DNA, 25 bp, E. coli
caacagcaacgtcttgaacaggcgc

SEQ ID NO: 857 - DNA, 25 bp, E. coli
caaagtctgttcaggcggcattgtg

SEQ ID NO: 858 - DNA, 25 bp, E. coli
caaagtctgttctggcggcattgtg

SEQ ID NO: 859 - DNA, 25 bp, E. coli
cagcaacgtcttcaacaggcgctga

SEQ ID NO: 860 - DNA, 25 bp, E. coli
cagcaacgtcttgaacaggcgctga

SEQ ID NO: 861 - DNA, 25 bp, E. coli
acgccgcttgccgataacgatgatg

SEQ ID NO: 862 - DNA, 25 bp, E. coli
acgccgcttgcccataacgatgatg

SEQ ID NO: 863 - DNA, 25 bp, E. coli
aacagcaacgtcatgaacaggcgct

SEQ ID NO: 864 - DNA, 25 bp, E. coli
aacagcaacgtcttgaacaggcgct

SEQ ID NO: 865 - DNA, 25 bp, E. coli
gccgcttgccgaaaacgatgatgtc

SEQ ID NO: 866 - DNA, 25 bp, E. coli
gccgcttgccgataacgatgatgtc

SEQ ID NO: 867 - DNA, 25 bp, E. coli
gaacaacagcaaggtcttgaacagg

SEQ ID NO: 868 - DNA, 25 bp, E. coli
gaacaacagcaacgtcttgaacagg

SEQ ID NO: 869 - DNA, 25 bp, E. coli
gatcaaagtctgttctggcggcatt

SEQ ID NO: 870 - DNA, 25 bp, E. coli
gatcaaagtctgatctggcggcatt

SEQ ID NO: 871 - DNA, 25 bp, E. coli
gggatcaaagtcagttctggcggca

SEQ ID NO: 872 - DNA, 25 bp, E. coli
gggatcaaagtctgttctggcggca

SEQ ID NO: 873 - DNA, 25 bp, E. coli
ggcacgccgcttgccgataacgatg

SEQ ID NO: 874 - DNA, 25 bp, E. coli
ggcacgccgcttcccgataacgatg

SEQ ID NO: 875 - DNA, 25 bp, E. coli
taacgaacaacaccaacgtcttgaa

SEQ ID NO: 876 - DNA, 25 bp, E. coli
taacgaacaacagcaacgtcttgaa

SEQ ID NO: 877 - DNA, 25 bp, B. subtillis
agatccgaacactgcggtcgacatt

SEQ ID NO: 878 - DNA, 25 bp, B. subtillis
agatccgaacacagcggtcgacatt

SEQ ID NO: 879 - DNA, 25 bp, B. subtillis
aaatgcctcctgaccatgtgaaggt

SEQ ID NO: 880 - DNA, 25 bp, B. subtillis
aaatgcctcctgtccatgtgaaggt

SEQ ID NO: 881 - DNA, 25 bp, B. subtillis
aaatcaagcctgtcacattgccgac

SEQ ID NO: 882 - DNA, 25 bp, B. subtillis
aaatcaagcctgacacattgccgac

SEQ ID NO: 883 - DNA, 25 bp, B. subtillis
tatcagctgatcgcccgtgtagaag

SEQ ID NO: 884 - DNA, 25 bp, B. subtillis
tatcagctgatcccccgtgtagaag

SEQ ID NO: 885 - DNA, 25 bp, B. subtillis
tgaaatccttcacgcatatcagctg

SEQ ID NO: 886 - DNA, 25 bp, B. subtillis
tgaaatccttcaggcatatcagctg

SEQ ID NO: 887 - DNA, 25 bp, B. subtillis
tctgtcactgttgccggaagcacag

SEQ ID NO: 888 - DNA, 25 bp, B. subtillis
tctgtcactgttcccggaagcacag

SEQ ID NO: 889 - DNA, 25 bp, B. subtillis
tcagtcggaatgccgctcagcagat

SEQ ID NO: 890 - DNA, 25 bp, B. subtillis
tcagtcggaatggcgctcagcagat

SEQ ID NO: 891 - DNA, 25 bp, B. subtillis
gccccggctttgtttcagtcggaat

SEQ ID NO: 892 - DNA, 25 bp, B. subtillis
gccccggctttgattcagtcggaat

SEQ ID NO: 893 - DNA, 25 bp, B. subtillis
gaacgaagccgacatgctgttctct

SEQ ID NO: 894 - DNA, 25 bp, B. subtillis
gaacgaagccgagatgctgttctct

SEQ ID NO: 895 - DNA, 25 bp, B. subtillis
gttcttgcgcgtctatcgcaggagt

SEQ ID NO: 896 - DNA, 25 bp, B. subtillis
gataacctgatctaccaagtggcta

SEQ ID NO: 897 - DNA, 25 bp, B. subtillis
gttcttgcgcgtgtatcgcaggagt

SEQ ID NO: 898 - DNA, 25 bp, B. subtillis
gataacctgatcaaccaagtggcta

SEQ ID NO: 899 - DNA, 25 bp, B. subtillis
caggccttccgataatgcgcggctt

SEQ ID NO: 900 - DNA, 25 bp, B. subtillis
caggccttccgaaaatgcgcggctt

SEQ ID NO: 901 - DNA, 25 bp, B. subtillis
agcgcctgatgtattagcgatcccg

SEQ ID NO: 902 - DNA, 25 bp, B. subtillis
agcgcctgatgttttagcgatcccg

SEQ ID NO: 903 - DNA, 25 bp, B. subtillis
aaactgctgcctacgaagtgtgcga

SEQ ID NO: 904 - DNA, 25 bp, B. subtillis
aaactgctgccttcgaagtgtgcga

SEQ ID NO: 905 - DNA, 25 bp, B. subtillis
aactcgctcaaggtgtcatgtacgg

SEQ ID NO: 906 - DNA, 25 bp, B. subtillis
aactcgctcaagctgtcatgtacgg

SEQ ID NO: 907 - DNA, 25 bp, B. subtillis
gcatatgcagccggtgctaacatga

SEQ ID NO: 908 - DNA, 25 bp, B. subtillis
gcatatgcagcccgtgctaacatga

SEQ ID NO: 909 - DNA, 25 bp, B. subtillis
gacggaaactttgacgatgcgctta

SEQ ID NO: 910 - DNA, 25 bp, B. subtillis
gaaatgcattgtgatcatcccgaac

SEQ ID NO: 911 - DNA, 25 bp, B. subtillis
gaaatgcattgtcatcatcccgaac

SEQ ID NO: 912 - DNA, 25 bp, B. subtillis
gtcaacccttaccgcattgaaggcc

SEQ ID NO: 913 - DNA, 25 bp, B. subtillis
gtcaacaggtaacacttccgctgct

SEQ ID NO: 914 - DNA, 25 bp, B. subtillis
gtcaacaggtaagacttccgctgct

SEQ ID NO: 915 - DNA, 25 bp, B. subtillis
gtcaacccttacggcattgaaggcc

SEQ ID NO: 916 - DNA, 25 bp, B. subtillis
gtaacagatcaaacaccggcgctaa

SEQ ID NO: 917 - DNA, 25 bp, B. subtillis
gtaacagatcaatcaccggcgctaa

SEQ ID NO: 918 - DNA, 25 bp, B. subtillis
gatgcgcttaaaattgtccgttcca

SEQ ID NO: 919 - DNA, 25 bp, B. subtillis
gatgcgcttaaatttgtccgttcca

SEQ ID NO: 920 - DNA, 25 bp, B. subtillis
gacggaaactttcacgatgcgctta

SEQ ID NO: 921 - DNA, 25 bp, B. subtillis
acgcgagagacgtgcttccgaagga

SEQ ID NO: 922 - DNA, 25 bp, B. subtillis
atgcttgtgcctgagctgtcaaaag

SEQ ID NO: 923 - DNA, 25 bp, B. subtillis
acgcgagagacgagcttccgaagga

SEQ ID NO: 924 - DNA, 25 bp, B. subtillis
atgcttgtgcctcagctgtcaaaag

SEQ ID NO: 925 - DNA, 25 bp, B. subtillis
aaagaacagctcgcgcttcatttcc

SEQ ID NO: 926 - DNA, 25 bp, B. subtillis
aaagaacagctcccgcttcatttcc

SEQ ID NO: 927 - DNA, 25 bp, B. subtillis
tcctcattgctgggatcatgtccaa

SEQ ID NO: 928 - DNA, 25 bp, B. subtillis
tcctcattgctgcgatcatgtccaa

SEQ ID NO: 929 - DNA, 25 bp, B. subtillis
gaaggatatgttccatcagccgtac

SEQ ID NO: 930 - DNA, 25 bp, B. subtillis
gaaggatatgttgcatcagccgtac

SEQ ID NO: 931 - DNA, 25 bp, B. subtillis
gaagggcgcatatggaacggctctc

SEQ ID NO: 932 - DNA, 25 bp, B. subtillis
gaaggagtttccatatgccgatgcc

SEQ ID NO: 933 - DNA, 25 bp, B. subtillis
gaagggcgcataaggaacggctctc

SEQ ID NO: 934 - DNA, 25 bp, B. subtillis
gaaggagtttccttatgccgatgcc

SEQ ID NO: 935 - DNA, 25 bp, B. subtillis
gacgtagtcgttgtcattccttttt

SEQ ID NO: 936 - DNA, 25 bp, B. subtillis
gacgtagtcgttctcattccttttt

SEQ ID NO: 937 - DNA, 25 bp, B. subtillis
gtgatcggcctggatgaggatgacg

SEQ ID NO: 938 - DNA, 25 bp, B. subtillis
gtgatcggcctgcatgaggatgacg

SEQ ID NO: 939 - DNA, 25 bp, B. subtillis
ggattggccgcttgtcgggaaaatc

SEQ ID NO: 940 - DNA, 25 bp, B. subtillis
ggattggccgctagtcgggaaaatc

SEQ ID NO: 941 - DNA, 25 bp, B. subtillis
gacgagacccaattgatccgcgtcc

SEQ ID NO: 942 - DNA, 25 bp, B. subtillis
gacgagacccaaatgatccgcgtcc

SEQ ID NO: 943 - DNA, 25 bp, B. subtillis
aatcgtgggtgatatgacgttgccg

SEQ ID NO: 944 - DNA, 25 bp, B. subtillis
aatcgtgggtgaaatgacgttgccg

SEQ ID NO: 945 - DNA, 25 bp, B. subtillis
tacatttacacaactagcagtcagt

SEQ ID NO: 946 - DNA, 25 bp, B. subtillis
tacatttacacatctagcagtcagt

SEQ ID NO: 947 - DNA, 25 bp, B. subtillis
atttcttcatcgacattttccttcc

SEQ ID NO: 948 - DNA, 25 bp, B. subtillis
atatgaatacgcgaattctaccggg

SEQ ID NO: 949 - DNA, 25 bp, B. subtillis
atttcttcatcgtcattttccttcc

SEQ ID NO: 950 - DNA, 25 bp, B. subtillis
atatgaatacgccaattctaccggg

SEQ ID NO: 951 - DNA, 25 bp, B. subtillis
tcggttatttaggtccagcagctac

SEQ ID NO: 952 - DNA, 25 bp, B. subtillis
tcggttatttagctccagcagctac

SEQ ID NO: 953 - DNA, 25 bp, B. subtillis
gctcgacaaaatttactcacattca

SEQ ID NO: 954 - DNA, 25 bp, B. subtillis
gctcgacaaaatatactcacattca

SEQ ID NO: 955 - DNA, 25 bp, B. subtillis
gaacatgttgctaaccgcaccattc

SEQ ID NO: 956 - DNA, 25 bp, B. subtillis
gaacatgttgcttaccgcaccattc

SEQ ID NO: 957 - DNA, 25 bp, B. subtillis
ccgaacatgttgcttaccgcaccat

SEQ ID NO: 958 - DNA, 25 bp, B. subtillis
ccgaacatgttggttaccgcaccat

SEQ ID NO: 959 - DNA, 25 bp, B. subtillis
ctacatttacacatctagcagtcag

SEQ ID NO: 960 - DNA, 25 bp, B. subtillis
ctacatttacacttctagcagtcag

SEQ ID NO: 961 - DNA, 25 bp, B. subtillis
ggagtgtatagatgcagccgttgca

SEQ ID NO: 962 - DNA, 25 bp, B. subtillis
ggagtgtatagaagcagccgttgca

SEQ ID NO: 963 - DNA, 25 bp, B. subtillis
gttgcaggcgaacttgattttgctt

SEQ ID NO: 964 - DNA, 25 bp, B. subtillis
gttgcaggcgaagttgattttgctt

SEQ ID NO: 965 - DNA, 25 bp, B. subtillis
aggtcgatttaactagaagtgcgtt

SEQ ID NO: 966 - DNA, 25 bp, B. subtillis
aggtcgatttaagtagaagtgcgtt

SEQ ID NO: 967 - DNA, 25 bp, B. subtillis
tatcagtacgtccgcaatggaagaa

SEQ ID NO: 968 - DNA, 25 bp, B. subtillis
tatcagtacgtcggcaatggaagaa

SEQ ID NO: 969 - DNA, 25 bp, B. subtillis
tttggaggatagctcaggtgcgtta

SEQ ID NO: 970 - DNA, 25 bp, B. subtillis
tttggaggataggtcaggtgcgtta

SEQ ID NO: 971 - DNA, 25 bp, B. subtillis
ttttccattctacaccatggtaaaa

SEQ ID NO: 972 - DNA, 25 bp, B. subtillis
ttttccattctagaccatggtaaaa

SEQ ID NO: 973 - DNA, 25 bp, B. subtillis
tgacactgtctaacagtacgtcggc

SEQ ID NO: 974 - DNA, 25 bp, B. subtillis
tgacactgtctatcagtacgtcggc

SEQ ID NO: 975 - DNA, 25 bp, B. subtillis
gcagatgccgttcaaaaggtcgatt

SEQ ID NO: 976 - DNA, 25 bp, B. subtillis
gcagatgccgttgaaaaggtcgatt

SEQ ID NO: 977 - DNA, 25 bp, B. subtillis
ctggaagcaacgttctttccattca

SEQ ID NO: 978 - DNA, 25 bp, B. subtillis
ctggaagcaacgatctttccattca

SEQ ID NO: 979 - DNA, 25 bp, B. subtillis
gattcagtagcagatgccgttcaaa

SEQ ID NO: 980 - DNA, 25 bp, B. subtillis
gattcagtagcacatgccgttcaaa

SEQ ID NO: 981 - DNA, 25 bp, B. subtillis
gtagctgattctggaagcaacgttc

SEQ ID NO: 982 - DNA, 25 bp, B. subtillis
ggaggataggtctggtgcgttatct

SEQ ID NO: 983 - DNA, 25 bp, B. subtillis
gtgacactgtctatcagtacgtcgg

SEQ ID NO: 984 - DNA, 25 bp, B. subtillis
gtgacactgtctttcagtacgtcgg

SEQ ID NO: 985 - DNA, 25 bp, B. subtillis
ggaggataggtcaggtgcgttatct

SEQ ID NO: 986 - DNA, 25 bp, B. subtillis
gtagctgattctcgaagcaacgttc

SEQ ID NO: 987 - DNA, 25 bp, B. subtillis
atggtcatgctgccgcaggatgatc

SEQ ID NO: 988 - DNA, 25 bp, B. subtillis
atcggggtcattcccaatgatatgg

SEQ ID NO: 989 - DNA, 25 bp, B. subtillis
atggtcatgctggcgcaggatgatc

SEQ ID NO: 990 - DNA, 25 bp, B. subtillis
atcggggtcattgccaatgatatgg

SEQ ID NO: 991 - DNA, 25 bp, B. subtillis
tccggggcgctgcatagagtgctgt

SEQ ID NO: 992 - DNA, 25 bp, B. subtillis
tccggggcgctggatagagtgctgt

SEQ ID NO: 993 - DNA, 25 bp, B. subtillis
cctgtcaaaaatagagtcacgtccg

SEQ ID NO: 994 - DNA, 25 bp, B. subtillis
cctgtcaaaaattgagtcacgtccg

SEQ ID NO: 995 - DNA, 25 bp, B. subtillis
ctgtctcccgatgaaaacatatctt

SEQ ID NO: 996 - DNA, 25 bp, B. subtillis
ctgtctcccgatcaaaacatatctt

SEQ ID NO: 997 - DNA, 25 bp, B. subtillis
ctgtcaaaaattcagtcacgtccga

SEQ ID NO: 998 - DNA, 25 bp, B. subtillis
ctgtcaaaaattgagtcacgtccga

SEQ ID NO: 999 - DNA, 25 bp, B. subtillis
gtctgcattttcttggagaaattta

SEQ ID NO: 1000 - DNA, 25 bp, B. subtillis
gtctgcattttcatggagaaattta

SEQ ID NO: 1001 - DNA, 25 bp, B. subtillis
tcaaaaattgagtcacgtccgacta

SEQ ID NO: 1002 - DNA, 25 bp, B. subtillis
tcaaaaattgagacacgtccgacta

SEQ ID NO: 1003 - DNA, 25 bp, B. subtillis
gagtcacgtccgtctaaaaccggat

SEQ ID NO: 1004 - DNA, 25 bp, B. subtillis
gagctctaggcccaaaacgacctta

SEQ ID NO: 1005 - DNA, 25 bp, B. subtillis
gaccatcccgaggtgaatatcgggg

SEQ ID NO: 1006 - DNA, 25 bp, B. subtillis
gagtcacgtccgactaaaaccggat

SEQ ID NO: 1007 - DNA, 25 bp, B. subtillis
gaccatcccgagctgaatatcgggg

SEQ ID NO: 1008 - DNA, 25 bp, B. subtillis
gagctctaggccgaaaacgacctta

SEQ ID NO: 1009 - DNA, 25 bp, B. subtillis
tacgcatgactacattacaacgggc

SEQ ID NO: 1010 - DNA, 25 bp, B. subtillis
actgaacgggcctttgaacaagtat

SEQ ID NO: 1011 - DNA, 25 bp, B. subtillis
agtttggtttcgatcttcataacgg

SEQ ID NO: 1012 - DNA, 25 bp, B. subtillis
agtttggtttcgttcttcataacgg

SEQ ID NO: 1013 - DNA, 25 bp, B. subtillis
actgaacgggccattgaacaagtat

SEQ ID NO: 1014 - DNA, 25 bp, B. subtillis
tacgcatgactagattacaacgggc

SEQ ID NO: 1015 - DNA, 25 bp, B. subtillis
tttcgatcttcataacggacaaact

SEQ ID NO: 1016 - DNA, 25 bp, B. subtillis
tttcgatcttcaaaacggacaaact

SEQ ID NO: 1017 - DNA, 25 bp, B. subtillis
tgactacattactacgggccaggaa

SEQ ID NO: 1018 - DNA, 25 bp, B. subtillis
tgactacattacaacgggccaggaa

SEQ ID NO: 1019 - DNA, 25 bp, B. subtillis
tccattgccatatcggctcgcaaat

SEQ ID NO: 1020 - DNA, 25 bp, B. subtillis
tccattgccataacggctcgcaaat

SEQ ID NO: 1021 - DNA, 25 bp, B. subtillis
gcttcttgaagagctatgtaaagaa

SEQ ID NO: 1022 - DNA, 25 bp, B. subtillis
gcttcttgaagacctatgtaaagaa

SEQ ID NO: 1023 - DNA, 25 bp, B. subtillis
gaacgcatccactttcatggaaaca

SEQ ID NO: 1024 - DNA, 25 bp, B. subtillis
gactacattacatcgggccaggaag

SEQ ID NO: 1025 - DNA, 25 bp, B. subtillis
gaacgcatccacattcatggaaaca

SEQ ID NO: 1026 - DNA, 25 bp, B. subtillis
gactacattacaacgggccaggaag

SEQ ID NO: 1027 - DNA, 25 bp, B. subtillis
cttcggatcacgcccggagtagaag

SEQ ID NO: 1028 - DNA, 25 bp, B. subtillis
ctgaacgggccaatgaacaagtatt

SEQ ID NO: 1029 - DNA, 25 bp, B. subtillis
ctgaacgggccattgaacaagtatt

SEQ ID NO: 1030 - DNA, 25 bp, B. subtillis
cttcggatcacggccggagtagaag

SEQ ID NO: 1031 - DNA, 25 bp, B. subtillis
cacctctttacgaatatgatgtggc

SEQ ID NO: 1032 - DNA, 25 bp, B. subtillis
cacctctttacgtatatgatgtggc

SEQ ID NO: 1033 - DNA, 25 bp, B. subtillis
tacacctctttaggtatatgatgtg

SEQ ID NO: 1034 - DNA, 25 bp, B. subtillis
tacacctctttacgtatatgatgtg

SEQ ID NO: 1035 - DNA, 25 bp, B. subtillis
agcggagaaatatggtacacctctt

SEQ ID NO: 1036 - DNA, 25 bp, B. subtillis
agcggagaaataaggtacacctctt

SEQ ID NO: 1037 - DNA, 25 bp, B. subtillis
atcagtcgcaatcattcagctcgct

SEQ ID NO: 1038 - DNA, 25 bp, B. subtillis
atcagtcgcaatgattcagctcgct

SEQ ID NO: 1039 - DNA, 25 bp, B. subtillis
tagaaatcggaggtgtggatgctct

SEQ ID NO: 1040 - DNA, 25 bp, B. subtillis
tagaaatcggagctgtggatgctct

SEQ ID NO: 1041 - DNA, 25 bp, B. subtillis
gcaggcgtttatatctgcagggctg

SEQ ID NO: 1042 - DNA, 25 bp, B. subtillis
gcaggcgtttatttctgcagggctg

SEQ ID NO: 1043 - DNA, 25 bp, B. subtillis
ggagaaatatggtacacctctttac

SEQ ID NO: 1044 - DNA, 25 bp, B. subtillis
ggatgctctctatttagcggagaaa

SEQ ID NO: 1045 - DNA, 25 bp, B. subtillis
ggatgctctctaattagcggagaaa

SEQ ID NO: 1046 - DNA, 25 bp, B. subtillis
ggagaaatatggaacacctctttac

SEQ ID NO: 1047 - DNA, 25 bp, B. subtillis
ggctttaatacgtgagcgtgctaaa

SEQ ID NO: 1048 - DNA, 25 bp, B. subtillis
ggactttctttagatgtcgtatccg

SEQ ID NO: 1049 - DNA, 25 bp, B. subtillis
ggctttaatacgagagcgtgctaaa

SEQ ID NO: 1050 - DNA, 25 bp, B. subtillis
ggactttctttacatgtcgtatccg

SEQ ID NO: 1051 - DNA, 25 bp, B. subtillis
gagagctatatacggctgttgcagc

SEQ ID NO: 1052 - DNA, 25 bp, B. subtillis
gagagctatatagggctgttgcagc

SEQ ID NO: 1053 - DNA, 25 bp, B. subtillis
atacggccggttatgtgttagcagc

SEQ ID NO: 1054 - DNA, 25 bp, B. subtillis
atacggccggttttgtgttagcagc

SEQ ID NO: 1055 - DNA, 25 bp, B. subtillis
atgccactgaattcgttgaaaaaat

SEQ ID NO: 1056 - DNA, 25 bp, B. subtillis
atgccactgaatacgttgaaaaaat

SEQ ID NO: 1057 - DNA, 25 bp, B. subtillis
gaaccgggccgttctctcgtgggag

SEQ ID NO: 1058 - DNA, 25 bp, B. subtillis
gaaccgggccgtactctcgtgggag

SEQ ID NO: 1059 - DNA, 25 bp, B. subtillis
tattcatttgtaaccaaggtgctga

SEQ ID NO: 1060 - DNA, 25 bp, B. subtillis
tattcatttgtatccaaggtgctga

SEQ ID NO: 1061 - DNA, 25 bp, B. subtillis
ttcatttgtatccaaggtgctgaat

SEQ ID NO: 1062 - DNA, 25 bp, B. subtillis
ttgtatccaaggtgctgaatcttgg

SEQ ID NO: 1063 - DNA, 25 bp, B. subtillis
ttcatttgtatcgaaggtgctgaat

SEQ ID NO: 1064 - DNA, 25 bp, B. subtillis
ttgtatccaaggagctgaatcttgg

SEQ ID NO: 1065 - DNA, 25 bp, B. subtillis
tcatgccactgattacgttgaaaaa

SEQ ID NO: 1066 - DNA, 25 bp, B. subtillis
tcatgccactgaatacgttgaaaaa

SEQ ID NO: 1067 - DNA, 25 bp, B. subtillis
gttttgtgttaggagcggaaaaaat

SEQ ID NO: 1068 - DNA, 25 bp, B. subtillis
gttttgtgttagcagcggaaaaaat

SEQ ID NO: 1069 - DNA, 25 bp, B. subtillis
cgggccgttctcacgtgggagacgc

SEQ ID NO: 1070 - DNA, 25 bp, B. subtillis
cgggccgttctctcgtgggagacgc

SEQ ID NO: 1071 - DNA, 25 bp, B. subtillis
gtgctgaatcttggaggaggtttcg

SEQ ID NO: 1072 - DNA, 25 bp, B. subtillis
gtgctgaatcttcgaggaggtttcg

SEQ ID NO: 1073 - DNA, 25 bp, B. subtillis
ggccggttttgtcttagcagcggaa

SEQ ID NO: 1074 - DNA, 25 bp, B. subtillis
ggccggttttgtgttagcagcggaa

SEQ ID NO: 1075 - DNA, 25 bp, B. subtillis
atgaaggtgtttacgaattccgtga

SEQ ID NO: 1076 - DNA, 25 bp, B. subtillis
atgaaggtgttttcgaattccgtga

SEQ ID NO: 1077 - DNA, 25 bp, B. subtillis
aaagaatcatgaactatacgcaacc

SEQ ID NO: 1078 - DNA, 25 bp, B. subtillis
aaagaatcatgatctatacgcaacc

SEQ ID NO: 1079 - DNA, 25 bp, B. subtillis
tgaagattgatctgcttgtgtatgg

SEQ ID NO: 1080 - DNA, 25 bp, B. subtillis
tgaaccggatgtctcggcattaatc

SEQ ID NO: 1081 - DNA, 25 bp, B. subtillis
tgaaccggatgtgtcggcattaatc

SEQ ID NO: 1082 - DNA, 25 bp, B. subtillis
tgaagattgatcagcttgtgtatgg

SEQ ID NO: 1083 - DNA, 25 bp, B. subtillis
ccgtttatgtgaagtgtattccatt

SEQ ID NO: 1084 - DNA, 25 bp, B. subtillis
ccgtttatgtgatgtgtattccatt

SEQ ID NO: 1085 - DNA, 25 bp, B. subtillis
gcggaaattcttctgcgcacacttg

SEQ ID NO: 1086 - DNA, 25 bp, B. subtillis
gcggaaattcttgtgcgcacacttg

SEQ ID NO: 1087 - DNA, 25 bp, B. subtillis
gaaaattgctttcatcgcgcatgac

SEQ ID NO: 1088 - DNA, 25 bp, B. subtillis
gaaaattgctttgatcgcgcatgac

SEQ ID NO: 1089 - DNA, 25 bp, B. subtillis
ccgaatgtataaagctgacgttctt

SEQ ID NO: 1090 - DNA, 25 bp, B. subtillis
ccgaatgtataatgctgacgttctt

SEQ ID NO: 1091 - DNA, 25 bp, B. subtillis
ctgcggaaattcatgtgcgcacact

SEQ ID NO: 1092 - DNA, 25 bp, B. subtillis
cccacagtgatgatgtcgagatcgg

SEQ ID NO: 1093 - DNA, 25 bp, B. subtillis
cccacagtgatgttgtcgagatcgg

SEQ ID NO: 1094 - DNA, 25 bp, B. subtillis
ctgcggaaattcttgtgcgcacact

SEQ ID NO: 1095 - DNA, 25 bp, B. subtillis
gtcatttttttgcgcgacccgctga

SEQ ID NO: 1096 - DNA, 25 bp, B. subtillis
gtcatttttttgggcgacccgctga

SEQ ID NO: 1097 - DNA, 25 bp, B. subtillis
acaccacattttgaccttgtagggg

SEQ ID NO: 1098 - DNA, 25 bp, B. subtillis
attatctgatgtgatgcctgttgag

SEQ ID NO: 1099 - DNA, 25 bp, B. subtillis
attatctgatgtcatgcctgttgag

SEQ ID NO: 1100 - DNA, 25 bp, B. subtillis
acaccacattttcaccttgtagggg

SEQ ID NO: 1101 - DNA, 25 bp, B. subtillis
acaaccggatgtcttgattgattta

SEQ ID NO: 1102 - DNA, 25 bp, B. subtillis
acaaccggtttctcagaagctgatt

SEQ ID NO: 1103 - DNA, 25 bp, B. subtillis
acaaccggtttcacagaagctgatt

SEQ ID NO: 1104 - DNA, 25 bp, B. subtillis
acaaccggatgtgttgattgattta

SEQ ID NO: 1105 - DNA, 25 bp, B. subtillis
tcttgattgattaaacaacgcccga

SEQ ID NO: 1106 - DNA, 25 bp, B. subtillis
ttagagcacggactccgtccagttg

SEQ ID NO: 1107 - DNA, 25 bp, B. subtillis
ttagagcacggagtccgtccagttg

SEQ ID NO: 1108 - DNA, 25 bp, B. subtillis
tcatcatgaccacaagcttgacgca

SEQ ID NO: 1109 - DNA, 25 bp, B. subtillis
tcatcatgaccagaagcttgacgca

SEQ ID NO: 1110 - DNA, 25 bp, B. subtillis
tcttgattgatttaacaacgcccga

SEQ ID NO: 1111 - DNA, 25 bp, B. subtillis
ccaaattttgcggtcggtgcgatac

SEQ ID NO: 1112 - DNA, 25 bp, B. subtillis
ccaaattttgcgctcggtgcgatac

SEQ ID NO: 1113 - DNA, 25 bp, B. subtillis
gaaaaagggatccgagccatcatcg

SEQ ID NO: 1114 - DNA, 25 bp, B. subtillis
gaaaaagggatcggagccatcatcg

SEQ ID NO: 1115 - DNA, 25 bp, B. subtillis
ctcggtgcgatagtgatgatgaaat

SEQ ID NO: 1116 - DNA, 25 bp, B. subtillis
ctcggtgcgatactgatgatgaaat

SEQ ID NO: 1117 - DNA, 25 bp, B. subtillis
ggccatagaccatacatacgatcag

SEQ ID NO: 1118 - DNA, 25 bp, B. subtillis
ggccatagaccaaacatacgatcag

SEQ ID NO: 1119 - DNA, 25 bp, B. subtillis
caattcggtcaaatgtcactgtcat

SEQ ID NO: 1120 - DNA, 25 bp, B. subtillis
caattcggtcaattgtcactgtcat

SEQ ID NO: 1121 - DNA, 25 bp, B. subtillis
tatcccgtcaaacgattccgtttct

SEQ ID NO: 1122 - DNA, 25 bp, B. subtillis
tatcccgtcaaaggattccgtttct

SEQ ID NO: 1123 - DNA, 25 bp, B. subtillis
gtacggtcagttagcgtaaagaaga

SEQ ID NO: 1124 - DNA, 25 bp, B. subtillis
atctcggatacaatagaggcaaaga

SEQ ID NO: 1125 - DNA, 25 bp, B. subtillis
atctcggatacattagaggcaaaga

SEQ ID NO: 1126 - DNA, 25 bp, B. subtillis
gtacggtcagtttgcgtaaagaaga

SEQ ID NO: 1127 - DNA, 25 bp, B. subtillis
aagaattcagctaacgcttccagac

SEQ ID NO: 1128 - DNA, 25 bp, B. subtillis
aagaattcagcttacgcttccagac

SEQ ID NO: 1129 - DNA, 25 bp, B. subtillis
ttcatcagccggtttttgttattga

SEQ ID NO: 1130 - DNA, 25 bp, B. subtillis
ttcatcagccggattttgttattga

SEQ ID NO: 1131 - DNA, 25 bp, B. subtillis
ttccggcgcataaagtcagcaaggt

SEQ ID NO: 1132 - DNA, 25 bp, B. subtillis
ttccggcgcatatagtcagcaaggt

SEQ ID NO: 1133 - DNA, 25 bp, B. subtillis
tcatcagccggattttgttattgat

SEQ ID NO: 1134 - DNA, 25 bp, B. subtillis
tcatcagccggaatttgttattgat

SEQ ID NO: 1135 - DNA, 25 bp, B. subtillis
gctgaagcagcccgcatattaggcg

SEQ ID NO: 1136 - DNA, 25 bp, B. subtillis
gctgaagcagccggcatattaggcg

SEQ ID NO: 1137 - DNA, 25 bp, B. subtillis
gaagcgatctttaccgccggaatcc

SEQ ID NO: 1138 - DNA, 25 bp, B. subtillis
gaagcgatcttttccgccggaatcc

SEQ ID NO: 1139 - DNA, 25 bp, B. subtillis
gatttgacagaaccggaactctctt

SEQ ID NO: 1140 - DNA, 25 bp, B. subtillis
gatttgacagaagcggaactctctt

SEQ ID NO: 1141 - DNA, 25 bp, B. subtillis
aatttactcacaatcacacgcgatt

SEQ ID NO: 1142 - DNA, 25 bp, B. subtillis
cacttgctcgtcgatccctcaagag

SEQ ID NO: 1143 - DNA, 25 bp, B. subtillis
cacttgctcgtccatccctcaagag

SEQ ID NO: 1144 - DNA, 25 bp, B. subtillis
aatttactcacattcacacgcgatt

SEQ ID NO: 1145 - DNA, 25 bp, B. subtillis
catgaacagcctttgccaatcgtgg

SEQ ID NO: 1146 - DNA, 25 bp, B. subtillis
catgaacagcctatgccaatcgtgg

SEQ ID NO: 1147 - DNA, 25 bp, B. subtillis
tacacatctagctgtcagttcttgt

SEQ ID NO: 1148 - DNA, 25 bp, B. subtillis
tacacatctagcagtcagttcttgt

SEQ ID NO: 1149 - DNA, 25 bp, B. subtillis
aggtccagcagctacatttacacat

SEQ ID NO: 1150 - DNA, 25 bp, B. subtillis
aggtccagcagcaacatttacacat

SEQ ID NO: 1151 - DNA, 25 bp, B. subtillis
attgcgcaatgcgataaatttcttc

SEQ ID NO: 1152 - DNA, 25 bp, B. subtillis
attgcgcaatgccataaatttcttc

SEQ ID NO: 1153 - DNA, 25 bp, B. subtillis
acacgcgattgcccaatgccataaa

SEQ ID NO: 1154 - DNA, 25 bp, B. subtillis
acacgcgattgcgcaatgccataaa

SEQ ID NO: 1155 - DNA, 25 bp, B. subtillis
ttatttaggtccagcagctacattt

SEQ ID NO: 1156 - DNA, 25 bp, B. subtillis
ttatttaggtcctgcagctacattt

SEQ ID NO: 1157 - DNA, 25 bp, B. subtillis
gctacatttacagatctagcagtca

SEQ ID NO: 1158 - DNA, 25 bp, B. subtillis
gctacatttacacatctagcagtca

SEQ ID NO: 1159 - DNA, 25 bp, B. subtillis
gaaatattaggttcaggtgcataag

SEQ ID NO: 1160 - DNA, 25 bp, B. subtillis
gaaatattaggtacaggtgcataag

SEQ ID NO: 1161 - DNA, 25 bp, B. subtillis
ccgcaccattccggagtgtatagat

SEQ ID NO: 1162 - DNA, 25 bp, B. subtillis
cgaacatgttgcataccgcaccatt

SEQ ID NO: 1163 - DNA, 25 bp, B. subtillis
ccgcaccattcccgagtgtatagat

SEQ ID NO: 1164 - DNA, 25 bp, B. subtillis
cgaacatgttgcttaccgcaccatt

SEQ ID NO: 1165 - DNA, 25 bp, B. subtillis
ctatttaatacaagaacagcctttg

SEQ ID NO: 1166 - DNA, 25 bp, B. subtillis
ctatttaatacatgaacagcctttg

SEQ ID NO: 1167 - DNA, 25 bp, B. subtillis
gtgtatagatgcagccgttgcaggc

SEQ ID NO: 1168 - DNA, 25 bp, B. subtillis
gtgtatagatgctgccgttgcaggc

SEQ ID NO: 1169 - DNA, 25 bp, B. subtillis
gggtgaaatgaccttgccgattcac

SEQ ID NO: 1170 - DNA, 25 bp, B. subtillis
gggtgaaatgacgttgccgattcac

SEQ ID NO: 1171 - DNA, 25 bp, B. subtillis
tcacattcacacgcgattgcgcaat

SEQ ID NO: 1172 - DNA, 25 bp, B. subtillis
tcacattcacacccgattgcgcaat

SEQ ID NO: 1173 - DNA, 25 bp, B. subtillis
tcaaaacggcgcggaacatgttgct

SEQ ID NO: 1174 - DNA, 25 bp, B. subtillis
tcaaaacggcgccgaacatgttgct

SEQ ID NO: 1175 - DNA, 25 bp, B. subtillis
gagctcgacaaattttactcacatt

SEQ ID NO: 1176 - DNA, 25 bp, B. subtillis
gagctcgacaaaatttactcacatt

SEQ ID NO: 1177 - DNA, 25 bp, B. subtillis
gacgttgccgattcaccagcacttg

SEQ ID NO: 1178 - DNA, 25 bp, B. subtillis
gatgcagccgttgcaggcgaagttg

SEQ ID NO: 1179 - DNA, 25 bp, B. subtillis
gatgcagccgttccaggcgaagttg

SEQ ID NO: 1180 - DNA, 25 bp, B. subtillis
gacgttgccgatacaccagcacttg

SEQ ID NO: 1181 - DNA, 25 bp, B. subtillis
aagatgtattgcccgatgcaatgag

SEQ ID NO: 1182 - DNA, 25 bp, B. subtillis
aagatgtattgcgcgatgcaatgag

SEQ ID NO: 1183 - DNA, 25 bp, B. subtillis
cactgtctatcagtacgtcggcaat

SEQ ID NO: 1184 - DNA, 25 bp, B. subtillis
cactgtctatcactacgtcggcaat

SEQ ID NO: 1185 - DNA, 25 bp, B. subtillis
cagtagcagatgccgttcaaaaggt

SEQ ID NO: 1186 - DNA, 25 bp, B. subtillis
ctcagcttcttctggcggtagctga

SEQ ID NO: 1187 - DNA, 25 bp, B. subtillis
ctgattctggaaccaacgttctttc

SEQ ID NO: 1188 - DNA, 25 bp, B. subtillis
ctcagcttcttcaggcggtagctga

SEQ ID NO: 1189 - DNA, 25 bp, B. subtillis
ctgattctggaagcaacgttctttc

SEQ ID NO: 1190 - DNA, 25 bp, B. subtillis
cagtagcagatggcgttcaaaaggt

SEQ ID NO: 1191 - DNA, 25 bp, B. subtillis
tacagggatgctctttttccattct

SEQ ID NO: 1192 - DNA, 25 bp, B. subtillis
tacagggatgctgtttttccattct

SEQ ID NO: 1193 - DNA, 25 bp, B. subtillis
atcttgtccgtgaagatgtattgcc

SEQ ID NO: 1194 - DNA, 25 bp, B. subtillis
atcttgtccgtgtagatgtattgcc

SEQ ID NO: 1195 - DNA, 25 bp, B. subtillis
accagaccattccgcttcaaggcag

SEQ ID NO: 1196 - DNA, 25 bp, B. subtillis
agcagattcagttgcagatgccgtt

SEQ ID NO: 1197 - DNA, 25 bp, B. subtillis
agcagattcagtagcagatgccgtt

SEQ ID NO: 1198 - DNA, 25 bp, B. subtillis
accagaccattcggcttcaaggcag

SEQ ID NO: 1199 - DNA, 25 bp, B. subtillis
taggtcaggtgcgttatctcagctt

SEQ ID NO: 1200 - DNA, 25 bp, B. subtillis
taggtcaggtgccttatctcagctt

SEQ ID NO: 1201 - DNA, 25 bp, B. subtillis
tctttccattcaccagaccattccg

SEQ ID NO: 1202 - DNA, 25 bp, B. subtillis
tcttcaggcggtagctgattctgga

SEQ ID NO: 1203 - DNA, 25 bp, B. subtillis
tcttcaggcggttgctgattctgga

SEQ ID NO: 1204 - DNA, 25 bp, B. subtillis
tctttccattcagcagaccattccg

SEQ ID NO: 1205 - DNA, 25 bp, B. subtillis
gcgttatctcagcttcttcaggcgg

SEQ ID NO: 1206 - DNA, 25 bp, B. subtillis
gcgttatctcaggttcttcaggcgg

SEQ ID NO: 1207 - DNA, 25 bp, B. subtillis
gcaaatgtgacactgtctatcagta

SEQ ID NO: 1208 - DNA, 25 bp, B. subtillis
gcaaatgtgacagtgtctatcagta

SEQ ID NO: 1209 - DNA, 25 bp, B. subtillis
gacattttatcttgtccgtgaagat

SEQ ID NO: 1210 - DNA, 25 bp, B. subtillis
gacattttatctagtccgtgaagat

SEQ ID NO: 1211 - DNA, 25 bp, B. subtillis
cgcttcaaggcacagcaaatgtgac

SEQ ID NO: 1212 - DNA, 25 bp, B. subtillis
ccattccgcttctaggcagagcaaa

SEQ ID NO: 1213 - DNA, 25 bp, B. subtillis
cgcttcaaggcagagcaaatgtgac

SEQ ID NO: 1214 - DNA, 25 bp, B. subtillis
ccattccgcttcaaggcagagcaaa

SEQ ID NO: 1215 - DNA, 25 bp, B. subtillis
gtattgcccgatccaatgagaaaaa

SEQ ID NO: 1216 - DNA, 25 bp, B. subtillis
gtattgcccgatgcaatgagaaaaa

SEQ ID NO: 1217 - DNA, 25 bp, B. subtillis
ggaggataggtctggtgcgttatct

SEQ ID NO: 1218 - DNA, 25 bp, B. subtillis
ggaggataggtcaggtgcgttatct

SEQ ID NO: 1219 - DNA, 25 bp, B. subtillis
ggcggtagctgaatctggaagcaac

SEQ ID NO: 1220 - DNA, 25 bp, B. subtillis
ggcggtagctgattctggaagcaac

SEQ ID NO: 1221 - DNA, 25 bp, B. subtillis
aagtttgtcagtgaccatcccgagc

SEQ ID NO: 1222 - DNA, 25 bp, B. subtillis
aagtttgtcagtcaccatcccgagc

SEQ ID NO: 1223 - DNA, 25 bp, B. subtillis
catgctgccgcacgatgatcagtcc

SEQ ID NO: 1224 - DNA, 25 bp, B. subtillis
catgctgccgcaggatgatcagtcc

SEQ ID NO: 1225 - DNA, 25 bp, B. subtillis
aggggccatgcaggagcttgaagca

SEQ ID NO: 1226 - DNA, 25 bp, B. subtillis
aggggccatgcacgagcttgaagca

SEQ ID NO: 1227 - DNA, 25 bp, B. subtillis
agtgaggcttctgggtgcataccag

SEQ ID NO: 1228 - DNA, 25 bp, B. subtillis
atggcagcttcttcatacgaattaa

SEQ ID NO: 1229 - DNA, 25 bp, B. subtillis
atggcagcttctacatacgaattaa

SEQ ID NO: 1230 - DNA, 25 bp, B. subtillis
agtgaggcttctcggtgcataccag

SEQ ID NO: 1231 - DNA, 25 bp, B. subtillis
tatcggggtcattgccaatgatatg

SEQ ID NO: 1232 - DNA, 25 bp, B. subtillis
tatcggggtcatagccaatgatatg

SEQ ID NO: 1233 - DNA, 25 bp, B. subtillis
ttaatggtcatgctgccgcaggatg

SEQ ID NO: 1234 - DNA, 25 bp, B. subtillis
ttaatggtcatggtgccgcaggatg

SEQ ID NO: 1235 - DNA, 25 bp, B. subtillis
tgatgatgtattcattccaggggcc

SEQ ID NO: 1236 - DNA, 25 bp, B. subtillis
tgatgatgtattgattccaggggcc

SEQ ID NO: 1237 - DNA, 25 bp, B. subtillis
gccaatgatatggcagcttctacat

SEQ ID NO: 1238 - DNA, 25 bp, B. subtillis
gccaatgatatgccagcttctacat

SEQ ID NO: 1239 - DNA, 25 bp, B. subtillis
gaattcaaaattcagctctaggccc

SEQ ID NO: 1240 - DNA, 25 bp, B. subtillis
gaattcaaaattgagctctaggccc

SEQ ID NO: 1241 - DNA, 25 bp, B. subtillis
gagctgaatatcggggtcattgcca

SEQ ID NO: 1242 - DNA, 25 bp, B. subtillis
gagctgaatatccgggtcattgcca

SEQ ID NO: 1243 - DNA, 25 bp, B. subtillis
ccatcccgagctcaatatcggggtc

SEQ ID NO: 1244 - DNA, 25 bp, B. subtillis
ccatcccgagctgaatatcggggtc

SEQ ID NO: 1245 - DNA, 25 bp, B. subtillis
ctgcatagagtggtgtctgcatttt

SEQ ID NO: 1246 - DNA, 25 bp, B. subtillis
cttctgggtgcaaaccagtcttacc

SEQ ID NO: 1247 - DNA, 25 bp, B. subtillis
ctgtctcccgatcaaaacatatctt

SEQ ID NO: 1248 - DNA, 25 bp, B. subtillis
ctgtctcccgatgaaaacatatctt

SEQ ID NO: 1249 - DNA, 25 bp, B. subtillis
ctgcatagagtgctgtctgcatttt

SEQ ID NO: 1250 - DNA, 25 bp, B. subtillis
cggggcgctgcatagagtgctgtct

SEQ ID NO: 1251 - DNA, 25 bp, B. subtillis
cggggcgctgcaaagagtgctgtct

SEQ ID NO: 1252 - DNA, 25 bp, B. subtillis
cttctgggtgcataccagtcttacc

SEQ ID NO: 1253 - DNA, 25 bp, B. subtillis
gtattgattccaggggccatgcagg

SEQ ID NO: 1254 - DNA, 25 bp, B. subtillis
gtcagtgaccatgccgagctgaata

SEQ ID NO: 1255 - DNA, 25 bp, B. subtillis
ggatgatcagtcgggggcgctgcat

SEQ ID NO: 1256 - DNA, 25 bp, B. subtillis
gtgctgtctgcattttcttggagaa

SEQ ID NO: 1257 - DNA, 25 bp, B. subtillis
gtattgattccacgggccatgcagg

SEQ ID NO: 1258 - DNA, 25 bp, B. subtillis
ggatgatcagtccggggcgctgcat

SEQ ID NO: 1259 - DNA, 25 bp, B. subtillis
gtgctgtctgcaatttcttggagaa

SEQ ID NO: 1260 - DNA, 25 bp, B. subtillis
gtcagtgaccatcccgagctgaata

SEQ ID NO: 1261 - DNA, 25 bp, B. subtillis
aatcggaacacaatcagctgctggg

SEQ ID NO: 1262 - DNA, 25 bp, B. subtillis
aatcgcgcttcttgaagacctatgt

SEQ ID NO: 1263 - DNA, 25 bp, B. subtillis
aatcggaacacattcagctgctggg

SEQ ID NO: 1264 - DNA, 25 bp, B. subtillis
aatcgcgcttctagaagacctatgt

SEQ ID NO: 1265 - DNA, 25 bp, B. subtillis
atacgcatgactacattacaacggg

SEQ ID NO: 1266 - DNA, 25 bp, B. subtillis
attacaatcggatcacattcagctg

SEQ ID NO: 1267 - DNA, 25 bp, B. subtillis
agcgcatacgcatgactacattaca

SEQ ID NO: 1268 - DNA, 25 bp, B. subtillis
atacgcatgacttcattacaacggg

SEQ ID NO: 1269 - DNA, 25 bp, B. subtillis
atttctatgaaaacgcgcttcttga

SEQ ID NO: 1270 - DNA, 25 bp, B. subtillis
agctgctgggtgaccattgccatat

SEQ ID NO: 1271 - DNA, 25 bp, B. subtillis
attacaatcggaacacattcagctg

SEQ ID NO: 1272 - DNA, 25 bp, B. subtillis
atttctatgaaatcgcgcttcttga

SEQ ID NO: 1273 - DNA, 25 bp, B. subtillis
agctgctgggtgtccattgccatat

SEQ ID NO: 1274 - DNA, 25 bp, B. subtillis
agcgcatacgcaagactacattaca

SEQ ID NO: 1275 - DNA, 25 bp, B. subtillis
aacacattcagcagctgggtgtcca

SEQ ID NO: 1276 - DNA, 25 bp, B. subtillis
aacacattcagctgctgggtgtcca

SEQ ID NO: 1277 - DNA, 25 bp, B. subtillis
tagaagcgcatacgcatgactacat

SEQ ID NO: 1278 - DNA, 25 bp, B. subtillis
tagaagcgcataggcatgactacat

SEQ ID NO: 1279 - DNA, 25 bp, B. subtillis
ttcggatcacgcccggagtagaagc

SEQ ID NO: 1280 - DNA, 25 bp, B. subtillis
ttcggatcacgcgcggagtagaagc

SEQ ID NO: 1281 - DNA, 25 bp, B. subtillis
tcgatcttcatatcggacaaactga

SEQ ID NO: 1282 - DNA, 25 bp, B. subtillis
tcgatcttcataacggacaaactga

SEQ ID NO: 1283 - DNA, 25 bp, B. subtillis
gcatcggctgcaatgtggtggataa

SEQ ID NO: 1284 - DNA, 25 bp, B. subtillis
gcatcggctgcattgtggtggataa

SEQ ID NO: 1285 - DNA, 25 bp, B. subtillis
gcaccgcatcggctgcattgtggtg

SEQ ID NO: 1286 - DNA, 25 bp, B. subtillis
gcaccgcatcgggtgcattgtggtg

SEQ ID NO: 1287 - DNA, 25 bp, B. subtillis
cgcttgagcaccccatcggctgcat

SEQ ID NO: 1288 - DNA, 25 bp, B. subtillis
cgcttgagcaccgcatcggctgcat

SEQ ID NO: 1289 - DNA, 25 bp, B. subtillis
ctatgaaatcgcccttcttgaagac

SEQ ID NO: 1290 - DNA, 25 bp, B. subtillis
cattcagctgctcggtgtccattgc

SEQ ID NO: 1291 - DNA, 25 bp, B. subtillis
cattcagctgctgggtgtccattgc

SEQ ID NO: 1292 - DNA, 25 bp, B. subtillis
ctatgaaatcgcgcttcttgaagac

SEQ ID NO: 1293 - DNA, 25 bp, B. subtillis
gtcactccatcgttgttcttcttcg

SEQ ID NO: 1294 - DNA, 25 bp, B. subtillis
gtcactccatcgatgttcttcttcg

SEQ ID NO: 1295 - DNA, 25 bp, B. subtillis
ggataatttctatgaaatcgcgctt

SEQ ID NO: 1296 - DNA, 25 bp, B. subtillis
ggataatttctaagaaatcgcgctt

SEQ ID NO: 1297 - DNA, 25 bp, B. subtillis
gatggcgcttgagcaccgcatcggc

SEQ ID NO: 1298 - DNA, 25 bp, B. subtillis
gatcacgcccggtgtagaagcgcat

SEQ ID NO: 1299 - DNA, 25 bp, B. subtillis
gatcacgcccggagtagaagcgcat

SEQ ID NO: 1300 - DNA, 25 bp, B. subtillis
gatggcgcttgaccaccgcatcggc

SEQ ID NO: 1301 - DNA, 25 bp, B. subtillis
cacctctttacgtatatgatgtggc

SEQ ID NO: 1302 - DNA, 25 bp, B. subtillis
cacctctttacgaatatgatgtggc

SEQ ID NO: 1303 - DNA, 25 bp, B. subtillis
catcagtcgcaaagattcagctcgc

SEQ ID NO: 1304 - DNA, 25 bp, B. subtillis
catcagtcgcaatgattcagctcgc

SEQ ID NO: 1305 - DNA, 25 bp, B. subtillis
atgtcgtatccggaggagagctata

SEQ ID NO: 1306 - DNA, 25 bp, B. subtillis
atgcgagcaaaggattctcatcagt

SEQ ID NO: 1307 - DNA, 25 bp, B. subtillis
atgtcgtatccgcaggagagctata

SEQ ID NO: 1308 - DNA, 25 bp, B. subtillis
atgcgagcaaagcattctcatcagt

SEQ ID NO: 1309 - DNA, 25 bp, B. subtillis
aggtgtggatgctctctatttagcg

SEQ ID NO: 1310 - DNA, 25 bp, B. subtillis
aggtgtggatgcactctatttagcg

SEQ ID NO: 1311 - DNA, 25 bp, B. subtillis
tttaagcaggcgattatttctgcag

SEQ ID NO: 1312 - DNA, 25 bp, B. subtillis
tttaagcaggcgtttatttctgcag

SEQ ID NO: 1313 - DNA, 25 bp, B. subtillis
tagaaatcggaggtgtggatgctct

SEQ ID NO: 1314 - DNA, 25 bp, B. subtillis
tagaaatcggagctgtggatgctct

SEQ ID NO: 1315 - DNA, 25 bp, B. subtillis
tttatttctgcacggctgaaagcac

SEQ ID NO: 1316 - DNA, 25 bp, B. subtillis
tttatttctgcagggctgaaagcac

SEQ ID NO: 1317 - DNA, 25 bp, B. subtillis
tcgcaatgattctgctcgctgagga

SEQ ID NO: 1318 - DNA, 25 bp, B. subtillis
tcgcaatgattcagctcgctgagga

SEQ ID NO: 1319 - DNA, 25 bp, B. subtillis
tctttagatgtcctatccggaggag

SEQ ID NO: 1320 - DNA, 25 bp, B. subtillis
tctttagatgtcgtatccggaggag

SEQ ID NO: 1321 - DNA, 25 bp, B. subtillis
gcaaagcattctgatcagtcgcaat

SEQ ID NO: 1322 - DNA, 25 bp, B. subtillis
gcagacaaaatcaacatggtcattt

SEQ ID NO: 1323 - DNA, 25 bp, B. subtillis
gcaaagcattctcatcagtcgcaat

SEQ ID NO: 1324 - DNA, 25 bp, B. subtillis
gcaggcgtttatttctgcagggctg

SEQ ID NO: 1325 - DNA, 25 bp, B. subtillis
gcaggcgtttatatctgcagggctg

SEQ ID NO: 1326 - DNA, 25 bp, B. subtillis
gcagacaaaatctacatggtcattt

SEQ ID NO: 1327 - DNA, 25 bp, B. subtillis
cattctcatcagacgcaatgattca

SEQ ID NO: 1328 - DNA, 25 bp, B. subtillis
cattctcatcagtcgcaatgattca

SEQ ID NO: 1329 - DNA, 25 bp, B. subtillis
gtatatgatgtgcctttaatacgtg

SEQ ID NO: 1330 - DNA, 25 bp, B. subtillis
gtatatgatgtggctttaatacgtg

SEQ ID NO: 1331 - DNA, 25 bp, B. subtillis
ggagagctatatacggctgttgcag

SEQ ID NO: 1332 - DNA, 25 bp, B. subtillis
gggctgaaagcagaggtggcatatg

SEQ ID NO: 1333 - DNA, 25 bp, B. subtillis
ggagagctatattcggctgttgcag

SEQ ID NO: 1334 - DNA, 25 bp, B. subtillis
gggctgaaagcacaggtggcatatg

SEQ ID NO: 1335 - DNA, 25 bp, B. subtillis
tggtacacctctatacgtatatgat

SEQ ID NO: 1336 - DNA, 25 bp, B. subtillis
tggatgctctctttttagcggagaa

SEQ ID NO: 1337 - DNA, 25 bp, B. subtillis
ggcatatgcgaggaaagcattctca

SEQ ID NO: 1338 - DNA, 25 bp, B. subtillis
ggcatatgcgagcaaagcattctca

SEQ ID NO: 1339 - DNA, 25 bp, B. subtillis
tggatgctctctatttagcggagaa

SEQ ID NO: 1340 - DNA, 25 bp, B. subtillis
tggtacacctctttacgtatatgat

SEQ ID NO: 1341 - DNA, 25 bp, B. subtillis
aatcgtttcatcattcggcgtgcga

SEQ ID NO: 1342 - DNA, 25 bp, B. subtillis
aagatgatgaaccgcttcatgccac

SEQ ID NO: 1343 - DNA, 25 bp, B. subtillis
aatcgtttcatctttcggcgtgcga

SEQ ID NO: 1344 - DNA, 25 bp, B. subtillis
aagatgatgaacggcttcatgccac

SEQ ID NO: 1345 - DNA, 25 bp, B. subtillis
catattcatttgtatccaaggtgct

SEQ ID NO: 1346 - DNA, 25 bp, B. subtillis
catttgtatccaaggtgctgaatct

SEQ ID NO: 1347 - DNA, 25 bp, B. subtillis
catttgtatccatggtgctgaatct

SEQ ID NO: 1348 - DNA, 25 bp, B. subtillis
catattcatttgaatccaaggtgct

SEQ ID NO: 1349 - DNA, 25 bp, B. subtillis
tacaatcgtttcttcattcggcgtg

SEQ ID NO: 1350 - DNA, 25 bp, B. subtillis
tacaatcgtttcatcattcggcgtg

SEQ ID NO: 1351 - DNA, 25 bp, B. subtillis
agctgtacaatcctttcatcattcg

SEQ ID NO: 1352 - DNA, 25 bp, B. subtillis
attcatattcatatgtatccaaggt

SEQ ID NO: 1353 - DNA, 25 bp, B. subtillis
agctgtacaatcgtttcatcattcg

SEQ ID NO: 1354 - DNA, 25 bp, B. subtillis
accgcttcatgccactgaatacgtt

SEQ ID NO: 1355 - DNA, 25 bp, B. subtillis
ataagctgtacattcgtttcatcat

SEQ ID NO: 1356 - DNA, 25 bp, B. subtillis
accgcttcatgcgactgaatacgtt

SEQ ID NO: 1357 - DNA, 25 bp, B. subtillis
ataagctgtacaatcgtttcatcat

SEQ ID NO: 1358 - DNA, 25 bp, B. subtillis
attcatattcatttgtatccaaggt

SEQ ID NO: 1359 - DNA, 25 bp, B. subtillis
atgatgaaccgcttcatgccactga

SEQ ID NO: 1360 - DNA, 25 bp, B. subtillis
atgatgaaccgcatcatgccactga

SEQ ID NO: 1361 - DNA, 25 bp, B. subtillis
tatccaaggtgctgaatcttggagg

SEQ ID NO: 1362 - DNA, 25 bp, B. subtillis
tatccaaggtgcagaatcttggagg

SEQ ID NO: 1363 - DNA, 25 bp, B. subtillis
tttgtatccaaggtgctgaatcttg

SEQ ID NO: 1364 - DNA, 25 bp, B. subtillis
tattcgttatacggaagatgatgaa

SEQ ID NO: 1365 - DNA, 25 bp, B. subtillis
tattcgttataccgaagatgatgaa

SEQ ID NO: 1366 - DNA, 25 bp, B. subtillis
tttgtatccaagctgctgaatcttg

SEQ ID NO: 1367 - DNA, 25 bp, B. subtillis
tgggagacgcaggcacaactcttta

SEQ ID NO: 1368 - DNA, 25 bp, B. subtillis
tgggagacgcagccacaactcttta

SEQ ID NO: 1369 - DNA, 25 bp, B. subtillis
tgaaccgcttcaagccactgaatac

SEQ ID NO: 1370 - DNA, 25 bp, B. subtillis
tgaaccgcttcatgccactgaatac

SEQ ID NO: 1371 - DNA, 25 bp, B. subtillis
gcacaactctttatacggttggctc

SEQ ID NO: 1372 - DNA, 25 bp, B. subtillis
gcacaactctttttacggttggctc

SEQ ID NO: 1373 - DNA, 25 bp, B. subtillis
cgtttcatcattcggcgtgcgaatt

SEQ ID NO: 1374 - DNA, 25 bp, B. subtillis
cgtttcatcattgggcgtgcgaatt

SEQ ID NO: 1375 - DNA, 25 bp, B. subtillis
ctgtacaatcgtatcatcattcggc

SEQ ID NO: 1376 - DNA, 25 bp, B. subtillis
ctgtacaatcgtttcatcattcggc

SEQ ID NO: 1377 - DNA, 25 bp, B. subtillis
tggagagattcaaattcatttgtat

SEQ ID NO: 1378 - DNA, 25 bp, B. subtillis
tggagagattcatattcatttgtat

SEQ ID NO: 1379 - DNA, 25 bp, B. subtillis
gagacgcaggcacaactctttatac

SEQ ID NO: 1380 - DNA, 25 bp, B. subtillis
gagacgcaggcagaactctttatac

SEQ ID NO: 1381 - DNA, 25 bp, artificial sequence
  synthetic oligonucleotide
aattgggcctgaaaatccatacaat

SEQ ID NO: 1382 - DNA, 25 bp, artificial sequence
  synthetic oligonucleotide
aattgggcctgataatccatacaat

SEQ ID NO: 1383 - DNA, 25 bp, artificial sequence
  synthetic oligonucleotide
taaacaatggcctttgacagaagaa

SEQ ID NO: 1384 - DNA, 25 bp, artificial sequence
  synthetic oligonucleotide
tactggatgtggctgatgcatattt

SEQ ID NO: 1385 - DNA, 25 bp, artificial sequence
  synthetic oligonucleotide
tactggatgtgggtgatgcatattt

SEQ ID NO: 1386 - DNA, 25 bp, artificial sequence
  synthetic oligonucleotide
tactccagtattagccataaagaaa

SEQ ID NO: 1387 - DNA, 25 bp, artificial sequence
  synthetic oligonucleotide
tactccagtatttgccataaagaaa

SEQ ID NO: 1388 - DNA, 25 bp, artificial sequence
  synthetic oligonucleotide
taaacaatggccattgacagaagaa

SEQ ID NO: 1389 - DNA, 25 bp, artificial sequence
  synthetic oligonucleotide
ctcaagacttctcggaagttcaatt

SEQ ID NO: 1390 - DNA, 25 bp, artificial sequence
  synthetic oligonucleotide
atggatggcccataagttaaacaat

SEQ ID NO: 1391 - DNA, 25 bp, artificial sequence
  synthetic oligonucleotide
agaactcaagacatctgggaagttc

SEQ ID NO: 1392 - DNA, 25 bp, artificial sequence
  synthetic oligonucleotide
agaactcaagacttctgggaagttc

SEQ ID NO: 1393 - DNA, 25 bp, artificial sequence
  synthetic oligonucleotide
ctcaagacttctgggaagttcaatt

SEQ ID NO: 1394 - DNA, 25 bp, artificial sequence
  synthetic oligonucleotide
atggatggcccaaaagttaaacaat

SEQ ID NO: 1395 - DNA, 25 bp, artificial sequence
  synthetic oligonucleotide
atactccagtatatgccataaagaa

SEQ ID NO: 1396 - DNA, 25 bp, artificial sequence
  synthetic oligonucleotide
aggaataccacaacccgcagggtta

SEQ ID NO: 1397 - DNA, 25 bp, artificial sequence
  synthetic oligonucleotide
agccaggaatggttggcccaaaagt

SEQ ID NO: 1398 - DNA, 25 bp, artificial sequence
  synthetic oligonucleotide
agccaggaatggatggcccaaaagt

SEQ ID NO: 1399 - DNA, 25 bp, artificial sequence
  synthetic oligonucleotide
aggaataccacatcccgcagggtta

SEQ ID NO: 1400 - DNA, 25 bp, artificial sequence
  synthetic oligonucleotide
atactccagtatttgccataaagaa

SEQ ID NO: 1401 - DNA, 25 bp, artificial sequence
  synthetic oligonucleotide
acagtactggatctgggtgatgcat

SEQ ID NO: 1402 - DNA, 25 bp, artificial sequence
  synthetic oligonucleotide
acagtactggatgtgggtgatgcat

SEQ ID NO: 1403 - DNA, 25 bp, artificial sequence
  synthetic oligonucleotide
ttctgggaagttgaattaggaatac

SEQ ID NO: 1404 - DNA, 25 bp, artificial sequence
  synthetic oligonucleotide
ttctgggaagttcaattaggaatac

SEQ ID NO: 1405 - DNA, 25 bp, artificial sequence
  synthetic oligonucleotide
ttaaagccaggaatggatggcccaa

SEQ ID NO: 1406 - DNA, 25 bp, artificial sequence
  synthetic oligonucleotide
ttaaacaatggcgattgacagaaga

SEQ ID NO: 1407 - DNA, 25 bp, artificial sequence
  synthetic oligonucleotide
ttaaagccaggattggatggcccaa

SEQ ID NO: 1408 - DNA, 25 bp, artificial sequence
  synthetic oligonucleotide
ttaaacaatggccattgacagaaga

SEQ ID NO: 1409 - DNA, 25 bp, artificial sequence
  synthetic oligonucleotide
tgaaaatccatagaatactccagta

SEQ ID NO: 1410 - DNA, 25 bp, artificial sequence
  synthetic oligonucleotide
tgaaaatccatacaatactccagta

SEQ ID NO: 1411 - DNA, 25 bp, artificial sequence
  synthetic oligonucleotide
tatttttcagttcccttagatgaag

SEQ ID NO: 1412 - DNA, 25 bp, artificial sequence
  synthetic oligonucleotide
tatttttcagttgccttagatgaag

SEQ ID NO: 1413 - DNA, 25 bp, artificial sequence
  synthetic oligonucleotide
ccttagatgaagacttcaggaaata

SEQ ID NO: 1414 - DNA, 25 bp, artificial sequence
  synthetic oligonucleotide
ccttagatgaagtcttcaggaaata

SEQ ID NO: 1415 - DNA, 25 bp, artificial sequence
  synthetic oligonucleotide
cccttagatgaagacttcaggaaat

SEQ ID NO: 1416 - DNA, 25 bp, artificial sequence
  synthetic oligonucleotide
cccttagatgaacacttcaggaaat

SEQ ID NO: 1417 - DNA, 25 bp, artificial sequence
  synthetic oligonucleotide
ggaataccacatcccgcagggttaa

SEQ ID NO: 1418 - DNA, 25 bp, artificial sequence
  synthetic oligonucleotide
ggaataccacatgccgcagggttaa

SEQ ID NO: 1419 - DNA, 25 bp, artificial sequence
  synthetic oligonucleotide
tcaaaaattggggctgaaaatccat

SEQ ID NO: 1420 - DNA, 25 bp, artificial sequence
  synthetic oligonucleotide
tcaaaaattgggcctgaaaatccat

SEQ ID NO: 1421 - DNA, 25 bp, artificial sequence
  synthetic oligonucleotide
ctcagatcactctttggcaacgacc

SEQ ID NO: 1422 - DNA, 25 bp, artificial sequence
  synthetic oligonucleotide
ctcagatcactcattggcaacgacc

SEQ ID NO: 1423 - DNA, 25 bp, artificial sequence
  synthetic oligonucleotide
ccctcgtcacaataaagataggggg

SEQ ID NO: 1424 - DNA, 25 bp, artificial sequence
  synthetic oligonucleotide
attagatacaggtgcagatgataca

SEQ ID NO: 1425 - DNA, 25 bp, artificial sequence
  synthetic oligonucleotide
actaaaggaagcactattagataca

SEQ ID NO: 1426 - DNA, 25 bp, artificial sequence
  synthetic oligonucleotide
agtttgccaggaagatggaaaccaa

SEQ ID NO: 1427 - DNA, 25 bp, artificial sequence
  synthetic oligonucleotide
agtaggacctacacctgtcaacata

SEQ ID NO: 1428 - DNA, 25 bp, artificial sequence
  synthetic oligonucleotide
ccctcgtcacaaaaaagataggggg

SEQ ID NO: 1429 - DNA, 25 bp, artificial sequence
  synthetic oligonucleotide
attttcccattagccctattgagac

SEQ ID NO: 1430 - DNA, 25 bp, artificial sequence
  synthetic oligonucleotide
atcagatactcaaagaaatctgtgg

SEQ ID NO: 1431 - DNA, 25 bp, artificial sequence
  synthetic oligonucleotide
acctgtcaacattattggaagaaat

SEQ ID NO: 1432 - DNA, 25 bp, artificial sequence
  synthetic oligonucleotide
ctttaacttcccacagatcactctt

SEQ ID NO: 1433 - DNA, 25 bp, artificial sequence
  synthetic oligonucleotide
agtttgccaggatgatggaaaccaa

SEQ ID NO: 1434 - DNA, 25 bp, artificial sequence
  synthetic oligonucleotide
atcagatactcatagaaatctgtgg

SEQ ID NO: 1435 - DNA, 25 bp, artificial sequence
  synthetic oligonucleotide
attagatacaggagcagatgataca

SEQ ID NO: 1436 - DNA, 25 bp, artificial sequence
  synthetic oligonucleotide
actaaaggaagctctattagataca

SEQ ID NO: 1437 - DNA, 25 bp, artificial sequence
  synthetic oligonucleotide
agtaggacctactcctgtcaacata

SEQ ID NO: 1438 - DNA, 25 bp, artificial sequence
  synthetic oligonucleotide
acctgtcaacataattggaagaaat

SEQ ID NO: 1439 - DNA, 25 bp, artificial sequence
  synthetic oligonucleotide
attttcccattacccctattgagac

SEQ ID NO: 1440 - DNA, 25 bp, artificial sequence
  synthetic oligonucleotide
ctttaacttccctcagatcactctt

SEQ ID NO: 1441 - DNA, 25 bp, artificial sequence
  synthetic oligonucleotide
actcagattggtagcactttaaatt

SEQ ID NO: 1442 - DNA, 25 bp, artificial sequence
  synthetic oligonucleotide
actcagattggttgcactttaaatt

SEQ ID NO: 1443 - DNA, 25 bp, artificial sequence
  synthetic oligonucleotide
ttggcaacgaccgctcgtcacaata

SEQ ID NO: 1444 - DNA, 25 bp, artificial sequence
  synthetic oligonucleotide
ttggcaacgacccctcgtcacaata

SEQ ID NO: 1445 - DNA, 25 bp, artificial sequence
  synthetic oligonucleotide
tattgagactgttccagtaaaatta

SEQ ID NO: 1446 - DNA, 25 bp, artificial sequence
  synthetic oligonucleotide
tattgagactgtaccagtaaaatta

SEQ ID NO: 1447 - DNA, 25 bp, artificial sequence
  synthetic oligonucleotide
ttagatacaggagcagatgatacag

SEQ ID NO: 1448 - DNA, 25 bp, artificial sequence
  synthetic oligonucleotide
ttagatacaggaccagatgatacag

SEQ ID NO: 1449 - DNA, 25 bp, artificial sequence
  synthetic oligonucleotide
tgactcagattggttgcactttaaa

SEQ ID NO: 1450 - DNA, 25 bp, artificial sequence
  synthetic oligonucleotide
tgactcagattgcttgcactttaaa

SEQ ID NO: 1451 - DNA, 25 bp, artificial sequence
  synthetic oligonucleotide
tcagatcactctatggcaacgaccc

SEQ ID NO: 1452 - DNA, 25 bp, artificial sequence
  synthetic oligonucleotide
tcagatcactctttggcaacgaccc

SEQ ID NO: 1453 - DNA, 25 bp, artificial sequence
  synthetic oligonucleotide
gccctattgagagtgtaccagtaaa

SEQ ID NO: 1454 - DNA, 25 bp, artificial sequence
  synthetic oligonucleotide
cctgtcaacatatttggaagaaatc

SEQ ID NO: 1455 - DNA, 25 bp, artificial sequence
  synthetic oligonucleotide
cctgtcaacataattggaagaaatc

SEQ ID NO: 1456 - DNA, 25 bp, artificial sequence
  synthetic oligonucleotide
gccctattgagactgtaccagtaaa

SEQ ID NO: 1457 - DNA, 25 bp, artificial sequence
  synthetic oligonucleotide
ctcatagaaatcagtggacataaag

SEQ ID NO: 1458 - DNA, 25 bp, artificial sequence
  synthetic oligonucleotide
ctcatagaaatctgtggacataaag

SEQ ID NO: 1459 - DNA, 25 bp, artificial sequence
  synthetic oligonucleotide
gagtttgccaggtagatggaaacca

SEQ ID NO: 1460 - DNA, 25 bp, artificial sequence
  synthetic oligonucleotide
gagtttgccaggaagatggaaacca

SEQ ID NO: 1461 - DNA, 25 bp, artificial sequence
  synthetic oligonucleotide
caatgagacacctgggattagatat

SEQ ID NO: 1462 - DNA, 25 bp, artificial sequence
  synthetic oligonucleotide
caatgagacaccagggattagatat

SEQ ID NO: 1463 - DNA, 25 bp, artificial sequence
  synthetic oligonucleotide
agtacaatgtgcatccacagggatg

SEQ ID NO: 1464 - DNA, 25 bp, artificial sequence
  synthetic oligonucleotide
atgtaggatctgtcttagaaatagg

SEQ ID NO: 1465 - DNA, 25 bp, artificial sequence
  synthetic oligonucleotide
atacgtggatgaattgtatgtagga

SEQ ID NO: 1466 - DNA, 25 bp, artificial sequence
  synthetic oligonucleotide
accagcaatattgcaaagtagcatg

SEQ ID NO: 1467 - DNA, 25 bp, artificial sequence
  synthetic oligonucleotide
atacgtggatgatttgtatgtagga

SEQ ID NO: 1468 - DNA, 25 bp, artificial sequence
  synthetic oligonucleotide
atgtaggatctgacttagaaatagg

SEQ ID NO: 1469 - DNA, 25 bp, artificial sequence
  synthetic oligonucleotide
agtacaatgtgcttccacagggatg

SEQ ID NO: 1470 - DNA, 25 bp, artificial sequence
  synthetic oligonucleotide
agttatctatcattacgtggatgat

SEQ ID NO: 1471 - DNA, 25 bp, artificial sequence
  synthetic oligonucleotide
attcctttggatcggttatgaactc

SEQ ID NO: 1472 - DNA, 25 bp, artificial sequence
  synthetic oligonucleotide
accagcaatattccaaagtagcatg

SEQ ID NO: 1473 - DNA, 25 bp, artificial sequence
  synthetic oligonucleotide
attcctttggatgggttatgaactc

SEQ ID NO: 1474 - DNA, 25 bp, artificial sequence
  synthetic oligonucleotide
agttatctatcaatacgtggatgat

SEQ ID NO: 1475 - DNA, 25 bp, artificial sequence
  synthetic oligonucleotide
aaatccagacattgttatctatcaa

SEQ ID NO: 1476 - DNA, 25 bp, artificial sequence
  synthetic oligonucleotide
aaatccagacatagttatctatcaa

SEQ ID NO: 1477 - DNA, 25 bp, artificial sequence
  synthetic oligonucleotide
ttccaaagtagcttgacaaaaatct

SEQ ID NO: 1478 - DNA, 25 bp, artificial sequence
  synthetic oligonucleotide
ttccacagggatcgaaaggatcacc

SEQ ID NO: 1479 - DNA, 25 bp, artificial sequence
  synthetic oligonucleotide
ttccaaagtagcatgacaaaaatct

SEQ ID NO: 1480 - DNA, 25 bp, artificial sequence
  synthetic oligonucleotide
ttccacagggatggaaaggatcacc

SEQ ID NO: 1481 - DNA, 25 bp, artificial sequence
  synthetic oligonucleotide
tgcatttaccatacctagtataaac

SEQ ID NO: 1482 - DNA, 25 bp, artificial sequence
  synthetic oligonucleotide
tgcatttaccattcctagtataaac

SEQ ID NO: 1483 - DNA, 25 bp, artificial sequence
  synthetic oligonucleotide
tctatcaatacgaggatgatttgta

SEQ ID NO: 1484 - DNA, 25 bp, artificial sequence
  synthetic oligonucleotide
tctatcaatacgtggatgatttgta

SEQ ID NO: 1485 - DNA, 25 bp, artificial sequence
  synthetic oligonucleotide
ccatcctgataaatggacagtacag

SEQ ID NO: 1486 - DNA, 25 bp, artificial sequence
  synthetic oligonucleotide
ccatcctgataattggacagtacag

SEQ ID NO: 1487 - DNA, 25 bp, artificial sequence
  synthetic oligonucleotide
gcttccacagggttggaaaggatca

SEQ ID NO: 1488 - DNA, 25 bp, artificial sequence
  synthetic oligonucleotide
gctgagacaacatctgttgaggtgg

SEQ ID NO: 1489 - DNA, 25 bp, artificial sequence
  synthetic oligonucleotide
gcttccacagggatggaaaggatca

SEQ ID NO: 1490 - DNA, 25 bp, artificial sequence
  synthetic oligonucleotide
gctgagacaacaactgttgaggtgg

SEQ ID NO: 1491 - DNA, 25 bp, artificial sequence
  synthetic oligonucleotide
gacaaaaatcttagagccttttaga

SEQ ID NO: 1492 - DNA, 25 bp, artificial sequence
  synthetic oligonucleotide
gacaaaaatctttgagccttttaga

SEQ ID NO: 1493 - DNA, 25 bp, artificial sequence
  synthetic oligonucleotide
gaaagaacctccattcctttggatg

SEQ ID NO: 1494 - DNA, 25 bp, artificial sequence
  synthetic oligonucleotide
gaaagaacctcctttcctttggatg

SEQ ID NO: 1495 - DNA, 25 bp, artificial sequence
  synthetic oligonucleotide
tggggacttaccacaccagacaaaa

SEQ ID NO: 1496 - DNA, 25 bp, artificial sequence
  synthetic oligonucleotide
gggttatgaactccatcctgataaa

SEQ ID NO: 1497 - DNA, 25 bp, artificial sequence
  synthetic oligonucleotide
tggggacttacctcaccagacaaaa

SEQ ID NO: 1498 - DNA, 25 bp, artificial sequence
  synthetic oligonucleotide
gggttatgaactgcatcctgataaa

SEQ ID NO: 1499 - DNA, 25 bp, artificial sequence
  synthetic oligonucleotide
tcaccagcaataatccaaagtagca

SEQ ID NO: 1500 - DNA, 25 bp, artificial sequence
  synthetic oligonucleotide
tcaccagcaatattccaaagtagca

SEQ ID NO: 1501 - DNA, 25 bp, E. coli
catcatccagtacgtgtggcggaag

SEQ ID NO: 1502 - DNA, 25 bp, E. coli
catcatccagtaggtgtggcggaag

SEQ ID NO: 1503 - DNA, 25 bp, E. coli
tatgacaaagaaggccaaagtggct

SEQ ID NO: 1504 - DNA, 25 bp, E. coli
taccacgaagttcctcaggcacatg

SEQ ID NO: 1505 - DNA, 25 bp, E. coli
tatgaagaaagttctcaggcagcgc

SEQ ID NO: 1506 - DNA, 25 bp, E. coli
tatgacaaagaacgccaaagtggct

SEQ ID NO: 1507 - DNA, 25 bp, E. coli
taccacgaagttgctcaggcacatg

SEQ ID NO: 1508 - DNA, 25 bp, E. coli
tatgaagaaagtactcaggcagcgc

SEQ ID NO: 1509 - DNA, 25 bp, E. coli
tggtgccgcggagctattgatgtct

SEQ ID NO: 1510 - DNA, 25 bp, E. coli
tggtgccgcggacctattgatgtct

SEQ ID NO: 1511 - DNA, 25 bp, E. coli
tgcgcttctttaatcgaccaacgga

SEQ ID NO: 1512 - DNA, 25 bp, E. coli
tgcgcttctttattcgaccaacgga

SEQ ID NO: 1513 - DNA, 25 bp, E. coli
gctgttgtcagataatgccatcggt

SEQ ID NO: 1514 - DNA, 25 bp, E. coli
gctgttgtcagaaaatgccatcggt

SEQ ID NO: 1515 - DNA, 25 bp, E. coli
gaaggcggtcctccgcaatttgtga

SEQ ID NO: 1516 - DNA, 25 bp, E. coli
gaatacgccggtttgtaccacgaag

SEQ ID NO: 1517 - DNA, 25 bp, E. coli
gaaggcggtcctgcgcaatttgtga

SEQ ID NO: 1518 - DNA, 25 bp, E. coli
gaatacgccggtatgtaccacgaag

SEQ ID NO: 1519 - DNA, 25 bp, E. coli
gaacaatggtgtcgttggtgcccca

SEQ ID NO: 1520 - DNA, 25 bp, E. coli
gaacaatggtgtggttggtgcccca

SEQ ID NO: 1521 - DNA, 25 bp, E. coli
ggttcgacacaacctgacgctgctg

SEQ ID NO: 1522 - DNA, 25 bp, E. coli
ggttcgacacaagctgacgctgctg

SEQ ID NO: 1523 - DNA, 25 bp, E. coli
caatgaaggctatatcgcggcggat

SEQ ID NO: 1524 - DNA, 25 bp, E. coli
caatgaaggctaaatcgcggcggat

SEQ ID NO: 1525 - DNA, 25 bp, E. coli
tacagacatggataacagccgagcc

SEQ ID NO: 1526 - DNA, 25 bp, E. coli
tacagacatggaaaacagccgagcc

SEQ ID NO: 1527 - DNA, 25 bp, E. coli
tatctcagaccgtagtgatgaagcg

SEQ ID NO: 1528 - DNA, 25 bp, E. coli
tatctcagaccgaagtgatgaagcg

SEQ ID NO: 1529 - DNA, 25 bp, E. coli
tgaatccatcgggttacacacaagg

SEQ ID NO: 1530 - DNA, 25 bp, E. coli
tgaatccatcggcttacacacaagg

SEQ ID NO: 1531 - DNA, 25 bp, E. coli
tgaaaggccacaaagacaccaatcg

SEQ ID NO: 1532 - DNA, 25 bp, E. coli
tgaaaggccacatagacaccaatcg

SEQ ID NO: 1533 - DNA, 25 bp, E. coli
tgcccatccggttcgacaagcagaa

SEQ ID NO: 1534 - DNA, 25 bp, E. coli
tgcccatccggtacgacaagcagaa

SEQ ID NO: 1535 - DNA, 25 bp, E. coli
gaaatcaacccagtagggacgcctg

SEQ ID NO: 1536 - DNA, 25 bp, E. coli
gaaatcaacccactagggacgcctg

SEQ ID NO: 1537 - DNA, 25 bp, E. coli
tggatcatcaactctcacgagaaga

SEQ ID NO: 1538 - DNA, 25 bp, E. coli
ggaatccttatgttgctgccgcaca

SEQ ID NO: 1539 - DNA, 25 bp, E. coli
ggaatccttatgatgctgccgcaca

SEQ ID NO: 1540 - DNA, 25 bp, E. coli
tggatcatcaacactcacgagaaga

SEQ ID NO: 1541 - DNA, 25 bp, E. coli
tcaacgacagaaagggctgcagagc

SEQ ID NO: 1542 - DNA, 25 bp, E. coli
tcaacgacagaatgggctgcagagc

SEQ ID NO: 1543 - DNA, 25 bp, E. coli
taatctgggcaatgcgtctgaaggt

SEQ ID NO: 1544 - DNA, 25 bp, E. coli
taatctgggcaaagcgtctgaaggt

SEQ ID NO: 1545 - DNA, 25 bp, E. coli
catgccgacgcgctagacgatttcg

SEQ ID NO: 1546 - DNA, 25 bp, E. coli
catgccgacgcggtagacgatttcg

SEQ ID NO: 1547 - DNA, 25 bp, E. coli
atggcgcatgcccacgcgctagacg

SEQ ID NO: 1548 - DNA, 25 bp, E. coli
acgatttcgatctggacatgttggg

SEQ ID NO: 1549 - DNA, 25 bp, E. coli
agctccacttagacggcgaggacgt

SEQ ID NO: 1550 - DNA, 25 bp, E. coli
agctccacttagtcggcgaggacgt

SEQ ID NO: 1551 - DNA, 25 bp, E. coli
acgatttcgatcaggacatgttggg

SEQ ID NO: 1552 - DNA, 25 bp, E. coli
atggcgcatgccgacgcgctagacg

SEQ ID NO: 1553 - DNA, 25 bp, E. coli
acttagacggcgtggacgtggcgat

SEQ ID NO: 1554 - DNA, 25 bp, E. coli
acttagacggcgaggacgtggcgat

SEQ ID NO: 1555 - DNA, 25 bp, E. coli
tgccgacgcgcttgacgatttcgat

SEQ ID NO: 1556 - DNA, 25 bp, E. coli
tgccgacgcgctagacgatttcgat

SEQ ID NO: 1557 - DNA, 25 bp, E. coli
gctagacgatttggatctggacatg

SEQ ID NO: 1558 - DNA, 25 bp, E. coli
gctagacgatttcgatctggacatg

SEQ ID NO: 1559 - DNA, 25 bp, E. coli
cgagctccacttagacggcgaggac

SEQ ID NO: 1560 - DNA, 25 bp, E. coli
cgagctccactttgacggcgaggac

SEQ ID NO: 1561 - DNA, 25 bp, E. coli
cggcgaggacgtcgcgatggcgcat

SEQ ID NO: 1562 - DNA, 25 bp, E. coli
cggcgaggacgtggcgatggcgcat

SEQ ID NO: 1563 - DNA, 25 bp, E. coli
gggacgagctcctcttagacggcga

SEQ ID NO: 1564 - DNA, 25 bp, E. coli
gacgcgctagaccatttcgatctgg

SEQ ID NO: 1565 - DNA, 25 bp, E. coli
gggacgagctccacttagacggcga

SEQ ID NO: 1566 - DNA, 25 bp, E. coli
gacgcgctagacgatttcgatctgg

SEQ ID NO: 1567 - DNA, 25 bp, E. coli
tatcaggacataccgttggctaccc

SEQ ID NO: 1568 - DNA, 25 bp, E. coli
tatcaggacatagcgttggctaccc

SEQ ID NO: 1569 - DNA, 25 bp, E. coli
tttttgtcaagaccgacctgtccgg

SEQ ID NO: 1570 - DNA, 25 bp, E. coli
tttttgtcaagagcgacctgtccgg

SEQ ID NO: 1571 - DNA, 25 bp, E. coli
tgtccggtgcccagaatgaactgca

SEQ ID NO: 1572 - DNA, 25 bp, E. coli
tgtccggtgccctgaatgaactgca

SEQ ID NO: 1573 - DNA, 25 bp, E. coli
tgggcacaacagacaatcggctgct

SEQ ID NO: 1574 - DNA, 25 bp, E. coli
tgggcacaacagtcaatcggctgct

SEQ ID NO: 1575 - DNA, 25 bp, E. coli
tctggattcatccactgtggccggc

SEQ ID NO: 1576 - DNA, 25 bp, E. coli
tctggattcatcgactgtggccggc

SEQ ID NO: 1577 - DNA, 25 bp, E. coli
gctcctgccgagaaagtatccatca

SEQ ID NO: 1578 - DNA, 25 bp, E. coli
gctattcggctaagactgggcacaa

SEQ ID NO: 1579 - DNA, 25 bp, E. coli
gctcctgccgagtaagtatccatca

SEQ ID NO: 1580 - DNA, 25 bp, E. coli
gctattcggctatgactgggcacaa

SEQ ID NO: 1581 - DNA, 25 bp, E. coli
gaatatcatggtggaaaatggccgc

SEQ ID NO: 1582 - DNA, 25 bp, E. coli
gaatatcatggtcgaaaatggccgc

SEQ ID NO: 1583 - DNA, 25 bp, E. coli
gatctcgtcgtgtcccatggcgatg

SEQ ID NO: 1584 - DNA, 25 bp, E. coli
tggctacccgtgatattgctgaaga

SEQ ID NO: 1585 - DNA, 25 bp, E. coli
ggcgatgcctgcatgccgaatatca

SEQ ID NO: 1586 - DNA, 25 bp, E. coli
tggctacccgtgttattgctgaaga

SEQ ID NO: 1587 - DNA, 25 bp, E. coli
ggcgatgcctgcttgccgaatatca

SEQ ID NO: 1588 - DNA, 25 bp, E. coli
gatctcgtcgtgacccatggcgatg

SEQ ID NO: 1589 - DNA, 25 bp, E. coli
catgccgacgcggtagacgatttcg

SEQ ID NO: 1590 - DNA, 25 bp, E. coli
catgccgacgcgctagacgatttcg

SEQ ID NO: 1591 - DNA, 25 bp, E. coli
acgatttcgatctggacatgttggg

SEQ ID NO: 1592 - DNA, 25 bp, E. coli
agctccacttagtcggcgaggacgt

SEQ ID NO: 1593 - DNA, 25 bp, E. coli
acgatttcgatcaggacatgttggg

SEQ ID NO: 1594 - DNA, 25 bp, E. coli
agctccacttagacggcgaggacgt

SEQ ID NO: 1595 - DNA, 25 bp, E. coli
atggcgcatgcccacgcgctagacg

SEQ ID NO: 1596 - DNA, 25 bp, E. coli
atggcgcatgccgacgcgctagacg

SEQ ID NO: 1597 - DNA, 25 bp, E. coli
acttagacggcgaggacgtggcgat

SEQ ID NO: 1598 - DNA, 25 bp, E. coli
acttagacggcgtggacgtggcgat

SEQ ID NO: 1599 - DNA, 25 bp, E. coli
tgccgacgcgcttgacgatttcgat

SEQ ID NO: 1600 - DNA, 25 bp, E. coli
tgccgacgcgctagacgatttcgat

SEQ ID NO: 1601 - DNA, 25 bp, E. coli
gctagacgatttggatctggacatg

SEQ ID NO: 1602 - DNA, 25 bp, E. coli
gctagacgatttcgatctggacatg

SEQ ID NO: 1603 - DNA, 25 bp, E. coli
cgagctccactttgacggcgaggac

SEQ ID NO: 1604 - DNA, 25 bp, E. coli
cgagctccacttagacggcgaggac

SEQ ID NO: 1605 - DNA, 25 bp, E. coli
cggcgaggacgtggcgatggcgcat

SEQ ID NO: 1606 - DNA, 25 bp, E. coli
cggcgaggacgtcgcgatggcgcat

SEQ ID NO: 1607 - DNA, 25 bp, E. coli
gggacgagctccacttagacggcga

SEQ ID NO: 1608 - DNA, 25 bp, E. coli
gggacgagctcctcttagacggcga

SEQ ID NO: 1609 - DNA, 25 bp, E. coli
gacgcgctagaccatttcgatctgg

SEQ ID NO: 1610 - DNA, 25 bp, E. coli
gacgcgctagacgatttcgatctgg

SEQ ID NO: 1611 - DNA, 25 bp, E. coli
cagctattctgattacacccgaggg

SEQ ID NO: 1612 - DNA, 25 bp, E. coli
cagaatcgtcgtttgcagtgaaaac

SEQ ID NO: 1613 - DNA, 25 bp, E. coli
cagaatcgtcgtatgcagtgaaaac

SEQ ID NO: 1614 - DNA, 25 bp, E. coli
cagctattctgaatacacccgaggg

SEQ ID NO: 1615 - DNA, 25 bp, E. coli
tacgtcgccagtgaagtaacaaccg

SEQ ID NO: 1616 - DNA, 25 bp, E. coli
tatttatcggagatgcagttgcgcc

SEQ ID NO: 1617 - DNA, 25 bp, E. coli
tatttatcggagttgcagttgcgcc

SEQ ID NO: 1618 - DNA, 25 bp, E. coli
ttatgtaaacaatccggaagcgacc

SEQ ID NO: 1619 - DNA, 25 bp, E. coli
ttttggagcacggaaagacgatgac

SEQ ID NO: 1620 - DNA, 25 bp, E. coli
ttatgtaaacaaaccggaagcgacc

SEQ ID NO: 1621 - DNA, 25 bp, E. coli
ttttggagcacgcaaagacgatgac

SEQ ID NO: 1622 - DNA, 25 bp, E. coli
tgcgcccgcgaaggacatttataat

SEQ ID NO: 1623 - DNA, 25 bp, E. coli
tgcgcccgcgaacgacatttataat

SEQ ID NO: 1624 - DNA, 25 bp, E. coli
tctggagacatagcttactgggacg

SEQ ID NO: 1625 - DNA, 25 bp, E. coli
tctggagacataccttactgggacg

SEQ ID NO: 1626 - DNA, 25 bp, E. coli
tctggataccggcaaaacgctgggc

SEQ ID NO: 1627 - DNA, 25 bp, E. coli
tctggataccgggaaaacgctgggc

SEQ ID NO: 1628 - DNA, 25 bp, E. coli
ccagggatttcagtcgatgtacacg

SEQ ID NO: 1629 - DNA, 25 bp, E. coli
ccagggatttcactcgatgtacacg

SEQ ID NO: 1630 - DNA, 25 bp, E. coli
tacgtcgccagtcaagtaacaaccg

SEQ ID NO: 1631 - DNA, 25 bp, E. coli
gagatacgccctcgttcctggaaca

SEQ ID NO: 1632 - DNA, 25 bp, E. coli
gagatacgccctggttcctggaaca

SEQ ID NO: 1633 - DNA, 25 bp, E. coli
cacatggtcctggtggagttcgtga

SEQ ID NO: 1634 - DNA, 25 bp, E. coli
cacatggtcctgctggagttcgtga

SEQ ID NO: 1635 - DNA, 25 bp, E. coli
tacggcaagctgtccctgaagttca

SEQ ID NO: 1636 - DNA, 25 bp, E. coli
tacggcaagctgaccctgaagttca

SEQ ID NO: 1637 - DNA, 25 bp, E. coli
agctggacggcgacgtaaacggcca

SEQ ID NO: 1638 - DNA, 25 bp, E. coli
agctggacggcgtcgtaaacggcca

SEQ ID NO: 1639 - DNA, 25 bp, E. coli
aacgagaagcgcgatcacatggtcc

SEQ ID NO: 1640 - DNA, 25 bp, E. coli
aacgagaagcgccatcacatggtcc

SEQ ID NO: 1641 - DNA, 25 bp, E. coli
tctcggcatggaggagctgtacaag

SEQ ID NO: 1642 - DNA, 25 bp, E. coli
tctcggcatggacgagctgtacaag

SEQ ID NO: 1643 - DNA, 25 bp, E. coli
cctgagcaaagagcccaacgagaag

SEQ ID NO: 1644 - DNA, 25 bp, E. coli
ccgggatcactctcggcatggacga

SEQ ID NO: 1645 - DNA, 25 bp, E. coli
cctgagcaaagaccccaacgagaag

SEQ ID NO: 1646 - DNA, 25 bp, E. coli
ccgggatcactcacggcatggacga

SEQ ID NO: 1647 - DNA, 25 bp, E. coli
ctgaagttcatctgcaccaccggca

SEQ ID NO: 1648 - DNA, 25 bp, E. coli
ctgaagttcatcagcaccaccggca

SEQ ID NO: 1649 - DNA, 25 bp, E. coli
tggtgcccatcctggtcgagctgga

SEQ ID NO: 1650 - DNA, 25 bp, E. coli
tggtgcccatccaggtcgagctgga

SEQ ID NO: 1651 - DNA, 25 bp, E. coli
ggcgatgccaccaacggcaagctga

SEQ ID NO: 1652 - DNA, 25 bp, E. coli
ggcgatgccacctacggcaagctga

SEQ ID NO: 1653 - DNA, 25 bp, E. coli
taaacggccacaagttcagcgtgtc

SEQ ID NO: 1654 - DNA, 25 bp, E. coli
taaacggccacatgttcagcgtgtc

SEQ ID NO: 1655 - DNA, 25 bp, E. coli
cagaaggccgagaaggaagtgtcca

SEQ ID NO: 1656 - DNA, 25 bp, E. coli
cagaaggccgagtaggaagtgtcca

SEQ ID NO: 1657 - DNA, 25 bp, E. coli
tttggctggagcagatactggcctc

SEQ ID NO: 1658 - DNA, 25 bp, E. coli
tttggctggagctgatactggcctc

SEQ ID NO: 1659 - DNA, 25 bp, E. coli
tgaagacctcctctggccctgatgt

SEQ ID NO: 1660 - DNA, 25 bp, E. coli
tgcaatttatgctgcccggcgaaag

SEQ ID NO: 1661 - DNA, 25 bp, E. coli
tgaagacctcctgtggccctgatgt

SEQ ID NO: 1662 - DNA, 25 bp, E. coli
tgcaatttatgcagcccggcgaaag

SEQ ID NO: 1663 - DNA, 25 bp, E. coli
tcttcagtggaagcgaggaccctgg

SEQ ID NO: 1664 - DNA, 25 bp, E. coli
tcttcagtggaaccgaggaccctgg

SEQ ID NO: 1665 - DNA, 25 bp, E. coli
gacagttccgcgaatgcatcatgca

SEQ ID NO: 1666 - DNA, 25 bp, E. coli
gacagttccgcgtatgcatcatgca

SEQ ID NO: 1667 - DNA, 25 bp, E. coli
ccctcgatgggtctacaatgttgca

SEQ ID NO: 1668 - DNA, 25 bp, E. coli
ccggcgaaagggtgatgaaaccaca

SEQ ID NO: 1669 - DNA, 25 bp, E. coli
ccggcgaaagggagatgaaaccaca

SEQ ID NO: 1670 - DNA, 25 bp, E. coli
ccctcgatgggtgtacaatgttgca

SEQ ID NO: 1671 - DNA, 25 bp, E. coli
ggagagactctgtttgccagcacaa

SEQ ID NO: 1672 - DNA, 25 bp, E. coli
tggccacggccatattcaagaagct

SEQ ID NO: 1673 - DNA, 25 bp, E. coli
ggagagactctgattgccagcacaa

SEQ ID NO: 1674 - DNA, 25 bp, E. coli
tggccacggccaaattcaagaagct

SEQ ID NO: 1675 - DNA, 25 bp, E. coli
gaggtgtccacaaccaaaacagaag

SEQ ID NO: 1676 - DNA, 25 bp, E. coli
gaggtgtccacatccaaaacagaag

SEQ ID NO: 1677 - DNA, 25 bp, E. coli
tacggatcgacattcgagggcctgc

SEQ ID NO: 1678 - DNA, 25 bp, E. coli
tactttatgctggtgatccgggcca

SEQ ID NO: 1679 - DNA, 25 bp, E. coli
tactttatgctgctgatccgggcca

SEQ ID NO: 1680 - DNA, 25 bp, E. coli
tacggatcgacaatcgagggcctgc

SEQ ID NO: 1681 - DNA, 25 bp, E. coli
taccgggagtgcaagtttctgtcga

SEQ ID NO: 1682 - DNA, 25 bp, E. coli
taccgggagtgctagtttctgtcga

SEQ ID NO: 1683 - DNA, 25 bp, E. coli
tttctgagccgcgagatcctatggg

SEQ ID NO: 1684 - DNA, 25 bp, E. coli
tttctgagccgccagatcctatggg

SEQ ID NO: 1685 - DNA, 25 bp, E. coli
tgctagatacctggaacgaggacct

SEQ ID NO: 1686 - DNA, 25 bp, E. coli
tgctagatacctcgaacgaggacct

SEQ ID NO: 1687 - DNA, 25 bp, E. coli
tgatgcggcccgatctgttcgacgg

SEQ ID NO: 1688 - DNA, 25 bp, E. coli
tgatgcggcccgttctgttcgacgg

SEQ ID NO: 1689 - DNA, 25 bp, E. coli
ccattaccgacgacagcctgggaga

SEQ ID NO: 1690 - DNA, 25 bp, E. coli
ccattaccgacgtcagcctgggaga

SEQ ID NO: 1691 - DNA, 25 bp, E. coli
gacgacttcgacatggagatgctgg

SEQ ID NO: 1692 - DNA, 25 bp, E. coli
gacgacttcgacttggagatgctgg

SEQ ID NO: 1693 - DNA, 25 bp, E. coli
gactgcgggagcaaaaccacattcg

SEQ ID NO: 1694 - DNA, 25 bp, E. coli
gactgcgggagctaaaccacattcg

SEQ ID NO: 1695 - DNA, 25 bp, E. coli
cccgcgctgtgttccatgctagata

SEQ ID NO: 1696 - DNA, 25 bp, E. coli
cccgcgctgtgtaccatgctagata

SEQ ID NO: 1697 - DNA, 25 bp, E. coli
gacgagctgcctacgtactacgagg

SEQ ID NO: 1698 - DNA, 25 bp, E. coli
gacgagctgccttcgtactacgagg

SEQ ID NO: 1699 - DNA, 25 bp, E. coli
cagctattctgattacacccgaggg

SEQ ID NO: 1700 - DNA, 25 bp, E. coli
cagaatcgtcgtttgcagtgaaaac

SEQ ID NO: 1701 - DNA, 25 bp, E. coli
cagaatcgtcgtatgcagtgaaaac

SEQ ID NO: 1702 - DNA, 25 bp, E. coli
cagctattctgaatacacccgaggg

SEQ ID NO: 1703 - DNA, 25 bp, E. coli
tacgtcgccagtgaagtaacaaccg

SEQ ID NO: 1704 - DNA, 25 bp, E. coli
tatttatcggagttgcagttgcgcc

SEQ ID NO: 1705 - DNA, 25 bp, E. coli
tatttatcggagatgcagttgcgcc

SEQ ID NO: 1706 - DNA, 25 bp, E. coli
ttttggagcacgcaaagacgatgac

SEQ ID NO: 1707 - DNA, 25 bp, E. coli
ttatgtaaacaaaccggaagcgacc

SEQ ID NO: 1708 - DNA, 25 bp, E. coli
ttttggagcacggaaagacgatgac

SEQ ID NO: 1709 - DNA, 25 bp, E. coli
ttatgtaaacaatccggaagcgacc

SEQ ID NO: 1710 - DNA, 25 bp, E. coli
tgcgcccgcgaacgacatttataat

SEQ ID NO: 1711 - DNA, 25 bp, E. coli
tgcgcccgcgaaggacatttataat

SEQ ID NO: 1712 - DNA, 25 bp, E. coli
tctggagacataccttactgggacg

SEQ ID NO: 1713 - DNA, 25 bp, E. coli
tctggataccgggaaaacgctgggc

SEQ ID NO: 1714 - DNA, 25 bp, E. coli
tctggataccggcaaaacgctgggc

SEQ ID NO: 1715 - DNA, 25 bp, E. coli
tctggagacatagcttactgggacg

SEQ ID NO: 1716 - DNA, 25 bp, E. coli
ccagggatttcactcgatgtacacg

SEQ ID NO: 1717 - DNA, 25 bp, E. coli
ccagggatttcagtcgatgtacacg

SEQ ID NO: 1718 - DNA, 25 bp, E. coli
tacgtcgccagtcaagtaacaaccg

SEQ ID NO: 1719 - DNA, 25 bp, E. coli
gagatacgccctcgttcctggaaca

SEQ ID NO: 1720 - DNA, 25 bp, E. coli
gagatacgccctggttcctggaaca

SEQ ID NO: 1721 - DNA, 25 bp, E. coli
cagctgacatctggccttgttaaag

SEQ ID NO: 1722 - DNA, 25 bp, E. coli
cagctgacatctcgccttgttaaag

SEQ ID NO: 1723 - DNA, 25 bp, E. coli
catgggaactcctcagcaatggtca

SEQ ID NO: 1724 - DNA, 25 bp, E. coli
catgggaactccacagcaatggtca

SEQ ID NO: 1725 - DNA, 25 bp, E. coli
atcaccattcttttcgccgatagcg

SEQ ID NO: 1726 - DNA, 25 bp, E. coli
atcaccattcttatcgccgatagcg

SEQ ID NO: 1727 - DNA, 25 bp, E. coli
tatcgtcagttctgcgagaggctgg

SEQ ID NO: 1728 - DNA, 25 bp, E. coli
tatcgtcagttcagcgagaggctgg

SEQ ID NO: 1729 - DNA, 25 bp, E. coli
tggtcattgcaggaacaaaaacagc

SEQ ID NO: 1730 - DNA, 25 bp, E. coli
tggtcattgcagcaacaaaaacagc

SEQ ID NO: 1731 - DNA, 25 bp, E. coli
gaagaccctatttacacttgacgat

SEQ ID NO: 1732 - DNA, 25 bp, E. coli
gcagcgagcacagaaatcgatgact

SEQ ID NO: 1733 - DNA, 25 bp, E. coli
gcagcgagcacacaaatcgatgact

SEQ ID NO: 1734 - DNA, 25 bp, E. coli
gaagaccctattaacacttgacgat

SEQ ID NO: 1735 - DNA, 25 bp, E. coli
gacgtactttcaccggttaagcagg

SEQ ID NO: 1736 - DNA, 25 bp, E. coli
gacgtactttcagcggttaagcagg

SEQ ID NO: 1737 - DNA, 25 bp, E. coli
ccgatagcgctatctaatagaggca

SEQ ID NO: 1738 - DNA, 25 bp, E. coli
ccgatagcgctaactaatagaggca

SEQ ID NO: 1739 - DNA, 25 bp, E. coli
tggaagatctcaacgatatccccgt

SEQ ID NO: 1740 - DNA, 25 bp, E. coli
tggaagatctcatcgatatccccgt

SEQ ID NO: 1741 - DNA, 25 bp, E. coli
taagcaggaaaacatcgcagcgagc

SEQ ID NO: 1742 - DNA, 25 bp, E. coli
taagcaggaaaagatcgcagcgagc

SEQ ID NO: 1743 - DNA, 25 bp, E. coli
caaaacattggcttgattgcggcaa

SEQ ID NO: 1744 - DNA, 25 bp, E. coli
caaaacattggcatgattgcggcaa

SEQ ID NO: 1745 - DNA, 25 bp, E. coli
cagtttgcctatcgatgagctacca

SEQ ID NO: 1746 - DNA, 25 bp, E. coli
cagtttgcctatggatgagctacca

SEQ ID NO: 1747 - DNA, 25 bp, E. coli
tatgacatgttagcgcatatccgca

SEQ ID NO: 1748 - DNA, 25 bp, E. coli
tatgacatgttaccgcatatccgca

SEQ ID NO: 1749 - DNA, 25 bp, E. coli
ttgaaagccgtacgccagaaatggc

SEQ ID NO: 1750 - DNA, 25 bp, E. coli
ttgcggcaagtcactcagctcgtgt

SEQ ID NO: 1751 - DNA, 25 bp, E. coli
ttgcggcaagtctctcagctcgtgt

SEQ ID NO: 1752 - DNA, 25 bp, E. coli
ttgaaagccgtaggccagaaatggc

SEQ ID NO: 1753 - DNA, 25 bp, E. coli
tgcttcgagcatcactgggatacct

SEQ ID NO: 1754 - DNA, 25 bp, E. coli
tgcttcgagcatgactgggatacct

SEQ ID NO: 1755 - DNA, 25 bp, E. coli
gaattcaccatgacgacgggcaaaa

SEQ ID NO: 1756 - DNA, 25 bp, E. coli
gaattcaccatgtcgacgggcaaaa

SEQ ID NO: 1757 - DNA, 25 bp, E. coli
gattttgaacaactcaccatcgcga

SEQ ID NO: 1758 - DNA, 25 bp, E. coli
gattttgaacaagtcaccatcgcga

SEQ ID NO: 1759 - DNA, 25 bp, E. coli
ggtagctctcatcacttgggcgaaa

SEQ ID NO: 1760 - DNA, 25 bp, E. coli
gtgacacactagtaaaagcgcttgg

SEQ ID NO: 1761 - DNA, 25 bp, E. coli
ggtagctctcatgacttgggcgaaa

SEQ ID NO: 1762 - DNA, 25 bp, E. coli
gtgacacactagaaaaagcgcttgg

SEQ ID NO: 1763 - DNA, 25 bp, E. coli
tggaggcagctttgaaatcgacgtc

SEQ ID NO: 1764 - DNA, 25 bp, E. coli
tggaggcagcttagaaatcgacgtc

SEQ ID NO: 1765 - DNA, 25 bp, E. coli
aagctactgtctactatcgaacaag

SEQ ID NO: 1766 - DNA, 25 bp, E. coli
aagctactgtcttctatcgaacaag

SEQ ID NO: 1767 - DNA, 25 bp, E. coli
tactgtcttctaacgaacaagcatg

SEQ ID NO: 1768 - DNA, 25 bp, E. coli
tactgtcttctatcgaacaagcatg

SEQ ID NO: 1769 - DNA, 25 bp, E. coli
atgaagctactgacttctatcgaac

SEQ ID NO: 1770 - DNA, 25 bp, E. coli
atgaagctactgtcttctatcgaac

SEQ ID NO: 1771 - DNA, 25 bp, E. coli
agctactgtcttctatcgaacaagc

SEQ ID NO: 1772 - DNA, 25 bp, E. coli
agctactgtcttgtatcgaacaagc

SEQ ID NO: 1773 - DNA, 25 bp, E. coli
actgtcttctatcgaacaagcatgc

SEQ ID NO: 1774 - DNA, 25 bp, E. coli
actgtcttctatggaacaagcatgc

SEQ ID NO: 1775 - DNA, 25 bp, E. coli
tgaagctactgtcttctatcgaaca

SEQ ID NO: 1776 - DNA, 25 bp, E. coli
tgaagctactgtgttctatcgaaca

SEQ ID NO: 1777 - DNA, 25 bp, E. coli
gctactgtcttcaatcgaacaagca

SEQ ID NO: 1778 - DNA, 25 bp, E. coli
gctactgtcttctatcgaacaagca

SEQ ID NO: 1779 - DNA, 25 bp, E. coli
gaagctactgtcatctatcgaacaa

SEQ ID NO: 1780 - DNA, 25 bp, E. coli
gaagctactgtcttctatcgaacaa

SEQ ID NO: 1781 - DNA, 25 bp, E. coli
ctactgtcttctatcgaacaagcat

SEQ ID NO: 1782 - DNA, 25 bp, E. coli
ctactgtcttctttcgaacaagcat

SEQ ID NO: 1783 - DNA, 25 bp, E. coli
acggttgccaatgcggtaggtgcca

SEQ ID NO: 1784 - DNA, 25 bp, E. coli
acggttgccaatccggtaggtgcca

SEQ ID NO: 1785 - DNA, 25 bp, E. coli
agtcagccgtcgcagtaatttcgaa

SEQ ID NO: 1786 - DNA, 25 bp, E. coli
agtcagccgtcggagtaatttcgaa

SEQ ID NO: 1787 - DNA, 25 bp, E. coli
tattaccagccactttgaagtgcgt

SEQ ID NO: 1788 - DNA, 25 bp, E. coli
tattaccagccagtttgaagtgcgt

SEQ ID NO: 1789 - DNA, 25 bp, E. coli
ttgaagtaccgtacctgctggtggg

SEQ ID NO: 1790 - DNA, 25 bp, E. coli
tttttcgccaaaacggatgcgccct

SEQ ID NO: 1791 - DNA, 25 bp, E. coli
ttgaagtaccgttcctgctggtggg

SEQ ID NO: 1792 - DNA, 25 bp, E. coli
tttttcgccaaatcggatgcgccct

SEQ ID NO: 1793 - DNA, 25 bp, E. coli
tgctttctgacatactcgggctgcg

SEQ ID NO: 1794 - DNA, 25 bp, E. coli
tgaaagcatcggtttccagggcgct

SEQ ID NO: 1795 - DNA, 25 bp, E. coli
tgaaagcatcggattccagggcgct

SEQ ID NO: 1796 - DNA, 25 bp, E. coli
tgctttctgacaaactcgggctgcg

SEQ ID NO: 1797 - DNA, 25 bp, E. coli
tcgggctgcgcatatacctgctgtg

SEQ ID NO: 1798 - DNA, 25 bp, E. coli
tcgggctgcgcaaatacctgctgtg

SEQ ID NO: 1799 - DNA, 25 bp, E. coli
gcttctttaagcaactggcgatgat

SEQ ID NO: 1800 - DNA, 25 bp, E. coli
gcttctttaagctactggcgatgat

SEQ ID NO: 1801 - DNA, 25 bp, E. coli
gatcattaatcggatcggtgggaaa

SEQ ID NO: 1802 - DNA, 25 bp, E. coli
gatcattaatcgcatcggtgggaaa

SEQ ID NO: 1803 - DNA, 25 bp, E. coli
taatttcgaatttggtcgcgcgcgg

SEQ ID NO: 1804 - DNA, 25 bp, E. coli
taatttcgaattaggtcgcgcgcgg

SEQ ID NO: 1805 - DNA, 25 bp, E. coli
tgatgcggtgctgattacgaccgct

SEQ ID NO: 1806 - DNA, 25 bp, E. coli
tgtgcggcgagttgcgtgactacct

SEQ ID NO: 1807 - DNA, 25 bp, E. coli
tgtgcggcgagtagcgtgactacct

SEQ ID NO: 1808 - DNA, 25 bp, E. coli
tgatgcggtgctcattacgaccgct

SEQ ID NO: 1809 - DNA, 25 bp, E. coli
tcgctccacaaggtaaacagttgat

SEQ ID NO: 1810 - DNA, 25 bp, E. coli
tcgctccacaagctaaacagttgat

SEQ ID NO: 1811 - DNA, 25 bp, E. coli
gcaactctggctcacagtacgcgta

SEQ ID NO: 1812 - DNA, 25 bp, E. coli
gcaactctggctgacagtacgcgta

SEQ ID NO: 1813 - DNA, 25 bp, E. coli
gaaaacctcagtctgacgctccccg

SEQ ID NO: 1814 - DNA, 25 bp, E. coli
gaaaacctcagtgtgacgctccccg

SEQ ID NO: 1815 - DNA, 25 bp, E. coli
cgagttgcgtgagtacctacgggta

SEQ ID NO: 1816 - DNA, 25 bp, E. coli
cgagttgcgtgactacctacgggta

SEQ ID NO: 1817 - DNA, 25 bp, E. coli
ctacctggagagtcgcgcccgctga

SEQ ID NO: 1818 - DNA, 25 bp, E. coli
gcgtgactacctacgggtaacagtt

SEQ ID NO: 1819 - DNA, 25 bp, E. coli
ctgaagttcagatgtgcggcgagtt

SEQ ID NO: 1820 - DNA, 25 bp, E. coli
gcgtgactaccttcgggtaacagtt

SEQ ID NO: 1821 - DNA, 25 bp, E. coli
ctacctggagagacgcgcccgctga

SEQ ID NO: 1822 - DNA, 25 bp, E. coli
ctgaagttcagaagtgcggcgagtt

SEQ ID NO: 1823 - DNA, 25 bp, E. coli
tggctttcgctagctggagagacgc

SEQ ID NO: 1824 - DNA, 25 bp, E. coli
tggctttcgctacctggagagacgc

SEQ ID NO: 1825 - DNA, 25 bp, E. coli
taacagtttctttatggcagggtga

SEQ ID NO: 1826 - DNA, 25 bp, E. coli
taacagtttcttaatggcagggtga

SEQ ID NO: 1827 - DNA, 25 bp, E. coli
aatgagggcatcgttcccactgcga

SEQ ID NO: 1828 - DNA, 25 bp, E. coli
aatgagggcatccttcccactgcga

SEQ ID NO: 1829 - DNA, 25 bp, E. coli
caaattcagccgatagcggaacggg

SEQ ID NO: 1830 - DNA, 25 bp, E. coli
caaattcagccgttagcggaacggg

SEQ ID NO: 1831 - DNA, 25 bp, E. coli
cattgggtcaccagcaaatcgcgct

SEQ ID NO: 1832 - DNA, 25 bp, E. coli
cagtcgttgctgtttggcgttgcca

SEQ ID NO: 1833 - DNA, 25 bp, E. coli
cagtcgttgctgattggcgttgcca

SEQ ID NO: 1834 - DNA, 25 bp, E. coli
aaatctcgcgccgatcaactgggtg

SEQ ID NO: 1835 - DNA, 25 bp, E. coli
aaatctcgcgcccatcaactgggtg

SEQ ID NO: 1836 - DNA, 25 bp, E. coli
tatacgatgtcggagagtatgccgg

SEQ ID NO: 1837 - DNA, 25 bp, E. coli
tatacgatgtcgcagagtatgccgg

SEQ ID NO: 1838 - DNA, 25 bp, E. coli
ttttctcccatgtagacggtacgcg

SEQ ID NO: 1839 - DNA, 25 bp, E. coli
ttttctcccatgaagacggtacgcg

SEQ ID NO: 1840 - DNA, 25 bp, E. coli
tgcacaatcttctcgcgcaacgcgt

SEQ ID NO: 1841 - DNA, 25 bp, E. coli
tgcacaatcttcacgcgcaacgcgt

SEQ ID NO: 1842 - DNA, 25 bp, E. coli
gaattacattcccaaccgcgtggca

SEQ ID NO: 1843 - DNA, 25 bp, E. coli
gaattacattccgaaccgcgtggca

SEQ ID NO: 1844 - DNA, 25 bp, E. coli
cattaagttctgactcggcgcgtct

SEQ ID NO: 1845 - DNA, 25 bp, E. coli
cggcgatggcggagctgaattacat

SEQ ID NO: 1846 - DNA, 25 bp, E. coli
cattaagttctgtctcggcgcgtct

SEQ ID NO: 1847 - DNA, 25 bp, E. coli
cggcgatggcggtgctgaattacat

SEQ ID NO: 1848 - DNA, 25 bp, E. coli
cattgggtcacctgcaaatcgcgct

SEQ ID NO: 1849 - DNA, 25 bp, E. coli
aatgaagaagttccctccaggcgaa

SEQ ID NO: 1850 - DNA, 25 bp, E. coli
aatgaagaagttgcctccaggcgaa

SEQ ID NO: 1851 - DNA, 25 bp, E. coli
catggaatctctcacaaccggtagg

SEQ ID NO: 1852 - DNA, 25 bp, E. coli
catggaatctctgacaaccggtagg

SEQ ID NO: 1853 - DNA, 25 bp, E. coli
tatgaagctcgttagcgtcgttacc

SEQ ID NO: 1854 - DNA, 25 bp, E. coli
tagttccaccagatcgtcaagctgc

SEQ ID NO: 1855 - DNA, 25 bp, E. coli
tagttccaccagttcgtcaagctgc

SEQ ID NO: 1856 - DNA, 25 bp, E. coli
tagtttcaatgatctggcggcagag

SEQ ID NO: 1857 - DNA, 25 bp, E. coli
tatgaagctcgtaagcgtcgttacc

SEQ ID NO: 1858 - DNA, 25 bp, E. coli
tagtttcaatgaactggcggcagag

SEQ ID NO: 1859 - DNA, 25 bp, E. coli
tataataataggtagattgcccgag

SEQ ID NO: 1860 - DNA, 25 bp, E. coli
tatagcgtctgggatgtatgtcggc

SEQ ID NO: 1861 - DNA, 25 bp, E. coli
tataataataggaagattgcccgag

SEQ ID NO: 1862 - DNA, 25 bp, E. coli
tatagcgtctggcatgtatgtcggc

SEQ ID NO: 1863 - DNA, 25 bp, E. coli
tccaggcgaacaagaagtagagaca

SEQ ID NO: 1864 - DNA, 25 bp, E. coli
tccaggcgaacatgaagtagagaca

SEQ ID NO: 1865 - DNA, 25 bp, E. coli
tcttcacaagaagcaagtcaggctg

SEQ ID NO: 1866 - DNA, 25 bp, E. coli
tcttcacaagaaccaagtcaggctg

SEQ ID NO: 1867 - DNA, 25 bp, E. coli
gattctagcgcacaagattccagcg

SEQ ID NO: 1868 - DNA, 25 bp, E. coli
gattctagcgcagaagattccagcg

SEQ ID NO: 1869 - DNA, 25 bp, E. coli
tcactgagggccgtaaagcggttcc

SEQ ID NO: 1870 - DNA, 25 bp, E. coli
tcactgagggccctaaagcggttcc

SEQ ID NO: 1871 - DNA, 25 bp, E. coli
taaagctggcacatagaattccacg

SEQ ID NO: 1872 - DNA, 25 bp, E. coli
taaagctggcacttagaattccacg

SEQ ID NO: 1873 - DNA, 25 bp, E. coli
aaactagctagaccgagaaagagac

SEQ ID NO: 1874 - DNA, 25 bp, E. coli
aaactagctagagcgagaaagagac

SEQ ID NO: 1875 - DNA, 25 bp, E. coli
tattatccgatgtgacgctgcagct

SEQ ID NO: 1876 - DNA, 25 bp, E. coli
tattgatccagcacagcaaaggcag

SEQ ID NO: 1877 - DNA, 25 bp, E. coli
tattgatccagctcagcaaaggcag

SEQ ID NO: 1878 - DNA, 25 bp, E. coli
tattatccgatgagacgctgcagct

SEQ ID NO: 1879 - DNA, 25 bp, E. coli
tgtacgatacacatccgctcaggtc

SEQ ID NO: 1880 - DNA, 25 bp, E. coli
tgtacgatacacttccgctcaggtc

SEQ ID NO: 1881 - DNA, 25 bp, E. coli
tgaattttgaacttccgaacctggg

SEQ ID NO: 1882 - DNA, 25 bp, E. coli
tgaattttgaacatccgaacctggg

SEQ ID NO: 1883 - DNA, 25 bp, E. coli
tcaggtccttgtcctttaacgaggc

SEQ ID NO: 1884 - DNA, 25 bp, E. coli
tcaggtccttgtgctttaacgaggc

SEQ ID NO: 1885 - DNA, 25 bp, E. coli
gcaaaaggcactactacaatggctg

SEQ ID NO: 1886 - DNA, 25 bp, E. coli
gaattccacggagtatagactatac

SEQ ID NO: 1887 - DNA, 25 bp, E. coli
gcaaaaggcacttctacaatggctg

SEQ ID NO: 1888 - DNA, 25 bp, E. coli
gaattccacggactatagactatac

SEQ ID NO: 1889 - DNA, 25 bp, E. coli
gaatacgctttgtggagatacagcc

SEQ ID NO: 1890 - DNA, 25 bp, E. coli
gaatacgctttgaggagatacagcc

SEQ ID NO: 1891 - DNA, 25 bp, E. coli
gatgtgtctactatcaggcgggtct

SEQ ID NO: 1892 - DNA, 25 bp, E. coli
gatgtgtctactttcaggcgggtct

SEQ ID NO: 1893 - DNA, 25 bp, E. coli
tactgaatacagacgacacaccggt

SEQ ID NO: 1894 - DNA, 25 bp, E. coli
tactgaatacagtcgacacaccggt

SEQ ID NO: 1895 - DNA, 25 bp, E. coli
tatgcagcacttgcaacctatggtg

SEQ ID NO: 1896 - DNA, 25 bp, E. coli
tatgcagcacttccaacctatggtg

SEQ ID NO: 1897 - DNA, 25 bp, E. coli
tataggagatcacgagctaccgcct

SEQ ID NO: 1898 - DNA, 25 bp, E. coli
tataggagatcaggagctaccgcct

SEQ ID NO: 1899 - DNA, 25 bp, E. coli
tttaacggaacatgatgcggaggcg

SEQ ID NO: 1900 - DNA, 25 bp, E. coli
ttcaatctcaggcaaccgtaaaggt

SEQ ID NO: 1901 - DNA, 25 bp, E. coli
ttcaatctcagggaaccgtaaaggt

SEQ ID NO: 1902 - DNA, 25 bp, E. coli
tttaacggaacaagatgcggaggcg

SEQ ID NO: 1903 - DNA, 25 bp, E. coli
tgtcaagcatatagggcatctggcc

SEQ ID NO: 1904 - DNA, 25 bp, E. coli
tgtcaagcatattgggcatctggcc

SEQ ID NO: 1905 - DNA, 25 bp, E. coli
tgaagcggaagatcaaactgaggcg

SEQ ID NO: 1906 - DNA, 25 bp, E. coli
tgaagcggaagaacaaactgaggcg

SEQ ID NO: 1907 - DNA, 25 bp, E. coli
tcagttaaaggcgaccatcggagag

SEQ ID NO: 1908 - DNA, 25 bp, E. coli
tcagttaaaggccaccatcggagag

SEQ ID NO: 1909 - DNA, 25 bp, E. coli
gattggcctgatgctgcactagtgt

SEQ ID NO: 1910 - DNA, 25 bp, E. coli
gattggcctgatcctgcactagtgt

SEQ ID NO: 1911 - DNA, 25 bp, E. coli
taatgtaaaaggcacgctaaaccgc

SEQ ID NO: 1912 - DNA, 25 bp, E. coli
taatgtaaaagggacgctaaaccgc

SEQ ID NO: 1913 - DNA, 25 bp, E. coli
gagcagcatatttcagccgtatggg

SEQ ID NO: 1914 - DNA, 25 bp, E. coli
gagcagcatattacagccgtatggg

SEQ ID NO: 1915 - DNA, 25 bp, E. coli
aataggaccggctattcttcaagca

SEQ ID NO: 1916 - DNA, 25 bp, E. coli
aataggaccggcaattcttcaagca

SEQ ID NO: 1917 - DNA, 25 bp, E. coli
cacatatacttcattagcgcaaggg

SEQ ID NO: 1918 - DNA, 25 bp, E. coli
caaagacaagcgttagtaggcacat

SEQ ID NO: 1919 - DNA, 25 bp, E. coli
caaagacaagcgatagtaggcacat

SEQ ID NO: 1920 - DNA, 25 bp, E. coli
cacatatacttctttagcgcaaggg

SEQ ID NO: 1921 - DNA, 25 bp, E. coli
taacggaacagctatcaagagagcc

SEQ ID NO: 1922 - DNA, 25 bp, E. coli
ataagcgtgcttctgccgtggccag

SEQ ID NO: 1923 - DNA, 25 bp, E. coli
ataagcgtgcttgtgccgtggccag

SEQ ID NO: 1924 - DNA, 25 bp, E. coli
tctttcaatgaagggcctaacggag

SEQ ID NO: 1925 - DNA, 25 bp, E. coli
tctaagtgagggagaaagcatctgg

SEQ ID NO: 1926 - DNA, 25 bp, E. coli
tctttcaatgaacggcctaacggag

SEQ ID NO: 1927 - DNA, 25 bp, E. coli
tctaagtgagggtgaaagcatctgg

SEQ ID NO: 1928 - DNA, 25 bp, E. coli
gaaggaagcatacgataccccgcat

SEQ ID NO: 1929 - DNA, 25 bp, E. coli
gaaggaagcataggataccccgcat

SEQ ID NO: 1930 - DNA, 25 bp, E. coli
ggccaggacaacgtatactcatcag

SEQ ID NO: 1931 - DNA, 25 bp, E. coli
ggccaggacaacctatactcatcag

SEQ ID NO: 1932 - DNA, 25 bp, E. coli
taatccagtgtttagtgacagagac

SEQ ID NO: 1933 - DNA, 25 bp, E. coli
taatccaattgaggagtggcagcat

SEQ ID NO: 1934 - DNA, 25 bp, E. coli
taacggaacagcaatcaagagagcc

SEQ ID NO: 1935 - DNA, 25 bp, E. coli
taatccaattgacgagtggcagcat

SEQ ID NO: 1936 - DNA, 25 bp, E. coli
taatccagtgttaagtgacagagac

SEQ ID NO: 1937 - DNA, 25 bp, E. coli
catatcactcactttggtgatttca

SEQ ID NO: 1938 - DNA, 25 bp, E. coli
catatcactcacattggtgatttca

SEQ ID NO: 1939 - DNA, 25 bp, E. coli
tatccgaaacatttcactcactttg

SEQ ID NO: 1940 - DNA, 25 bp, E. coli
tatccgaaacatatcactcactttg

SEQ ID NO: 1941 - DNA, 25 bp, E. coli
tgttatccgaaagatatcactcact

SEQ ID NO: 1942 - DNA, 25 bp, E. coli
tgttatccgaaacatatcactcact

SEQ ID NO: 1943 - DNA, 25 bp, E. coli
tccgaaacatatcactcactttggt

SEQ ID NO: 1944 - DNA, 25 bp, E. coli
tccgaaacatatgactcactttggt

SEQ ID NO: 1945 - DNA, 25 bp, E. coli
ccgaaacatatctctcactttggtg

SEQ ID NO: 1946 - DNA, 25 bp, E. coli
gaaacatatcacacactttggtgat

SEQ ID NO: 1947 - DNA, 25 bp, E. coli
gaaacatatcactcactttggtgat

SEQ ID NO: 1948 - DNA, 25 bp, E. coli
ccgaaacatatcactcactttggtg

SEQ ID NO: 1949 - DNA, 25 bp, E. coli
gttatccgaaacttatcactcactt

SEQ ID NO: 1950 - DNA, 25 bp, E. coli
gatttcaccgtatctgtctatgatt

SEQ ID NO: 1951 - DNA, 25 bp, E. coli
gatttcaccgtaactgtctatgatt

SEQ ID NO: 1952 - DNA, 25 bp, E. coli
gttatccgaaacatatcactcactt

SEQ ID NO: 1953 - DNA, 25 bp, E. coli
ggtgatttcaccctaactgtctatg

SEQ ID NO: 1954 - DNA, 25 bp, E. coli
gtgatttcaccgtaactgtctatga

SEQ ID NO: 1955 - DNA, 25 bp, E. coli
gtgatttcaccgaaactgtctatga

SEQ ID NO: 1956 - DNA, 25 bp, E. coli
ggtgatttcaccgtaactgtctatg

SEQ ID NO: 1957 - DNA, 25 bp, E. coli
tcaccgtaactgactatgattaatg

SEQ ID NO: 1958 - DNA, 25 bp, E. coli
tcaccgtaactgtctatgattaatg

SEQ ID NO: 1959 - DNA, 25 bp, E. coli
cacaaggccctgtagctgaaggacg

SEQ ID NO: 1960 - DNA, 25 bp, E. coli
cacaaggccctgaagctgaaggacg

SEQ ID NO: 1961 - DNA, 25 bp, E. coli
cagaccgccaagctgaaggtgacca

SEQ ID NO: 1962 - DNA, 25 bp, E. coli
catctacatggcgaagaagcccgtg

SEQ ID NO: 1963 - DNA, 25 bp, E. coli
catctacatggccaagaagcccgtg

SEQ ID NO: 1964 - DNA, 25 bp, E. coli
cagaccgccaaggtgaaggtgacca

SEQ ID NO: 1965 - DNA, 25 bp, E. coli
tacaccatcgtggagcagtacgagc

SEQ ID NO: 1966 - DNA, 25 bp, E. coli
tacggctccaagctgtacgtgaagc

SEQ ID NO: 1967 - DNA, 25 bp, E. coli
tacaagaagctgaccttccccgagg

SEQ ID NO: 1968 - DNA, 25 bp, E. coli
tacaccatcgtgcagcagtacgagc

SEQ ID NO: 1969 - DNA, 25 bp, E. coli
tacaagaagctgtccttccccgagg

SEQ ID NO: 1970 - DNA, 25 bp, E. coli
tacggctccaaggtgtacgtgaagc

SEQ ID NO: 1971 - DNA, 25 bp, E. coli
gacggccccgtaatgcagaagaaga

SEQ ID NO: 1972 - DNA, 25 bp, E. coli
gaacggccacgacttcgagatcgag

SEQ ID NO: 1973 - DNA, 25 bp, E. coli
gaacggccacgagttcgagatcgag

SEQ ID NO: 1974 - DNA, 25 bp, E. coli
ccgaggacgtcatcaaggagttcat

SEQ ID NO: 1975 - DNA, 25 bp, E. coli
ccgaggacgtcaacaaggagttcat

SEQ ID NO: 1976 - DNA, 25 bp, E. coli
tactacgtggacaccaagctggaca

SEQ ID NO: 1977 - DNA, 25 bp, E. coli
tactacgtggactccaagctggaca

SEQ ID NO: 1978 - DNA, 25 bp, E. coli
gacggctgcttcatctacaaggtga

SEQ ID NO: 1979 - DNA, 25 bp, E. coli
gacggccccgtattgcagaagaaga

SEQ ID NO: 1980 - DNA, 25 bp, E. coli
gacggctgcttcttctacaaggtga

SEQ ID NO: 1981 - DNA, 25 bp, E. coli
caccgatggtggcagaatgctgatc

SEQ ID NO: 1982 - DNA, 25 bp, E. coli
caccgatggtgggagaatgctgatc

SEQ ID NO: 1983 - DNA, 25 bp, E. coli
aacatgctgcactggagatctggcc

SEQ ID NO: 1984 - DNA, 25 bp, E. coli
aacatgctgcacaggagatctggcc

SEQ ID NO: 1985 - DNA, 25 bp, E. coli
tgtgaagaccatgcaacagcacctg

SEQ ID NO: 1986 - DNA, 25 bp, E. coli
tgtggatgccacctctgatgaagtc

SEQ ID NO: 1987 - DNA, 25 bp, E. coli
tgtggatgccacgtctgatgaagtc

SEQ ID NO: 1988 - DNA, 25 bp, E. coli
tgtgaagaccatccaacagcacctg

SEQ ID NO: 1989 - DNA, 25 bp, E. coli
tgaacacacctggaagatgctcctg

SEQ ID NO: 1990 - DNA, 25 bp, E. coli
tgaacacacctgcaagatgctcctg

SEQ ID NO: 1991 - DNA, 25 bp, E. coli
tctggtgtggctcatgaccccaaca

SEQ ID NO: 1992 - DNA, 25 bp, E. coli
tcagaaagaatggtgtggctgcccc

SEQ ID NO: 1993 - DNA, 25 bp, E. coli
tcagaaagaatgctgtggctgcccc

SEQ ID NO: 1994 - DNA, 25 bp, E. coli
tctggtgtggctgatgaccccaaca

SEQ ID NO: 1995 - DNA, 25 bp, E. coli
gaacctgaggatctgagggactacc

SEQ ID NO: 1996 - DNA, 25 bp, E. coli
gaatcagagtgaaggacatctcccg

SEQ ID NO: 1997 - DNA, 25 bp, E. coli
gaatcagagtgatggacatctcccg

SEQ ID NO: 1998 - DNA, 25 bp, E. coli
gaacctgaggatgtgagggactacc

SEQ ID NO: 1999 - DNA, 25 bp, E. coli
gacatgttcagggacaggcaggcct

SEQ ID NO: 2000 - DNA, 25 bp, E. coli
gacatgttcaggcacaggcaggcct

SEQ ID NO: 2001 - DNA, 25 bp, E. coli
cctggaagggatctttgaggccacc

SEQ ID NO: 2002 - DNA, 25 bp, E. coli
cctggaagggatgtttgaggccacc

SEQ ID NO: 2003 - DNA, 25 bp, E. coli
tacaacagtactccgatgagtggca

SEQ ID NO: 2004 - DNA, 25 bp, E. coli
tacaacagtactgcgatgagtggca

SEQ ID NO: 2005 - DNA, 25 bp, E. coli
tatggcaatgaaagacggtgagctg

SEQ ID NO: 2006 - DNA, 25 bp, E. coli
tatggcaatgaatgacggtgagctg

SEQ ID NO: 2007 - DNA, 25 bp, E. coli
tatacgcaaggcgacaaggtgctga

SEQ ID NO: 2008 - DNA, 25 bp, E. coli
tatacgcaaggccacaaggtgctga

SEQ ID NO: 2009 - DNA, 25 bp, E. coli
tttttcgtctcacccaatccctggg

SEQ ID NO: 2010 - DNA, 25 bp, E. coli
tttttcgtctcagccaatccctggg

SEQ ID NO: 2011 - DNA, 25 bp, E. coli
gctggcgattcacgttcatcatgcc

SEQ ID NO: 2012 - DNA, 25 bp, E. coli
gctggcgattcaggttcatcatgcc

SEQ ID NO: 2013 - DNA, 25 bp, E. coli
gaaacgttttcaacgctctggagtg

SEQ ID NO: 2014 - DNA, 25 bp, E. coli
gaaacgttttcatcgctctggagtg

SEQ ID NO: 2015 - DNA, 25 bp, E. coli
gtgttacggtgataacctggcctat

SEQ ID NO: 2016 - DNA, 25 bp, E. coli
gtgttacggtgaaaacctggcctat

SEQ ID NO: 2017 - DNA, 25 bp, E. coli
tggccaatatggtcaacttcttcgc

SEQ ID NO: 2018 - DNA, 25 bp, E. coli
tggccaatatggacaacttcttcgc

SEQ ID NO: 2019 - DNA, 25 bp, E. coli
gatggcttccatctcggcagaatgc

SEQ ID NO: 2020 - DNA, 25 bp, E. coli
gatggcttccatgtcggcagaatgc

SEQ ID NO: 2021 - DNA, 25 bp, E. coli
gacgatttccggcagtttctacaca

SEQ ID NO: 2022 - DNA, 25 bp, E. coli
gagtgaataccacgacgatttccgg

SEQ ID NO: 2023 - DNA, 25 bp, E. coli
gagtgaataccaggacgatttccgg

SEQ ID NO: 2024 - DNA, 25 bp, E. coli
gacgatttccgggagtttctacaca

SEQ ID NO: 2025 - DNA, 25 bp, E. coli
catcctatggaagtgcctcggtgag

SEQ ID NO: 2026 - DNA, 25 bp, E. coli
catcctatggaactgcctcggtgag

SEQ ID NO: 2027 - DNA, 25 bp, E. coli
aaaagactcacgattcgaggccgcg

SEQ ID NO: 2028 - DNA, 25 bp, E. coli
aaaagactcacgtttcgaggccgcg

SEQ ID NO: 2029 - DNA, 25 bp, E. coli
tatccgtactcctgatgatgcatgg

SEQ ID NO: 2030 - DNA, 25 bp, E. coli
tatccgtactccagatgatgcatgg

SEQ ID NO: 2031 - DNA, 25 bp, E. coli
tataaatgggctcgcgataatgtcg

SEQ ID NO: 2032 - DNA, 25 bp, E. coli
tataaatgggctggcgataatgtcg

SEQ ID NO: 2033 - DNA, 25 bp, E. coli
tttctgaaacatggcaaaggtagcg

SEQ ID NO: 2034 - DNA, 25 bp, E. coli
tttctgaaacatcgcaaaggtagcg

SEQ ID NO: 2035 - DNA, 25 bp, E. coli
tcgctcaggcgcaatcacgaatgaa

SEQ ID NO: 2036 - DNA, 25 bp, E. coli
tcgctcaggcgctatcacgaatgaa

SEQ ID NO: 2037 - DNA, 25 bp, E. coli
gaaaatattgttcatgcgctggcag

SEQ ID NO: 2038 - DNA, 25 bp, E. coli
gaaaatattgttgatgcgctggcag

SEQ ID NO: 2039 - DNA, 25 bp, E. coli
cggattcagtcgtcactcatggtga

SEQ ID NO: 2040 - DNA, 25 bp, E. coli
cggattcagtcgacactcatggtga

SEQ ID NO: 2041 - DNA, 25 bp, E. coli
gattgtatgggatgcccgatgcgcc

SEQ ID NO: 2042 - DNA, 25 bp, E. coli
gattgtatgggaagcccgatgcgcc

SEQ ID NO: 2043 - DNA, 25 bp, E. coli
taagcttttgccattctcaccggat

SEQ ID NO: 2044 - DNA, 25 bp, E. coli
taatggctggccagttgaacaagtc

SEQ ID NO: 2045 - DNA, 25 bp, E. coli
taagcttttgcctttctcaccggat

SEQ ID NO: 2046 - DNA, 25 bp, E. coli
taatggctggcctgttgaacaagtc

SEQ ID NO: 2047 - DNA, 25 bp, E. coli
catattcatatactagagcgggaga

SEQ ID NO: 2048 - DNA, 25 bp, E. coli
caggatttgcttattcagacggtca

SEQ ID NO: 2049 - DNA, 25 bp, E. coli
caggatttgctttttcagacggtca

SEQ ID NO: 2050 - DNA, 25 bp, E. coli
cataaacagtagcagagtggcatca

SEQ ID NO: 2051 - DNA, 25 bp, E. coli
cataaacagtaggagagtggcatca

SEQ ID NO: 2052 - DNA, 25 bp, E. coli
catattcatatagtagagcgggaga

SEQ ID NO: 2053 - DNA, 25 bp, E. coli
tatacgttcgcgttgtacgagcgga

SEQ ID NO: 2054 - DNA, 25 bp, E. coli
tatacaaactagaggcatctgacgc

SEQ ID NO: 2055 - DNA, 25 bp, E. coli
tatacaaactagtggcatctgacgc

SEQ ID NO: 2056 - DNA, 25 bp, E. coli
tatacgttcgcgatgtacgagcgga

SEQ ID NO: 2057 - DNA, 25 bp, E. coli
tattttggaacgaaggatctacaca

SEQ ID NO: 2058 - DNA, 25 bp, E. coli
tattttggaacgtaggatctacaca

SEQ ID NO: 2059 - DNA, 25 bp, E. coli
gaaatagtatcaggctcagctgaca

SEQ ID NO: 2060 - DNA, 25 bp, E. coli
gaaatagtatcacgctcagctgaca

SEQ ID NO: 2061 - DNA, 25 bp, E. coli
gattattaaagcatggtccagacac

SEQ ID NO: 2062 - DNA, 25 bp, E. coli
gattattaaagcttggtccagacac

SEQ ID NO: 2063 - DNA, 25 bp, E. coli
ggcaagaagttcaatacgtacgcga

SEQ ID NO: 2064 - DNA, 25 bp, E. coli
ggcaagaagttctatacgtacgcga

SEQ ID NO: 2065 - DNA, 25 bp, E. coli
taatactgtccaagaaataacgccc

SEQ ID NO: 2066 - DNA, 25 bp, E. coli
taatactgtccatgaaataacgccc

SEQ ID NO: 2067 - DNA, 25 bp, E. coli
gagcatatggaggatcgctgcctac

SEQ ID NO: 2068 - DNA, 25 bp, E. coli
gagcatatggagcatcgctgcctac

SEQ ID NO: 2069 - DNA, 25 bp, E. coli
caactgcatggagatgagtcgtggc

SEQ ID NO: 2070 - DNA, 25 bp, E. coli
cacagaggccgcagaatgtgctcta

SEQ ID NO: 2071 - DNA, 25 bp, E. coli
caactgcatggacatgagtcgtggc

SEQ ID NO: 2072 - DNA, 25 bp, E. coli
cacagaggccgctgaatgtgctcta

SEQ ID NO: 2073 - DNA, 25 bp, E. coli
tatgtgtgcccattagaaagagaac

SEQ ID NO: 2074 - DNA, 25 bp, E. coli
taccaagagttcgtcggtttgccag

SEQ ID NO: 2075 - DNA, 25 bp, E. coli
tatgttagctggtggactgacgcca

SEQ ID NO: 2076 - DNA, 25 bp, E. coli
tatgttagctggaggactgacgcca

SEQ ID NO: 2077 - DNA, 25 bp, E. coli
tatgtgtgcccaatagaaagagaac

SEQ ID NO: 2078 - DNA, 25 bp, E. coli
taccaagagttcctcggtttgccag

SEQ ID NO: 2079 - DNA, 25 bp, E. coli
tataaaaatagttcaggcactccga

SEQ ID NO: 2080 - DNA, 25 bp, E. coli
tttgattcagaagcaggtgggacag

SEQ ID NO: 2081 - DNA, 25 bp, E. coli
tataaaaatagtacaggcactccga

SEQ ID NO: 2082 - DNA, 25 bp, E. coli
tttgattcagaaccaggtgggacag

SEQ ID NO: 2083 - DNA, 25 bp, E. coli
tctagattccgatgctgacttgctg

SEQ ID NO: 2084 - DNA, 25 bp, E. coli
tctagattccgaagctgacttgctg

SEQ ID NO: 2085 - DNA, 25 bp, E. coli
gaaagtttgcgggttgcagagcaca

SEQ ID NO: 2086 - DNA, 25 bp, E. coli
gaaagtttgcggcttgcagagcaca

SEQ ID NO: 2087 - DNA, 25 bp, E. coli
cgatttctgactcggttggaaggca

SEQ ID NO: 2088 - DNA, 25 bp, E. coli
cgatttctgactgggttggaaggca

SEQ ID NO: 2089 - DNA, 25 bp, E. coli
ggcactccgaaatacttggttggcg

SEQ ID NO: 2090 - DNA, 25 bp, E. coli
ggcactccgaaaaacttggttggcg

SEQ ID NO: 2091 - DNA, 25 bp, E. coli
tacacatggcatggatgaactatac

SEQ ID NO: 2092 - DNA, 25 bp, E. coli
taaaggagaagaacttttcactgga

SEQ ID NO: 2093 - DNA, 25 bp, E. coli
taaaggagaagatcttttcactgga

SEQ ID NO: 2094 - DNA, 25 bp, E. coli
tacacatggcatcgatgaactatac

SEQ ID NO: 2095 - DNA, 25 bp, E. coli
agagggtgaaggagatgcaacatac

SEQ ID NO: 2096 - DNA, 25 bp, E. coli
agagggtgaaggtgatgcaacatac

SEQ ID NO: 2097 - DNA, 25 bp, E. coli
aacagctgctgggattacacatggc

SEQ ID NO: 2098 - DNA, 25 bp, E. coli
aacagctgctggcattacacatggc

SEQ ID NO: 2099 - DNA, 25 bp, E. coli
tttgcactactggaaaactacctgt

SEQ ID NO: 2100 - DNA, 25 bp, E. coli
tttgcactactgcaaaactacctgt

SEQ ID NO: 2101 - DNA, 25 bp, E. coli
tgcaacatacggtaaacttaccctt

SEQ ID NO: 2102 - DNA, 25 bp, E. coli
tgcaacatacggaaaacttaccctt

SEQ ID NO: 2103 - DNA, 25 bp, E. coli
ccttcttgagttagtaacagctgct

SEQ ID NO: 2104 - DNA, 25 bp, E. coli
ccttcttgagtttgtaacagctgct

SEQ ID NO: 2105 - DNA, 25 bp, E. coli
gcacaaattttcagtcagtggagag

SEQ ID NO: 2106 - DNA, 25 bp, E. coli
gcacaaattttctgtcagtggagag

SEQ ID NO: 2107 - DNA, 25 bp, E. coli
tggagttgtccctattcttgttgaa

SEQ ID NO: 2108 - DNA, 25 bp, E. coli
tggagttgtcccaattcttgttgaa

SEQ ID NO: 2109 - DNA, 25 bp, E. coli
gatcccaacgaatagagagaccaca

SEQ ID NO: 2110 - DNA, 25 bp, E. coli
gagagaccacatggtccttcttgag

SEQ ID NO: 2111 - DNA, 25 bp, E. coli
gatcccaacgaaaagagagaccaca

SEQ ID NO: 2112 - DNA, 25 bp, E. coli
gagagaccacatcgtccttcttgag

SEQ ID NO: 2113 - DNA, 25 bp, E. coli
tacttactgaataacgatctggccg

SEQ ID NO: 2114 - DNA, 25 bp, E. coli
tacttactgaattacgatctggccg

SEQ ID NO: 2115 - DNA, 25 bp, E. coli
taaaagatacggtaggaatgtctcc

SEQ ID NO: 2116 - DNA, 25 bp, E. coli
taaaagatacggaaggaatgtctcc

SEQ ID NO: 2117 - DNA, 25 bp, E. coli
tatacgaatagcatagacagccgct

SEQ ID NO: 2118 - DNA, 25 bp, E. coli
tatttaaaaatgacggacagccggt

SEQ ID NO: 2119 - DNA, 25 bp, E. coli
tatacgaatagcttagacagccgct

SEQ ID NO: 2120 - DNA, 25 bp, E. coli
tatttaaaaatgtcggacagccggt

SEQ ID NO: 2121 - DNA, 25 bp, E. coli
tttattgatcttgggagaagcggca

SEQ ID NO: 2122 - DNA, 25 bp, E. coli
tttattgatcttcggagaagcggca

SEQ ID NO: 2123 - DNA, 25 bp, E. coli
tccatttaaagaaccgcgcgagctg

SEQ ID NO: 2124 - DNA, 25 bp, E. coli
tccatttaaagatccgcgcgagctg

SEQ ID NO: 2125 - DNA, 25 bp, E. coli
gctatggctggaaggaaagctgcct

SEQ ID NO: 2126 - DNA, 25 bp, E. coli
gctatggctggatggaaagctgcct

SEQ ID NO: 2127 - DNA, 25 bp, E. coli
gacattgccttctgcgtccggtcga

SEQ ID NO: 2128 - DNA, 25 bp, E. coli
gacagccggtattaagggaccacct

SEQ ID NO: 2129 - DNA, 25 bp, E. coli
gacattgccttcagcgtccggtcga

SEQ ID NO: 2130 - DNA, 25 bp, E. coli
gacagccggtataaagggaccacct

SEQ ID NO: 2131 - DNA, 25 bp, E. coli
ggcgacctgggagacagcaacatct

SEQ ID NO: 2132 - DNA, 25 bp, E. coli
ggcgacctgggacacagcaacatct

SEQ ID NO: 2133 - DNA, 25 bp, E. coli
gaggaacttgtcttttcccacggcg

SEQ ID NO: 2134 - DNA, 25 bp, E. coli
gaggaacttgtcatttcccacggcg

SEQ ID NO: 2135 - DNA, 25 bp, E. coli
aattcagttgccaagctttacagag

SEQ ID NO: 2136 - DNA, 25 bp, E. coli
aattcagttgcctagctttacagag

SEQ ID NO: 2137 - DNA, 25 bp, E. coli
caaagcttattttgagtgggacgag

SEQ ID NO: 2138 - DNA, 25 bp, E. coli
caaagcttatttagagtgggacgag

SEQ ID NO: 2139 - DNA, 25 bp, E. coli
taaagcaatttacaaccactggcaa

SEQ ID NO: 2140 - DNA, 25 bp, E. coli
taaagcaatttagaaccactggcaa

SEQ ID NO: 2141 - DNA, 25 bp, E. coli
ctttttgaccaatttagagtgcctt

SEQ ID NO: 2142 - DNA, 25 bp, E. coli
ctttttgaccaaattagagtgcctt

SEQ ID NO: 2143 - DNA, 25 bp, E. coli
taccacaagattttagacaaagcga

SEQ ID NO: 2144 - DNA, 25 bp, E. coli
taccacaagattatagacaaagcga

SEQ ID NO: 2145 - DNA, 25 bp, E. coli
tgaaaaagaaaaaaccgcaggcgtg

SEQ ID NO: 2146 - DNA, 25 bp, E. coli
tgaaaaagaaaataccgcaggcgtg

SEQ ID NO: 2147 - DNA, 25 bp, E. coli
cctgatgatggaaatgatgaaagca

SEQ ID NO: 2148 - DNA, 25 bp, E. coli
cctgatgatggatatgatgaaagca

SEQ ID NO: 2149 - DNA, 25 bp, E. coli
gctttacagagcaagagcagaacct

SEQ ID NO: 2150 - DNA, 25 bp, E. coli
gctttacagagctagagcagaacct

SEQ ID NO: 2151 - DNA, 25 bp, E. coli
gaagaatttataccccttagcggta

SEQ ID NO: 2152 - DNA, 25 bp, E. coli
gaagaatttatagcccttagcggta

SEQ ID NO: 2153 - DNA, 25 bp, E. coli
gaaaatatcgaaatgcaaaagctag

SEQ ID NO: 2154 - DNA, 25 bp, E. coli
gaaaatatcgaattgcaaaagctag

SEQ ID NO: 2155 - DNA, 25 bp, E. coli
cgtggcggcaaactttcaggcatta

SEQ ID NO: 2156 - DNA, 25 bp, E. coli
cgtggcggcaaagtttcaggcatta

SEQ ID NO: 2157 - DNA, 25 bp, E. coli
cacagatgaaagcaggagagaagct

SEQ ID NO: 2158 - DNA, 25 bp, E. coli
cacagatgaaaggaggagagaagct

SEQ ID NO: 2159 - DNA, 25 bp, E. coli
caggaccagagcataaattaacgca

SEQ ID NO: 2160 - DNA, 25 bp, E. coli
caggaccagagcttaaattaacgca

SEQ ID NO: 2161 - DNA, 25 bp, E. coli
tacaacgccaaagtaagagaagact

SEQ ID NO: 2162 - DNA, 25 bp, E. coli
tacaacgccaaactaagagaagact

SEQ ID NO: 2163 - DNA, 25 bp, E. coli
aaaatggagcgtggagctaatcgcc

SEQ ID NO: 2164 - DNA, 25 bp, E. coli
aaaatggagcgtcgagctaatcgcc

SEQ ID NO: 2165 - DNA, 25 bp, E. coli
tttagaactaggacacgaaagagct

SEQ ID NO: 2166 - DNA, 25 bp, E. coli
tttagaactaggtcacgaaagagct

SEQ ID NO: 2167 - DNA, 25 bp, E. coli
ttgcagagcttacaggatttacacc

SEQ ID NO: 2168 - DNA, 25 bp, E. coli
ttgcagagcttagaggatttacacc

SEQ ID NO: 2169 - DNA, 25 bp, E. coli
tgcttcaaagaataccaggaccaga

SEQ ID NO: 2170 - DNA, 25 bp, E. coli
tgcttcaaagaaaaccaggaccaga

SEQ ID NO: 2171 - DNA, 25 bp, E. coli
cgcaaatgcccctagaattgaaaaa

SEQ ID NO: 2172 - DNA, 25 bp, E. coli
cgcaaatgccccaagaattgaaaaa

SEQ ID NO: 2173 - DNA, 25 bp, E. coli
ggagcaatgccatgagcttacgcaa

SEQ ID NO: 2174 - DNA, 25 bp, E. coli
ggagcaatgccaagagcttacgcaa

SEQ ID NO: 2175 - DNA, 25 bp, E. coli
ggcttacaacttcctagacgtgaag

SEQ ID NO: 2176 - DNA, 25 bp, E. coli
ggcttacaacttgctagacgtgaag

SEQ ID NO: 2177 - DNA, 25 bp, E. coli
gagaataacgaatagcaaccccaat

SEQ ID NO: 2178 - DNA, 25 bp, E. coli
gagaataacgaaaagcaaccccaat

SEQ ID NO: 2179 - DNA, 25 bp, E. coli
aacgagctgggtcttccttacgaag

SEQ ID NO: 2180 - DNA, 25 bp, E. coli
caagtgggacgacttcaagttcgcc

SEQ ID NO: 2181 - DNA, 25 bp, E. coli
caagtgggacgagttcaagttcgcc

SEQ ID NO: 2182 - DNA, 25 bp, E. coli
cagtaccactggacacgatgggcca

SEQ ID NO: 2183 - DNA, 25 bp, E. coli
catcgtcaagaagacccgcgaggtt

SEQ ID NO: 2184 - DNA, 25 bp, E. coli
cagtaccactggtcacgatgggcca

SEQ ID NO: 2185 - DNA, 25 bp, E. coli
catcgtcaagaacacccgcgaggtt

SEQ ID NO: 2186 - DNA, 25 bp, E. coli
agacgttactttgaggacctggaca

SEQ ID NO: 2187 - DNA, 25 bp, E. coli
agacgttactttcaggacctggaca

SEQ ID NO: 2188 - DNA, 25 bp, E. coli
aacgagctgggtgttccttacgaag

SEQ ID NO: 2189 - DNA, 25 bp, E. coli
taccgctgttgacgacttgatcacc

SEQ ID NO: 2190 - DNA, 25 bp, E. coli
taccgctgttgaggacttgatcacc

SEQ ID NO: 2191 - DNA, 25 bp, E. coli
cctggacaagtaggctgaaagtgac

SEQ ID NO: 2192 - DNA, 25 bp, E. coli
cctggacaagtacgctgaaagtgac

SEQ ID NO: 2193 - DNA, 25 bp, E. coli
gaagattgctatggtcgaggccagc

SEQ ID NO: 2194 - DNA, 25 bp, E. coli
gaagattgctatcgtcgaggccagc

SEQ ID NO: 2195 - DNA, 25 bp, E. coli
cattgaaggtgttcgacgagcgtca

SEQ ID NO: 2196 - DNA, 25 bp, E. coli
cattgaaggtgtacgacgagcgtca

SEQ ID NO: 2197 - DNA, 25 bp, E. coli
gataatcggcggtatggagctgtct

SEQ ID NO: 2198 - DNA, 25 bp, E. coli
gataatcggcggaatggagctgtct

SEQ ID NO: 2199 - DNA, 25 bp, E. coli
gagcactgcgtaggtcttggccaag

SEQ ID NO: 2200 - DNA, 25 bp, E. coli
gagcactgcgtacgtcttggccaag

SEQ ID NO: 2201 - DNA, 25 bp, E. coli
caacaggtggttccaactggacaag

SEQ ID NO: 2202 - DNA, 25 bp, E. coli
caacaggtggttgcaactggacaag

SEQ ID NO: 2203 - DNA, 25 bp, E. coli
caacgtctggtatcagcgcgaagtc

SEQ ID NO: 2204 - DNA, 25 bp, E. coli
caacgtctggtaacagcgcgaagtc

SEQ ID NO: 2205 - DNA, 25 bp, E. coli
tattgccgggaatagtgtacgtatc

SEQ ID NO: 2206 - DNA, 25 bp, E. coli
tatcaccgtggtcacgcatgtcgcg

SEQ ID NO: 2207 - DNA, 25 bp, E. coli
tattgccgggaaaagtgtacgtatc

SEQ ID NO: 2208 - DNA, 25 bp, E. coli
tatcaccgtggtgacgcatgtcgcg

SEQ ID NO: 2209 - DNA, 25 bp, E. coli
tttaacgatcagatcgccgatgcag

SEQ ID NO: 2210 - DNA, 25 bp, E. coli
tttaacgatcagttcgccgatgcag

SEQ ID NO: 2211 - DNA, 25 bp, E. coli
tgtgtgaacaacgaactgaactggc

SEQ ID NO: 2212 - DNA, 25 bp, E. coli
tgtgtgaacaaccaactgaactggc

SEQ ID NO: 2213 - DNA, 25 bp, E. coli
tctggatcgcgataactgtggaatt

SEQ ID NO: 2214 - DNA, 25 bp, E. coli
tctggatcgcgaaaactgtggaatt

SEQ ID NO: 2215 - DNA, 25 bp, E. coli
tcagcgttgaactgcgtgatgcgga

SEQ ID NO: 2216 - DNA, 25 bp, E. coli
tcagcgttgaacagcgtgatgcgga

SEQ ID NO: 2217 - DNA, 25 bp, E. coli
cgcgttacaagatagccgggcaatt

SEQ ID NO: 2218 - DNA, 25 bp, E. coli
cgcgttacaagaaagccgggcaatt

SEQ ID NO: 2219 - DNA, 25 bp, E. coli
tcaaaaaactcgtcggcctgtgggc

SEQ ID NO: 2220 - DNA, 25 bp, E. coli
tcaaaaaactcgacggcctgtgggc

SEQ ID NO: 2221 - DNA, 25 bp, E. coli
gatgcggtcactcattacggcaaag

SEQ ID NO: 2222 - DNA, 25 bp, E. coli
gatgcggtcactgattacggcaaag

SEQ ID NO: 2223 - DNA, 25 bp, B. subtillis
cacagtgatgatgtcgagatcggaa

SEQ ID NO: 2224 - DNA, 25 bp, B. subtillis
cacagtgatgatctcgagatcggaa

SEQ ID NO: 2225 - DNA, 25 bp, B. subtillis
catgtcaggcgtaaaactgtcagtc

SEQ ID NO: 2226 - DNA, 25 bp, B. subtillis
catgtcaggcgttaaactgtcagtc

SEQ ID NO: 2227 - DNA, 25 bp, B. subtillis
cattaatccgtttatgtgatgtgta

SEQ ID NO: 2228 - DNA, 25 bp, B. subtillis
aggatatggttctatttacgactgc

SEQ ID NO: 2229 - DNA, 25 bp, B. subtillis
atgctgacgttcttgcttttggcgc

SEQ ID NO: 2230 - DNA, 25 bp, B. subtillis
atgaagattgatgagcttgtgtatg

SEQ ID NO: 2231 - DNA, 25 bp, B. subtillis
agcaaatcggtgcactgatcgctgc

SEQ ID NO: 2232 - DNA, 25 bp, B. subtillis
aggatatggttcaatttacgactgc

SEQ ID NO: 2233 - DNA, 25 bp, B. subtillis
agcaaatcggtggactgatcgctgc

SEQ ID NO: 2234 - DNA, 25 bp, B. subtillis
atgaagattgatcagcttgtgtatg

SEQ ID NO: 2235 - DNA, 25 bp, B. subtillis
atgctgacgttcatgcttttggcgc

SEQ ID NO: 2236 - DNA, 25 bp, B. subtillis
aaattcttgtgcccacacttgatga

SEQ ID NO: 2237 - DNA, 25 bp, B. subtillis
aaattcttgtgcgcacacttgatga

SEQ ID NO: 2238 - DNA, 25 bp, B. subtillis
ttcatgaggcgagaggtcttcaaat

SEQ ID NO: 2239 - DNA, 25 bp, B. subtillis
ttcatgaggcgacaggtcttcaaat

SEQ ID NO: 2240 - DNA, 25 bp, B. subtillis
tgcactgatcgcagccaatgcactc

SEQ ID NO: 2241 - DNA, 25 bp, B. subtillis
tgcactgatcgctgccaatgcactc

SEQ ID NO: 2242 - DNA, 25 bp, B. subtillis
tcaatttacgacagcctatcgggat

SEQ ID NO: 2243 - DNA, 25 bp, B. subtillis
tcaatttacgactgcctatcgggat

SEQ ID NO: 2244 - DNA, 25 bp, B. subtillis
tgatgtgtattccattccgctcgcc

SEQ ID NO: 2245 - DNA, 25 bp, B. subtillis
tgaaaattgctttgatcgcgcatga

SEQ ID NO: 2246 - DNA, 25 bp, B. subtillis
tgaaaattgcttagatcgcgcatga

SEQ ID NO: 2247 - DNA, 25 bp, B. subtillis
tgatgtgtattcgattccgctcgcc

SEQ ID NO: 2248 - DNA, 25 bp, B. subtillis
tcatgatctatacgcaaccggaacc

SEQ ID NO: 2249 - DNA, 25 bp, B. subtillis
tcatgatctataggcaaccggaacc

SEQ ID NO: 2250 - DNA, 25 bp, B. subtillis
gctcgccacaaatatgggtactgcg

SEQ ID NO: 2251 - DNA, 25 bp, B. subtillis
gcgcacacttgatgaaggtgttttc

SEQ ID NO: 2252 - DNA, 25 bp, B. subtillis
gcttttggcgcccacagtgatgatg

SEQ ID NO: 2253 - DNA, 25 bp, B. subtillis
gcttttggcgccgacagtgatgatg

SEQ ID NO: 2254 - DNA, 25 bp, B. subtillis
gcgcacacttgaagaaggtgttttc

SEQ ID NO: 2255 - DNA, 25 bp, B. subtillis
gctgccaatgcagtcgatcttgtca

SEQ ID NO: 2256 - DNA, 25 bp, B. subtillis
gctgccaatgcactcgatcttgtca

SEQ ID NO: 2257 - DNA, 25 bp, B. subtillis
gctcgccacaaaaatgggtactgcg

SEQ ID NO: 2258 - DNA, 25 bp, B. subtillis
cccgctgaccgcccagccgcatgaa

SEQ ID NO: 2259 - DNA, 25 bp, B. subtillis
cccgctgaccgcgcagccgcatgaa

SEQ ID NO: 2260 - DNA, 25 bp, B. subtillis
cattaatccgttaatgtgatgtgta

SEQ ID NO: 2261 - DNA, 25 bp, B. subtillis
gatgtctcggcaataatccgtttat

SEQ ID NO: 2262 - DNA, 25 bp, B. subtillis
gatgtctcggcattaatccgtttat

SEQ ID NO: 2263 - DNA, 25 bp, B. subtillis
caagcggaactgcgcttaaaacagc

SEQ ID NO: 2264 - DNA, 25 bp, B. subtillis
caagcggaactgggcttaaaacagc

SEQ ID NO: 2265 - DNA, 25 bp, B. subtillis
catgaccagaagcttgacgcaccaa

SEQ ID NO: 2266 - DNA, 25 bp, B. subtillis
catgaccagaaggttgacgcaccaa

SEQ ID NO: 2267 - DNA, 25 bp, B. subtillis
tacacagatatcgatgcctgtttta

SEQ ID NO: 2268 - DNA, 25 bp, B. subtillis
tacacagatatccatgcctgtttta

SEQ ID NO: 2269 - DNA, 25 bp, B. subtillis
agcttcatcatgtccagaagcttga

SEQ ID NO: 2270 - DNA, 25 bp, B. subtillis
agggatcggagcgatcatcgcgcca

SEQ ID NO: 2271 - DNA, 25 bp, B. subtillis
agggatcggagccatcatcgcgcca

SEQ ID NO: 2272 - DNA, 25 bp, B. subtillis
agcagcaaggacatccggatgaaaa

SEQ ID NO: 2273 - DNA, 25 bp, B. subtillis
agcagcaaggacttccggatgaaaa

SEQ ID NO: 2274 - DNA, 25 bp, B. subtillis
agcttcatcatgaccagaagcttga

SEQ ID NO: 2275 - DNA, 25 bp, B. subtillis
aaaaattgcattagagcacggagtc

SEQ ID NO: 2276 - DNA, 25 bp, B. subtillis
aaattttgcgctgggtgcgatactg

SEQ ID NO: 2277 - DNA, 25 bp, B. subtillis
aaaaattgcatttgagcacggagtc

SEQ ID NO: 2278 - DNA, 25 bp, B. subtillis
aaattttgcgctcggtgcgatactg

SEQ ID NO: 2279 - DNA, 25 bp, B. subtillis
tatctgatgtgatgcctgttgagtc

SEQ ID NO: 2280 - DNA, 25 bp, B. subtillis
tatctgatgtgaagcctgttgagtc

SEQ ID NO: 2281 - DNA, 25 bp, B. subtillis
ttgagtcagatgctttcatttacac

SEQ ID NO: 2282 - DNA, 25 bp, B. subtillis
ttgagtcagatggtttcatttacac

SEQ ID NO: 2283 - DNA, 25 bp, B. subtillis
tgctttcatttacacagatatccat

SEQ ID NO: 2284 - DNA, 25 bp, B. subtillis
tgctttcatttagacagatatccat

SEQ ID NO: 2285 - DNA, 25 bp, B. subtillis
tgccaactatttagaggatgttgag

SEQ ID NO: 2286 - DNA, 25 bp, B. subtillis
tgccaactattttgaggatgttgag

SEQ ID NO: 2287 - DNA, 25 bp, B. subtillis
tcatcgcgccaatttttgcgctcgg

SEQ ID NO: 2288 - DNA, 25 bp, B. subtillis
tcatcgcgccaaattttgcgctcgg

SEQ ID NO: 2289 - DNA, 25 bp, B. subtillis
gaagcttgacgcaccaagcggaact

SEQ ID NO: 2290 - DNA, 25 bp, B. subtillis
gaagcttgacgctccaagcggaact

SEQ ID NO: 2291 - DNA, 25 bp, B. subtillis
cgctcggtgcgatactgatgatgaa

SEQ ID NO: 2292 - DNA, 25 bp, B. subtillis
cgctcggtgcgaaactgatgatgaa

SEQ ID NO: 2293 - DNA, 25 bp, B. subtillis
gatatccatgcctgttttacagaaa

SEQ ID NO: 2294 - DNA, 25 bp, B. subtillis
gatatccatgccagttttacagaaa

SEQ ID NO: 2295 - DNA, 25 bp, B. subtillis
gtgatgcctgttgagtcagatgctt

SEQ ID NO: 2296 - DNA, 25 bp, B. subtillis
gtgatgcctgttcagtcagatgctt

SEQ ID NO: 2297 - DNA, 25 bp, B. subtillis
tggcagaacgaagaccacattttga

SEQ ID NO: 2298 - DNA, 25 bp, B. subtillis
tggcagaacgaacaccacattttga

SEQ ID NO: 2299 - DNA, 25 bp, B. subtillis
gagattattgagcttcatcatgacc

SEQ ID NO: 2300 - DNA, 25 bp, B. subtillis
gagattattgaggttcatcatgacc

SEQ ID NO: 2301 - DNA, 25 bp, B. subtillis
gagccatcatcgcgccaaattttgc

SEQ ID NO: 2302 - DNA, 25 bp, B. subtillis
gagccatcatcgggccaaattttgc

SEQ ID NO: 2303 - DNA, 25 bp, B. subtillis
aatgagtgatcacgcaattcggtca

SEQ ID NO: 2304 - DNA, 25 bp, B. subtillis
aatgagtgatcaggcaattcggtca

SEQ ID NO: 2305 - DNA, 25 bp, B. subtillis
catcagaatctgacggccaaaagcg

SEQ ID NO: 2306 - DNA, 25 bp, B. subtillis
catcagaatctgtcggccaaaagcg

SEQ ID NO: 2307 - DNA, 25 bp, B. subtillis
agaagaagcagcagaagcagcccgc

SEQ ID NO: 2308 - DNA, 25 bp, B. subtillis
attcggtcaattgtcactgtcatca

SEQ ID NO: 2309 - DNA, 25 bp, B. subtillis
aggatcgccatcgggatcacggcaa

SEQ ID NO: 2310 - DNA, 25 bp, B. subtillis
agaagaagcagctgaagcagcccgc

SEQ ID NO: 2311 - DNA, 25 bp, B. subtillis
attcggtcaattctcactgtcatca

SEQ ID NO: 2312 - DNA, 25 bp, B. subtillis
aggatcgccatccggatcacggcaa

SEQ ID NO: 2313 - DNA, 25 bp, B. subtillis
aagaattcagctaacgcttccagac

SEQ ID NO: 2314 - DNA, 25 bp, B. subtillis
aagaattcagcttacgcttccagac

SEQ ID NO: 2315 - DNA, 25 bp, B. subtillis
ttgatatctcggatacaatagaggc

SEQ ID NO: 2316 - DNA, 25 bp, B. subtillis
ttttgttattgatatctcggataca

SEQ ID NO: 2317 - DNA, 25 bp, B. subtillis
ttttgttattgaaatctcggataca

SEQ ID NO: 2318 - DNA, 25 bp, B. subtillis
ttgatatctcggttacaatagaggc

SEQ ID NO: 2319 - DNA, 25 bp, B. subtillis
tgatcaggcaattcggtcaattgtc

SEQ ID NO: 2320 - DNA, 25 bp, B. subtillis
tgatcaggcaatacggtcaattgtc

SEQ ID NO: 2321 - DNA, 25 bp, B. subtillis
tccggatcacgggaatgcggctgca

SEQ ID NO: 2322 - DNA, 25 bp, B. subtillis
tccggatcacggcaatgcggctgca

SEQ ID NO: 2323 - DNA, 25 bp, B. subtillis
gccttccggcgcttaaagtcagcaa

SEQ ID NO: 2324 - DNA, 25 bp, B. subtillis
gccttccggcgcataaagtcagcaa

SEQ ID NO: 2325 - DNA, 25 bp, B. subtillis
gctgaagcagcccgcatattaggcg

SEQ ID NO: 2326 - DNA, 25 bp, B. subtillis
gctgaagcagccggcatattaggcg

SEQ ID NO: 2327 - DNA, 25 bp, B. subtillis
gaagcagctgaaccagcccgcatat

SEQ ID NO: 2328 - DNA, 25 bp, B. subtillis
gcagcccgcatattaggcgcagata

SEQ ID NO: 2329 - DNA, 25 bp, B. subtillis
gcagcccgcataataggcgcagata

SEQ ID NO: 2330 - DNA, 25 bp, B. subtillis
gaagcagctgaagcagcccgcatat

SEQ ID NO: 2331 - DNA, 25 bp, B. subtillis
ctactcctctgacgaatgggtatat

SEQ ID NO: 2332 - DNA, 25 bp, B. subtillis
ctactcctctgaggaatgggtatat

SEQ ID NO: 2333 - DNA, 25 bp, B. subtillis
gtcactgtcatcagaatctgtcggc

SEQ ID NO: 2334 - DNA, 25 bp, B. subtillis
gtcactgtcatctgaatctgtcggc

SEQ ID NO: 2335 - DNA, 25 bp, B. subtillis
gataaatggttttcatcagccggat

SEQ ID NO: 2336 - DNA, 25 bp, B. subtillis
gataaatggtttacatcagccggat

SEQ ID NO: 2337 - DNA, 25 bp, B. subtillis
ggtatattgaaatcgttgaagcgag

SEQ ID NO: 2338 - DNA, 25 bp, B. subtillis
ggtatattgaaaacgttgaagcgag

SEQ ID NO: 2339 - DNA, 25 bp, B. subtillis
ggcaatgcggctccactggtggaag

SEQ ID NO: 2340 - DNA, 25 bp, B. subtillis
ggcaatgcggctgcactggtggaag

SEQ ID NO: 2341 - DNA, 25 bp, B. subtillis
tcaattgtcactctcatcagaatct

SEQ ID NO: 2342 - DNA, 25 bp, B. subtillis
tcaattgtcactgtcatcagaatct

SEQ ID NO: 2343 - DNA, 25 bp, P1 bacteriophage
taccggtcgatgcaacgagtgatga

SEQ ID NO: 2344 - DNA, 25 bp, P1 bacteriophage
gagtgatgaggtacgcaagaacctg

SEQ ID NO: 2345 - DNA, 25 bp, P1 bacteriophage
atttgcctgcataaccggtcgatgc

SEQ ID NO: 2346 - DNA, 25 bp, P1 bacteriophage
gagtgatgaggttcgcaagaacctg

SEQ ID NO: 2347 - DNA, 25 bp, P1 bacteriophage
atttgcctgcattaccggtcgatgc

SEQ ID NO: 2348 - DNA, 25 bp, P1 bacteriophage
gcaagaacctgatggacatgttcag

SEQ ID NO: 2349 - DNA, 25 bp, P1 bacteriophage
acgtgcaaaacaggctctagcgttc

SEQ ID NO: 2350 - DNA, 25 bp, P1 bacteriophage
tcagggttaaagatatctcacgtac

SEQ ID NO: 2351 - DNA, 25 bp, P1 bacteriophage
taccggtcgatggaacgagtgatga

SEQ ID NO: 2352 - DNA, 25 bp, P1 bacteriophage
gcaagaacctgaaggacatgttcag

SEQ ID NO: 2353 - DNA, 25 bp, P1 bacteriophage
atggaaaatagcgatcgctgccagg

SEQ ID NO: 2354 - DNA, 25 bp, P1 bacteriophage
ctctagcgttcgaacgcactgattt

SEQ ID NO: 2355 - DNA, 25 bp, P1 bacteriophage
tcgttcactcatggaaaatagcgat

SEQ ID NO: 2356 - DNA, 25 bp, P1 bacteriophage
atgccggtgaacgtgcaaaacaggc

SEQ ID NO: 2357 - DNA, 25 bp, P1 bacteriophage
aatgctgtttcactggttatgcggc

SEQ ID NO: 2358 - DNA, 25 bp, P1 bacteriophage
gaccaagtgacagcaatgctgtttc

SEQ ID NO: 2359 - DNA, 25 bp, P1 bacteriophage
gcggcatggtgcaagttgaataacc

SEQ ID NO: 2360 - DNA, 25 bp, P1 bacteriophage
ccagctaaacatgcttcatcgtcgg

SEQ ID NO: 2361 - DNA, 25 bp, P1 bacteriophage
gcaacatttgggccagctaaacatg

SEQ ID NO: 2362 - DNA, 25 bp, P1 bacteriophage
gacatgttcagggatcgccaggcgt

SEQ ID NO: 2363 - DNA, 25 bp, P1 bacteriophage
tctatatcttcaggcgcgcggtctg

SEQ ID NO: 2364 - DNA, 25 bp, P1 bacteriophage
gaagatgttcgcgattatcttctat

SEQ ID NO: 2365 - DNA, 25 bp, P1 bacteriophage
ccgggctgccacgaccaagtgacag

SEQ ID NO: 2366 - DNA, 25 bp, P1 bacteriophage
gccaggcgttttctgagcatacctg

SEQ ID NO: 2367 - DNA, 25 bp, P1 bacteriophage
acgtgcaaaacacgctctagcgttc

SEQ ID NO: 2368 - DNA, 25 bp, P1 bacteriophage
ctctagcgttcgtacgcactgattt

SEQ ID NO: 2369 - DNA, 25 bp, P1 bacteriophage
tcgttcactcatcgaaaatagcgat

SEQ ID NO: 2370 - DNA, 25 bp, P1 bacteriophage
tcagggttaaagttatctcacgtac

SEQ ID NO: 2371 - DNA, 25 bp, P1 bacteriophage
aatgctgtttcagtggttatgcggc

SEQ ID NO: 2372 - DNA, 25 bp, P1 bacteriophage
atggaaaatagccatcgctgccagg

SEQ ID NO: 2373 - DNA, 25 bp, P1 bacteriophage
ccagctaaacatccttcatcgtcgg

SEQ ID NO: 2374 - DNA, 25 bp, P1 bacteriophage
gacatgttcaggcatcgccaggcgt

SEQ ID NO: 2375 - DNA, 25 bp, P1 bacteriophage
gccaggcgttttgtgagcatacctg

SEQ ID NO: 2376 - DNA, 25 bp, P1 bacteriophage
gcggcatggtgctagttgaataacc

SEQ ID NO: 2377 - DNA, 25 bp, P1 bacteriophage
gaagatgttcgccattatcttctat

SEQ ID NO: 2378 - DNA, 25 bp, P1 bacteriophage
tctatatcttcacgcgcgcggtctg

SEQ ID NO: 2379 - DNA, 25 bp, P1 bacteriophage
gcaacatttggggcagctaaacatg

SEQ ID NO: 2380 - DNA, 25 bp, P1 bacteriophage
atgccggtgaacctgcaaaacaggc

SEQ ID NO: 2381 - DNA, 25 bp, P1 bacteriophage
gaccaagtgacaccaatgctgtttc

SEQ ID NO: 2382 - DNA, 25 bp, P1 bacteriophage
ccgggctgccaccaccaagtgacag

SEQ ID NO: 2383 - DNA, 25 bp, P1 bacteriophage
cgctggttagcaccgcaggtgtaga

SEQ ID NO: 2384 - DNA, 25 bp, P1 bacteriophage
caccgcaggtgtagagaaggcactt

SEQ ID NO: 2385 - DNA, 25 bp, P1 bacteriophage
tagtgaaacaggggcaatggtgcgc

SEQ ID NO: 2386 - DNA, 25 bp, P1 bacteriophage
tggtcagagatagctggcctggtct

SEQ ID NO: 2387 - DNA, 25 bp, P1 bacteriophage
tggtcgagcgatcgatttccgtctc

SEQ ID NO: 2388 - DNA, 25 bp, P1 bacteriophage
ccaatgtaaataatgtcatgaacta

SEQ ID NO: 2389 - DNA, 25 bp, P1 bacteriophage
accagccagctaacaactcgcgccc

SEQ ID NO: 2390 - DNA, 25 bp, P1 bacteriophage
ctggtctggacagagtgcccgtgtc

SEQ ID NO: 2391 - DNA, 25 bp, P1 bacteriophage
gtgcccgtgtcgcagccgcgcgaga

SEQ ID NO: 2392 - DNA, 25 bp, P1 bacteriophage
atggatttccgtgtctggtgtagct

SEQ ID NO: 2393 - DNA, 25 bp, P1 bacteriophage
taaggatgactcaggtcagagatac

SEQ ID NO: 2394 - DNA, 25 bp, P1 bacteriophage
gtctctggtgtacctgatgatccga

SEQ ID NO: 2395 - DNA, 25 bp, P1 bacteriophage
ctggtggctggagcaatgtaaatat

SEQ ID NO: 2396 - DNA, 25 bp, P1 bacteriophage
ttgtcatgaactttatccgtaacct

SEQ ID NO: 2397 - DNA, 25 bp, P1 bacteriophage
gcaactcatcgaatgatttacggcg

SEQ ID NO: 2398 - DNA, 25 bp, P1 bacteriophage
ggagatcatgcatgctggtggctgg

SEQ ID NO: 2399 - DNA, 25 bp, P1 bacteriophage
tgtagctgatgaaccgaataactac

SEQ ID NO: 2400 - DNA, 25 bp, P1 bacteriophage
gattgatttacgccgctaaggatga

SEQ ID NO: 2401 - DNA, 25 bp, P1 bacteriophage
tagtgaaacaggcgcaatggtgcgc

SEQ ID NO: 2402 - DNA, 25 bp, P1 bacteriophage
ggagtttcaatagcggagatcatgc

SEQ ID NO: 2403 - DNA, 25 bp, P1 bacteriophage
cgagatatggccggcgctggagttt

SEQ ID NO: 2404 - DNA, 25 bp, P1 bacteriophage
ggagtttcaataccggagatcatgc

SEQ ID NO: 2405 - DNA, 25 bp, P1 bacteriophage
atggatttccgtctctggtgtagct

SEQ ID NO: 2406 - DNA, 25 bp, P1 bacteriophage
tggtcagagatacctggcctggtct

SEQ ID NO: 2407 - DNA, 25 bp, P1 bacteriophage
taaggatgactctggtcagagatac

SEQ ID NO: 2408 - DNA, 25 bp, P1 bacteriophage
gattgatttacggcgctaaggatga

SEQ ID NO: 2409 - DNA, 25 bp, P1 bacteriophage
accagccagctatcaactcgcgccc

SEQ ID NO: 2410 - DNA, 25 bp, P1 bacteriophage
gcaactcatcgattgatttacggcg

SEQ ID NO: 2411 - DNA, 25 bp, P1 bacteriophage
gtctctggtgtagctgatgatccga

SEQ ID NO: 2412 - DNA, 25 bp, P1 bacteriophage
gtgcccgtgtcggagccgcgcgaga

SEQ ID NO: 2413 - DNA, 25 bp, P1 bacteriophage
tggtcgagcgatggatttccgtctc

SEQ ID NO: 2414 - DNA, 25 bp, P1 bacteriophage
ctggtctggacacagtgcccgtgtc

SEQ ID NO: 2415 - DNA, 25 bp, P1 bacteriophage
cgagatatggcccgcgctggagttt

SEQ ID NO: 2416 - DNA, 25 bp, P1 bacteriophage
ggagatcatgcaagctggtggctgg

SEQ ID NO: 2417 - DNA, 25 bp, P1 bacteriophage
ccaatgtaaatattgtcatgaacta

SEQ ID NO: 2418 - DNA, 25 bp, P1 bacteriophage
ttgtcatgaactatatccgtaacct

SEQ ID NO: 2419 - DNA, 25 bp, P1 bacteriophage
tgtagctgatgatccgaataactac

SEQ ID NO: 2420 - DNA, 25 bp, P1 bacteriophage
ctggtggctggaccaatgtaaatat

SEQ ID NO: 2421 - DNA, 25 bp, P1 bacteriophage
cgctggttagcagcgcaggtgtaga

SEQ ID NO: 2422 - DNA, 25 bp, P1 bacteriophage
caccgcaggtgttgagaaggcactt

SEQ ID NO: 2423 - DNA, 25 bp, E. coli
atgagcgccggattacgcgcgcttg

SEQ ID NO: 2424 - DNA, 25 bp, E. coli
ttggtaatgagcgccggattacgcg

SEQ ID NO: 2425 - DNA, 25 bp, E. coli
agaatcattggtaatgagcgccgga

SEQ ID NO: 2426 - DNA, 25 bp, E. coli
gaccgatagaatcattggtaatgag

SEQ ID NO: 2427 - DNA, 25 bp, E. coli
cgcaagagggcagaccgatagaatc

SEQ ID NO: 2428 - DNA, 25 bp, E. coli
catcagcgcgcaagagggcagaccg

SEQ ID NO: 2429 - DNA, 25 bp, E. coli
ctgcagctggattacgcaacagtaa

SEQ ID NO: 2430 - DNA, 25 bp, E. coli
cagcagcctgcagctggattacgca

SEQ ID NO: 2431 - DNA, 25 bp, E. coli
gggcagaccgatagaatcattggta

SEQ ID NO: 2432 - DNA, 25 bp, E. coli
gcgctggcgttagagcgcaacagca

SEQ ID NO: 2433 - DNA, 25 bp, E. coli
cgttacagcgcatcagcagcctgca

SEQ ID NO: 2434 - DNA, 25 bp, E. coli
agcgcaacagcaccctgcagctgga

SEQ ID NO: 2435 - DNA, 25 bp, E. coli
cagcagcctgcacctggattacgca

SEQ ID NO: 2436 - DNA, 25 bp, E. coli
ctgcagctggataacgcaacagtaa

SEQ ID NO: 2437 - DNA, 25 bp, E. coli
cgcaagagggcacaccgatagaatc

SEQ ID NO: 2438 - DNA, 25 bp, E. coli
gggcagaccgattgaatcattggta

SEQ ID NO: 2439 - DNA, 25 bp, E. coli
gaccgatagaatgattggtaatgag

SEQ ID NO: 2440 - DNA, 25 bp, E. coli
agaatcattggttatgagcgccgga

SEQ ID NO: 2441 - DNA, 25 bp, E. coli
ttggtaatgagccccggattacgcg

SEQ ID NO: 2442 - DNA, 25 bp, E. coli
atgagcgccggaatacgcgcgcttg

SEQ ID NO: 2443 - DNA, 25 bp, E. coli
agcgcaacagcagcctgcagctgga

SEQ ID NO: 2444 - DNA, 25 bp, E. coli
catcagcgcgcatgagggcagaccg

SEQ ID NO: 2445 - DNA, 25 bp, E. coli
caagccgcaaaggcagcaggctacc

SEQ ID NO: 2446 - DNA, 25 bp, E. coli
cgttacagcgcaacagcagcctgca

SEQ ID NO: 2447 - DNA, 25 bp, E. coli
gcgacgcgctggggttacagcgcaa

SEQ ID NO: 2448 - DNA, 25 bp, E. coli
gggaaaactgtcgccagttgtgcac

SEQ ID NO: 2449 - DNA, 25 bp, E. coli
cacttttacaagccgcaaaggcagc

SEQ ID NO: 2450 - DNA, 25 bp, E. coli
gcaaaggcagcaggctaccggacgg

SEQ ID NO: 2451 - DNA, 25 bp, E. coli
aggtttacgcaatagcgacgcgctg

SEQ ID NO: 2452 - DNA, 25 bp, E. coli
cgcaatagcgacgcgctggcgttac

SEQ ID NO: 2453 - DNA, 25 bp, E. coli
gcgacgcgctggcgttacagcgcaa

SEQ ID NO: 2454 - DNA, 25 bp, E. coli
caagccgcaaagccagcaggctacc

SEQ ID NO: 2455 - DNA, 25 bp, E. coli
cgccagttgtgcacttttacaagcc

SEQ ID NO: 2456 - DNA, 25 bp, E. coli
gggaaaactgtccccagttgtgcac

SEQ ID NO: 2457 - DNA, 25 bp, E. coli
cgcaatagcgacccgctggcgttac

SEQ ID NO: 2458 - DNA, 25 bp, E. coli
aggtttacgcaaaagcgacgcgctg

SEQ ID NO: 2459 - DNA, 25 bp, E. coli
gcaaaggcagcacgctaccggacgg

SEQ ID NO: 2460 - DNA, 25 bp, E. coli
cacttttacaaggcgcaaaggcagc

SEQ ID NO: 2461 - DNA, 25 bp, E. coli
cgccagttgtgctcttttacaagcc

SEQ ID NO: 2462 - DNA, 25 bp, E. coli
gcgctggcgttacagcgcaacagca

SEQ ID NO: 2463 - DNA, 25 bp, E. coli
gattcccgcgcccctgctgggagag

SEQ ID NO: 2464 - DNA, 25 bp, E. coli
ctgctgggagagatcccctggcttg

SEQ ID NO: 2465 - DNA, 25 bp, E. coli
acgctgaatataagaccacgctcac

SEQ ID NO: 2466 - DNA, 25 bp, E. coli
ccgctgctgggagagatcccctggc

SEQ ID NO: 2467 - DNA, 25 bp, E. coli
cgcgccgctgctgggagagatcccc

SEQ ID NO: 2468 - DNA, 25 bp, E. coli
gagatcccctggcttgcagaaaatc

SEQ ID NO: 2469 - DNA, 25 bp, E. coli
gattcccgcgccgctgctgggagag

SEQ ID NO: 2470 - DNA, 25 bp, E. coli
atcccctggcttgcagaaaatccag

SEQ ID NO: 2471 - DNA, 25 bp, E. coli
catgattcccgcgccgctgctggga

SEQ ID NO: 2472 - DNA, 25 bp, E. coli
cgtcacgctgaaaatatgaccacgc

SEQ ID NO: 2473 - DNA, 25 bp, E. coli
ggagagatcccctggcttgcagaaa

SEQ ID NO: 2474 - DNA, 25 bp, E. coli
ctgaatatatgagcacgctcacccg

SEQ ID NO: 2475 - DNA, 25 bp, E. coli
gaatatatgacctcgctcacccgca

SEQ ID NO: 2476 - DNA, 25 bp, E. coli
catgattcccgccccgctgctggga

SEQ ID NO: 2477 - DNA, 25 bp, E. coli
atcccctggcttccagaaaatccag

SEQ ID NO: 2478 - DNA, 25 bp, E. coli
cccgcatgattcccgcgccgctgct

SEQ ID NO: 2479 - DNA, 25 bp, E. coli
gctgggagagatcccctggcttgca

SEQ ID NO: 2480 - DNA, 25 bp, E. coli
cgcgccgctgctcggagagatcccc

SEQ ID NO: 2481 - DNA, 25 bp, E. coli
ccgctgctgggacagatcccctggc

SEQ ID NO: 2482 - DNA, 25 bp, E. coli
ctgctgggagagttcccctggcttg

SEQ ID NO: 2483 - DNA, 25 bp, E. coli
gctgggagagatgccctggcttgca

SEQ ID NO: 2484 - DNA, 25 bp, E. coli
ggagagatccccaggcttgcagaaa

SEQ ID NO: 2485 - DNA, 25 bp, E. coli
gagatcccctgggttgcagaaaatc

SEQ ID NO: 2486 - DNA, 25 bp, E. coli
cccgcatgattcgcgcgccgctgct

SEQ ID NO: 2487 - DNA, 25 bp, E. coli
tgacactttcacttttgcagattgg

SEQ ID NO: 2488 - DNA, 25 bp, E. coli
ctttctgacactttcacttttgcag

SEQ ID NO: 2489 - DNA, 25 bp, E. coli
gaatatatgaccacgctcacccgca

SEQ ID NO: 2490 - DNA, 25 bp, E. coli
tttgcagattgggtaacacaggaac

SEQ ID NO: 2491 - DNA, 25 bp, E. coli
gaaaacgtcacgctgaatatatgac

SEQ ID NO: 2492 - DNA, 25 bp, E. coli
aaacgtcacgctgaatatatgacca

SEQ ID NO: 2493 - DNA, 25 bp, E. coli
ggtgctggcggcaggtttacgccgc

SEQ ID NO: 2494 - DNA, 25 bp, E. coli
ctttctgacactatcacttttgcag

SEQ ID NO: 2495 - DNA, 25 bp, E. coli
tgacactttcacatttgcagattgg

SEQ ID NO: 2496 - DNA, 25 bp, E. coli
gaaaacgtcacggtgaatatatgac

SEQ ID NO: 2497 - DNA, 25 bp, E. coli
ggtgctggcggctggtttacgccgc

SEQ ID NO: 2498 - DNA, 25 bp, E. coli
tttgcagattggctaacacaggaac

SEQ ID NO: 2499 - DNA, 25 bp, E. coli
aaacgtcacgctcaatatatgacca

SEQ ID NO: 2500 - DNA, 25 bp, E. coli
ctgaatatatgaccacgctcacccg

SEQ ID NO: 2501 - DNA, 25 bp, E. coli
acgctgaatatatgaccacgctcac

SEQ ID NO: 2502 - DNA, 25 bp, E. coli
cgtcacgctgaatatatgaccacgc

SEQ ID NO: 2503 - DNA, 25 bp, E. coli
gcgcaggtgacggccttagatctct

SEQ ID NO: 2504 - DNA, 25 bp, E. coli
tactggcaatgcatccacagcgtaa

SEQ ID NO: 2505 - DNA, 25 bp, E. coli
gagtgctgacgcgttactggcaatg

SEQ ID NO: 2506 - DNA, 25 bp, E. coli
tacagcgccagactgctgacgcctt

SEQ ID NO: 2507 - DNA, 25 bp, E. coli
aacatgcagatcaacagcgccagag

SEQ ID NO: 2508 - DNA, 25 bp, E. coli
cgcacactatgaccaacatgcagat

SEQ ID NO: 2509 - DNA, 25 bp, E. coli
cagcggcatttgctcgggcagccgc

SEQ ID NO: 2510 - DNA, 25 bp, E. coli
gggttgtggaccaggctggatgagc

SEQ ID NO: 2511 - DNA, 25 bp, E. coli
gccttagatctctcgccgccaatgc

SEQ ID NO: 2512 - DNA, 25 bp, E. coli
tgttcaggcacgccagaaggatgcc

SEQ ID NO: 2513 - DNA, 25 bp, E. coli
tgagccgccactggcgggaacgtca

SEQ ID NO: 2514 - DNA, 25 bp, E. coli
gggttgtggacctggctggatgagc

SEQ ID NO: 2515 - DNA, 25 bp, E. coli
tactggcaatgcttccacagcgtaa

SEQ ID NO: 2516 - DNA, 25 bp, E. coli
gagtgctgacgccttactggcaatg

SEQ ID NO: 2517 - DNA, 25 bp, E. coli
tacagcgccagagtgctgacgcctt

SEQ ID NO: 2518 - DNA, 25 bp, E. coli
aacatgcagatctacagcgccagag

SEQ ID NO: 2519 - DNA, 25 bp, E. coli
cgcacactatgagcaacatgcagat

SEQ ID NO: 2520 - DNA, 25 bp, E. coli
gtcgggcagccgcacactatgagca

SEQ ID NO: 2521 - DNA, 25 bp, E. coli
cagcggcatttggtcgggcagccgc

SEQ ID NO: 2522 - DNA, 25 bp, E. coli
gccgccaatgcttgttcaggcacgc

SEQ ID NO: 2523 - DNA, 25 bp, E. coli
gatcttgcatggtgcaatctcgcag

SEQ ID NO: 2524 - DNA, 25 bp, E. coli
caatctcgcagtgcagtggtgcggt

SEQ ID NO: 2525 - DNA, 25 bp, E. coli
gatcttgcatggagcaatctcgcag

SEQ ID NO: 2526 - DNA, 25 bp, E. coli
cgacgttcgatcttgcatggagcaa

SEQ ID NO: 2527 - DNA, 25 bp, E. coli
cgttagcgactgcgacgttcgatct

SEQ ID NO: 2528 - DNA, 25 bp, E. coli
gccgcagaccattatctggcgggag

SEQ ID NO: 2529 - DNA, 25 bp, E. coli
agaaggatgccgcagaccattatct

SEQ ID NO: 2530 - DNA, 25 bp, E. coli
gccgcagaccataatctggcgggag

SEQ ID NO: 2531 - DNA, 25 bp, E. coli
gccttagatctcacgccgccaatgc

SEQ ID NO: 2532 - DNA, 25 bp, E. coli
cgacgttcgatcatgcatggagcaa

SEQ ID NO: 2533 - DNA, 25 bp, E. coli
tgagccgccactcgcgggaacgtca

SEQ ID NO: 2534 - DNA, 25 bp, E. coli
caatctcgcagtccagtggtgcggt

SEQ ID NO: 2535 - DNA, 25 bp, E. coli
atttatccacgggactccgcgagct

SEQ ID NO: 2536 - DNA, 25 bp, E. coli
agaaggatgccggagaccattatct

SEQ ID NO: 2537 - DNA, 25 bp, E. coli
tgttcaggcacggcagaaggatgcc

SEQ ID NO: 2538 - DNA, 25 bp, E. coli
atttatccacggcactccgcgagct

SEQ ID NO: 2539 - DNA, 25 bp, E. coli
gtcgggcagccggacactatgagca

SEQ ID NO: 2540 - DNA, 25 bp, E. coli
gccgccaatgctagttcaggcacgc

SEQ ID NO: 2541 - DNA, 25 bp, E. coli
gcgcaggtgacgcccttagatctct

SEQ ID NO: 2542 - DNA, 25 bp, E. coli
cgttagcgactgggacgttcgatct

SEQ ID NO: 2543 - DNA, 25 bp, E. coli
ggtggacgagcgaccgcatgctaat

SEQ ID NO: 2544 - DNA, 25 bp, E. coli
aacagtcgctgatcggcgtgcatta

SEQ ID NO: 2545 - DNA, 25 bp, E. coli
tttaccgccagatgaaatcgaacag

SEQ ID NO: 2546 - DNA, 25 bp, E. coli
gcgttcgcagttgcagcgattgcaa

SEQ ID NO: 2547 - DNA, 25 bp, E. coli
atgatgcgctcactgccatgcgttc

SEQ ID NO: 2548 - DNA, 25 bp, E. coli
gatgaaatcgaacagtcgctgaacg

SEQ ID NO: 2549 - DNA, 25 bp, E. coli
aacagtcgctgaacggcgtgcatta

SEQ ID NO: 2550 - DNA, 25 bp, E. coli
acatcatattcagcccatcacgctg

SEQ ID NO: 2551 - DNA, 25 bp, E. coli
gatgaaatcgaagagtcgctgaacg

SEQ ID NO: 2552 - DNA, 25 bp, E. coli
tttaccgccagaagaaatcgaacag

SEQ ID NO: 2553 - DNA, 25 bp, E. coli
ttcagcccatcacgctgtggtttga

SEQ ID NO: 2554 - DNA, 25 bp, E. coli
attaacgcgttcgcagttgcagcga

SEQ ID NO: 2555 - DNA, 25 bp, E. coli
tacccgaacgtcttcaggcgtggca

SEQ ID NO: 2556 - DNA, 25 bp, E. coli
agttgcagcgattgcaactggcctg

SEQ ID NO: 2557 - DNA, 25 bp, E. coli
ctcagtgccatgggttcgctgaaag

SEQ ID NO: 2558 - DNA, 25 bp, E. coli
catgcgttcgctcaaaggcatcggt

SEQ ID NO: 2559 - DNA, 25 bp, E. coli
ctgaaaggcatccgtgccacgcatc

SEQ ID NO: 2560 - DNA, 25 bp, E. coli
atcacgctgtggtttgatgatgcgc

SEQ ID NO: 2561 - DNA, 25 bp, E. coli
ggcatcggtgcctcgcatcttcatg

SEQ ID NO: 2562 - DNA, 25 bp, E. coli
tgccacgcatctacatgaagggcgc

SEQ ID NO: 2563 - DNA, 25 bp, E. coli
atcttcatgaagcgcgcgacccgcg

SEQ ID NO: 2564 - DNA, 25 bp, E. coli
ggtttgatgatgcgctcagtgccat

SEQ ID NO: 2565 - DNA, 25 bp, E. coli
attaacgcgttcccagttgcagcga

SEQ ID NO: 2566 - DNA, 25 bp, E. coli
agttgcagcgatagcaactggcctg

SEQ ID NO: 2567 - DNA, 25 bp, E. coli
gcgttcgcagttccagcgattgcaa

SEQ ID NO: 2568 - DNA, 25 bp, E. coli
cgtccgcatgcttatcgctttttac

SEQ ID NO: 2569 - DNA, 25 bp, E. coli
ctgaaaggcatcggtgccacgcatc

SEQ ID NO: 2570 - DNA, 25 bp, E. coli
atcttcatgaagggcgcgacccgcg

SEQ ID NO: 2571 - DNA, 25 bp, E. coli
atgatgcgctcagtgccatgcgttc

SEQ ID NO: 2572 - DNA, 25 bp, E. coli
ctcagtgccatgcgttcgctgaaag

SEQ ID NO: 2573 - DNA, 25 bp, E. coli
catgcgttcgctgaaaggcatcggt

SEQ ID NO: 2574 - DNA, 25 bp, E. coli
tacccgaacgtcatcaggcgtggca

SEQ ID NO: 2575 - DNA, 25 bp, E. coli
acatcatattcaccccatcacgctg

SEQ ID NO: 2576 - DNA, 25 bp, E. coli
ggtggacgagcgtccgcatgctaat

SEQ ID NO: 2577 - DNA, 25 bp, E. coli
ttcagcccatcaggctgtggtttga

SEQ ID NO: 2578 - DNA, 25 bp, E. coli
tgccacgcatcttcatgaagggcgc

SEQ ID NO: 2579 - DNA, 25 bp, E. coli
ggtttgatgatgggctcagtgccat

SEQ ID NO: 2580 - DNA, 25 bp, E. coli
atcacgctgtggattgatgatgcgc

SEQ ID NO: 2581 - DNA, 25 bp, E. coli
ggcatcggtgccacgcatcttcatg

SEQ ID NO: 2582 - DNA, 25 bp, E. coli
cgtccgcatgctaatcgctttttac

SEQ ID NO: 2583 - DNA, 25 bp, E. coli
ggaaaaagtgcgggatgccgggatc

SEQ ID NO: 2584 - DNA, 25 bp, E. coli
atacgctggaaatagtgcgcgatgc

SEQ ID NO: 2585 - DNA, 25 bp, E. coli
ggaaaaagtgcgcgatgccgggatc

SEQ ID NO: 2586 - DNA, 25 bp, E. coli
acgcacttatcacgaacgcctcgat

SEQ ID NO: 2587 - DNA, 25 bp, E. coli
acgcacttatcaggaacgcctcgat

SEQ ID NO: 2588 - DNA, 25 bp, E. coli
gccggagttttagggcaatatcatc

SEQ ID NO: 2589 - DNA, 25 bp, E. coli
gccggagttttacggcaatatcatc

SEQ ID NO: 2590 - DNA, 25 bp, E. coli
atacgctggaaaaagtgcgcgatgc

SEQ ID NO: 2591 - DNA, 25 bp, E. coli
gcaatatcatcaccacacgcactta

SEQ ID NO: 2592 - DNA, 25 bp, E. coli
agtgcgcgatgcggggatcaaagtc

SEQ ID NO: 2593 - DNA, 25 bp, E. coli
gccggattattggtgcaactggcaa

SEQ ID NO: 2594 - DNA, 25 bp, E. coli
atcaccacacgcacttatcaggaac

SEQ ID NO: 2595 - DNA, 25 bp, E. coli
gcaatatcatcagcacacgcactta

SEQ ID NO: 2596 - DNA, 25 bp, E. coli
gttttacggcaaaatcatcaccaca

SEQ ID NO: 2597 - DNA, 25 bp, E. coli
gttttacggcaatatcatcaccaca

SEQ ID NO: 2598 - DNA, 25 bp, E. coli
atcaccacacgctcttatcaggaac

SEQ ID NO: 2599 - DNA, 25 bp, E. coli
caatcaacatgcaggtgaaggtgaa

SEQ ID NO: 2600 - DNA, 25 bp, E. coli
acgccgcttgcccataacgatgatg

SEQ ID NO: 2601 - DNA, 25 bp, E. coli
ttgccgataacgttgatgtcgatgc

SEQ ID NO: 2602 - DNA, 25 bp, E. coli
acgatgatgtcgttgcctttgattt

SEQ ID NO: 2603 - DNA, 25 bp, E. coli
gccggattattgctgcaactggcaa

SEQ ID NO: 2604 - DNA, 25 bp, E. coli
attgctgcaactggcaaacctgccg

SEQ ID NO: 2605 - DNA, 25 bp, E. coli
tggtgaaggtgataggcacgccgct

SEQ ID NO: 2606 - DNA, 25 bp, E. coli
cgccggaaagcgtgccaatcaacat

SEQ ID NO: 2607 - DNA, 25 bp, E. coli
aagatcgcgccggattattgctgca

SEQ ID NO: 2608 - DNA, 25 bp, E. coli
aagatcgcgccgcattattgctgca

SEQ ID NO: 2609 - DNA, 25 bp, E. coli
acgatgatgtcgatgcctttgattt

SEQ ID NO: 2610 - DNA, 25 bp, E. coli
gccgggatcaaactctgttctggcg

SEQ ID NO: 2611 - DNA, 25 bp, E. coli
aagcgtgccaatgaacatgctggtg

SEQ ID NO: 2612 - DNA, 25 bp, E. coli
cgccggaaagcgagccaatcaacat

SEQ ID NO: 2613 - DNA, 25 bp, E. coli
attgctgcaactcgcaaacctgccg

SEQ ID NO: 2614 - DNA, 25 bp, E. coli
gccgggatcaaagtctgttctggcg

SEQ ID NO: 2615 - DNA, 25 bp, E. coli
aagcgtgccaatcaacatgctggtg

SEQ ID NO: 2616 - DNA, 25 bp, E. coli
aagtctgttctgccggcattgtggg

SEQ ID NO: 2617 - DNA, 25 bp, E. coli
caatcaacatgctggtgaaggtgaa

SEQ ID NO: 2618 - DNA, 25 bp, E. coli
agtgcgcgatgccgggatcaaagtc

SEQ ID NO: 2619 - DNA, 25 bp, E. coli
aagtctgttctggcggcattgtggg

SEQ ID NO: 2620 - DNA, 25 bp, E. coli
acgccgcttgccgataacgatgatg

SEQ ID NO: 2621 - DNA, 25 bp, E. coli
tggtgaaggtgaaaggcacgccgct

SEQ ID NO: 2622 - DNA, 25 bp, E. coli
ttgccgataacgatgatgtcgatgc

SEQ ID NO: 2623 - DNA, 25 bp, E. coli
attgtcgcaagtgacagaattattt

SEQ ID NO: 2624 - DNA, 25 bp, E. coli
ggatctgctgtttgaagcgcagcag

SEQ ID NO: 2625 - DNA, 25 bp, E. coli
gttgctggatctcctgtttgaagcg

SEQ ID NO: 2626 - DNA, 25 bp, E. coli
caaagcgaaagcggcaggatcgacg

SEQ ID NO: 2627 - DNA, 25 bp, E. coli
tgaacaggtgctggagtcggcgcgc

SEQ ID NO: 2628 - DNA, 25 bp, E. coli
gcgcagcaggtgcatcgccagcatt

SEQ ID NO: 2629 - DNA, 25 bp, E. coli
gcatcgccagcatttcgatcctcgt

SEQ ID NO: 2630 - DNA, 25 bp, E. coli
gcatttcgatcctcgtcaggtgcag

SEQ ID NO: 2631 - DNA, 25 bp, E. coli
cgatcctcgtcaggtgcaggtcagc

SEQ ID NO: 2632 - DNA, 25 bp, E. coli
gcaggtcagcacgttgctgtcgatt

SEQ ID NO: 2633 - DNA, 25 bp, E. coli
tcgtcaggtgcaggtcagcacgttg

SEQ ID NO: 2634 - DNA, 25 bp, E. coli
ggatctgctgttagaagcgcagcag

SEQ ID NO: 2635 - DNA, 25 bp, E. coli
ggagtcggcgcgcaaagcgaaagcg

SEQ ID NO: 2636 - DNA, 25 bp, E. coli
gcaggtgcatcggcagcatttcgat

SEQ ID NO: 2637 - DNA, 25 bp, E. coli
cagcacgttgctgtcgattaagacc

SEQ ID NO: 2638 - DNA, 25 bp, E. coli
ggcaggatcgacccgcttctgtatg

SEQ ID NO: 2639 - DNA, 25 bp, E. coli
gctgtcgattaagaccggagcttgt

SEQ ID NO: 2640 - DNA, 25 bp, E. coli
agcttgtccggaagattgcaaatac

SEQ ID NO: 2641 - DNA, 25 bp, E. coli
agattgcaaatactgcccgcaaacg

SEQ ID NO: 2642 - DNA, 25 bp, E. coli
caaatactgcccgcaaacgtcgcgc

SEQ ID NO: 2643 - DNA, 25 bp, E. coli
gcgcagcaggtggatcgccagcatt

SEQ ID NO: 2644 - DNA, 25 bp, E. coli
agattgcaaatagtgcccgcaaacg

SEQ ID NO: 2645 - DNA, 25 bp, E. coli
attgtcgcaagtcacagaattattt

SEQ ID NO: 2646 - DNA, 25 bp, E. coli
ggcaggatcgacgcgcttctgtatg

SEQ ID NO: 2647 - DNA, 25 bp, E. coli
gcaggtgcatcgccagcatttcgat

SEQ ID NO: 2648 - DNA, 25 bp, E. coli
caaatactgcccccaaacgtcgcgc

SEQ ID NO: 2649 - DNA, 25 bp, E. coli
gcatcgccagcaattcgatcctcgt

SEQ ID NO: 2650 - DNA, 25 bp, E. coli
gacattgtcgcaagtcacagaatta

SEQ ID NO: 2651 - DNA, 25 bp, E. coli
caaagcgaaagccgcaggatcgacg

SEQ ID NO: 2652 - DNA, 25 bp, E. coli
ggagtcggcgcggaaagcgaaagcg

SEQ ID NO: 2653 - DNA, 25 bp, E. coli
cagcacgttgctctcgattaagacc

SEQ ID NO: 2654 - DNA, 25 bp, E. coli
gacattgtcgcatgtcacagaatta

SEQ ID NO: 2655 - DNA, 25 bp, E. coli
tgaacaggtgctcgagtcggcgcgc

SEQ ID NO: 2656 - DNA, 25 bp, E. coli
agcttgtccggatgattgcaaatac

SEQ ID NO: 2657 - DNA, 25 bp, E. coli
gcaggtcagcaccttgctgtcgatt

SEQ ID NO: 2658 - DNA, 25 bp, E. coli
tcgtcaggtgcacgtcagcacgttg

SEQ ID NO: 2659 - DNA, 25 bp, E. coli
cgatcctcgtcacgtgcaggtcagc

SEQ ID NO: 2660 - DNA, 25 bp, E. coli
gcatttcgatccacgtcaggtgcag

SEQ ID NO: 2661 - DNA, 25 bp, E. coli
gttgctggatctgctgtttgaagcg

SEQ ID NO: 2662 - DNA, 25 bp, E. coli
gctgtcgattaacaccggagcttgt

SEQ ID NO: 2663 - DNA, 25 bp, E. coli
acaggcgctgatcaccccggacacc

SEQ ID NO: 2664 - DNA, 25 bp, E. coli
gtgctttatggcaggcgcaaactcg

SEQ ID NO: 2665 - DNA, 25 bp, E. coli
tcaggcgatgtgctttatggcaggc

SEQ ID NO: 2666 - DNA, 25 bp, E. coli
acagcaacgtctagaacaggcgctg

SEQ ID NO: 2667 - DNA, 25 bp, E. coli
gccggacgcgagcagatgaacgaac

SEQ ID NO: 2668 - DNA, 25 bp, E. coli
tacggttgcaaactgctgaccacgc

SEQ ID NO: 2669 - DNA, 25 bp, E. coli
ggtcgcgcggatgatgatgccaacc

SEQ ID NO: 2670 - DNA, 25 bp, E. coli
caaactgctgaccacgccgaatccg

SEQ ID NO: 2671 - DNA, 25 bp, E. coli
atattacaacgccgcagcattatga

SEQ ID NO: 2672 - DNA, 25 bp, E. coli
cgtcttgaacagccgctgatgaccc

SEQ ID NO: 2673 - DNA, 25 bp, E. coli
gacctgcaactgatccgcaaactgg

SEQ ID NO: 2674 - DNA, 25 bp, E. coli
caaactgctgacgacgccgaatccg

SEQ ID NO: 2675 - DNA, 25 bp, E. coli
acagcaacgtcttgaacaggcgctg

SEQ ID NO: 2676 - DNA, 25 bp, E. coli
gggctaaatccgcagcaaactgccg

SEQ ID NO: 2677 - DNA, 25 bp, E. coli
cgcagcaaactgccgtgctggcagg

SEQ ID NO: 2678 - DNA, 25 bp, E. coli
aacagactcaggcgatgtgctttat

SEQ ID NO: 2679 - DNA, 25 bp, E. coli
gacctgcaactgttccgcaaactgg

SEQ ID NO: 2680 - DNA, 25 bp, E. coli
atggcaggcgcaaactcgattttct

SEQ ID NO: 2681 - DNA, 25 bp, E. coli
cgagcagatgaacgaacagactcag

SEQ ID NO: 2682 - DNA, 25 bp, E. coli
gatgaacgaacacactcaggcgatg

SEQ ID NO: 2683 - DNA, 25 bp, E. coli
cgtcttgaacaggcgctgatgaccc

SEQ ID NO: 2684 - DNA, 25 bp, E. coli
atggcaggcgcatactcgattttct

SEQ ID NO: 2685 - DNA, 25 bp, E. coli
gtgctttatggctggcgcaaactcg

SEQ ID NO: 2686 - DNA, 25 bp, E. coli
cgagcagatgaaggaacagactcag

SEQ ID NO: 2687 - DNA, 25 bp, E. coli
tcaggcgatgtggtttatggcaggc

SEQ ID NO: 2688 - DNA, 25 bp, E. coli
acaggcgctgatgaccccggacacc

SEQ ID NO: 2689 - DNA, 25 bp, E. coli
gcgcctttctgccggacgcgagcag

SEQ ID NO: 2690 - DNA, 25 bp, E. coli
tgccaacctcttacgtgcgcctttc

SEQ ID NO: 2691 - DNA, 25 bp, E. coli
ggatcatgatgccaacctcttacgt

SEQ ID NO: 2692 - DNA, 25 bp, E. coli
ggtcgcgcggatcatgatgccaacc

SEQ ID NO: 2693 - DNA, 25 bp, E. coli
aacagactcaggggatgtgctttat

SEQ ID NO: 2694 - DNA, 25 bp, E. coli
atattacaacgcggcagcattatga

SEQ ID NO: 2695 - DNA, 25 bp, E. coli
ggatcatgatgcgaacctcttacgt

SEQ ID NO: 2696 - DNA, 25 bp, E. coli
gcgcctttctgcgggacgcgagcag

SEQ ID NO: 2697 - DNA, 25 bp, E. coli
cgcagcaaactggcgtgctggcagg

SEQ ID NO: 2698 - DNA, 25 bp, E. coli
tgccaacctctttcgtgcgcctttc

SEQ ID NO: 2699 - DNA, 25 bp, E. coli
tacggttgcaaagtgctgaccacgc

SEQ ID NO: 2700 - DNA, 25 bp, E. coli
gggctaaatccggagcaaactgccg

SEQ ID NO: 2701 - DNA, 25 bp, E. coli
gccggacgcgaggagatgaacgaac

SEQ ID NO: 2702 - DNA, 25 bp, E. coli
gatgaacgaacagactcaggcgatg

SEQ ID NO: 2703 - DNA, 25 bp, E. coli
tactgaggccgtactgtcgagttcc

SEQ ID NO: 2704 - DNA, 25 bp, E. coli
taaaccgacgtgctcatgggtgctg

SEQ ID NO: 2705 - DNA, 25 bp, E. coli
tactgaggccgttctgtcgagttcc

SEQ ID NO: 2706 - DNA, 25 bp, E. coli
taaaccgacgtggtcatgggtgctg

SEQ ID NO: 2707 - DNA, 25 bp, E. coli
aaaatagttctccatgccagagagg

SEQ ID NO: 2708 - DNA, 25 bp, E. coli
aaaatagttctcgatgccagagagg

SEQ ID NO: 2709 - DNA, 25 bp, E. coli
ttatgtttagagagttccccgcgcc

SEQ ID NO: 2710 - DNA, 25 bp, E. coli
ttatgtttagagtgttccccgcgcc

SEQ ID NO: 2711 - DNA, 25 bp, E. coli
ttattatgttccgtgcatcagcggg

SEQ ID NO: 2712 - DNA, 25 bp, E. coli
ttattatgttccctgcatcagcggg

SEQ ID NO: 2713 - DNA, 25 bp, E. coli
tgtttgcggcataaacgctcaccag

SEQ ID NO: 2714 - DNA, 25 bp, E. coli
tgtttgcggcattaacgctcaccag

SEQ ID NO: 2715 - DNA, 25 bp, E. coli
gatttgcgaaaacaggtgttccccg

SEQ ID NO: 2716 - DNA, 25 bp, E. coli
gatttgcgaaaagaggtgttccccg

SEQ ID NO: 2717 - DNA, 25 bp, E. coli
gcaaaaaggcgttatgtgttccccg

SEQ ID NO: 2718 - DNA, 25 bp, E. coli
gcaaaaaggcgtaatgtgttccccg

SEQ ID NO: 2719 - DNA, 25 bp, E. coli
cattcaggtatgatcaggccgggca

SEQ ID NO: 2720 - DNA, 25 bp, E. coli
cattcaggtatgttcaggccgggca

SEQ ID NO: 2721 - DNA, 25 bp, E. coli
ggataaaccggagcctgacgagact

SEQ ID NO: 2722 - DNA, 25 bp, E. coli
ggataaaccgaggagatacacggct

SEQ ID NO: 2723 - DNA, 25 bp, E. coli
ggataaaccggaccctgacgagact

SEQ ID NO: 2724 - DNA, 25 bp, E. coli
ggataaaccgagcagatacacggct

SEQ ID NO: 2725 - DNA, 25 bp, E. coli
atatctggcgcctagccgtcgatgc

SEQ ID NO: 2726 - DNA, 25 bp, E. coli
acgggatccaggcacaggacgacca

SEQ ID NO: 2727 - DNA, 25 bp, E. coli
agccggacacccaatcgccacttat

SEQ ID NO: 2728 - DNA, 25 bp, E. coli
acaggacgaccagggcaatgtctgg

SEQ ID NO: 2729 - DNA, 25 bp, E. coli
agccggacaccctatcgccacttat

SEQ ID NO: 2730 - DNA, 25 bp, E. coli
atatctggcgccaagccgtcgatgc

SEQ ID NO: 2731 - DNA, 25 bp, E. coli
acaggacgaccacggcaatgtctgg

SEQ ID NO: 2732 - DNA, 25 bp, E. coli
acgggatccagggacaggacgacca

SEQ ID NO: 2733 - DNA, 25 bp, E. coli
aaataatgcgcgaccgctgacgctg

SEQ ID NO: 2734 - DNA, 25 bp, E. coli
aaataatgcgcgtccgctgacgctg

SEQ ID NO: 2735 - DNA, 25 bp, E. coli
tttcgcaccaaaaaatgcgcgtccg

SEQ ID NO: 2736 - DNA, 25 bp, E. coli
tttcgcaccaaataatgcgcgtccg

SEQ ID NO: 2737 - DNA, 25 bp, E. coli
tgcctttcgcacgaaataatgcgcg

SEQ ID NO: 2738 - DNA, 25 bp, E. coli
tgcctttcgcaccaaataatgcgcg

SEQ ID NO: 2739 - DNA, 25 bp, E. coli
gcaccaaataatccgcgtccgctga

SEQ ID NO: 2740 - DNA, 25 bp, E. coli
gcaccaaataatgcgcgtccgctga

SEQ ID NO: 2741 - DNA, 25 bp, E. coli
gcagccagtgcctttcgcaccaaat

SEQ ID NO: 2742 - DNA, 25 bp, E. coli
gcagccagtgccattcgcaccaaat

SEQ ID NO: 2743 - DNA, 25 bp, E. coli
gatcatcagccggacagttattgcc

SEQ ID NO: 2744 - DNA, 25 bp, E. coli
tggcgccaagccctcgatgccatgt

SEQ ID NO: 2745 - DNA, 25 bp, E. coli
tggcgccaagccgtcgatgccatgt

SEQ ID NO: 2746 - DNA, 25 bp, E. coli
gatcatcagccgcacagttattgcc

SEQ ID NO: 2747 - DNA, 25 bp, E. coli
caccatcgtcagtcaaatcattgcc

SEQ ID NO: 2748 - DNA, 25 bp, E. coli
caccatcgtcagacaaatcattgcc

SEQ ID NO: 2749 - DNA, 25 bp, E. coli
acgcttgccaccatcgtcagacaaa

SEQ ID NO: 2750 - DNA, 25 bp, E. coli
acgcttgccaccttcgtcagacaaa

SEQ ID NO: 2751 - DNA, 25 bp, E. coli
taccgaggccggatatggcaagttt

SEQ ID NO: 2752 - DNA, 25 bp, E. coli
tatcggtattgaagtccatgaagaa

SEQ ID NO: 2753 - DNA, 25 bp, E. coli
taccgaggccggttatggcaagttt

SEQ ID NO: 2754 - DNA, 25 bp, E. coli
tattgaagtccatgaagaaccgcgt

SEQ ID NO: 2755 - DNA, 25 bp, E. coli
tatcggtattgatgtccatgaagaa

SEQ ID NO: 2756 - DNA, 25 bp, E. coli
tattgaagtccaagaagaaccgcgt

SEQ ID NO: 2757 - DNA, 25 bp, E. coli
ttgctcgacgcgttgcacacgcttg

SEQ ID NO: 2758 - DNA, 25 bp, E. coli
ttgctcgacgcgatgcacacgcttg

SEQ ID NO: 2759 - DNA, 25 bp, E. coli
tgaagatgtcgtgctggtcaccccg

SEQ ID NO: 2760 - DNA, 25 bp, E. coli
tgaagatgtcgtcctggtcaccccg

SEQ ID NO: 2761 - DNA, 25 bp, E. coli
gcgggattgccgatcgtggcgcaga

SEQ ID NO: 2762 - DNA, 25 bp, E. coli
gcgggattgccgttcgtggcgcaga

SEQ ID NO: 2763 - DNA, 25 bp, E. coli
cgccgcgtgatttccgaggccggtt

SEQ ID NO: 2764 - DNA, 25 bp, E. coli
cgccgcgtgattaccgaggccggtt

SEQ ID NO: 2765 - DNA, 25 bp, E. coli
cgcattgaagatctcgtgctggtca

SEQ ID NO: 2766 - DNA, 25 bp, E. coli
cgcattgaagatgtcgtgctggtca

SEQ ID NO: 2767 - DNA, 25 bp, E. coli
tggcaagtttttcggccataacacc

SEQ ID NO: 2768 - DNA, 25 bp, E. coli
tggcaagtttttgggccataacacc

SEQ ID NO: 2769 - DNA, 25 bp, E. coli
aaagcactggatctcgccactaacg

SEQ ID NO: 2770 - DNA, 25 bp, E. coli
aaagcactggatgtcgccactaacg

SEQ ID NO: 2771 - DNA, 25 bp, E. coli
tatcccgctggataaagcaccggaa

SEQ ID NO: 2772 - DNA, 25 bp, E. coli
tatcccgctggaaaaagcaccggaa

SEQ ID NO: 2773 - DNA, 25 bp, E. coli
tatttcagcggctcactcgtgggct

SEQ ID NO: 2774 - DNA, 25 bp, E. coli
tatttcagcggcacactcgtgggct

SEQ ID NO: 2775 - DNA, 25 bp, E. coli
tggtcgtcggtagagatggcattcc

SEQ ID NO: 2776 - DNA, 25 bp, E. coli
tgaagcgcgtcgtaatggtgccacc

SEQ ID NO: 2777 - DNA, 25 bp, E. coli
tgaagcgcgtcgaaatggtgccacc

SEQ ID NO: 2778 - DNA, 25 bp, E. coli
tcattgagggtatagccggtaacgc

SEQ ID NO: 2779 - DNA, 25 bp, E. coli
tctattgcgcgaatgacacgatggc

SEQ ID NO: 2780 - DNA, 25 bp, E. coli
tcattgagggtaaagccggtaacgc

SEQ ID NO: 2781 - DNA, 25 bp, E. coli
tctattgcgcgattgacacgatggc

SEQ ID NO: 2782 - DNA, 25 bp, E. coli
gaaatccggcaacgttatcccgctg

SEQ ID NO: 2783 - DNA, 25 bp, E. coli
gaaatccggcaaggttatcccgctg

SEQ ID NO: 2784 - DNA, 25 bp, E. coli
cgcaaaatggtgcaagccggacaaa

SEQ ID NO: 2785 - DNA, 25 bp, E. coli
cccgcgcatggaaaaaaggcattta

SEQ ID NO: 2786 - DNA, 25 bp, E. coli
cgcaaaatggtggaagccggacaaa

SEQ ID NO: 2787 - DNA, 25 bp, E. coli
cccgcgcatggataaaaggcattta

SEQ ID NO: 2788 - DNA, 25 bp, E. coli
tggtcgtcggtacagatggcattcc

SEQ ID NO: 2789 - DNA, 25 bp, E. coli
gatggttgacgcagagaaatccggc

SEQ ID NO: 2790 - DNA, 25 bp, E. coli
gatggttgacgctgagaaatccggc

SEQ ID NO: 2791 - DNA, 25 bp, E. coli
caactggattgaaaagctgggagac

SEQ ID NO: 2792 - DNA, 25 bp, E. coli
caactggattgataagctgggagac

SEQ ID NO: 2793 - DNA, 25 bp, E. coli
catgttgtgtcacgtactggctgca

SEQ ID NO: 2794 - DNA, 25 bp, E. coli
catgttgtgtcaggtactggctgca

SEQ ID NO: 2795 - DNA, 25 bp, E. coli
taaacaagtccctgcagaagcggaa

SEQ ID NO: 2796 - DNA, 25 bp, E. coli
taaacaagtcccagcagaagcggaa

SEQ ID NO: 2797 - DNA, 25 bp, E. coli
tatcgactgattgagcaggccaaag

SEQ ID NO: 2798 - DNA, 25 bp, E. coli
tagacgggagcctaatttcgacact

SEQ ID NO: 2799 - DNA, 25 bp, E. coli
tagacgggagccaaatttcgacact

SEQ ID NO: 2800 - DNA, 25 bp, E. coli
tatcgactgattcagcaggccaaag

SEQ ID NO: 2801 - DNA, 25 bp, E. coli
tattatcgacgagctgaaggcccgt

SEQ ID NO: 2802 - DNA, 25 bp, E. coli
tattatcgacgacctgaaggcccgt

SEQ ID NO: 2803 - DNA, 25 bp, E. coli
gaaggacaatataagggcgctcaac

SEQ ID NO: 2804 - DNA, 25 bp, E. coli
gaaggacaatattagggcgctcaac

SEQ ID NO: 2805 - DNA, 25 bp, E. coli
gacactctggctgaactgtgcgaca

SEQ ID NO: 2806 - DNA, 25 bp, E. coli
gacactctggctcaactgtgcgaca

SEQ ID NO: 2807 - DNA, 25 bp, E. coli
gaaaacggcaacgagatcggcaaag

SEQ ID NO: 2808 - DNA, 25 bp, E. coli
gaaaacggcaaccagatcggcaaag

SEQ ID NO: 2809 - DNA, 25 bp, E. coli
gtttatgccctgatgccgatgcgtg

SEQ ID NO: 2810 - DNA, 25 bp, E. coli
gtttatgccctgttgccgatgcgtg

SEQ ID NO: 2811 - DNA, 25 bp, E. coli
taaatggattcgtgttcacccggaa

SEQ ID NO: 2812 - DNA, 25 bp, E. coli
taaatggattcgagttcacccggaa

SEQ ID NO: 2813 - DNA, 25 bp, E. coli
aacaacaagatgctcgtgccctcgc

SEQ ID NO: 2814 - DNA, 25 bp, E. coli
aacaacaagatggtcgtgccctcgc

SEQ ID NO: 2815 - DNA, 25 bp, E. coli
tatcaacaacaagatgctcgtgccc

SEQ ID NO: 2816 - DNA, 25 bp, E. coli
tatcaacaacaacatgctcgtgccc

SEQ ID NO: 2817 - DNA, 25 bp, E. coli
ttgagcagaacgtcagctggagtct

SEQ ID NO: 2818 - DNA, 25 bp, E. coli
ttgagcagaacgacagctggagtct

SEQ ID NO: 2819 - DNA, 25 bp, E. coli
tcatctggtgggttagcgtaccgca

SEQ ID NO: 2820 - DNA, 25 bp, E. coli
tcatctggtgggatagcgtaccgca

SEQ ID NO: 2821 - DNA, 25 bp, E. coli
gcgcgcttaacgtcgatgagcgtga

SEQ ID NO: 2822 - DNA, 25 bp, E. coli
gctggtatcaacaacaagatgctcg

SEQ ID NO: 2823 - DNA, 25 bp, E. coli
gcgcgcttaacgacgatgagcgtga

SEQ ID NO: 2824 - DNA, 25 bp, E. coli
gcggttatatcggtggtatcaacaa

SEQ ID NO: 2825 - DNA, 25 bp, E. coli
gctggtatcaactacaagatgctcg

SEQ ID NO: 2826 - DNA, 25 bp, E. coli
gcggttatatcgctggtatcaacaa

SEQ ID NO: 2827 - DNA, 25 bp, E. coli
cgatgagcgtgaccggttatatcgc

SEQ ID NO: 2828 - DNA, 25 bp, E. coli
cgttttgagcagtacgtcagctgga

SEQ ID NO: 2829 - DNA, 25 bp, E. coli
cgttttgagcagaacgtcagctgga

SEQ ID NO: 2830 - DNA, 25 bp, E. coli
cgatgagcgtgagcggttatatcgc

SEQ ID NO: 2831 - DNA, 25 bp, E. coli
cgactgggcgctgatctggtgggat

SEQ ID NO: 2832 - DNA, 25 bp, E. coli
cgactgggcgctcatctggtgggat

SEQ ID NO: 2833 - DNA, 25 bp, E. coli
cttaacgacgatcagcgtgagcggt

SEQ ID NO: 2834 - DNA, 25 bp, E. coli
cttaacgacgatgagcgtgagcggt

SEQ ID NO: 2835 - DNA, 25 bp, E. coli
cagttgccgggtgataaagtcacgc

SEQ ID NO: 2836 - DNA, 25 bp, E. coli
cagttgccgggtcataaagtcacgc

SEQ ID NO: 2837 - DNA, 25 bp, E. coli
accgggagtaggcaccatcgcgact

SEQ ID NO: 2838 - DNA, 25 bp, E. coli
accgggagtagggaccatcgcgact

SEQ ID NO: 2839 - DNA, 25 bp, E. coli
tggggcttgttgtaacccagcaggc

SEQ ID NO: 2840 - DNA, 25 bp, E. coli
tggggcttgttgaaacccagcaggc

SEQ ID NO: 2841 - DNA, 25 bp, E. coli
tggtggagcaaggtttgaagacttc

SEQ ID NO: 2842 - DNA, 25 bp, E. coli
ccagcaggcgctggttgctaacggc

SEQ ID NO: 2843 - DNA, 25 bp, E. coli
gccgcattggtggagcaagctttga

SEQ ID NO: 2844 - DNA, 25 bp, E. coli
ccagcaggcgctcgttgctaacggc

SEQ ID NO: 2845 - DNA, 25 bp, E. coli
gccgcattggtgcagcaagctttga

SEQ ID NO: 2846 - DNA, 25 bp, E. coli
gtgataaagtcaggccttacatcgc

SEQ ID NO: 2847 - DNA, 25 bp, E. coli
ggttgctaacggcttgcgtcacaag

SEQ ID NO: 2848 - DNA, 25 bp, E. coli
gtcagccgcattcgtggagcaagct

SEQ ID NO: 2849 - DNA, 25 bp, E. coli
ggttgctaacgggttgcgtcacaag

SEQ ID NO: 2850 - DNA, 25 bp, E. coli
gtcagccgcattggtggagcaagct

SEQ ID NO: 2851 - DNA, 25 bp, E. coli
gtgataaagtcacgccttacatcgc

SEQ ID NO: 2852 - DNA, 25 bp, E. coli
tggtggagcaagctttgaagacttc

SEQ ID NO: 2853 - DNA, 25 bp, E. coli
taacggcttgcgtcacaagatccgt

SEQ ID NO: 2854 - DNA, 25 bp, E. coli
taacggcttgcgacacaagatccgt

SEQ ID NO: 2855 - DNA, 25 bp, E. coli
gagtaggcaccaacgcgactggcgt

SEQ ID NO: 2856 - DNA, 25 bp, E. coli
gagtaggcaccatcgcgactggcgt

SEQ ID NO: 2857 - DNA, 25 bp, E. coli
caaagcgatggtttactggcgaagg

SEQ ID NO: 2858 - DNA, 25 bp, E. coli
caaagcgatggtatactggcgaagg

SEQ ID NO: 2859 - DNA, 25 bp, E. coli
cagttatcgcacaggttatcggcgt

SEQ ID NO: 2860 - DNA, 25 bp, E. coli
catccactgggtctggtcatgctgg

SEQ ID NO: 2861 - DNA, 25 bp, E. coli
catccactgggtgtggtcatgctgg

SEQ ID NO: 2862 - DNA, 25 bp, E. coli
cagttatcgcactggttatcggcgt

SEQ ID NO: 2863 - DNA, 25 bp, E. coli
actgtttgccatgaacgcgcaggcg

SEQ ID NO: 2864 - DNA, 25 bp, E. coli
actgtttgccatcaacgcgcaggcg

SEQ ID NO: 2865 - DNA, 25 bp, E. coli
tatcggcgtattcattggcgtgcag

SEQ ID NO: 2866 - DNA, 25 bp, E. coli
tatcggcgtattgattggcgtgcag

SEQ ID NO: 2867 - DNA, 25 bp, E. coli
tgtctctggcgttaaagaagaaaac

SEQ ID NO: 2868 - DNA, 25 bp, E. coli
tgtctctggcgtaaaagaagaaaac

SEQ ID NO: 2869 - DNA, 25 bp, E. coli
tccgtgggccgtcactatgacacca

SEQ ID NO: 2870 - DNA, 25 bp, E. coli
tccgtgggccgtgactatgacacca

SEQ ID NO: 2871 - DNA, 25 bp, E. coli
gaaaatcaccgatcaaagcgatggt

SEQ ID NO: 2872 - DNA, 25 bp, E. coli
gaaaatcaccgaacaaagcgatggt

SEQ ID NO: 2873 - DNA, 25 bp, E. coli
gattggtctcgggaatattccgccg

SEQ ID NO: 2874 - DNA, 25 bp, E. coli
gattggtctcggcaatattccgccg

SEQ ID NO: 2875 - DNA, 25 bp, E. coli
ggtgagccgcttattaaccggcgcg

SEQ ID NO: 2876 - DNA, 25 bp, E. coli
ggtgagccgctttttaaccggcgcg

SEQ ID NO: 2877 - DNA, 25 bp, E. coli
tggccttggtgagtggattgcccac

SEQ ID NO: 2878 - DNA, 25 bp, E. coli
tggccttggtgactggattgcccac

SEQ ID NO: 2879 - DNA, 25 bp, E. coli
taacgaaaaccgtttatttaatgcg

SEQ ID NO: 2880 - DNA, 25 bp, E. coli
taacgaaaaccgattatttaatgcg

SEQ ID NO: 2881 - DNA, 25 bp, E. coli
tgaataaactgtacgacaagatccc

SEQ ID NO: 2882 - DNA, 25 bp, E. coli
tgaataaactgttcgacaagatccc

SEQ ID NO: 2883 - DNA, 25 bp, E. coli
tcgttgccagactattgacacgctg

SEQ ID NO: 2884 - DNA, 25 bp, E. coli
tcgttgccagacaattgacacgctg

SEQ ID NO: 2885 - DNA, 25 bp, E. coli
gcctcgccgaattgaccatgaataa

SEQ ID NO: 2886 - DNA, 25 bp, E. coli
gcctcgccgaatagaccatgaataa

SEQ ID NO: 2887 - DNA, 25 bp, E. coli
gaattatcagattatgaactggcgg

SEQ ID NO: 2888 - DNA, 25 bp, E. coli
gaattatcagataatgaactggcgg

SEQ ID NO: 2889 - DNA, 25 bp, E. coli
gacaagatcccttcctcagtatgga

SEQ ID NO: 2890 - DNA, 25 bp, E. coli
gaactggcggtaatttactcagccg

SEQ ID NO: 2891 - DNA, 25 bp, E. coli
gacaagatccctacctcagtatgga

SEQ ID NO: 2892 - DNA, 25 bp, E. coli
gaactggcggtattttactcagccg

SEQ ID NO: 2893 - DNA, 25 bp, E. coli
cctcagtatggatatttattcgcta

SEQ ID NO: 2894 - DNA, 25 bp, E. coli
cgctggagcgtgttatcgagaaaaa

SEQ ID NO: 2895 - DNA, 25 bp, E. coli
cgctggagcgtgatatcgagaaaaa

SEQ ID NO: 2896 - DNA, 25 bp, E. coli
cctcagtatggaaatttattcgcta

SEQ ID NO: 2897 - DNA, 25 bp, E. coli
ggtattttactcagccgcagatcac

SEQ ID NO: 2898 - DNA, 25 bp, E. coli
ggtattttactctgccgcagatcac

SEQ ID NO: 2899 - DNA, 25 bp, E. coli
taatgcgtttacgtcgttgccagac

SEQ ID NO: 2900 - DNA, 25 bp, E. coli
taatgcgtttacctcgttgccagac

SEQ ID NO: 2901 - DNA, 25 bp, E. coli
caatgcggcccgcaaactttacccg

SEQ ID NO: 2902 - DNA, 25 bp, E. coli
caatgcggcccggaaactttacccg

SEQ ID NO: 2903 - DNA, 25 bp, E. coli
cagacgtggcgcagttgcgcaaacc

SEQ ID NO: 2904 - DNA, 25 bp, E. coli
cagacgtggcgctgttgcgcaaacc

SEQ ID NO: 2905 - DNA, 25 bp, E. coli
tactcatcagcggtcaggatttacg

SEQ ID NO: 2906 - DNA, 25 bp, E. coli
tactcatcagcgctcaggatttacg

SEQ ID NO: 2907 - DNA, 25 bp, E. coli
accctttacccgtgcgcagttggcg

SEQ ID NO: 2908 - DNA, 25 bp, E. coli
acctgacgctgcaactcatcagcgg

SEQ ID NO: 2909 - DNA, 25 bp, E. coli
acctgacgctgctactcatcagcgg

SEQ ID NO: 2910 - DNA, 25 bp, E. coli
accctttacccgagcgcagttggcg

SEQ ID NO: 2911 - DNA, 25 bp, E. coli
tgagcggcgcagaagtggtcaatgc

SEQ ID NO: 2912 - DNA, 25 bp, E. coli
tgagcggcgcagtagtggtcaatgc

SEQ ID NO: 2913 - DNA, 25 bp, E. coli
gcggtcaggattaacgccccagcca

SEQ ID NO: 2914 - DNA, 25 bp, E. coli
gcggtcaggatttacgccccagcca

SEQ ID NO: 2915 - DNA, 25 bp, E. coli
ccgcgctgccagacgtggcgctgtt

SEQ ID NO: 2916 - DNA, 25 bp, E. coli
ccgcgctgccagtcgtggcgctgtt

SEQ ID NO: 2917 - DNA, 25 bp, E. coli
gttgcgcaaaccctttacccgtgcg

SEQ ID NO: 2918 - DNA, 25 bp, E. coli
gttgcgcaaaccgtttacccgtgcg

SEQ ID NO: 2919 - DNA, 25 bp, E. coli
ggcgctgttgcgcaaaccctttacc

SEQ ID NO: 2920 - DNA, 25 bp, E. coli
ggcgctgttgcggaaaccctttacc

SEQ ID NO: 2921 - DNA, 25 bp, E. coli
tcagcggtcaggttttacgccccag

SEQ ID NO: 2922 - DNA, 25 bp, E. coli
tcagcggtcaggatttacgccccag

SEQ ID NO: 2923 - DNA, 25 bp, E. coli
caatcacagctattcgccgggcgat

SEQ ID NO: 2924 - DNA, 25 bp, E. coli
caatcacagctaatcgccgggcgat

SEQ ID NO: 2925 - DNA, 25 bp, E. coli
cagcttacgccaagagattgttaca

SEQ ID NO: 2926 - DNA, 25 bp, E. coli
caaaatggctatatcatggaacgca

SEQ ID NO: 2927 - DNA, 25 bp, E. coli
cagcttacgccatgagattgttaca

SEQ ID NO: 2928 - DNA, 25 bp, E. coli
caaaatggctatttcatggaacgca

SEQ ID NO: 2929 - DNA, 25 bp, E. coli
catgctaatgctaaggtccctagcg

SEQ ID NO: 2930 - DNA, 25 bp, E. coli
catgctaatgcttaggtccctagcg

SEQ ID NO: 2931 - DNA, 25 bp, E. coli
taaatatggctttggtcactgcgac

SEQ ID NO: 2932 - DNA, 25 bp, E. coli
taaatatggcttaggtcactgcgac

SEQ ID NO: 2933 - DNA, 25 bp, E. coli
tatttgttcaactagccgtctcaca

SEQ ID NO: 2934 - DNA, 25 bp, E. coli
tatttgttcaacaagccgtctcaca

SEQ ID NO: 2935 - DNA, 25 bp, E. coli
gaacgcaggagacgccttttcatct

SEQ ID NO: 2936 - DNA, 25 bp, E. coli
gaacgcaggagaggccttttcatct

SEQ ID NO: 2937 - DNA, 25 bp, E. coli
gattattcctgcctggttcgtcagc

SEQ ID NO: 2938 - DNA, 25 bp, E. coli
gattattcctgcgtggttcgtcagc

SEQ ID NO: 2939 - DNA, 25 bp, E. coli
gggcgatacggctaacaaactatct

SEQ ID NO: 2940 - DNA, 25 bp, E. coli
gggcgatacggcaaacaaactatct

SEQ ID NO: 2941 - DNA, 25 bp, E. coli
ggaacgcagtaatttcttagtggct

SEQ ID NO: 2942 - DNA, 25 bp, E. coli
ggaacgcagtaaattcttagtggct

SEQ ID NO: 2943 - DNA, 25 bp, E. coli
tcaactgcatttcccacaaaatggc

SEQ ID NO: 2944 - DNA, 25 bp, E. coli
tcaactgcatttgccacaaaatggc

SEQ ID NO: 2945 - DNA, 25 bp, E. coli
taaactgggcgttccgaaagatcag

SEQ ID NO: 2946 - DNA, 25 bp, E. coli
taaactgggcgtaccgaaagatcag

SEQ ID NO: 2947 - DNA, 25 bp, E. coli
tcttgaaactgcgattgtggtcgtc

SEQ ID NO: 2948 - DNA, 25 bp, E. coli
tcttgaaactgccattgtggtcgtc

SEQ ID NO: 2949 - DNA, 25 bp, E. coli
gctgcgttcggtaatcgcggaagat

SEQ ID NO: 2950 - DNA, 25 bp, E. coli
gctgcgttcggttatcgcggaagat

SEQ ID NO: 2951 - DNA, 25 bp, E. coli
cgaaagcggcagtgtgatgctggtg

SEQ ID NO: 2952 - DNA, 25 bp, E. coli
ccgctttctgcggtgcgttcggtaa

SEQ ID NO: 2953 - DNA, 25 bp, E. coli
cgaaagcggcagagtgatgctggtg

SEQ ID NO: 2954 - DNA, 25 bp, E. coli
ccgctttctgcgctgcgttcggtaa

SEQ ID NO: 2955 - DNA, 25 bp, E. coli
gtcgtcgaccgcattagtggtgaag

SEQ ID NO: 2956 - DNA, 25 bp, E. coli
gtcgtcgaccgctttagtggtgaag

SEQ ID NO: 2957 - DNA, 25 bp, E. coli
gatcagttgcatgcggttccggcaa

SEQ ID NO: 2958 - DNA, 25 bp, E. coli
gatcagttgcatccggttccggcaa

SEQ ID NO: 2959 - DNA, 25 bp, E. coli
gggcgtaccgaaagatcagttgcat

SEQ ID NO: 2960 - DNA, 25 bp, E. coli
gggcgtaccgaatgatcagttgcat

SEQ ID NO: 2961 - DNA, 25 bp, E. coli
tggtaaccgtgctccgctttctgcg

SEQ ID NO: 2962 - DNA, 25 bp, E. coli
tggcaaagtgctgtatcagagcttc

SEQ ID NO: 2963 - DNA, 25 bp, E. coli
tggtaaccgtgcaccgctttctgcg

SEQ ID NO: 2964 - DNA, 25 bp, E. coli
tggcaaagtgctctatcagagcttc

SEQ ID NO: 2965 - DNA, 25 bp, E. coli
taatcgcggaagttggcaaagtgct

SEQ ID NO: 2966 - DNA, 25 bp, E. coli
taatcgcggaagatggcaaagtgct

SEQ ID NO: 2967 - DNA, 25 bp, E. coli
catgtcaataaaaccgactcggcgg

SEQ ID NO: 2968 - DNA, 25 bp, E. coli
catgtcaataaatccgactcggcgg

SEQ ID NO: 2969 - DNA, 25 bp, E. coli
taccgctgatgagcaggaacaatcg

SEQ ID NO: 2970 - DNA, 25 bp, E. coli
taccgctgatgaccaggaacaatcg

SEQ ID NO: 2971 - DNA, 25 bp, E. coli
tgggcattgggcgttttaccgctga

SEQ ID NO: 2972 - DNA, 25 bp, E. coli
tgggcattgggccttttaccgctga

SEQ ID NO: 2973 - DNA, 25 bp, E. coli
tgcaatccgttaagagacgctgcgt

SEQ ID NO: 2974 - DNA, 25 bp, E. coli
tgcaatccgttatgagacgctgcgt

SEQ ID NO: 2975 - DNA, 25 bp, E. coli
tccgtatcggccacatcatgggcgc

SEQ ID NO: 2976 - DNA, 25 bp, E. coli
tccgtatcggcctcatcatgggcgc

SEQ ID NO: 2977 - DNA, 25 bp, E. coli
gctgaaatcgcagcggcgaatgttc

SEQ ID NO: 2978 - DNA, 25 bp, E. coli
gctgaaatcgcaccggcgaatgttc

SEQ ID NO: 2979 - DNA, 25 bp, E. coli
ggcgaatgttccttcaccagattga

SEQ ID NO: 2980 - DNA, 25 bp, E. coli
ggcgcaaaaactcgtttctgggcat

SEQ ID NO: 2981 - DNA, 25 bp, E. coli
ggccgggcggtctacatgtcaataa

SEQ ID NO: 2982 - DNA, 25 bp, E. coli
ggccgggcggtcaacatgtcaataa

SEQ ID NO: 2983 - DNA, 25 bp, E. coli
ggcgcaaaaactggtttctgggcat

SEQ ID NO: 2984 - DNA, 25 bp, E. coli
ggcgaatgttccatcaccagattga

SEQ ID NO: 2985 - DNA, 25 bp, E. coli
tcaccagattgatcgtggcaacccg

SEQ ID NO: 2986 - DNA, 25 bp, E. coli
tcaccagattgaacgtggcaacccg

SEQ ID NO: 2987 - DNA, 25 bp, E. coli
gagcaggaacaaacggatgcaatcc

SEQ ID NO: 2988 - DNA, 25 bp, E. coli
gagcaggaacaatcggatgcaatcc

SEQ ID NO: 2989 - DNA, 25 bp, E. coli
cagtggcgctatgcgccttccggat

SEQ ID NO: 2990 - DNA, 25 bp, E. coli
cagtggcgctatccgccttccggat

SEQ ID NO: 2991 - DNA, 25 bp, E. coli
acactacaacagtggcgctatccgc

SEQ ID NO: 2992 - DNA, 25 bp, E. coli
acactacaacagaggcgctatccgc

SEQ ID NO: 2993 - DNA, 25 bp, E. coli
acctgccgtttggtgtgcgacgaat

SEQ ID NO: 2994 - DNA, 25 bp, E. coli
acctgccgtttgctgtgcgacgaat

SEQ ID NO: 2995 - DNA, 25 bp, E. coli
aacagtggcgctatccgccttccgg

SEQ ID NO: 2996 - DNA, 25 bp, E. coli
aacagtggcgctttccgccttccgg

SEQ ID NO: 2997 - DNA, 25 bp, E. coli
tgtctgtagcccctaatctctggcg

SEQ ID NO: 2998 - DNA, 25 bp, E. coli
tgtctgtagcccgtaatctctggcg

SEQ ID NO: 2999 - DNA, 25 bp, E. coli
tctgtagcccgttatctctggcgcg

SEQ ID NO: 3000 - DNA, 25 bp, E. coli
tctgtagcccgtaatctctggcgcg

SEQ ID NO: 3001 - DNA, 25 bp, E. coli
gccttccggattgggcatcacctac

SEQ ID NO: 3002 - DNA, 25 bp, E. coli
gccttccggattcggcatcacctac

SEQ ID NO: 3003 - DNA, 25 bp, E. coli
gctatccgccttgcggattcggcat

SEQ ID NO: 3004 - DNA, 25 bp, E. coli
gctatccgccttccggattcggcat

SEQ ID NO: 3005 - DNA, 25 bp, E. coli
cctgccgtttgctgtgcgacgaatc

SEQ ID NO: 3006 - DNA, 25 bp, E. coli
cctgccgtttgcagtgcgacgaatc

SEQ ID NO: 3007 - DNA, 25 bp, E. coli
ctggagtgtggcacctgccgtttgc

SEQ ID NO: 3008 - DNA, 25 bp, E. coli
ctggagtgtggctcctgccgtttgc

SEQ ID NO: 3009 - DNA, 25 bp, E. coli
ggcgctatccgccttccggattcgg

SEQ ID NO: 3010 - DNA, 25 bp, E. coli
ggcgctatccgcgttccggattcgg

SEQ ID NO: 3011 - DNA, 25 bp, E. coli
aaccaggaacaagatgaaatcatta

SEQ ID NO: 3012 - DNA, 25 bp, E. coli
caggaacaacatgaaatcattaacc

SEQ ID NO: 3013 - DNA, 25 bp, E. coli
caggaacaacatcaaatcattaacc

SEQ ID NO: 3014 - DNA, 25 bp, E. coli
actggtaaccaggaacaacatgaaa

SEQ ID NO: 3015 - DNA, 25 bp, E. coli
aaccaggaacaacatgaaatcatta

SEQ ID NO: 3016 - DNA, 25 bp, E. coli
actggtaaccagcaacaacatgaaa

SEQ ID NO: 3017 - DNA, 25 bp, E. coli
tttcgactggtaaccaggaacaaca

SEQ ID NO: 3018 - DNA, 25 bp, E. coli
tttcgactggtatccaggaacaaca

SEQ ID NO: 3019 - DNA, 25 bp, E. coli
tcgactggtaacgaggaacaacatg

SEQ ID NO: 3020 - DNA, 25 bp, E. coli
tcgactggtaaccaggaacaacatg

SEQ ID NO: 3021 - DNA, 25 bp, E. coli
ccaggaacaacatgaaatcattaac

SEQ ID NO: 3022 - DNA, 25 bp, E. coli
ccaggaacaacaagaaatcattaac

SEQ ID NO: 3023 - DNA, 25 bp, E. coli
gactggtaaccaggaacaacatgaa

SEQ ID NO: 3024 - DNA, 25 bp, E. coli
gtaaccaggaacaacatgaaatcat

SEQ ID NO: 3025 - DNA, 25 bp, E. coli
gtaaccaggaactacatgaaatcat

SEQ ID NO: 3026 - DNA, 25 bp, E. coli
ggtaaccaggaacaacatgaaatca

SEQ ID NO: 3027 - DNA, 25 bp, E. coli
ggtaaccaggaagaacatgaaatca

SEQ ID NO: 3028 - DNA, 25 bp, E. coli
tggtaaccaggatcaacatgaaatc

SEQ ID NO: 3029 - DNA, 25 bp, E. coli
tggtaaccaggaacaacatgaaatc

SEQ ID NO: 3030 - DNA, 25 bp, E. coli
taaccaggaacaacatgaaatcatt

SEQ ID NO: 3031 - DNA, 25 bp, E. coli
taaccaggaacatcatgaaatcatt

SEQ ID NO: 3032 - DNA, 25 bp, E. coli
gactggtaaccacgaacaacatgaa

SEQ ID NO: 3033 - DNA, 25 bp, E. coli
aagagagtgtggtgatcgccgcaca

SEQ ID NO: 3034 - DNA, 25 bp, E. coli
aagagagtgtggagatcgccgcaca

SEQ ID NO: 3035 - DNA, 25 bp, E. coli
agagtgtggtgatcgccgcacatca

SEQ ID NO: 3036 - DNA, 25 bp, E. coli
agagtgtggtgaacgccgcacatca

SEQ ID NO: 3037 - DNA, 25 bp, E. coli
tgggcgcaaaaaataatcaggtgac

SEQ ID NO: 3038 - DNA, 25 bp, E. coli
tggtgatcgccggacatcaggcatt

SEQ ID NO: 3039 - DNA, 25 bp, E. coli
tgggcgcaaaaattaatcaggtgac

SEQ ID NO: 3040 - DNA, 25 bp, E. coli
tggtgatcgccgcacatcaggcatt

SEQ ID NO: 3041 - DNA, 25 bp, E. coli
gcgcaaaaaatattcaggtgaccgt

SEQ ID NO: 3042 - DNA, 25 bp, E. coli
gcgcaaaaaataatcaggtgaccgt

SEQ ID NO: 3043 - DNA, 25 bp, E. coli
gcaaaaaataatcaggtgaccgtta

SEQ ID NO: 3044 - DNA, 25 bp, E. coli
gcaaaaaataatgaggtgaccgtta

SEQ ID NO: 3045 - DNA, 25 bp, E. coli
cgccgcacatcacgcattgttacag

SEQ ID NO: 3046 - DNA, 25 bp, E. coli
cgccgcacatcaggcattgttacag

SEQ ID NO: 3047 - DNA, 25 bp, E. coli
gtgatcgccgcagatcaggcattgt

SEQ ID NO: 3048 - DNA, 25 bp, E. coli
gtgatcgccgcacatcaggcattgt

SEQ ID NO: 3049 - DNA, 25 bp, E. coli
ggcgcaaaaaataatcaggtgaccg

SEQ ID NO: 3050 - DNA, 25 bp, E. coli
ggcgcaaaaaattatcaggtgaccg

SEQ ID NO: 3051 - DNA, 25 bp, E. coli
gagagtgtggtgttcgccgcacatc

SEQ ID NO: 3052 - DNA, 25 bp, E. coli
gatcgccgcacatcaggcattgtta

SEQ ID NO: 3053 - DNA, 25 bp, E. coli
gagagtgtggtgatcgccgcacatc

SEQ ID NO: 3054 - DNA, 25 bp, E. coli
gatcgccgcacaacaggcattgtta

SEQ ID NO: 3055 - DNA, 25 bp, E. coli
caaagacgaagctggagtctggtcg

SEQ ID NO: 3056 - DNA, 25 bp, E. coli
caaagacgaagcaggagtctggtcg

SEQ ID NO: 3057 - DNA, 25 bp, E. coli
cacgacaaccgttccggatgaaggt

SEQ ID NO: 3058 - DNA, 25 bp, E. coli
cacgacaaccgtaccggatgaaggt

SEQ ID NO: 3059 - DNA, 25 bp, E. coli
caggcgctggttaccggaatgaatc

SEQ ID NO: 3060 - DNA, 25 bp, E. coli
caggcgctggtttccggaatgaatc

SEQ ID NO: 3061 - DNA, 25 bp, E. coli
tacaggcaccgctatgactaatcct

SEQ ID NO: 3062 - DNA, 25 bp, E. coli
tacaggcaccgcaatgactaatcct

SEQ ID NO: 3063 - DNA, 25 bp, E. coli
aaccgtaccggaagaaggtgtcgcg

SEQ ID NO: 3064 - DNA, 25 bp, E. coli
aaccgtaccggatgaaggtgtcgcg

SEQ ID NO: 3065 - DNA, 25 bp, E. coli
ttcacaaggcggctaccaggcgctg

SEQ ID NO: 3066 - DNA, 25 bp, E. coli
ttcacaaggcgggtaccaggcgctg

SEQ ID NO: 3067 - DNA, 25 bp, E. coli
gcgaccagcctaagcagcctttgta

SEQ ID NO: 3068 - DNA, 25 bp, E. coli
gcgaccagcctatgcagcctttgta

SEQ ID NO: 3069 - DNA, 25 bp, E. coli
gcacacctatccagaaaggcaacct

SEQ ID NO: 3070 - DNA, 25 bp, E. coli
gcacacctatcctgaaaggcaacct

SEQ ID NO: 3071 - DNA, 25 bp, E. coli
cgactgaacgatgcggcagctatca

SEQ ID NO: 3072 - DNA, 25 bp, E. coli
cgactgaacgatccggcagctatca

SEQ ID NO: 3073 - DNA, 25 bp, E. coli
gtcgtggcgcacacctatcctgaaa

SEQ ID NO: 3074 - DNA, 25 bp, E. coli
gtcgtggcgcactcctatcctgaaa

SEQ ID NO: 3075 - DNA, 25 bp, E. coli
tcacccgatgaccaaagacgaagca

SEQ ID NO: 3076 - DNA, 25 bp, E. coli
tcacccgatgacgaaagacgaagca

SEQ ID NO: 3077 - DNA, 25 bp, E. coli
aactggttgagtttctgcgcgagcc

SEQ ID NO: 3078 - DNA, 25 bp, E. coli
cagtattccagagctttgggcccag

SEQ ID NO: 3079 - DNA, 25 bp, E. coli
cagtattccagacctttgggcccag

SEQ ID NO: 3080 - DNA, 25 bp, E. coli
aaaggctcctcgtccggttgatgaa

SEQ ID NO: 3081 - DNA, 25 bp, E. coli
aaattgggtccagtgctgtacgcgg

SEQ ID NO: 3082 - DNA, 25 bp, E. coli
aactggttgagtatctgcgcgagcc

SEQ ID NO: 3083 - DNA, 25 bp, E. coli
aaaggctcctcgaccggttgatgaa

SEQ ID NO: 3084 - DNA, 25 bp, E. coli
aaattgggtccactgctgtacgcgg

SEQ ID NO: 3085 - DNA, 25 bp, E. coli
aaatcatgatggctgcggaacgtcg

SEQ ID NO: 3086 - DNA, 25 bp, E. coli
aaatcatgatgggtgcggaacgtcg

SEQ ID NO: 3087 - DNA, 25 bp, E. coli
tgaagtgttcctcggccgtagcgta

SEQ ID NO: 3088 - DNA, 25 bp, E. coli
tgaagtgttcctgggccgtagcgta

SEQ ID NO: 3089 - DNA, 25 bp, E. coli
tcttcatgcgtctaatgcagggcgg

SEQ ID NO: 3090 - DNA, 25 bp, E. coli
tcttcatgcgtcaaatgcagggcgg

SEQ ID NO: 3091 - DNA, 25 bp, E. coli
gcttgccagatgttcgcggtcgtga

SEQ ID NO: 3092 - DNA, 25 bp, E. coli
gcttgccagatgatcgcggtcgtga

SEQ ID NO: 3093 - DNA, 25 bp, E. coli
gaaggtatcatccttatcgccgcga

SEQ ID NO: 3094 - DNA, 25 bp, E. coli
gaaggtatcatcgttatcgccgcga

SEQ ID NO: 3095 - DNA, 25 bp, E. coli
gaaatatgagactatcgacgcaccg

SEQ ID NO: 3096 - DNA, 25 bp, E. coli
gaaatatgagacaatcgacgcaccg

SEQ ID NO: 3097 - DNA, 25 bp, E. coli
gacgcaccgcagattgatgacctga

SEQ ID NO: 3098 - DNA, 25 bp, E. coli
gacgcaccgcagtttgatgacctga

SEQ ID NO: 3099 - DNA, 25 bp, E. coli
cagatgttctttttgatttcgcgca

SEQ ID NO: 3100 - DNA, 25 bp, E. coli
cagatgttctttatgatttcgcgca

SEQ ID NO: 3101 - DNA, 25 bp, E. coli
ttttaactggccagtcaggcagtgg

SEQ ID NO: 3102 - DNA, 25 bp, E. coli
ttttaactggcctgtcaggcagtgg

SEQ ID NO: 3103 - DNA, 25 bp, E. coli
tgttagtttcctggcgcagtaatac

SEQ ID NO: 3104 - DNA, 25 bp, E. coli
tgatttcgcgcataaagattcagaa

SEQ ID NO: 3105 - DNA, 25 bp, E. coli
tgatttcgcgcaaaaagattcagaa

SEQ ID NO: 3106 - DNA, 25 bp, E. coli
tgttagtttcctcgcgcagtaatac

SEQ ID NO: 3107 - DNA, 25 bp, E. coli
tctcttgccgttaaaaattaagctg

SEQ ID NO: 3108 - DNA, 25 bp, E. coli
tctcttgccgtttaaaattaagctg

SEQ ID NO: 3109 - DNA, 25 bp, E. coli
gcagtggtgcgtttttctaccgcta

SEQ ID NO: 3110 - DNA, 25 bp, E. coli
gctcgctgttttctctctcttgccg

SEQ ID NO: 3111 - DNA, 25 bp, E. coli
gcagtaatacccgtgaaaaaagagg

SEQ ID NO: 3112 - DNA, 25 bp, E. coli
gctcgctgttttgtctctcttgccg

SEQ ID NO: 3113 - DNA, 25 bp, E. coli
gcagtaatacccctgaaaaaagagg

SEQ ID NO: 3114 - DNA, 25 bp, E. coli
gcagtggtgcgtatttctaccgcta

SEQ ID NO: 3115 - DNA, 25 bp, E. coli
gaaggcggattaatttgtggcaaac

SEQ ID NO: 3116 - DNA, 25 bp, E. coli
gaaggcggattattttgtggcaaac

SEQ ID NO: 3117 - DNA, 25 bp, E. coli
gtaggtcaatttgcgaaggcggatt

SEQ ID NO: 3118 - DNA, 25 bp, E. coli
gtaggtcaatttccgaaggcggatt

SEQ ID NO: 3119 - DNA, 25 bp, E. coli
tctaccgctattcaggtaggtcaat

SEQ ID NO: 3120 - DNA, 25 bp, E. coli
tctaccgctattgaggtaggtcaat

SEQ ID NO: 3121 - DNA, 25 bp, E. coli
tttgcttggcggagtatatactgcg

SEQ ID NO: 3122 - DNA, 25 bp, E. coli
tttgcttggcggtgtatatactgcg

SEQ ID NO: 3123 - DNA, 25 bp, E. coli
tatattgggttatgcctgtcagtgg

SEQ ID NO: 3124 - DNA, 25 bp, E. coli
tatattgggttaagcctgtcagtgg

SEQ ID NO: 3125 - DNA, 25 bp, E. coli
tgttggctcaaaaacttccggctgc

SEQ ID NO: 3126 - DNA, 25 bp, E. coli
tgttggctcaaatacttccggctgc

SEQ ID NO: 3127 - DNA, 25 bp, E. coli
tcgccattatggtgttctgcgtaac

SEQ ID NO: 3128 - DNA, 25 bp, E. coli
tcgccattatggagttctgcgtaac

SEQ ID NO: 3129 - DNA, 25 bp, E. coli
tcagtgggcttattctggtctggta

SEQ ID NO: 3130 - DNA, 25 bp, E. coli
gcgtaacctggcaagttattgcacg

SEQ ID NO: 3131 - DNA, 25 bp, E. coli
gcgtaacctggctagttattgcacg

SEQ ID NO: 3132 - DNA, 25 bp, E. coli
gcactgtgcttgatgagttcaccca

SEQ ID NO: 3133 - DNA, 25 bp, E. coli
gcactgtgcttgttgagttcaccca

SEQ ID NO: 3134 - DNA, 25 bp, E. coli
cggctgcatctgttctgacgcttga

SEQ ID NO: 3135 - DNA, 25 bp, E. coli
cggctgcatctgatctgacgcttga

SEQ ID NO: 3136 - DNA, 25 bp, E. coli
gttattttcatgatctatggcggga

SEQ ID NO: 3137 - DNA, 25 bp, E. coli
gttattttcatgttctatggcggga

SEQ ID NO: 3138 - DNA, 25 bp, E. coli
ggatgttgctgctttattctcgcca

SEQ ID NO: 3139 - DNA, 25 bp, E. coli
ggatgttgctgcattattctcgcca

SEQ ID NO: 3140 - DNA, 25 bp, E. coli
taataagatccttgccggatgttgc

SEQ ID NO: 3141 - DNA, 25 bp, E. coli
taataagatcctagccggatgttgc

SEQ ID NO: 3142 - DNA, 25 bp, E. coli
tcagtgggcttaatctggtctggta

SEQ ID NO: 3143 - DNA, 25 bp, E. coli
catccgttgttattgtgagtgcgag

SEQ ID NO: 3144 - DNA, 25 bp, E. coli
catccgttgttaatgtgagtgcgag

SEQ ID NO: 3145 - DNA, 25 bp, E. coli
tagcactgataacaatgcgaaagcc

SEQ ID NO: 3146 - DNA, 25 bp, E. coli
tagcactgataagaatgcgaaagcc

SEQ ID NO: 3147 - DNA, 25 bp, E. coli
tttaagcgctggtgatctgcaaaca

SEQ ID NO: 3148 - DNA, 25 bp, E. coli
tttaagcgctggagatctgcaaaca

SEQ ID NO: 3149 - DNA, 25 bp, E. coli
tctgcaaacagtgaaggcggctatt

SEQ ID NO: 3150 - DNA, 25 bp, E. coli
tctgcaaacagtcaaggcggctatt

SEQ ID NO: 3151 - DNA, 25 bp, E. coli
gctaaagcgaattacctgacaacgg

SEQ ID NO: 3152 - DNA, 25 bp, E. coli
gctaaagcgaataacctgacaacgg

SEQ ID NO: 3153 - DNA, 25 bp, E. coli
gacatcgacgatctatgacttaggt

SEQ ID NO: 3154 - DNA, 25 bp, E. coli
gacatcgacgatgtatgacttaggt

SEQ ID NO: 3155 - DNA, 25 bp, E. coli
gaactcggtgtttttcaggctgcga

SEQ ID NO: 3156 - DNA, 25 bp, E. coli
gaactcggtgttattcaggctgcga

SEQ ID NO: 3157 - DNA, 25 bp, E. coli
cggtagtgaatattagccagctcga

SEQ ID NO: 3158 - DNA, 25 bp, E. coli
cggtagtgaataatagccagctcga

SEQ ID NO: 3159 - DNA, 25 bp, E. coli
gtcaaccacggcacaaaagatggct

SEQ ID NO: 3160 - DNA, 25 bp, E. coli
gtcaaccacggctcaaaagatggct

SEQ ID NO: 3161 - DNA, 25 bp, E. coli
gaggcatctaaaccgtcaaccacgg

SEQ ID NO: 3162 - DNA, 25 bp, E. coli
gagtgcgagttcttcgacatcgacg

SEQ ID NO: 3163 - DNA, 25 bp, E. coli
gaggcatctaaagcgtcaaccacgg

SEQ ID NO: 3164 - DNA, 25 bp, E. coli
gagtgcgagttcatcgacatcgacg

SEQ ID NO: 3165 - DNA, 25 bp, E. coli
caaatatgcgcgttctggctgtgcg

SEQ ID NO: 3166 - DNA, 25 bp, E. coli
caccggtcaaagtgtctggctttaa

SEQ ID NO: 3167 - DNA, 25 bp, E. coli
caaatatgcgcgatctggctgtgcg

SEQ ID NO: 3168 - DNA, 25 bp, E. coli
caccggtcaaagagtctggctttaa

SEQ ID NO: 3169 - DNA, 25 bp, E. coli
aaaataagcccgtgtagcagagttc

SEQ ID NO: 3170 - DNA, 25 bp, E. coli
aaaataagcccgagtagcagagttc

SEQ ID NO: 3171 - DNA, 25 bp, E. coli
tatgcgcgttctggctgtgcgtagc

SEQ ID NO: 3172 - DNA, 25 bp, E. coli
tatgcgcgttctcgctgtgcgtagc

SEQ ID NO: 3173 - DNA, 25 bp, E. coli
gcctggctaccgctcgggcagatat

SEQ ID NO: 3174 - DNA, 25 bp, E. coli
gcccgtgtagcacagttctccatca

SEQ ID NO: 3175 - DNA, 25 bp, E. coli
gcccgtgtagcagagttctccatca

SEQ ID NO: 3176 - DNA, 25 bp, E. coli
gcctggctaccggtcgggcagatat

SEQ ID NO: 3177 - DNA, 25 bp, E. coli
gaaacaccggtcaaagtgtctggct

SEQ ID NO: 3178 - DNA, 25 bp, E. coli
gaaacaccggtctaagtgtctggct

SEQ ID NO: 3179 - DNA, 25 bp, E. coli
gatatttacacggaaacaccggtca

SEQ ID NO: 3180 - DNA, 25 bp, E. coli
gatatttacacgcaaacaccggtca

SEQ ID NO: 3181 - DNA, 25 bp, E. coli
gggcagatatttacacggaaacacc

SEQ ID NO: 3182 - DNA, 25 bp, E. coli
gggcagatattttcacggaaacacc

SEQ ID NO: 3183 - DNA, 25 bp, E. coli
taagcccgtgtagcagagttctcca

SEQ ID NO: 3184 - DNA, 25 bp, E. coli
taagcccgtgtaccagagttctcca

SEQ ID NO: 3185 - DNA, 25 bp, E. coli
gagttctccatcagcctggctaccg

SEQ ID NO: 3186 - DNA, 25 bp, E. coli
gagttctccatctgcctggctaccg

SEQ ID NO: 3187 - DNA, 25 bp, E. coli
caataaagcaacagacggatccggt

SEQ ID NO: 3188 - DNA, 25 bp, E. coli
aattttctggagcaagcacgcggcc

SEQ ID NO: 3189 - DNA, 25 bp, E. coli
caataaagcaactgacggatccggt

SEQ ID NO: 3190 - DNA, 25 bp, E. coli
aattttctggaggaagcacgcggcc

SEQ ID NO: 3191 - DNA, 25 bp, E. coli
catgattatggcgaaccggtacgac

SEQ ID NO: 3192 - DNA, 25 bp, E. coli
catgattatggccaaccggtacgac

SEQ ID NO: 3193 - DNA, 25 bp, E. coli
taaatggcttgagcacgcagccgga

SEQ ID NO: 3194 - DNA, 25 bp, E. coli
taaatggcttgaccacgcagccgga

SEQ ID NO: 3195 - DNA, 25 bp, E. coli
tttattgaggccaccggagacggcg

SEQ ID NO: 3196 - DNA, 25 bp, E. coli
ttctggcagggaaacaaaacacggt

SEQ ID NO: 3197 - DNA, 25 bp, E. coli
tttattgaggcctccggagacggcg

SEQ ID NO: 3198 - DNA, 25 bp, E. coli
ttctggcagggatacaaaacacggt

SEQ ID NO: 3199 - DNA, 25 bp, E. coli
tgatattcaccgaacgggccggagg

SEQ ID NO: 3200 - DNA, 25 bp, E. coli
tgatattcaccgtacgggccggagg

SEQ ID NO: 3201 - DNA, 25 bp, E. coli
tgaagtacacgagcagaaacagcct

SEQ ID NO: 3202 - DNA, 25 bp, E. coli
tgaagtacacgaccagaaacagcct

SEQ ID NO: 3203 - DNA, 25 bp, E. coli
gcatcaagaaaatcacgggcggcga

SEQ ID NO: 3204 - DNA, 25 bp, E. coli
gcatcaagaaaaacacgggcggcga

SEQ ID NO: 3205 - DNA, 25 bp, E. coli
gaaatcgttcacgtatggcgcggcg

SEQ ID NO: 3206 - DNA, 25 bp, E. coli
gaaatcgttcacctatggcgcggcg

SEQ ID NO: 3207 - DNA, 25 bp, E. coli
gatctattcagaccacagggccact

SEQ ID NO: 3208 - DNA, 25 bp, E. coli
gatctattcagagcacagggccact

SEQ ID NO: 3209 - DNA, 25 bp, E. coli
caacgggcgattcaagcggcagaaa

SEQ ID NO: 3210 - DNA, 25 bp, E. coli
caacgggcgattgaagcggcagaaa

SEQ ID NO: 3211 - DNA, 25 bp, E. coli
catctgaaaggtcctggcctgacgc

SEQ ID NO: 3212 - DNA, 25 bp, E. coli
catctgaaaggtgctggcctgacgc

SEQ ID NO: 3213 - DNA, 25 bp, E. coli
taaacggctggaagtcagctgctcg

SEQ ID NO: 3214 - DNA, 25 bp, E. coli
taaacggctggatgtcagctgctcg

SEQ ID NO: 3215 - DNA, 25 bp, E. coli
tattcagtctgaaggcgcgagagcg

SEQ ID NO: 3216 - DNA, 25 bp, E. coli
tattcagtctgatggcgcgagagcg

SEQ ID NO: 3217 - DNA, 25 bp, E. coli
tgatatgacggatttgcaccgcctg

SEQ ID NO: 3218 - DNA, 25 bp, E. coli
tgatatgacggaattgcaccgcctg

SEQ ID NO: 3219 - DNA, 25 bp, E. coli
tgctgatggcacaacaatggactgg

SEQ ID NO: 3220 - DNA, 25 bp, E. coli
tgaggccctggagagctatcagcag

SEQ ID NO: 3221 - DNA, 25 bp, E. coli
tgaggccctggacagctatcagcag

SEQ ID NO: 3222 - DNA, 25 bp, E. coli
tgctgatggcactacaatggactgg

SEQ ID NO: 3223 - DNA, 25 bp, E. coli
taattgcccaatcgcagacggtcgg

SEQ ID NO: 3224 - DNA, 25 bp, E. coli
taattgcccaatggcagacggtcgg

SEQ ID NO: 3225 - DNA, 25 bp, E. coli
cctttcagcgacagagatgatgact

SEQ ID NO: 3226 - DNA, 25 bp, E. coli
gcgcgatgaattgccagaaacctat

SEQ ID NO: 3227 - DNA, 25 bp, E. coli
cctttcagcgactgagatgatgact

SEQ ID NO: 3228 - DNA, 25 bp, E. coli
gcgcgatgaattcccagaaacctat

SEQ ID NO: 3229 - DNA, 25 bp, E. coli
taagtatcgtcaccagcgattcgcc

SEQ ID NO: 3230 - DNA, 25 bp, E. coli
taagtatcgtcagcagcgattcgcc

SEQ ID NO: 3231 - DNA, 25 bp, E. coli
aatagtcaatgaggaattcttctgc

SEQ ID NO: 3232 - DNA, 25 bp, E. coli
aatagtcaatgacgaattcttctgc

SEQ ID NO: 3233 - DNA, 25 bp, E. coli
aatcagtatgcttaatataacaggc

SEQ ID NO: 3234 - DNA, 25 bp, E. coli
aatcagtatgctaaatataacaggc

SEQ ID NO: 3235 - DNA, 25 bp, E. coli
tactgagcggagattcttacagctg

SEQ ID NO: 3236 - DNA, 25 bp, E. coli
tactgagcggagtttcttacagctg

SEQ ID NO: 3237 - DNA, 25 bp, E. coli
tataacaggctggagaaaagaggaa

SEQ ID NO: 3238 - DNA, 25 bp, E. coli
tataacaggctgcagaaaagaggaa

SEQ ID NO: 3239 - DNA, 25 bp, E. coli
tttaatccatgtcagcaaattgcga

SEQ ID NO: 3240 - DNA, 25 bp, E. coli
tttaatccatgtgagcaaattgcga

SEQ ID NO: 3241 - DNA, 25 bp, E. coli
tcttacagctgtaggcagaagttta

SEQ ID NO: 3242 - DNA, 25 bp, E. coli
tcttacagctgttggcagaagttta

SEQ ID NO: 3243 - DNA, 25 bp, E. coli
gcggatgacagctgaagaaatgaga

SEQ ID NO: 3244 - DNA, 25 bp, E. coli
gcggatgacagcagaagaaatgaga

SEQ ID NO: 3245 - DNA, 25 bp, E. coli
gaattcttctgcagtgcggatgaca

SEQ ID NO: 3246 - DNA, 25 bp, E. coli
gaattcttctgctgtgcggatgaca

SEQ ID NO: 3247 - DNA, 25 bp, E. coli
gaaaagaggaaaaaggactggtgct

SEQ ID NO: 3248 - DNA, 25 bp, E. coli
gaaaagaggaaataggactggtgct

SEQ ID NO: 3249 - DNA, 25 bp, E. coli
cgttaaaaatcgataatcagtatgc

SEQ ID NO: 3250 - DNA, 25 bp, E. coli
cgttaaaaatcgttaatcagtatgc

SEQ ID NO: 3251 - DNA, 25 bp, E. coli
gactggtgcttctgtactgagcgga

SEQ ID NO: 3252 - DNA, 25 bp, E. coli
gactggtgcttcagtactgagcgga

SEQ ID NO: 3253 - DNA, 25 bp, E. coli
aactgacgtgctgttcactgcggca

SEQ ID NO: 3254 - DNA, 25 bp, E. coli
aactgacgtgctcttcactgcggca

SEQ ID NO: 3255 - DNA, 25 bp, E. coli
ttaggtactttgatcgtcggcgcac

SEQ ID NO: 3256 - DNA, 25 bp, E. coli
ttaggtactttgttcgtcggcgcac

SEQ ID NO: 3257 - DNA, 25 bp, E. coli
tattccggcgtcaggctcatggcag

SEQ ID NO: 3258 - DNA, 25 bp, E. coli
tattccggcgtctggctcatggcag

SEQ ID NO: 3259 - DNA, 25 bp, E. coli
tttcgaacgatatcgccatgcaggt

SEQ ID NO: 3260 - DNA, 25 bp, E. coli
tttcgaacgataacgccatgcaggt

SEQ ID NO: 3261 - DNA, 25 bp, E. coli
tgtgaaaagctgtatctggatcgcg

SEQ ID NO: 3262 - DNA, 25 bp, E. coli
tgtgaaaagctgaatctggatcgcg

SEQ ID NO: 3263 - DNA, 25 bp, E. coli
tcccactggcctctaatatgttcgg

SEQ ID NO: 3264 - DNA, 25 bp, E. coli
tccgtttctattccgctgggagcca

SEQ ID NO: 3265 - DNA, 25 bp, E. coli
tcccactggcctgtaatatgttcgg

SEQ ID NO: 3266 - DNA, 25 bp, E. coli
tccgtttctattgcgctgggagcca

SEQ ID NO: 3267 - DNA, 25 bp, E. coli
tctggcatggatctcaaaacccgcg

SEQ ID NO: 3268 - DNA, 25 bp, E. coli
tctggcatggatgtcaaaacccgcg

SEQ ID NO: 3269 - DNA, 25 bp, E. coli
gatcgtctggcatatagcgccctgc

SEQ ID NO: 3270 - DNA, 25 bp, E. coli
ggtaatgagcatggtttccaacccc

SEQ ID NO: 3271 - DNA, 25 bp, E. coli
ggtaatgagcatcgtttccaacccc

SEQ ID NO: 3272 - DNA, 25 bp, E. coli
ggcagcctggtataacaaatcctgg

SEQ ID NO: 3273 - DNA, 25 bp, E. coli
ggcagcctggtaaaacaaatcctgg

SEQ ID NO: 3274 - DNA, 25 bp, E. coli
gatcgtctggcaaatagcgccctgc

SEQ ID NO: 3275 - DNA, 25 bp, E. coli
cagttcttcagtcaggcgtggtgca

SEQ ID NO: 3276 - DNA, 25 bp, E. coli
cagttcttcagtgaggcgtggtgca

SEQ ID NO: 3277 - DNA, 25 bp, E. coli
agtttacagactagcagtgcgttcc

SEQ ID NO: 3278 - DNA, 25 bp, E. coli
agtttacagacttgcagtgcgttcc

SEQ ID NO: 3279 - DNA, 25 bp, E. coli
tgaccagtttttacagtccggacct

SEQ ID NO: 3280 - DNA, 25 bp, E. coli
tgaccagttttttcagtccggacct

SEQ ID NO: 3281 - DNA, 25 bp, E. coli
tgccagcccaccaaataaatcaagg

SEQ ID NO: 3282 - DNA, 25 bp, E. coli
tgccagcccacctaataaatcaagg

SEQ ID NO: 3283 - DNA, 25 bp, E. coli
tcaggcagctaaggaaagttgaacc

SEQ ID NO: 3284 - DNA, 25 bp, E. coli
tcaggcagctaacgaaagttgaacc

SEQ ID NO: 3285 - DNA, 25 bp, E. coli
gcgttccctgccgatgatgtcctga

SEQ ID NO: 3286 - DNA, 25 bp, E. coli
gcgttccctgcccatgatgtcctga

SEQ ID NO: 3287 - DNA, 25 bp, E. coli
gacctcctgccagggttttacgttg

SEQ ID NO: 3288 - DNA, 25 bp, E. coli
gacctcctgccacggttttacgttg

SEQ ID NO: 3289 - DNA, 25 bp, E. coli
cgccccagtcggttcagtttacaga

SEQ ID NO: 3290 - DNA, 25 bp, E. coli
cgccccagtcggatcagtttacaga

SEQ ID NO: 3291 - DNA, 25 bp, E. coli
cgtaacgctgttattgctgggtaag

SEQ ID NO: 3292 - DNA, 25 bp, E. coli
cgtaacgctgtttttgctgggtaag

SEQ ID NO: 3293 - DNA, 25 bp, E. coli
taagatcaaaaaactttcaggcagc

SEQ ID NO: 3294 - DNA, 25 bp, E. coli
taagatcaaaaatctttcaggcagc

SEQ ID NO: 3295 - DNA, 25 bp, E. coli
gatgtagtgtgatgaataatcccgt

SEQ ID NO: 3296 - DNA, 25 bp, E. coli
gatgtagtgtgaagaataatcccgt

SEQ ID NO: 3297 - DNA, 25 bp, E. coli
aatgactgtcaggaccggactggag

SEQ ID NO: 3298 - DNA, 25 bp, E. coli
aatgactgtcagcaccggactggag

SEQ ID NO: 3299 - DNA, 25 bp, E. coli
caaacggtctacaggatgtcatggc

SEQ ID NO: 3300 - DNA, 25 bp, E. coli
caaacggtctactggatgtcatggc

SEQ ID NO: 3301 - DNA, 25 bp, E. coli
cagaatttgcgtcggaaggcttccg

SEQ ID NO: 3302 - DNA, 25 bp, E. coli
cagaatttgcgtgggaaggcttccg

SEQ ID NO: 3303 - DNA, 25 bp, E. coli
tactgtccttaacggcggtgatcaa

SEQ ID NO: 3304 - DNA, 25 bp, E. coli
tactgtccttaagggcggtgatcaa

SEQ ID NO: 3305 - DNA, 25 bp, E. coli
tgataaatcacgtccgccagtttgt

SEQ ID NO: 3306 - DNA, 25 bp, E. coli
tgatcaatggatacatgcaggcggc

SEQ ID NO: 3307 - DNA, 25 bp, E. coli
tgataaatcacgaccgccagtttgt

SEQ ID NO: 3308 - DNA, 25 bp, E. coli
tgactctgttgtaccggcaggagaa

SEQ ID NO: 3309 - DNA, 25 bp, E. coli
tgactctgttgttccggcaggagaa

SEQ ID NO: 3310 - DNA, 25 bp, E. coli
tgatcaatggattcatgcaggcggc

SEQ ID NO: 3311 - DNA, 25 bp, E. coli
gaaacttccatcagccggatctgcg

SEQ ID NO: 3312 - DNA, 25 bp, E. coli
gaaacttccatctgccggatctgcg

SEQ ID NO: 3313 - DNA, 25 bp, E. coli
catttacacaggtggtgaccagacg

SEQ ID NO: 3314 - DNA, 25 bp, E. coli
catttacacaggaggtgaccagacg

SEQ ID NO: 3315 - DNA, 25 bp, E. coli
gatatcatcgctcatcgcggcacgg

SEQ ID NO: 3316 - DNA, 25 bp, E. coli
gatatcatcgctgatcgcggcacgg

SEQ ID NO: 3317 - DNA, 25 bp, E. coli
ggaacagccagaaacaccagagtca

SEQ ID NO: 3318 - DNA, 25 bp, E. coli
ggaacagccagatacaccagagtca

SEQ ID NO: 3319 - DNA, 25 bp, E. coli
atgaatagtctagccgctggatggg

SEQ ID NO: 3320 - DNA, 25 bp, E. coli
atgaatagtctacccgctggatggg

SEQ ID NO: 3321 - DNA, 25 bp, E. coli
aaatatcagtatatgtggacggtgg

SEQ ID NO: 3322 - DNA, 25 bp, E. coli
aaatatcagtatttgtggacggtgg

SEQ ID NO: 3323 - DNA, 25 bp, E. coli
tttgaaagccctgatgactgtgccg

SEQ ID NO: 3324 - DNA, 25 bp, E. coli
tatctggctcattatcgcgagccgg

SEQ ID NO: 3325 - DNA, 25 bp, E. coli
tatctggctcataatcgcgagccgg

SEQ ID NO: 3326 - DNA, 25 bp, E. coli
tttgaaagccctcatgactgtgccg

SEQ ID NO: 3327 - DNA, 25 bp, E. coli
tttaaaacaggcgaaaatatcagta

SEQ ID NO: 3328 - DNA, 25 bp, E. coli
tttaaaacaggccaaaatatcagta

SEQ ID NO: 3329 - DNA, 25 bp, E. coli
tgtggacggtggatatatctggctc

SEQ ID NO: 3330 - DNA, 25 bp, E. coli
tgtggacggtggttatatctggctc

SEQ ID NO: 3331 - DNA, 25 bp, E. coli
tgaataaggagaaagataatggaca

SEQ ID NO: 3332 - DNA, 25 bp, E. coli
tgaataaggagatagataatggaca

SEQ ID NO: 3333 - DNA, 25 bp, E. coli
tcgcgagccggatacatttgaaagc

SEQ ID NO: 3334 - DNA, 25 bp, E. coli
tcgcgagccggaaacatttgaaagc

SEQ ID NO: 3335 - DNA, 25 bp, E. coli
gccactaatggcgaggaagcatcat

SEQ ID NO: 3336 - DNA, 25 bp, E. coli
gccactaatggccaggaagcatcat

SEQ ID NO: 3337 - DNA, 25 bp, E. coli
ccgaatgccgcacaagagtgaataa

SEQ ID NO: 3338 - DNA, 25 bp, E. coli
ccgaatgccgcagaagagtgaataa

SEQ ID NO: 3339 - DNA, 25 bp, E. coli
gatgactgtgcccaatgccgcagaa

SEQ ID NO: 3340 - DNA, 25 bp, E. coli
gatgactgtgccgaatgccgcagaa

SEQ ID NO: 3341 - DNA, 25 bp, E. coli
aagacgtgatggtacaaaacttccg

SEQ ID NO: 3342 - DNA, 25 bp, E. coli
aagacgtgatggaacaaaacttccg

SEQ ID NO: 3343 - DNA, 25 bp, E. coli
caactgtaacatatttgcccactga

SEQ ID NO: 3344 - DNA, 25 bp, E. coli
cagcaactgtaacatatttgcccac

SEQ ID NO: 3345 - DNA, 25 bp, E. coli
caactgtaacatttttgcccactga

SEQ ID NO: 3346 - DNA, 25 bp, E. coli
cagcaactgtaagatatttgcccac

SEQ ID NO: 3347 - DNA, 25 bp, E. coli
atttgcccactgttgcaggaagacg

SEQ ID NO: 3348 - DNA, 25 bp, E. coli
atttgcccactgatgcaggaagacg

SEQ ID NO: 3349 - DNA, 25 bp, E. coli
ttgcccactgatccaggaagacgtg

SEQ ID NO: 3350 - DNA, 25 bp, E. coli
ttgcccactgatgcaggaagacgtg

SEQ ID NO: 3351 - DNA, 25 bp, E. coli
tgtaacatatttgcccactgatgca

SEQ ID NO: 3352 - DNA, 25 bp, E. coli
tgtaacatatttccccactgatgca

SEQ ID NO: 3353 - DNA, 25 bp, E. coli
gcccactgatgcaggaagacgtgat

SEQ ID NO: 3354 - DNA, 25 bp, E. coli
ccactgatgcaggaagacgtgatgg

SEQ ID NO: 3355 - DNA, 25 bp, E. coli
ccactgatgcagcaagacgtgatgg

SEQ ID NO: 3356 - DNA, 25 bp, E. coli
gcccactgatgctggaagacgtgat

SEQ ID NO: 3357 - DNA, 25 bp, E. coli
ttttggttatgctggatttggtgga

SEQ ID NO: 3358 - DNA, 25 bp, E. coli
ttttggttatgcaggatttggtgga

SEQ ID NO: 3359 - DNA, 25 bp, E. coli
ccgaaatgatttaggttatgcagga

SEQ ID NO: 3360 - DNA, 25 bp, E. coli
ccgaaatgattttggttatgcagga

SEQ ID NO: 3361 - DNA, 25 bp, E. coli
ctgatgcaggaagacgtgatggtac

SEQ ID NO: 3362 - DNA, 25 bp, E. coli
ctgatgcaggaacacgtgatggtac

SEQ ID NO: 3363 - DNA, 25 bp, E. coli
aatggtctggcctgtattaccccga

SEQ ID NO: 3364 - DNA, 25 bp, E. coli
aatggtctggccagtattaccccga

SEQ ID NO: 3365 - DNA, 25 bp, E. coli
agaagattgtgattcgcccgctgcc

SEQ ID NO: 3366 - DNA, 25 bp, E. coli
agaagattgtgaatcgcccgctgcc

SEQ ID NO: 3367 - DNA, 25 bp, E. coli
aaagagaaagatcccagcctgtcgt

SEQ ID NO: 3368 - DNA, 25 bp, E. coli
aaagagaaagatgccagcctgtcgt

SEQ ID NO: 3369 - DNA, 25 bp, E. coli
tataacccggatcttgatgatgctc

SEQ ID NO: 3370 - DNA, 25 bp, E. coli
tataacccggatgttgatgatgctc

SEQ ID NO: 3371 - DNA, 25 bp, E. coli
tttacagatgcctgagcagcgcgaa

SEQ ID NO: 3372 - DNA, 25 bp, E. coli
tttacagatgccagagcagcgcgaa

SEQ ID NO: 3373 - DNA, 25 bp, E. coli
gaactgcgtcagagtatgtccgaag

SEQ ID NO: 3374 - DNA, 25 bp, E. coli
gacatgatgctgctggatgcgctta

SEQ ID NO: 3375 - DNA, 25 bp, E. coli
gaactgcgtcagtgtatgtccgaag

SEQ ID NO: 3376 - DNA, 25 bp, E. coli
gacatgatgctggtggatgcgctta

SEQ ID NO: 3377 - DNA, 25 bp, E. coli
ccgtctttctggtggaatcccgata

SEQ ID NO: 3378 - DNA, 25 bp, E. coli
ccgtctttctggaggaatcccgata

SEQ ID NO: 3379 - DNA, 25 bp, E. coli
gatagccgtgattccgagactgaca

SEQ ID NO: 3380 - DNA, 25 bp, E. coli
gatagccgtgataccgagactgaca

SEQ ID NO: 3381 - DNA, 25 bp, E. coli
taatggacaaaatccgccagctcgc

SEQ ID NO: 3382 - DNA, 25 bp, E. coli
taatggacaaaaaccgccagctcgc

SEQ ID NO: 3383 - DNA, 25 bp, E. coli
gatgctccgcgtatgcaggattaca

SEQ ID NO: 3384 - DNA, 25 bp, E. coli
gatgctccgcgtttgcaggattaca

SEQ ID NO: 3385 - DNA, 25 bp, E. coli
caacagcggttgattgatcaggtag

SEQ ID NO: 3386 - DNA, 25 bp, E. coli
caacagcggttgtttgatcaggtag

SEQ ID NO: 3387 - DNA, 25 bp, E. coli
tagaagctttggtgattatcgtcac

SEQ ID NO: 3388 - DNA, 25 bp, E. coli
tagaagctttggagattatcgtcac

SEQ ID NO: 3389 - DNA, 25 bp, E. coli
tcctgacgacgatacggagctgctg

SEQ ID NO: 3390 - DNA, 25 bp, E. coli
tcctgacgacgaaacggagctgctg

SEQ ID NO: 3391 - DNA, 25 bp, E. coli
gcttgcccaaaatgaagaagagtcg

SEQ ID NO: 3392 - DNA, 25 bp, E. coli
gcttgcccaaaaagaagaagagtcg

SEQ ID NO: 3393 - DNA, 25 bp, E. coli
gcaatgcttcgctatatggcgcaaa

SEQ ID NO: 3394 - DNA, 25 bp, E. coli
gcaatgcttcgcaatatggcgcaaa

SEQ ID NO: 3395 - DNA, 25 bp, E. coli
cgcgattacgtaaagaagttattga

SEQ ID NO: 3396 - DNA, 25 bp, E. coli
cgcgattacgtatagaagttattga

SEQ ID NO: 3397 - DNA, 25 bp, E. coli
ggcgctgtacgacgtaaagcccgat

SEQ ID NO: 3398 - DNA, 25 bp, E. coli
ggcgctgtacgaggtaaagcccgat

SEQ ID NO: 3399 - DNA, 25 bp, E. coli
gatgccagcattgctgacgacgata

SEQ ID NO: 3400 - DNA, 25 bp, E. coli
gatgccagcattcctgacgacgata

SEQ ID NO: 3401 - DNA, 25 bp, E. coli
gagctgctgcgcgattacgtaaaga

SEQ ID NO: 3402 - DNA, 25 bp, E. coli
gaggtaaagccccatgccagcattc

SEQ ID NO: 3403 - DNA, 25 bp, E. coli
gagttgttatttaagcttgcccaaa

SEQ ID NO: 3404 - DNA, 25 bp, E. coli
gagctgctgcgccattacgtaaaga

SEQ ID NO: 3405 - DNA, 25 bp, E. coli
gaggtaaagcccgatgccagcattc

SEQ ID NO: 3406 - DNA, 25 bp, E. coli
gagttgttattttagcttgcccaaa

SEQ ID NO: 3407 - DNA, 25 bp, E. coli
aatgtatcgcgtcctgaaacccggc

SEQ ID NO: 3408 - DNA, 25 bp, E. coli
aatgtatcgcgtgctgaaacccggc

SEQ ID NO: 3409 - DNA, 25 bp, E. coli
caaaaagcggatttggtcgcccacg

SEQ ID NO: 3410 - DNA, 25 bp, E. coli
caaaaagcggatatggtcgcccacg

SEQ ID NO: 3411 - DNA, 25 bp, E. coli
aaaatgggccgccagaagctgcgta

SEQ ID NO: 3412 - DNA, 25 bp, E. coli
aaaatgggccgcgagaagctgcgta

SEQ ID NO: 3413 - DNA, 25 bp, E. coli
tatgttcaggcgtacgctgaggcgc

SEQ ID NO: 3414 - DNA, 25 bp, E. coli
tatgttcaggcgaacgctgaggcgc

SEQ ID NO: 3415 - DNA, 25 bp, E. coli
tcagaccgtcgcgaaggaacaaaaa

SEQ ID NO: 3416 - DNA, 25 bp, E. coli
tcagaccgtcgccaaggaacaaaaa

SEQ ID NO: 3417 - DNA, 25 bp, E. coli
ccatgatgcaggttgccggattcga

SEQ ID NO: 3418 - DNA, 25 bp, E. coli
ccatgatgcaggatgccggattcga

SEQ ID NO: 3419 - DNA, 25 bp, E. coli
gaagccaattatcgagccgctgagc

SEQ ID NO: 3420 - DNA, 25 bp, E. coli
gaagccaattatggagccgctgagc

SEQ ID NO: 3421 - DNA, 25 bp, E. coli
cgactactacaaactgacggcaggg

SEQ ID NO: 3422 - DNA, 25 bp, E. coli
cgactactacaatctgacggcaggg

SEQ ID NO: 3423 - DNA, 25 bp, E. coli
gtattggctcacaggtcgcgaacga

SEQ ID NO: 3424 - DNA, 25 bp, E. coli
gtattggctcactggtcgcgaacga

SEQ ID NO: 3425 - DNA, 25 bp, E. coli
tcaccgacaaagttaaagcactgcg

SEQ ID NO: 3426 - DNA, 25 bp, E. coli
tcaccgacaaagataaagcactgcg

SEQ ID NO: 3427 - DNA, 25 bp, E. coli
tcacgattgattgcagcggcgtacg

SEQ ID NO: 3428 - DNA, 25 bp, E. coli
tcacgattgattccagcggcgtacg

SEQ ID NO: 3429 - DNA, 25 bp, E. coli
cataaaagtcagtgccagcgagatt

SEQ ID NO: 3430 - DNA, 25 bp, E. coli
cataaaagtcagagccagcgagatt

SEQ ID NO: 3431 - DNA, 25 bp, E. coli
atggttgcctgtggcgctattccgc

SEQ ID NO: 3432 - DNA, 25 bp, E. coli
atggttgcctgtcgcgctattccgc

SEQ ID NO: 3433 - DNA, 25 bp, E. coli
tattgctaccgtggtgatgactacc

SEQ ID NO: 3434 - DNA, 25 bp, E. coli
tatttttctcttaaactgactgcgt

SEQ ID NO: 3435 - DNA, 25 bp, E. coli
tattgctaccgtcgtgatgactacc

SEQ ID NO: 3436 - DNA, 25 bp, E. coli
tatttttctctttaactgactgcgt

SEQ ID NO: 3437 - DNA, 25 bp, E. coli
tgcagtctatcaagcctcaatggtt

SEQ ID NO: 3438 - DNA, 25 bp, E. coli
tgcagtctatcatgcctcaatggtt

SEQ ID NO: 3439 - DNA, 25 bp, E. coli
tctgccctggaaaacatcataaaaa

SEQ ID NO: 3440 - DNA, 25 bp, E. coli
tctgccctggaatacatcataaaaa

SEQ ID NO: 3441 - DNA, 25 bp, E. coli
gccacgaagaatcacgcaacgctct

SEQ ID NO: 3442 - DNA, 25 bp, E. coli
gccacgaagaatgacgcaacgctct

SEQ ID NO: 3443 - DNA, 25 bp, E. coli
gcgagattatatccgcccggagcgt

SEQ ID NO: 3444 - DNA, 25 bp, E. coli
gcgagattatatgcgcccggagcgt

SEQ ID NO: 3445 - DNA, 25 bp, E. coli
ccctctgatgttgaaattatacgtg

SEQ ID NO: 3446 - DNA, 25 bp, E. coli
ccctctgatgttcaaattatacgtg

SEQ ID NO: 3447 - DNA, 25 bp, E. coli
ggagcgtctgcgagcagttgctcaa

SEQ ID NO: 3448 - DNA, 25 bp, E. coli
ggagcgtctgcgtgcagttgctcaa

SEQ ID NO: 3449 - DNA, 25 bp, E. coli
gatgactaccggtaattctggcgta

SEQ ID NO: 3450 - DNA, 25 bp, E. coli
gatgactaccggaaattctggcgta

SEQ ID NO: 3451 - DNA, 25 bp, E. coli
tacagcagttttttgtcgttgccgt

SEQ ID NO: 3452 - DNA, 25 bp, E. coli
tacagcagttttatgtcgttgccgt

SEQ ID NO: 3453 - DNA, 25 bp, E. coli
atggatgtacaggagttttttgtcg

SEQ ID NO: 3454 - DNA, 25 bp, E. coli
accggaaccggtgtatgtctggcga

SEQ ID NO: 3455 - DNA, 25 bp, E. coli
agcatggaaaggctggcgcgcaggc

SEQ ID NO: 3456 - DNA, 25 bp, E. coli
accggaaccggtctatgtctggcga

SEQ ID NO: 3457 - DNA, 25 bp, E. coli
atggatgtacagcagttttttgtcg

SEQ ID NO: 3458 - DNA, 25 bp, E. coli
agcatggaaagggtggcgcgcaggc

SEQ ID NO: 3459 - DNA, 25 bp, E. coli
tatggtggcataaatcggcttcgga

SEQ ID NO: 3460 - DNA, 25 bp, E. coli
tatggtggcatatatcggcttcgga

SEQ ID NO: 3461 - DNA, 25 bp, E. coli
tttgtttccgcgaagcatggaaagg

SEQ ID NO: 3462 - DNA, 25 bp, E. coli
tttgtttccgcgtagcatggaaagg

SEQ ID NO: 3463 - DNA, 25 bp, E. coli
tgataaacgggtaaaaaatgcaccg

SEQ ID NO: 3464 - DNA, 25 bp, E. coli
tgataaacgggttaaaaatgcaccg

SEQ ID NO: 3465 - DNA, 25 bp, E. coli
tcccgatattttgtttccgcgaagc

SEQ ID NO: 3466 - DNA, 25 bp, E. coli
tcccgatattttctttccgcgaagc

SEQ ID NO: 3467 - DNA, 25 bp, E. coli
tctatcggcatgtttgtttatctta

SEQ ID NO: 3468 - DNA, 25 bp, E. coli
tctatcggcatgattgtttatctta

SEQ ID NO: 3469 - DNA, 25 bp, E. coli
cgcaggcgcgatagataaacgggtt

SEQ ID NO: 3470 - DNA, 25 bp, E. coli
cgcaggcgcgattgataaacgggtt

SEQ ID NO: 3471 - DNA, 25 bp, E. coli
ggcttcggaattatatctatcggca

SEQ ID NO: 3472 - DNA, 25 bp, E. coli
ggcttcggaattttatctatcggca

SEQ ID NO: 3473 - DNA, 25 bp, E. coli
caggccggacgtaataatgaaattc

SEQ ID NO: 3474 - DNA, 25 bp, E. coli
caggccggacgttataatgaaattc

SEQ ID NO: 3475 - DNA, 25 bp, E. coli
aaacagcacgacagctcaccatggg

SEQ ID NO: 3476 - DNA, 25 bp, E. coli
aaacagcacgactgctcaccatggg

SEQ ID NO: 3477 - DNA, 25 bp, E. coli
tattgctatggtgtgtcaggccgga

SEQ ID NO: 3478 - DNA, 25 bp, E. coli
tattgctatggtctgtcaggccgga

SEQ ID NO: 3479 - DNA, 25 bp, E. coli
ttccggccttgatagcagcaatcag

SEQ ID NO: 3480 - DNA, 25 bp, E. coli
ttccggccttgaaagcagcaatcag

SEQ ID NO: 3481 - DNA, 25 bp, E. coli
tgattgaggttcctgccgcagtcat

SEQ ID NO: 3482 - DNA, 25 bp, E. coli
tgattgaggttcgtgccgcagtcat

SEQ ID NO: 3483 - DNA, 25 bp, E. coli
gcaatatattatggcggcagacaga

SEQ ID NO: 3484 - DNA, 25 bp, E. coli
gcaatatattatcgcggcagacaga

SEQ ID NO: 3485 - DNA, 25 bp, E. coli
gacaaattagccagtgaagtcgatt

SEQ ID NO: 3486 - DNA, 25 bp, E. coli
gaaattccggtcagtatgtgcggcg

SEQ ID NO: 3487 - DNA, 25 bp, E. coli
gaaattccggtctgtatgtgcggcg

SEQ ID NO: 3488 - DNA, 25 bp, E. coli
gacaaattagcctgtgaagtcgatt

SEQ ID NO: 3489 - DNA, 25 bp, E. coli
gatttcttttccatcggcaccaacg

SEQ ID NO: 3490 - DNA, 25 bp, E. coli
gatttcttttccttcggcaccaacg

SEQ ID NO: 3491 - DNA, 25 bp, E. coli
gattgataagctcagtgccagtccg

SEQ ID NO: 3492 - DNA, 25 bp, E. coli
gattgataagctgagtgccagtccg

SEQ ID NO: 3493 - DNA, 25 bp, E. coli
ggaaatagcaccctcgcgaaactgg

SEQ ID NO: 3494 - DNA, 25 bp, E. coli
ggaaatagcaccgtcgcgaaactgg

SEQ ID NO: 3495 - DNA, 25 bp, E. coli
caagaaactggacatgcgctttggc

SEQ ID NO: 3496 - DNA, 25 bp, E. coli
caagaaactggagatgcgctttggc

SEQ ID NO: 3497 - DNA, 25 bp, E. coli
cagaagagaagataacgggttgcct

SEQ ID NO: 3498 - DNA, 25 bp, E. coli
catacggtaaccttgctggtgcaaa

SEQ ID NO: 3499 - DNA, 25 bp, E. coli
catacggtaaccatgctggtgcaaa

SEQ ID NO: 3500 - DNA, 25 bp, E. coli
cagaagagaagaaaacgggttgcct

SEQ ID NO: 3501 - DNA, 25 bp, E. coli
taaagaaacgactcatgtcacaggc

SEQ ID NO: 3502 - DNA, 25 bp, E. coli
taaagaaacgacacatgtcacaggc

SEQ ID NO: 3503 - DNA, 25 bp, E. coli
tatgggttatgccaccccgaaagca

SEQ ID NO: 3504 - DNA, 25 bp, E. coli
tatgggttatgcgaccccgaaagca

SEQ ID NO: 3505 - DNA, 25 bp, E. coli
ccgggcgaaaacttgacgatggata

SEQ ID NO: 3506 - DNA, 25 bp, E. coli
cctggtgtgtctcgatagctgcccg

SEQ ID NO: 3507 - DNA, 25 bp, E. coli
ccgggcgaaaacatgacgatggata

SEQ ID NO: 3508 - DNA, 25 bp, E. coli
cctggtgtgtctggatagctgcccg

SEQ ID NO: 3509 - DNA, 25 bp, E. coli
gaatacgacggactttcgaacagcc

SEQ ID NO: 3510 - DNA, 25 bp, E. coli
gaatacgacggagtttcgaacagcc

SEQ ID NO: 3511 - DNA, 25 bp, E. coli
tggatatttcggacaactggcaagg

SEQ ID NO: 3512 - DNA, 25 bp, E. coli
tggctccaacggtcataaatcgctg

SEQ ID NO: 3513 - DNA, 25 bp, E. coli
tggctccaacggacataaatcgctg

SEQ ID NO: 3514 - DNA, 25 bp, E. coli
ggcggtaatttatcggcagcagaag

SEQ ID NO: 3515 - DNA, 25 bp, E. coli
tggatatttcggtcaactggcaagg

SEQ ID NO: 3516 - DNA, 25 bp, E. coli
ggcggtaatttaacggcagcagaag

SEQ ID NO: 3517 - DNA, 25 bp, E. coli
caaaggatttattggcatcgacggt

SEQ ID NO: 3518 - DNA, 25 bp, E. coli
caaaggatttataggcatcgacggt

SEQ ID NO: 3519 - DNA, 25 bp, E. coli
caggcagtggtagatacggtagaac

SEQ ID NO: 3520 - DNA, 25 bp, E. coli
caggcagtggtacatacggtagaac

SEQ ID NO: 3521 - DNA, 25 bp, E. coli
aacgttgagcgtgcggcgaaattca

SEQ ID NO: 3522 - DNA, 25 bp, E. coli
aacgttgagcgtccggcgaaattca

SEQ ID NO: 3523 - DNA, 25 bp, E. coli
ttgtacagggcagcgcaaaactggt

SEQ ID NO: 3524 - DNA, 25 bp, E. coli
ttgtacagggcaccgcaaaactggt

SEQ ID NO: 3525 - DNA, 25 bp, E. coli
tcggcgaagtcaggccaacgcgttt

SEQ ID NO: 3526 - DNA, 25 bp, E. coli
tcggcgaagtcacgccaacgcgttt

SEQ ID NO: 3527 - DNA, 25 bp, E. coli
gaaatcgatccacaaactcaggcag

SEQ ID NO: 3528 - DNA, 25 bp, E. coli
gaaatcgatccagaaactcaggcag

SEQ ID NO: 3529 - DNA, 25 bp, E. coli
ggtattagcctgtccgtcggcgaag

SEQ ID NO: 3530 - DNA, 25 bp, E. coli
ggtattagcctgaccgtcggcgaag

SEQ ID NO: 3531 - DNA, 25 bp, E. coli
ggaaattaacgggaaccatgtcagt

SEQ ID NO: 3532 - DNA, 25 bp, E. coli
tggagttacccgtccacatgctgga

SEQ ID NO: 3533 - DNA, 25 bp, E. coli
ggcgcacgcgtctacattgaaatcg

SEQ ID NO: 3534 - DNA, 25 bp, E. coli
ggcgcacgcgtcaacattgaaatcg

SEQ ID NO: 3535 - DNA, 25 bp, E. coli
tggagttacccgaccacatgctgga

SEQ ID NO: 3536 - DNA, 25 bp, E. coli
tggaacgcacgagtcttgggaagaa

SEQ ID NO: 3537 - DNA, 25 bp, E. coli
tggaacgcacgactcttgggaagaa

SEQ ID NO: 3538 - DNA, 25 bp, E. coli
ggaaattaacggcaaccatgtcagt

SEQ ID NO: 3539 - DNA, 25 bp, E. coli
aatccgccgcgaactgaaagatgct

SEQ ID NO: 3540 - DNA, 25 bp, E. coli
aatccgccgcgatctgaaagatgct

SEQ ID NO: 3541 - DNA, 25 bp, E. coli
caccggtgactcaattactgtagcg

SEQ ID NO: 3542 - DNA, 25 bp, E. coli
caccggtgactctattactgtagcg

SEQ ID NO: 3543 - DNA, 25 bp, E. coli
taccaccatcgatatggcggttgag

SEQ ID NO: 3544 - DNA, 25 bp, E. coli
tactgtagcgcctgcgcaaacactg

SEQ ID NO: 3545 - DNA, 25 bp, E. coli
taccaccatcgaaatggcggttgag

SEQ ID NO: 3546 - DNA, 25 bp, E. coli
tactgtagcgccagcgcaaacactg

SEQ ID NO: 3547 - DNA, 25 bp, E. coli
aaccggtaacgcaggaagacgtgct

SEQ ID NO: 3548 - DNA, 25 bp, E. coli
aaccggtaacgctggaagacgtgct

SEQ ID NO: 3549 - DNA, 25 bp, E. coli
tatcgaaatgaacccgcgtgtgtcg

SEQ ID NO: 3550 - DNA, 25 bp, E. coli
tatcgaaatgaagccgcgtgtgtcg

SEQ ID NO: 3551 - DNA, 25 bp, E. coli
tccggtatcgctcattcaatggaag

SEQ ID NO: 3552 - DNA, 25 bp, E. coli
tccggtatcgctgattcaatggaag

SEQ ID NO: 3553 - DNA, 25 bp, E. coli
gcaagttgcgcgtccagtatgatct

SEQ ID NO: 3554 - DNA, 25 bp, E. coli
gaagcgctgactaaaatccgccgcg

SEQ ID NO: 3555 - DNA, 25 bp, E. coli
gaagcgctgacttaaatccgccgcg

SEQ ID NO: 3556 - DNA, 25 bp, E. coli
gcaagttgcgcgaccagtatgatct

SEQ ID NO: 3557 - DNA, 25 bp, E. coli
ccgatgcgcgtctggctaaactggc

SEQ ID NO: 3558 - DNA, 25 bp, E. coli
ccgatgcgcgtcaggctaaactggc

SEQ ID NO: 3559 - DNA, 25 bp, E. coli
gtatatcgctgatgccttccgcgcg

SEQ ID NO: 3560 - DNA, 25 bp, E. coli
gtatatcgctgaagccttccgcgcg

SEQ ID NO: 3561 - DNA, 25 bp, E. coli
catcgataatatacgcggtgccctg

SEQ ID NO: 3562 - DNA, 25 bp, E. coli
catcgataatattcgcggtgccctg

SEQ ID NO: 3563 - DNA, 25 bp, E. coli
aaaagacgggctgtgtgcctacggc

SEQ ID NO: 3564 - DNA, 25 bp, E. coli
aaaagacgggctctgtgcctacggc

SEQ ID NO: 3565 - DNA, 25 bp, E. coli
tgctgcagggcgtcctcgtaagcct

SEQ ID NO: 3566 - DNA, 25 bp, E. coli
tgcctacggctgcaatgaagttcct

SEQ ID NO: 3567 - DNA, 25 bp, E. coli
tgctgcagggcgacctcgtaagcct

SEQ ID NO: 3568 - DNA, 25 bp, E. coli
tgcctacggctggaatgaagttcct

SEQ ID NO: 3569 - DNA, 25 bp, E. coli
gcggtgccctgcattatctggcgaa

SEQ ID NO: 3570 - DNA, 25 bp, E. coli
gcggtgccctgctttatctggcgaa

SEQ ID NO: 3571 - DNA, 25 bp, E. coli
gaagttcctgaaggtcctgctgcag

SEQ ID NO: 3572 - DNA, 25 bp, E. coli
gaagttcctgaacgtcctgctgcag

SEQ ID NO: 3573 - DNA, 25 bp, E. coli
gaaagaagaacataaagacgggctg

SEQ ID NO: 3574 - DNA, 25 bp, E. coli
gaaagaagaacaaaaagacgggctg

SEQ ID NO: 3575 - DNA, 25 bp, E. coli
cattatctggcgaaagaagaacaaa

SEQ ID NO: 3576 - DNA, 25 bp, E. coli
cattatctggcgtaagaagaacaaa

SEQ ID NO: 3577 - DNA, 25 bp, E. coli
gtgcgccacaacgatcctgaaagca

SEQ ID NO: 3578 - DNA, 25 bp, E. coli
gtgcgccacaaccatcctgaaagca

SEQ ID NO: 3579 - DNA, 25 bp, E. coli
ggcgtcctcgtaagcctcacttctg

SEQ ID NO: 3580 - DNA, 25 bp, E. coli
ggcgtcctcgtatgcctcacttctg

SEQ ID NO: 3581 - DNA, 25 bp, E. coli
gatcctgaaagcatcgataatattc

SEQ ID NO: 3582 - DNA, 25 bp, E. coli
gatcctgaaagcttcgataatattc

SEQ ID NO: 3583 - DNA, 25 bp, E. coli
aataagctcttaagccgcgccaatg

SEQ ID NO: 3584 - DNA, 25 bp, E. coli
aataagctcttatgccgcgccaatg

SEQ ID NO: 3585 - DNA, 25 bp, E. coli
cacgggcgagcaagatggttatatc

SEQ ID NO: 3586 - DNA, 25 bp, E. coli
cacgggcgagcatgatggttatatc

SEQ ID NO: 3587 - DNA, 25 bp, E. coli
catgcaacacgatctacagcctgat

SEQ ID NO: 3588 - DNA, 25 bp, E. coli
catgcaacacgaactacagcctgat

SEQ ID NO: 3589 - DNA, 25 bp, E. coli
taaattaaattccaactagcaggcc

SEQ ID NO: 3590 - DNA, 25 bp, E. coli
taaattaaattcgaactagcaggcc

SEQ ID NO: 3591 - DNA, 25 bp, E. coli
aaaatatcctgaactaccatcgccg

SEQ ID NO: 3592 - DNA, 25 bp, E. coli
aaaatatcctgatctaccatcgccg

SEQ ID NO: 3593 - DNA, 25 bp, E. coli
tatgaccggatttagtcaggcgacc

SEQ ID NO: 3594 - DNA, 25 bp, E. coli
tatgaccggattaagtcaggcgacc

SEQ ID NO: 3595 - DNA, 25 bp, E. coli
tattcggagatagcactcatgcaac

SEQ ID NO: 3596 - DNA, 25 bp, E. coli
tattcggagataccactcatgcaac

SEQ ID NO: 3597 - DNA, 25 bp, E. coli
tcatcatggctgatactggctttgg

SEQ ID NO: 3598 - DNA, 25 bp, E. coli
tcatcatggctgttactggctttgg

SEQ ID NO: 3599 - DNA, 25 bp, E. coli
gccaaaagccaaagttatccacggg

SEQ ID NO: 3600 - DNA, 25 bp, E. coli
gccaaaagccaatgttatccacggg

SEQ ID NO: 3601 - DNA, 25 bp, E. coli
gcaggttcgattccctattcggaga

SEQ ID NO: 3602 - DNA, 25 bp, E. coli
gaataaggcacaccaggaactcgtg

SEQ ID NO: 3603 - DNA, 25 bp, E. coli
gaataaggcacagcaggaactcgtg

SEQ ID NO: 3604 - DNA, 25 bp, E. coli
gcaggttcgattgcctattcggaga

SEQ ID NO: 3605 - DNA, 25 bp, E. coli
aaggcggctataagacgctcgcgca

SEQ ID NO: 3606 - DNA, 25 bp, E. coli
caaggcggctatttgacgctcgcgc

SEQ ID NO: 3607 - DNA, 25 bp, E. coli
aaggcggctatatgacgctcgcgca

SEQ ID NO: 3608 - DNA, 25 bp, E. coli
caaggcggctatatgacgctcgcgc

SEQ ID NO: 3609 - DNA, 25 bp, E. coli
caacaaggcggcaatatgacgctcg

SEQ ID NO: 3610 - DNA, 25 bp, E. coli
caacaaggcggctatatgacgctcg

SEQ ID NO: 3611 - DNA, 25 bp, E. coli
attttctggcacgacctggcagcac

SEQ ID NO: 3612 - DNA, 25 bp, E. coli
attttctggcaccacctggcagcac

SEQ ID NO: 3613 - DNA, 25 bp, E. coli
aggcggctatatcacgctcgcgcag

SEQ ID NO: 3614 - DNA, 25 bp, E. coli
aggcggctatatgacgctcgcgcag

SEQ ID NO: 3615 - DNA, 25 bp, E. coli
aacaaggcggctttatgacgctcgc

SEQ ID NO: 3616 - DNA, 25 bp, E. coli
acaaggcggctaaatgacgctcgcg

SEQ ID NO: 3617 - DNA, 25 bp, E. coli
aacaaggcggctatatgacgctcgc

SEQ ID NO: 3618 - DNA, 25 bp, E. coli
acaaggcggctatatgacgctcgcg

SEQ ID NO: 3619 - DNA, 25 bp, E. coli
tattaccgcagcgattgtcggctgg

SEQ ID NO: 3620 - DNA, 25 bp, E. coli
tattaccgcagccattgtcggctgg

SEQ ID NO: 3621 - DNA, 25 bp, E. coli
gcagcaccgatcctggcgggaatta

SEQ ID NO: 3622 - DNA, 25 bp, E. coli
gcagcaccgatcgtggcgggaatta

SEQ ID NO: 3623 - DNA, 25 bp, E. coli
cgcagtttgccatgattttctggca

SEQ ID NO: 3624 - DNA, 25 bp, E. coli
cgcagtttgccaagattttctggca

SEQ ID NO: 3625 - DNA, 25 bp, E. coli
ctatatgacgctcgcgcagtttgcc

SEQ ID NO: 3626 - DNA, 25 bp, E. coli
ctatatgacgctggcgcagtttgcc

SEQ ID NO: 3627 - DNA, 25 bp, E. coli
aaccttctgccgcacagataatgct

SEQ ID NO: 3628 - DNA, 25 bp, E. coli
acgcggatgcctcggtggtcgataa

SEQ ID NO: 3629 - DNA, 25 bp, E. coli
aaccttctgccggacagataatgct

SEQ ID NO: 3630 - DNA, 25 bp, E. coli
acgcggatgcctgggtggtcgataa

SEQ ID NO: 3631 - DNA, 25 bp, E. coli
tgccggacagataatgcttgatggc

SEQ ID NO: 3632 - DNA, 25 bp, E. coli
tgccggacagattatgcttgatggc

SEQ ID NO: 3633 - DNA, 25 bp, E. coli
tctgccggacagataatgcttgatg

SEQ ID NO: 3634 - DNA, 25 bp, E. coli
tctgccggacagttaatgcttgatg

SEQ ID NO: 3635 - DNA, 25 bp, E. coli
gaacaaccttctgccggacagataa

SEQ ID NO: 3636 - DNA, 25 bp, E. coli
gaacaaccttctcccggacagataa

SEQ ID NO: 3637 - DNA, 25 bp, E. coli
cgaacaaccttcagccggacagata

SEQ ID NO: 3638 - DNA, 25 bp, E. coli
gctcggtaaacgactttgaaggcgt

SEQ ID NO: 3639 - DNA, 25 bp, E. coli
gctcggtaaacgtctttgaaggcgt

SEQ ID NO: 3640 - DNA, 25 bp, E. coli
cgaacaaccttctgccggacagata

SEQ ID NO: 3641 - DNA, 25 bp, E. coli
cttctgccggacagataatgcttga

SEQ ID NO: 3642 - DNA, 25 bp, E. coli
ctgaaagtcgacccggatgcctcgg

SEQ ID NO: 3643 - DNA, 25 bp, E. coli
ctgaaagtcgacgcggatgcctcgg

SEQ ID NO: 3644 - DNA, 25 bp, E. coli
cttctgccggactgataatgcttga

SEQ ID NO: 3645 - DNA, 25 bp, E. coli
tggctcggtaaacgtctttgaaggc

SEQ ID NO: 3646 - DNA, 25 bp, E. coli
tggctcggtaaaggtctttgaaggc

SEQ ID NO: 3647 - DNA, 25 bp, E. coli
taaacgtctttgaaggcgtactcaa

SEQ ID NO: 3648 - DNA, 25 bp, E. coli
taaacgtctttgtaggcgtactcaa

SEQ ID NO: 3649 - DNA, 25 bp, E. coli
cagaggtatcctgtttatccggaaa

SEQ ID NO: 3650 - DNA, 25 bp, E. coli
cagaggtatcctctttatccggaaa

SEQ ID NO: 3651 - DNA, 25 bp, E. coli
tatctaatagttggcgtctcatccg

SEQ ID NO: 3652 - DNA, 25 bp, E. coli
tatccggaaactgagcgtcttgaaa

SEQ ID NO: 3653 - DNA, 25 bp, E. coli
tatccggaaactcagcgtcttgaaa

SEQ ID NO: 3654 - DNA, 25 bp, E. coli
tatctaatagttcgcgtctcatccg

SEQ ID NO: 3655 - DNA, 25 bp, E. coli
tcttagtgatgggagatgattggct

SEQ ID NO: 3656 - DNA, 25 bp, E. coli
tcttagtgatggcagatgattggct

SEQ ID NO: 3657 - DNA, 25 bp, E. coli
gctaaaaatgcgaaaagttatcacc

SEQ ID NO: 3658 - DNA, 25 bp, E. coli
gctaaaaatgcgtaaagttatcacc

SEQ ID NO: 3659 - DNA, 25 bp, E. coli
gaagtatcatatctgccaagaactg

SEQ ID NO: 3660 - DNA, 25 bp, E. coli
gaagtatcatatgtgccaagaactg

SEQ ID NO: 3661 - DNA, 25 bp, E. coli
gaactgttggtatttcaacgacaga

SEQ ID NO: 3662 - DNA, 25 bp, E. coli
gaactgttggtaattcaacgacaga

SEQ ID NO: 3663 - DNA, 25 bp, E. coli
gcgtcttgaaataattaggtcctta

SEQ ID NO: 3664 - DNA, 25 bp, E. coli
gcgtcttgaaattattaggtcctta

SEQ ID NO: 3665 - DNA, 25 bp, E. coli
tggctagggcgatttgatgaatata

SEQ ID NO: 3666 - DNA, 25 bp, E. coli
ggcgtctcatcccattatttgaatt

SEQ ID NO: 3667 - DNA, 25 bp, E. coli
ggcgtctcatccgattatttgaatt

SEQ ID NO: 3668 - DNA, 25 bp, E. coli
tggctagggcgaattgatgaatata

SEQ ID NO: 3669 - DNA, 25 bp, E. coli
gagtcattggaattaaagggcgagt

SEQ ID NO: 3670 - DNA, 25 bp, E. coli
gagtcattggaaataaagggcgagt

SEQ ID NO: 3671 - DNA, 25 bp, E. coli
aatcgtacctgggtggcggcaactg

SEQ ID NO: 3672 - DNA, 25 bp, E. coli
aatcgtacctggctggcggcaactg

SEQ ID NO: 3673 - DNA, 25 bp, E. coli
cactggttggcagagataaaccttc

SEQ ID NO: 3674 - DNA, 25 bp, E. coli
cactggttggcacagataaaccttc

SEQ ID NO: 3675 - DNA, 25 bp, E. coli
catattcaggagaggctgtagcgac

SEQ ID NO: 3676 - DNA, 25 bp, E. coli
catattcaggagtggctgtagcgac

SEQ ID NO: 3677 - DNA, 25 bp, E. coli
taaacatcatgtccggttctcggag

SEQ ID NO: 3678 - DNA, 25 bp, E. coli
taaacatcatgtgcggttctcggag

SEQ ID NO: 3679 - DNA, 25 bp, E. coli
aaaaatagaaatgtcgctgctgagc

SEQ ID NO: 3680 - DNA, 25 bp, E. coli
aaaaatagaaatctcgctgctgagc

SEQ ID NO: 3681 - DNA, 25 bp, E. coli
ttagaaacacattccgctgacacgg

SEQ ID NO: 3682 - DNA, 25 bp, E. coli
ttagaaacacataccgctgacacgg

SEQ ID NO: 3683 - DNA, 25 bp, E. coli
tgactatttccaccctatgccaggc

SEQ ID NO: 3684 - DNA, 25 bp, E. coli
tgactatttccagcctatgccaggc

SEQ ID NO: 3685 - DNA, 25 bp, E. coli
gcggcaactggacaggatgaatata

SEQ ID NO: 3686 - DNA, 25 bp, E. coli
gcggcaactggagaggatgaatata

SEQ ID NO: 3687 - DNA, 25 bp, E. coli
cgctgacacggtattgaggaagaaa

SEQ ID NO: 3688 - DNA, 25 bp, E. coli
cgctgacacggttttgaggaagaaa

SEQ ID NO: 3689 - DNA, 25 bp, E. coli
tggcaagtcctataaacagcggaat

SEQ ID NO: 3690 - DNA, 25 bp, E. coli
tggcaagtcctaaaaacagcggaat

SEQ ID NO: 3691 - DNA, 25 bp, E. coli
gatgttgcaggatataaagcgctta

SEQ ID NO: 3692 - DNA, 25 bp, E. coli
gatgttgcaggaaataaagcgctta

SEQ ID NO: 3693 - DNA, 25 bp, E. coli
aattgagtccggtgcttttacagcc

SEQ ID NO: 3694 - DNA, 25 bp, E. coli
aattaaagccgccattgaacgtgca

SEQ ID NO: 3695 - DNA, 25 bp, E. coli
aattaaagccgcgattgaacgtgca

SEQ ID NO: 3696 - DNA, 25 bp, E. coli
aattgagtccggagcttttacagcc

SEQ ID NO: 3697 - DNA, 25 bp, E. coli
tactcgatgcaatagcacgctctgg

SEQ ID NO: 3698 - DNA, 25 bp, E. coli
tacattcacagcgtaaagcggcagc

SEQ ID NO: 3699 - DNA, 25 bp, E. coli
tactcgatgcaaaagcacgctctgg

SEQ ID NO: 3700 - DNA, 25 bp, E. coli
tacattcacagcctaaagcggcagc

SEQ ID NO: 3701 - DNA, 25 bp, E. coli
aaaaattgtgtcatcgtcagtgcgg

SEQ ID NO: 3702 - DNA, 25 bp, E. coli
aaaaattgtgtcttcgtcagtgcgg

SEQ ID NO: 3703 - DNA, 25 bp, E. coli
tcgataaagcaggaacagtcaccgc

SEQ ID NO: 3704 - DNA, 25 bp, E. coli
tcgataaagcagcaacagtcaccgc

SEQ ID NO: 3705 - DNA, 25 bp, E. coli
tcttaaaagtgtcgcgcttgccgcc

SEQ ID NO: 3706 - DNA, 25 bp, E. coli
tcttaaaagtgtggcgcttgccgcc

SEQ ID NO: 3707 - DNA, 25 bp, E. coli
gctgcacagttcgttgccgttggga

SEQ ID NO: 3708 - DNA, 25 bp, E. coli
gctgcacagttccttgccgttggga

SEQ ID NO: 3709 - DNA, 25 bp, E. coli
gaaatgcaggatgaactggcgctac

SEQ ID NO: 3710 - DNA, 25 bp, E. coli
gaaatgcaggatcaactggcgctac

SEQ ID NO: 3711 - DNA, 25 bp, E. coli
cattaaaagttaagccagcggtggc

SEQ ID NO: 3712 - DNA, 25 bp, E. coli
cattaaaagttatgccagcggtggc

SEQ ID NO: 3713 - DNA, 25 bp, E. coli
ggtttatgacgtaatcctgcgcgat

SEQ ID NO: 3714 - DNA, 25 bp, E. coli
ggtttatgacgttatcctgcgcgat

SEQ ID NO: 3715 - DNA, 25 bp, E. coli
catgaactcgatcggcaggtacttc

SEQ ID NO: 3716 - DNA, 25 bp, E. coli
catgaactcgatgggcaggtacttc

SEQ ID NO: 3717 - DNA, 25 bp, E. coli
catgccctcgtgctcaggtctggac

SEQ ID NO: 3718 - DNA, 25 bp, E. coli
caggtacttctcctcggcgtgggac

SEQ ID NO: 3719 - DNA, 25 bp, E. coli
catgccctcgtggtcaggtctggac

SEQ ID NO: 3720 - DNA, 25 bp, E. coli
caggtacttctcgtcggcgtgggac

SEQ ID NO: 3721 - DNA, 25 bp, E. coli
tacgaatggcgaaaagccgagctca

SEQ ID NO: 3722 - DNA, 25 bp, E. coli
ccgagttgatggcaaaggttcccta

SEQ ID NO: 3723 - DNA, 25 bp, E. coli
ccgagttgatgggaaaggttcccta

SEQ ID NO: 3724 - DNA, 25 bp, E. coli
tacgaatggcgataagccgagctca

SEQ ID NO: 3725 - DNA, 25 bp, E. coli
ttcagaaggaaggtccagtcggtca

SEQ ID NO: 3726 - DNA, 25 bp, E. coli
tatctcgagaatgaccactgctgtg

SEQ ID NO: 3727 - DNA, 25 bp, E. coli
tatctcgagaatcaccactgctgtg

SEQ ID NO: 3728 - DNA, 25 bp, E. coli
ttcagaaggaagctccagtcggtca

SEQ ID NO: 3729 - DNA, 25 bp, E. coli
ttgatcttcctggatccgccagagg

SEQ ID NO: 3730 - DNA, 25 bp, E. coli
ttgatcttcctgcatccgccagagg

SEQ ID NO: 3731 - DNA, 25 bp, E. coli
tgtctctgacactttctggcgcctg

SEQ ID NO: 3732 - DNA, 25 bp, E. coli
tgtctctgacacattctggcgcctg

SEQ ID NO: 3733 - DNA, 25 bp, E. coli
tgccaaatgtaaagcgcagcgccca

SEQ ID NO: 3734 - DNA, 25 bp, E. coli
tgccaaatgtaatgcgcagcgccca

SEQ ID NO: 3735 - DNA, 25 bp, E. coli
tcaggatggcaacttggtacgcgtc

SEQ ID NO: 3736 - DNA, 25 bp, E. coli
tcaggatggcaagttggtacgcgtc

SEQ ID NO: 3737 - DNA, 25 bp, E. coli
caagtgttacattttccggacgagc

SEQ ID NO: 3738 - DNA, 25 bp, E. coli
caagtgttacatattccggacgagc

SEQ ID NO: 3739 - DNA, 25 bp, E. coli
cagaaattcagcgtatcgtcgatga

SEQ ID NO: 3740 - DNA, 25 bp, E. coli
catgagatggatcacctggtcggca

SEQ ID NO: 3741 - DNA, 25 bp, E. coli
catgagatggatgacctggtcggca

SEQ ID NO: 3742 - DNA, 25 bp, E. coli
cagaaattcagcctatcgtcgatga

SEQ ID NO: 3743 - DNA, 25 bp, E. coli
cagagaaagttaaaattcgcgccct

SEQ ID NO: 3744 - DNA, 25 bp, E. coli
cagagaaagttataattcgcgccct

SEQ ID NO: 3745 - DNA, 25 bp, E. coli
aaactggatcgtgtgaaagcccggg

SEQ ID NO: 3746 - DNA, 25 bp, E. coli
aaactggatcgtctgaaagcccggg

SEQ ID NO: 3747 - DNA, 25 bp, E. coli
tatggattatctgtcaccgctgaaa

SEQ ID NO: 3748 - DNA, 25 bp, E. coli
tatggattatctctcaccgctgaaa

SEQ ID NO: 3749 - DNA, 25 bp, E. coli
tgtacgcagaagtaggtattggcct

SEQ ID NO: 3750 - DNA, 25 bp, E. coli
tgtacgcagaagaaggtattggcct

SEQ ID NO: 3751 - DNA, 25 bp, E. coli
tcgatccctgaagaacgtgctttag

SEQ ID NO: 3752 - DNA, 25 bp, E. coli
tcgatccctgaacaacgtgctttag

SEQ ID NO: 3753 - DNA, 25 bp, E. coli
gaagaaggttgcctgtcgatccctg

SEQ ID NO: 3754 - DNA, 25 bp, E. coli
gaagaaggttgcgtgtcgatccctg

SEQ ID NO: 3755 - DNA, 25 bp, E. coli
gatatgttcgagtcgatgtacgcag

SEQ ID NO: 3756 - DNA, 25 bp, E. coli
gatatgttcgagacgatgtacgcag

SEQ ID NO: 3757 - DNA, 25 bp, E. coli
gacgagcggcttcgcaaagttgcta

SEQ ID NO: 3758 - DNA, 25 bp, E. coli
gacgagcggcttggcaaagttgcta

SEQ ID NO: 3759 - DNA, 25 bp, E. coli
tactgatatcaccatggccggaacc

SEQ ID NO: 3760 - DNA, 25 bp, E. coli
tactgatatcacgatggccggaacc

SEQ ID NO: 3761 - DNA, 25 bp, E. coli
tatcgcgatggaaaacaacacctgg

SEQ ID NO: 3762 - DNA, 25 bp, E. coli
tagacgccatttagcaacgctttgc

SEQ ID NO: 3763 - DNA, 25 bp, E. coli
tagacgccattttgcaacgctttgc

SEQ ID NO: 3764 - DNA, 25 bp, E. coli
tatcgcgatggataacaacacctgg

SEQ ID NO: 3765 - DNA, 25 bp, E. coli
tgttaagtcagttcgccggttccac

SEQ ID NO: 3766 - DNA, 25 bp, E. coli
tgttaagtcagtacgccggttccac

SEQ ID NO: 3767 - DNA, 25 bp, E. coli
tgttctggacgggtgaaacaccctg

SEQ ID NO: 3768 - DNA, 25 bp, E. coli
tgtcgtgtcagaacgctggctggca

SEQ ID NO: 3769 - DNA, 25 bp, E. coli
tgttctggacggctgaaacaccctg

SEQ ID NO: 3770 - DNA, 25 bp, E. coli
tgtcgtgtcagatcgctggctggca

SEQ ID NO: 3771 - DNA, 25 bp, E. coli
tgaacggttaatctccgcacagcgg

SEQ ID NO: 3772 - DNA, 25 bp, E. coli
tgactgaatgcctcatccgcggtat

SEQ ID NO: 3773 - DNA, 25 bp, E. coli
tgaacggttaatgtccgcacagcgg

SEQ ID NO: 3774 - DNA, 25 bp, E. coli
tgactgaatgccacatccgcggtat

SEQ ID NO: 3775 - DNA, 25 bp, E. coli
gaaattttaatgcttcgcagcgccc

SEQ ID NO: 3776 - DNA, 25 bp, E. coli
gaaattttaatggttcgcagcgccc

SEQ ID NO: 3777 - DNA, 25 bp, E. coli
gattggtacgcttcagaacagcgcc

SEQ ID NO: 3778 - DNA, 25 bp, E. coli
gattggtacgctacagaacagcgcc

SEQ ID NO: 3779 - DNA, 25 bp, E. coli
taacccaggtatgcaatggctggca

SEQ ID NO: 3780 - DNA, 25 bp, E. coli
taacccaggtatccaatggctggca

SEQ ID NO: 3781 - DNA, 25 bp, E. coli
tgatgcccatcatcacggcatgatg

SEQ ID NO: 3782 - DNA, 25 bp, E. coli
tgatgcccatcaacacggcatgatg

SEQ ID NO: 3783 - DNA, 25 bp, E. coli
gaagccgatgatccccatcatcacg

SEQ ID NO: 3784 - DNA, 25 bp, E. coli
gaagccgatgatgcccatcatcacg

SEQ ID NO: 3785 - DNA, 25 bp, E. coli
cgacgtaacgcgataatgcctgcca

SEQ ID NO: 3786 - DNA, 25 bp, E. coli
cgacgtaacgcgttaatgcctgcca

SEQ ID NO: 3787 - DNA, 25 bp, E. coli
cgtaacgcgatattgcctgccagca

SEQ ID NO: 3788 - DNA, 25 bp, E. coli
cgtaacgcgataatgcctgccagca

SEQ ID NO: 3789 - DNA, 25 bp, E. coli
cgtggaagccgatgatgcccatcat

SEQ ID NO: 3790 - DNA, 25 bp, E. coli
cgtggaagccgaagatgcccatcat

SEQ ID NO: 3791 - DNA, 25 bp, E. coli
gtaacgcgataaagcctgccagcag

SEQ ID NO: 3792 - DNA, 25 bp, E. coli
gtaacgcgataatgcctgccagcag

SEQ ID NO: 3793 - DNA, 25 bp, E. coli
tggaagccgatgatgcccatcatca

SEQ ID NO: 3794 - DNA, 25 bp, E. coli
tggaagccgatgttgcccatcatca

SEQ ID NO: 3795 - DNA, 25 bp, E. coli
taacgcgataatgcctgccagcagc

SEQ ID NO: 3796 - DNA, 25 bp, E. coli
taacgcgataatccctgccagcagc

SEQ ID NO: 3797 - DNA, 25 bp, E. coli
gatgatgcccatgatcacggcatga

SEQ ID NO: 3798 - DNA, 25 bp, E. coli
gacgtaacgcgataatgcctgccag

SEQ ID NO: 3799 - DNA, 25 bp, E. coli
gatgcccatcatcacggcatgatgc

SEQ ID NO: 3800 - DNA, 25 bp, E. coli
gatgatgcccatcatcacggcatga

SEQ ID NO: 3801 - DNA, 25 bp, E. coli
gatgcccatcatgacggcatgatgc

SEQ ID NO: 3802 - DNA, 25 bp, E. coli
gacgtaacgcgaaaatgcctgccag

SEQ ID NO: 3803 - DNA, 25 bp, E. coli
caattactggaatgggcgaacgacc

SEQ ID NO: 3804 - DNA, 25 bp, E. coli
caattactggaaagggcgaacgacc

SEQ ID NO: 3805 - DNA, 25 bp, E. coli
taaaaatatgaatacgccaccaggc

SEQ ID NO: 3806 - DNA, 25 bp, E. coli
taaaaatatcccgttcctggcggtg

SEQ ID NO: 3807 - DNA, 25 bp, E. coli
taaaaatatccccttcctggcggtg

SEQ ID NO: 3808 - DNA, 25 bp, E. coli
taaaaatatgaaaacgccaccaggc

SEQ ID NO: 3809 - DNA, 25 bp, E. coli
tattgatgccgacttacgccgtggt

SEQ ID NO: 3810 - DNA, 25 bp, E. coli
tattgatgccgagttacgccgtggt

SEQ ID NO: 3811 - DNA, 25 bp, E. coli
tatcgtgcgctggtggaaaaacgcc

SEQ ID NO: 3812 - DNA, 25 bp, E. coli
tatcgtgcgctgctggaaaaacgcc

SEQ ID NO: 3813 - DNA, 25 bp, E. coli
ttaagtcgtgacctagaagcgggcc

SEQ ID NO: 3814 - DNA, 25 bp, E. coli
ttaagtcgtgacgtagaagcgggcc

SEQ ID NO: 3815 - DNA, 25 bp, E. coli
tgttgcgtcgtgctgtagaagcccc

SEQ ID NO: 3816 - DNA, 25 bp, E. coli
tgttgcgtcgtggtgtagaagcccc

SEQ ID NO: 3817 - DNA, 25 bp, E. coli
cctcaatggtgtcattaaacgcgcc

SEQ ID NO: 3818 - DNA, 25 bp, E. coli
cctcaatggtgtgattaaacgcgcc

SEQ ID NO: 3819 - DNA, 25 bp, E. coli
gcaattacttaaccgccagcaggag

SEQ ID NO: 3820 - DNA, 25 bp, E. coli
gcaattacttaagcgccagcaggag

SEQ ID NO: 3821 - DNA, 25 bp, E. coli
cattgctgaactcaatctgcgcgac

SEQ ID NO: 3822 - DNA, 25 bp, E. coli
cattgctgaactgaatctgcgcgac

SEQ ID NO: 3823 - DNA, 25 bp, E. coli
taagtttattatgagcgtgaccgcg

SEQ ID NO: 3824 - DNA, 25 bp, E. coli
taagtttattatcagcgtgaccgcg

SEQ ID NO: 3825 - DNA, 25 bp, E. coli
tactggtctggaaaattggaaggac

SEQ ID NO: 3826 - DNA, 25 bp, E. coli
tactggtctggataattggaaggac

SEQ ID NO: 3827 - DNA, 25 bp, E. coli
aaattacccacgaaagagcagaaca

SEQ ID NO: 3828 - DNA, 25 bp, E. coli
aaattacccacgtaagagcagaaca

SEQ ID NO: 3829 - DNA, 25 bp, E. coli
tgggaatcattctgcgcactgcaca

SEQ ID NO: 3830 - DNA, 25 bp, E. coli
tgggaatcattcagcgcactgcaca

SEQ ID NO: 3831 - DNA, 25 bp, E. coli
tcattcagcgcactgcacaataaaa

SEQ ID NO: 3832 - DNA, 25 bp, E. coli
tcattcagcgcagtgcacaataaaa

SEQ ID NO: 3833 - DNA, 25 bp, E. coli
gaaccagttattgagctatataccg

SEQ ID NO: 3834 - DNA, 25 bp, E. coli
gaaccagttattcagctatataccg

SEQ ID NO: 3835 - DNA, 25 bp, E. coli
gaaagagcagaacaacagagtttct

SEQ ID NO: 3836 - DNA, 25 bp, E. coli
gaaagagcagaagaacagagtttct

SEQ ID NO: 3837 - DNA, 25 bp, E. coli
ccgatgtgacatgggaatcattcag

SEQ ID NO: 3838 - DNA, 25 bp, E. coli
ccgatgtgacatcggaatcattcag

SEQ ID NO: 3839 - DNA, 25 bp, E. coli
gatatccccgcttttactggtctgg

SEQ ID NO: 3840 - DNA, 25 bp, E. coli
gatatccccgctattactggtctgg

SEQ ID NO: 3841 - DNA, 25 bp, E. coli
ggaaggacatttgaaccagttattg

SEQ ID NO: 3842 - DNA, 25 bp, E. coli
ggaaggacatttcaaccagttattg

SEQ ID NO: 3843 - DNA, 25 bp, E. coli
ggataattggaaggacatttgaacc

SEQ ID NO: 3844 - DNA, 25 bp, E. coli
ggataattggaacgacatttgaacc

SEQ ID NO: 3845 - DNA, 25 bp, E. coli
gagctatataccgatgtgacatggg

SEQ ID NO: 3846 - DNA, 25 bp, E. coli
gagctatatacccatgtgacatggg

SEQ ID NO: 3847 - DNA, 25 bp, E. coli
cagccattgcctgcgcgcgtgaaaa

SEQ ID NO: 3848 - DNA, 25 bp, E. coli
cagccattgcctccgcgcgtgaaaa

SEQ ID NO: 3849 - DNA, 25 bp, E. coli
cacatgaaagcgctaaatataagtt

SEQ ID NO: 3850 - DNA, 25 bp, E. coli
cacatgaaagcggtaaatataagtt

SEQ ID NO: 3851 - DNA, 25 bp, E. coli
taactcaccagtacgtggaggccgc

SEQ ID NO: 3852 - DNA, 25 bp, E. coli
agacgcaacttttcctgagccacaa

SEQ ID NO: 3853 - DNA, 25 bp, E. coli
agacgcaactttacctgagccacaa

SEQ ID NO: 3854 - DNA, 25 bp, E. coli
tgacgctatcgaggcggtgtatatt

SEQ ID NO: 3855 - DNA, 25 bp, E. coli
tgacgctatcgacgcggtgtatatt

SEQ ID NO: 3856 - DNA, 25 bp, E. coli
gcaacttttcctcagccacaaaatt

SEQ ID NO: 3857 - DNA, 25 bp, E. coli
gcaacttttcctgagccacaaaatt

SEQ ID NO: 3858 - DNA, 25 bp, E. coli
tttaaaacggccagcctgcctaact

SEQ ID NO: 3859 - DNA, 25 bp, E. coli
tttaaaacggcctgcctgcctaact

SEQ ID NO: 3860 - DNA, 25 bp, E. coli
ggatgcagccatagcctgcgcgcgt

SEQ ID NO: 3861 - DNA, 25 bp, E. coli
ggatgcagccattgcctgcgcgcgt

SEQ ID NO: 3862 - DNA, 25 bp, E. coli
tggaggccgcacttgaaagcggtaa

SEQ ID NO: 3863 - DNA, 25 bp, E. coli
tggataactcaccagttcgtggagg

SEQ ID NO: 3864 - DNA, 25 bp, E. coli
tggataactcacgagttcgtggagg

SEQ ID NO: 3865 - DNA, 25 bp, E. coli
ggccagcctgccaaactttcatctg

SEQ ID NO: 3866 - DNA, 25 bp, E. coli
ggccagcctgcctaactttcatctg

SEQ ID NO: 3867 - DNA, 25 bp, E. coli
tggaggccgcacatgaaagcggtaa

SEQ ID NO: 3868 - DNA, 25 bp, E. coli
taactcaccagttcgtggaggccgc

SEQ ID NO: 3869 - DNA, 25 bp, E. coli
atatcgcaccatttcacgacaattt

SEQ ID NO: 3870 - DNA, 25 bp, E. coli
acggcgcgggctaccacattctttg

SEQ ID NO: 3871 - DNA, 25 bp, E. coli
atatcgcaccatatcacgacaattt

SEQ ID NO: 3872 - DNA, 25 bp, E. coli
acggcgcgggcttccacattctttg

SEQ ID NO: 3873 - DNA, 25 bp, E. coli
tgacgccgatatcgcaccatatcac

SEQ ID NO: 3874 - DNA, 25 bp, E. coli
tgacgccgatatggcaccatatcac

SEQ ID NO: 3875 - DNA, 25 bp, E. coli
gccgatatcgcagcatatcacgaca

SEQ ID NO: 3876 - DNA, 25 bp, E. coli
ccgatatcgcacgatatcacgacaa

SEQ ID NO: 3877 - DNA, 25 bp, E. coli
gccgatatcgcaccatatcacgaca

SEQ ID NO: 3878 - DNA, 25 bp, E. coli
gacggcgcgggcaaccacattcttt

SEQ ID NO: 3879 - DNA, 25 bp, E. coli
gacgccgatatcccaccatatcacg

SEQ ID NO: 3880 - DNA, 25 bp, E. coli
gacggcgcgggctaccacattcttt

SEQ ID NO: 3881 - DNA, 25 bp, E. coli
gacgccgatatcgcaccatatcacg

SEQ ID NO: 3882 - DNA, 25 bp, E. coli
cgatatcgcaccatatcacgacaat

SEQ ID NO: 3883 - DNA, 25 bp, E. coli
ccgatatcgcaccatatcacgacaa

SEQ ID NO: 3884 - DNA, 25 bp, E. coli
cgatatcgcaccttatcacgacaat

SEQ ID NO: 3885 - DNA, 25 bp, E. coli
cggcgcgggctagcacattctttgg

SEQ ID NO: 3886 - DNA, 25 bp, E. coli
cggcgcgggctaccacattctttgg

SEQ ID NO: 3887 - DNA, 25 bp, E. coli
gatatcgcaccaaatcacgacaatt

SEQ ID NO: 3888 - DNA, 25 bp, E. coli
gatatcgcaccatatcacgacaatt

SEQ ID NO: 3889 - DNA, 25 bp, E. coli
cagggtaaggacatcttctcttgcc

SEQ ID NO: 3890 - DNA, 25 bp, E. coli
cagggtaaggacttcttctcttgcc

SEQ ID NO: 3891 - DNA, 25 bp, E. coli
taaataagcgtcaatacggtgctcc

SEQ ID NO: 3892 - DNA, 25 bp, E. coli
taaataagcgtctatacggtgctcc

SEQ ID NO: 3893 - DNA, 25 bp, E. coli
tatcctaccgttccttcatggtcgg

SEQ ID NO: 3894 - DNA, 25 bp, E. coli
tatcctaccgttgcttcatggtcgg

SEQ ID NO: 3895 - DNA, 25 bp, E. coli
tattcaatgaggcttgcccggcaac

SEQ ID NO: 3896 - DNA, 25 bp, E. coli
tattcaatgagggttgcccggcaac

SEQ ID NO: 3897 - DNA, 25 bp, E. coli
tgcttaatacaggacaacagtgctg

SEQ ID NO: 3898 - DNA, 25 bp, E. coli
tgcttaatacagcacaacagtgctg

SEQ ID NO: 3899 - DNA, 25 bp, E. coli
gctggcgtcaggagaaatgaagcct

SEQ ID NO: 3900 - DNA, 25 bp, E. coli
gctggcgtcaggtgaaatgaagcct

SEQ ID NO: 3901 - DNA, 25 bp, E. coli
gaagcctgttgactgagattcaccg

SEQ ID NO: 3902 - DNA, 25 bp, E. coli
gaagcctgttgagtgagattcaccg

SEQ ID NO: 3903 - DNA, 25 bp, E. coli
gaaaacgccagctgtattcaggctg

SEQ ID NO: 3904 - DNA, 25 bp, E. coli
gaaaacgccagcagtattcaggctg

SEQ ID NO: 3905 - DNA, 25 bp, E. coli
tgttcctacccacaccgtggatttg

SEQ ID NO: 3906 - DNA, 25 bp, E. coli
ggtcaatgctaatcgttaaaacggc

SEQ ID NO: 3907 - DNA, 25 bp, E. coli
gggcgtccattcgattattatcggt

SEQ ID NO: 3908 - DNA, 25 bp, E. coli
gggcgtccattccattattatcggt

SEQ ID NO: 3909 - DNA, 25 bp, E. coli
ggtcaatgctaaacgttaaaacggc

SEQ ID NO: 3910 - DNA, 25 bp, E. coli
tgttcctacccagaccgtggatttg

SEQ ID NO: 3911 - DNA, 25 bp, E. coli
actgcgactgggcccggcagacatc

SEQ ID NO: 3912 - DNA, 25 bp, E. coli
acatcctggagtcagatgagaatgg

SEQ ID NO: 3913 - DNA, 25 bp, E. coli
actgcgactggggccggcagacatc

SEQ ID NO: 3914 - DNA, 25 bp, E. coli
acatcctggagtgagatgagaatgg

SEQ ID NO: 3915 - DNA, 25 bp, E. coli
tgtgtggtaagagcgctgcaaatcc

SEQ ID NO: 3916 - DNA, 25 bp, E. coli
tgtgtggtaagaccgctgcaaatcc

SEQ ID NO: 3917 - DNA, 25 bp, E. coli
tgcggataaaaagcagatacagtgt

SEQ ID NO: 3918 - DNA, 25 bp, E. coli
tgcggataaaaaccagatacagtgt

SEQ ID NO: 3919 - DNA, 25 bp, E. coli
gccggcagacatcctggagtcagat

SEQ ID NO: 3920 - DNA, 25 bp, E. coli
gccggcagacatgctggagtcagat

SEQ ID NO: 3921 - DNA, 25 bp, E. coli
gcagacatcctggagtcagatgaga

SEQ ID NO: 3922 - DNA, 25 bp, E. coli
gcagacatcctgcagtcagatgaga

SEQ ID NO: 3923 - DNA, 25 bp, E. coli
cggataaaaagctgatacagtgtgt

SEQ ID NO: 3924 - DNA, 25 bp, E. coli
cggagcaggacacggtaatcacgca

SEQ ID NO: 3925 - DNA, 25 bp, E. coli
cggagcaggacagggtaatcacgca

SEQ ID NO: 3926 - DNA, 25 bp, E. coli
cggataaaaagcagatacagtgtgt

SEQ ID NO: 3927 - DNA, 25 bp, E. coli
ggataaaaagcagatacagtgtgtg

SEQ ID NO: 3928 - DNA, 25 bp, E. coli
ggaaaatattggcgggatgaagtaa

SEQ ID NO: 3929 - DNA, 25 bp, E. coli
ggataaaaagcacatacagtgtgtg

SEQ ID NO: 3930 - DNA, 25 bp, E. coli
ggaaaatattggggggatgaagtaa

SEQ ID NO: 3931 - DNA, 25 bp, E. coli
ggccggcagacatcctggagtcaga

SEQ ID NO: 3932 - DNA, 25 bp, E. coli
ggccggcagacaacctggagtcaga

SEQ ID NO: 3933 - DNA, 25 bp, E. coli
caatttgctaaagattatggttgcc

SEQ ID NO: 3934 - DNA, 25 bp, E. coli
caatttgctaaacattatggttgcc

SEQ ID NO: 3935 - DNA, 25 bp, E. coli
catataaccggatgatgactaaacc

SEQ ID NO: 3936 - DNA, 25 bp, E. coli
catataaccggaagatgactaaacc

SEQ ID NO: 3937 - DNA, 25 bp, E. coli
tacattcaaatgactgaacatcctg

SEQ ID NO: 3938 - DNA, 25 bp, E. coli
taaagcaaggaaactcaatggatgt

SEQ ID NO: 3939 - DNA, 25 bp, E. coli
taaagcaaggaatctcaatggatgt

SEQ ID NO: 3940 - DNA, 25 bp, E. coli
tacattcaaatgtctgaacatcctg

SEQ ID NO: 3941 - DNA, 25 bp, E. coli
attgaaacggacgtgtggcacggcc

SEQ ID NO: 3942 - DNA, 25 bp, E. coli
attgaaacggacctgtggcacggcc

SEQ ID NO: 3943 - DNA, 25 bp, E. coli
tagcctttatgctactttgtgccaa

SEQ ID NO: 3944 - DNA, 25 bp, E. coli
tagcctttatgcaactttgtgccaa

SEQ ID NO: 3945 - DNA, 25 bp, E. coli
tgactaaaccaaaatacatgtgcgt

SEQ ID NO: 3946 - DNA, 25 bp, E. coli
tgactaaaccaatatacatgtgcgt

SEQ ID NO: 3947 - DNA, 25 bp, E. coli
tcctggctaaaaaacatataaccgg

SEQ ID NO: 3948 - DNA, 25 bp, E. coli
tcctggctaaaatacatataaccgg

SEQ ID NO: 3949 - DNA, 25 bp, E. coli
gaatgatttaacgtgttcctggcta

SEQ ID NO: 3950 - DNA, 25 bp, E. coli
gaatgatttaacctgttcctggcta

SEQ ID NO: 3951 - DNA, 25 bp, E. coli
tggcacggccgtagtttttataaat

SEQ ID NO: 3952 - DNA, 25 bp, E. coli
tggcacggccgttgtttttataaat

SEQ ID NO: 3953 - DNA, 25 bp, E. coli
taatcatccatagagatagtctctg

SEQ ID NO: 3954 - DNA, 25 bp, E. coli
taatcatccatacagatagtctctg

SEQ ID NO: 3955 - DNA, 25 bp, E. coli
caactgaatccgaccagacaggcta

SEQ ID NO: 3956 - DNA, 25 bp, E. coli
caactgaatccgtccagacaggcta

SEQ ID NO: 3957 - DNA, 25 bp, E. coli
caggctaaccctgtcattatcaact

SEQ ID NO: 3958 - DNA, 25 bp, E. coli
catccggcaagatacgccgggcaaa

SEQ ID NO: 3959 - DNA, 25 bp, E. coli
catccggcaagaaacgccgggcaaa

SEQ ID NO: 3960 - DNA, 25 bp, E. coli
caggctaaccctctcattatcaact

SEQ ID NO: 3961 - DNA, 25 bp, E. coli
aatccgtccagacaggctaaccctg

SEQ ID NO: 3962 - DNA, 25 bp, E. coli
aatccgtccagagaggctaaccctg

SEQ ID NO: 3963 - DNA, 25 bp, E. coli
actgaatccgtcgagacaggctaac

SEQ ID NO: 3964 - DNA, 25 bp, E. coli
actgaatccgtccagacaggctaac

SEQ ID NO: 3965 - DNA, 25 bp, E. coli
tccggcaagaaacgccgggcaaaat

SEQ ID NO: 3966 - DNA, 25 bp, E. coli
tccggcaagaaaggccgggcaaaat

SEQ ID NO: 3967 - DNA, 25 bp, E. coli
tctgcaactgaatccgtccagacag

SEQ ID NO: 3968 - DNA, 25 bp, E. coli
tctgcaactgaaaccgtccagacag

SEQ ID NO: 3969 - DNA, 25 bp, E. coli
gccgggcaaaatatgccctttaagt

SEQ ID NO: 3970 - DNA, 25 bp, E. coli
gccgggcaaaatttgccctttaagt

SEQ ID NO: 3971 - DNA, 25 bp, E. coli
gcaaaatatgccctttaagtattta

SEQ ID NO: 3972 - DNA, 25 bp, E. coli
gcaaaatatgccgtttaagtattta

SEQ ID NO: 3973 - DNA, 25 bp, E. coli
gaaacgccgggctaaatatgccctt

SEQ ID NO: 3974 - DNA, 25 bp, E. coli
gaaacgccgggcaaaatatgccctt

SEQ ID NO: 3975 - DNA, 25 bp, E. coli
cgtccagacaggctaaccctgtcat

SEQ ID NO: 3976 - DNA, 25 bp, E. coli
cgtccagacagggtaaccctgtcat

SEQ ID NO: 3977 - DNA, 25 bp, E. coli
catttcttttggagtaggaacggca

SEQ ID NO: 3978 - DNA, 25 bp, E. coli
catttcttttggtgtaggaacggca

SEQ ID NO: 3979 - DNA, 25 bp, E. coli
tacttccctaggagcaagactggca

SEQ ID NO: 3980 - DNA, 25 bp, E. coli
tacttccctaggtgcaagactggca

SEQ ID NO: 3981 - DNA, 25 bp, E. coli
tagttgcagaactcaataggctaag

SEQ ID NO: 3982 - DNA, 25 bp, E. coli
tagttgcagaacacaataggctaag

SEQ ID NO: 3983 - DNA, 25 bp, E. coli
tgatattaacgcttggcattgtggg

SEQ ID NO: 3984 - DNA, 25 bp, E. coli
tgatattaacgcatggcattgtggg

SEQ ID NO: 3985 - DNA, 25 bp, E. coli
tgaagcagggtcactgaaaggtctg

SEQ ID NO: 3986 - DNA, 25 bp, E. coli
tgaagcagggtctctgaaaggtctg

SEQ ID NO: 3987 - DNA, 25 bp, E. coli
tcactaattttaggtggcagacaag

SEQ ID NO: 3988 - DNA, 25 bp, E. coli
tcactaattttacgtggcagacaag

SEQ ID NO: 3989 - DNA, 25 bp, E. coli
tcatttagatcagcagagtcacgcg

SEQ ID NO: 3990 - DNA, 25 bp, E. coli
tcatttagatcaccagagtcacgcg

SEQ ID NO: 3991 - DNA, 25 bp, E. coli
gatcatatgggctcgcagcattcca

SEQ ID NO: 3992 - DNA, 25 bp, E. coli
gatcatatgggcacgcagcattcca

SEQ ID NO: 3993 - DNA, 25 bp, E. coli
ggaacggcaacaggagcagcatatt

SEQ ID NO: 3994 - DNA, 25 bp, E. coli
tggcgctaacactaaccagagcaac

SEQ ID NO: 3995 - DNA, 25 bp, E. coli
ggaacggcaacacgagcagcatatt

SEQ ID NO: 3996 - DNA, 25 bp, E. coli
tggcgctaacacaaaccagagcaac

SEQ ID NO: 3997 - DNA, 25 bp, E. coli
gagtcacgcgctgaaagtatgaatt

SEQ ID NO: 3998 - DNA, 25 bp, E. coli
gagtcacgcgctcaaagtatgaatt

SEQ ID NO: 3999 - DNA, 25 bp, E. coli
taattcggtttacaggaaggcggca

SEQ ID NO: 4000 - DNA, 25 bp, E. coli
taattcggtttagaggaaggcggca

SEQ ID NO: 4001 - DNA, 25 bp, E. coli
catgccgcgcaaaggataatcaaat

SEQ ID NO: 4002 - DNA, 25 bp, E. coli
catgccgcgcaatggataatcaaat

SEQ ID NO: 4003 - DNA, 25 bp, E. coli
tttctcctgtggcagcctgtcggcc

SEQ ID NO: 4004 - DNA, 25 bp, E. coli
tttctcctgtgggagcctgtcggcc

SEQ ID NO: 4005 - DNA, 25 bp, E. coli
tgtttaagggcaaggtaacgctctg

SEQ ID NO: 4006 - DNA, 25 bp, E. coli
tgtttaagggcatggtaacgctctg

SEQ ID NO: 4007 - DNA, 25 bp, E. coli
tgaatcccaggagcttactaaagta

SEQ ID NO: 4008 - DNA, 25 bp, E. coli
tgaatcccaggaccttactaaagta

SEQ ID NO: 4009 - DNA, 25 bp, E. coli
gccgcagcacatgtaacccgaagta

SEQ ID NO: 4010 - DNA, 25 bp, E. coli
gcctgtcggccctctgataaatcga

SEQ ID NO: 4011 - DNA, 25 bp, E. coli
gcctgtcggcccactgataaatcga

SEQ ID NO: 4012 - DNA, 25 bp, E. coli
gccgcagcacatctaacccgaagta

SEQ ID NO: 4013 - DNA, 25 bp, E. coli
gaaggcggcaagtgaatgaatccca

SEQ ID NO: 4014 - DNA, 25 bp, E. coli
gaaggcggcaagagaatgaatccca

SEQ ID NO: 4015 - DNA, 25 bp, E. coli
ctctgaaacagcctgggaattgata

SEQ ID NO: 4016 - DNA, 25 bp, E. coli
ctctgaaacagcgtgggaattgata

SEQ ID NO: 4017 - DNA, 25 bp, E. coli
ggtattaaggagtattccccatggg

SEQ ID NO: 4018 - DNA, 25 bp, E. coli
ggtattaaggagaattccccatggg

SEQ ID NO: 4019 - DNA, 25 bp, E. coli
taatggctcttattgaaatccggcg

SEQ ID NO: 4020 - DNA, 25 bp, E. coli
taatggctcttaatgaaatccggcg

SEQ ID NO: 4021 - DNA, 25 bp, E. coli
cagtttacgctttctgacaacgcga

SEQ ID NO: 4022 - DNA, 25 bp, E. coli
cagtttacgcttactgacaacgcga

SEQ ID NO: 4023 - DNA, 25 bp, E. coli
catacggcggtcagtttacgcttac

SEQ ID NO: 4024 - DNA, 25 bp, E. coli
catacggcggtctgtttacgcttac

SEQ ID NO: 4025 - DNA, 25 bp, E. coli
tacggcggtcagtttacgcttactg

SEQ ID NO: 4026 - DNA, 25 bp, E. coli
tacggcggtcagattacgcttactg

SEQ ID NO: 4027 - DNA, 25 bp, E. coli
tacatacggcggacagtttacgctt

SEQ ID NO: 4028 - DNA, 25 bp, E. coli
tacatacggcggtcagtttacgctt

SEQ ID NO: 4029 - DNA, 25 bp, E. coli
acggcggtcagtttacgcttactga

SEQ ID NO: 4030 - DNA, 25 bp, E. coli
acggcggtcagtatacgcttactga

SEQ ID NO: 4031 - DNA, 25 bp, E. coli
tttacgcttactcacaacgcgatgg

SEQ ID NO: 4032 - DNA, 25 bp, E. coli
tttacgcttactgacaacgcgatgg

SEQ ID NO: 4033 - DNA, 25 bp, E. coli
ttacgcttactgacaacgcgatggc

SEQ ID NO: 4034 - DNA, 25 bp, E. coli
ttacgcttactgtcaacgcgatggc

SEQ ID NO: 4035 - DNA, 25 bp, E. coli
ctacatacggcggtcagtttacgct

SEQ ID NO: 4036 - DNA, 25 bp, E. coli
ctacatacggcgctcagtttacgct

SEQ ID NO: 4037 - DNA, 25 bp, E. coli
gtttacgcttactgacaacgcgatg

SEQ ID NO: 4038 - DNA, 25 bp, E. coli
gtttacgcttacagacaacgcgatg

SEQ ID NO: 4039 - DNA, 25 bp, E. coli
ggtcagtttacgcttactgacaacg

SEQ ID NO: 4040 - DNA, 25 bp, E. coli
ggtcagtttacggttactgacaacg

SEQ ID NO: 4041 - DNA, 25 bp, E. coli
ggcggtcagttttcgcttactgaca

SEQ ID NO: 4042 - DNA, 25 bp, E. coli
ggcggtcagtttacgcttactgaca

SEQ ID NO: 4043 - DNA, 25 bp, E. coli
caattgctcgttgaaagagtgagct

SEQ ID NO: 4044 - DNA, 25 bp, E. coli
caattgctcgttcaaagagtgagct

SEQ ID NO: 4045 - DNA, 25 bp, E. coli
tttgtcattaaaccatcaggatgcg

SEQ ID NO: 4046 - DNA, 25 bp, E. coli
tttgtcattaaagcatcaggatgcg

SEQ ID NO: 4047 - DNA, 25 bp, E. coli
tgctcctgttgcaaaatagaagaga

SEQ ID NO: 4048 - DNA, 25 bp, E. coli
tagaaccctccccagtgcggaaggg

SEQ ID NO: 4049 - DNA, 25 bp, E. coli
tagaaccctcccgagtgcggaaggg

SEQ ID NO: 4050 - DNA, 25 bp, E. coli
tgctcctgttgctaaatagaagaga

SEQ ID NO: 4051 - DNA, 25 bp, E. coli
tctgaccggtgtaagcacttgctta

SEQ ID NO: 4052 - DNA, 25 bp, E. coli
tcaggatgcgtgatatgtcatgcga

SEQ ID NO: 4053 - DNA, 25 bp, E. coli
tctgaccggtgttagcacttgctta

SEQ ID NO: 4054 - DNA, 25 bp, E. coli
tcaggatgcgtgttatgtcatgcga

SEQ ID NO: 4055 - DNA, 25 bp, E. coli
ctataacagtagtaccctcccgagt

SEQ ID NO: 4056 - DNA, 25 bp, E. coli
ctataacagtagaaccctcccgagt

SEQ ID NO: 4057 - DNA, 25 bp, E. coli
gatttaatgttctccataatgagca

SEQ ID NO: 4058 - DNA, 25 bp, E. coli
gatttaatgttcaccataatgagca

SEQ ID NO: 4059 - DNA, 25 bp, E. coli
ggttgacgtaatagaggtttcaaag

SEQ ID NO: 4060 - DNA, 25 bp, E. coli
ggttgacgtaattgaggtttcaaag

SEQ ID NO: 4061 - DNA, 25 bp, E. coli
tgagcaaaattcagaccggtgtaag

SEQ ID NO: 4062 - DNA, 25 bp, E. coli
tgagcaaaattctgaccggtgtaag

SEQ ID NO: 4063 - DNA, 25 bp, E. coli
gagtgagctaaattccctataacag

SEQ ID NO: 4064 - DNA, 25 bp, E. coli
gagtgagctaaaatccctataacag

SEQ ID NO: 4065 - DNA, 25 bp, E. coli
cagaaaccggcagggaggcagtatt

SEQ ID NO: 4066 - DNA, 25 bp, E. coli
catttaacgaaacgcatgaggtgct

SEQ ID NO: 4067 - DNA, 25 bp, E. coli
cagaaaccggcacggaggcagtatt

SEQ ID NO: 4068 - DNA, 25 bp, E. coli
tactggatcgggaaagaaccacagg

SEQ ID NO: 4069 - DNA, 25 bp, E. coli
tactggatcgggtaagaaccacagg

SEQ ID NO: 4070 - DNA, 25 bp, E. coli
aacttccgcgaatccatgagtcggg

SEQ ID NO: 4071 - DNA, 25 bp, E. coli
aacttccgcgaaaccatgagtcggg

SEQ ID NO: 4072 - DNA, 25 bp, E. coli
tatggaagcctcatcggccagaaac

SEQ ID NO: 4073 - DNA, 25 bp, E. coli
tatggaagcctcttcggccagaaac

SEQ ID NO: 4074 - DNA, 25 bp, E. coli
tatagaacgctaagaaccccggatc

SEQ ID NO: 4075 - DNA, 25 bp, E. coli
tatagaacgctatgaaccccggatc

SEQ ID NO: 4076 - DNA, 25 bp, E. coli
ccagcccgctggttatgacgtttca

SEQ ID NO: 4077 - DNA, 25 bp, E. coli
ccagcccgctggatatgacgtttca

SEQ ID NO: 4078 - DNA, 25 bp, E. coli
gaatggcagccaccattaccgggtg

SEQ ID NO: 4079 - DNA, 25 bp, E. coli
gaatggcagccagcattaccgggtg

SEQ ID NO: 4080 - DNA, 25 bp, E. coli
catttaacgaaaggcatgaggtgct

SEQ ID NO: 4081 - DNA, 25 bp, E. coli
gatctcacacgcagaagtgcaggca

SEQ ID NO: 4082 - DNA, 25 bp, E. coli
gagtcgggccatcgagcaatgtata

SEQ ID NO: 4083 - DNA, 25 bp, E. coli
gacgtttcatattacagcctgggtg

SEQ ID NO: 4084 - DNA, 25 bp, E. coli
gagtcgggccatggagcaatgtata

SEQ ID NO: 4085 - DNA, 25 bp, E. coli
gatctcacacgctgaagtgcaggca

SEQ ID NO: 4086 - DNA, 25 bp, E. coli
gacgtttcatataacagcctgggtg

SEQ ID NO: 4087 - DNA, 25 bp, E. coli
cagaacctcggaaaaagaccagcca

SEQ ID NO: 4088 - DNA, 25 bp, E. coli
cagaacctcggataaagaccagcca

SEQ ID NO: 4089 - DNA, 25 bp, E. coli
caggcggtagcgacacgtacggcta

SEQ ID NO: 4090 - DNA, 25 bp, E. coli
caggcggtagcgtcacgtacggcta

SEQ ID NO: 4091 - DNA, 25 bp, E. coli
acgacgtgatggcaattgtccggcc

SEQ ID NO: 4092 - DNA, 25 bp, E. coli
acgacgtgatgggaattgtccggcc

SEQ ID NO: 4093 - DNA, 25 bp, E. coli
ttgcagctatccttccaggccagaa

SEQ ID NO: 4094 - DNA, 25 bp, E. coli
ttaatgaactgcgttgcagctatcc

SEQ ID NO: 4095 - DNA, 25 bp, E. coli
ttgcagctatccatccaggccagaa

SEQ ID NO: 4096 - DNA, 25 bp, E. coli
ttttccaggcggaagcgacacgtac

SEQ ID NO: 4097 - DNA, 25 bp, E. coli
ttttccaggcggtagcgacacgtac

SEQ ID NO: 4098 - DNA, 25 bp, E. coli
ttaatgaactgccttgcagctatcc

SEQ ID NO: 4099 - DNA, 25 bp, E. coli
tccaggccagaagctcggataaaga

SEQ ID NO: 4100 - DNA, 25 bp, E. coli
tccaggccagaacctcggataaaga

SEQ ID NO: 4101 - DNA, 25 bp, E. coli
gaattgtccggccttttccaggcgg

SEQ ID NO: 4102 - DNA, 25 bp, E. coli
gaattgtccggcgttttccaggcgg

SEQ ID NO: 4103 - DNA, 25 bp, E. coli
gaacgaccgccaagtttacgacgtg

SEQ ID NO: 4104 - DNA, 25 bp, E. coli
gaacgaccgccatgtttacgacgtg

SEQ ID NO: 4105 - DNA, 25 bp, E. coli
ccgccaagtttacgacgtgatggga

SEQ ID NO: 4106 - DNA, 25 bp, E. coli
ccgccaagtttaggacgtgatggga

SEQ ID NO: 4107 - DNA, 25 bp, E. coli
ggataaagaccagccaacggaacga

SEQ ID NO: 4108 - DNA, 25 bp, E. coli
ggataaagaccacccaacggaacga

SEQ ID NO: 4109 - DNA, 25 bp, E. coli
cagtctgttaataggtttagtcggg

SEQ ID NO: 4110 - DNA, 25 bp, E. coli
cagtctgttaattggtttagtcggg

SEQ ID NO: 4111 - DNA, 25 bp, E. coli
catcatgaacatggcgacaacgaag

SEQ ID NO: 4112 - DNA, 25 bp, E. coli
catcatgaacatcgcgacaacgaag

SEQ ID NO: 4113 - DNA, 25 bp, E. coli
tacagtaggcgttggagcggcaatc

SEQ ID NO: 4114 - DNA, 25 bp, E. coli
tacagtaggcgtaggagcggcaatc

SEQ ID NO: 4115 - DNA, 25 bp, E. coli
tcggtctggcactaacgctggttac

SEQ ID NO: 4116 - DNA, 25 bp, E. coli
tcggtctggcacaaacgctggttac

SEQ ID NO: 4117 - DNA, 25 bp, E. coli
gctggagaatatgcatgagcatcat

SEQ ID NO: 4118 - DNA, 25 bp, E. coli
gctggagaatatccatgagcatcat

SEQ ID NO: 4119 - DNA, 25 bp, E. coli
cgacaacgaagagtatcaggatgcc

SEQ ID NO: 4120 - DNA, 25 bp, E. coli
cgacaacgaagactatcaggatgcc

SEQ ID NO: 4121 - DNA, 25 bp, E. coli
cgtcagtttcaggatcggtctggca

SEQ ID NO: 4122 - DNA, 25 bp, E. coli
cgtcagtttcagcatcggtctggca

SEQ ID NO: 4123 - DNA, 25 bp, E. coli
gatcacgaacatcatcaagaccacg

SEQ ID NO: 4124 - DNA, 25 bp, E. coli
gatcacgaacatgatcaagaccacg

SEQ ID NO: 4125 - DNA, 25 bp, E. coli
ggagcggcaatctgtgttcaacaag

SEQ ID NO: 4126 - DNA, 25 bp, E. coli
ggagcggcaatcagtgttcaacaag

SEQ ID NO: 4127 - DNA, 25 bp, E. coli
tcaacaagttgcaaaacgctggagc

SEQ ID NO: 4128 - DNA, 25 bp, E. coli
tcaacaagttgctaaacgctggagc

SEQ ID NO: 4129 - DNA, 25 bp, E. coli
gaccacgaacatcatcaccatcatg

SEQ ID NO: 4130 - DNA, 25 bp, E. coli
gaccacgaacatgatcaccatcatg

SEQ ID NO: 4131 - DNA, 25 bp, E. coli
caatgagcgtgtcattcgtgctgtt

SEQ ID NO: 4132 - DNA, 25 bp, E. coli
caatgagcgtgtgattcgtgctgtt

SEQ ID NO: 4133 - DNA, 25 bp, E. coli
agccgaaaagcatgcgcggtctgcc

SEQ ID NO: 4134 - DNA, 25 bp, E. coli
agccgaaaagcaagcgcggtctgcc

SEQ ID NO: 4135 - DNA, 25 bp, E. coli
ttgcgtcatgtctaatcctgccagt

SEQ ID NO: 4136 - DNA, 25 bp, E. coli
ttgcgtcatgtcaaatcctgccagt

SEQ ID NO: 4137 - DNA, 25 bp, E. coli
ttactgccgtttttcagcaatgagc

SEQ ID NO: 4138 - DNA, 25 bp, E. coli
ttactgccgtttatcagcaatgagc

SEQ ID NO: 4139 - DNA, 25 bp, E. coli
tggtgactatcaacacagtgaaacc

SEQ ID NO: 4140 - DNA, 25 bp, E. coli
tggtgactatcatcacagtgaaacc

SEQ ID NO: 4141 - DNA, 25 bp, E. coli
tgactggctgttccgtcatgtcaaa

SEQ ID NO: 4142 - DNA, 25 bp, E. coli
tgactggctgttgcgtcatgtcaaa

SEQ ID NO: 4143 - DNA, 25 bp, E. coli
ccgtttttcagcaatgagcgtgtga

SEQ ID NO: 4144 - DNA, 25 bp, E. coli
ccggagccgaaaagcatgcgcggtc

SEQ ID NO: 4145 - DNA, 25 bp, E. coli
ccggagccgaaatgcatgcgcggtc

SEQ ID NO: 4146 - DNA, 25 bp, E. coli
ccgtttttcagctatgagcgtgtga

SEQ ID NO: 4147 - DNA, 25 bp, E. coli
gcatgcgcggtcagccgtccggcat

SEQ ID NO: 4148 - DNA, 25 bp, E. coli
gcatgcgcggtctgccgtccggcat

SEQ ID NO: 4149 - DNA, 25 bp, E. coli
gcaggtattccaaaaccctcgagtg

SEQ ID NO: 4150 - DNA, 25 bp, E. coli
gcaggtattccataaccctcgagtg

SEQ ID NO: 4151 - DNA, 25 bp, E. coli
taaccctcgagtccttgtggagccg

SEQ ID NO: 4152 - DNA, 25 bp, E. coli
taaccctcgagtgcttgtggagccg

SEQ ID NO: 4153 - DNA, 25 bp, E. coli
aatgatatcgggatgttgcacagcc

SEQ ID NO: 4154 - DNA, 25 bp, E. coli
caagagttgttctcacgcgacggta

SEQ ID NO: 4155 - DNA, 25 bp, E. coli
aattttattattccccagccgctgg

SEQ ID NO: 4156 - DNA, 25 bp, E. coli
aattttattattgcccagccgctgg

SEQ ID NO: 4157 - DNA, 25 bp, E. coli
aattgtttgtgcagaccacgcgcag

SEQ ID NO: 4158 - DNA, 25 bp, E. coli
aattgtttgtgctgaccacgcgcag

SEQ ID NO: 4159 - DNA, 25 bp, E. coli
caagagttgttcacacgcgacggta

SEQ ID NO: 4160 - DNA, 25 bp, E. coli
aatgatatcgggttgttgcacagcc

SEQ ID NO: 4161 - DNA, 25 bp, E. coli
cagattgtgatgcaaagcgccgagc

SEQ ID NO: 4162 - DNA, 25 bp, E. coli
cagattgtgatggaaagcgccgagc

SEQ ID NO: 4163 - DNA, 25 bp, E. coli
aaacgtttgtcaacatgctcggcgg

SEQ ID NO: 4164 - DNA, 25 bp, E. coli
aaacgtttgtcatcatgctcggcgg

SEQ ID NO: 4165 - DNA, 25 bp, E. coli
tatccggcggattgatgaagacgcg

SEQ ID NO: 4166 - DNA, 25 bp, E. coli
tatccggcggatagatgaagacgcg

SEQ ID NO: 4167 - DNA, 25 bp, E. coli
ttttccctaacgaagcgcaagcgcg

SEQ ID NO: 4168 - DNA, 25 bp, E. coli
ttttccctaacgtagcgcaagcgcg

SEQ ID NO: 4169 - DNA, 25 bp, E. coli
tgtgaccgacgcgaaaacactggaa

SEQ ID NO: 4170 - DNA, 25 bp, E. coli
tgtgaccgacgccaaaacactggaa

SEQ ID NO: 4171 - DNA, 25 bp, E. coli
gaaaggcgattacaactccggtacg

SEQ ID NO: 4172 - DNA, 25 bp, E. coli
gaaaggcgattagaactccggtacg

SEQ ID NO: 4173 - DNA, 25 bp, E. coli
ggtttttgctcttcccagggcgtca

SEQ ID NO: 4174 - DNA, 25 bp, E. coli
ggtttttgctctacccagggcgtca

SEQ ID NO: 4175 - DNA, 25 bp, E. coli
aagcgacagtatattcatgcatgcc

SEQ ID NO: 4176 - DNA, 25 bp, E. coli
cacggcagggcttctgtgtgatatc

SEQ ID NO: 4177 - DNA, 25 bp, E. coli
cacggcagggctactgtgtgatatc

SEQ ID NO: 4178 - DNA, 25 bp, E. coli
acagtttatctgaacacggcagggc

SEQ ID NO: 4179 - DNA, 25 bp, E. coli
acagtttatctgtacacggcagggc

SEQ ID NO: 4180 - DNA, 25 bp, E. coli
aagcgacagtattttcatgcatgcc

SEQ ID NO: 4181 - DNA, 25 bp, E. coli
ccatacatttgtagcggacgtcgct

SEQ ID NO: 4182 - DNA, 25 bp, E. coli
ccatacatttgttgcggacgtcgct

SEQ ID NO: 4183 - DNA, 25 bp, E. coli
gcatgcctgtcttcagtcatacggg

SEQ ID NO: 4184 - DNA, 25 bp, E. coli
gcatgcctgtctacagtcatacggg

SEQ ID NO: 4185 - DNA, 25 bp, E. coli
gactgagcactgctcgggtcatgca

SEQ ID NO: 4186 - DNA, 25 bp, E. coli
gactgagcactggtcgggtcatgca

SEQ ID NO: 4187 - DNA, 25 bp, E. coli
gggtcatgcagaagataatttcccc

SEQ ID NO: 4188 - DNA, 25 bp, E. coli
ggacgtcgctcctgagtcactgact

SEQ ID NO: 4189 - DNA, 25 bp, E. coli
ggagagcatctgtgatacagtccat

SEQ ID NO: 4190 - DNA, 25 bp, E. coli
gggcctccagagttgaatggaataa

SEQ ID NO: 4191 - DNA, 25 bp, E. coli
gggtcatgcagatgataatttcccc

SEQ ID NO: 4192 - DNA, 25 bp, E. coli
gggcctccagagatgaatggaataa

SEQ ID NO: 4193 - DNA, 25 bp, E. coli
ggacgtcgctccagagtcactgact

SEQ ID NO: 4194 - DNA, 25 bp, E. coli
ggagagcatctgagatacagtccat

SEQ ID NO: 4195 - DNA, 25 bp, E. coli
gagtcactgactggtctgcaaacag

SEQ ID NO: 4196 - DNA, 25 bp, E. coli
gagtcactgactcgtctgcaaacag

SEQ ID NO: 4197 - DNA, 25 bp, E. coli
atggcgaacagcaacagggtgaatt

SEQ ID NO: 4198 - DNA, 25 bp, E. coli
atggcgaacagctacagggtgaatt

SEQ ID NO: 4199 - DNA, 25 bp, E. coli
tatggcgaacaggtacagggtgaat

SEQ ID NO: 4200 - DNA, 25 bp, E. coli
tatggcgaacagctacagggtgaat

SEQ ID NO: 4201 - DNA, 25 bp, E. coli
tgatgtcccgtagcggtggtctggg

SEQ ID NO: 4202 - DNA, 25 bp, E. coli
tgatgtcccgtaccggtggtctggg

SEQ ID NO: 4203 - DNA, 25 bp, E. coli
gcgaacagctacagggtgaattacg

SEQ ID NO: 4204 - DNA, 25 bp, E. coli
gctgatgtcccgaaccggtggtctg

SEQ ID NO: 4205 - DNA, 25 bp, E. coli
gcgaacagctactgggtgaattacg

SEQ ID NO: 4206 - DNA, 25 bp, E. coli
gctgatgtcccgtaccggtggtctg

SEQ ID NO: 4207 - DNA, 25 bp, E. coli
cgaacagctacacggtgaattacgc

SEQ ID NO: 4208 - DNA, 25 bp, E. coli
cgctgatgtcccctaccggtggtct

SEQ ID NO: 4209 - DNA, 25 bp, E. coli
cgaacagctacagggtgaattacgc

SEQ ID NO: 4210 - DNA, 25 bp, E. coli
cgctgatgtcccgtaccggtggtct

SEQ ID NO: 4211 - DNA, 25 bp, E. coli
ctgatgtcccgtaccggtggtctgg

SEQ ID NO: 4212 - DNA, 25 bp, E. coli
ctgatgtcccgttccggtggtctgg

SEQ ID NO: 4213 - DNA, 25 bp, E. coli
tgtcccgtaccggtggtctgggcgc

SEQ ID NO: 4214 - DNA, 25 bp, E. coli
tgtcccgtaccgctggtctgggcgc

SEQ ID NO: 4215 - DNA, 25 bp, E. coli
tggcgaacagctacagggtgaatta

SEQ ID NO: 4216 - DNA, 25 bp, E. coli
ggcgaacagctagagggtgaattac

SEQ ID NO: 4217 - DNA, 25 bp, E. coli
ggcgaacagctacagggtgaattac

SEQ ID NO: 4218 - DNA, 25 bp, E. coli
tggcgaacagcttcagggtgaatta

SEQ ID NO: 4219 - DNA, 25 bp, E. coli
aagagatgcgctttagtctgaaata

SEQ ID NO: 4220 - DNA, 25 bp, E. coli
aagagatgcgctatagtctgaaata

SEQ ID NO: 4221 - DNA, 25 bp, E. coli
aggtggcagcaataagcaactttcc

SEQ ID NO: 4222 - DNA, 25 bp, E. coli
aggtggcagcaaaaagcaactttcc

SEQ ID NO: 4223 - DNA, 25 bp, E. coli
actttccagtttttacgctgattca

SEQ ID NO: 4224 - DNA, 25 bp, E. coli
actttccagtttatacgctgattca

SEQ ID NO: 4225 - DNA, 25 bp, E. coli
ttttacctgtctctcaggtggcagc

SEQ ID NO: 4226 - DNA, 25 bp, E. coli
ttttacctgtctgtcaggtggcagc

SEQ ID NO: 4227 - DNA, 25 bp, E. coli
ccattgtggtgagtcgatgccggaa

SEQ ID NO: 4228 - DNA, 25 bp, E. coli
ccagattttgcgaccattgtggtga

SEQ ID NO: 4229 - DNA, 25 bp, E. coli
ccattgtggtgactcgatgccggaa

SEQ ID NO: 4230 - DNA, 25 bp, E. coli
ccagattttgcgtccattgtggtga

SEQ ID NO: 4231 - DNA, 25 bp, E. coli
cgctgattcagattttagctataaa

SEQ ID NO: 4232 - DNA, 25 bp, E. coli
cgctgattcagaatttagctataaa

SEQ ID NO: 4233 - DNA, 25 bp, E. coli
cgaaaattgtttactgccggagcag

SEQ ID NO: 4234 - DNA, 25 bp, E. coli
cgaaaattgttttctgccggagcag

SEQ ID NO: 4235 - DNA, 25 bp, E. coli
cttagtcccttaatggcgatgtggt

SEQ ID NO: 4236 - DNA, 25 bp, E. coli
cttagtcccttattggcgatgtggt

SEQ ID NO: 4237 - DNA, 25 bp, E. coli
ggatgatagttttccagattttgcg

SEQ ID NO: 4238 - DNA, 25 bp, E. coli
ggatgatagtttaccagattttgcg

SEQ ID NO: 4239 - DNA, 25 bp, E. coli
gtctgaaatagtagacttagtccct

SEQ ID NO: 4240 - DNA, 25 bp, E. coli
gtctgaaatagttgacttagtccct

SEQ ID NO: 4241 - DNA, 25 bp, E. coli
aatgaaagtggtcgaccattcgggc

SEQ ID NO: 4242 - DNA, 25 bp, E. coli
aatgaaagtggtggaccattcgggc

SEQ ID NO: 4243 - DNA, 25 bp, E. coli
caaactctgatccttcagatcgtca

SEQ ID NO: 4244 - DNA, 25 bp, E. coli
caaactctgatcgttcagatcgtca

SEQ ID NO: 4245 - DNA, 25 bp, E. coli
cagggtaataatcaaagtggtggac

SEQ ID NO: 4246 - DNA, 25 bp, E. coli
cagggtaataatgaaagtggtggac

SEQ ID NO: 4247 - DNA, 25 bp, E. coli
aacatcctacgacttcgacttcggt

SEQ ID NO: 4248 - DNA, 25 bp, E. coli
aacatcctacgagttcgacttcggt

SEQ ID NO: 4249 - DNA, 25 bp, E. coli
tggtgatggccgtagcctttccaaa

SEQ ID NO: 4250 - DNA, 25 bp, E. coli
tggtgatggccgaagcctttccaaa

SEQ ID NO: 4251 - DNA, 25 bp, E. coli
gcctttccaaagaaaatggtgatgg

SEQ ID NO: 4252 - DNA, 25 bp, E. coli
gcctttccaaagtaaatggtgatgg

SEQ ID NO: 4253 - DNA, 25 bp, E. coli
gatcgtcaggttggagttggtttaa

SEQ ID NO: 4254 - DNA, 25 bp, E. coli
gaactttgctttccaatatcagggt

SEQ ID NO: 4255 - DNA, 25 bp, E. coli
gaactttgctttgcaatatcagggt

SEQ ID NO: 4256 - DNA, 25 bp, E. coli
gatcgtcaggttcgagttggtttaa

SEQ ID NO: 4257 - DNA, 25 bp, E. coli
ctgggtgctgcatatcaaactctga

SEQ ID NO: 4258 - DNA, 25 bp, E. coli
ctgggtgctgcaaatcaaactctga

SEQ ID NO: 4259 - DNA, 25 bp, E. coli
cttcggtttaagactgggtgctgca

SEQ ID NO: 4260 - DNA, 25 bp, E. coli
cttcggtttaagtctgggtgctgca

SEQ ID NO: 4261 - DNA, 25 bp, E. coli
ggtttcggtatgacaacatcctacg

SEQ ID NO: 4262 - DNA, 25 bp, E. coli
ggtttcggtatgtcaacatcctacg

SEQ ID NO: 4263 - DNA, 25 bp, E. coli
caaactttcgtctgaaatctcccgg

SEQ ID NO: 4264 - DNA, 25 bp, E. coli
caactgtgttaataacagcgtcagg

SEQ ID NO: 4265 - DNA, 25 bp, E. coli
caaactttcgtcagaaatctcccgg

SEQ ID NO: 4266 - DNA, 25 bp, E. coli
caactgtgttaaaaacagcgtcagg

SEQ ID NO: 4267 - DNA, 25 bp, E. coli
aaaacagcgtcaggatactctatat

SEQ ID NO: 4268 - DNA, 25 bp, E. coli
aaaacagcgtcacgatactctatat

SEQ ID NO: 4269 - DNA, 25 bp, E. coli
tatccagcatctatcaaactttcgt

SEQ ID NO: 4270 - DNA, 25 bp, E. coli
tatccagcatctttcaaactttcgt

SEQ ID NO: 4271 - DNA, 25 bp, E. coli
tattacaactgtgttaaaaacagcg

SEQ ID NO: 4272 - DNA, 25 bp, E. coli
tattacaactgtcttaaaaacagcg

SEQ ID NO: 4273 - DNA, 25 bp, E. coli
tgtgttaaaaactgcgtcaggatac

SEQ ID NO: 4274 - DNA, 25 bp, E. coli
gcgtcaggatacactatatccagca

SEQ ID NO: 4275 - DNA, 25 bp, E. coli
gcgtcaggatactctatatccagca

SEQ ID NO: 4276 - DNA, 25 bp, E. coli
gttaaaaacagcgtcaggatactct

SEQ ID NO: 4277 - DNA, 25 bp, E. coli
gttaaaaacagcctcaggatactct

SEQ ID NO: 4278 - DNA, 25 bp, E. coli
gatactctatatgcagcatctttca

SEQ ID NO: 4279 - DNA, 25 bp, E. coli
gtcactcaagggattaacctcttat

SEQ ID NO: 4280 - DNA, 25 bp, E. coli
gatactctatatccagcatctttca

SEQ ID NO: 4281 - DNA, 25 bp, E. coli
ggattaacctcttattacaactgtg

SEQ ID NO: 4282 - DNA, 25 bp, E. coli
gtcactcaagggtttaacctcttat

SEQ ID NO: 4283 - DNA, 25 bp, E. coli
ggattaacctctaattacaactgtg

SEQ ID NO: 4284 - DNA, 25 bp, E. coli
tgtgttaaaaacagcgtcaggatac

SEQ ID NO: 4285 - DNA, 25 bp, E. coli
attgcctggaaataccggtgcctgg

SEQ ID NO: 4286 - DNA, 25 bp, E. coli
attgcctggaaaaaccggtgcctgg

SEQ ID NO: 4287 - DNA, 25 bp, E. coli
tagctcattgccaggaaataccggt

SEQ ID NO: 4288 - DNA, 25 bp, E. coli
tagctcattgcctggaaataccggt

SEQ ID NO: 4289 - DNA, 25 bp, E. coli
tttagtatgcgcggaattactctgc

SEQ ID NO: 4290 - DNA, 25 bp, E. coli
tttagtatgcgccgaattactctgc

SEQ ID NO: 4291 - DNA, 25 bp, E. coli
tcccggcggcgctattacttgggcc

SEQ ID NO: 4292 - DNA, 25 bp, E. coli
tcccggcggcgcaattacttgggcc

SEQ ID NO: 4293 - DNA, 25 bp, E. coli
tcatctttagtatgcgcggaattac

SEQ ID NO: 4294 - DNA, 25 bp, E. coli
tcatctttagtaagcgcggaattac

SEQ ID NO: 4295 - DNA, 25 bp, E. coli
tcattgcctggaaataccggtgcct

SEQ ID NO: 4296 - DNA, 25 bp, E. coli
tcattgcctggatataccggtgcct

SEQ ID NO: 4297 - DNA, 25 bp, E. coli
gcgctattacttcggccgatgatcg

SEQ ID NO: 4298 - DNA, 25 bp, E. coli
gcgctattacttgggccgatgatcg

SEQ ID NO: 4299 - DNA, 25 bp, E. coli
gctcattgcctgcaaataccggtgc

SEQ ID NO: 4300 - DNA, 25 bp, E. coli
gctcattgcctggaaataccggtgc

SEQ ID NO: 4301 - DNA, 25 bp, E. coli
cggcggcgctattacttgggccgat

SEQ ID NO: 4302 - DNA, 25 bp, E. coli
cggcggcgctataacttgggccgat

SEQ ID NO: 4303 - DNA, 25 bp, E. coli
ctatagctcattccctggaaatacc

SEQ ID NO: 4304 - DNA, 25 bp, E. coli
ctatagctcattgcctggaaatacc

SEQ ID NO: 4305 - DNA, 25 bp, E. coli
ctattggtttcctcgcggtacatct

SEQ ID NO: 4306 - DNA, 25 bp, E. coli
ctattggtttccacgcggtacatct

SEQ ID NO: 4307 - DNA, 25 bp, E. coli
cacgtcagtctgataatcagaccgt

SEQ ID NO: 4308 - DNA, 25 bp, E. coli
cacgtcagtctgttaatcagaccgt

SEQ ID NO: 4309 - DNA, 25 bp, E. coli
catatgatggttgccttggcggcca

SEQ ID NO: 4310 - DNA, 25 bp, E. coli
catatgatggttcccttggcggcca

SEQ ID NO: 4311 - DNA, 25 bp, E. coli
tacacgtcagtcagataatcagacc

SEQ ID NO: 4312 - DNA, 25 bp, E. coli
tacacgtcagtctgataatcagacc

SEQ ID NO: 4313 - DNA, 25 bp, E. coli
tgccgtttacacgtcagtctgataa

SEQ ID NO: 4314 - DNA, 25 bp, E. coli
tgccgtttacacctcagtctgataa

SEQ ID NO: 4315 - DNA, 25 bp, E. coli
tcttcgcatatgttggttcccttgg

SEQ ID NO: 4316 - DNA, 25 bp, E. coli
tcttcgcatatgatggttcccttgg

SEQ ID NO: 4317 - DNA, 25 bp, E. coli
gcatatgatggttcccttggcggcc

SEQ ID NO: 4318 - DNA, 25 bp, E. coli
gcatatgatggtacccttggcggcc

SEQ ID NO: 4319 - DNA, 25 bp, E. coli
cgtttacacgtcagtctgataatca

SEQ ID NO: 4320 - DNA, 25 bp, E. coli
cccgatcttcgcttatgatggttcc

SEQ ID NO: 4321 - DNA, 25 bp, E. coli
cgatcttcgcatttgatggttccct

SEQ ID NO: 4322 - DNA, 25 bp, E. coli
cccgatcttcgcatatgatggttcc

SEQ ID NO: 4323 - DNA, 25 bp, E. coli
cgtttacacgtctgtctgataatca

SEQ ID NO: 4324 - DNA, 25 bp, E. coli
cgatcttcgcatatgatggttccct

SEQ ID NO: 4325 - DNA, 25 bp, E. coli
cggtctgccgtttacacgtcagtct

SEQ ID NO: 4326 - DNA, 25 bp, E. coli
cggtctgccgttaacacgtcagtct

SEQ ID NO: 4327 - DNA, 25 bp, E. coli
gtctgccgtttagacgtcagtctga

SEQ ID NO: 4328 - DNA, 25 bp, E. coli
gtctgccgtttacacgtcagtctga

SEQ ID NO: 4329 - DNA, 25 bp, E. coli
cagaggttactgtggcacacctgtc

SEQ ID NO: 4330 - DNA, 25 bp, E. coli
cagaggttactgaggcacacctgtc

SEQ ID NO: 4331 - DNA, 25 bp, E. coli
tactgaggcacacctgtcactcgat

SEQ ID NO: 4332 - DNA, 25 bp, E. coli
taacagaggttagtgaggcacacct

SEQ ID NO: 4333 - DNA, 25 bp, E. coli
tactgaggcacagctgtcactcgat

SEQ ID NO: 4334 - DNA, 25 bp, E. coli
aggttactgagggacacctgtcact

SEQ ID NO: 4335 - DNA, 25 bp, E. coli
agaggttactgaggcacacctgtca

SEQ ID NO: 4336 - DNA, 25 bp, E. coli
agaggttactgacgcacacctgtca

SEQ ID NO: 4337 - DNA, 25 bp, E. coli
aggttactgaggcacacctgtcact

SEQ ID NO: 4338 - DNA, 25 bp, E. coli
aacagaggttacagaggcacacctg

SEQ ID NO: 4339 - DNA, 25 bp, E. coli
aacagaggttactgaggcacacctg

SEQ ID NO: 4340 - DNA, 25 bp, E. coli
tgtaacagaggtaactgaggcacac

SEQ ID NO: 4341 - DNA, 25 bp, E. coli
tgtaacagaggttactgaggcacac

SEQ ID NO: 4342 - DNA, 25 bp, E. coli
gttactgaggcacacctgtcactcg

SEQ ID NO: 4343 - DNA, 25 bp, E. coli
gtaacagaggttactgaggcacacc

SEQ ID NO: 4344 - DNA, 25 bp, E. coli
gttactgaggcagacctgtcactcg

SEQ ID NO: 4345 - DNA, 25 bp, E. coli
gtaacagaggtttctgaggcacacc

SEQ ID NO: 4346 - DNA, 25 bp, E. coli
ggttactgaggctcacctgtcactc

SEQ ID NO: 4347 - DNA, 25 bp, E. coli
ggttactgaggcacacctgtcactc

SEQ ID NO: 4348 - DNA, 25 bp, E. coli
taacagaggttactgaggcacacct

SEQ ID NO: 4349 - DNA, 25 bp, E. coli
gatgtaacagaggttactgaggcac

SEQ ID NO: 4350 - DNA, 25 bp, E. coli
gatgtaacagagcttactgaggcac

SEQ ID NO: 4351 - DNA, 25 bp, E. coli
aattctgcatgggttgttacgcacg

SEQ ID NO: 4352 - DNA, 25 bp, E. coli
aattctgcatggcttgttacgcacg

SEQ ID NO: 4353 - DNA, 25 bp, E. coli
cacggtctagatgtaaggaatttta

SEQ ID NO: 4354 - DNA, 25 bp, E. coli
cacggtctagatctaaggaatttta

SEQ ID NO: 4355 - DNA, 25 bp, E. coli
ctaaggaattttttatgcaaaggaa

SEQ ID NO: 4356 - DNA, 25 bp, E. coli
catggcttgttaggcacggtctaga

SEQ ID NO: 4357 - DNA, 25 bp, E. coli
catggcttgttacgcacggtctaga

SEQ ID NO: 4358 - DNA, 25 bp, E. coli
ctaaggaattttatatgcaaaggaa

SEQ ID NO: 4359 - DNA, 25 bp, E. coli
tacgcacggtctagatctaaggaat

SEQ ID NO: 4360 - DNA, 25 bp, E. coli
tacgcacggtcttgatctaaggaat

SEQ ID NO: 4361 - DNA, 25 bp, E. coli
tgttacgcacggactagatctaagg

SEQ ID NO: 4362 - DNA, 25 bp, E. coli
tgttacgcacggtctagatctaagg

SEQ ID NO: 4363 - DNA, 25 bp, E. coli
tctgcatggcttcttacgcacggtc

SEQ ID NO: 4364 - DNA, 25 bp, E. coli
tctgcatggcttgttacgcacggtc

SEQ ID NO: 4365 - DNA, 25 bp, E. coli
gaatatttactaggatttatcttca

SEQ ID NO: 4366 - DNA, 25 bp, E. coli
gaatatttactacgatttatcttca

SEQ ID NO: 4367 - DNA, 25 bp, E. coli
gatttatcttcatattctgcatggc

SEQ ID NO: 4368 - DNA, 25 bp, E. coli
gatttatcttcaaattctgcatggc

SEQ ID NO: 4369 - DNA, 25 bp, E. coli
ggcttgttacgcacggtctagatct

SEQ ID NO: 4370 - DNA, 25 bp, E. coli
ggcttgttacgctcggtctagatct

SEQ ID NO: 4371 - DNA, 25 bp, E. coli
tcaaattctgcatggcttgttacgc

SEQ ID NO: 4372 - DNA, 25 bp, E. coli
tcaaattctgcaaggcttgttacgc

SEQ ID NO: 4373 - DNA, 25 bp, E. coli
cacacggtcgcacatgtcatggaag

SEQ ID NO: 4374 - DNA, 25 bp, E. coli
cacacggtcgcagatgtcatggaag

SEQ ID NO: 4375 - DNA, 25 bp, E. coli
catgcggcggaaaatctcaccgggc

SEQ ID NO: 4376 - DNA, 25 bp, E. coli
catgcggcggaatatctcaccgggc

SEQ ID NO: 4377 - DNA, 25 bp, E. coli
tacaaagtgggcgtctacagttcgc

SEQ ID NO: 4378 - DNA, 25 bp, E. coli
tacaaagtgggcctctacagttcgc

SEQ ID NO: 4379 - DNA, 25 bp, E. coli
aaactatcgatcacggccttgagcg

SEQ ID NO: 4380 - DNA, 25 bp, E. coli
aaatcatttgatagcgttgcgcagg

SEQ ID NO: 4381 - DNA, 25 bp, E. coli
aaatcatttgattgcgttgcgcagg

SEQ ID NO: 4382 - DNA, 25 bp, E. coli
aaactatcgatctcggccttgagcg

SEQ ID NO: 4383 - DNA, 25 bp, E. coli
tattgcgctggatcataccgactgg

SEQ ID NO: 4384 - DNA, 25 bp, E. coli
tttccagattgtgagcgagtcgcca

SEQ ID NO: 4385 - DNA, 25 bp, E. coli
tttccagattgtcagcgagtcgcca

SEQ ID NO: 4386 - DNA, 25 bp, E. coli
tattgcgctggaacataccgactgg

SEQ ID NO: 4387 - DNA, 25 bp, E. coli
tgactggtattgagcgccactggaa

SEQ ID NO: 4388 - DNA, 25 bp, E. coli
tgactggtattgtgcgccactggaa

SEQ ID NO: 4389 - DNA, 25 bp, E. coli
gccgatgtcgcgctagtaaccagta

SEQ ID NO: 4390 - DNA, 25 bp, E. coli
gccgatgtcgcggtagtaaccagta

SEQ ID NO: 4391 - DNA, 25 bp, E. coli
gaaaatgccattcgcgacgggattg

SEQ ID NO: 4392 - DNA, 25 bp, E. coli
gaaaatgccattggcgacgggattg

SEQ ID NO: 4393 - DNA, 25 bp, E. coli
gaactctggcctcgttgaaaagcgt

SEQ ID NO: 4394 - DNA, 25 bp, E. coli
gaactctggcctggttgaaaagcgt

SEQ ID NO: 4395 - DNA, 25 bp, E. coli
caagagcagcaacatggtcgtcagg

SEQ ID NO: 4396 - DNA, 25 bp, E. coli
caagagcagcaagatggtcgtcagg

SEQ ID NO: 4397 - DNA, 25 bp, E. coli
aaaatgtgttaatcgccaccgccgg

SEQ ID NO: 4398 - DNA, 25 bp, E. coli
aaaatgtgttaaacgccaccgccgg

SEQ ID NO: 4399 - DNA, 25 bp, E. coli
taggttctctgcacactcttggcgg

SEQ ID NO: 4400 - DNA, 25 bp, E. coli
tagatcgactggtcgacgacgttcg

SEQ ID NO: 4401 - DNA, 25 bp, E. coli
taggttctctgctcactcttggcgg

SEQ ID NO: 4402 - DNA, 25 bp, E. coli
tagatcgactggacgacgacgttcg

SEQ ID NO: 4403 - DNA, 25 bp, E. coli
tatcaaaccgacgatgacgaagccg

SEQ ID NO: 4404 - DNA, 25 bp, E. coli
tatcaaaccgaccatgacgaagccg

SEQ ID NO: 4405 - DNA, 25 bp, E. coli
tttgccatgccgttaaagtccgacg

SEQ ID NO: 4406 - DNA, 25 bp, E. coli
tatctggaaaattacgacgctctgg

SEQ ID NO: 4407 - DNA, 25 bp, E. coli
tttgccatgccgataaagtccgacg

SEQ ID NO: 4408 - DNA, 25 bp, E. coli
tatctggaaaataacgacgctctgg

SEQ ID NO: 4409 - DNA, 25 bp, E. coli
ttactcaggcgctcgataacgggtc

SEQ ID NO: 4410 - DNA, 25 bp, E. coli
ttttgcacaggctgaacccgcatgg

SEQ ID NO: 4411 - DNA, 25 bp, E. coli
ttactcaggcgcacgataacgggtc

SEQ ID NO: 4412 - DNA, 25 bp, E. coli
ttttgcacaggcagaacccgcatgg

SEQ ID NO: 4413 - DNA, 25 bp, E. coli
tgtgggccgcgttcctcaaggttaa

SEQ ID NO: 4414 - DNA, 25 bp, E. coli
tgtgggccgcgtacctcaaggttaa

SEQ ID NO: 4415 - DNA, 25 bp, E. coli
taatccagaacctgtgccgggtgac

SEQ ID NO: 4416 - DNA, 25 bp, E. coli
taatccagaaccagtgccgggtgac

SEQ ID NO: 4417 - DNA, 25 bp, E. coli
aattaacgtgccatttgtgacatcg

SEQ ID NO: 4418 - DNA, 25 bp, E. coli
aattaacgtgccttttgtgacatcg

SEQ ID NO: 4419 - DNA, 25 bp, E. coli
taacgtgcctttagtgacatcgctc

SEQ ID NO: 4420 - DNA, 25 bp, E. coli
tttgtgacatcgctcgcacttcgct

SEQ ID NO: 4421 - DNA, 25 bp, E. coli
tttgtgacatcggtcgcacttcgct

SEQ ID NO: 4422 - DNA, 25 bp, E. coli
ttcgctctgcgtcgccatacggcga

SEQ ID NO: 4423 - DNA, 25 bp, E. coli
ttcgctctgcgtggccatacggcga

SEQ ID NO: 4424 - DNA, 25 bp, E. coli
tgtgacatcgctggcacttcgctct

SEQ ID NO: 4425 - DNA, 25 bp, E. coli
tgtgacatcgctcgcacttcgctct

SEQ ID NO: 4426 - DNA, 25 bp, E. coli
tctgcgtcgccatacggcgatgcga

SEQ ID NO: 4427 - DNA, 25 bp, E. coli
tctgcgtcgccaaacggcgatgcga

SEQ ID NO: 4428 - DNA, 25 bp, E. coli
gccttttgtgacttcgctcgcactt

SEQ ID NO: 4429 - DNA, 25 bp, E. coli
gccttttgtgacatcgctcgcactt

SEQ ID NO: 4430 - DNA, 25 bp, E. coli
gcaaattaacgtcccttttgtgaca

SEQ ID NO: 4431 - DNA, 25 bp, E. coli
gcaaattaacgtgccttttgtgaca

SEQ ID NO: 4432 - DNA, 25 bp, E. coli
cggcgatgcgaacgttaattcttac

SEQ ID NO: 4433 - DNA, 25 bp, E. coli
cgtgccttttgtgacatcgctcgca

SEQ ID NO: 4434 - DNA, 25 bp, E. coli
cgtgccttttgtcacatcgctcgca

SEQ ID NO: 4435 - DNA, 25 bp, E. coli
cggcgatgcgaaggttaattcttac

SEQ ID NO: 4436 - DNA, 25 bp, E. coli
taacgtgccttttgtgacatcgctc

SEQ ID NO: 4437 - DNA, 25 bp, E. coli
gatgcgaaggtttattcttacgacc

SEQ ID NO: 4438 - DNA, 25 bp, E. coli
gatgcgaaggttaattcttacgacc

SEQ ID NO: 4439 - DNA, 25 bp, E. coli
caggcggtagagtaaatgaaggaac

SEQ ID NO: 4440 - DNA, 25 bp, E. coli
caggcggtagagaaaatgaaggaac

SEQ ID NO: 4441 - DNA, 25 bp, E. coli
aggcggtagagttaatgaaggaaca

SEQ ID NO: 4442 - DNA, 25 bp, E. coli
aggcggtagagtaaatgaaggaaca

SEQ ID NO: 4443 - DNA, 25 bp, E. coli
atgaccactggcgggaaacagcctg

SEQ ID NO: 4444 - DNA, 25 bp, E. coli
atgaccactggccggaaacagcctg

SEQ ID NO: 4445 - DNA, 25 bp, E. coli
aaatgaaggaactgagaatgaagtc

SEQ ID NO: 4446 - DNA, 25 bp, E. coli
aaatgaaggaacagagaatgaagtc

SEQ ID NO: 4447 - DNA, 25 bp, E. coli
tagagtaaatgaaggaacagagaat

SEQ ID NO: 4448 - DNA, 25 bp, E. coli
tagagtaaatgatggaacagagaat

SEQ ID NO: 4449 - DNA, 25 bp, E. coli
tattcctcgccaggcggtagagtaa

SEQ ID NO: 4450 - DNA, 25 bp, E. coli
tattcctcgccacgcggtagagtaa

SEQ ID NO: 4451 - DNA, 25 bp, E. coli
tcgccaggcggttgagtaaatgaag

SEQ ID NO: 4452 - DNA, 25 bp, E. coli
tcgccaggcggtagagtaaatgaag

SEQ ID NO: 4453 - DNA, 25 bp, E. coli
cctcgccaggcggtagagtaaatga

SEQ ID NO: 4454 - DNA, 25 bp, E. coli
ccaggcggtagagtaaatgaaggaa

SEQ ID NO: 4455 - DNA, 25 bp, E. coli
cctcgccaggcgctagagtaaatga

SEQ ID NO: 4456 - DNA, 25 bp, E. coli
ccaggcggtagactaaatgaaggaa

SEQ ID NO: 4457 - DNA, 25 bp, E. coli
ggtagagtaaatcaaggaacagaga

SEQ ID NO: 4458 - DNA, 25 bp, E. coli
ggtagagtaaatgaaggaacagaga

SEQ ID NO: 4459 - DNA, 25 bp, E. coli
gagtaaatgaaggaacagagaatga

SEQ ID NO: 4460 - DNA, 25 bp, E. coli
gagtaaatgaagcaacagagaatga

SEQ ID NO: 4461 - DNA, 25 bp, E. coli
cagtttctgcagctcaacgtctgac

SEQ ID NO: 4462 - DNA, 25 bp, E. coli
cagtttctgcaggtcaacgtctgac

SEQ ID NO: 4463 - DNA, 25 bp, E. coli
tattaaaggcattcaaactggacgt

SEQ ID NO: 4464 - DNA, 25 bp, E. coli
tattaaaggcatacaaactggacgt

SEQ ID NO: 4465 - DNA, 25 bp, E. coli
tgacacgagtcacaggaaacgacgg

SEQ ID NO: 4466 - DNA, 25 bp, E. coli
tgacacgagtcagaggaaacgacgg

SEQ ID NO: 4467 - DNA, 25 bp, E. coli
tcctcgaatagataatgcagccccg

SEQ ID NO: 4468 - DNA, 25 bp, E. coli
tcctcgaatagaaaatgcagccccg

SEQ ID NO: 4469 - DNA, 25 bp, E. coli
tctttcagtcatagcttcgggccgc

SEQ ID NO: 4470 - DNA, 25 bp, E. coli
tcgggccgcgattagactcactgat

SEQ ID NO: 4471 - DNA, 25 bp, E. coli
tctttcagtcattgcttcgggccgc

SEQ ID NO: 4472 - DNA, 25 bp, E. coli
tcgggccgcgataagactcactgat

SEQ ID NO: 4473 - DNA, 25 bp, E. coli
gccagatttatttgcgccaccagat

SEQ ID NO: 4474 - DNA, 25 bp, E. coli
gccagatttattagcgccaccagat

SEQ ID NO: 4475 - DNA, 25 bp, E. coli
gctctctcggtatggcactgtcaca

SEQ ID NO: 4476 - DNA, 25 bp, E. coli
gctctctcggtaaggcactgtcaca

SEQ ID NO: 4477 - DNA, 25 bp, E. coli
gcagccccggcaagtgattcacatt

SEQ ID NO: 4478 - DNA, 25 bp, E. coli
gcagccccggcatgtgattcacatt

SEQ ID NO: 4479 - DNA, 25 bp, E. coli
taaccggacctgatactgatatgag

SEQ ID NO: 4480 - DNA, 25 bp, E. coli
taaccggacctgttactgatatgag

SEQ ID NO: 4481 - DNA, 25 bp, E. coli
taatggcccaaatacgaagttgctc

SEQ ID NO: 4482 - DNA, 25 bp, E. coli
taatggcccaaaaacgaagttgctc

SEQ ID NO: 4483 - DNA, 25 bp, E. coli
caaagttgaccgttattcctatgtg

SEQ ID NO: 4484 - DNA, 25 bp, E. coli
caaagttgaccgatattcctatgtg

SEQ ID NO: 4485 - DNA, 25 bp, E. coli
actgcgtcacgatcttgacgccctg

SEQ ID NO: 4486 - DNA, 25 bp, E. coli
actgcgtcacgaacttgacgccctg

SEQ ID NO: 4487 - DNA, 25 bp, E. coli
actggacagagatctcgacagccgt

SEQ ID NO: 4488 - DNA, 25 bp, E. coli
actggacagagaactcgacagccgt

SEQ ID NO: 4489 - DNA, 25 bp, E. coli
tattcctatgtgttgcacctcgtct

SEQ ID NO: 4490 - DNA, 25 bp, E. coli
tattcctatgtgatgcacctcgtct

SEQ ID NO: 4491 - DNA, 25 bp, E. coli
tgatgcacctcgtctctcgcgtagt

SEQ ID NO: 4492 - DNA, 25 bp, E. coli
tgatgcacctcgactctcgcgtagt

SEQ ID NO: 4493 - DNA, 25 bp, E. coli
tcggcgaactgcgtcacgatcttga

SEQ ID NO: 4494 - DNA, 25 bp, E. coli
tctctcgcgtagtcggcgaactgcg

SEQ ID NO: 4495 - DNA, 25 bp, E. coli
tctctcgcgtagacggcgaactgcg

SEQ ID NO: 4496 - DNA, 25 bp, E. coli
tcggcgaactgcctcacgatcttga

SEQ ID NO: 4497 - DNA, 25 bp, E. coli
gagatctcgacagccgtattgaact

SEQ ID NO: 4498 - DNA, 25 bp, E. coli
gagatctcgacacccgtattgaact

SEQ ID NO: 4499 - DNA, 25 bp, E. coli
cgccgatggttcactggacagagat

SEQ ID NO: 4500 - DNA, 25 bp, E. coli
cgccgatggttctctggacagagat

SEQ ID NO: 4501 - DNA, 25 bp, E. coli
cgtagtcggcgaactgcgtcacgat

SEQ ID NO: 4502 - DNA, 25 bp, E. coli
cgtagtcggcgatctgcgtcacgat

SEQ ID NO: 4503 - DNA, 25 bp, E. coli
gaccgttattccaatgtgatgcacc

SEQ ID NO: 4504 - DNA, 25 bp, E. coli
gaccgttattcctatgtgatgcacc

SEQ ID NO: 4505 - DNA, 25 bp, E. coli
catttactaccccaatacagccgta

SEQ ID NO: 4506 - DNA, 25 bp, E. coli
catttactacccgaatacagccgta

SEQ ID NO: 4507 - DNA, 25 bp, E. coli
taaaggcgcaatgttcatgcaaaag

SEQ ID NO: 4508 - DNA, 25 bp, E. coli
tacgtgacatacaccattttgctca

SEQ ID NO: 4509 - DNA, 25 bp, E. coli
taaaggcgcaatcttcatgcaaaag

SEQ ID NO: 4510 - DNA, 25 bp, E. coli
tacagccgtacataactcgcttgtg

SEQ ID NO: 4511 - DNA, 25 bp, E. coli
tacgtgacatactccattttgctca

SEQ ID NO: 4512 - DNA, 25 bp, E. coli
tacagccgtacaaaactcgcttgtg

SEQ ID NO: 4513 - DNA, 25 bp, E. coli
ctcgcttgtgggagcaaacaaagta

SEQ ID NO: 4514 - DNA, 25 bp, E. coli
ctcgcttgtgggtgcaaacaaagta

SEQ ID NO: 4515 - DNA, 25 bp, E. coli
aaaacctctttgttatgacctatcg

SEQ ID NO: 4516 - DNA, 25 bp, E. coli
aaaacctctttgatatgacctatcg

SEQ ID NO: 4517 - DNA, 25 bp, E. coli
tagcataacttataatccgagatca

SEQ ID NO: 4518 - DNA, 25 bp, E. coli
tagcataacttaaaatccgagatca

SEQ ID NO: 4519 - DNA, 25 bp, E. coli
tattagtaacacgtacgaaagtcgg

SEQ ID NO: 4520 - DNA, 25 bp, E. coli
tattagtaacacctacgaaagtcgg

SEQ ID NO: 4521 - DNA, 25 bp, E. coli
ttatctcattatccataaaggcgca

SEQ ID NO: 4522 - DNA, 25 bp, E. coli
ttatctcattatgcataaaggcgca

SEQ ID NO: 4523 - DNA, 25 bp, E. coli
tcagtatttgaatctgcgaccaaga

SEQ ID NO: 4524 - DNA, 25 bp, E. coli
tcagtatttgaaactgcgaccaaga

SEQ ID NO: 4525 - DNA, 25 bp, E. coli
gcgaccaagagttctcacctaacaa

SEQ ID NO: 4526 - DNA, 25 bp, E. coli
gcgaccaagagtactcacctaacaa

SEQ ID NO: 4527 - DNA, 25 bp, E. coli
caatttgcagcttctcttagaccgg

SEQ ID NO: 4528 - DNA, 25 bp, E. coli
caatttgcagctactcttagaccgg

SEQ ID NO: 4529 - DNA, 25 bp, E. coli
tacagcagccgggaggttttggaac

SEQ ID NO: 4530 - DNA, 25 bp, E. coli
tacagcagccggcaggttttggaac

SEQ ID NO: 4531 - DNA, 25 bp, E. coli
aacaggtaagctgcagattcagggc

SEQ ID NO: 4532 - DNA, 25 bp, E. coli
aacaggtaagctccagattcagggc

SEQ ID NO: 4533 - DNA, 25 bp, E. coli
ttcacgtttaacatggcagccctgc

SEQ ID NO: 4534 - DNA, 25 bp, E. coli
ttcacgtttaacttggcagccctgc

SEQ ID NO: 4535 - DNA, 25 bp, E. coli
tattgttcaacaggaggttgcccgc

SEQ ID NO: 4536 - DNA, 25 bp, E. coli
tattgttcaacacgaggttgcccgc

SEQ ID NO: 4537 - DNA, 25 bp, E. coli
tctgggccaagacttagcggatcat

SEQ ID NO: 4538 - DNA, 25 bp, E. coli
tatggcccggttcatgggtaaagcc

SEQ ID NO: 4539 - DNA, 25 bp, E. coli
tatggcccggttgatgggtaaagcc

SEQ ID NO: 4540 - DNA, 25 bp, E. coli
tctgggccaagagttagcggatcat

SEQ ID NO: 4541 - DNA, 25 bp, E. coli
gaaactgtggtccatgccagccgta

SEQ ID NO: 4542 - DNA, 25 bp, E. coli
gaaactgtggtcgatgccagccgta

SEQ ID NO: 4543 - DNA, 25 bp, E. coli
tcaattggtcctatgccagggtcaa

SEQ ID NO: 4544 - DNA, 25 bp, E. coli
tcaattggtcctttgccagggtcaa

SEQ ID NO: 4545 - DNA, 25 bp, E. coli
gagaaagtgctattccgccaggagg

SEQ ID NO: 4546 - DNA, 25 bp, E. coli
gacgaattgactctgagcctgcata

SEQ ID NO: 4547 - DNA, 25 bp, E. coli
gagaaagtgctaatccgccaggagg

SEQ ID NO: 4548 - DNA, 25 bp, E. coli
gacgaattgactgtgagcctgcata

SEQ ID NO: 4549 - DNA, 25 bp, E. coli
aacgaatttctgacgctgcgcacca

SEQ ID NO: 4550 - DNA, 25 bp, E. coli
aacgaatttctgtcgctgcgcacca

SEQ ID NO: 4551 - DNA, 25 bp, E. coli
taacgatccgcacgttgccgacgat

SEQ ID NO: 4552 - DNA, 25 bp, E. coli
tatcgatggcgccaccgtttcttgc

SEQ ID NO: 4553 - DNA, 25 bp, E. coli
tatcgatggcgcgaccgtttcttgc

SEQ ID NO: 4554 - DNA, 25 bp, E. coli
ttaatatcgccaaacagatccccgg

SEQ ID NO: 4555 - DNA, 25 bp, E. coli
tttagctgggtctcgcgcaaactga

SEQ ID NO: 4556 - DNA, 25 bp, E. coli
ttaatatcgccatacagatccccgg

SEQ ID NO: 4557 - DNA, 25 bp, E. coli
ttgtgatgctcctgcgcaaagccag

SEQ ID NO: 4558 - DNA, 25 bp, E. coli
tttagctgggtcacgcgcaaactga

SEQ ID NO: 4559 - DNA, 25 bp, E. coli
ttgtgatgctccagcgcaaagccag

SEQ ID NO: 4560 - DNA, 25 bp, E. coli
gcaaattttgcataccgggcgctac

SEQ ID NO: 4561 - DNA, 25 bp, E. coli
gcaaattttgcaaaccgggcgctac

SEQ ID NO: 4562 - DNA, 25 bp, E. coli
ggttaggcaaaagcaccggctggat

SEQ ID NO: 4563 - DNA, 25 bp, E. coli
ggttaggcaaaaccaccggctggat

SEQ ID NO: 4564 - DNA, 25 bp, E. coli
taacgatccgcaggttgccgacgat

SEQ ID NO: 4565 - DNA, 25 bp, E. coli
gatgtatttaagacagccgggcgaa

SEQ ID NO: 4566 - DNA, 25 bp, E. coli
gatgaaacgatcctcgccagtggga

SEQ ID NO: 4567 - DNA, 25 bp, E. coli
gatgtactgcgcgacaaagcgccgg

SEQ ID NO: 4568 - DNA, 25 bp, E. coli
gatgtatttaagtcagccgggcgaa

SEQ ID NO: 4569 - DNA, 25 bp, E. coli
gatgaaacgatcgtcgccagtggga

SEQ ID NO: 4570 - DNA, 25 bp, E. coli
gatgtactgcgccacaaagcgccgg

SEQ ID NO: 4571 - DNA, 25 bp, E. coli
caatgagcaaatagccggagaactg

SEQ ID NO: 4572 - DNA, 25 bp, E. coli
caatgagcaaattgccggagaactg

SEQ ID NO: 4573 - DNA, 25 bp, E. coli
acaactgcgtcacctgattcagctt

SEQ ID NO: 4574 - DNA, 25 bp, E. coli
acaactgcgtcagctgattcagctt

SEQ ID NO: 4575 - DNA, 25 bp, E. coli
tttgaaccggcagaaattgttctcg

SEQ ID NO: 4576 - DNA, 25 bp, E. coli
tttgaaccggcacaaattgttctcg

SEQ ID NO: 4577 - DNA, 25 bp, E. coli
tgaagtacctgaactgatccgcacc

SEQ ID NO: 4578 - DNA, 25 bp, E. coli
tgctaaatcatcgtgaagtacctga

SEQ ID NO: 4579 - DNA, 25 bp, E. coli
tgaagtacctgatctgatccgcacc

SEQ ID NO: 4580 - DNA, 25 bp, E. coli
tgctaaatcatcctgaagtacctga

SEQ ID NO: 4581 - DNA, 25 bp, E. coli
tgcggtacaacaggcccagcaattg

SEQ ID NO: 4582 - DNA, 25 bp, E. coli
tgcggtacaacacgcccagcaattg

SEQ ID NO: 4583 - DNA, 25 bp, E. coli
tctgtatcagaaactcggcgtggcc

SEQ ID NO: 4584 - DNA, 25 bp, E. coli
tctgtatcagaatctcggcgtggcc

SEQ ID NO: 4585 - DNA, 25 bp, E. coli
gcccagcaattgctgaagatgatgg

SEQ ID NO: 4586 - DNA, 25 bp, E. coli
ccggagaactggaagtcgcggcaac

SEQ ID NO: 4587 - DNA, 25 bp, E. coli
gcccagcaattggtgaagatgatgg

SEQ ID NO: 4588 - DNA, 25 bp, E. coli
ccggagaactggtagtcgcggcaac

SEQ ID NO: 4589 - DNA, 25 bp, E. coli
cggcagaaattgatctcgaagaact

SEQ ID NO: 4590 - DNA, 25 bp, E. coli
cggcagaaattgttctcgaagaact

SEQ ID NO: 4591 - DNA, 25 bp, E. coli
ggcccatcgccaggatgcggtacaa

SEQ ID NO: 4592 - DNA, 25 bp, E. coli
ggcccatcgccacgatgcggtacaa

SEQ ID NO: 4593 - DNA, 25 bp, E. coli
cactggtatcggcaatgaatcatct

SEQ ID NO: 4594 - DNA, 25 bp, E. coli
cacgcctgttctcaaaggcaacctg

SEQ ID NO: 4595 - DNA, 25 bp, E. coli
cactggtatcgggaatgaatcatct

SEQ ID NO: 4596 - DNA, 25 bp, E. coli
cacgacgaccgtaccagatgaaggg

SEQ ID NO: 4597 - DNA, 25 bp, E. coli
cacgcctgttctgaaaggcaacctg

SEQ ID NO: 4598 - DNA, 25 bp, E. coli
cacgacgaccgttccagatgaaggg

SEQ ID NO: 4599 - DNA, 25 bp, E. coli
tacagcaatgacaaagcctcagcgc

SEQ ID NO: 4600 - DNA, 25 bp, E. coli
tacagcaatgactaagcctcagcgc

SEQ ID NO: 4601 - DNA, 25 bp, E. coli
actaaagatgaaccgggagtctggt

SEQ ID NO: 4602 - DNA, 25 bp, E. coli
actaaagatgaagcgggagtctggt

SEQ ID NO: 4603 - DNA, 25 bp, E. coli
acaaggtgggtaacaggcactggta

SEQ ID NO: 4604 - DNA, 25 bp, E. coli
acaaggtgggtatcaggcactggta

SEQ ID NO: 4605 - DNA, 25 bp, E. coli
tgatacaggtactgcaatgactaag

SEQ ID NO: 4606 - DNA, 25 bp, E. coli
tgatacaggtacagcaatgactaag

SEQ ID NO: 4607 - DNA, 25 bp, E. coli
ccggctgaacgacccggcagctatt

SEQ ID NO: 4608 - DNA, 25 bp, E. coli
ccggctgaacgagccggcagctatt

SEQ ID NO: 4609 - DNA, 25 bp, E. coli
gcggcctgcctatgcagccttcgta

SEQ ID NO: 4610 - DNA, 25 bp, E. coli
gcggcctgcctaagcagccttcgta

SEQ ID NO: 4611 - DNA, 25 bp, E. coli
tggtcgtggcgcacgcctgttctga

SEQ ID NO: 4612 - DNA, 25 bp, E. coli
tggtcgtggcgctcgcctgttctga

SEQ ID NO: 4613 - DNA, 25 bp, E. coli
tcacccgatgactaaagatgaagcg

SEQ ID NO: 4614 - DNA, 25 bp, E. coli
tcacccgatgacaaaagatgaagcg

SEQ ID NO: 4615 - DNA, 25 bp, E. coli
cagcataacaaaaccgtggtcggtg

SEQ ID NO: 4616 - DNA, 25 bp, E. coli
caccagcataactaatccgtggtcg

SEQ ID NO: 4617 - DNA, 25 bp, E. coli
caccagcataacaaatccgtggtcg

SEQ ID NO: 4618 - DNA, 25 bp, E. coli
cagcataacaaatccgtggtcggtg

SEQ ID NO: 4619 - DNA, 25 bp, E. coli
cataacaaatccgtggtcggtggca

SEQ ID NO: 4620 - DNA, 25 bp, E. coli
cataacaaatccctggtcggtggca

SEQ ID NO: 4621 - DNA, 25 bp, E. coli
tacaaaggccaccagcataacaaat

SEQ ID NO: 4622 - DNA, 25 bp, E. coli
tacaaaggccacgagcataacaaat

SEQ ID NO: 4623 - DNA, 25 bp, E. coli
tatgatctacaaaggccaccagcat

SEQ ID NO: 4624 - DNA, 25 bp, E. coli
tatgatctacaatggccaccagcat

SEQ ID NO: 4625 - DNA, 25 bp, E. coli
tatcgttatgatctacaaaggccac

SEQ ID NO: 4626 - DNA, 25 bp, E. coli
tatcgttatgatgtacaaaggccac

SEQ ID NO: 4627 - DNA, 25 bp, E. coli
tcgttatgatcttcaaaggccacca

SEQ ID NO: 4628 - DNA, 25 bp, E. coli
tcgttatgatctacaaaggccacca

SEQ ID NO: 4629 - DNA, 25 bp, E. coli
tctacaaaggccaccagcataacaa

SEQ ID NO: 4630 - DNA, 25 bp, E. coli
tctacaaaggcctccagcataacaa

SEQ ID NO: 4631 - DNA, 25 bp, E. coli
gttatgatctactaaggccaccagc

SEQ ID NO: 4632 - DNA, 25 bp, E. coli
gttatgatctacaaaggccaccagc

SEQ ID NO: 4633 - DNA, 25 bp, E. coli
gtggcaaaaaaaccagatttcgctt

SEQ ID NO: 4634 - DNA, 25 bp, E. coli
gtggcaaaaaaagcagatttcgctt

SEQ ID NO: 4635 - DNA, 25 bp, E. coli
taacaaatccgtcgtcggtggcaaa

SEQ ID NO: 4636 - DNA, 25 bp, E. coli
taacaaatccgtggtcggtggcaaa

SEQ ID NO: 4637 - DNA, 25 bp, E. coli
cagcgcgcagaggattgagcgccaa

SEQ ID NO: 4638 - DNA, 25 bp, E. coli
cagcgcgcagagcattgagcgccaa

SEQ ID NO: 4639 - DNA, 25 bp, E. coli
cataagtgtgatgtataaaactggc

SEQ ID NO: 4640 - DNA, 25 bp, E. coli
cataagtgtgatctataaaactggc

SEQ ID NO: 4641 - DNA, 25 bp, E. coli
catcctgttggatagcgtttcacgc

SEQ ID NO: 4642 - DNA, 25 bp, E. coli
catcctgttggaaagcgtttcacgc

SEQ ID NO: 4643 - DNA, 25 bp, E. coli
taaaactggctgacaaaacggtatc

SEQ ID NO: 4644 - DNA, 25 bp, E. coli
taaaactggctgtcaaaacggtatc

SEQ ID NO: 4645 - DNA, 25 bp, E. coli
aacgggtagtaaagttgtcatcatc

SEQ ID NO: 4646 - DNA, 25 bp, E. coli
aacgggtagtaatgttgtcatcatc

SEQ ID NO: 4647 - DNA, 25 bp, E. coli
tgtcatcatcagcattcctggccgt

SEQ ID NO: 4648 - DNA, 25 bp, E. coli
tgtcatcatcaggattcctggccgt

SEQ ID NO: 4649 - DNA, 25 bp, E. coli
tcctggccgtaattgaaacacgcat

SEQ ID NO: 4650 - DNA, 25 bp, E. coli
tcctggccgtaaatgaaacacgcat

SEQ ID NO: 4651 - DNA, 25 bp, E. coli
tcacgcctgttcagttgcaggaaca

SEQ ID NO: 4652 - DNA, 25 bp, E. coli
gaaacacgcatactcataagtgtga

SEQ ID NO: 4653 - DNA, 25 bp, E. coli
gacaaaacggtaaccatcctgttgg

SEQ ID NO: 4654 - DNA, 25 bp, E. coli
gacaaaacggtatccatcctgttgg

SEQ ID NO: 4655 - DNA, 25 bp, E. coli
gaaacacgcatagtcataagtgtga

SEQ ID NO: 4656 - DNA, 25 bp, E. coli
cgttttatcaacagtctcaaccaga

SEQ ID NO: 4657 - DNA, 25 bp, E. coli
cgttttatcaactgtctcaaccaga

SEQ ID NO: 4658 - DNA, 25 bp, E. coli
tcacgcctgttctgttgcaggaaca

SEQ ID NO: 4659 - DNA, 25 bp, E. coli
aataacgttagaagagacatccgcc

SEQ ID NO: 4660 - DNA, 25 bp, E. coli
aataacgttagatgagacatccgcc

SEQ ID NO: 4661 - DNA, 25 bp, E. coli
tgtggctaccgcactcagtcattct

SEQ ID NO: 4662 - DNA, 25 bp, E. coli
tgtggctaccgctctcagtcattct

SEQ ID NO: 4663 - DNA, 25 bp, E. coli
tgccggtgtggctaccgcactcagt

SEQ ID NO: 4664 - DNA, 25 bp, E. coli
tgccggtgtggcaaccgcactcagt

SEQ ID NO: 4665 - DNA, 25 bp, E. coli
ccacagactatgcaactctgggtag

SEQ ID NO: 4666 - DNA, 25 bp, E. coli
ccacagactatggaactctgggtag

SEQ ID NO: 4667 - DNA, 25 bp, E. coli
ctgccagacgctgttacagcttggt

SEQ ID NO: 4668 - DNA, 25 bp, E. coli
ctgccagacgctcttacagcttggt

SEQ ID NO: 4669 - DNA, 25 bp, E. coli
ctgttacagcttcgtcagatggacc

SEQ ID NO: 4670 - DNA, 25 bp, E. coli
ctgttacagcttggtcagatggacc

SEQ ID NO: 4671 - DNA, 25 bp, E. coli
gttagaagagacatccgcctcgcag

SEQ ID NO: 4672 - DNA, 25 bp, E. coli
gttagaagagacttccgcctcgcag

SEQ ID NO: 4673 - DNA, 25 bp, E. coli
ggcgcgtgccactgactatgcaact

SEQ ID NO: 4674 - DNA, 25 bp, E. coli
ggcgcgtgccacagactatgcaact

SEQ ID NO: 4675 - DNA, 25 bp, E. coli
taacgttagaagtgacatccgcctc

SEQ ID NO: 4676 - DNA, 25 bp, E. coli
tcaaataacgttagaagagacatcc

SEQ ID NO: 4677 - DNA, 25 bp, E. coli
taacgttagaagagacatccgcctc

SEQ ID NO: 4678 - DNA, 25 bp, E. coli
tcaaataacgtttgaagagacatcc

SEQ ID NO: 4679 - DNA, 25 bp, E. coli
gaccagggcgcgagccacagactat

SEQ ID NO: 4680 - DNA, 25 bp, E. coli
gaccagggcgcgtgccacagactat

SEQ ID NO: 4681 - DNA, 25 bp, E. coli
tactggcgatagaggtaaaactgct

SEQ ID NO: 4682 - DNA, 25 bp, E. coli
tactggcgatagtggtaaaactgct

SEQ ID NO: 4683 - DNA, 25 bp, E. coli
tatcctgctgttgtgcggctgcaag

SEQ ID NO: 4684 - DNA, 25 bp, E. coli
tatcctgctgttctgcggctgcaag

SEQ ID NO: 4685 - DNA, 25 bp, E. coli
tgcaagcagcaggaattactgaacc

SEQ ID NO: 4686 - DNA, 25 bp, E. coli
tgagcagcggttagagcaatctctc

SEQ ID NO: 4687 - DNA, 25 bp, E. coli
tgagcagcggtttgagcaatctctc

SEQ ID NO: 4688 - DNA, 25 bp, E. coli
tgcaagcagcagcaattactgaacc

SEQ ID NO: 4689 - DNA, 25 bp, E. coli
tccacgagcggataaagcaaggcta

SEQ ID NO: 4690 - DNA, 25 bp, E. coli
tccacgagcggaaaaagcaaggcta

SEQ ID NO: 4691 - DNA, 25 bp, E. coli
tctcccgggtaagcctgatattcaa

SEQ ID NO: 4692 - DNA, 25 bp, E. coli
tctcccgggtaaccctgatattcaa

SEQ ID NO: 4693 - DNA, 25 bp, E. coli
gctaaaaatctacaatctcccgggt

SEQ ID NO: 4694 - DNA, 25 bp, E. coli
gctaaaaatctagaatctcccgggt

SEQ ID NO: 4695 - DNA, 25 bp, E. coli
gcttctgcggtggattggctaaaaa

SEQ ID NO: 4696 - DNA, 25 bp, E. coli
gcttctgcggtgcattggctaaaaa

SEQ ID NO: 4697 - DNA, 25 bp, E. coli
gaaccaacggattttgcttctgcgg

SEQ ID NO: 4698 - DNA, 25 bp, E. coli
gaaccaacggatattgcttctgcgg

SEQ ID NO: 4699 - DNA, 25 bp, E. coli
gatgttccctgctgatgcactcgtt

SEQ ID NO: 4700 - DNA, 25 bp, E. coli
gagacattattgagcaagcaccaac

SEQ ID NO: 4701 - DNA, 25 bp, E. coli
gatgttccctgcagatgcactcgtt

SEQ ID NO: 4702 - DNA, 25 bp, E. coli
gagacattattgtgcaagcaccaac

SEQ ID NO: 4703 - DNA, 25 bp, E. coli
cagcctgtcgtatcctgtgaacgca

SEQ ID NO: 4704 - DNA, 25 bp, E. coli
caccttcgcgttgtgcactgaacag

SEQ ID NO: 4705 - DNA, 25 bp, E. coli
cagcctgtcgtaacctgtgaacgca

SEQ ID NO: 4706 - DNA, 25 bp, E. coli
caccttcgcgttctgcactgaacag

SEQ ID NO: 4707 - DNA, 25 bp, E. coli
actgaacagcctgtcgtaacctgtg

SEQ ID NO: 4708 - DNA, 25 bp, E. coli
actgaacagcctctcgtaacctgtg

SEQ ID NO: 4709 - DNA, 25 bp, E. coli
ttgctccgggtgtttcccctgcctg

SEQ ID NO: 4710 - DNA, 25 bp, E. coli
ttgctccgggtgattcccctgcctg

SEQ ID NO: 4711 - DNA, 25 bp, E. coli
ttttctccgggcatgagcacagcac

SEQ ID NO: 4712 - DNA, 25 bp, E. coli
tttctccgggcatgagcacagcacg

SEQ ID NO: 4713 - DNA, 25 bp, E. coli
ttttctccgggcttgagcacagcac

SEQ ID NO: 4714 - DNA, 25 bp, E. coli
tttctccgggcaagagcacagcacg

SEQ ID NO: 4715 - DNA, 25 bp, E. coli
tccgggcatgagcacagcacgcaac

SEQ ID NO: 4716 - DNA, 25 bp, E. coli
tccgggcatgaggacagcacgcaac

SEQ ID NO: 4717 - DNA, 25 bp, E. coli
tctccgggcatgtgcacagcacgca

SEQ ID NO: 4718 - DNA, 25 bp, E. coli
tctccgggcatgagcacagcacgca

SEQ ID NO: 4719 - DNA, 25 bp, E. coli
cctgtcgtaaccagtgaacgcatcc

SEQ ID NO: 4720 - DNA, 25 bp, E. coli
cctgtcgtaacctgtgaacgcatcc

SEQ ID NO: 4721 - DNA, 25 bp, E. coli
ggtgtttcccctccctgttcggtga

SEQ ID NO: 4722 - DNA, 25 bp, E. coli
ggtgtttcccctgcctgttcggtga

SEQ ID NO: 4723 - DNA, 25 bp, E. coli
ggcatgagcacagcacgcaacttct

SEQ ID NO: 4724 - DNA, 25 bp, E. coli
ggcatgagcacaccacgcaacttct

SEQ ID NO: 4725 - DNA, 25 bp, E. coli
tacagaatcggttcgagttttgaca

SEQ ID NO: 4726 - DNA, 25 bp, E. coli
tacagaatcggtacgagttttgaca

SEQ ID NO: 4727 - DNA, 25 bp, E. coli
agaatcggttcgtgttttgacacca

SEQ ID NO: 4728 - DNA, 25 bp, E. coli
acctgaattacagaatcggttcgag

SEQ ID NO: 4729 - DNA, 25 bp, E. coli
acctgaattacacaatcggttcgag

SEQ ID NO: 4730 - DNA, 25 bp, E. coli
agaatcggttcgagttttgacacca

SEQ ID NO: 4731 - DNA, 25 bp, E. coli
tagtctggatctgctgctggtcgtg

SEQ ID NO: 4732 - DNA, 25 bp, E. coli
tagtctggatctcctgctggtcgtg

SEQ ID NO: 4733 - DNA, 25 bp, E. coli
tttcgacgactccgctgtgggccgc

SEQ ID NO: 4734 - DNA, 25 bp, E. coli
tttcgacgactcggctgtgggccgc

SEQ ID NO: 4735 - DNA, 25 bp, E. coli
tgggccgcttgataacggcattgct

SEQ ID NO: 4736 - DNA, 25 bp, E. coli
tgggccgcttgaaaacggcattgct

SEQ ID NO: 4737 - DNA, 25 bp, E. coli
tctggatctgctgctggtcgtgttc

SEQ ID NO: 4738 - DNA, 25 bp, E. coli
tctggatctgctcctggtcgtgttc

SEQ ID NO: 4739 - DNA, 25 bp, E. coli
gccgtagtctggatctgctgctggt

SEQ ID NO: 4740 - DNA, 25 bp, E. coli
gccgtagtctggttctgctgctggt

SEQ ID NO: 4741 - DNA, 25 bp, E. coli
gctgtgggccgcttgaaaacggcat

SEQ ID NO: 4742 - DNA, 25 bp, E. coli
gctgtgggccgcatgaaaacggcat

SEQ ID NO: 4743 - DNA, 25 bp, E. coli
gcttgaaaacgggattgctgacctt

SEQ ID NO: 4744 - DNA, 25 bp, E. coli
gcttgaaaacggcattgctgacctt

SEQ ID NO: 4745 - DNA, 25 bp, E. coli
ggatctgctgctggtcgtgttctca

SEQ ID NO: 4746 - DNA, 25 bp, E. coli
ggatctgctgctcgtcgtgttctca

SEQ ID NO: 4747 - DNA, 25 bp, E. coli
cacctgatggtcgactttctgcgaa

SEQ ID NO: 4748 - DNA, 25 bp, E. coli
cacctgatggtccactttctgcgaa

SEQ ID NO: 4749 - DNA, 25 bp, E. coli
catatggtgctaataactggacgcc

SEQ ID NO: 4750 - DNA, 25 bp, E. coli
caggaaatctttcagcaacccgcga

SEQ ID NO: 4751 - DNA, 25 bp, E. coli
caggaaatctttgagcaacccgcga

SEQ ID NO: 4752 - DNA, 25 bp, E. coli
catatggtgctattaactggacgcc

SEQ ID NO: 4753 - DNA, 25 bp, E. coli
ttttgaccgtcacatagtagtcccc

SEQ ID NO: 4754 - DNA, 25 bp, E. coli
ttttgaccgtcagatagtagtcccc

SEQ ID NO: 4755 - DNA, 25 bp, E. coli
tatgccagcggtacaataacggtca

SEQ ID NO: 4756 - DNA, 25 bp, E. coli
tatgccagcggttcaataacggtca

SEQ ID NO: 4757 - DNA, 25 bp, E. coli
tggtgccggtgtagagaatactcct

SEQ ID NO: 4758 - DNA, 25 bp, E. coli
tgtacgatgaccaggcttttgaccg

SEQ ID NO: 4759 - DNA, 25 bp, E. coli
tgtacgatgacctggcttttgaccg

SEQ ID NO: 4760 - DNA, 25 bp, E. coli
tggtgccggtgttgagaatactcct

SEQ ID NO: 4761 - DNA, 25 bp, E. coli
tgaagaaatctagagccggtatcag

SEQ ID NO: 4762 - DNA, 25 bp, E. coli
tgaagaaatctacagccggtatcag

SEQ ID NO: 4763 - DNA, 25 bp, E. coli
cctttccgagaattggcagttatgc

SEQ ID NO: 4764 - DNA, 25 bp, E. coli
cctttccgagaaatggcagttatgc

SEQ ID NO: 4765 - DNA, 25 bp, E. coli
gacggatgtcaggagggtattttca

SEQ ID NO: 4766 - DNA, 25 bp, E. coli
gacggatgtcagcagggtattttca

SEQ ID NO: 4767 - DNA, 25 bp, E. coli
taagctgcaggtactgaagaacgga

SEQ ID NO: 4768 - DNA, 25 bp, E. coli
taagctgcaggttctgaagaacgga

SEQ ID NO: 4769 - DNA, 25 bp, E. coli
caggaaggtttcaccactgacggca

SEQ ID NO: 4770 - DNA, 25 bp, E. coli
caggaaggtttctccactgacggca

SEQ ID NO: 4771 - DNA, 25 bp, E. coli
tacaaggtgctgtcggataacccga

SEQ ID NO: 4772 - DNA, 25 bp, E. coli
tacaaggtgctgacggataacccga

SEQ ID NO: 4773 - DNA, 25 bp, E. coli
tgtccgacggtaaggcgctgttcca

SEQ ID NO: 4774 - DNA, 25 bp, E. coli
tgtccgacggtatggcgctgttcca

SEQ ID NO: 4775 - DNA, 25 bp, E. coli
tgaatgggctcggatgtcactgacg

SEQ ID NO: 4776 - DNA, 25 bp, E. coli
tgcggcagaccccaaaacctggtat

SEQ ID NO: 4777 - DNA, 25 bp, E. coli
tgcggcagacccgaaaacctggtat

SEQ ID NO: 4778 - DNA, 25 bp, E. coli
tgaatgggctcgcatgtcactgacg

SEQ ID NO: 4779 - DNA, 25 bp, E. coli
tctgaatatgctggtggacgtgccg

SEQ ID NO: 4780 - DNA, 25 bp, E. coli
tctgaatatgctcgtggacgtgccg

SEQ ID NO: 4781 - DNA, 25 bp, E. coli
gaaggcgatcgtgccctgaatatcc

SEQ ID NO: 4782 - DNA, 25 bp, E. coli
gaaggcgatcgtcccctgaatatcc

SEQ ID NO: 4783 - DNA, 25 bp, E. coli
gaaaatgtcgagtaggataacgcct

SEQ ID NO: 4784 - DNA, 25 bp, E. coli
gaaaatgtcgagaaggataacgcct

SEQ ID NO: 4785 - DNA, 25 bp, E. coli
gataacgcctattacgggatgaccc

SEQ ID NO: 4786 - DNA, 25 bp, E. coli
gataacgcctataacgggatgaccc

SEQ ID NO: 4787 - DNA, 25 bp, E. coli
tcagacttcaaaacagcgtatcgcg

SEQ ID NO: 4788 - DNA, 25 bp, E. coli
tcagacttcaaatcagcgtatcgcg

SEQ ID NO: 4789 - DNA, 25 bp, E. coli
gaccattgcactggccacttacggg

SEQ ID NO: 4790 - DNA, 25 bp, E. coli
gaccattgcactcgccacttacggg

SEQ ID NO: 4791 - DNA, 25 bp, E. coli
aagaatgtcaggtgtttaaacgcag

SEQ ID NO: 4792 - DNA, 25 bp, E. coli
caatgattattattctcgcgctgct

SEQ ID NO: 4793 - DNA, 25 bp, E. coli
aagaatgtcaggagtttaaacgcag

SEQ ID NO: 4794 - DNA, 25 bp, E. coli
caatgattattaatctcgcgctgct

SEQ ID NO: 4795 - DNA, 25 bp, E. coli
taaacgcagaaatgtgatcaatgtc

SEQ ID NO: 4796 - DNA, 25 bp, E. coli
taaaaatcagcaaaagtacccgagg

SEQ ID NO: 4797 - DNA, 25 bp, E. coli
taaacgcagaaaagtgatcaatgtc

SEQ ID NO: 4798 - DNA, 25 bp, E. coli
taaaaatcagcataagtacccgagg

SEQ ID NO: 4799 - DNA, 25 bp, E. coli
tagcgcgcaaccttatgtgcatatg

SEQ ID NO: 4800 - DNA, 25 bp, E. coli
tagcgcgcaaccatatgtgcatatg

SEQ ID NO: 4801 - DNA, 25 bp, E. coli
tcatttcagggattgcagtgccgcc

SEQ ID NO: 4802 - DNA, 25 bp, E. coli
tcatttcagggaatgcagtgccgcc

SEQ ID NO: 4803 - DNA, 25 bp, E. coli
gcccggtaaggttaagcgcaaatct

SEQ ID NO: 4804 - DNA, 25 bp, E. coli
gcccggtaaggtaaagcgcaaatct

SEQ ID NO: 4805 - DNA, 25 bp, E. coli
cgcaaatctgtggtttagcgcgcaa

SEQ ID NO: 4806 - DNA, 25 bp, E. coli
cgcgctgcttatactaattcccgag

SEQ ID NO: 4807 - DNA, 25 bp, E. coli
cgcaaatctgtgctttagcgcgcaa

SEQ ID NO: 4808 - DNA, 25 bp, E. coli
cgcgctgcttattctaattcccgag

SEQ ID NO: 4809 - DNA, 25 bp, E. coli
gttattaaaatgtggacctggtctc

SEQ ID NO: 4810 - DNA, 25 bp, E. coli
gttattaaaatgaggacctggtctc

SEQ ID NO: 4811 - DNA, 25 bp, E. coli
tgtcgttacggcataaatgaaactc

SEQ ID NO: 4812 - DNA, 25 bp, E. coli
tgtcgttacggcttaaatgaaactc

SEQ ID NO: 4813 - DNA, 25 bp, E. coli
aatccaggagagttcatgtactacc

SEQ ID NO: 4814 - DNA, 25 bp, E. coli
aatccaggagagatcatgtactacc

SEQ ID NO: 4815 - DNA, 25 bp, E. coli
cacaggaattaatcggacgcttgcc

SEQ ID NO: 4816 - DNA, 25 bp, E. coli
cacaggaattaaacggacgcttgcc

SEQ ID NO: 4817 - DNA, 25 bp, E. coli
attattggtgttcgcggcattgact

SEQ ID NO: 4818 - DNA, 25 bp, E. coli
acaggaattaaacggacgcttgccg

SEQ ID NO: 4819 - DNA, 25 bp, E. coli
acaggaattaaagggacgcttgccg

SEQ ID NO: 4820 - DNA, 25 bp, E. coli
attattggtgttggcggcattgact

SEQ ID NO: 4821 - DNA, 25 bp, E. coli
aggaattaaacgcacgcttgccgat

SEQ ID NO: 4822 - DNA, 25 bp, E. coli
aggaattaaacggacgcttgccgat

SEQ ID NO: 4823 - DNA, 25 bp, E. coli
aggagagttcatctactaccccttc

SEQ ID NO: 4824 - DNA, 25 bp, E. coli
aggagagttcatgtactaccccttc

SEQ ID NO: 4825 - DNA, 25 bp, E. coli
tccaggagagttcatgtactacccc

SEQ ID NO: 4826 - DNA, 25 bp, E. coli
tccaggagagttgatgtactacccc

SEQ ID NO: 4827 - DNA, 25 bp, E. coli
cgattattggtgttggcggcattga

SEQ ID NO: 4828 - DNA, 25 bp, E. coli
cgattattggtgatggcggcattga

SEQ ID NO: 4829 - DNA, 25 bp, E. coli
cttgccgattataggtgttggcggc

SEQ ID NO: 4830 - DNA, 25 bp, E. coli
cttgccgattattggtgttggcggc

SEQ ID NO: 4831 - DNA, 25 bp, E. coli
tcacaggaattatacggacgcttgc

SEQ ID NO: 4832 - DNA, 25 bp, E. coli
tcacaggaattaaacggacgcttgc

SEQ ID NO: 4833 - DNA, 25 bp, E. coli
gacgcttgccgaatattggtgttgg

SEQ ID NO: 4834 - DNA, 25 bp, E. coli
gacgcttgccgattattggtgttgg

SEQ ID NO: 4835 - DNA, 25 bp, E. coli
caattaccgcttactggtcgccgct

SEQ ID NO: 4836 - DNA, 25 bp, E. coli
caattaccgctttctggtcgccgct

SEQ ID NO: 4837 - DNA, 25 bp, E. coli
tactacctgtggaatgacgcaacgg

SEQ ID NO: 4838 - DNA, 25 bp, E. coli
taaattttccctcggcgcaggcgta

SEQ ID NO: 4839 - DNA, 25 bp, E. coli
tactacctgtggtatgacgcaacgg

SEQ ID NO: 4840 - DNA, 25 bp, E. coli
taaattttccctgggcgcaggcgta

SEQ ID NO: 4841 - DNA, 25 bp, E. coli
tatcgttacaccaacggtggcctga

SEQ ID NO: 4842 - DNA, 25 bp, E. coli
tagcgcacgctgtaggtaaattttc

SEQ ID NO: 4843 - DNA, 25 bp, E. coli
tagcgcacgctgaaggtaaattttc

SEQ ID NO: 4844 - DNA, 25 bp, E. coli
tatcgttacacctacggtggcctga

SEQ ID NO: 4845 - DNA, 25 bp, E. coli
ccgtgactccggctattggtgtgca

SEQ ID NO: 4846 - DNA, 25 bp, E. coli
ccgtgactccgggtattggtgtgca

SEQ ID NO: 4847 - DNA, 25 bp, E. coli
gataccgatgtttacccagtaccgg

SEQ ID NO: 4848 - DNA, 25 bp, E. coli
gataccgatgttaacccagtaccgg

SEQ ID NO: 4849 - DNA, 25 bp, E. coli
tggcgatcaccatatgcgtcacctg

SEQ ID NO: 4850 - DNA, 25 bp, E. coli
tggactggcctgttttctaccggga

SEQ ID NO: 4851 - DNA, 25 bp, E. coli
tggcgatcaccaaatgcgtcacctg

SEQ ID NO: 4852 - DNA, 25 bp, E. coli
tggactggcctgatttctaccggga

SEQ ID NO: 4853 - DNA, 25 bp, E. coli
tcacctggatgagcgtaagagcacc

SEQ ID NO: 4854 - DNA, 25 bp, E. coli
tcacctggatgaccgtaagagcacc

SEQ ID NO: 4855 - DNA, 25 bp, E. coli
gagtgcttatcggaacgtctgcagg

SEQ ID NO: 4856 - DNA, 25 bp, E. coli
gagtgcttatcgcaacgtctgcagg

SEQ ID NO: 4857 - DNA, 25 bp, E. coli
caaattgcgcaaccggcggatcgtc

SEQ ID NO: 4858 - DNA, 25 bp, E. coli
caaattgcgcaagcggcggatcgtc

SEQ ID NO: 4859 - DNA, 25 bp, E. coli
tatctgggaacgcaagaaggttcac

SEQ ID NO: 4860 - DNA, 25 bp, E. coli
tatctgggaacggaagaaggttcac

SEQ ID NO: 4861 - DNA, 25 bp, E. coli
tgtttaacctggacacaggcagcga

SEQ ID NO: 4862 - DNA, 25 bp, E. coli
tgtttaacctggtcacaggcagcga

SEQ ID NO: 4863 - DNA, 25 bp, E. coli
tgccgcgcatggtcgcaaaattcgt

SEQ ID NO: 4864 - DNA, 25 bp, E. coli
tgccgcgcatggacgcaaaattcgt

SEQ ID NO: 4865 - DNA, 25 bp, E. coli
tcacggttatctgcaacaaattgcg

SEQ ID NO: 4866 - DNA, 25 bp, E. coli
tcacggttatctccaacaaattgcg

SEQ ID NO: 4867 - DNA, 25 bp, E. coli
ccgcatctggaagaagcgtatcggg

SEQ ID NO: 4868 - DNA, 25 bp, E. coli
ccgcatctggaacaagcgtatcggg

SEQ ID NO: 4869 - DNA, 25 bp, E. coli
cgtctgcatgtgtttgttcgtgaaa

SEQ ID NO: 4870 - DNA, 25 bp, E. coli
cgtctgcatgtgattgttcgtgaaa

SEQ ID NO: 4871 - DNA, 25 bp, E. coli
ggcaagcgcgacaatctggagatca

SEQ ID NO: 4872 - DNA, 25 bp, E. coli
ggcaagcgcgactatctggagatca

SEQ ID NO: 4873 - DNA, 25 bp, E. coli
ggctgaagtttcttgtcgccctgcg

SEQ ID NO: 4874 - DNA, 25 bp, E. coli
tggcaggccgccgagcggttaatct

SEQ ID NO: 4875 - DNA, 25 bp, E. coli
ggctgaagtttcatgtcgccctgcg

SEQ ID NO: 4876 - DNA, 25 bp, E. coli
tggcaggccgcccagcggttaatct

SEQ ID NO: 4877 - DNA, 25 bp, E. coli
gagatcagcccctatttatgggcgg

SEQ ID NO: 4878 - DNA, 25 bp, E. coli
gagatcagccccaatttatgggcgg

SEQ ID NO: 4879 - DNA, 25 bp, E. coli
cagcaatattgcatggtcccgtgaa

SEQ ID NO: 4880 - DNA, 25 bp, E. coli
cactgttgttctcgctgggtattga

SEQ ID NO: 4881 - DNA, 25 bp, E. coli
cactgttgttctggctgggtattga

SEQ ID NO: 4882 - DNA, 25 bp, E. coli
cagcaatattgcttggtcccgtgaa

SEQ ID NO: 4883 - DNA, 25 bp, E. coli
tatgccagaacccatgcactgttgt

SEQ ID NO: 4884 - DNA, 25 bp, E. coli
tatgccagaaccgatgcactgttgt

SEQ ID NO: 4885 - DNA, 25 bp, E. coli
ttttatgctgcccaaaagcgagtcg

SEQ ID NO: 4886 - DNA, 25 bp, E. coli
ttttatgctgccgaaaagcgagtcg

SEQ ID NO: 4887 - DNA, 25 bp, E. coli
tcccgtgaagtgcttctgcgttgac

SEQ ID NO: 4888 - DNA, 25 bp, E. coli
tcccgtgaagtggttctgcgttgac

SEQ ID NO: 4889 - DNA, 25 bp, E. coli
ccttgaggccgtgctgaatgttgcg

SEQ ID NO: 4890 - DNA, 25 bp, E. coli
gcgcgttgcctcagacgaacttaac

SEQ ID NO: 4891 - DNA, 25 bp, E. coli
gcgcgttgcctctgacgaacttaac

SEQ ID NO: 4892 - DNA, 25 bp, E. coli
ccttcagtgcgaagatgattccgca

SEQ ID NO: 4893 - DNA, 25 bp, E. coli
ccttgaggccgtcctgaatgttgcg

SEQ ID NO: 4894 - DNA, 25 bp, E. coli
ccttcagtgcgatgatgattccgca

SEQ ID NO: 4895 - DNA, 25 bp, E. coli
gcaaaaatatcagcaggactgccag

SEQ ID NO: 4896 - DNA, 25 bp, E. coli
gcaaaaatatcaccaggactgccag

SEQ ID NO: 4897 - DNA, 25 bp, E. coli
gacttatggcgataaccgactgcgt

SEQ ID NO: 4898 - DNA, 25 bp, E. coli
gacttatggcgaaaaccgactgcgt

SEQ ID NO: 4899 - DNA, 25 bp, E. coli
cgcgctggccgcgtggcaaaaatat

SEQ ID NO: 4900 - DNA, 25 bp, E. coli
cgcgctggccgcctggcaaaaatat

SEQ ID NO: 4901 - DNA, 25 bp, E. coli
aatgcgcagccaaagctcagcctat

SEQ ID NO: 4902 - DNA, 25 bp, E. coli
aatgcgcagccatagctcagcctat

SEQ ID NO: 4903 - DNA, 25 bp, E. coli
aacgactggtgacagacgctgatga

SEQ ID NO: 4904 - DNA, 25 bp, E. coli
caggaaatattgaggctgtgcattg

SEQ ID NO: 4905 - DNA, 25 bp, E. coli
cagtggcgatcggtggtttcaacca

SEQ ID NO: 4906 - DNA, 25 bp, E. coli
cagtggcgatcgctggtttcaacca

SEQ ID NO: 4907 - DNA, 25 bp, E. coli
caggaaatattgtggctgtgcattg

SEQ ID NO: 4908 - DNA, 25 bp, E. coli
aacgactggtgagagacgctgatga

SEQ ID NO: 4909 - DNA, 25 bp, E. coli
aaaaatcaatgcgacctctgctggt

SEQ ID NO: 4910 - DNA, 25 bp, E. coli
aaaaatcaatgccacctctgctggt

SEQ ID NO: 4911 - DNA, 25 bp, E. coli
ttttgaactgggaatgacgttccca

SEQ ID NO: 4912 - DNA, 25 bp, E. coli
ttttgaactgggtatgacgttccca

SEQ ID NO: 4913 - DNA, 25 bp, E. coli
tattttcgggaactagtggagacgc

SEQ ID NO: 4914 - DNA, 25 bp, E. coli
tattttcgggaagtagtggagacgc

SEQ ID NO: 4915 - DNA, 25 bp, E. coli
tgttaccagctaacgaaaaatcaat

SEQ ID NO: 4916 - DNA, 25 bp, E. coli
tgttaccagctatcgaaaaatcaat

SEQ ID NO: 4917 - DNA, 25 bp, E. coli
tccggcagctgatataaccagggct

SEQ ID NO: 4918 - DNA, 25 bp, E. coli
tccggcagctgaaataaccagggct

SEQ ID NO: 4919 - DNA, 25 bp, E. coli
cgtggtggccctccaggaaatattg

SEQ ID NO: 4920 - DNA, 25 bp, E. coli
cgtggtggccctgcaggaaatattg

SEQ ID NO: 4921 - DNA, 25 bp, E. coli
gagagacgctgatgattttgtcgca

SEQ ID NO: 4922 - DNA, 25 bp, E. coli
gagagacgctgaagattttgtcgca

SEQ ID NO: 4923 - DNA, 25 bp, E. coli
catttgcgacatttgtcgatcctgg

SEQ ID NO: 4924 - DNA, 25 bp, E. coli
ctggcagccatcacaatatgcccgt

SEQ ID NO: 4925 - DNA, 25 bp, E. coli
catttgtcgatcctggcagccatct

SEQ ID NO: 4926 - DNA, 25 bp, E. coli
ctggcagccatctcaatatgcccgt

SEQ ID NO: 4927 - DNA, 25 bp, E. coli
catttgtcgatcgtggcagccatct

SEQ ID NO: 4928 - DNA, 25 bp, E. coli
tttctaccgcgccaattctgagcga

SEQ ID NO: 4929 - DNA, 25 bp, E. coli
tttgtcgatcctcgcagccatctca

SEQ ID NO: 4930 - DNA, 25 bp, E. coli
tttgtcgatcctggcagccatctca

SEQ ID NO: 4931 - DNA, 25 bp, E. coli
tttctaccgcgcgaattctgagcga

SEQ ID NO: 4932 - DNA, 25 bp, E. coli
tgtcgatcctggcagccatctcaat

SEQ ID NO: 4933 - DNA, 25 bp, E. coli
tgtcgatcctgggagccatctcaat

SEQ ID NO: 4934 - DNA, 25 bp, E. coli
tgcgacatttgtcgatcctggcagc

SEQ ID NO: 4935 - DNA, 25 bp, E. coli
tgcgacatttgtggatcctggcagc

SEQ ID NO: 4936 - DNA, 25 bp, E. coli
gacatttgtcgaacctggcagccat

SEQ ID NO: 4937 - DNA, 25 bp, E. coli
gacatttgtcgatcctggcagccat

SEQ ID NO: 4938 - DNA, 25 bp, E. coli
cgacatttgtcgttcctggcagcca

SEQ ID NO: 4939 - DNA, 25 bp, E. coli
cgacatttgtcgatcctggcagcca

SEQ ID NO: 4940 - DNA, 25 bp, E. coli
catttgcgacatatgtcgatcctgg

SEQ ID NO: 4941 - DNA, 25 bp, E. coli
ggcgctcatttcaaccgcgccaatt

SEQ ID NO: 4942 - DNA, 25 bp, E. coli
ggcgctcatttctaccgcgccaatt

SEQ ID NO: 4943 - DNA, 25 bp, E. coli
gatcctggcagcgatctcaatatgc

SEQ ID NO: 4944 - DNA, 25 bp, E. coli
gatcctggcagccatctcaatatgc

SEQ ID NO: 4945 - DNA, 25 bp, E. coli
gaccgtttcgttatccctgaaagct

SEQ ID NO: 4946 - DNA, 25 bp, E. coli
aaaagggcgctcatgaatcaatttc

SEQ ID NO: 4947 - DNA, 25 bp, E. coli
aaaagggcgctcttgaatcaatttc

SEQ ID NO: 4948 - DNA, 25 bp, E. coli
gaccgtttcgttttccctgaaagct

SEQ ID NO: 4949 - DNA, 25 bp, E. coli
tcattgctcaaaaaaggactcctcg

SEQ ID NO: 4950 - DNA, 25 bp, E. coli
tcattgctcaaataaggactcctcg

SEQ ID NO: 4951 - DNA, 25 bp, E. coli
gctaataaccagctacaaacggaaa

SEQ ID NO: 4952 - DNA, 25 bp, E. coli
gctaataaccaggtacaaacggaaa

SEQ ID NO: 4953 - DNA, 25 bp, E. coli
gctacaaacggataagggcgctcat

SEQ ID NO: 4954 - DNA, 25 bp, E. coli
gctacaaacggaaaagggcgctcat

SEQ ID NO: 4955 - DNA, 25 bp, E. coli
ccctgaaagctaaagacatgagtgc

SEQ ID NO: 4956 - DNA, 25 bp, E. coli
ccctgaaagctatagacatgagtgc

SEQ ID NO: 4957 - DNA, 25 bp, E. coli
ctacattaggtttgccgggaaggca

SEQ ID NO: 4958 - DNA, 25 bp, E. coli
ctacattaggttagccgggaaggca

SEQ ID NO: 4959 - DNA, 25 bp, E. coli
ggatatcctgataccgaccgtttcg

SEQ ID NO: 4960 - DNA, 25 bp, E. coli
ggactcctcgttggaaggcctcctg

SEQ ID NO: 4961 - DNA, 25 bp, E. coli
ggactcctcgttcgaaggcctcctg

SEQ ID NO: 4962 - DNA, 25 bp, E. coli
ggatatcctgattccgaccgtttcg

SEQ ID NO: 4963 - DNA, 25 bp, E. coli
ggcctcctgctgatggatatcctga

SEQ ID NO: 4964 - DNA, 25 bp, E. coli
ggcagacagccttatggatgaactt

SEQ ID NO: 4965 - DNA, 25 bp, E. coli
ggcagacagcctaatggatgaactt

SEQ ID NO: 4966 - DNA, 25 bp, E. coli
ggcctcctgctgttggatatcctga

SEQ ID NO: 4967 - DNA, 25 bp, E. coli
cacagttcgccacgctaagtgctcg

SEQ ID NO: 4968 - DNA, 25 bp, E. coli
cacagttcgccaggctaagtgctcg

SEQ ID NO: 4969 - DNA, 25 bp, E. coli
cagttcgccacgctaagtgctcgtt

SEQ ID NO: 4970 - DNA, 25 bp, E. coli
cagttcgccacggtaagtgctcgtt

SEQ ID NO: 4971 - DNA, 25 bp, E. coli
tgtgccccggtgtcacagttcgcca

SEQ ID NO: 4972 - DNA, 25 bp, E. coli
tgtgccccggtgacacagttcgcca

SEQ ID NO: 4973 - DNA, 25 bp, E. coli
tgaccgatctcgaggaacagcaaac

SEQ ID NO: 4974 - DNA, 25 bp, E. coli
tgaccgatctcgtggaacagcaaac

SEQ ID NO: 4975 - DNA, 25 bp, E. coli
cgcgggtgaccgttctcgtggaaca

SEQ ID NO: 4976 - DNA, 25 bp, E. coli
cgttgtgccccggtgtcacagttcg

SEQ ID NO: 4977 - DNA, 25 bp, E. coli
cgcgggtgaccgatctcgtggaaca

SEQ ID NO: 4978 - DNA, 25 bp, E. coli
cgttgtgccccgctgtcacagttcg

SEQ ID NO: 4979 - DNA, 25 bp, E. coli
cggtgtcacagtacgccacgctaag

SEQ ID NO: 4980 - DNA, 25 bp, E. coli
cggtgtcacagttcgccacgctaag

SEQ ID NO: 4981 - DNA, 25 bp, E. coli
gttcgccacgctaagtgctcgtttc

SEQ ID NO: 4982 - DNA, 25 bp, E. coli
gtcacagttcgccacgctaagtgct

SEQ ID NO: 4983 - DNA, 25 bp, E. coli
gttgtgccccggtgtcacagttcgc

SEQ ID NO: 4984 - DNA, 25 bp, E. coli
gttcgccacgcttagtgctcgtttc

SEQ ID NO: 4985 - DNA, 25 bp, E. coli
gtcacagttcgcgacgctaagtgct

SEQ ID NO: 4986 - DNA, 25 bp, E. coli
gttgtgccccggagtcacagttcgc

SEQ ID NO: 4987 - DNA, 25 bp, E. coli
ggtgtcacagttggccacgctaagt

SEQ ID NO: 4988 - DNA, 25 bp, E. coli
ggtgtcacagttcgccacgctaagt

SEQ ID NO: 4989 - DNA, 25 bp, E. coli
caagcagagctgattcgcgggtcga

SEQ ID NO: 4990 - DNA, 25 bp, E. coli
caagcagagctgtttcgcgggtcga

SEQ ID NO: 4991 - DNA, 25 bp, E. coli
taaaatcgttgctagtgggaccggg

SEQ ID NO: 4992 - DNA, 25 bp, E. coli
taaaatcgttgcaagtgggaccggg

SEQ ID NO: 4993 - DNA, 25 bp, E. coli
tatagcgatcgcatacaggcaggga

SEQ ID NO: 4994 - DNA, 25 bp, E. coli
tatcaggcctggacgcgtaaagagc

SEQ ID NO: 4995 - DNA, 25 bp, E. coli
tatcaggcctggtcgcgtaaagagc

SEQ ID NO: 4996 - DNA, 25 bp, E. coli
tatagcgatcgcttacaggcaggga

SEQ ID NO: 4997 - DNA, 25 bp, E. coli
ttaagccaggtcgaacagtttctcg

SEQ ID NO: 4998 - DNA, 25 bp, E. coli
tttttaatgtcgtcaccgggtcagg

SEQ ID NO: 4999 - DNA, 25 bp, E. coli
tttttaatgtcgacaccgggtcagg

SEQ ID NO: 5000 - DNA, 25 bp, E. coli
ttaagccaggtccaacagtttctcg

SEQ ID NO: 5001 - DNA, 25 bp, E. coli
tgttcattcctcgacgatgcgcagg

SEQ ID NO: 5002 - DNA, 25 bp, E. coli
tgttcattcctccacgatgcgcagg

SEQ ID NO: 5003 - DNA, 25 bp, E. coli
tgattaagccttgggaaaccacgcc

SEQ ID NO: 5004 - DNA, 25 bp, E. coli
tgattaagccttcggaaaccacgcc

SEQ ID NO: 5005 - DNA, 25 bp, E. coli
gaactggatgcgatataccgccggg

SEQ ID NO: 5006 - DNA, 25 bp, E. coli
gaactgctgctgatcacttaacgcg

SEQ ID NO: 5007 - DNA, 25 bp, E. coli
gaaattgcgtctactgctgatgcca

SEQ ID NO: 5008 - DNA, 25 bp, E. coli
gaactgctgctgttcacttaacgcg

SEQ ID NO: 5009 - DNA, 25 bp, E. coli
gaactggatgcgttataccgccggg

SEQ ID NO: 5010 - DNA, 25 bp, E. coli
gaaattgcgtcttctgctgatgcca

SEQ ID NO: 5011 - DNA, 25 bp, E. coli
cagacgtcgttttctccaacaggga

SEQ ID NO: 5012 - DNA, 25 bp, E. coli
cagacgtcgtttactccaacaggga

SEQ ID NO: 5013 - DNA, 25 bp, E. coli
tataaaaaccccaagcatgttcagg

SEQ ID NO: 5014 - DNA, 25 bp, E. coli
tagaggtcactattcattttccggg

SEQ ID NO: 5015 - DNA, 25 bp, E. coli
tataaaaacccctagcatgttcagg

SEQ ID NO: 5016 - DNA, 25 bp, E. coli
tagaggtcactaatcattttccggg

SEQ ID NO: 5017 - DNA, 25 bp, E. coli
tgttcagcaaaaacagtgtggcacc

SEQ ID NO: 5018 - DNA, 25 bp, E. coli
tgttcagcaaaatcagtgtggcacc

SEQ ID NO: 5019 - DNA, 25 bp, E. coli
tgcagcatgtgactcagataacccg

SEQ ID NO: 5020 - DNA, 25 bp, E. coli
tgcagcatgtgagtcagataacccg

SEQ ID NO: 5021 - DNA, 25 bp, E. coli
tcgttgcgtcgatggttactacacc

SEQ ID NO: 5022 - DNA, 25 bp, E. coli
tcgttgcgtcgaaggttactacacc

SEQ ID NO: 5023 - DNA, 25 bp, E. coli
ccagtattgatatggcgacagcact

SEQ ID NO: 5024 - DNA, 25 bp, E. coli
ccagtattgataaggcgacagcact

SEQ ID NO: 5025 - DNA, 25 bp, E. coli
gaaaaaatccttccgccggacagac

SEQ ID NO: 5026 - DNA, 25 bp, E. coli
gaaaaaatccttgcgccggacagac

SEQ ID NO: 5027 - DNA, 25 bp, E. coli
cccattacgtggagaaagatgcaga

SEQ ID NO: 5028 - DNA, 25 bp, E. coli
cccattacgtggtgaaagatgcaga

SEQ ID NO: 5029 - DNA, 25 bp, E. coli
gatatgcgggcataatacgtcagtt

SEQ ID NO: 5030 - DNA, 25 bp, E. coli
gatatgcgggcaaaatacgtcagtt

SEQ ID NO: 5031 - DNA, 25 bp, E. coli
gagatcccagtaattgatggccagg

SEQ ID NO: 5032 - DNA, 25 bp, E. coli
gagatcccagtatttgatggccagg

SEQ ID NO: 5033 - DNA, 25 bp, E. coli
taccattagaaattagtgaatcccc

SEQ ID NO: 5034 - DNA, 25 bp, E. coli
taccattagaaaatagtgaatcccc

SEQ ID NO: 5035 - DNA, 25 bp, E. coli
tattaaccagaaaagattcaatcgt

SEQ ID NO: 5036 - DNA, 25 bp, E. coli
tattgcccgccggtatttatagtga

SEQ ID NO: 5037 - DNA, 25 bp, E. coli
tattgcccgccgctatttatagtga

SEQ ID NO: 5038 - DNA, 25 bp, E. coli
tattaaccagaatagattcaatcgt

SEQ ID NO: 5039 - DNA, 25 bp, E. coli
tgctgcaactaaacctctgataatt

SEQ ID NO: 5040 - DNA, 25 bp, E. coli
tgctgcaactaatcctctgataatt

SEQ ID NO: 5041 - DNA, 25 bp, E. coli
tcagaatgcatcactttcgtttgct

SEQ ID NO: 5042 - DNA, 25 bp, E. coli
tctatgacagatcaaactggctcag

SEQ ID NO: 5043 - DNA, 25 bp, E. coli
tcagaatgcatctctttcgtttgct

SEQ ID NO: 5044 - DNA, 25 bp, E. coli
tctatgacagatgaaactggctcag

SEQ ID NO: 5045 - DNA, 25 bp, E. coli
gcagcagtacgcttcctgaacgcta

SEQ ID NO: 5046 - DNA, 25 bp, E. coli
gcagcagtacgcatcctgaacgcta

SEQ ID NO: 5047 - DNA, 25 bp, E. coli
gacacagcttaagcccggtggatgg

SEQ ID NO: 5048 - DNA, 25 bp, E. coli
gacacagcttaaccccggtggatgg

SEQ ID NO: 5049 - DNA, 25 bp, E. coli
cggtggatgggaaatattgcccgcc

SEQ ID NO: 5050 - DNA, 25 bp, E. coli
cggtggatgggatatattgcccgcc

SEQ ID NO: 5051 - DNA, 25 bp, E. coli
gggcgtgatgggtgatattcttaat

SEQ ID NO: 5052 - DNA, 25 bp, E. coli
gggcgtgatgggagatattcttaat

SEQ ID NO: 5053 - DNA, 25 bp, E. coli
taatattcatgctgggacacagctt

SEQ ID NO: 5054 - DNA, 25 bp, E. coli
taatattcatgcagggacacagctt

SEQ ID NO: 5055 - DNA, 25 bp, E. coli
caacggctattttcatggtcgcccg

SEQ ID NO: 5056 - DNA, 25 bp, E. coli
caatggtggtttgcctggcaggcca

SEQ ID NO: 5057 - DNA, 25 bp, E. coli
caatggtggtttccctggcaggcca

SEQ ID NO: 5058 - DNA, 25 bp, E. coli
caacggctatttacatggtcgcccg

SEQ ID NO: 5059 - DNA, 25 bp, E. coli
tggtgaaatataacggccagccggt

SEQ ID NO: 5060 - DNA, 25 bp, E. coli
tgatcgcaaaatacagccaacaacc

SEQ ID NO: 5061 - DNA, 25 bp, E. coli
tgatcgcaaaattcagccaacaacc

SEQ ID NO: 5062 - DNA, 25 bp, E. coli
tggtgaaatatatcggccagccggt

SEQ ID NO: 5063 - DNA, 25 bp, E. coli
tctttctgttattgattactggcgg

SEQ ID NO: 5064 - DNA, 25 bp, E. coli
tctttctgttatagattactggcgg

SEQ ID NO: 5065 - DNA, 25 bp, E. coli
gctcacgcaactgatcgcaaaatac

SEQ ID NO: 5066 - DNA, 25 bp, E. coli
ccacaggcttctcgcgggagcaatc

SEQ ID NO: 5067 - DNA, 25 bp, E. coli
ccacaggcttctggcgggagcaatc

SEQ ID NO: 5068 - DNA, 25 bp, E. coli
gcgaaagcgcgttatctcagcgttg

SEQ ID NO: 5069 - DNA, 25 bp, E. coli
gctcacgcaactcatcgcaaaatac

SEQ ID NO: 5070 - DNA, 25 bp, E. coli
gcgaaagcgcgtaatctcagcgttg

SEQ ID NO: 5071 - DNA, 25 bp, E. coli
ctattttcatggacgcccgtcggca

SEQ ID NO: 5072 - DNA, 25 bp, E. coli
ctattttcatggtcgcccgtcggca

SEQ ID NO: 5073 - DNA, 25 bp, E. coli
taatccacaggcatctggcgggagc

SEQ ID NO: 5074 - DNA, 25 bp, E. coli
taatctcagcgtagaacagctcacg

SEQ ID NO: 5075 - DNA, 25 bp, E. coli
taatctcagcgttgaacagctcacg

SEQ ID NO: 5076 - DNA, 25 bp, E. coli
taatccacaggcttctggcgggagc

SEQ ID NO: 5077 - DNA, 25 bp, E. coli
ataaagagactgaaaaaacatcagc

SEQ ID NO: 5078 - DNA, 25 bp, E. coli
ataaagagactgtaaaaacatcagc

SEQ ID NO: 5079 - DNA, 25 bp, E. coli
acatcagcgatgtcgaccacacact

SEQ ID NO: 5080 - DNA, 25 bp, E. coli
acatcagcgatgacgaccacacact

SEQ ID NO: 5081 - DNA, 25 bp, E. coli
aaaaacatcagcgatgacgaccaca

SEQ ID NO: 5082 - DNA, 25 bp, E. coli
aaacatcagcgaagacgaccacaca

SEQ ID NO: 5083 - DNA, 25 bp, E. coli
aaacatcagcgatgacgaccacaca

SEQ ID NO: 5084 - DNA, 25 bp, E. coli
aaaaacatcagccatgacgaccaca

SEQ ID NO: 5085 - DNA, 25 bp, E. coli
tttccatttcggctggtggaagtga

SEQ ID NO: 5086 - DNA, 25 bp, E. coli
tttccatttcgggtggtggaagtga

SEQ ID NO: 5087 - DNA, 25 bp, E. coli
tgagaggagctataaagagactgaa

SEQ ID NO: 5088 - DNA, 25 bp, E. coli
tgacgaccacacactctacaaaact

SEQ ID NO: 5089 - DNA, 25 bp, E. coli
tgacgaccacactctctacaaaact

SEQ ID NO: 5090 - DNA, 25 bp, E. coli
tgagaggagctaaaaagagactgaa

SEQ ID NO: 5091 - DNA, 25 bp, E. coli
gcattttccatttcgggtggtggaa

SEQ ID NO: 5092 - DNA, 25 bp, E. coli
gcattttccattacgggtggtggaa

SEQ ID NO: 5093 - DNA, 25 bp, E. coli
gaagtgagaggagctataaagagac

SEQ ID NO: 5094 - DNA, 25 bp, E. coli
gaagtgagaggacctataaagagac

SEQ ID NO: 5095 - DNA, 25 bp, E. coli
gaggagctataatgagactgaaaaa

SEQ ID NO: 5096 - DNA, 25 bp, E. coli
gaccacacactcaacaaaacttcag

SEQ ID NO: 5097 - DNA, 25 bp, E. coli
gaccacacactctacaaaacttcag

SEQ ID NO: 5098 - DNA, 25 bp, E. coli
gaggagctataaagagactgaaaaa

SEQ ID NO: 5099 - DNA, 25 bp, E. coli
aattgatcagtatggccatagtgcg

SEQ ID NO: 5100 - DNA, 25 bp, E. coli
aattgatcagtaaggccatagtgcg

SEQ ID NO: 5101 - DNA, 25 bp, E. coli
tgctggcagtgaacgcctggatcat

SEQ ID NO: 5102 - DNA, 25 bp, E. coli
tccgttttggtattctgagctcata

SEQ ID NO: 5103 - DNA, 25 bp, E. coli
tccgttttggtaatctgagctcata

SEQ ID NO: 5104 - DNA, 25 bp, E. coli
tgctggcagtgatcgcctggatcat

SEQ ID NO: 5105 - DNA, 25 bp, E. coli
tcagtatgcggctgaatgggttgct

SEQ ID NO: 5106 - DNA, 25 bp, E. coli
tcagtatgcggcagaatgggttgct

SEQ ID NO: 5107 - DNA, 25 bp, E. coli
cctggatcattgaaggaaaggcatt

SEQ ID NO: 5108 - DNA, 25 bp, E. coli
ccatagtgcggtgtaattatagaca

SEQ ID NO: 5109 - DNA, 25 bp, E. coli
ccatagtgcggtctaattatagaca

SEQ ID NO: 5110 - DNA, 25 bp, E. coli
cctggatcattgtaggaaaggcatt

SEQ ID NO: 5111 - DNA, 25 bp, E. coli
gcgcaaatagttgtcaaccctggtg

SEQ ID NO: 5112 - DNA, 25 bp, E. coli
gcgcaaatagttctcaaccctggtg

SEQ ID NO: 5113 - DNA, 25 bp, E. coli
taaggtgaaaaaagataatgccgac

SEQ ID NO: 5114 - DNA, 25 bp, E. coli
taaacaaaatcgacacctcaaagtg

SEQ ID NO: 5115 - DNA, 25 bp, E. coli
taaacaaaatcgtcacctcaaagtg

SEQ ID NO: 5116 - DNA, 25 bp, E. coli
tcaaccacagggatcagcaataatc

SEQ ID NO: 5117 - DNA, 25 bp, E. coli
tcaaccacagggttcagcaataatc

SEQ ID NO: 5118 - DNA, 25 bp, E. coli
taaggtgaaaaatgataatgccgac

SEQ ID NO: 5119 - DNA, 25 bp, E. coli
gagctcataggttatttgaccagga

SEQ ID NO: 5120 - DNA, 25 bp, E. coli
gagctcataggtaatttgaccagga

SEQ ID NO: 5121 - DNA, 25 bp, E. coli
catttagtctgttcctgaaaggagc

SEQ ID NO: 5122 - DNA, 25 bp, E. coli
catttagtctgtacctgaaaggagc

SEQ ID NO: 5123 - DNA, 25 bp, E. coli
tatcgtcgcctggttctcactggtg

SEQ ID NO: 5124 - DNA, 25 bp, E. coli
tattggtgacacacggtaatccgac

SEQ ID NO: 5125 - DNA, 25 bp, E. coli
tatcgtcgcctgcttctcactggtg

SEQ ID NO: 5126 - DNA, 25 bp, E. coli
tattggtgacactcggtaatccgac

SEQ ID NO: 5127 - DNA, 25 bp, E. coli
ttaattggcggtccaaaagccagca

SEQ ID NO: 5128 - DNA, 25 bp, E. coli
ttaattggcggtgcaaaagccagca

SEQ ID NO: 5129 - DNA, 25 bp, E. coli
tatttggtggtctttggtacgtccc

SEQ ID NO: 5130 - DNA, 25 bp, E. coli
tatttggtggtcattggtacgtccc

SEQ ID NO: 5131 - DNA, 25 bp, E. coli
tcatggagcaaacccagatgtcgtc

SEQ ID NO: 5132 - DNA, 25 bp, E. coli
tcatggagcaaagccagatgtcgtc

SEQ ID NO: 5133 - DNA, 25 bp, E. coli
gactggctgggaacgctgctgattc

SEQ ID NO: 5134 - DNA, 25 bp, E. coli
gaaaaataaatcctccggcgcggca

SEQ ID NO: 5135 - DNA, 25 bp, E. coli
gaaaaataaatcgtccggcgcggca

SEQ ID NO: 5136 - DNA, 25 bp, E. coli
gattttttccgtggttggcgcgcta

SEQ ID NO: 5137 - DNA, 25 bp, E. coli
gattttttccgtcgttggcgcgcta

SEQ ID NO: 5138 - DNA, 25 bp, E. coli
ggtctgcgcgcattacatcatggag

SEQ ID NO: 5139 - DNA, 25 bp, E. coli
ggtctgcgcgcaatacatcatggag

SEQ ID NO: 5140 - DNA, 25 bp, E. coli
gatgctgaacgttctgattgccgcc

SEQ ID NO: 5141 - DNA, 25 bp, E. coli
gatgctgaacgtactgattgccgcc

SEQ ID NO: 5142 - DNA, 25 bp, E. coli
gactggctgggatcgctgctgattc

SEQ ID NO: 5143 - DNA, 25 bp, E. coli
tgattgcccggatatgcggcgtgcc

SEQ ID NO: 5144 - DNA, 25 bp, E. coli
tgattgcccggaaatgcggcgtgcc

SEQ ID NO: 5145 - DNA, 25 bp, E. coli
tgaactcatgggtacgcaaagcgat

SEQ ID NO: 5146 - DNA, 25 bp, E. coli
tgaactcatgggaacgcaaagcgat

SEQ ID NO: 5147 - DNA, 25 bp, E. coli
gcaaagcgatatcgaaaacgttcgt

SEQ ID NO: 5148 - DNA, 25 bp, E. coli
gcaaagcgatatggaaaacgttcgt

SEQ ID NO: 5149 - DNA, 25 bp, E. coli
gacgagccttacttcctgatcgtgc

SEQ ID NO: 5150 - DNA, 25 bp, E. coli
gacgagccttacatcctgatcgtgc

SEQ ID NO: 5151 - DNA, 25 bp, E. coli
cgcggtgcgcatcccgctcaatgag

SEQ ID NO: 5152 - DNA, 25 bp, E. coli
cgcggtgcgcatgccgctcaatgag

SEQ ID NO: 5153 - DNA, 25 bp, E. coli
cgccggagatgtcattgcccggaaa

SEQ ID NO: 5154 - DNA, 25 bp, E. coli
cgccggagatgtgattgcccggaaa

SEQ ID NO: 5155 - DNA, 25 bp, E. coli
cggattcaggtacacgagccttaca

SEQ ID NO: 5156 - DNA, 25 bp, E. coli
ctgatcgtgccctcttacggcggcg

SEQ ID NO: 5157 - DNA, 25 bp, E. coli
ctgatcgtgcccacttacggcggcg

SEQ ID NO: 5158 - DNA, 25 bp, E. coli
cggattcaggtagacgagccttaca

SEQ ID NO: 5159 - DNA, 25 bp, E. coli
cgcagcgttttatcgaacgtttagg

SEQ ID NO: 5160 - DNA, 25 bp, E. coli
cgcagcgttttaacgaacgtttagg

SEQ ID NO: 5161 - DNA, 25 bp, E. coli
tcaatgagcgggtacggattcaggt

SEQ ID NO: 5162 - DNA, 25 bp, E. coli
tcaatgagcgggaacggattcaggt

SEQ ID NO: 5163 - DNA, 25 bp, E. coli
gagtaaccgaattttggcaacgaca

SEQ ID NO: 5164 - DNA, 25 bp, E. coli
gagtaaccgaatattggcaacgaca

SEQ ID NO: 5165 - DNA, 25 bp, E. coli
aatatgcgttgtaatggtgtagcgc

SEQ ID NO: 5166 - DNA, 25 bp, E. coli
aatatgcgttgttatggtgtagcgc

SEQ ID NO: 5167 - DNA, 25 bp, E. coli
caaacattacagtggttggcggagg

SEQ ID NO: 5168 - DNA, 25 bp, E. coli
ccttttgatccctcctgagggtctt

SEQ ID NO: 5169 - DNA, 25 bp, E. coli
caaacattacagaggttggcggagg

SEQ ID NO: 5170 - DNA, 25 bp, E. coli
ccttttgatcccacctgagggtctt

SEQ ID NO: 5171 - DNA, 25 bp, E. coli
attacccgacgcgagccaaaattgg

SEQ ID NO: 5172 - DNA, 25 bp, E. coli
attacccgacgccagccaaaattgg

SEQ ID NO: 5173 - DNA, 25 bp, E. coli
ttggcggaggagacattacccgacg

SEQ ID NO: 5174 - DNA, 25 bp, E. coli
ttggcggaggagtcattacccgacg

SEQ ID NO: 5175 - DNA, 25 bp, E. coli
tcaccttttgatcccacctgagggt

SEQ ID NO: 5176 - DNA, 25 bp, E. coli
tcaccttttgatgccacctgagggt

SEQ ID NO: 5177 - DNA, 25 bp, E. coli
ccagccaaaattggcactggacggt

SEQ ID NO: 5178 - DNA, 25 bp, E. coli
ccagccaaaattcgcactggacggt

SEQ ID NO: 5179 - DNA, 25 bp, E. coli
gacgccagccaaaattggcactgga

SEQ ID NO: 5180 - DNA, 25 bp, E. coli
cgttgttatggtgtagcgcctcacg

SEQ ID NO: 5181 - DNA, 25 bp, E. coli
cgttgttatggtctagcgcctcacg

SEQ ID NO: 5182 - DNA, 25 bp, E. coli
ggcatcgcgttctggcaaacgctta

SEQ ID NO: 5183 - DNA, 25 bp, E. coli
ggcatcgcgttcaggcaaacgctta

SEQ ID NO: 5184 - DNA, 25 bp, E. coli
tcaccgcgcaaacattacagtggtt

SEQ ID NO: 5185 - DNA, 25 bp, E. coli
tcaccgcgcaaagattacagtggtt

SEQ ID NO: 5186 - DNA, 25 bp, E. coli
gacgccagccaatattggcactgga

SEQ ID NO: 5187 - DNA, 25 bp, E. coli
agcgttaaacccaaactggcctgag

SEQ ID NO: 5188 - DNA, 25 bp, E. coli
agcgttaaaccctaactggcctgag

SEQ ID NO: 5189 - DNA, 25 bp, E. coli
taccgcccgggacacatgatttttg

SEQ ID NO: 5190 - DNA, 25 bp, E. coli
taccgcccgggagacatgatttttg

SEQ ID NO: 5191 - DNA, 25 bp, E. coli
tttgagcacagcagaaacgtatccc

SEQ ID NO: 5192 - DNA, 25 bp, E. coli
tttgagcacagctgaaacgtatccc

SEQ ID NO: 5193 - DNA, 25 bp, E. coli
ttgtcgatcctgaagtacctgcctg

SEQ ID NO: 5194 - DNA, 25 bp, E. coli
ttgtcgatcctgtagtacctgcctg

SEQ ID NO: 5195 - DNA, 25 bp, E. coli
tgggacacagcgatatctcaaagcg

SEQ ID NO: 5196 - DNA, 25 bp, E. coli
tgggacacagcgttatctcaaagcg

SEQ ID NO: 5197 - DNA, 25 bp, E. coli
tgcctgccacggtgacgacgttatt

SEQ ID NO: 5198 - DNA, 25 bp, E. coli
tgcctgccacggagacgacgttatt

SEQ ID NO: 5199 - DNA, 25 bp, E. coli
tcatatcatgggaacaggccggagc

SEQ ID NO: 5200 - DNA, 25 bp, E. coli
tcatatcatgggtacaggccggagc

SEQ ID NO: 5201 - DNA, 25 bp, E. coli
ccggagcatggaaagaagttggata

SEQ ID NO: 5202 - DNA, 25 bp, E. coli
ccggagcatggatagaagttggata

SEQ ID NO: 5203 - DNA, 25 bp, E. coli
gtatccctgccctgtaccctgtggg

SEQ ID NO: 5204 - DNA, 25 bp, E. coli
gtatccctgcccagtaccctgtggg

SEQ ID NO: 5205 - DNA, 25 bp, E. coli
tcaatgattgatcagtaccgcccgg

SEQ ID NO: 5206 - DNA, 25 bp, E. coli
tcaatgattgatgagtaccgcccgg

SEQ ID NO: 5207 - DNA, 25 bp, E. coli
gatgcacgatacaggtgaaaccacc

SEQ ID NO: 5208 - DNA, 25 bp, E. coli
gatgcacgatactggtgaaaccacc

SEQ ID NO: 5209 - DNA, 25 bp, E. coli
caatccttttacaggtagacggcaa

SEQ ID NO: 5210 - DNA, 25 bp, E. coli
caatccttttactggtagacggcaa

SEQ ID NO: 5211 - DNA, 25 bp, E. coli
aacgcgctgggatcgaaattttgcg

SEQ ID NO: 5212 - DNA, 25 bp, E. coli
caaagaatatgtgctcatgacgcat

SEQ ID NO: 5213 - DNA, 25 bp, E. coli
caaagaatatgtcctcatgacgcat

SEQ ID NO: 5214 - DNA, 25 bp, E. coli
aaattttgcgatgccagcgcgcacc

SEQ ID NO: 5215 - DNA, 25 bp, E. coli
aaattttgcgatcccagcgcgcacc

SEQ ID NO: 5216 - DNA, 25 bp, E. coli
aacgcgctgggaacgaaattttgcg

SEQ ID NO: 5217 - DNA, 25 bp, E. coli
tgcaatttacggtataccgcagtcg

SEQ ID NO: 5218 - DNA, 25 bp, E. coli
tgcaatttacggaataccgcagtcg

SEQ ID NO: 5219 - DNA, 25 bp, E. coli
gcattagattttttgctcgacggga

SEQ ID NO: 5220 - DNA, 25 bp, E. coli
gcattagattttatgctcgacggga

SEQ ID NO: 5221 - DNA, 25 bp, E. coli
cgcaccgaacgtagattaaaggagc

SEQ ID NO: 5222 - DNA, 25 bp, E. coli
cgcaccgaacgttgattaaaggagc

SEQ ID NO: 5223 - DNA, 25 bp, E. coli
gtattcgcccaccagaacggcttaa

SEQ ID NO: 5224 - DNA, 25 bp, E. coli
gtattcgcccacgagaacggcttaa

SEQ ID NO: 5225 - DNA, 25 bp, E. coli
taacacctattgtacgatttagccg

SEQ ID NO: 5226 - DNA, 25 bp, E. coli
taacacctattgaacgatttagccg

SEQ ID NO: 5227 - DNA, 25 bp, E. coli
gacgcatgagacagcaactgttcca

SEQ ID NO: 5228 - DNA, 25 bp, E. coli
gatgttaccagccacattattggtg

SEQ ID NO: 5229 - DNA, 25 bp, E. coli
gacgcatgagactgcaactgttcca

SEQ ID NO: 5230 - DNA, 25 bp, E. coli
gatgttaccagcgacattattggtg

SEQ ID NO: 5231 - DNA, 25 bp, E. coli
ttttgaaggtcgtgaagccccacct

SEQ ID NO: 5232 - DNA, 25 bp, E. coli
ttttgaaggtcgagaagccccacct

SEQ ID NO: 5233 - DNA, 25 bp, E. coli
tgatcctagggagggaagcaccttc

SEQ ID NO: 5234 - DNA, 25 bp, E. coli
tgatcctagggacggaagcaccttc

SEQ ID NO: 5235 - DNA, 25 bp, E. coli
tgactgatgaaatgacggcgtacga

SEQ ID NO: 5236 - DNA, 25 bp, E. coli
tgactgatgaaaagacggcgtacga

SEQ ID NO: 5237 - DNA, 25 bp, E. coli
gcattaatgtctggcgcgccagtaa

SEQ ID NO: 5238 - DNA, 25 bp, E. coli
gcattaatgtctcgcgcgccagtaa

SEQ ID NO: 5239 - DNA, 25 bp, E. coli
gaatatcatgaaaggtgctggcagc

SEQ ID NO: 5240 - DNA, 25 bp, E. coli
gaatatcatgaatggtgctggcagc

SEQ ID NO: 5241 - DNA, 25 bp, E. coli
gacgaagaccctgactttgaggcaa

SEQ ID NO: 5242 - DNA, 25 bp, E. coli
gacgaagaccctcactttgaggcaa

SEQ ID NO: 5243 - DNA, 25 bp, E. coli
cgtatttgcccaaatgcgcggtgaa

SEQ ID NO: 5244 - DNA, 25 bp, E. coli
cgtatttgcccatatgcgcggtgaa

SEQ ID NO: 5245 - DNA, 25 bp, E. coli
gataaatggctaaaatcaacgcgtg

SEQ ID NO: 5246 - DNA, 25 bp, E. coli
gataaatggctataatcaacgcgtg

SEQ ID NO: 5247 - DNA, 25 bp, E. coli
tctggagtaattgaacaccttggct

SEQ ID NO: 5248 - DNA, 25 bp, E. coli
tctggagtaattcaacaccttggct

SEQ ID NO: 5249 - DNA, 25 bp, E. coli
ggcgccgcgcatctcaaagagttga

SEQ ID NO: 5250 - DNA, 25 bp, E. coli
ggcgccgcgcatgtcaaagagttga

SEQ ID NO: 5251 - DNA, 25 bp, E. coli
gatgatgacgacttactgagcaaca

SEQ ID NO: 5252 - DNA, 25 bp, E. coli
gatgatgacgacatactgagcaaca

SEQ ID NO: 5253 - DNA, 25 bp, E. coli
caacgcaggctgacaaacgataaaa

SEQ ID NO: 5254 - DNA, 25 bp, E. coli
cacatgaggtaaattgcatcaatgg

SEQ ID NO: 5255 - DNA, 25 bp, E. coli
caacgcaggctgtcaaacgataaaa

SEQ ID NO: 5256 - DNA, 25 bp, E. coli
cacatgaggtaatttgcatcaatgg

SEQ ID NO: 5257 - DNA, 25 bp, E. coli
catctcatagctcaaattttgccgc

SEQ ID NO: 5258 - DNA, 25 bp, E. coli
catctcatagctgaaattttgccgc

SEQ ID NO: 5259 - DNA, 25 bp, E. coli
catctaaaaatgaaggtgaattgag

SEQ ID NO: 5260 - DNA, 25 bp, E. coli
catctaaaaatgtaggtgaattgag

SEQ ID NO: 5261 - DNA, 25 bp, E. coli
tacacttaagcgaaaaatgaggtga

SEQ ID NO: 5262 - DNA, 25 bp, E. coli
tacacttaagcgtaaaatgaggtga

SEQ ID NO: 5263 - DNA, 25 bp, E. coli
tggttcactttacctcatctcatag

SEQ ID NO: 5264 - DNA, 25 bp, E. coli
ccttcccctgtgattaacctgatga

SEQ ID NO: 5265 - DNA, 25 bp, E. coli
ccttcccctgtgtttaacctgatga

SEQ ID NO: 5266 - DNA, 25 bp, E. coli
gcatcaatggagtgatttacatcta

SEQ ID NO: 5267 - DNA, 25 bp, E. coli
gcatcaatggagagatttacatcta

SEQ ID NO: 5268 - DNA, 25 bp, E. coli
gaattgagatatcgttcactttagc

SEQ ID NO: 5269 - DNA, 25 bp, E. coli
gaattgagatatggttcactttagc

SEQ ID NO: 5270 - DNA, 25 bp, E. coli
gataaaatttgcgtttcacatgagg

SEQ ID NO: 5271 - DNA, 25 bp, E. coli
gataaaatttgcctttcacatgagg

SEQ ID NO: 5272 - DNA, 25 bp, E. coli
gattaacctgatcatattggacaaa

SEQ ID NO: 5273 - DNA, 25 bp, E. coli
gattaacctgatgatattggacaaa

SEQ ID NO: 5274 - DNA, 25 bp, E. coli
tggttcactttagctcatctcatag

SEQ ID NO: 5275 - DNA, 25 bp, E. coli
cacccattgacaatgtttttggcgg

SEQ ID NO: 5276 - DNA, 25 bp, E. coli
cacccattgacattgtttttggcgg

SEQ ID NO: 5277 - DNA, 25 bp, E. coli
attgacaatgtttttggcggtggca

SEQ ID NO: 5278 - DNA, 25 bp, E. coli
attgacaatgttattggcggtggca

SEQ ID NO: 5279 - DNA, 25 bp, E. coli
tgtttttggcggtggcatgatgcgc

SEQ ID NO: 5280 - DNA, 25 bp, E. coli
tgtttttggcggaggcatgatgcgc

SEQ ID NO: 5281 - DNA, 25 bp, E. coli
tgacaatgttttaggcggtggcatg

SEQ ID NO: 5282 - DNA, 25 bp, E. coli
tgacaatgtttttggcggtggcatg

SEQ ID NO: 5283 - DNA, 25 bp, E. coli
tcacccattgacaatgtttttggcg

SEQ ID NO: 5284 - DNA, 25 bp, E. coli
gacaatgtttttggcggtggcatga

SEQ ID NO: 5285 - DNA, 25 bp, E. coli
gacaatgtttttcgcggtggcatga

SEQ ID NO: 5286 - DNA, 25 bp, E. coli
cccattgacaatctttttggcggtg

SEQ ID NO: 5287 - DNA, 25 bp, E. coli
cgcgtattttcagccattgacaatg

SEQ ID NO: 5288 - DNA, 25 bp, E. coli
cccattgacaatgtttttggcggtg

SEQ ID NO: 5289 - DNA, 25 bp, E. coli
cgcgtattttcacccattgacaatg

SEQ ID NO: 5290 - DNA, 25 bp, E. coli
cgtattttcacccattgacaatgtt

SEQ ID NO: 5291 - DNA, 25 bp, E. coli
cgtattttcaccgattgacaatgtt

SEQ ID NO: 5292 - DNA, 25 bp, E. coli
cattgacaatgtttttggcggtggc

SEQ ID NO: 5293 - DNA, 25 bp, E. coli
cattgacaatgtatttggcggtggc

SEQ ID NO: 5294 - DNA, 25 bp, E. coli
gtattttcaccctttgacaatgttt

SEQ ID NO: 5295 - DNA, 25 bp, E. coli
gtattttcacccattgacaatgttt

SEQ ID NO: 5296 - DNA, 25 bp, E. coli
tcacccattgactatgtttttggcg

SEQ ID NO: 5297 - DNA, 25 bp, E. coli
gaaggaagtttctgttcaccgtgaa

SEQ ID NO: 5298 - DNA, 25 bp, E. coli
gaaggaagtttcagttcaccgtgaa

SEQ ID NO: 5299 - DNA, 25 bp, E. coli
taaagggcaaccaggtacgtattgg

SEQ ID NO: 5300 - DNA, 25 bp, E. coli
tacgtattggcgtaaatgccccgaa

SEQ ID NO: 5301 - DNA, 25 bp, E. coli
taaagggcaacctggtacgtattgg

SEQ ID NO: 5302 - DNA, 25 bp, E. coli
tacgtattggcgaaaatgccccgaa

SEQ ID NO: 5303 - DNA, 25 bp, E. coli
tgttcaccgtgatgagatctaccag

SEQ ID NO: 5304 - DNA, 25 bp, E. coli
tgttcaccgtgaagagatctaccag

SEQ ID NO: 5305 - DNA, 25 bp, E. coli
tgctgattctgactcgtcgagttgg

SEQ ID NO: 5306 - DNA, 25 bp, E. coli
tgctgattctgagtcgtcgagttgg

SEQ ID NO: 5307 - DNA, 25 bp, E. coli
tcgtcgagttggagagaccctcatg

SEQ ID NO: 5308 - DNA, 25 bp, E. coli
tcgtcgagttggtgagaccctcatg

SEQ ID NO: 5309 - DNA, 25 bp, E. coli
gcgtatccaggctgaaaaatcccag

SEQ ID NO: 5310 - DNA, 25 bp, E. coli
gcgtatccaggcagaaaaatcccag

SEQ ID NO: 5311 - DNA, 25 bp, E. coli
taaatgccccgaaggaagtttctgt

SEQ ID NO: 5312 - DNA, 25 bp, E. coli
gaagagatctaccagcgtatccagg

SEQ ID NO: 5313 - DNA, 25 bp, E. coli
taaatgccccgatggaagtttctgt

SEQ ID NO: 5314 - DNA, 25 bp, E. coli
gaagagatctacgagcgtatccagg

SEQ ID NO: 5315 - DNA, 25 bp, E. coli
gaaaaatcccaggagtccagttact

SEQ ID NO: 5316 - DNA, 25 bp, E. coli
gaaaaatcccagcagtccagttact

SEQ ID NO: 5317 - DNA, 25 bp, E. coli
gatgaggtcaccgtgacagttttag

SEQ ID NO: 5318 - DNA, 25 bp, E. coli
gatgaggtcaccctgacagttttag

SEQ ID NO: 5319 - DNA, 25 bp, E. coli
taaaagatttggataaccgctatca

SEQ ID NO: 5320 - DNA, 25 bp, E. coli
tataaagtgcttgcaccattgcccg

SEQ ID NO: 5321 - DNA, 25 bp, E. coli
tataaagtgcttccaccattgcccg

SEQ ID NO: 5322 - DNA, 25 bp, E. coli
tgcttccaccattgcccgacaagaa

SEQ ID NO: 5323 - DNA, 25 bp, E. coli
tgacagagcagctaatcatgcaact

SEQ ID NO: 5324 - DNA, 25 bp, E. coli
tgacagagcagcaaatcatgcaact

SEQ ID NO: 5325 - DNA, 25 bp, E. coli
tgcttccaccatagcccgacaagaa

SEQ ID NO: 5326 - DNA, 25 bp, E. coli
tgcccgacaagattgaagccagtac

SEQ ID NO: 5327 - DNA, 25 bp, E. coli
tgcccgacaagaatgaagccagtac

SEQ ID NO: 5328 - DNA, 25 bp, E. coli
tcatgcaacttatgcaaaagaccta

SEQ ID NO: 5329 - DNA, 25 bp, E. coli
tcatgcaacttaagcaaaagaccta

SEQ ID NO: 5330 - DNA, 25 bp, E. coli
ccagtacgactgatatgacagagca

SEQ ID NO: 5331 - DNA, 25 bp, E. coli
cctataaagcgatggtaaaagattt

SEQ ID NO: 5332 - DNA, 25 bp, E. coli
cctataaagcgaaggtaaaagattt

SEQ ID NO: 5333 - DNA, 25 bp, E. coli
ccagtacgactgttatgacagagca

SEQ ID NO: 5334 - DNA, 25 bp, E. coli
gacaagaatgaacccagtacgactg

SEQ ID NO: 5335 - DNA, 25 bp, E. coli
gacaagaatgaagccagtacgactg

SEQ ID NO: 5336 - DNA, 25 bp, E. coli
cggtgaattatgaatataaagtgct

SEQ ID NO: 5337 - DNA, 25 bp, E. coli
cggtgaattatgtatataaagtgct

SEQ ID NO: 5338 - DNA, 25 bp, E. coli
taagcaaaagacctataaagcgatg

SEQ ID NO: 5339 - DNA, 25 bp, E. coli
taaaagatttggttaaccgctatca

SEQ ID NO: 5340 - DNA, 25 bp, E. coli
taagcaaaagacgtataaagcgatg

SEQ ID NO: 5341 - DNA, 25 bp, E. coli
catggcaagccagtacaaagagaag

SEQ ID NO: 5342 - DNA, 25 bp, E. coli
catggcaagccactacaaagagaag

SEQ ID NO: 5343 - DNA, 25 bp, E. coli
tacagtctgtacttcgcccagaagg

SEQ ID NO: 5344 - DNA, 25 bp, E. coli
tacagtctgtacatcgcccagaagg

SEQ ID NO: 5345 - DNA, 25 bp, E. coli
tatgctgcaagagctgctgggtaac

SEQ ID NO: 5346 - DNA, 25 bp, E. coli
tatgctgcaagacctgctgggtaac

SEQ ID NO: 5347 - DNA, 25 bp, E. coli
tgatttcgccagtgcagatcctgca

SEQ ID NO: 5348 - DNA, 25 bp, E. coli
tgatttcgccagagcagatcctgca

SEQ ID NO: 5349 - DNA, 25 bp, E. coli
tgaacccggaacagaaaatgcctgc

SEQ ID NO: 5350 - DNA, 25 bp, E. coli
tgaacccggaactgaaaatgcctgc

SEQ ID NO: 5351 - DNA, 25 bp, E. coli
tccacaaagtgctgccgatggctga

SEQ ID NO: 5352 - DNA, 25 bp, E. coli
tccacaaagtgcagccgatggctga

SEQ ID NO: 5353 - DNA, 25 bp, E. coli
gcgacgcctgcggttattaacaacg

SEQ ID NO: 5354 - DNA, 25 bp, E. coli
gcgacgcctgcgcttattaacaacg

SEQ ID NO: 5355 - DNA, 25 bp, E. coli
gaaggtgatgaaactcgaccccacg

SEQ ID NO: 5356 - DNA, 25 bp, E. coli
gaaggtgatgaatctcgaccccacg

SEQ ID NO: 5357 - DNA, 25 bp, E. coli
gaaccgggtctttacttcgcgatga

SEQ ID NO: 5358 - DNA, 25 bp, E. coli
gaaccgggtcttaacttcgcgatga

SEQ ID NO: 5359 - DNA, 25 bp, E. coli
gcgtttcatcgggtacggcgcaatg

SEQ ID NO: 5360 - DNA, 25 bp, E. coli
gcgtttcatcggctacggcgcaatg

SEQ ID NO: 5361 - DNA, 25 bp, E. coli
gagaagattgcttacggtactgacc

SEQ ID NO: 5362 - DNA, 25 bp, E. coli
gagaagattgctaacggtactgacc

SEQ ID NO: 5363 - DNA, 25 bp, E. coli
cagggattctgaacggaaacgttta

SEQ ID NO: 5364 - DNA, 25 bp, E. coli
cagggattctgatcggaaacgttta

SEQ ID NO: 5365 - DNA, 25 bp, E. coli
acagattgtgtttggcgaaggtgca

SEQ ID NO: 5366 - DNA, 25 bp, E. coli
acagattgtgttaggcgaaggtgca

SEQ ID NO: 5367 - DNA, 25 bp, E. coli
tattccggacaaccatggactgacc

SEQ ID NO: 5368 - DNA, 25 bp, E. coli
tattccggacaagcatggactgacc

SEQ ID NO: 5369 - DNA, 25 bp, E. coli
ttctgttcagatcaggtagccgctg

SEQ ID NO: 5370 - DNA, 25 bp, E. coli
ttctgttcagatgaggtagccgctg

SEQ ID NO: 5371 - DNA, 25 bp, E. coli
taaaaatgctggtgaaccggttatc

SEQ ID NO: 5372 - DNA, 25 bp, E. coli
taaaaatgctggagaaccggttatc

SEQ ID NO: 5373 - DNA, 25 bp, E. coli
taacggaggtgctgtaaaggaaaca

SEQ ID NO: 5374 - DNA, 25 bp, E. coli
taacggaggtgcagtaaaggaaaca

SEQ ID NO: 5375 - DNA, 25 bp, E. coli
ccaatggttgatcgtctggagctga

SEQ ID NO: 5376 - DNA, 25 bp, E. coli
ccaatggttgatggtctggagctga

SEQ ID NO: 5377 - DNA, 25 bp, E. coli
gacagcgctgtaaagtggaatacca

SEQ ID NO: 5378 - DNA, 25 bp, E. coli
gaaatggctgaagaacccagtcctg

SEQ ID NO: 5379 - DNA, 25 bp, E. coli
gaaacgtttactaatcagccttggc

SEQ ID NO: 5380 - DNA, 25 bp, E. coli
gaaatggctgaacaacccagtcctg

SEQ ID NO: 5381 - DNA, 25 bp, E. coli
gaaacgtttacttatcagccttggc

SEQ ID NO: 5382 - DNA, 25 bp, E. coli
gacagcgctgtatagtggaatacca

SEQ ID NO: 5383 - DNA, 25 bp, E. coli
gatttattcatctcggtggcgcagg

SEQ ID NO: 5384 - DNA, 25 bp, E. coli
gatttattcatcacggtggcgcagg

SEQ ID NO: 5385 - DNA, 25 bp, E. coli
aattcaatatattgtgggctccacg

SEQ ID NO: 5386 - DNA, 25 bp, E. coli
caagtgcgcgttctacacgccggat

SEQ ID NO: 5387 - DNA, 25 bp, E. coli
caagtgcgcgttgtacacgccggat

SEQ ID NO: 5388 - DNA, 25 bp, E. coli
aattcaatatatagtgggctccacg

SEQ ID NO: 5389 - DNA, 25 bp, E. coli
tactgactggccacagattgttgac

SEQ ID NO: 5390 - DNA, 25 bp, E. coli
taaaggccaggctgtaacattactg

SEQ ID NO: 5391 - DNA, 25 bp, E. coli
tactgactggcctcagattgttgac

SEQ ID NO: 5392 - DNA, 25 bp, E. coli
taaaggccaggcagtaacattactg

SEQ ID NO: 5393 - DNA, 25 bp, E. coli
agtaacattactcactggcctcaga

SEQ ID NO: 5394 - DNA, 25 bp, E. coli
agtaacattactgactggcctcaga

SEQ ID NO: 5395 - DNA, 25 bp, E. coli
tattgtgggctccacgtaggcctga

SEQ ID NO: 5396 - DNA, 25 bp, E. coli
tattgtgggctcgacgtaggcctga

SEQ ID NO: 5397 - DNA, 25 bp, E. coli
tgttgaccaagtgcgcgttgtacac

SEQ ID NO: 5398 - DNA, 25 bp, E. coli
tgttgaccaagtccgcgttgtacac

SEQ ID NO: 5399 - DNA, 25 bp, E. coli
tctcagaccagcgagtaacattact

SEQ ID NO: 5400 - DNA, 25 bp, E. coli
tctcagaccagccagtaacattact

SEQ ID NO: 5401 - DNA, 25 bp, E. coli
gcgtttgtcagcactctcagaccag

SEQ ID NO: 5402 - DNA, 25 bp, E. coli
gcgtttgtcagctctctcagaccag

SEQ ID NO: 5403 - DNA, 25 bp, E. coli
gattcattgattaaaggccaggcag

SEQ ID NO: 5404 - DNA, 25 bp, E. coli
gattcattgatttaaggccaggcag

SEQ ID NO: 5405 - DNA, 25 bp, E. coli
ggcctcagattgatgaccaagtgcg

SEQ ID NO: 5406 - DNA, 25 bp, E. coli
ggcctcagattgttgaccaagtgcg

SEQ ID NO: 5407 - DNA, 25 bp, E. coli
caaccttgtacgttgtgggtggcaa

SEQ ID NO: 5408 - DNA, 25 bp, E. coli
aatatgccgtggctgtgttactgga

SEQ ID NO: 5409 - DNA, 25 bp, E. coli
aatatgccgtgggtgtgttactgga

SEQ ID NO: 5410 - DNA, 25 bp, E. coli
caaccttgtacgatgtgggtggcaa

SEQ ID NO: 5411 - DNA, 25 bp, E. coli
cacacagtcctgtatgaatatgccg

SEQ ID NO: 5412 - DNA, 25 bp, E. coli
cacacagtcctgaatgaatatgccg

SEQ ID NO: 5413 - DNA, 25 bp, E. coli
atgtacgaacaggacacgctcagcg

SEQ ID NO: 5414 - DNA, 25 bp, E. coli
atgtacgaacagcacacgctcagcg

SEQ ID NO: 5415 - DNA, 25 bp, E. coli
tatgcttttccaggcagctttgtgc

SEQ ID NO: 5416 - DNA, 25 bp, E. coli
tatgcttttccacgcagctttgtgc

SEQ ID NO: 5417 - DNA, 25 bp, E. coli
tgcacagcggtttgaagcgacatcg

SEQ ID NO: 5418 - DNA, 25 bp, E. coli
tgcgattactgaccacacagtcctg

SEQ ID NO: 5419 - DNA, 25 bp, E. coli
tgcgattactgagcacacagtcctg

SEQ ID NO: 5420 - DNA, 25 bp, E. coli
tgcacagcggttagaagcgacatcg

SEQ ID NO: 5421 - DNA, 25 bp, E. coli
tgccatcaccgaagcacagcggatt

SEQ ID NO: 5422 - DNA, 25 bp, E. coli
tgccatcaccgatgcacagcggatt

SEQ ID NO: 5423 - DNA, 25 bp, E. coli
gcacagcggattgcctttgctccta

SEQ ID NO: 5424 - DNA, 25 bp, E. coli
gcacagcggattccctttgctccta

SEQ ID NO: 5425 - DNA, 25 bp, E. coli
gggagctccccttaatgcgattact

SEQ ID NO: 5426 - DNA, 25 bp, E. coli
gggagctcccctaaatgcgattact

SEQ ID NO: 5427 - DNA, 25 bp, E. coli
tcaacagggtaatcagggagctccc

SEQ ID NO: 5428 - DNA, 25 bp, E. coli
tcaacagggtaaacagggagctccc

SEQ ID NO: 5429 - DNA, 25 bp, E. coli
aatattagtattgcgcaagcctggc

SEQ ID NO: 5430 - DNA, 25 bp, E. coli
aatattagtattccgcaagcctggc

SEQ ID NO: 5431 - DNA, 25 bp, E. coli
caaaatatgctgaggcttggcgcac

SEQ ID NO: 5432 - DNA, 25 bp, E. coli
caaaatatgctgtggcttggcgcac

SEQ ID NO: 5433 - DNA, 25 bp, E. coli
taggttacaaatcactggcttcccg

SEQ ID NO: 5434 - DNA, 25 bp, E. coli
taggttacaaatgactggcttcccg

SEQ ID NO: 5435 - DNA, 25 bp, E. coli
aacatgaatgacttacccgacggcg

SEQ ID NO: 5436 - DNA, 25 bp, E. coli
aacatgaatgacatacccgacggcg

SEQ ID NO: 5437 - DNA, 25 bp, E. coli
tattccggttcagggcaatctcgac

SEQ ID NO: 5438 - DNA, 25 bp, E. coli
tattgcacagaccaatgccacggtg

SEQ ID NO: 5439 - DNA, 25 bp, E. coli
tattccggttcacggcaatctcgac

SEQ ID NO: 5440 - DNA, 25 bp, E. coli
tattgcacagacgaatgccacggtg

SEQ ID NO: 5441 - DNA, 25 bp, E. coli
ttttgatactcagcaggacgagcgg

SEQ ID NO: 5442 - DNA, 25 bp, E. coli
ttttgatactcaccaggacgagcgg

SEQ ID NO: 5443 - DNA, 25 bp, E. coli
tgacgatcagtcaatcaggccgcgt

SEQ ID NO: 5444 - DNA, 25 bp, E. coli
tgacgatcagtctatcaggccgcgt

SEQ ID NO: 5445 - DNA, 25 bp, E. coli
gaacaatttccaggtttcggcagca

SEQ ID NO: 5446 - DNA, 25 bp, E. coli
gaacaatttccacgtttcggcagca

SEQ ID NO: 5447 - DNA, 25 bp, E. coli
gattacagttccctcagcagcagct

SEQ ID NO: 5448 - DNA, 25 bp, E. coli
gattacagttccgtcagcagcagct

SEQ ID NO: 5449 - DNA, 25 bp, E. coli
tggaagacacgaccaaacgcctgat

SEQ ID NO: 5450 - DNA, 25 bp, E. coli
tggaagacacgagcaaacgcctgat

SEQ ID NO: 5451 - DNA, 25 bp, E. coli
cacgtgtttacgtggcgttttgctt

SEQ ID NO: 5452 - DNA, 25 bp, E. coli
cacgtgtttacgaggcgttttgctt

SEQ ID NO: 5453 - DNA, 25 bp, E. coli
tacgtggcgttttgcttttatatct

SEQ ID NO: 5454 - DNA, 25 bp, E. coli
gccaaaaacgccacgtgtttacgtg

SEQ ID NO: 5455 - DNA, 25 bp, E. coli
gccaaaaacgcctcgtgtttacgtg

SEQ ID NO: 5456 - DNA, 25 bp, E. coli
tacgtggcgtttagcttttatatct

SEQ ID NO: 5457 - DNA, 25 bp, E. coli
tgccaaaaacgccacgtgtttacgt

SEQ ID NO: 5458 - DNA, 25 bp, E. coli
tgccaaaaacgcgacgtgtttacgt

SEQ ID NO: 5459 - DNA, 25 bp, E. coli
taggaaaattccaggaatttgctgg

SEQ ID NO: 5460 - DNA, 25 bp, E. coli
taggaaaattcctggaatttgctgg

SEQ ID NO: 5461 - DNA, 25 bp, E. coli
gcttttatatctctaatcttaatgc

SEQ ID NO: 5462 - DNA, 25 bp, E. coli
gcgctggcgatgttaggaaaattcc

SEQ ID NO: 5463 - DNA, 25 bp, E. coli
gcgctggcgatgataggaaaattcc

SEQ ID NO: 5464 - DNA, 25 bp, E. coli
gcttttatatctgtaatcttaatgc

SEQ ID NO: 5465 - DNA, 25 bp, E. coli
cgctggcgatgtaaggaaaattcct

SEQ ID NO: 5466 - DNA, 25 bp, E. coli
cgctggcgatgttaggaaaattcct

SEQ ID NO: 5467 - DNA, 25 bp, E. coli
ctggcgatgttacgaaaattcctgg

SEQ ID NO: 5468 - DNA, 25 bp, E. coli
ctggcgatgttaggaaaattcctgg

SEQ ID NO: 5469 - DNA, 25 bp, E. coli
ggcgatgttaggaaaattcctggaa

SEQ ID NO: 5470 - DNA, 25 bp, E. coli
tggcgttttgcttttatatctgtaa

SEQ ID NO: 5471 - DNA, 25 bp, E. coli
ggcgatgttaggtaaattcctggaa

SEQ ID NO: 5472 - DNA, 25 bp, E. coli
tggcgttttgctattatatctgtaa

SEQ ID NO: 5473 - DNA, 25 bp, E. coli
catattatctcgtcttccggtggta

SEQ ID NO: 5474 - DNA, 25 bp, E. coli
catgctgagagccagtgggtatttt

SEQ ID NO: 5475 - DNA, 25 bp, E. coli
catattatctcgacttccggtggta

SEQ ID NO: 5476 - DNA, 25 bp, E. coli
catgctgagagcgagtgggtatttt

SEQ ID NO: 5477 - DNA, 25 bp, E. coli
aaaggaacttcctgacccatagtga

SEQ ID NO: 5478 - DNA, 25 bp, E. coli
atagagccagaggacgacagcgtca

SEQ ID NO: 5479 - DNA, 25 bp, E. coli
atagagccagagcacgacagcgtca

SEQ ID NO: 5480 - DNA, 25 bp, E. coli
aaaggaacttccagacccatagtga

SEQ ID NO: 5481 - DNA, 25 bp, E. coli
tttttacggcatgtgggatagagcc

SEQ ID NO: 5482 - DNA, 25 bp, E. coli
tttttacggcatctgggatagagcc

SEQ ID NO: 5483 - DNA, 25 bp, E. coli
gccagcaatgcagggcgtttttacg

SEQ ID NO: 5484 - DNA, 25 bp, E. coli
gccgggttgtcagtggagattcatc

SEQ ID NO: 5485 - DNA, 25 bp, E. coli
gccgggttgtcactggagattcatc

SEQ ID NO: 5486 - DNA, 25 bp, E. coli
gccagcaatgcacggcgtttttacg

SEQ ID NO: 5487 - DNA, 25 bp, E. coli
cgaatatgggaatagatacgcgact

SEQ ID NO: 5488 - DNA, 25 bp, E. coli
cgaatatgggaaaagatacgcgact

SEQ ID NO: 5489 - DNA, 25 bp, E. coli
gttttattcatgctttccgggcgag

SEQ ID NO: 5490 - DNA, 25 bp, E. coli
gttttattcatggtttccgggcgag

SEQ ID NO: 5491 - DNA, 25 bp, E. coli
ggcttttcaacatcgcacccgctat

SEQ ID NO: 5492 - DNA, 25 bp, E. coli
ggcttttcaacaacgcacccgctat

SEQ ID NO: 5493 - DNA, 25 bp, E. coli
gagattcatccggacatgttacgcc

SEQ ID NO: 5494 - DNA, 25 bp, E. coli
gagattcatccgcacatgttacgcc

SEQ ID NO: 5495 - DNA, 25 bp, E. coli
caatatattgcaagaagatcgtagg

SEQ ID NO: 5496 - DNA, 25 bp, E. coli
aatatattgcaagaagatcgtaggc

SEQ ID NO: 5497 - DNA, 25 bp, E. coli
caatatattgcatgaagatcgtagg

SEQ ID NO: 5498 - DNA, 25 bp, E. coli
aatatattgcaacaagatcgtaggc

SEQ ID NO: 5499 - DNA, 25 bp, E. coli
atattgcaagaacatcgtaggcctg

SEQ ID NO: 5500 - DNA, 25 bp, E. coli
atattgcaagaagatcgtaggcctg

SEQ ID NO: 5501 - DNA, 25 bp, E. coli
atatattgcaagaagatcgtaggcc

SEQ ID NO: 5502 - DNA, 25 bp, E. coli
atatattgcaagtagatcgtaggcc

SEQ ID NO: 5503 - DNA, 25 bp, E. coli
attgcaagaagatcgtaggcctgat

SEQ ID NO: 5504 - DNA, 25 bp, E. coli
attgcaagaagaacgtaggcctgat

SEQ ID NO: 5505 - DNA, 25 bp, E. coli
tatattgcaagatgatcgtaggcct

SEQ ID NO: 5506 - DNA, 25 bp, E. coli
tattgcaagaagatcgtaggcctga

SEQ ID NO: 5507 - DNA, 25 bp, E. coli
tatattgcaagaagatcgtaggcct

SEQ ID NO: 5508 - DNA, 25 bp, E. coli
tattgcaagaagttcgtaggcctga

SEQ ID NO: 5509 - DNA, 25 bp, E. coli
ttcaatatattggaagaagatcgta

SEQ ID NO: 5510 - DNA, 25 bp, E. coli
ttcaatatattgcaagaagatcgta

SEQ ID NO: 5511 - DNA, 25 bp, E. coli
ttgcaagaagatggtaggcctgata

SEQ ID NO: 5512 - DNA, 25 bp, E. coli
ttgcaagaagatcgtaggcctgata

SEQ ID NO: 5513 - DNA, 25 bp, E. coli
tgcaagaagatcctaggcctgataa

SEQ ID NO: 5514 - DNA, 25 bp, E. coli
tgcaagaagatcgtaggcctgataa

SEQ ID NO: 5515 - DNA, 25 bp, E. coli
tcaatatattgcaagaagatcgtag

SEQ ID NO: 5516 - DNA, 25 bp, E. coli
tcaatatattgctagaagatcgtag

SEQ ID NO: 5517 - DNA, 25 bp, E. coli
aattgtgcgcggtttttcttacagg

SEQ ID NO: 5518 - DNA, 25 bp, E. coli
aattgtgcgcggattttcttacagg

SEQ ID NO: 5519 - DNA, 25 bp, E. coli
tacgataagttatgcatcatctctc

SEQ ID NO: 5520 - DNA, 25 bp, E. coli
tacaaagggattatcgccaacatgg

SEQ ID NO: 5521 - DNA, 25 bp, E. coli
tacgataagttaagcatcatctctc

SEQ ID NO: 5522 - DNA, 25 bp, E. coli
tacaaagggattttcgccaacatgg

SEQ ID NO: 5523 - DNA, 25 bp, E. coli
tgaatggagcgcatagactaaggtc

SEQ ID NO: 5524 - DNA, 25 bp, E. coli
tgaatggagcgcttagactaaggtc

SEQ ID NO: 5525 - DNA, 25 bp, E. coli
tccgcgcaattttcgtgaatggagc

SEQ ID NO: 5526 - DNA, 25 bp, E. coli
tccgcgcaatttacgtgaatggagc

SEQ ID NO: 5527 - DNA, 25 bp, E. coli
tcttacaggtgttggctaatagcct

SEQ ID NO: 5528 - DNA, 25 bp, E. coli
tcttacaggtgtaggctaatagcct

SEQ ID NO: 5529 - DNA, 25 bp, E. coli
ccaacatggatatataagagtaggg

SEQ ID NO: 5530 - DNA, 25 bp, E. coli
ccaacatggataaataagagtaggg

SEQ ID NO: 5531 - DNA, 25 bp, E. coli
ccttcacaaaattattatccgcgca

SEQ ID NO: 5532 - DNA, 25 bp, E. coli
ccttcacaaaataattatccgcgca

SEQ ID NO: 5533 - DNA, 25 bp, E. coli
ggatttgtaataccgatgatgcaca

SEQ ID NO: 5534 - DNA, 25 bp, E. coli
ggatttgtaatagcgatgatgcaca

SEQ ID NO: 5535 - DNA, 25 bp, E. coli
taagactctggcatcaattgtgcgc

SEQ ID NO: 5536 - DNA, 25 bp, E. coli
taagactctggcttcaattgtgcgc

SEQ ID NO: 5537 - DNA, 25 bp, E. coli
gatgatgcacagaacatacaaaggg

SEQ ID NO: 5538 - DNA, 25 bp, E. coli
gatgatgcacagtacatacaaaggg

SEQ ID NO: 5539 - DNA, 25 bp, E. coli
ttttaagattatagcggaatggcga

SEQ ID NO: 5540 - DNA, 25 bp, E. coli
ttcactcgcaactagaataactccc

SEQ ID NO: 5541 - DNA, 25 bp, E. coli
ttcactcgcaacaagaataactccc

SEQ ID NO: 5542 - DNA, 25 bp, E. coli
ttttaagattattgcggaatggcga

SEQ ID NO: 5543 - DNA, 25 bp, E. coli
tgtcaaaacaaaaccttcactcgca

SEQ ID NO: 5544 - DNA, 25 bp, E. coli
tgtcaaaacaaatccttcactcgca

SEQ ID NO: 5545 - DNA, 25 bp, E. coli
tgcagaataatccaacacgaatatg

SEQ ID NO: 5546 - DNA, 25 bp, E. coli
tgcagaataatcgaacacgaatatg

SEQ ID NO: 5547 - DNA, 25 bp, E. coli
tgccactgcatagtgattaaccctc

SEQ ID NO: 5548 - DNA, 25 bp, E. coli
tgccactgcatactgattaaccctc

SEQ ID NO: 5549 - DNA, 25 bp, E. coli
gtccattctccccaaaaatgcagaa

SEQ ID NO: 5550 - DNA, 25 bp, E. coli
gtccattctcccgaaaaatgcagaa

SEQ ID NO: 5551 - DNA, 25 bp, E. coli
ggcgaaataagctcctaacatcaag

SEQ ID NO: 5552 - DNA, 25 bp, E. coli
ggcgaaataagcacctaacatcaag

SEQ ID NO: 5553 - DNA, 25 bp, E. coli
taatcagtcggcaagtccattctcc

SEQ ID NO: 5554 - DNA, 25 bp, E. coli
taaccctcattattcagtcggcaag

SEQ ID NO: 5555 - DNA, 25 bp, E. coli
taagtatttgacagcactgaatgtc

SEQ ID NO: 5556 - DNA, 25 bp, E. coli
tcaaaatgtaaatgcaagggaactt

SEQ ID NO: 5557 - DNA, 25 bp, E. coli
taatcagtcggctagtccattctcc

SEQ ID NO: 5558 - DNA, 25 bp, E. coli
tcaaaatgtaaaagcaagggaactt

SEQ ID NO: 5559 - DNA, 25 bp, E. coli
taagtatttgactgcactgaatgtc

SEQ ID NO: 5560 - DNA, 25 bp, E. coli
taaccctcattaatcagtcggcaag

SEQ ID NO: 5561 - DNA, 25 bp, E. coli
aataaattagctaccggtgccaggc

SEQ ID NO: 5562 - DNA, 25 bp, E. coli
aataaattagcttccggtgccaggc

SEQ ID NO: 5563 - DNA, 25 bp, E. coli
tgggatacgccgcaattcaggaatc

SEQ ID NO: 5564 - DNA, 25 bp, E. coli
tgggatacgccggaattcaggaatc

SEQ ID NO: 5565 - DNA, 25 bp, E. coli
tgccagcgatatcagtaaaggtacg

SEQ ID NO: 5566 - DNA, 25 bp, E. coli
tgccagcgatatgagtaaaggtacg

SEQ ID NO: 5567 - DNA, 25 bp, E. coli
tctggcgggcgggatgtttttacaa

SEQ ID NO: 5568 - DNA, 25 bp, E. coli
tctggcgggcggcatgtttttacaa

SEQ ID NO: 5569 - DNA, 25 bp, E. coli
cctctgtttcattggcgctgtggga

SEQ ID NO: 5570 - DNA, 25 bp, E. coli
gccacgcgtataggcgagaaactgt

SEQ ID NO: 5571 - DNA, 25 bp, E. coli
gccacgcgtatacgcgagaaactgt

SEQ ID NO: 5572 - DNA, 25 bp, E. coli
cctctgtttcataggcgctgtggga

SEQ ID NO: 5573 - DNA, 25 bp, E. coli
ccaggcttggacgtcaggcgttact

SEQ ID NO: 5574 - DNA, 25 bp, E. coli
ccaggcttggacctcaggcgttact

SEQ ID NO: 5575 - DNA, 25 bp, E. coli
gaattttcaacctatatcggcaacg

SEQ ID NO: 5576 - DNA, 25 bp, E. coli
gaattttcaaccaatatcggcaacg

SEQ ID NO: 5577 - DNA, 25 bp, E. coli
ctcggtcgtgactataagctggtgc

SEQ ID NO: 5578 - DNA, 25 bp, E. coli
ctcggtcgtgacaataagctggtgc

SEQ ID NO: 5579 - DNA, 25 bp, E. coli
gattcaacccggaatgttggccgtg

SEQ ID NO: 5580 - DNA, 25 bp, E. coli
gattcaacccggtatgttggccgtg

SEQ ID NO: 5581 - DNA, 25 bp, E. coli
ggcaacggttatgtcatcgcacgcg

SEQ ID NO: 5582 - DNA, 25 bp, E. coli
ggcaacggttatctcatcgcacgcg

SEQ ID NO: 5583 - DNA, 25 bp, E. coli
aagagatgttgagcgagctggaagc

SEQ ID NO: 5584 - DNA, 25 bp, E. coli
aagagatgttgaccgagctggaagc

SEQ ID NO: 5585 - DNA, 25 bp, E. coli
caaaaattttggctatgaagagatg

SEQ ID NO: 5586 - DNA, 25 bp, E. coli
caaaaattttgggtatgaagagatg

SEQ ID NO: 5587 - DNA, 25 bp, E. coli
ttttggctatgatgagatgttgagc

SEQ ID NO: 5588 - DNA, 25 bp, E. coli
ttttggctatgaagagatgttgagc

SEQ ID NO: 5589 - DNA, 25 bp, E. coli
tgaagcccgtggtggcgaaagaacc

SEQ ID NO: 5590 - DNA, 25 bp, E. coli
tgaagcccgtggaggcgaaagaacc

SEQ ID NO: 5591 - DNA, 25 bp, E. coli
tcgcggatgctgaaacgcgtttagc

SEQ ID NO: 5592 - DNA, 25 bp, E. coli
tcgcggatgctgtaacgcgtttagc

SEQ ID NO: 5593 - DNA, 25 bp, E. coli
tcgtcgcggatgctgaaacgcgttt

SEQ ID NO: 5594 - DNA, 25 bp, E. coli
tcgtcgcggatggtgaaacgcgttt

SEQ ID NO: 5595 - DNA, 25 bp, E. coli
gcccgtggtggccaaagaacctgct

SEQ ID NO: 5596 - DNA, 25 bp, E. coli
gcccgtggtggcgaaagaacctgct

SEQ ID NO: 5597 - DNA, 25 bp, E. coli
gaagcccgtggtcgcgaaagaacct

SEQ ID NO: 5598 - DNA, 25 bp, E. coli
gaagcccgtggtggcgaaagaacct

SEQ ID NO: 5599 - DNA, 25 bp, E. coli
ccgtggtggcgaaagaacctgctcg

SEQ ID NO: 5600 - DNA, 25 bp, E. coli
ccgtggtggcgatagaacctgctcg

SEQ ID NO: 5601 - DNA, 25 bp, E. coli
ctatgaagagatgttgagcgagctg

SEQ ID NO: 5602 - DNA, 25 bp, E. coli
cggatgctgaaaggcgtttagccga

SEQ ID NO: 5603 - DNA, 25 bp, E. coli
ctatgaagagatcttgagcgagctg

SEQ ID NO: 5604 - DNA, 25 bp, E. coli
cggatgctgaaacgcgtttagccga

SEQ ID NO: 5605 - DNA, 25 bp, E. coli
taacacacaatgctcgtgaagagcg

SEQ ID NO: 5606 - DNA, 25 bp, E. coli
aaaatggacttttgcggcatgaccc

SEQ ID NO: 5607 - DNA, 25 bp, E. coli
aaaatggactttagcggcatgaccc

SEQ ID NO: 5608 - DNA, 25 bp, E. coli
tttgtcattcgtgcgctgaaaggcg

SEQ ID NO: 5609 - DNA, 25 bp, E. coli
tttgtcattcgtccgctgaaaggcg

SEQ ID NO: 5610 - DNA, 25 bp, E. coli
tgctgccaactaatagcggtgtccg

SEQ ID NO: 5611 - DNA, 25 bp, E. coli
tgaagtgaagaatcagagcaccctg

SEQ ID NO: 5612 - DNA, 25 bp, E. coli
tgaagtgaagaaacagagcaccctg

SEQ ID NO: 5613 - DNA, 25 bp, E. coli
tgcaggcgctgatgcaaaacggcga

SEQ ID NO: 5614 - DNA, 25 bp, E. coli
tgctgaaggcatcgacatgaccacc

SEQ ID NO: 5615 - DNA, 25 bp, E. coli
tgctgaaggcatggacatgaccacc

SEQ ID NO: 5616 - DNA, 25 bp, E. coli
tgctgccaactattagcggtgtccg

SEQ ID NO: 5617 - DNA, 25 bp, E. coli
tgcaggcgctgaagcaaaacggcga

SEQ ID NO: 5618 - DNA, 25 bp, E. coli
tctaccagctggatatgtccgatgc

SEQ ID NO: 5619 - DNA, 25 bp, E. coli
tctaccagctggttatgtccgatgc

SEQ ID NO: 5620 - DNA, 25 bp, E. coli
gaattccgcctgcaaccttatgacg

SEQ ID NO: 5621 - DNA, 25 bp, E. coli
gaattccgcctggaaccttatgacg

SEQ ID NO: 5622 - DNA, 25 bp, E. coli
gaagccctgggcaatgctgaaggca

SEQ ID NO: 5623 - DNA, 25 bp, E. coli
gaagccctgggctatgctgaaggca

SEQ ID NO: 5624 - DNA, 25 bp, E. coli
gttacatgacggatacagccagcga

SEQ ID NO: 5625 - DNA, 25 bp, E. coli
gttacatgacggttacagccagcga

SEQ ID NO: 5626 - DNA, 25 bp, E. coli
taacacacaatggtcgtgaagagcg

SEQ ID NO: 5627 - DNA, 25 bp, E. coli
caaaagcggctttttctggctggat

SEQ ID NO: 5628 - DNA, 25 bp, E. coli
caaaagcggcttattctggctggat

SEQ ID NO: 5629 - DNA, 25 bp, E. coli
catgcctcagaatacgccaaaagcg

SEQ ID NO: 5630 - DNA, 25 bp, E. coli
catgcctcagaaaacgccaaaagcg

SEQ ID NO: 5631 - DNA, 25 bp, E. coli
caggagaaaaatcaacgcgtacggt

SEQ ID NO: 5632 - DNA, 25 bp, E. coli
caggagaaaaatgaacgcgtacggt

SEQ ID NO: 5633 - DNA, 25 bp, E. coli
taaaggatttttcctcatcggcgtc

SEQ ID NO: 5634 - DNA, 25 bp, E. coli
taaaggatttttgctcatcggcgtc

SEQ ID NO: 5635 - DNA, 25 bp, E. coli
tatcgcgcattacgtcactgcaagg

SEQ ID NO: 5636 - DNA, 25 bp, E. coli
tatttacccgcagactcagggcgtt

SEQ ID NO: 5637 - DNA, 25 bp, E. coli
tatcgcgcattaggtcactgcaagg

SEQ ID NO: 5638 - DNA, 25 bp, E. coli
tatttacccgcacactcagggcgtt

SEQ ID NO: 5639 - DNA, 25 bp, E. coli
cgcagtcgctgaggcaggattttaa

SEQ ID NO: 5640 - DNA, 25 bp, E. coli
cgcagtcgctgacgcaggattttaa

SEQ ID NO: 5641 - DNA, 25 bp, E. coli
cgttgttggcgctaattaaagggca

SEQ ID NO: 5642 - DNA, 25 bp, E. coli
cgttgttggcgcaaattaaagggca

SEQ ID NO: 5643 - DNA, 25 bp, E. coli
gatatggacgacaacgatccgcgac

SEQ ID NO: 5644 - DNA, 25 bp, E. coli
gatatggacgactacgatccgcgac

SEQ ID NO: 5645 - DNA, 25 bp, E. coli
tcaaagacaccgtacacatgctggc

SEQ ID NO: 5646 - DNA, 25 bp, E. coli
tcaagcggacggttatgcggcaaca

SEQ ID NO: 5647 - DNA, 25 bp, E. coli
tcaagcggacggatatgcggcaaca

SEQ ID NO: 5648 - DNA, 25 bp, E. coli
tcaaagacaccgaacacatgctggc

SEQ ID NO: 5649 - DNA, 25 bp, E. coli
caagatatgaaagccgccattcggg

SEQ ID NO: 5650 - DNA, 25 bp, E. coli
caagatatgaaacccgccattcggg

SEQ ID NO: 5651 - DNA, 25 bp, E. coli
catacgttgaaccatgatgacgata

SEQ ID NO: 5652 - DNA, 25 bp, E. coli
cattacgtgggcttacgttgaacga

SEQ ID NO: 5653 - DNA, 25 bp, E. coli
cattacgtgggcatacgttgaacga

SEQ ID NO: 5654 - DNA, 25 bp, E. coli
catacgttgaacgatgatgacgata

SEQ ID NO: 5655 - DNA, 25 bp, E. coli
tgtccattcgttttttactgtgcaa

SEQ ID NO: 5656 - DNA, 25 bp, E. coli
tgtccattcgttatttactgtgcaa

SEQ ID NO: 5657 - DNA, 25 bp, E. coli
tgaaagccgccattcgggaatttct

SEQ ID NO: 5658 - DNA, 25 bp, E. coli
tgaaaaagcaagttatgaaagccgc

SEQ ID NO: 5659 - DNA, 25 bp, E. coli
tgaaaaagcaagatatgaaagccgc

SEQ ID NO: 5660 - DNA, 25 bp, E. coli
tgaaagccgccaatcgggaatttct

SEQ ID NO: 5661 - DNA, 25 bp, E. coli
tcgggcttgtcctttcgttatttac

SEQ ID NO: 5662 - DNA, 25 bp, E. coli
tcgggcttgtccattcgttatttac

SEQ ID NO: 5663 - DNA, 25 bp, E. coli
gatattttttctgtcgggcttgtcc

SEQ ID NO: 5664 - DNA, 25 bp, E. coli
gatattttttctctcgggcttgtcc

SEQ ID NO: 5665 - DNA, 25 bp, E. coli
gggaatttctttcacgctcattacg

SEQ ID NO: 5666 - DNA, 25 bp, E. coli
gggaatttctttgacgctcattacg

SEQ ID NO: 5667 - DNA, 25 bp, E. coli
tcacgctcattaggtgggcatacgt

SEQ ID NO: 5668 - DNA, 25 bp, E. coli
tcacgctcattacgtgggcatacgt

SEQ ID NO: 5669 - DNA, 25 bp, E. coli
gatgacgatattatttctctcgggc

SEQ ID NO: 5670 - DNA, 25 bp, E. coli
gatgacgatattttttctctcgggc

SEQ ID NO: 5671 - DNA, 25 bp, E. coli
caccacgctgggaaaatcgctgcta

SEQ ID NO: 5672 - DNA, 25 bp, E. coli
caccacgctgggtaaatcgctgcta

SEQ ID NO: 5673 - DNA, 25 bp, E. coli
aaatgcaaaagaggcaccacgctgg

SEQ ID NO: 5674 - DNA, 25 bp, E. coli
aaatgcaaaagacgcaccacgctgg

SEQ ID NO: 5675 - DNA, 25 bp, E. coli
tttgtatcgagaatggtggccagcc

SEQ ID NO: 5676 - DNA, 25 bp, E. coli
tattgctctcgcctaagcgggtacc

SEQ ID NO: 5677 - DNA, 25 bp, E. coli
tttgtatcgagattggtggccagcc

SEQ ID NO: 5678 - DNA, 25 bp, E. coli
tattgctctcgcgtaagcgggtacc

SEQ ID NO: 5679 - DNA, 25 bp, E. coli
gctattcagcagtgttttgtatcga

SEQ ID NO: 5680 - DNA, 25 bp, E. coli
gctattcagcagagttttgtatcga

SEQ ID NO: 5681 - DNA, 25 bp, E. coli
gcgtaagcgggtaccgtgacattct

SEQ ID NO: 5682 - DNA, 25 bp, E. coli
gcgtaagcgggttccgtgacattct

SEQ ID NO: 5683 - DNA, 25 bp, E. coli
gaaccagtaaaatgcaaaagacgca

SEQ ID NO: 5684 - DNA, 25 bp, E. coli
gaaccagtaaaaagcaaaagacgca

SEQ ID NO: 5685 - DNA, 25 bp, E. coli
ctttttagagtagtcattagtgaac

SEQ ID NO: 5686 - DNA, 25 bp, E. coli
ctttttagagtactcattagtgaac

SEQ ID NO: 5687 - DNA, 25 bp, E. coli
gataattgataactcagaaccagta

SEQ ID NO: 5688 - DNA, 25 bp, E. coli
gataattgataagtcagaaccagta

SEQ ID NO: 5689 - DNA, 25 bp, E. coli
ggtggccagccagttattgctctcg

SEQ ID NO: 5690 - DNA, 25 bp, E. coli
ggtggccagccacttattgctctcg

SEQ ID NO: 5691 - DNA, 25 bp, E. coli
ggaaaatcgctgctattcagcagag

SEQ ID NO: 5692 - DNA, 25 bp, E. coli
ggaaaatcgctggtattcagcagag

SEQ ID NO: 5693 - DNA, 25 bp, E. coli
aattcgttctctctggtcgcgctgg

SEQ ID NO: 5694 - DNA, 25 bp, E. coli
caataacgttctatgctggctggcg

SEQ ID NO: 5695 - DNA, 25 bp, E. coli
aattcgttctctgtggtcgcgctgg

SEQ ID NO: 5696 - DNA, 25 bp, E. coli
caataacgttctttgctggctggcg

SEQ ID NO: 5697 - DNA, 25 bp, E. coli
caccgcgttgcaccgtatggataac

SEQ ID NO: 5698 - DNA, 25 bp, E. coli
caccgcgttgcagcgtatggataac

SEQ ID NO: 5699 - DNA, 25 bp, E. coli
tatggtcgcaagtatggataggctg

SEQ ID NO: 5700 - DNA, 25 bp, E. coli
tatggtcgcaagaatggataggctg

SEQ ID NO: 5701 - DNA, 25 bp, E. coli
tgtgtgctattcagtatgccgcgca

SEQ ID NO: 5702 - DNA, 25 bp, E. coli
tgtgtgctattctgtatgccgcgca

SEQ ID NO: 5703 - DNA, 25 bp, E. coli
tgaaattctgcgtggtgaaccggaa

SEQ ID NO: 5704 - DNA, 25 bp, E. coli
tgaatgcttccctacgccagcaggt

SEQ ID NO: 5705 - DNA, 25 bp, E. coli
tgaaattctgcgaggtgaaccggaa

SEQ ID NO: 5706 - DNA, 25 bp, E. coli
tgaatgcttcccaacgccagcaggt

SEQ ID NO: 5707 - DNA, 25 bp, E. coli
cctgaaatgattgtggctggcgtac

SEQ ID NO: 5708 - DNA, 25 bp, E. coli
cctgaaatgattctggctggcgtac

SEQ ID NO: 5709 - DNA, 25 bp, E. coli
gctggctggcggagttcaatactct

SEQ ID NO: 5710 - DNA, 25 bp, E. coli
gctggctggcggtgttcaatactct

SEQ ID NO: 5711 - DNA, 25 bp, E. coli
ggcaatttttacaggacaccgcgtt

SEQ ID NO: 5712 - DNA, 25 bp, E. coli
ggcaatttttactggacaccgcgtt

SEQ ID NO: 5713 - DNA, 25 bp, E. coli
gatggctggtccactgataatcgcg

SEQ ID NO: 5714 - DNA, 25 bp, E. coli
gatggctggtcctctgataatcgcg

SEQ ID NO: 5715 - DNA, 25 bp, E. coli
taaaagaaggcgtcgtgctggtcac

SEQ ID NO: 5716 - DNA, 25 bp, E. coli
taaaagaaggcgacgtgctggtcac

SEQ ID NO: 5717 - DNA, 25 bp, E. coli
tttgaaaaagcctaaactgcactgg

SEQ ID NO: 5718 - DNA, 25 bp, E. coli
tttgaaaaagccaaaactgcactgg

SEQ ID NO: 5719 - DNA, 25 bp, E. coli
ttggtcgcgaagagctgcaacacgc

SEQ ID NO: 5720 - DNA, 25 bp, E. coli
ttggtcgcgaagtgctgcaacacgc

SEQ ID NO: 5721 - DNA, 25 bp, E. coli
tgacgaaagtctcggccgataacac

SEQ ID NO: 5722 - DNA, 25 bp, E. coli
tgacgaaagtctgggccgataacac

SEQ ID NO: 5723 - DNA, 25 bp, E. coli
tgccaccgaagttcgtaacgcctgg

SEQ ID NO: 5724 - DNA, 25 bp, E. coli
tgccaccgaagtacgtaacgcctgg

SEQ ID NO: 5725 - DNA, 25 bp, E. coli
ccaatatgcgtatcggtcagccggt

SEQ ID NO: 5726 - DNA, 25 bp, E. coli
ccaatatgcgtaacggtcagccggt

SEQ ID NO: 5727 - DNA, 25 bp, E. coli
gaagaaaccgatgacgcatacgtgg

SEQ ID NO: 5728 - DNA, 25 bp, E. coli
gaagaaaccgatcacgcatacgtgg

SEQ ID NO: 5729 - DNA, 25 bp, E. coli
gatatcgtaaaagctaacgctggct

SEQ ID NO: 5730 - DNA, 25 bp, E. coli
gatatgggcacacgtagcgcgttct

SEQ ID NO: 5731 - DNA, 25 bp, E. coli
gatatcgtaaaacctaacgctggct

SEQ ID NO: 5732 - DNA, 25 bp, E. coli
gatatgggcacaggtagcgcgttct

SEQ ID NO: 5733 - DNA, 25 bp, E. coli
ggtcgttccagcgaccaatatgtgg

SEQ ID NO: 5734 - DNA, 25 bp, E. coli
ggtcgttccagccaccaatatgtgg

SEQ ID NO: 5735 - DNA, 25 bp, E. coli
tggatcaaagtcgttcagcgtctgc

SEQ ID NO: 5736 - DNA, 25 bp, E. coli
tggatcaaagtccttcagcgtctgc

SEQ ID NO: 5737 - DNA, 25 bp, E. coli
aataagatcagcgagattgaagccg

SEQ ID NO: 5738 - DNA, 25 bp, E. coli
aataagatcagccagattgaagccg

SEQ ID NO: 5739 - DNA, 25 bp, E. coli
aaaggcgagtttatcgccaagagcg

SEQ ID NO: 5740 - DNA, 25 bp, E. coli
aaaggcgagtttttcgccaagagcg

SEQ ID NO: 5741 - DNA, 25 bp, E. coli
tatttccagaaacacaaaggcgagt

SEQ ID NO: 5742 - DNA, 25 bp, E. coli
tatttccagaaagacaaaggcgagt

SEQ ID NO: 5743 - DNA, 25 bp, E. coli
tgtacgacaatcagaaaagtctggg

SEQ ID NO: 5744 - DNA, 25 bp, E. coli
tgtacgacaatctgaaaagtctggg

SEQ ID NO: 5745 - DNA, 25 bp, E. coli
tcttaagcgtaacatcctcgacgac

SEQ ID NO: 5746 - DNA, 25 bp, E. coli
tcttaagcgtaagatcctcgacgac

SEQ ID NO: 5747 - DNA, 25 bp, E. coli
gaaattgatcgtaacagcctccggc

SEQ ID NO: 5748 - DNA, 25 bp, E. coli
gacgacttacgtgacctggagtcag

SEQ ID NO: 5749 - DNA, 25 bp, E. coli
gacgacttacgtcacctggagtcag

SEQ ID NO: 5750 - DNA, 25 bp, E. coli
gaaattgatcgttacagcctccggc

SEQ ID NO: 5751 - DNA, 25 bp, E. coli
cggcaggaagccaacaacgatattc

SEQ ID NO: 5752 - DNA, 25 bp, E. coli
cgtaaaacggtcgtcgctgatggtg

SEQ ID NO: 5753 - DNA, 25 bp, E. coli
cgtaaaacggtcctcgctgatggtg

SEQ ID NO: 5754 - DNA, 25 bp, E. coli
cggcaggaagcctacaacgatattc

SEQ ID NO: 5755 - DNA, 25 bp, E. coli
gatcaaatctgcgagcgtgaccgca

SEQ ID NO: 5756 - DNA, 25 bp, E. coli
gatcaaatctgccagcgtgaccgca

SEQ ID NO: 5757 - DNA, 25 bp, E. coli
gaccgcagcgaagttgatcttaagc

SEQ ID NO: 5758 - DNA, 25 bp, E. coli
gaccgcagcgaacttgatcttaagc

SEQ ID NO: 5759 - DNA, 25 bp, E. coli
aatttacgtctgttccgcgacggcg

SEQ ID NO: 5760 - DNA, 25 bp, E. coli
aatttacgtctgatccgcgacggcg

SEQ ID NO: 5761 - DNA, 25 bp, E. coli
taaactgcgcggtgaagcggaactg

SEQ ID NO: 5762 - DNA, 25 bp, E. coli
taaactgcgcggagaagcggaactg

SEQ ID NO: 5763 - DNA, 25 bp, E. coli
tatggtttgaactcccggcagaacg

SEQ ID NO: 5764 - DNA, 25 bp, E. coli
tatggtttgaacacccggcagaacg

SEQ ID NO: 5765 - DNA, 25 bp, E. coli
tataccggacaagagatggtggcgc

SEQ ID NO: 5766 - DNA, 25 bp, E. coli
tttgcatggattgaacggcgcagcg

SEQ ID NO: 5767 - DNA, 25 bp, E. coli
tataccggacaacagatggtggcgc

SEQ ID NO: 5768 - DNA, 25 bp, E. coli
ttctctaaagtgaccatcgcgccag

SEQ ID NO: 5769 - DNA, 25 bp, E. coli
ttctctaaagtgtccatcgcgccag

SEQ ID NO: 5770 - DNA, 25 bp, E. coli
tttgcatggattcaacggcgcagcg

SEQ ID NO: 5771 - DNA, 25 bp, E. coli
gaacgtttcctgatcgtaaccgatg

SEQ ID NO: 5772 - DNA, 25 bp, E. coli
gaacgtttcctgttcgtaaccgatg

SEQ ID NO: 5773 - DNA, 25 bp, E. coli
cgactgccggaagctggtgaagact

SEQ ID NO: 5774 - DNA, 25 bp, E. coli
cgctgatgacgcttgatgactgggc

SEQ ID NO: 5775 - DNA, 25 bp, E. coli
cgactgccggaacctggtgaagact

SEQ ID NO: 5776 - DNA, 25 bp, E. coli
cgctgatgacgcatgatgactgggc

SEQ ID NO: 5777 - DNA, 25 bp, E. coli
ctgaaaatgggcgagaactggcgtc

SEQ ID NO: 5778 - DNA, 25 bp, E. coli
ctgaaaatgggccagaactggcgtc

SEQ ID NO: 5779 - DNA, 25 bp, E. coli
gatggtggcgcgtgcaaaattccgt

SEQ ID NO: 5780 - DNA, 25 bp, E. coli
gatggtggcgcgagcaaaattccgt

SEQ ID NO: 5781 - DNA, 25 bp, E. coli
caatcaaagaaaaattacatgcgca

SEQ ID NO: 5782 - DNA, 25 bp, E. coli
caatcaaagaaatattacatgcgca

SEQ ID NO: 5783 - DNA, 25 bp, E. coli
cgactatcaaccctcactcaaaaaa

SEQ ID NO: 5784 - DNA, 25 bp, E. coli
catatatggcttatacctgctacaa

SEQ ID NO: 5785 - DNA, 25 bp, E. coli
catatatggcttttacctgctacaa

SEQ ID NO: 5786 - DNA, 25 bp, E. coli
cgactatcaaccgtcactcaaaaaa

SEQ ID NO: 5787 - DNA, 25 bp, E. coli
attttatctgcaccggacaccagcc

SEQ ID NO: 5788 - DNA, 25 bp, E. coli
attttatctgcagcggacaccagcc

SEQ ID NO: 5789 - DNA, 25 bp, E. coli
tttcaagctatcaagaataagttgc

SEQ ID NO: 5790 - DNA, 25 bp, E. coli
tttcaagctatctagaataagttgc

SEQ ID NO: 5791 - DNA, 25 bp, E. coli
tcttgccgagtgaacgaaaacgtct

SEQ ID NO: 5792 - DNA, 25 bp, E. coli
tcttgccgagtgtacgaaaacgtct

SEQ ID NO: 5793 - DNA, 25 bp, E. coli
cctgctacaaagttgaagaagtgca

SEQ ID NO: 5794 - DNA, 25 bp, E. coli
cctgctacaaagatgaagaagtgca

SEQ ID NO: 5795 - DNA, 25 bp, E. coli
gcataaatgtgatgttaaaacaatc

SEQ ID NO: 5796 - DNA, 25 bp, E. coli
gcataaatgtgaagttaaaacaatc

SEQ ID NO: 5797 - DNA, 25 bp, E. coli
gaaaacgtcttcgttgccaccgact

SEQ ID NO: 5798 - DNA, 25 bp, E. coli
gaaaacgtcttccttgccaccgact

SEQ ID NO: 5799 - DNA, 25 bp, E. coli
gattcgtttttcatgccgagtgtac

SEQ ID NO: 5800 - DNA, 25 bp, E. coli
gattcgtttttcttgccgagtgtac

SEQ ID NO: 5801 - DNA, 25 bp, E. coli
taagttgcattttatctgcaccgga

SEQ ID NO: 5802 - DNA, 25 bp, E. coli
taagttgcatttaatctgcaccgga

SEQ ID NO: 5803 - DNA, 25 bp, E. coli
catcgaacttgaccgcgatctggcg

SEQ ID NO: 5804 - DNA, 25 bp, E. coli
catcgaacttgagcgcgatctggcg

SEQ ID NO: 5805 - DNA, 25 bp, E. coli
taaaaccattcgaaacagcctcggc

SEQ ID NO: 5806 - DNA, 25 bp, E. coli
taaaaccattcgtaacagcctcggc

SEQ ID NO: 5807 - DNA, 25 bp, E. coli
acccaaagtggaatccgccgtcgtg

SEQ ID NO: 5808 - DNA, 25 bp, E. coli
acccaaagtggattccgccgtcgtg

SEQ ID NO: 5809 - DNA, 25 bp, E. coli
atgaataatcgactccaccagggcc

SEQ ID NO: 5810 - DNA, 25 bp, E. coli
atgaataatcgagtccaccagggcc

SEQ ID NO: 5811 - DNA, 25 bp, E. coli
tatggtcgattatgcgtcatggcgc

SEQ ID NO: 5812 - DNA, 25 bp, E. coli
tatggtcgattaagcgtcatggcgc

SEQ ID NO: 5813 - DNA, 25 bp, E. coli
tatactgatgcctttgccgacatgc

SEQ ID NO: 5814 - DNA, 25 bp, E. coli
tatactgatgccattgccgacatgc

SEQ ID NO: 5815 - DNA, 25 bp, E. coli
ccggcgatgcgaccggaaaatatct

SEQ ID NO: 5816 - DNA, 25 bp, E. coli
gcgcctggttcctcatgcaacgatg

SEQ ID NO: 5817 - DNA, 25 bp, E. coli
ccggcgatgcgagcggaaaatatct

SEQ ID NO: 5818 - DNA, 25 bp, E. coli
gcgcctggttccacatgcaacgatg

SEQ ID NO: 5819 - DNA, 25 bp, E. coli
gaatcgtctggtagcaggaccgaac

SEQ ID NO: 5820 - DNA, 25 bp, E. coli
gaatcgtctggttgcaggaccgaac

SEQ ID NO: 5821 - DNA, 25 bp, E. coli
tcttaggcccgatactgacgattta

SEQ ID NO: 5822 - DNA, 25 bp, E. coli
gatttatcagcacgatgcgatgacc

SEQ ID NO: 5823 - DNA, 25 bp, E. coli
gatttatcagcaggatgcgatgacc

SEQ ID NO: 5824 - DNA, 25 bp, E. coli
tcttaggcccgaaactgacgattta

SEQ ID NO: 5825 - DNA, 25 bp, E. coli
cagaagtggagccttttgacgtcca

SEQ ID NO: 5826 - DNA, 25 bp, E. coli
cagaagtggagcgttttgacgtcca

SEQ ID NO: 5827 - DNA, 25 bp, E. coli
catttccgtcacctgagcgaggcgg

SEQ ID NO: 5828 - DNA, 25 bp, E. coli
aaatctcttttgaatgtgcagcacc

SEQ ID NO: 5829 - DNA, 25 bp, E. coli
aaatctcttttgtatgtgcagcacc

SEQ ID NO: 5830 - DNA, 25 bp, E. coli
ttcgactggcactagaaaaagcgca

SEQ ID NO: 5831 - DNA, 25 bp, E. coli
ttcgactggcacaagaaaaagcgca

SEQ ID NO: 5832 - DNA, 25 bp, E. coli
tgtgttcttgatggcgaaatcaccg

SEQ ID NO: 5833 - DNA, 25 bp, E. coli
tgtgttcttgatcgcgaaatcaccg

SEQ ID NO: 5834 - DNA, 25 bp, E. coli
tgcactgcgcggctagctttaagag

SEQ ID NO: 5835 - DNA, 25 bp, E. coli
tgcactgcgcgggtagctttaagag

SEQ ID NO: 5836 - DNA, 25 bp, E. coli
tctgcaattacgcaaagccagcggc

SEQ ID NO: 5837 - DNA, 25 bp, E. coli
tctgcaattacggaaagccagcggc

SEQ ID NO: 5838 - DNA, 25 bp, E. coli
gactggcgttgtataattcggcgaa

SEQ ID NO: 5839 - DNA, 25 bp, E. coli
gactggcgttgtttaattcggcgaa

SEQ ID NO: 5840 - DNA, 25 bp, E. coli
cgctgtgtcagaagttacgtcggga

SEQ ID NO: 5841 - DNA, 25 bp, E. coli
cgctgtgtcagatgttacgtcggga

SEQ ID NO: 5842 - DNA, 25 bp, E. coli
catttccgtcacgtgagcgaggcgg

SEQ ID NO: 5843 - DNA, 25 bp, E. coli
tggcgtcgcgctgttctggaaaaac

SEQ ID NO: 5844 - DNA, 25 bp, E. coli
tggcgtcgcgctcttctggaaaaac

SEQ ID NO: 5845 - DNA, 25 bp, E. coli
taacacgctggttggtttaccgcta

SEQ ID NO: 5846 - DNA, 25 bp, E. coli
taacacgctggtaggtttaccgcta

SEQ ID NO: 5847 - DNA, 25 bp, E. coli
caaacgatggaattgcacctccaga

SEQ ID NO: 5848 - DNA, 25 bp, E. coli
caaacgatggaaatgcacctccaga

SEQ ID NO: 5849 - DNA, 25 bp, E. coli
taaagccagcttagctacagagttc

SEQ ID NO: 5850 - DNA, 25 bp, E. coli
agccgccggactagataccacgaag

SEQ ID NO: 5851 - DNA, 25 bp, E. coli
agccgccggacttgataccacgaag

SEQ ID NO: 5852 - DNA, 25 bp, E. coli
aaaatgagaaatgttaccgagcgac

SEQ ID NO: 5853 - DNA, 25 bp, E. coli
aaaatgagaaatcttaccgagcgac

SEQ ID NO: 5854 - DNA, 25 bp, E. coli
ttaagcaagccattagcagcgcacc

SEQ ID NO: 5855 - DNA, 25 bp, E. coli
ttaagcaagccaatagcagcgcacc

SEQ ID NO: 5856 - DNA, 25 bp, E. coli
tgacagaaacccagatctacgagaa

SEQ ID NO: 5857 - DNA, 25 bp, E. coli
tgacagaaaccctgatctacgagaa

SEQ ID NO: 5858 - DNA, 25 bp, E. coli
tccagatgatcatatacgctgacca

SEQ ID NO: 5859 - DNA, 25 bp, E. coli
tccagatgatcaaatacgctgacca

SEQ ID NO: 5860 - DNA, 25 bp, E. coli
tctacgagaacaataagcaagccat

SEQ ID NO: 5861 - DNA, 25 bp, E. coli
tctacgagaacattaagcaagccat

SEQ ID NO: 5862 - DNA, 25 bp, E. coli
gcgcaccacgaattagccaaacgat

SEQ ID NO: 5863 - DNA, 25 bp, E. coli
gcgcaccacgaaatagccaaacgat

SEQ ID NO: 5864 - DNA, 25 bp, E. coli
cgaaggtgtaggacttaaagccagc

SEQ ID NO: 5865 - DNA, 25 bp, E. coli
cgaaggtgtaggtcttaaagccagc

SEQ ID NO: 5866 - DNA, 25 bp, E. coli
taaagccagctttgctacagagttc

SEQ ID NO: 5867 - DNA, 25 bp, E. coli
gaccatctgaaatacgtcacggcaa

SEQ ID NO: 5868 - DNA, 25 bp, E. coli
gaccatctgaaaaacgtcacggcaa

SEQ ID NO: 5869 - DNA, 25 bp, E. coli
caatgacgaaccagacgcagaagag

SEQ ID NO: 5870 - DNA, 25 bp, E. coli
caagattgctccagcggtcgcgaaa

SEQ ID NO: 5871 - DNA, 25 bp, E. coli
caatgacgaacctgacgcagaagag

SEQ ID NO: 5872 - DNA, 25 bp, E. coli
caagattgctcctgcggtcgcgaaa

SEQ ID NO: 5873 - DNA, 25 bp, E. coli
tacctacgtcaatgacgaaccagac

SEQ ID NO: 5874 - DNA, 25 bp, E. coli
tacgtcaatgacgaaccagacgcag

SEQ ID NO: 5875 - DNA, 25 bp, E. coli
tagtcaagattggtcctgcggtcgc

SEQ ID NO: 5876 - DNA, 25 bp, E. coli
tacgtcaatgaccaaccagacgcag

SEQ ID NO: 5877 - DNA, 25 bp, E. coli
tacctacgtcaaagacgaaccagac

SEQ ID NO: 5878 - DNA, 25 bp, E. coli
tagtcaagattgctcctgcggtcgc

SEQ ID NO: 5879 - DNA, 25 bp, E. coli
tgatccgcgtctcatagtcaagatt

SEQ ID NO: 5880 - DNA, 25 bp, E. coli
tgatccgcgtctgatagtcaagatt

SEQ ID NO: 5881 - DNA, 25 bp, E. coli
tgacgaaccagacgcagaagagctg

SEQ ID NO: 5882 - DNA, 25 bp, E. coli
tgacgaaccagaggcagaagagctg

SEQ ID NO: 5883 - DNA, 25 bp, E. coli
tctgatagtcaacattgctcctgcg

SEQ ID NO: 5884 - DNA, 25 bp, E. coli
tctgatagtcaagattgctcctgcg

SEQ ID NO: 5885 - DNA, 25 bp, E. coli
cgcgtctgatagacaagattgctcc

SEQ ID NO: 5886 - DNA, 25 bp, E. coli
cgaaccagacgcagaagagctggcg

SEQ ID NO: 5887 - DNA, 25 bp, E. coli
cgcgtctgatagtcaagattgctcc

SEQ ID NO: 5888 - DNA, 25 bp, E. coli
cgaaccagacgctgaagagctggcg

SEQ ID NO: 5889 - DNA, 25 bp, E. coli
gtcaagattgctgctgcggtcgcga

SEQ ID NO: 5890 - DNA, 25 bp, E. coli
gtcaagattgctcctgcggtcgcga

SEQ ID NO: 5891 - DNA, 25 bp, E. coli
aatcagctgcaagcgctgctgttga

SEQ ID NO: 5892 - DNA, 25 bp, E. coli
aatcagctgcaaccgctgctgttga

SEQ ID NO: 5893 - DNA, 25 bp, E. coli
ctacgtggaagacatcactgattac

SEQ ID NO: 5894 - DNA, 25 bp, E. coli
cagccacaccgcctgatggagttgc

SEQ ID NO: 5895 - DNA, 25 bp, E. coli
ctacgtggaagagatcactgattac

SEQ ID NO: 5896 - DNA, 25 bp, E. coli
cagccacaccgcgtgatggagttgc

SEQ ID NO: 5897 - DNA, 25 bp, E. coli
acaccgcgtgatcgagttgcacaac

SEQ ID NO: 5898 - DNA, 25 bp, E. coli
acaccgcgtgatggagttgcacaac

SEQ ID NO: 5899 - DNA, 25 bp, E. coli
tgttcgatgtcgatcagcagggccg

SEQ ID NO: 5900 - DNA, 25 bp, E. coli
tgtgtgcgaatctgctgcaaccgct

SEQ ID NO: 5901 - DNA, 25 bp, E. coli
tgtgtgcgaatcagctgcaaccgct

SEQ ID NO: 5902 - DNA, 25 bp, E. coli
tgttcgatgtcgttcagcagggccg

SEQ ID NO: 5903 - DNA, 25 bp, E. coli
tcttccatccggagttcgatgtcga

SEQ ID NO: 5904 - DNA, 25 bp, E. coli
tcttccatccggtgttcgatgtcga

SEQ ID NO: 5905 - DNA, 25 bp, E. coli
gcagaacatgcagggcggtaactcg

SEQ ID NO: 5906 - DNA, 25 bp, E. coli
gcagaacatgcacggcggtaactcg

SEQ ID NO: 5907 - DNA, 25 bp, E. coli
cgcgcgtttcgtggtgaaaaatgtt

SEQ ID NO: 5908 - DNA, 25 bp, E. coli
cgcgcgtttcgtcgtgaaaaatgtt

SEQ ID NO: 5909 - DNA, 25 bp, E. coli
gtatcgatgatgtcgcgcaggcgga

SEQ ID NO: 5910 - DNA, 25 bp, E. coli
gtatcgatgatgacgcgcaggcgga

SEQ ID NO: 5911 - DNA, 25 bp, E. coli
tggaagagatcactgattacgtgct

SEQ ID NO: 5912 - DNA, 25 bp, E. coli
tggaagagatcagtgattacgtgct

SEQ ID NO: 5913 - DNA, 25 bp, E. coli
cataagatccctacggcggaatacc

SEQ ID NO: 5914 - DNA, 25 bp, E. coli
cataagatcccttcggcggaatacc

SEQ ID NO: 5915 - DNA, 25 bp, E. coli
aggtgcggcccatctggaaggctca

SEQ ID NO: 5916 - DNA, 25 bp, E. coli
aggtgcggcccaactggaaggctca

SEQ ID NO: 5917 - DNA, 25 bp, E. coli
actgcactggaagccgcgctgcaaa

SEQ ID NO: 5918 - DNA, 25 bp, E. coli
aaaagattgatctgaccatcgtcgg

SEQ ID NO: 5919 - DNA, 25 bp, E. coli
aaaagattgatcagaccatcgtcgg

SEQ ID NO: 5920 - DNA, 25 bp, E. coli
actgcactggaacccgcgctgcaaa

SEQ ID NO: 5921 - DNA, 25 bp, E. coli
tgcggcccaactggaaggctcaaaa

SEQ ID NO: 5922 - DNA, 25 bp, E. coli
tgcggcccaactcgaaggctcaaaa

SEQ ID NO: 5923 - DNA, 25 bp, E. coli
gcgctgcaaaacgttgctattggcg

SEQ ID NO: 5924 - DNA, 25 bp, E. coli
ccaactggaaggctcaaaagcgttt

SEQ ID NO: 5925 - DNA, 25 bp, E. coli
gcgctgcaaaaccttgctattggcg

SEQ ID NO: 5926 - DNA, 25 bp, E. coli
ccaactggaagggtcaaaagcgttt

SEQ ID NO: 5927 - DNA, 25 bp, E. coli
gcacaaaacgaaaagattgatctga

SEQ ID NO: 5928 - DNA, 25 bp, E. coli
gcacaaaacgaatagattgatctga

SEQ ID NO: 5929 - DNA, 25 bp, E. coli
cgcgccggtagtaaccgatgacgtt

SEQ ID NO: 5930 - DNA, 25 bp, E. coli
cgcgccggtagttaccgatgacgtt

SEQ ID NO: 5931 - DNA, 25 bp, E. coli
gatccctacggccgaataccagaac

SEQ ID NO: 5932 - DNA, 25 bp, E. coli
gattgatctgaccatcgtcggcccg

SEQ ID NO: 5933 - DNA, 25 bp, E. coli
gattgatctgacgatcgtcggcccg

SEQ ID NO: 5934 - DNA, 25 bp, E. coli
gatccctacggcggaataccagaac

SEQ ID NO: 5935 - DNA, 25 bp, E. coli
cagcagtacaaatatcaggcgtgct

SEQ ID NO: 5936 - DNA, 25 bp, E. coli
cagcagtacaaaaatcaggcgtgct

SEQ ID NO: 5937 - DNA, 25 bp, E. coli
catatcagccagtaaggcggaagcg

SEQ ID NO: 5938 - DNA, 25 bp, E. coli
catatcagccagaaaggcggaagcg

SEQ ID NO: 5939 - DNA, 25 bp, E. coli
tctgcaaagaagacagaggaagcgt

SEQ ID NO: 5940 - DNA, 25 bp, E. coli
tctgcaaagaagtcagaggaagcgt

SEQ ID NO: 5941 - DNA, 25 bp, E. coli
gccgatgagaataattgagacaaac

SEQ ID NO: 5942 - DNA, 25 bp, E. coli
gccgatgagaattattgagacaaac

SEQ ID NO: 5943 - DNA, 25 bp, E. coli
gcggaagacgccctaaacagaattc

SEQ ID NO: 5944 - DNA, 25 bp, E. coli
gcgagcgccgcatatgctgatactt

SEQ ID NO: 5945 - DNA, 25 bp, E. coli
gcgagcgccgcaaatgctgatactt

SEQ ID NO: 5946 - DNA, 25 bp, E. coli
gcggaagacgccgtaaacagaattc

SEQ ID NO: 5947 - DNA, 25 bp, E. coli
cgccgtaaacagtattcccaccgtg

SEQ ID NO: 5948 - DNA, 25 bp, E. coli
cgccgtaaacagaattcccaccgtg

SEQ ID NO: 5949 - DNA, 25 bp, E. coli
cgcaaatgctgatacttcagcagag

SEQ ID NO: 5950 - DNA, 25 bp, E. coli
cgcaaatgctgaaacttcagcagag

SEQ ID NO: 5951 - DNA, 25 bp, E. coli
tggcagcagtactaatatcaggcgt

SEQ ID NO: 5952 - DNA, 25 bp, E. coli
tggcagcagtacaaatatcaggcgt

SEQ ID NO: 5953 - DNA, 25 bp, E. coli
taaggcggaagcgagcgccgcaaat

SEQ ID NO: 5954 - DNA, 25 bp, E. coli
taaggcggaagccagcgccgcaaat

SEQ ID NO: 5955 - DNA, 25 bp, E. coli
gaggagatacaggtccggcaggtcc

SEQ ID NO: 5956 - DNA, 25 bp, E. coli
gaggagatacagctccggcaggtcc

SEQ ID NO: 5957 - DNA, 25 bp, E. coli
accatggtttaaactgacagtacga

SEQ ID NO: 5958 - DNA, 25 bp, E. coli
accatggtttaatctgacagtacga

SEQ ID NO: 5959 - DNA, 25 bp, E. coli
tagcaacgggaatgatcatcattgg

SEQ ID NO: 5960 - DNA, 25 bp, E. coli
tagcaacgggaaagatcatcattgg

SEQ ID NO: 5961 - DNA, 25 bp, E. coli
gcgctggttagaccgcaacgtcgaa

SEQ ID NO: 5962 - DNA, 25 bp, E. coli
gcgctggttagagcgcaacgtcgaa

SEQ ID NO: 5963 - DNA, 25 bp, E. coli
gaatgactttaaaagtagcaacggg

SEQ ID NO: 5964 - DNA, 25 bp, E. coli
gaatgactttaatagtagcaacggg

SEQ ID NO: 5965 - DNA, 25 bp, E. coli
gacagtacgaaatcgctataaccat

SEQ ID NO: 5966 - DNA, 25 bp, E. coli
gacagtacgaaaacgctataaccat

SEQ ID NO: 5967 - DNA, 25 bp, E. coli
cgttaccgtattaatgaacactggc

SEQ ID NO: 5968 - DNA, 25 bp, E. coli
cgttaccgtatttatgaacactggc

SEQ ID NO: 5969 - DNA, 25 bp, E. coli
ggtgcagtgtatgtggacgtcaact

SEQ ID NO: 5970 - DNA, 25 bp, E. coli
ggtgcagtgtatctggacgtcaact

SEQ ID NO: 5971 - DNA, 25 bp, E. coli
ggcacctactggtattttaaaatca

SEQ ID NO: 5972 - DNA, 25 bp, E. coli
ggcacctactggaattttaaaatca

SEQ ID NO: 5973 - DNA, 25 bp, E. coli
ggctcccttattacgaattgcgctg

SEQ ID NO: 5974 - DNA, 25 bp, E. coli
ggctcccttatttcgaattgcgctg

SEQ ID NO: 5975 - DNA, 25 bp, E. coli
taatgacacctatgaaattggcacc

SEQ ID NO: 5976 - DNA, 25 bp, E. coli
taatgacacctaagaaattggcacc

SEQ ID NO: 5977 - DNA, 25 bp, E. coli
gagccacattacttcatgcgagtga

SEQ ID NO: 5978 - DNA, 25 bp, E. coli
gagccacattacatcatgcgagtga

SEQ ID NO: 5979 - DNA, 25 bp, E. coli
aagacttggctgaaaatgaccatgg

SEQ ID NO: 5980 - DNA, 25 bp, E. coli
aagacttggctgtaaatgaccatgg

SEQ ID NO: 5981 - DNA, 25 bp, E. coli
caactaaaccatcaaagagcatggg

SEQ ID NO: 5982 - DNA, 25 bp, E. coli
caactaaaccatgaaagagcatggg

SEQ ID NO: 5983 - DNA, 25 bp, E. coli
taaatctgttcgctatgtacggcag

SEQ ID NO: 5984 - DNA, 25 bp, E. coli
taaatgacgctgctgttagccgatc

SEQ ID NO: 5985 - DNA, 25 bp, E. coli
taaatctgttcggtatgtacggcag

SEQ ID NO: 5986 - DNA, 25 bp, E. coli
tacggcagaaaagtaaagctatccc

SEQ ID NO: 5987 - DNA, 25 bp, E. coli
taaatgacgctggtgttagccgatc

SEQ ID NO: 5988 - DNA, 25 bp, E. coli
tacggcagaaaactaaagctatccc

SEQ ID NO: 5989 - DNA, 25 bp, E. coli
tgtccatcaacatcagattgctcag

SEQ ID NO: 5990 - DNA, 25 bp, E. coli
tgtccatcaacaacagattgctcag

SEQ ID NO: 5991 - DNA, 25 bp, E. coli
ccgctgaatccgctgaatggtattg

SEQ ID NO: 5992 - DNA, 25 bp, E. coli
ccgctgaatccggtgaatggtattg

SEQ ID NO: 5993 - DNA, 25 bp, E. coli
gataaaggctttacaagatgctggc

SEQ ID NO: 5994 - DNA, 25 bp, E. coli
gataaaggcttttcaagatgctggc

SEQ ID NO: 5995 - DNA, 25 bp, E. coli
gaccatgggttgacatgtccatcaa

SEQ ID NO: 5996 - DNA, 25 bp, E. coli
gatggagtctgtttgcgtatccgct

SEQ ID NO: 5997 - DNA, 25 bp, E. coli
gatccattagggttaagtcccgcag

SEQ ID NO: 5998 - DNA, 25 bp, E. coli
gatggagtctgtatgcgtatccgct

SEQ ID NO: 5999 - DNA, 25 bp, E. coli
gaccatgggttgtcatgtccatcaa

SEQ ID NO: 6000 - DNA, 25 bp, E. coli
gatccattagggataagtcccgcag

SEQ ID NO: 6001 - DNA, 25 bp, E. coli
tacacggtgaaatggcctgtgccgc

SEQ ID NO: 6002 - DNA, 25 bp, E. coli
tacagatcagcctgagtttcgcatg

SEQ ID NO: 6003 - DNA, 25 bp, E. coli
tacactgttcgaaattaagatggcc

SEQ ID NO: 6004 - DNA, 25 bp, E. coli
tacacggtgaaaaggcctgtgccgc

SEQ ID NO: 6005 - DNA, 25 bp, E. coli
tacactgttcgatattaagatggcc

SEQ ID NO: 6006 - DNA, 25 bp, E. coli
tacagatcagccagagtttcgcatg

SEQ ID NO: 6007 - DNA, 25 bp, E. coli
tatctggctcaaccaacagtggtcc

SEQ ID NO: 6008 - DNA, 25 bp, E. coli
tatctggctcaagcaacagtggtcc

SEQ ID NO: 6009 - DNA, 25 bp, E. coli
ttataacggagagcaacaggtagcc

SEQ ID NO: 6010 - DNA, 25 bp, E. coli
ttataacggagaccaacaggtagcc

SEQ ID NO: 6011 - DNA, 25 bp, E. coli
tgcgcaatttgaaggacacggcctc

SEQ ID NO: 6012 - DNA, 25 bp, E. coli
tgcgcaatttgatggacacggcctc

SEQ ID NO: 6013 - DNA, 25 bp, E. coli
gaagatactcatgtgctacacggtg

SEQ ID NO: 6014 - DNA, 25 bp, E. coli
gaagatactcatctgctacacggtg

SEQ ID NO: 6015 - DNA, 25 bp, E. coli
gacacgctggatgctttataacgga

SEQ ID NO: 6016 - DNA, 25 bp, E. coli
gacacgctggatcctttataacgga

SEQ ID NO: 6017 - DNA, 25 bp, E. coli
gattcaggttgctccgcagcaaacg

SEQ ID NO: 6018 - DNA, 25 bp, E. coli
gattcaggttgcaccgcagcaaacg

SEQ ID NO: 6019 - DNA, 25 bp, E. coli
tcaacggattatccagggagaagcc

SEQ ID NO: 6020 - DNA, 25 bp, E. coli
tcaacggattatgcagggagaagcc

SEQ ID NO: 6021 - DNA, 25 bp, E. coli
gagaagcctctcagtcgacgctgag

SEQ ID NO: 6022 - DNA, 25 bp, E. coli
gagaagcctctctgtcgacgctgag

SEQ ID NO: 6023 - DNA, 25 bp, E. coli
caaggtttacgaactggcgggcgat

SEQ ID NO: 6024 - DNA, 25 bp, E. coli
caaggtttacgatctggcgggcgat

SEQ ID NO: 6025 - DNA, 25 bp, E. coli
catcgagacggacaaaatgctggct

SEQ ID NO: 6026 - DNA, 25 bp, E. coli
catcgagacggagaaaatgctggct

SEQ ID NO: 6027 - DNA, 25 bp, E. coli
tagtggctatcgatcgtaatccggc

SEQ ID NO: 6028 - DNA, 25 bp, E. coli
tagtggctatcgttcgtaatccggc

SEQ ID NO: 6029 - DNA, 25 bp, E. coli
tatgctggcggattctgacgttggc

SEQ ID NO: 6030 - DNA, 25 bp, E. coli
tatgctggcggaatctgacgttggc

SEQ ID NO: 6031 - DNA, 25 bp, E. coli
ttccagcgaagtcggtcaacgtgcc

SEQ ID NO: 6032 - DNA, 25 bp, E. coli
ttccagcgaagtgggtcaacgtgcc

SEQ ID NO: 6033 - DNA, 25 bp, E. coli
gcattaccgtgcctcaggctgacta

SEQ ID NO: 6034 - DNA, 25 bp, E. coli
gcattaccgtgcgtcaggctgacta

SEQ ID NO: 6035 - DNA, 25 bp, E. coli
gcagcactggaagacggcgtattta

SEQ ID NO: 6036 - DNA, 25 bp, E. coli
gcagcactggaacacggcgtattta

SEQ ID NO: 6037 - DNA, 25 bp, E. coli
gaaatttatcgcatataccagcctg

SEQ ID NO: 6038 - DNA, 25 bp, E. coli
gaaatttatcgcttataccagcctg

SEQ ID NO: 6039 - DNA, 25 bp, E. coli
cgttagccgaaaccgtaagccatct

SEQ ID NO: 6040 - DNA, 25 bp, E. coli
cgttagccgaaagcgtaagccatct

SEQ ID NO: 6041 - DNA, 25 bp, E. coli
cgtgccccgcaggatcgtaatgtta

SEQ ID NO: 6042 - DNA, 25 bp, E. coli
cgtgccccgcagcatcgtaatgtta

SEQ ID NO: 6043 - DNA, 25 bp, E. coli
gatgaaaacggtacctgccagccaa

SEQ ID NO: 6044 - DNA, 25 bp, E. coli
gatgaaaacggttcctgccagccaa

SEQ ID NO: 6045 - DNA, 25 bp, E. coli
ccgtcgttggatcaactccggtggc

SEQ ID NO: 6046 - DNA, 25 bp, E. coli
ccgtcgttggatgaactccggtggc

SEQ ID NO: 6047 - DNA, 25 bp, E. coli
tacagcgttgcattatgaactgccg

SEQ ID NO: 6048 - DNA, 25 bp, E. coli
tacagcgttgcaatatgaactgccg

SEQ ID NO: 6049 - DNA, 25 bp, E. coli
tatgaactgccggtgctggtggtta

SEQ ID NO: 6050 - DNA, 25 bp, E. coli
tatgaactgccgctgctggtggtta

SEQ ID NO: 6051 - DNA, 25 bp, E. coli
ttaatcttaataaccgctatttggg

SEQ ID NO: 6052 - DNA, 25 bp, E. coli
ttaatcttaatatccgctatttggg

SEQ ID NO: 6053 - DNA, 25 bp, E. coli
ttttgctgtcggtgtccgctttgac

SEQ ID NO: 6054 - DNA, 25 bp, E. coli
ttttgctgtcggagtccgctttgac

SEQ ID NO: 6055 - DNA, 25 bp, E. coli
tgtctacagcgtagcaatatgaact

SEQ ID NO: 6056 - DNA, 25 bp, E. coli
tgtctacagcgttgcaatatgaact

SEQ ID NO: 6057 - DNA, 25 bp, E. coli
tgcaatatgaacagccggtgctggt

SEQ ID NO: 6058 - DNA, 25 bp, E. coli
tgcaatatgaactgccggtgctggt

SEQ ID NO: 6059 - DNA, 25 bp, E. coli
tgccggtgctggaggttaatcttaa

SEQ ID NO: 6060 - DNA, 25 bp, E. coli
tcggtgtccgctttgacgatcgcac

SEQ ID NO: 6061 - DNA, 25 bp, E. coli
tcggtgtccgctatgacgatcgcac

SEQ ID NO: 6062 - DNA, 25 bp, E. coli
tcgcaccactaacaatctggcaaag

SEQ ID NO: 6063 - DNA, 25 bp, E. coli
tgccggtgctggtggttaatcttaa

SEQ ID NO: 6064 - DNA, 25 bp, E. coli
tcgcaccactaagaatctggcaaag

SEQ ID NO: 6065 - DNA, 25 bp, E. coli
gacgatcgcacctctaacaatctgg

SEQ ID NO: 6066 - DNA, 25 bp, E. coli
gacgatcgcaccactaacaatctgg

SEQ ID NO: 6067 - DNA, 25 bp, E. coli
aagatcaggcccgtcttgatttggt

SEQ ID NO: 6068 - DNA, 25 bp, E. coli
aagatcaggcccctcttgatttggt

SEQ ID NO: 6069 - DNA, 25 bp, E. coli
caggcccgtcttgatttggtacagc

SEQ ID NO: 6070 - DNA, 25 bp, E. coli
catccattgggaaaagatgcggcgc

SEQ ID NO: 6071 - DNA, 25 bp, E. coli
caggcccgtcttcatttggtacagc

SEQ ID NO: 6072 - DNA, 25 bp, E. coli
catccattgggataagatgcggcgc

SEQ ID NO: 6073 - DNA, 25 bp, E. coli
agcaactagggctggatggagaact

SEQ ID NO: 6074 - DNA, 25 bp, E. coli
agcaactagggcaggatggagaact

SEQ ID NO: 6075 - DNA, 25 bp, E. coli
gcgaagtagtagaacgtaaaggtgt

SEQ ID NO: 6076 - DNA, 25 bp, E. coli
gcgaagtagtagtacgtaaaggtgt

SEQ ID NO: 6077 - DNA, 25 bp, E. coli
ttcccatccattgggaaaagatgcg

SEQ ID NO: 6078 - DNA, 25 bp, E. coli
ttcccatccattcggaaaagatgcg

SEQ ID NO: 6079 - DNA, 25 bp, E. coli
tgatttggtacacctggtagcggaa

SEQ ID NO: 6080 - DNA, 25 bp, E. coli
tgatttggtacagctggtagcggaa

SEQ ID NO: 6081 - DNA, 25 bp, E. coli
tcttgatttggtacagctggtagcg

SEQ ID NO: 6082 - DNA, 25 bp, E. coli
tcttgatttggttcagctggtagcg

SEQ ID NO: 6083 - DNA, 25 bp, E. coli
gcggccaggcgaagcagcaattaat

SEQ ID NO: 6084 - DNA, 25 bp, E. coli
gcggccaggcgatgcagcaattaat

SEQ ID NO: 6085 - DNA, 25 bp, E. coli
cgctgattggcgtagtagtagaacg

SEQ ID NO: 6086 - DNA, 25 bp, E. coli
cgctgattggcgaagtagtagaacg

SEQ ID NO: 6087 - DNA, 25 bp, E. coli
cattgggaaaagttgcggcgctgat

SEQ ID NO: 6088 - DNA, 25 bp, E. coli
cattgggaaaagatgcggcgctgat

SEQ ID NO: 6089 - DNA, 25 bp, E. coli
catcagcggtcagcaactggattac

SEQ ID NO: 6090 - DNA, 25 bp, E. coli
cagcaactggataaccgcacgggtg

SEQ ID NO: 6091 - DNA, 25 bp, E. coli
cagcaactggattaccgcacgggtg

SEQ ID NO: 6092 - DNA, 25 bp, E. coli
catcagcggtcaccaactggattac

SEQ ID NO: 6093 - DNA, 25 bp, E. coli
attaccgcacgggtggcgatgtggg

SEQ ID NO: 6094 - DNA, 25 bp, E. coli
attaccgcacggctggcgatgtggg

SEQ ID NO: 6095 - DNA, 25 bp, E. coli
aggtattgccggtcagatgcacggt

SEQ ID NO: 6096 - DNA, 25 bp, E. coli
aggtattgccggacagatgcacggt

SEQ ID NO: 6097 - DNA, 25 bp, E. coli
aaagcgtgactggagcgatctcatg

SEQ ID NO: 6098 - DNA, 25 bp, E. coli
aaagcgtgactgcagcgatctcatg

SEQ ID NO: 6099 - DNA, 25 bp, E. coli
tgctttaatcactgcagctcgacag

SEQ ID NO: 6100 - DNA, 25 bp, E. coli
tgactggagcgaactcatgctgcag

SEQ ID NO: 6101 - DNA, 25 bp, E. coli
tgctttaatcacagcagctcgacag

SEQ ID NO: 6102 - DNA, 25 bp, E. coli
tgactggagcgatctcatgctgcag

SEQ ID NO: 6103 - DNA, 25 bp, E. coli
tccctgctttaatcactgcagctcg

SEQ ID NO: 6104 - DNA, 25 bp, E. coli
tccctgctttaaacactgcagctcg

SEQ ID NO: 6105 - DNA, 25 bp, E. coli
cgtgactggagcgatctcatgctgc

SEQ ID NO: 6106 - DNA, 25 bp, E. coli
cggacatcagcggtcagcaactgga

SEQ ID NO: 6107 - DNA, 25 bp, E. coli
cggacatcagcgctcagcaactgga

SEQ ID NO: 6108 - DNA, 25 bp, E. coli
cgtgactggagccatctcatgctgc

SEQ ID NO: 6109 - DNA, 25 bp, E. coli
tggagcgatctcttgctgcaggctt

SEQ ID NO: 6110 - DNA, 25 bp, E. coli
tggagcgatctcatgctgcaggctt

SEQ ID NO: 6111 - DNA, 25 bp, E. coli
caaagaaaagaaccaactggcggtc

SEQ ID NO: 6112 - DNA, 25 bp, E. coli
caaagaaaagaagcaactggcggtc

SEQ ID NO: 6113 - DNA, 25 bp, E. coli
cagtatcagtcagtcaaccgtttca

SEQ ID NO: 6114 - DNA, 25 bp, E. coli
cagtatcagtcactcaaccgtttca

SEQ ID NO: 6115 - DNA, 25 bp, E. coli
taccgtcgccggttatggtcgggca

SEQ ID NO: 6116 - DNA, 25 bp, E. coli
taccgtcgccggatatggtcgggca

SEQ ID NO: 6117 - DNA, 25 bp, E. coli
tgtggtaaagcgtacagccctggtg

SEQ ID NO: 6118 - DNA, 25 bp, E. coli
tgtggtaaagcgaacagccctggtg

SEQ ID NO: 6119 - DNA, 25 bp, E. coli
tccgccgcgattagcaaaaccatgg

SEQ ID NO: 6120 - DNA, 25 bp, E. coli
tccgccgcgatttgcaaaaccatgg

SEQ ID NO: 6121 - DNA, 25 bp, E. coli
tcagcgcctgataaccgaaaaaagt

SEQ ID NO: 6122 - DNA, 25 bp, E. coli
tctttcacaggaggaaatccgccgc

SEQ ID NO: 6123 - DNA, 25 bp, E. coli
tctttcacaggacgaaatccgccgc

SEQ ID NO: 6124 - DNA, 25 bp, E. coli
tcagcgcctgattaccgaaaaaagt

SEQ ID NO: 6125 - DNA, 25 bp, E. coli
cctgagtgtcgaccataatggtgaa

SEQ ID NO: 6126 - DNA, 25 bp, E. coli
cctgagtgtcgagcataatggtgaa

SEQ ID NO: 6127 - DNA, 25 bp, E. coli
gaatacgatgataactccgccaaag

SEQ ID NO: 6128 - DNA, 25 bp, E. coli
gcaatatcgtttcggtcgcaccacg

SEQ ID NO: 6129 - DNA, 25 bp, E. coli
gaatacgatgattactccgccaaag

SEQ ID NO: 6130 - DNA, 25 bp, E. coli
gcaatatcgtttgggtcgcaccacg

SEQ ID NO: 6131 - DNA, 25 bp, E. coli
gatccgtcgctgaaatggtcctgag

SEQ ID NO: 6132 - DNA, 25 bp, E. coli
gatccgtcgctgtaatggtcctgag

SEQ ID NO: 6133 - DNA, 25 bp, E. coli
cagaagccgctgttgagttccaacg

SEQ ID NO: 6134 - DNA, 25 bp, E. coli
cagaagccgctgatgagttccaacg

SEQ ID NO: 6135 - DNA, 25 bp, E. coli
taaatctgcccaaaccgaagttcgc

SEQ ID NO: 6136 - DNA, 25 bp, E. coli
taacacatcagctagatcaactggt

SEQ ID NO: 6137 - DNA, 25 bp, E. coli
taaatctgcccataccgaagttcgc

SEQ ID NO: 6138 - DNA, 25 bp, E. coli
tgaacagagtcttgagcaactatct

SEQ ID NO: 6139 - DNA, 25 bp, E. coli
tgaacagagtctagagcaactatct

SEQ ID NO: 6140 - DNA, 25 bp, E. coli
tcgtatctcgtctgagttcgaacca

SEQ ID NO: 6141 - DNA, 25 bp, E. coli
tcgtatctcgtcagagttcgaacca

SEQ ID NO: 6142 - DNA, 25 bp, E. coli
tcataaaacaacctacagaagccgc

SEQ ID NO: 6143 - DNA, 25 bp, E. coli
tcataaaacaacgtacagaagccgc

SEQ ID NO: 6144 - DNA, 25 bp, E. coli
gaacgcgtgttataccgtaaggcca

SEQ ID NO: 6145 - DNA, 25 bp, E. coli
gaacgcgtgttaaaccgtaaggcca

SEQ ID NO: 6146 - DNA, 25 bp, E. coli
gaaccatcaaaccaaaagcgcagga

SEQ ID NO: 6147 - DNA, 25 bp, E. coli
gaaccatcaaacgaaaagcgcagga

SEQ ID NO: 6148 - DNA, 25 bp, E. coli
cgtaaggccatttcagaaaagagcg

SEQ ID NO: 6149 - DNA, 25 bp, E. coli
cgtaaggccattacagaaaagagcg

SEQ ID NO: 6150 - DNA, 25 bp, E. coli
gatattccattgcttaaggcgcaaa

SEQ ID NO: 6151 - DNA, 25 bp, E. coli
gatattccattggttaaggcgcaaa

SEQ ID NO: 6152 - DNA, 25 bp, E. coli
taacacatcagcaagatcaactggt

SEQ ID NO: 6153 - DNA, 25 bp, E. coli
gacgagttaaatcccatcagcagtt

SEQ ID NO: 6154 - DNA, 25 bp, E. coli
gacgagttaaatgccatcagcagtt

SEQ ID NO: 6155 - DNA, 25 bp, E. coli
cacagcgtgaccagattgatatggc

SEQ ID NO: 6156 - DNA, 25 bp, E. coli
cacagcgtgacctgattgatatggc

SEQ ID NO: 6157 - DNA, 25 bp, E. coli
cactgattttatgctggatgccgca

SEQ ID NO: 6158 - DNA, 25 bp, E. coli
cactgattttatcctggatgccgca

SEQ ID NO: 6159 - DNA, 25 bp, E. coli
catcactgctgagcgtcaggccaaa

SEQ ID NO: 6160 - DNA, 25 bp, E. coli
caggccaaaattaacgcgttgatga

SEQ ID NO: 6161 - DNA, 25 bp, E. coli
catcactgctgaccgtcaggccaaa

SEQ ID NO: 6162 - DNA, 25 bp, E. coli
caggccaaaatttacgcgttgatga

SEQ ID NO: 6163 - DNA, 25 bp, E. coli
tacgatgcgtttctcgctgccctgg

SEQ ID NO: 6164 - DNA, 25 bp, E. coli
tacgatgcgtttgtcgctgccctgg

SEQ ID NO: 6165 - DNA, 25 bp, E. coli
tgatatggcagccaatctggtcgca

SEQ ID NO: 6166 - DNA, 25 bp, E. coli
tgatatggcagcgaatctggtcgca

SEQ ID NO: 6167 - DNA, 25 bp, E. coli
tctggtcgcaaaatcgcgcactgat

SEQ ID NO: 6168 - DNA, 25 bp, E. coli
tctggtcgcaaattcgcgcactgat

SEQ ID NO: 6169 - DNA, 25 bp, E. coli
tcatccttgatgacgagcaatacga

SEQ ID NO: 6170 - DNA, 25 bp, E. coli
tcatccttgatgtcgagcaatacga

SEQ ID NO: 6171 - DNA, 25 bp, E. coli
gccgtgaagcgcaagacatcttatt

SEQ ID NO: 6172 - DNA, 25 bp, E. coli
gccgtgaagcgctagacatcttatt

SEQ ID NO: 6173 - DNA, 25 bp, E. coli
ctggatgccgcaagccgtgaagcgc

SEQ ID NO: 6174 - DNA, 25 bp, E. coli
ctggatgccgcatgccgtgaagcgc

SEQ ID NO: 6175 - DNA, 25 bp, E. coli
gatgaatcgtaattcgccatgggaa

SEQ ID NO: 6176 - DNA, 25 bp, E. coli
gatgaatcgtaaatcgccatgggaa

SEQ ID NO: 6177 - DNA, 25 bp, E. coli
aagaaaacggtaagccctatgctgg

SEQ ID NO: 6178 - DNA, 25 bp, E. coli
aagaaaacggtatgccctatgctgg

SEQ ID NO: 6179 - DNA, 25 bp, E. coli
tagacagtccaggtaacgcaatggc

SEQ ID NO: 6180 - DNA, 25 bp, E. coli
tagacagtccagctaacgcaatggc

SEQ ID NO: 6181 - DNA, 25 bp, E. coli
tgaaatatcaggacggtgcaagcgg

SEQ ID NO: 6182 - DNA, 25 bp, E. coli
tgaaatatcaggtcggtgcaagcgg

SEQ ID NO: 6183 - DNA, 25 bp, E. coli
tccgaccgggatgtgaaagacaaca

SEQ ID NO: 6184 - DNA, 25 bp, E. coli
tccgaccgggatctgaaagacaaca

SEQ ID NO: 6185 - DNA, 25 bp, E. coli
tcaggtagccagagagtcagacgac

SEQ ID NO: 6186 - DNA, 25 bp, E. coli
tcaggtagccagtgagtcagacgac

SEQ ID NO: 6187 - DNA, 25 bp, E. coli
ccttatgtcatacagcaagcgtgga

SEQ ID NO: 6188 - DNA, 25 bp, E. coli
ccttatgtcatagagcaagcgtgga

SEQ ID NO: 6189 - DNA, 25 bp, E. coli
gcatttaaccagcattccgaccggg

SEQ ID NO: 6190 - DNA, 25 bp, E. coli
gcatttaaccaggattccgaccggg

SEQ ID NO: 6191 - DNA, 25 bp, E. coli
gacattaaacactcagggaaccgct

SEQ ID NO: 6192 - DNA, 25 bp, E. coli
gacattaaacacacagggaaccgct

SEQ ID NO: 6193 - DNA, 25 bp, E. coli
gattatctgcaattgaggcggcgct

SEQ ID NO: 6194 - DNA, 25 bp, E. coli
gattatctgcaaatgaggcggcgct

SEQ ID NO: 6195 - DNA, 25 bp, E. coli
ggtgacagcggaaacctcaaaatgg

SEQ ID NO: 6196 - DNA, 25 bp, E. coli
ggtgacagcggatacctcaaaatgg

SEQ ID NO: 6197 - DNA, 25 bp, E. coli
tggcgcgccttatcctgaacgataa

SEQ ID NO: 6198 - DNA, 25 bp, E. coli
tggcgcgccttaacctgaacgataa

SEQ ID NO: 6199 - DNA, 25 bp, E. coli
aacgttaccgatcggcagatcctcg

SEQ ID NO: 6200 - DNA, 25 bp, E. coli
actgtttgccgaggaagggctgaac

SEQ ID NO: 6201 - DNA, 25 bp, E. coli
acactaccgcagaacgtcgtggcgc

SEQ ID NO: 6202 - DNA, 25 bp, E. coli
acactaccgcagtacgtcgtggcgc

SEQ ID NO: 6203 - DNA, 25 bp, E. coli
actgtttgccgacgaagggctgaac

SEQ ID NO: 6204 - DNA, 25 bp, E. coli
aacgttaccgatgggcagatcctcg

SEQ ID NO: 6205 - DNA, 25 bp, E. coli
tcccgttaccgttgaagatatcgcc

SEQ ID NO: 6206 - DNA, 25 bp, E. coli
tcccgttaccgtagaagatatcgcc

SEQ ID NO: 6207 - DNA, 25 bp, E. coli
gcgcaggcaacgttaccgatgggca

SEQ ID NO: 6208 - DNA, 25 bp, E. coli
gcgcaggcaacgataccgatgggca

SEQ ID NO: 6209 - DNA, 25 bp, E. coli
ccttagaagccggtggtgcacagtt

SEQ ID NO: 6210 - DNA, 25 bp, E. coli
ccttagaagccgctggtgcacagtt

SEQ ID NO: 6211 - DNA, 25 bp, E. coli
gcaaaactgtttgccgaggaagggc

SEQ ID NO: 6212 - DNA, 25 bp, E. coli
gcaaaactgtttcccgaggaagggc

SEQ ID NO: 6213 - DNA, 25 bp, E. coli
gcagtacgtcgtggcgcgccaaact

SEQ ID NO: 6214 - DNA, 25 bp, E. coli
gcagtacgtcgtcgcgcgccaaact

SEQ ID NO: 6215 - DNA, 25 bp, E. coli
ccgctggtgcactgttgctggtgct

SEQ ID NO: 6216 - DNA, 25 bp, E. coli
ccgctggtgcacagttgctggtgct

SEQ ID NO: 6217 - DNA, 25 bp, E. coli
gggcatgaatctacccttcccgtta

SEQ ID NO: 6218 - DNA, 25 bp, E. coli
gggcatgaatcttcccttcccgtta

SEQ ID NO: 6219 - DNA, 25 bp, E. coli
tggcgcgccaaactgcctgctgttg

SEQ ID NO: 6220 - DNA, 25 bp, E. coli
tggcgcgccaaagtgcctgctgttg

SEQ ID NO: 6221 - DNA, 25 bp, E. coli
cactcggtgctgataatgtcgacac

SEQ ID NO: 6222 - DNA, 25 bp, E. coli
cactcggtgctgttaatgtcgacac

SEQ ID NO: 6223 - DNA, 25 bp, E. coli
tactgtcactcgctgctgttaatgt

SEQ ID NO: 6224 - DNA, 25 bp, E. coli
tactgtcactcggtgctgttaatgt

SEQ ID NO: 6225 - DNA, 25 bp, E. coli
tgtcactcggtgctgttaatgtcga

SEQ ID NO: 6226 - DNA, 25 bp, E. coli
tgtcactcggtggtgttaatgtcga

SEQ ID NO: 6227 - DNA, 25 bp, E. coli
tgaagcggtctctgaagctctgctg

SEQ ID NO: 6228 - DNA, 25 bp, E. coli
tgaagcggtctcagaagctctgctg

SEQ ID NO: 6229 - DNA, 25 bp, E. coli
tgctgttaatgtcgacaccgcgcgc

SEQ ID NO: 6230 - DNA, 25 bp, E. coli
tgctgttaatgtggacaccgcgcgc

SEQ ID NO: 6231 - DNA, 25 bp, E. coli
gcggtctctgaagctctgctgtttg

SEQ ID NO: 6232 - DNA, 25 bp, E. coli
gcggtctctgaacctctgctgtttg

SEQ ID NO: 6233 - DNA, 25 bp, E. coli
gaattactgtcagtcggtgctgtta

SEQ ID NO: 6234 - DNA, 25 bp, E. coli
gaagcggtctctgaagctctgctgt

SEQ ID NO: 6235 - DNA, 25 bp, E. coli
gaattactgtcactcggtgctgtta

SEQ ID NO: 6236 - DNA, 25 bp, E. coli
gaagcggtctctcaagctctgctgt

SEQ ID NO: 6237 - DNA, 25 bp, E. coli
ctctgaagctctgctgtttgcttca

SEQ ID NO: 6238 - DNA, 25 bp, E. coli
ctctgaagctctcctgtttgcttca

SEQ ID NO: 6239 - DNA, 25 bp, E. coli
ggtgctgttaatgtcgacaccgcgc

SEQ ID NO: 6240 - DNA, 25 bp, E. coli
ggtgctgttaatctcgacaccgcgc

SEQ ID NO: 6241 - DNA, 25 bp, E. coli
ggtctctgaagctctgctgtttgct

SEQ ID NO: 6242 - DNA, 25 bp, E. coli
ggtctctgaagcactgctgtttgct

SEQ ID NO: 6243 - DNA, 25 bp, E. coli
cacactgtgatgaaaaaatctcccg

SEQ ID NO: 6244 - DNA, 25 bp, E. coli
cacactgtgatgtaaaaatctcccg

SEQ ID NO: 6245 - DNA, 25 bp, E. coli
tatttgcgtactggccattgacccc

SEQ ID NO: 6246 - DNA, 25 bp, E. coli
tatttgcgtactcgccattgacccc

SEQ ID NO: 6247 - DNA, 25 bp, E. coli
ttaaagtggcgaaagcatgacagca

SEQ ID NO: 6248 - DNA, 25 bp, E. coli
ttaaagtggcgatagcatgacagca

SEQ ID NO: 6249 - DNA, 25 bp, E. coli
tgctaacaaacaggaaggagatgcg

SEQ ID NO: 6250 - DNA, 25 bp, E. coli
tgctaacaaacacgaaggagatgcg

SEQ ID NO: 6251 - DNA, 25 bp, E. coli
tccctcgagaggaaatcagtgcagc

SEQ ID NO: 6252 - DNA, 25 bp, E. coli
tccctcgagaggtaatcagtgcagc

SEQ ID NO: 6253 - DNA, 25 bp, E. coli
ccttgcgattttccaggagctgaag

SEQ ID NO: 6254 - DNA, 25 bp, E. coli
ccttgcgattttgcaggagctgaag

SEQ ID NO: 6255 - DNA, 25 bp, E. coli
gacgctccgtgtcgtttttccggcg

SEQ ID NO: 6256 - DNA, 25 bp, E. coli
gacgctccgtgtggtttttccggcg

SEQ ID NO: 6257 - DNA, 25 bp, E. coli
ggctacgatcaatccgaggacgata

SEQ ID NO: 6258 - DNA, 25 bp, E. coli
ggctacgatcaaaccgaggacgata

SEQ ID NO: 6259 - DNA, 25 bp, E. coli
tcaagatcggccaaaattccacgct

SEQ ID NO: 6260 - DNA, 25 bp, E. coli
tcaagatcggcctaaattccacgct

SEQ ID NO: 6261 - DNA, 25 bp, E. coli
taaggtcggtgctcatcaagttttc

SEQ ID NO: 6262 - DNA, 25 bp, E. coli
taaggtcggtgcacatcaagttttc

SEQ ID NO: 6263 - DNA, 25 bp, E. coli
gacgataatcgttgttaccagtgaa

SEQ ID NO: 6264 - DNA, 25 bp, E. coli
gacgataatcgtagttaccagtgaa

SEQ ID NO: 6265 - DNA, 25 bp, E. coli
caacccggttttctggcactggata

SEQ ID NO: 6266 - DNA, 25 bp, E. coli
caacccggttttgtggcactggata

SEQ ID NO: 6267 - DNA, 25 bp, E. coli
aatgagtagcacgttattcgcggca

SEQ ID NO: 6268 - DNA, 25 bp, E. coli
aatgagtagcaccttattcgcggca

SEQ ID NO: 6269 - DNA, 25 bp, E. coli
aaaagcggccgtgatgtgacgatcg

SEQ ID NO: 6270 - DNA, 25 bp, E. coli
aaaagcggccgtcatgtgacgatcg

SEQ ID NO: 6271 - DNA, 25 bp, E. coli
tatcaatttcagtgcctggctacag

SEQ ID NO: 6272 - DNA, 25 bp, E. coli
tatcaatttcagagcctggctacag

SEQ ID NO: 6273 - DNA, 25 bp, E. coli
tatctggcagagctgcgctttccca

SEQ ID NO: 6274 - DNA, 25 bp, E. coli
tatctggcagaggtgcgctttccca

SEQ ID NO: 6275 - DNA, 25 bp, E. coli
ccacggtcagtcctcaggatttgaa

SEQ ID NO: 6276 - DNA, 25 bp, E. coli
ccacggtcagtcgtcaggatttgaa

SEQ ID NO: 6277 - DNA, 25 bp, E. coli
gtagaagacagcgaacaacccggtt

SEQ ID NO: 6278 - DNA, 25 bp, E. coli
gatacgtcatcaaccgctcagggag

SEQ ID NO: 6279 - DNA, 25 bp, E. coli
gatttgaacgttgcaggccagtccg

SEQ ID NO: 6280 - DNA, 25 bp, E. coli
gatttgaacgttccaggccagtccg

SEQ ID NO: 6281 - DNA, 25 bp, E. coli
gtagaagacagccaacaacccggtt

SEQ ID NO: 6282 - DNA, 25 bp, E. coli
gatacgtcatcatccgctcagggag

SEQ ID NO: 6283 - DNA, 25 bp, E. coli
tcaatgattcagtccggtggttacg

SEQ ID NO: 6284 - DNA, 25 bp, E. coli
taagtaaatcctctgcgctggtggt

SEQ ID NO: 6285 - DNA, 25 bp, E. coli
tcaatgattcagaccggtggttacg

SEQ ID NO: 6286 - DNA, 25 bp, E. coli
taagtaaatcctgtgcgctggtggt

SEQ ID NO: 6287 - DNA, 25 bp, E. coli
cactcgttacgttgtgatggcgcag

SEQ ID NO: 6288 - DNA, 25 bp, E. coli
cactcgttacgtagtgatggcgcag

SEQ ID NO: 6289 - DNA, 25 bp, E. coli
caatgaaaagccacttctttctgat

SEQ ID NO: 6290 - DNA, 25 bp, E. coli
accgctgtacaacgtatactcggac

SEQ ID NO: 6291 - DNA, 25 bp, E. coli
actcggacgattttcactgttttga

SEQ ID NO: 6292 - DNA, 25 bp, E. coli
caatgaaaagcctcttctttctgat

SEQ ID NO: 6293 - DNA, 25 bp, E. coli
accgctgtacaaggtatactcggac

SEQ ID NO: 6294 - DNA, 25 bp, E. coli
actcggacgattatcactgttttga

SEQ ID NO: 6295 - DNA, 25 bp, E. coli
ttacgtagtgatcgcgcaggattct

SEQ ID NO: 6296 - DNA, 25 bp, E. coli
ttacgtagtgatggcgcaggattct

SEQ ID NO: 6297 - DNA, 25 bp, E. coli
tgtgccggcactcgttacgtagtga

SEQ ID NO: 6298 - DNA, 25 bp, E. coli
tgtgccggcactggttacgtagtga

SEQ ID NO: 6299 - DNA, 25 bp, E. coli
gctgtacaaggtatactcggacgat

SEQ ID NO: 6300 - DNA, 25 bp, E. coli
gcgcaggattcttccagcttgcggg

SEQ ID NO: 6301 - DNA, 25 bp, E. coli
gctgtacaaggtttactcggacgat

SEQ ID NO: 6302 - DNA, 25 bp, E. coli
gcgcaggattctaccagcttgcggg

SEQ ID NO: 6303 - DNA, 25 bp, E. coli
gggtgtgaatactgcttttccgcga

SEQ ID NO: 6304 - DNA, 25 bp, E. coli
ggtatactcggaggattttcactgt

SEQ ID NO: 6305 - DNA, 25 bp, E. coli
gggtgtgaatacagcttttccgcga

SEQ ID NO: 6306 - DNA, 25 bp, E. coli
ggtatactcggacgattttcactgt

SEQ ID NO: 6307 - DNA, 25 bp, E. coli
gatggcgcaggaatctaccagcttg

SEQ ID NO: 6308 - DNA, 25 bp, E. coli
gatggcgcaggattctaccagcttg

SEQ ID NO: 6309 - DNA, 25 bp, E. coli
cagacggctaaccatgccgaattaa

SEQ ID NO: 6310 - DNA, 25 bp, E. coli
cagacggctaacgatgccgaattaa

SEQ ID NO: 6311 - DNA, 25 bp, E. coli
tagcatcagcattaatgagctgacc

SEQ ID NO: 6312 - DNA, 25 bp, E. coli
tagcatcagcataaatgagctgacc

SEQ ID NO: 6313 - DNA, 25 bp, E. coli
tggtgagcttatatcccagacggct

SEQ ID NO: 6314 - DNA, 25 bp, E. coli
tggtgagcttatttcccagacggct

SEQ ID NO: 6315 - DNA, 25 bp, E. coli
tgagctgaccacagacgaaaagcgg

SEQ ID NO: 6316 - DNA, 25 bp, E. coli
tgaacaaaataaacgggcactggct

SEQ ID NO: 6317 - DNA, 25 bp, E. coli
tgagctgaccactgacgaaaagcgg

SEQ ID NO: 6318 - DNA, 25 bp, E. coli
tgaacaaaataatcgggcactggct

SEQ ID NO: 6319 - DNA, 25 bp, E. coli
tcccagctgaacgtcatagcatcag

SEQ ID NO: 6320 - DNA, 25 bp, E. coli
tcccagctgaacctcatagcatcag

SEQ ID NO: 6321 - DNA, 25 bp, E. coli
tctttatggcaataatcccagctga

SEQ ID NO: 6322 - DNA, 25 bp, E. coli
tctttatggcaaaaatcccagctga

SEQ ID NO: 6323 - DNA, 25 bp, E. coli
gaatcattttcgtgcagtggtgagc

SEQ ID NO: 6324 - DNA, 25 bp, E. coli
gaatcattttcgagcagtggtgagc

SEQ ID NO: 6325 - DNA, 25 bp, E. coli
cgaaaagcgggacctgattaaagca

SEQ ID NO: 6326 - DNA, 25 bp, E. coli
cgaaaagcgggagctgattaaagca

SEQ ID NO: 6327 - DNA, 25 bp, E. coli
cgggcactggctcccatattcttta

SEQ ID NO: 6328 - DNA, 25 bp, E. coli
cgggcactggctgccatattcttta

SEQ ID NO: 6329 - DNA, 25 bp, E. coli
gatccacgggatttcaataatgaac

SEQ ID NO: 6330 - DNA, 25 bp, E. coli
gatccacgggatatcaataatgaac

SEQ ID NO: 6331 - DNA, 25 bp, E. coli
aagacaccgcagttgcggtggtgaa

SEQ ID NO: 6332 - DNA, 25 bp, E. coli
aagacaccgcagatgcggtggtgaa

SEQ ID NO: 6333 - DNA, 25 bp, E. coli
caaatagcgggcgaatgaccttgcg

SEQ ID NO: 6334 - DNA, 25 bp, E. coli
caaatagcgggccaatgaccttgcg

SEQ ID NO: 6335 - DNA, 25 bp, E. coli
tacgttcgaaggcaagagtcattga

SEQ ID NO: 6336 - DNA, 25 bp, E. coli
tacgttcgaagggaagagtcattga

SEQ ID NO: 6337 - DNA, 25 bp, E. coli
ttaaacttaccggaggagccttcac

SEQ ID NO: 6338 - DNA, 25 bp, E. coli
ttaaacttaccgcaggagccttcac

SEQ ID NO: 6339 - DNA, 25 bp, E. coli
taccgcaggagccttcactggtgga

SEQ ID NO: 6340 - DNA, 25 bp, E. coli
taccgcaggagcgttcactggtgga

SEQ ID NO: 6341 - DNA, 25 bp, E. coli
gccaatgaccttgcggctggataaa

SEQ ID NO: 6342 - DNA, 25 bp, E. coli
ccaggcgcgttaatacgttcgaagg

SEQ ID NO: 6343 - DNA, 25 bp, E. coli
ccaggcgcgttattacgttcgaagg

SEQ ID NO: 6344 - DNA, 25 bp, E. coli
gccaatgaccttccggctggataaa

SEQ ID NO: 6345 - DNA, 25 bp, E. coli
gcattgccgttaaggctaaacaacg

SEQ ID NO: 6346 - DNA, 25 bp, E. coli
gcattgccgttatggctaaacaacg

SEQ ID NO: 6347 - DNA, 25 bp, E. coli
gcgtctaccgggaaatgactgttcg

SEQ ID NO: 6348 - DNA, 25 bp, E. coli
gcgtctaccgggtaatgactgttcg

SEQ ID NO: 6349 - DNA, 25 bp, E. coli
cgaaaaatggatagtgaaagacggc

SEQ ID NO: 6350 - DNA, 25 bp, E. coli
cgaaaaatggattgtgaaagacggc

SEQ ID NO: 6351 - DNA, 25 bp, E. coli
tggctaaacaacgaaaaatggatag

SEQ ID NO: 6352 - DNA, 25 bp, E. coli
tggctaaacaaccaaaaatggatag

SEQ ID NO: 6353 - DNA, 25 bp, E. coli
aatttcatgttgcagggcggcagca

SEQ ID NO: 6354 - DNA, 25 bp, E. coli
aatttcatgttggagggcggcagca

SEQ ID NO: 6355 - DNA, 25 bp, E. coli
caaaatggagtgaccccagaagctt

SEQ ID NO: 6356 - DNA, 25 bp, E. coli
caaaatggagtgtccccagaagctt

SEQ ID NO: 6357 - DNA, 25 bp, E. coli
atggagtgtccccagaagcttataa

SEQ ID NO: 6358 - DNA, 25 bp, E. coli
atggagtgtcccgagaagcttataa

SEQ ID NO: 6359 - DNA, 25 bp, E. coli
tagctcctgttttttaccctgaaat

SEQ ID NO: 6360 - DNA, 25 bp, E. coli
tagctcctgtttattaccctgaaat

SEQ ID NO: 6361 - DNA, 25 bp, E. coli
tttaccctgaaaattcatgttgcag

SEQ ID NO: 6362 - DNA, 25 bp, E. coli
tttcatgttgcagggcggcagcaaa

SEQ ID NO: 6363 - DNA, 25 bp, E. coli
tttaccctgaaatttcatgttgcag

SEQ ID NO: 6364 - DNA, 25 bp, E. coli
tttcatgttgcacggcggcagcaaa

SEQ ID NO: 6365 - DNA, 25 bp, E. coli
tgaaatttcatgatgcagggcggca

SEQ ID NO: 6366 - DNA, 25 bp, E. coli
tgaaatttcatgttgcagggcggca

SEQ ID NO: 6367 - DNA, 25 bp, E. coli
gcagcaaaatggtgtgtccccagaa

SEQ ID NO: 6368 - DNA, 25 bp, E. coli
gcagcaaaatggagtgtccccagaa

SEQ ID NO: 6369 - DNA, 25 bp, E. coli
cattggccataatttagctcctgtt

SEQ ID NO: 6370 - DNA, 25 bp, E. coli
cattggccataaattagctcctgtt

SEQ ID NO: 6371 - DNA, 25 bp, E. coli
ggcggcagcaaaatggagtgtcccc

SEQ ID NO: 6372 - DNA, 25 bp, E. coli
ggcggcagcaaattggagtgtcccc

SEQ ID NO: 6373 - DNA, 25 bp, E. coli
tcaacattggccttaaattagctcc

SEQ ID NO: 6374 - DNA, 25 bp, E. coli
tcaacattggccataaattagctcc

SEQ ID NO: 6375 - DNA, 25 bp, E. coli
aagtgtatcgtcgttctgcctgggc

SEQ ID NO: 6376 - DNA, 25 bp, E. coli
aagtgtatcgtccttctgcctgggc

SEQ ID NO: 6377 - DNA, 25 bp, E. coli
caacttctttgattcctggctggga

SEQ ID NO: 6378 - DNA, 25 bp, E. coli
caacttctttgaatcctggctggga

SEQ ID NO: 6379 - DNA, 25 bp, E. coli
catgacgttcaggatgccgatgaca

SEQ ID NO: 6380 - DNA, 25 bp, E. coli
catgacgttcagcatgccgatgaca

SEQ ID NO: 6381 - DNA, 25 bp, E. coli
taaaagctatctgtcgctgggcggc

SEQ ID NO: 6382 - DNA, 25 bp, E. coli
tactggtcaccagaagcaattgagc

SEQ ID NO: 6383 - DNA, 25 bp, E. coli
taaaagctatctctcgctgggcggc

SEQ ID NO: 6384 - DNA, 25 bp, E. coli
tactggtcaccacaagcaattgagc

SEQ ID NO: 6385 - DNA, 25 bp, E. coli
tattgaaggccaggattaccgcgct

SEQ ID NO: 6386 - DNA, 25 bp, E. coli
tattgaaggccacgattaccgcgct

SEQ ID NO: 6387 - DNA, 25 bp, E. coli
tgtcaacatcatgaaaggcctggga

SEQ ID NO: 6388 - DNA, 25 bp, E. coli
tgtcaacatcatcaaaggcctggga

SEQ ID NO: 6389 - DNA, 25 bp, E. coli
gatatgaccgaactgcgtcgccgta

SEQ ID NO: 6390 - DNA, 25 bp, E. coli
gatatgaccgaagtgcgtcgccgta

SEQ ID NO: 6391 - DNA, 25 bp, E. coli
gatcagaagattaacgacgaagccg

SEQ ID NO: 6392 - DNA, 25 bp, E. coli
gatcagaagatttacgacgaagccg

SEQ ID NO: 6393 - DNA, 25 bp, E. coli
tggactggcagatcacggcatcatc

SEQ ID NO: 6394 - DNA, 25 bp, E. coli
tggactggcagaacacggcatcatc

SEQ ID NO: 6395 - DNA, 25 bp, E. coli
tggcctgggctgttaaaaacttccg

SEQ ID NO: 6396 - DNA, 25 bp, E. coli
tggcctgggctgataaaaacttccg

SEQ ID NO: 6397 - DNA, 25 bp, E. coli
tacaaatattgtgcctgcgcgaagg

SEQ ID NO: 6398 - DNA, 25 bp, E. coli
tacaaatattgtccctgcgcgaagg

SEQ ID NO: 6399 - DNA, 25 bp, E. coli
gataacctttaatacgacccagcaa

SEQ ID NO: 6400 - DNA, 25 bp, E. coli
aacccattgctttgacgaagttgag

SEQ ID NO: 6401 - DNA, 25 bp, E. coli
aacccattgcttagacgaagttgag

SEQ ID NO: 6402 - DNA, 25 bp, E. coli
gataacctttaaaacgacccagcaa

SEQ ID NO: 6403 - DNA, 25 bp, E. coli
tattcctgaagtcactcttactcaa

SEQ ID NO: 6404 - DNA, 25 bp, E. coli
tattcctgaagtgactcttactcaa

SEQ ID NO: 6405 - DNA, 25 bp, E. coli
tcattgcctgcttatcaacccattg

SEQ ID NO: 6406 - DNA, 25 bp, E. coli
tcattgcctgctaatcaacccattg

SEQ ID NO: 6407 - DNA, 25 bp, E. coli
ccggacgatcgggtgaaaatagttg

SEQ ID NO: 6408 - DNA, 25 bp, E. coli
ccggacgatcggctgaaaatagttg

SEQ ID NO: 6409 - DNA, 25 bp, E. coli
gcggcactttccagtcagataacct

SEQ ID NO: 6410 - DNA, 25 bp, E. coli
gcggcactttcctgtcagataacct

SEQ ID NO: 6411 - DNA, 25 bp, E. coli
gcagttcagggcaaagtcagacgaa

SEQ ID NO: 6412 - DNA, 25 bp, E. coli
gcagttcagggctaagtcagacgaa

SEQ ID NO: 6413 - DNA, 25 bp, E. coli
cgttattactccatgcggcactttc

SEQ ID NO: 6414 - DNA, 25 bp, E. coli
cgttattactccttgcggcactttc

SEQ ID NO: 6415 - DNA, 25 bp, E. coli
gtcagacgaagcaagaaaagaccct

SEQ ID NO: 6416 - DNA, 25 bp, E. coli
gtcagacgaagctagaaaagaccct

SEQ ID NO: 6417 - DNA, 25 bp, E. coli
tcaatcttgtctgtgcagagtacaa

SEQ ID NO: 6418 - DNA, 25 bp, E. coli
tcaatcttgtctctgcagagtacaa

SEQ ID NO: 6419 - DNA, 25 bp, E. coli
catggctgccgtacgagactgtgag

SEQ ID NO: 6420 - DNA, 25 bp, E. coli
catggctgccgttcgagactgtgag

SEQ ID NO: 6421 - DNA, 25 bp, E. coli
aaagctccctggtttcctgtgtcga

SEQ ID NO: 6422 - DNA, 25 bp, E. coli
aaagctccctggattcctgtgtcga

SEQ ID NO: 6423 - DNA, 25 bp, E. coli
tatgcatgtggataaatggcttcgc

SEQ ID NO: 6424 - DNA, 25 bp, E. coli
tatgcatgtggaaaaatggcttcgc

SEQ ID NO: 6425 - DNA, 25 bp, E. coli
taccagaggataacaaaagctccct

SEQ ID NO: 6426 - DNA, 25 bp, E. coli
taccagaggatatcaaaagctccct

SEQ ID NO: 6427 - DNA, 25 bp, E. coli
tgtgagtggtcagacgataacgcac

SEQ ID NO: 6428 - DNA, 25 bp, E. coli
tgtgagtggtcacacgataacgcac

SEQ ID NO: 6429 - DNA, 25 bp, E. coli
tccctaaagggatagagtgtatgca

SEQ ID NO: 6430 - DNA, 25 bp, E. coli
tccctaaagggaaagagtgtatgca

SEQ ID NO: 6431 - DNA, 25 bp, E. coli
gacagacgcgcccattaagcaggcg

SEQ ID NO: 6432 - DNA, 25 bp, E. coli
gacagacgcgccgattaagcaggcg

SEQ ID NO: 6433 - DNA, 25 bp, E. coli
cgcgaaatgtcgactattccggaga

SEQ ID NO: 6434 - DNA, 25 bp, E. coli
cgcgaaatgtcgtctattccggaga

SEQ ID NO: 6435 - DNA, 25 bp, E. coli
ggctggacgcttaaccgggcttaag

SEQ ID NO: 6436 - DNA, 25 bp, E. coli
ggctggacgctttaccgggcttaag

SEQ ID NO: 6437 - DNA, 25 bp, E. coli
ggcgcttgcgcaaggattattatta

SEQ ID NO: 6438 - DNA, 25 bp, E. coli
ggcgcttgcgcatggattattatta

SEQ ID NO: 6439 - DNA, 25 bp, E. coli
gatggattacccagatcacccggtt

SEQ ID NO: 6440 - DNA, 25 bp, E. coli
gatggattaccctgatcacccggtt

SEQ ID NO: 6441 - DNA, 25 bp, E. coli
aaaaagcacgtcagtttggcggcgc

SEQ ID NO: 6442 - DNA, 25 bp, E. coli
aaagattctgttttccgctcggcac

SEQ ID NO: 6443 - DNA, 25 bp, E. coli
aaaaagcacgtctgtttggcggcgc

SEQ ID NO: 6444 - DNA, 25 bp, E. coli
aaagattctgttatccgctcggcac

SEQ ID NO: 6445 - DNA, 25 bp, E. coli
tatccgtgaggatgactgcaccaaa

SEQ ID NO: 6446 - DNA, 25 bp, E. coli
tatccgtgaggaagactgcaccaaa

SEQ ID NO: 6447 - DNA, 25 bp, E. coli
tgtttaagcgcctcgccaatctgga

SEQ ID NO: 6448 - DNA, 25 bp, E. coli
tgtttaagcgccacgccaatctgga

SEQ ID NO: 6449 - DNA, 25 bp, E. coli
tgaaagccttcagcatgcgcctgat

SEQ ID NO: 6450 - DNA, 25 bp, E. coli
tgaaagccttcaccatgcgcctgat

SEQ ID NO: 6451 - DNA, 25 bp, E. coli
gctattcagcaatgccagcgcgttt

SEQ ID NO: 6452 - DNA, 25 bp, E. coli
gcttccggtgagacagcacaactgg

SEQ ID NO: 6453 - DNA, 25 bp, E. coli
gcttccggtgagtcagcacaactgg

SEQ ID NO: 6454 - DNA, 25 bp, E. coli
gctattcagcaaagccagcgcgttt

SEQ ID NO: 6455 - DNA, 25 bp, E. coli
cggtgcgccggaaagtgaactgttt

SEQ ID NO: 6456 - DNA, 25 bp, E. coli
cattacgccgaactttgggcctggc

SEQ ID NO: 6457 - DNA, 25 bp, E. coli
cattacgccgaagtttgggcctggc

SEQ ID NO: 6458 - DNA, 25 bp, E. coli
cggtgcgccggatagtgaactgttt

SEQ ID NO: 6459 - DNA, 25 bp, E. coli
tggcggtgttaaccacgaatcgaca

SEQ ID NO: 6460 - DNA, 25 bp, E. coli
tggcggtgttaagcacgaatcgaca

SEQ ID NO: 6461 - DNA, 25 bp, E. coli
gacgcaaagctgaacatcactgaga

SEQ ID NO: 6462 - DNA, 25 bp, E. coli
gacgcaaagctgtacatcactgaga

SEQ ID NO: 6463 - DNA, 25 bp, E. coli
cacactggctgtcgcgattggtaca

SEQ ID NO: 6464 - DNA, 25 bp, E. coli
cagaagcgacaaatactccggcgat

SEQ ID NO: 6465 - DNA, 25 bp, E. coli
cagaagcgacaattactccggcgat

SEQ ID NO: 6466 - DNA, 25 bp, E. coli
cacactggctgtggcgattggtaca

SEQ ID NO: 6467 - DNA, 25 bp, E. coli
aacattttgcgcgacattgccggac

SEQ ID NO: 6468 - DNA, 25 bp, E. coli
aacattttgcgccacattgccggac

SEQ ID NO: 6469 - DNA, 25 bp, E. coli
tatccggatgcgattaacgcggcgc

SEQ ID NO: 6470 - DNA, 25 bp, E. coli
tatgaagaaaacgtggcgctgaccg

SEQ ID NO: 6471 - DNA, 25 bp, E. coli
tatgaagaaaacctggcgctgaccg

SEQ ID NO: 6472 - DNA, 25 bp, E. coli
tatccggatgcgtttaacgcggcgc

SEQ ID NO: 6473 - DNA, 25 bp, E. coli
tattgctcgtacaggtgccgacaca

SEQ ID NO: 6474 - DNA, 25 bp, E. coli
tattgctcgtactggtgccgacaca

SEQ ID NO: 6475 - DNA, 25 bp, E. coli
tgctgaatcagttacgctcggcgtc

SEQ ID NO: 6476 - DNA, 25 bp, E. coli
tgctgaatcagtaacgctcggcgtc

SEQ ID NO: 6477 - DNA, 25 bp, E. coli
tcggcgtcggcataatcaatatctc

SEQ ID NO: 6478 - DNA, 25 bp, E. coli
tcggcgtcggcaaaatcaatatctc

SEQ ID NO: 6479 - DNA, 25 bp, E. coli
ctaaagagagctggtgggacccgaa

SEQ ID NO: 6480 - DNA, 25 bp, E. coli
ctaaagagagctcgtgggacccgaa

SEQ ID NO: 6481 - DNA, 25 bp, E. coli
gattattgccatgcatcccagcgaa

SEQ ID NO: 6482 - DNA, 25 bp, E. coli
gattattgccatccatcccagcgaa

SEQ ID NO: 6483 - DNA, 25 bp, E. coli
taatgatcgacggttcgctgctgcc

SEQ ID NO: 6484 - DNA, 25 bp, E. coli
taatgatcgacgcttcgctgctgcc

SEQ ID NO: 6485 - DNA, 25 bp, E. coli
aattcgctgaaatcaacagtaaaag

SEQ ID NO: 6486 - DNA, 25 bp, E. coli
aacgccggaccgtatatgcctctta

SEQ ID NO: 6487 - DNA, 25 bp, E. coli
aattcgctgaaaacaacagtaaaag

SEQ ID NO: 6488 - DNA, 25 bp, E. coli
caggaaacgccggaccgaatatgcc

SEQ ID NO: 6489 - DNA, 25 bp, E. coli
caggaaacgccgcaccgaatatgcc

SEQ ID NO: 6490 - DNA, 25 bp, E. coli
aacgccggaccgaatatgcctctta

SEQ ID NO: 6491 - DNA, 25 bp, E. coli
acagtaaaagaaagaggaaagcatc

SEQ ID NO: 6492 - DNA, 25 bp, E. coli
aactgaatccttgcgctcaagctaa

SEQ ID NO: 6493 - DNA, 25 bp, E. coli
acagtaaaagaatgaggaaagcatc

SEQ ID NO: 6494 - DNA, 25 bp, E. coli
aactgaatccttccgctcaagctaa

SEQ ID NO: 6495 - DNA, 25 bp, E. coli
tagtaagggcgcgacgtttgcgccc

SEQ ID NO: 6496 - DNA, 25 bp, E. coli
tagtaagggcgccacgtttgcgccc

SEQ ID NO: 6497 - DNA, 25 bp, E. coli
tcttaattcgctgaaaacaacagta

SEQ ID NO: 6498 - DNA, 25 bp, E. coli
tctgcaactgaaaccttccgctcaa

SEQ ID NO: 6499 - DNA, 25 bp, E. coli
tcttaattcgctcaaaacaacagta

SEQ ID NO: 6500 - DNA, 25 bp, E. coli
tctgcaactgaatccttccgctcaa

SEQ ID NO: 6501 - DNA, 25 bp, E. coli
gccggaccgaatttgcctcttaagt

SEQ ID NO: 6502 - DNA, 25 bp, E. coli
gccggaccgaatatgcctcttaagt

SEQ ID NO: 6503 - DNA, 25 bp, E. coli
cgtttgcgccctttgtaggccggat

SEQ ID NO: 6504 - DNA, 25 bp, E. coli
cgtttgcgccctatgtaggccggat

SEQ ID NO: 6505 - DNA, 25 bp, E. coli
gaccgaatatgcgtcttaagtattt

SEQ ID NO: 6506 - DNA, 25 bp, E. coli
gaccgaatatgcctcttaagtattt

SEQ ID NO: 6507 - DNA, 25 bp, E. coli
caataatgccggtatcactcgtgat

SEQ ID NO: 6508 - DNA, 25 bp, E. coli
caataatgccggaatcactcgtgat

SEQ ID NO: 6509 - DNA, 25 bp, E. coli
cagtaaatcactggcgcgcgaagtt

SEQ ID NO: 6510 - DNA, 25 bp, E. coli
cagtaaatcactcgcgcgcgaagtt

SEQ ID NO: 6511 - DNA, 25 bp, E. coli
tactgtaaacgttgttgctccgggc

SEQ ID NO: 6512 - DNA, 25 bp, E. coli
tactgtaaacgtagttgctccgggc

SEQ ID NO: 6513 - DNA, 25 bp, E. coli
acaggaaatcgccaacgcggttgca

SEQ ID NO: 6514 - DNA, 25 bp, E. coli
acaggaaatcgcgaacgcggttgca

SEQ ID NO: 6515 - DNA, 25 bp, E. coli
tattgaaacggagatgacacgtgcg

SEQ ID NO: 6516 - DNA, 25 bp, E. coli
tattgaaacggacatgacacgtgcg

SEQ ID NO: 6517 - DNA, 25 bp, E. coli
tctgatgttgaatgtgaccgacccg

SEQ ID NO: 6518 - DNA, 25 bp, E. coli
tctgatgttgaaagtgaccgacccg

SEQ ID NO: 6519 - DNA, 25 bp, E. coli
gaagcagcttacttcacgggtgaaa

SEQ ID NO: 6520 - DNA, 25 bp, E. coli
gaagcagcttacatcacgggtgaaa

SEQ ID NO: 6521 - DNA, 25 bp, E. coli
gaaactttgcatgtgaacggcggga

SEQ ID NO: 6522 - DNA, 25 bp, E. coli
gaaagttattgggactgcgaccagt

SEQ ID NO: 6523 - DNA, 25 bp, E. coli
gaaaaatcgcacaggtaaccggtgc

SEQ ID NO: 6524 - DNA, 25 bp, E. coli
gaaactttgcatctgaacggcggga

SEQ ID NO: 6525 - DNA, 25 bp, E. coli
gaaaaatcgcactggtaaccggtgc

SEQ ID NO: 6526 - DNA, 25 bp, E. coli
gaaagttattggcactgcgaccagt

SEQ ID NO: 6527 - DNA, 25 bp, E. coli
gaccagtgaaaatggcgctcaggcg

SEQ ID NO: 6528 - DNA, 25 bp, E. coli
gaccagtgaaaaaggcgctcaggcg

SEQ ID NO: 6529 - DNA, 25 bp, E. coli
cagggaggaccgccgtaagacggcg

SEQ ID NO: 6530 - DNA, 25 bp, E. coli
cagggaggaccggcgtaagacggcg

SEQ ID NO: 6531 - DNA, 25 bp, E. coli
atcagggaggacggccgtaagacgg

SEQ ID NO: 6532 - DNA, 25 bp, E. coli
atcagggaggaccgccgtaagacgg

SEQ ID NO: 6533 - DNA, 25 bp, E. coli
aatcagggaggagcgccgtaagacg

SEQ ID NO: 6534 - DNA, 25 bp, E. coli
aatcagggaggaccgccgtaagacg

SEQ ID NO: 6535 - DNA, 25 bp, E. coli
tcagggaggacccccgtaagacggc

SEQ ID NO: 6536 - DNA, 25 bp, E. coli
tcagggaggaccgccgtaagacggc

SEQ ID NO: 6537 - DNA, 25 bp, E. coli
cgccgtaagacgccgcggggagact

SEQ ID NO: 6538 - DNA, 25 bp, E. coli
gccgtaagacggggcggggagacta

SEQ ID NO: 6539 - DNA, 25 bp, E. coli
cgccgtaagacggcgcggggagact

SEQ ID NO: 6540 - DNA, 25 bp, E. coli
gccgtaagacggcgcggggagacta

SEQ ID NO: 6541 - DNA, 25 bp, E. coli
ggaggaccgccgtaagacggcgcgg

SEQ ID NO: 6542 - DNA, 25 bp, E. coli
ggaggaccgccgaaagacggcgcgg

SEQ ID NO: 6543 - DNA, 25 bp, E. coli
gggaggaccgccctaagacggcgcg

SEQ ID NO: 6544 - DNA, 25 bp, E. coli
gggaggaccgccgtaagacggcgcg

SEQ ID NO: 6545 - DNA, 25 bp, E. coli
caggcgatgctggaacatgtcgaga

SEQ ID NO: 6546 - DNA, 25 bp, E. coli
caggcgatgctgcaacatgtcgaga

SEQ ID NO: 6547 - DNA, 25 bp, E. coli
catgtcgagagcattcttctggaaa

SEQ ID NO: 6548 - DNA, 25 bp, E. coli
catgtcgagagctttcttctggaaa

SEQ ID NO: 6549 - DNA, 25 bp, E. coli
acagcgccgtttagcattacctgag

SEQ ID NO: 6550 - DNA, 25 bp, E. coli
acagcgccgttttgcattacctgag

SEQ ID NO: 6551 - DNA, 25 bp, E. coli
tacctgagcagtaagcgagagaaga

SEQ ID NO: 6552 - DNA, 25 bp, E. coli
tacctgagcagttagcgagagaaga

SEQ ID NO: 6553 - DNA, 25 bp, E. coli
ttttaccacgcaaagtcgcgatccg

SEQ ID NO: 6554 - DNA, 25 bp, E. coli
ttttaccacgcatagtcgcgatccg

SEQ ID NO: 6555 - DNA, 25 bp, E. coli
tcggagtacggagaaaatcatggtg

SEQ ID NO: 6556 - DNA, 25 bp, E. coli
tcggagtacggacaaaatcatggtg

SEQ ID NO: 6557 - DNA, 25 bp, E. coli
tctcaatgcttagcgtgctggcgtt

SEQ ID NO: 6558 - DNA, 25 bp, E. coli
tctcaatgcttaccgtgctggcgtt

SEQ ID NO: 6559 - DNA, 25 bp, E. coli
gaaatcatacgcactaccgtgctgt

SEQ ID NO: 6560 - DNA, 25 bp, E. coli
gaaatcatacgctctaccgtgctgt

SEQ ID NO: 6561 - DNA, 25 bp, E. coli
gataacgatctcctgcaactggtcg

SEQ ID NO: 6562 - DNA, 25 bp, E. coli
gataacgatctcgtgcaactggtcg

SEQ ID NO: 6563 - DNA, 25 bp, E. coli
gattaatcgccagcagggtttcaca

SEQ ID NO: 6564 - DNA, 25 bp, E. coli
gattaatcgccaccagggtttcaca

SEQ ID NO: 6565 - DNA, 25 bp, E. coli
tcactgttcactggtatctgcgaaa

SEQ ID NO: 6566 - DNA, 25 bp, E. coli
tcactgttcactcgtatctgcgaaa

SEQ ID NO: 6567 - DNA, 25 bp, E. coli
cagccagggattatccggagaggtc

SEQ ID NO: 6568 - DNA, 25 bp, E. coli
cagccagggattttccggagaggtc

SEQ ID NO: 6569 - DNA, 25 bp, E. coli
acggatgtcattctttttaagtgga

SEQ ID NO: 6570 - DNA, 25 bp, E. coli
atggcctgcctgactctgtttgaaa

SEQ ID NO: 6571 - DNA, 25 bp, E. coli
acggatgtcattgtttttaagtgga

SEQ ID NO: 6572 - DNA, 25 bp, E. coli
atggcctgcctgtctctgtttgaaa

SEQ ID NO: 6573 - DNA, 25 bp, E. coli
tcagcataagctgacgaggactcgt

SEQ ID NO: 6574 - DNA, 25 bp, E. coli
cctgcctgtctcagtttgaaacaga

SEQ ID NO: 6575 - DNA, 25 bp, E. coli
ccggagaggtcagggatatgtttct

SEQ ID NO: 6576 - DNA, 25 bp, E. coli
cctgcctgtctctgtttgaaacaga

SEQ ID NO: 6577 - DNA, 25 bp, E. coli
ccggagaggtcacggatatgtttct

SEQ ID NO: 6578 - DNA, 25 bp, E. coli
gctctacagttggatatgagtgaga

SEQ ID NO: 6579 - DNA, 25 bp, E. coli
gctctacagttgcatatgagtgaga

SEQ ID NO: 6580 - DNA, 25 bp, E. coli
gcttggtgcgattgctctacagttg

SEQ ID NO: 6581 - DNA, 25 bp, E. coli
gcttggtgcgatagctctacagttg

SEQ ID NO: 6582 - DNA, 25 bp, E. coli
gtctgactgacaatccgctttacct

SEQ ID NO: 6583 - DNA, 25 bp, E. coli
gtttgaaacagaagaacggatgtca

SEQ ID NO: 6584 - DNA, 25 bp, E. coli
gtctgactgacattccgctttacct

SEQ ID NO: 6585 - DNA, 25 bp, E. coli
gtttgaaacagatgaacggatgtca

SEQ ID NO: 6586 - DNA, 25 bp, E. coli
tcagcataagctcacgaggactcgt

SEQ ID NO: 6587 - DNA, 25 bp, E. coli
gaggactcgtctgactgacattccg

SEQ ID NO: 6588 - DNA, 25 bp, E. coli
gaggactcgtctcactgacattccg

SEQ ID NO: 6589 - DNA, 25 bp, E. coli
caaacagcccaccattattgcaggc

SEQ ID NO: 6590 - DNA, 25 bp, E. coli
caaacagcccacgattattgcaggc

SEQ ID NO: 6591 - DNA, 25 bp, E. coli
caggtgtcttacttactccttcaca

SEQ ID NO: 6592 - DNA, 25 bp, E. coli
catctatttctgttaagaaggttca

SEQ ID NO: 6593 - DNA, 25 bp, E. coli
caggtgtcttacatactccttcaca

SEQ ID NO: 6594 - DNA, 25 bp, E. coli
catctatttctgataagaaggttca

SEQ ID NO: 6595 - DNA, 25 bp, E. coli
taaaaacttataatgttggcgggat

SEQ ID NO: 6596 - DNA, 25 bp, E. coli
tactggtaaatccttaacatgtgtt

SEQ ID NO: 6597 - DNA, 25 bp, E. coli
tactggtaaatcgttaacatgtgtt

SEQ ID NO: 6598 - DNA, 25 bp, E. coli
taaaaacttatattgttggcgggat

SEQ ID NO: 6599 - DNA, 25 bp, E. coli
tatcataacaggaaaaatctcgtct

SEQ ID NO: 6600 - DNA, 25 bp, E. coli
tatcataacaggtaaaatctcgtct

SEQ ID NO: 6601 - DNA, 25 bp, E. coli
tattgcaggctatttgccaggtgtc

SEQ ID NO: 6602 - DNA, 25 bp, E. coli
tattgcaggctaattgccaggtgtc

SEQ ID NO: 6603 - DNA, 25 bp, E. coli
gcatacttgcttataatatgtggaa

SEQ ID NO: 6604 - DNA, 25 bp, E. coli
gcatacttgcttttaatatgtggaa

SEQ ID NO: 6605 - DNA, 25 bp, E. coli
gtatccgcccaaggaagcaaacagc

SEQ ID NO: 6606 - DNA, 25 bp, E. coli
gtatccgcccaacgaagcaaacagc

SEQ ID NO: 6607 - DNA, 25 bp, E. coli
tggaatgatctcctcgaaaatttat

SEQ ID NO: 6608 - DNA, 25 bp, E. coli
tggaatgatctcgtcgaaaatttat

SEQ ID NO: 6609 - DNA, 25 bp, E. coli
taataaaactcgaatccgcccaagg

SEQ ID NO: 6610 - DNA, 25 bp, E. coli
taataaaactcgtatccgcccaagg

SEQ ID NO: 6611 - DNA, 25 bp, E. coli
tacgtttatagaagcgcagacctgg

SEQ ID NO: 6612 - DNA, 25 bp, E. coli
tacgggtcagcatatccgcgatcgg

SEQ ID NO: 6613 - DNA, 25 bp, E. coli
tacgtttatagatgcgcagacctgg

SEQ ID NO: 6614 - DNA, 25 bp, E. coli
tacgggtcagcaaatccgcgatcgg

SEQ ID NO: 6615 - DNA, 25 bp, E. coli
tagcagataatttcgccaccaagac

SEQ ID NO: 6616 - DNA, 25 bp, E. coli
tagcagataattacgccaccaagac

SEQ ID NO: 6617 - DNA, 25 bp, E. coli
ttcagagtaagttccagttcaggct

SEQ ID NO: 6618 - DNA, 25 bp, E. coli
ttcagagtaagtaccagttcaggct

SEQ ID NO: 6619 - DNA, 25 bp, E. coli
tgttcgcggcctcaccgttacggat

SEQ ID NO: 6620 - DNA, 25 bp, E. coli
tgttcgcggcctgaccgttacggat

SEQ ID NO: 6621 - DNA, 25 bp, E. coli
tgggcggctgactcgctgaatgctt

SEQ ID NO: 6622 - DNA, 25 bp, E. coli
tgggcggctgacacgctgaatgctt

SEQ ID NO: 6623 - DNA, 25 bp, E. coli
tccttcagcacgatggcgattgcca

SEQ ID NO: 6624 - DNA, 25 bp, E. coli
tccttcagcacgttggcgattgcca

SEQ ID NO: 6625 - DNA, 25 bp, E. coli
ccactttcagcttggaggaaggcat

SEQ ID NO: 6626 - DNA, 25 bp, E. coli
ccactttcagctaggaggaaggcat

SEQ ID NO: 6627 - DNA, 25 bp, E. coli
gcatggtgaccgcagctttgttcgc

SEQ ID NO: 6628 - DNA, 25 bp, E. coli
gcatggtgaccggagctttgttcgc

SEQ ID NO: 6629 - DNA, 25 bp, E. coli
cctttagaggtacaaacaactgcga

SEQ ID NO: 6630 - DNA, 25 bp, E. coli
cctttagaggtagaaacaactgcga

SEQ ID NO: 6631 - DNA, 25 bp, E. coli
tggcgcgctgcacgatcagtcataa

SEQ ID NO: 6632 - DNA, 25 bp, E. coli
tggcgcgctgcaggatcagtcataa

SEQ ID NO: 6633 - DNA, 25 bp, E. coli
taactttgacctgttaatgacttaa

SEQ ID NO: 6634 - DNA, 25 bp, E. coli
taactttgacctcttaatgacttaa

SEQ ID NO: 6635 - DNA, 25 bp, E. coli
catcacagtatctggagttatttga

SEQ ID NO: 6636 - DNA, 25 bp, E. coli
catcacagtatcaggagttatttga

SEQ ID NO: 6637 - DNA, 25 bp, E. coli
aaacgagactatgcgactcattcca

SEQ ID NO: 6638 - DNA, 25 bp, E. coli
aaacgagactatccgactcattcca

SEQ ID NO: 6639 - DNA, 25 bp, E. coli
tatttgataagacgatcaatgaact

SEQ ID NO: 6640 - DNA, 25 bp, E. coli
tatttgataagaggatcaatgaact

SEQ ID NO: 6641 - DNA, 25 bp, E. coli
ttcaccatttgaccagtgaggaggg

SEQ ID NO: 6642 - DNA, 25 bp, E. coli
ttcaccatttgagcagtgaggaggg

SEQ ID NO: 6643 - DNA, 25 bp, E. coli
tgctcaaaacgacactatgcgactc

SEQ ID NO: 6644 - DNA, 25 bp, E. coli
tgctcaaaacgagactatgcgactc

SEQ ID NO: 6645 - DNA, 25 bp, E. coli
tgacaacactgctcaaaacgagact

SEQ ID NO: 6646 - DNA, 25 bp, E. coli
tgacaacactgcacaaaacgagact

SEQ ID NO: 6647 - DNA, 25 bp, E. coli
gactggcaggacttcttcaccattt

SEQ ID NO: 6648 - DNA, 25 bp, E. coli
gggacaaggataataaccggagata

SEQ ID NO: 6649 - DNA, 25 bp, E. coli
gggacaaggatattaaccggagata

SEQ ID NO: 6650 - DNA, 25 bp, E. coli
taattattcatcacagtatcaggag

SEQ ID NO: 6651 - DNA, 25 bp, E. coli
taattattcatctcagtatcaggag

SEQ ID NO: 6652 - DNA, 25 bp, E. coli
taaccggagataattattcatcaca

SEQ ID NO: 6653 - DNA, 25 bp, E. coli
taaccggagatatttattcatcaca

SEQ ID NO: 6654 - DNA, 25 bp, E. coli
gactggcaggacatcttcaccattt

SEQ ID NO: 6655 - DNA, 25 bp, E. coli
aatttagcggcgtactgccttcggg

SEQ ID NO: 6656 - DNA, 25 bp, E. coli
aatttagcggcgaactgccttcggg

SEQ ID NO: 6657 - DNA, 25 bp, E. coli
tactgtctgggaaaccgtctgcgaa

SEQ ID NO: 6658 - DNA, 25 bp, E. coli
taaattcgatacagtctgggatacc

SEQ ID NO: 6659 - DNA, 25 bp, E. coli
tactgtctgggataccgtctgcgaa

SEQ ID NO: 6660 - DNA, 25 bp, E. coli
taaattcgatactgtctgggatacc

SEQ ID NO: 6661 - DNA, 25 bp, E. coli
tatttcaacctacgcggaaagcacg

SEQ ID NO: 6662 - DNA, 25 bp, E. coli
tatttcaacctaggcggaaagcacg

SEQ ID NO: 6663 - DNA, 25 bp, E. coli
tccgggcatatcaaagcagaaaact

SEQ ID NO: 6664 - DNA, 25 bp, E. coli
tcgggtttccatggccacggctatt

SEQ ID NO: 6665 - DNA, 25 bp, E. coli
tcctgagcgaactagtcagcgcctt

SEQ ID NO: 6666 - DNA, 25 bp, E. coli
tccgggcatatctaagcagaaaact

SEQ ID NO: 6667 - DNA, 25 bp, E. coli
tcctgagcgaacaagtcagcgcctt

SEQ ID NO: 6668 - DNA, 25 bp, E. coli
tcgggtttccatcgccacggctatt

SEQ ID NO: 6669 - DNA, 25 bp, E. coli
gcagaaaactgctcgcatattgcct

SEQ ID NO: 6670 - DNA, 25 bp, E. coli
gcagaaaactgcacgcatattgcct

SEQ ID NO: 6671 - DNA, 25 bp, E. coli
cgaacgtaaattaatgggcatggac

SEQ ID NO: 6672 - DNA, 25 bp, E. coli
cgaacgtaaatttatgggcatggac

SEQ ID NO: 6673 - DNA, 25 bp, E. coli
gggcaacgtcacgacgttagtacat

SEQ ID NO: 6674 - DNA, 25 bp, E. coli
ggaaagcacggcatgtccgggcata

SEQ ID NO: 6675 - DNA, 25 bp, E. coli
gggcaacgtcaccacgttagtacat

SEQ ID NO: 6676 - DNA, 25 bp, E. coli
ggaaagcacggcttgtccgggcata

SEQ ID NO: 6677 - DNA, 25 bp, E. coli
agcgctgaatgtgtgcctgacctgc

SEQ ID NO: 6678 - DNA, 25 bp, E. coli
agcgctgaatgtctgcctgacctgc

SEQ ID NO: 6679 - DNA, 25 bp, E. coli
actccgcgtggtggaggaatccgac

SEQ ID NO: 6680 - DNA, 25 bp, E. coli
acgtcgatggtgagaatctcgctga

SEQ ID NO: 6681 - DNA, 25 bp, E. coli
acgtcgatggtgtgaatctcgctga

SEQ ID NO: 6682 - DNA, 25 bp, E. coli
actccgcgtggtcgaggaatccgac

SEQ ID NO: 6683 - DNA, 25 bp, E. coli
tgacgtcgatggagtgaatctcgct

SEQ ID NO: 6684 - DNA, 25 bp, E. coli
tgaatgtctgccagacctgcccact

SEQ ID NO: 6685 - DNA, 25 bp, E. coli
tgaatgtctgcctgacctgcccact

SEQ ID NO: 6686 - DNA, 25 bp, E. coli
tgacgtcgatggtgtgaatctcgct

SEQ ID NO: 6687 - DNA, 25 bp, E. coli
tgccagcgctgattgtctgcctgac

SEQ ID NO: 6688 - DNA, 25 bp, E. coli
tgccagcgctgaatgtctgcctgac

SEQ ID NO: 6689 - DNA, 25 bp, E. coli
gcgtggtggaggaatccgaccaaca

SEQ ID NO: 6690 - DNA, 25 bp, E. coli
gctgaactgattaaccatgtcgctg

SEQ ID NO: 6691 - DNA, 25 bp, E. coli
gcgtggtggaggtatccgaccaaca

SEQ ID NO: 6692 - DNA, 25 bp, E. coli
gctgaactgatttaccatgtcgctg

SEQ ID NO: 6693 - DNA, 25 bp, E. coli
gaatccgaccaagagtcaacctgca

SEQ ID NO: 6694 - DNA, 25 bp, E. coli
gaatccgaccaacagtcaacctgca

SEQ ID NO: 6695 - DNA, 25 bp, E. coli
gtttacggcccttgccggcatacgc

SEQ ID NO: 6696 - DNA, 25 bp, E. coli
gtttacggccctagccggcatacgc

SEQ ID NO: 6697 - DNA, 25 bp, E. coli
tggaggaatccgtccaacagtcaac

SEQ ID NO: 6698 - DNA, 25 bp, E. coli
tggaggaatccgaccaacagtcaac

SEQ ID NO: 6699 - DNA, 25 bp, E. coli
catcacgtcggtcaatgggcatctc

SEQ ID NO: 6700 - DNA, 25 bp, E. coli
catcacgtcggtgaatgggcatctc

SEQ ID NO: 6701 - DNA, 25 bp, E. coli
tagtcaaagcctttgctaagaccga

SEQ ID NO: 6702 - DNA, 25 bp, E. coli
tagtcaaagcctatgctaagaccga

SEQ ID NO: 6703 - DNA, 25 bp, E. coli
tagccgaggccaatttcgaagtcgc

SEQ ID NO: 6704 - DNA, 25 bp, E. coli
tagccgaggccattttcgaagtcgc

SEQ ID NO: 6705 - DNA, 25 bp, E. coli
tttttggggcgaacagaccatcgaa

SEQ ID NO: 6706 - DNA, 25 bp, E. coli
tttttggggcgatcagaccatcgaa

SEQ ID NO: 6707 - DNA, 25 bp, E. coli
tgaatgggcatcactgcgcaatacg

SEQ ID NO: 6708 - DNA, 25 bp, E. coli
tgaatgggcatctctgcgcaatacg

SEQ ID NO: 6709 - DNA, 25 bp, E. coli
tgccaactcaagtagcgaaagctca

SEQ ID NO: 6710 - DNA, 25 bp, E. coli
tcgccggaaatagccgaggccattt

SEQ ID NO: 6711 - DNA, 25 bp, E. coli
tcgccggaaatacccgaggccattt

SEQ ID NO: 6712 - DNA, 25 bp, E. coli
tgccaactcaagaagcgaaagctca

SEQ ID NO: 6713 - DNA, 25 bp, E. coli
tctgcgcaatacctcgccggaaata

SEQ ID NO: 6714 - DNA, 25 bp, E. coli
tctgcgcaatacgtcgccggaaata

SEQ ID NO: 6715 - DNA, 25 bp, E. coli
gccattttcgaagtcgccgggtacg

SEQ ID NO: 6716 - DNA, 25 bp, E. coli
gccattttcgaactcgccgggtacg

SEQ ID NO: 6717 - DNA, 25 bp, E. coli
gaagcgaaagctgatcacgtcggtg

SEQ ID NO: 6718 - DNA, 25 bp, E. coli
gaagcgaaagctcatcacgtcggtg

SEQ ID NO: 6719 - DNA, 25 bp, E. coli
gatgaagtgttactcaaagcctttg

SEQ ID NO: 6720 - DNA, 25 bp, E. coli
gatgaagtgttagtcaaagcctttg

SEQ ID NO: 6721 - DNA, 25 bp, E. coli
aatacggatggtccgcgcctgatcc

SEQ ID NO: 6722 - DNA, 25 bp, E. coli
aatacggatggtgcgcgcctgatcc

SEQ ID NO: 6723 - DNA, 25 bp, E. coli
cagcacttcagatcggctcgggtga

SEQ ID NO: 6724 - DNA, 25 bp, E. coli
cagcacttcagaacggctcgggtga

SEQ ID NO: 6725 - DNA, 25 bp, E. coli
agcgccttcgctacgatctgacgga

SEQ ID NO: 6726 - DNA, 25 bp, E. coli
agcgccttcgcttcgatctgacgga

SEQ ID NO: 6727 - DNA, 25 bp, E. coli
tatcgataccgatacgcatacgcag

SEQ ID NO: 6728 - DNA, 25 bp, E. coli
tatcgataccgaaacgcatacgcag

SEQ ID NO: 6729 - DNA, 25 bp, E. coli
ttggcgatcttcagcactttgcgga

SEQ ID NO: 6730 - DNA, 25 bp, E. coli
ttggcgatcttctgcactttgcgga

SEQ ID NO: 6731 - DNA, 25 bp, E. coli
tctcaatcatatccaccggaatacg

SEQ ID NO: 6732 - DNA, 25 bp, E. coli
tctcaatcatatgcaccggaatacg

SEQ ID NO: 6733 - DNA, 25 bp, E. coli
cgcaggctttcggtggtcgcagaat

SEQ ID NO: 6734 - DNA, 25 bp, E. coli
cgcaggctttcgctggtcgcagaat

SEQ ID NO: 6735 - DNA, 25 bp, E. coli
ggagaacttgtatccacggcggtat

SEQ ID NO: 6736 - DNA, 25 bp, E. coli
ggagaacttgtaaccacggcggtat

SEQ ID NO: 6737 - DNA, 25 bp, E. coli
tcaaggaactgctagccacggttgg

SEQ ID NO: 6738 - DNA, 25 bp, E. coli
tcaaggaactgcaagccacggttgg

SEQ ID NO: 6739 - DNA, 25 bp, E. coli
tcaccgatcggcctttccatggaga

SEQ ID NO: 6740 - DNA, 25 bp, E. coli
taatcgtccaggaagctacgcagca

SEQ ID NO: 6741 - DNA, 25 bp, E. coli
tcaccgatcggcgtttccatggaga

SEQ ID NO: 6742 - DNA, 25 bp, E. coli
taatcgtccaggtagctacgcagca

SEQ ID NO: 6743 - DNA, 25 bp, E. coli
aagtccgcatatccacaaaatggca

SEQ ID NO: 6744 - DNA, 25 bp, E. coli
aagtccgcatatgcacaaaatggca

SEQ ID NO: 6745 - DNA, 25 bp, E. coli
cagagcgcatctgcaaatgatttta

SEQ ID NO: 6746 - DNA, 25 bp, E. coli
caaaatggcaccctgatgagtctga

SEQ ID NO: 6747 - DNA, 25 bp, E. coli
caaaatggcaccgtgatgagtctga

SEQ ID NO: 6748 - DNA, 25 bp, E. coli
cagagcgcatctccaaatgatttta

SEQ ID NO: 6749 - DNA, 25 bp, E. coli
tagcggcaacatcaaaaattcgatg

SEQ ID NO: 6750 - DNA, 25 bp, E. coli
tatgagactaccacgacagagcgca

SEQ ID NO: 6751 - DNA, 25 bp, E. coli
tagcggcaacatgaaaaattcgatg

SEQ ID NO: 6752 - DNA, 25 bp, E. coli
tatgagactacctcgacagagcgca

SEQ ID NO: 6753 - DNA, 25 bp, E. coli
tttaaggattaagcagaggacccac

SEQ ID NO: 6754 - DNA, 25 bp, E. coli
tttaaggattaaccagaggacccac

SEQ ID NO: 6755 - DNA, 25 bp, E. coli
taaacgaaccttatgagactacctc

SEQ ID NO: 6756 - DNA, 25 bp, E. coli
taaacgaaccttttgagactacctc

SEQ ID NO: 6757 - DNA, 25 bp, E. coli
gaaaaggtaactgacattgccgtcg

SEQ ID NO: 6758 - DNA, 25 bp, E. coli
gaaaaggtaactcacattgccgtcg

SEQ ID NO: 6759 - DNA, 25 bp, E. coli
cattgccgtcgatctataaacgaac

SEQ ID NO: 6760 - DNA, 25 bp, E. coli
cattgccgtcgaactataaacgaac

SEQ ID NO: 6761 - DNA, 25 bp, E. coli
gattttatggctcattagcggcaac

SEQ ID NO: 6762 - DNA, 25 bp, E. coli
gattttatggctgattagcggcaac

SEQ ID NO: 6763 - DNA, 25 bp, E. coli
gaggacccacagcttagagatatga

SEQ ID NO: 6764 - DNA, 25 bp, E. coli
gaggacccacaggttagagatatga

SEQ ID NO: 6765 - DNA, 25 bp, E. coli
aatccagcaagagaagcaacgtcgc

SEQ ID NO: 6766 - DNA, 25 bp, E. coli
aatccagcaagacaagcaacgtcgc

SEQ ID NO: 6767 - DNA, 25 bp, E. coli
cagaaatatgacagaaggcggtcgc

SEQ ID NO: 6768 - DNA, 25 bp, E. coli
cagaaatatgactgaaggcggtcgc

SEQ ID NO: 6769 - DNA, 25 bp, E. coli
caaaggcagcatcacgaatgggtcg

SEQ ID NO: 6770 - DNA, 25 bp, E. coli
caaaggcagcatgacgaatgggtcg

SEQ ID NO: 6771 - DNA, 25 bp, E. coli
tcgcagaagcggaacagcaaggtaa

SEQ ID NO: 6772 - DNA, 25 bp, E. coli
tcgcagaagcggtacagcaaggtaa

SEQ ID NO: 6773 - DNA, 25 bp, E. coli
tgcggacaaaaatcgcgatcaaagt

SEQ ID NO: 6774 - DNA, 25 bp, E. coli
tgcggacaaaaaacgcgatcaaagt

SEQ ID NO: 6775 - DNA, 25 bp, E. coli
tctttgcgccatgttagcctcctta

SEQ ID NO: 6776 - DNA, 25 bp, E. coli
tctttgcgccatcttagcctcctta

SEQ ID NO: 6777 - DNA, 25 bp, E. coli
gcctccttaagcaatccggctatcg

SEQ ID NO: 6778 - DNA, 25 bp, E. coli
gcctccttaagctatccggctatcg

SEQ ID NO: 6779 - DNA, 25 bp, E. coli
gaaagctcgtcacgataaactggac

SEQ ID NO: 6780 - DNA, 25 bp, E. coli
gaaagctcgtcaggataaactggac

SEQ ID NO: 6781 - DNA, 25 bp, E. coli
cggctatcgcctcatcattgcagga

SEQ ID NO: 6782 - DNA, 25 bp, E. coli
cggctatcgcctgatcattgcagga

SEQ ID NO: 6783 - DNA, 25 bp, E. coli
cggagcgcaacacggaaatccagca

SEQ ID NO: 6784 - DNA, 25 bp, E. coli
cggagcgcaacagggaaatccagca

SEQ ID NO: 6785 - DNA, 25 bp, E. coli
ggtaaaaatgaagagcaaaggcagc

SEQ ID NO: 6786 - DNA, 25 bp, E. coli
ggtaaaaatgaacagcaaaggcagc

SEQ ID NO: 6787 - DNA, 25 bp, E. coli
aattacgctaaatcatcgcggtgag

SEQ ID NO: 6788 - DNA, 25 bp, E. coli
aattacgctaaaacatcgcggtgag

SEQ ID NO: 6789 - DNA, 25 bp, E. coli
taaatcatcgcggtgagtcgatgtc

SEQ ID NO: 6790 - DNA, 25 bp, E. coli
tacgctaaatcatcgcggtgagtcg

SEQ ID NO: 6791 - DNA, 25 bp, E. coli
taaatcatcgcgctgagtcgatgtc

SEQ ID NO: 6792 - DNA, 25 bp, E. coli
attacgctaaatgatcgcggtgagt

SEQ ID NO: 6793 - DNA, 25 bp, E. coli
acgctaaatcatggcggtgagtcga

SEQ ID NO: 6794 - DNA, 25 bp, E. coli
attacgctaaatcatcgcggtgagt

SEQ ID NO: 6795 - DNA, 25 bp, E. coli
acgctaaatcatcgcggtgagtcga

SEQ ID NO: 6796 - DNA, 25 bp, E. coli
acaacgtaatgatgtgattgtgaat

SEQ ID NO: 6797 - DNA, 25 bp, E. coli
acaacgtaatgaagtgattgtgaat

SEQ ID NO: 6798 - DNA, 25 bp, E. coli
aaatcatcgcggagagtcgatgtcg

SEQ ID NO: 6799 - DNA, 25 bp, E. coli
aaatcatcgcggtgagtcgatgtcg

SEQ ID NO: 6800 - DNA, 25 bp, E. coli
tacgctaaatcaacgcggtgagtcg

SEQ ID NO: 6801 - DNA, 25 bp, E. coli
ttacgctaaatcatcgcggtgagtc

SEQ ID NO: 6802 - DNA, 25 bp, E. coli
ttacgctaaatcttcgcggtgagtc

SEQ ID NO: 6803 - DNA, 25 bp, E. coli
gaattacgctaaatcatcgcggtga

SEQ ID NO: 6804 - DNA, 25 bp, E. coli
gaattacgctaattcatcgcggtga

SEQ ID NO: 6805 - DNA, 25 bp, E. coli
gtacaacgtaatgaagtgattgtga

SEQ ID NO: 6806 - DNA, 25 bp, E. coli
gtacaacgtaatcaagtgattgtga

SEQ ID NO: 6807 - DNA, 25 bp, E. coli
ggaattacgctaaatcatcgcggtg

SEQ ID NO: 6808 - DNA, 25 bp, E. coli
ggaattacgctatatcatcgcggtg

SEQ ID NO: 6809 - DNA, 25 bp, E. coli
cagatggaagcggaagcagaaagcc

SEQ ID NO: 6810 - DNA, 25 bp, E. coli
cagatggaagcgcaagcagaaagcc

SEQ ID NO: 6811 - DNA, 25 bp, E. coli
aactcgtcgcgcgatgtgcgtcgtc

SEQ ID NO: 6812 - DNA, 25 bp, E. coli
aactcgtcgcgccatgtgcgtcgtc

SEQ ID NO: 6813 - DNA, 25 bp, E. coli
tttgccgaactgaaagccgatgatg

SEQ ID NO: 6814 - DNA, 25 bp, E. coli
tttgccgaactgtaagccgatgatg

SEQ ID NO: 6815 - DNA, 25 bp, E. coli
tcgctggacgatgagtttgccgaac

SEQ ID NO: 6816 - DNA, 25 bp, E. coli
tcgctggacgatcagtttgccgaac

SEQ ID NO: 6817 - DNA, 25 bp, E. coli
cctggaacatgaagtgacgctggtg

SEQ ID NO: 6818 - DNA, 25 bp, E. coli
cctggaacatgatgtgacgctggtg

SEQ ID NO: 6819 - DNA, 25 bp, E. coli
gcgtcgtcagctggacagtggcaaa

SEQ ID NO: 6820 - DNA, 25 bp, E. coli
gcgtcgtcagctcgacagtggcaaa

SEQ ID NO: 6821 - DNA, 25 bp, E. coli
gaaaacaaattgagcgaaacacgcg

SEQ ID NO: 6822 - DNA, 25 bp, E. coli
gaaaacaaattgtgcgaaacacgcg

SEQ ID NO: 6823 - DNA, 25 bp, E. coli
cgtattgaacaaccgtcggcgcgtg

SEQ ID NO: 6824 - DNA, 25 bp, E. coli
cgtattgaacaagcgtcggcgcgtg

SEQ ID NO: 6825 - DNA, 25 bp, E. coli
cgctcgccagcaggcattgatgtta

SEQ ID NO: 6826 - DNA, 25 bp, E. coli
cgctcgccagcacgcattgatgtta

SEQ ID NO: 6827 - DNA, 25 bp, E. coli
ctgttagagaaagcggaagatccac

SEQ ID NO: 6828 - DNA, 25 bp, E. coli
ctgttagagaaaccggaagatccac

SEQ ID NO: 6829 - DNA, 25 bp, E. coli
gtgaatgccaacatcaacgctctgt

SEQ ID NO: 6830 - DNA, 25 bp, E. coli
gtgaatgccaacttcaacgctctgt

SEQ ID NO: 6831 - DNA, 25 bp, E. coli
aagccgtggatcttgccggatgaag

SEQ ID NO: 6832 - DNA, 25 bp, E. coli
aagccgtggatcatgccggatgaag

SEQ ID NO: 6833 - DNA, 25 bp, E. coli
cactgcgatatgacagcattctggc

SEQ ID NO: 6834 - DNA, 25 bp, E. coli
cactgcgatatgtcagcattctggc

SEQ ID NO: 6835 - DNA, 25 bp, E. coli
acggcaagttatataatctcaaacg

SEQ ID NO: 6836 - DNA, 25 bp, E. coli
acggcaagttatttaatctcaaacg

SEQ ID NO: 6837 - DNA, 25 bp, E. coli
tatgtcagcattctggcaattgcgt

SEQ ID NO: 6838 - DNA, 25 bp, E. coli
tatgtcagcattgtggcaattgcgt

SEQ ID NO: 6839 - DNA, 25 bp, E. coli
ttaaagtgattgatacgtgcccgag

SEQ ID NO: 6840 - DNA, 25 bp, E. coli
ttaaagtgattgttacgtgcccgag

SEQ ID NO: 6841 - DNA, 25 bp, E. coli
ccactgtggttaaagtgattgatac

SEQ ID NO: 6842 - DNA, 25 bp, E. coli
ccactgtggttatagtgattgatac

SEQ ID NO: 6843 - DNA, 25 bp, E. coli
cattctggcaatagcgtacgtggca

SEQ ID NO: 6844 - DNA, 25 bp, E. coli
cgtggcaacggcaagttatttaatc

SEQ ID NO: 6845 - DNA, 25 bp, E. coli
cgtggcaacggctagttatttaatc

SEQ ID NO: 6846 - DNA, 25 bp, E. coli
cattctggcaattgcgtacgtggca

SEQ ID NO: 6847 - DNA, 25 bp, E. coli
gggttatcgctgatataccggcgaa

SEQ ID NO: 6848 - DNA, 25 bp, E. coli
gggttatcgctgttataccggcgaa

SEQ ID NO: 6849 - DNA, 25 bp, E. coli
tgcgtacgtggctacggcaagttat

SEQ ID NO: 6850 - DNA, 25 bp, E. coli
tggcaattgcgttcgtggcaacggc

SEQ ID NO: 6851 - DNA, 25 bp, E. coli
tggcaattgcgtacgtggcaacggc

SEQ ID NO: 6852 - DNA, 25 bp, E. coli
tgcgtacgtggcaacggcaagttat

SEQ ID NO: 6853 - DNA, 25 bp, E. coli
aagaaggctttaaggcaatgggcgc

SEQ ID NO: 6854 - DNA, 25 bp, E. coli
aagaaggctttatggcaatgggcgc

SEQ ID NO: 6855 - DNA, 25 bp, E. coli
tacccgcggcaatgtcatcaactgc

SEQ ID NO: 6856 - DNA, 25 bp, E. coli
tacccgcggcaaagtcatcaactgc

SEQ ID NO: 6857 - DNA, 25 bp, E. coli
aacactgctggcctgcgatatgggc

SEQ ID NO: 6858 - DNA, 25 bp, E. coli
aacactgctggcgtgcgatatgggc

SEQ ID NO: 6859 - DNA, 25 bp, E. coli
ttgccgctgcggaagtgaaattcct

SEQ ID NO: 6860 - DNA, 25 bp, E. coli
ttgccgctgcggtagtgaaattcct

SEQ ID NO: 6861 - DNA, 25 bp, E. coli
tgatcctgatgaacatgatcccggt

SEQ ID NO: 6862 - DNA, 25 bp, E. coli
tgatgcgcgccattgaagttatcgg

SEQ ID NO: 6863 - DNA, 25 bp, E. coli
tgaccgtcgttaactggcgctcggc

SEQ ID NO: 6864 - DNA, 25 bp, E. coli
tgatgcgcgccaatgaagttatcgg

SEQ ID NO: 6865 - DNA, 25 bp, E. coli
tgatcctgatgatcatgatcccggt

SEQ ID NO: 6866 - DNA, 25 bp, E. coli
tgatgaagcagaaggatacccgcgg

SEQ ID NO: 6867 - DNA, 25 bp, E. coli
tgatgaagcagatggatacccgcgg

SEQ ID NO: 6868 - DNA, 25 bp, E. coli
tgaccgtcgttatctggcgctcggc

SEQ ID NO: 6869 - DNA, 25 bp, E. coli
gcggttctgctcgtttcctcggtaa

SEQ ID NO: 6870 - DNA, 25 bp, E. coli
gcggttctgctcctttcctcggtaa

SEQ ID NO: 6871 - DNA, 25 bp, E. coli
gaaaaaatgatcaacggcttccaga

SEQ ID NO: 6872 - DNA, 25 bp, E. coli
gatcctatctttatggcccctggcg

SEQ ID NO: 6873 - DNA, 25 bp, E. coli
gaaaaaatgatctacggcttccaga

SEQ ID NO: 6874 - DNA, 25 bp, E. coli
gatcctatctttttggcccctggcg

SEQ ID NO: 6875 - DNA, 25 bp, E. coli
cacttttctagctctgagtatcggc

SEQ ID NO: 6876 - DNA, 25 bp, E. coli
cacttttctagcactgagtatcggc

SEQ ID NO: 6877 - DNA, 25 bp, E. coli
actaagtctgtttccacaactggga

SEQ ID NO: 6878 - DNA, 25 bp, E. coli
actaagtctgttaccacaactggga

SEQ ID NO: 6879 - DNA, 25 bp, E. coli
taggtgctggtactgtcctgctgaa

SEQ ID NO: 6880 - DNA, 25 bp, E. coli
tatgctcttcggcacctataaatgg

SEQ ID NO: 6881 - DNA, 25 bp, E. coli
tatgctcttcgggacctataaatgg

SEQ ID NO: 6882 - DNA, 25 bp, E. coli
taggtgctggtagtgtcctgctgaa

SEQ ID NO: 6883 - DNA, 25 bp, E. coli
ttttgaagtgatcgccctcaagccc

SEQ ID NO: 6884 - DNA, 25 bp, E. coli
ttttgaagtgatggccctcaagccc

SEQ ID NO: 6885 - DNA, 25 bp, E. coli
tgagtatcggcttcttcaggcctgc

SEQ ID NO: 6886 - DNA, 25 bp, E. coli
tgagtatcggctacttcaggcctgc

SEQ ID NO: 6887 - DNA, 25 bp, E. coli
tccacccggagaatgaaatgaaaaa

SEQ ID NO: 6888 - DNA, 25 bp, E. coli
tccacccggagattgaaatgaaaaa

SEQ ID NO: 6889 - DNA, 25 bp, E. coli
tctcccacgtgggtgaatatcctgt

SEQ ID NO: 6890 - DNA, 25 bp, E. coli
tctcccacgtggctgaatatcctgt

SEQ ID NO: 6891 - DNA, 25 bp, E. coli
cctgctgctggcatactgggagata

SEQ ID NO: 6892 - DNA, 25 bp, E. coli
cctgctgctggcttactgggagata

SEQ ID NO: 6893 - DNA, 25 bp, E. coli
gtgcatataattatccacccggaga

SEQ ID NO: 6894 - DNA, 25 bp, E. coli
ggagctatttccacggcatagtgga

SEQ ID NO: 6895 - DNA, 25 bp, E. coli
gtgcatataattttccacccggaga

SEQ ID NO: 6896 - DNA, 25 bp, E. coli
ggagctatttcctcggcatagtgga

SEQ ID NO: 6897 - DNA, 25 bp, E. coli
caagagctaagcgactgagagtgcc

SEQ ID NO: 6898 - DNA, 25 bp, E. coli
caagagctaagccactgagagtgcc

SEQ ID NO: 6899 - DNA, 25 bp, E. coli
tatcgccccttcaagagctaagcca

SEQ ID NO: 6900 - DNA, 25 bp, E. coli
tatcgccccttctagagctaagcca

SEQ ID NO: 6901 - DNA, 25 bp, E. coli
ttcaagagctaagccactgagagtg

SEQ ID NO: 6902 - DNA, 25 bp, E. coli
ttcaagagctaacccactgagagtg

SEQ ID NO: 6903 - DNA, 25 bp, E. coli
tcttatcgccccttcaagagctaag

SEQ ID NO: 6904 - DNA, 25 bp, E. coli
tcttatcgccccatcaagagctaag

SEQ ID NO: 6905 - DNA, 25 bp, E. coli
gccactgagagtcccggagataagc

SEQ ID NO: 6906 - DNA, 25 bp, E. coli
ccttcaagagcttagccactgagag

SEQ ID NO: 6907 - DNA, 25 bp, E. coli
gccactgagagtgccggagataagc

SEQ ID NO: 6908 - DNA, 25 bp, E. coli
ccttcaagagctaagccactgagag

SEQ ID NO: 6909 - DNA, 25 bp, E. coli
gctaagccactgtgagtgccggaga

SEQ ID NO: 6910 - DNA, 25 bp, E. coli
gctaagccactgagagtgccggaga

SEQ ID NO: 6911 - DNA, 25 bp, E. coli
ccccttcaagagctaagccactgag

SEQ ID NO: 6912 - DNA, 25 bp, E. coli
ccccttcaagaggtaagccactgag

SEQ ID NO: 6913 - DNA, 25 bp, E. coli
ctgagagtgccggagataagcgccg

SEQ ID NO: 6914 - DNA, 25 bp, E. coli
ctgagagtgccgcagataagcgccg

SEQ ID NO: 6915 - DNA, 25 bp, E. coli
taagccactgagtgtgccggagata

SEQ ID NO: 6916 - DNA, 25 bp, E. coli
taagccactgagagtgccggagata

SEQ ID NO: 6917 - DNA, 25 bp, E. coli
gagctaagccacagagagtgccgga

SEQ ID NO: 6918 - DNA, 25 bp, E. coli
gagctaagccactgagagtgccgga

SEQ ID NO: 6919 - DNA, 25 bp, E. coli
aatgcgggtattcaggtcaacgatc

SEQ ID NO: 6920 - DNA, 25 bp, E. coli
aatgcgggtattgaggtcaacgatc

SEQ ID NO: 6921 - DNA, 25 bp, E. coli
caattaatgcacgtcgcgtaccgca

SEQ ID NO: 6922 - DNA, 25 bp, E. coli
caattaatgcacctcgcgtaccgca

SEQ ID NO: 6923 - DNA, 25 bp, E. coli
cattgctggtgggatctgactctct

SEQ ID NO: 6924 - DNA, 25 bp, E. coli
tacttaaaattattgccactggcgg

SEQ ID NO: 6925 - DNA, 25 bp, E. coli
tacttaaaattaatgccactggcgg

SEQ ID NO: 6926 - DNA, 25 bp, E. coli
tatggataagctcatccgcgatggt

SEQ ID NO: 6927 - DNA, 25 bp, E. coli
tatggataagctgatccgcgatggt

SEQ ID NO: 6928 - DNA, 25 bp, E. coli
tctgctctggagacgatggatcagg

SEQ ID NO: 6929 - DNA, 25 bp, E. coli
tctgctctggagtcgatggatcagg

SEQ ID NO: 6930 - DNA, 25 bp, E. coli
cgcagggcggtggtatagatcaact

SEQ ID NO: 6931 - DNA, 25 bp, E. coli
cgcagggcggtgctatagatcaact

SEQ ID NO: 6932 - DNA, 25 bp, E. coli
cgtgatccgcgggtacattggtatc

SEQ ID NO: 6933 - DNA, 25 bp, E. coli
cattgctggtggcatctgactctct

SEQ ID NO: 6934 - DNA, 25 bp, E. coli
cgtgatccgcggctacattggtatc

SEQ ID NO: 6935 - DNA, 25 bp, E. coli
gataagcagttatcgctgcaggtca

SEQ ID NO: 6936 - DNA, 25 bp, E. coli
gataagcagttaacgctgcaggtca

SEQ ID NO: 6937 - DNA, 25 bp, E. coli
ggtggataacaatccggccatctct

SEQ ID NO: 6938 - DNA, 25 bp, E. coli
ggtggataacaaaccggccatctct

SEQ ID NO: 6939 - DNA, 25 bp, E. coli
taatgaagtgtctcctgacggcccg

SEQ ID NO: 6940 - DNA, 25 bp, E. coli
taatgaagtgtcacctgacggcccg

SEQ ID NO: 6941 - DNA, 25 bp, E. coli
caaagcgtattggtctggctgcgga

SEQ ID NO: 6942 - DNA, 25 bp, E. coli
caaagcgtattgctctggctgcgga

SEQ ID NO: 6943 - DNA, 25 bp, E. coli
tagcgttccttttcattgcgaagaa

SEQ ID NO: 6944 - DNA, 25 bp, E. coli
tagcgttcctttacattgcgaagaa

SEQ ID NO: 6945 - DNA, 25 bp, E. coli
ttggctttgatccagcaagcggcca

SEQ ID NO: 6946 - DNA, 25 bp, E. coli
ttggctttgatcgagcaagcggcca

SEQ ID NO: 6947 - DNA, 25 bp, E. coli
gcaagcggccatgaacagcaaggtg

SEQ ID NO: 6948 - DNA, 25 bp, E. coli
gcaaggtgctggacgacctgcgctt

SEQ ID NO: 6949 - DNA, 25 bp, E. coli
gcaaggtgctggtcgacctgcgctt

SEQ ID NO: 6950 - DNA, 25 bp, E. coli
gcaagcggccatcaacagcaaggtg

SEQ ID NO: 6951 - DNA, 25 bp, E. coli
cgcccggctggcaaagcgtattggt

SEQ ID NO: 6952 - DNA, 25 bp, E. coli
cgcccggctggctaagcgtattggt

SEQ ID NO: 6953 - DNA, 25 bp, E. coli
ccgttatgccggatttagcgttcct

SEQ ID NO: 6954 - DNA, 25 bp, E. coli
ccgttatgccggttttagcgttcct

SEQ ID NO: 6955 - DNA, 25 bp, E. coli
cattgcgaagaaggcgatgtgcacg

SEQ ID NO: 6956 - DNA, 25 bp, E. coli
cattgcgaagaacgcgatgtgcacg

SEQ ID NO: 6957 - DNA, 25 bp, E. coli
tcaactgggaatgacgctggtggcc

SEQ ID NO: 6958 - DNA, 25 bp, E. coli
tcaactgggaatcacgctggtggcc

SEQ ID NO: 6959 - DNA, 25 bp, E. coli
gagacattgtgctggttggctttga

SEQ ID NO: 6960 - DNA, 25 bp, E. coli
gacctgcgcttgtgctctccgttca

SEQ ID NO: 6961 - DNA, 25 bp, E. coli
gagacattgtgcaggttggctttga

SEQ ID NO: 6962 - DNA, 25 bp, E. coli
gacctgcgcttgagctctccgttca

SEQ ID NO: 6963 - DNA, 25 bp, E. coli
tactggatggatattcagttgaacc

SEQ ID NO: 6964 - DNA, 25 bp, E. coli
tactggatggattttcagttgaacc

SEQ ID NO: 6965 - DNA, 25 bp, E. coli
ttgaaccggtgagaggaggcttact

SEQ ID NO: 6966 - DNA, 25 bp, E. coli
ttgaaccggtgacaggaggcttact

SEQ ID NO: 6967 - DNA, 25 bp, E. coli
aaagagaagcttattgttgtaagtg

SEQ ID NO: 6968 - DNA, 25 bp, E. coli
aaagagaagctttttgttgtaagtg

SEQ ID NO: 6969 - DNA, 25 bp, E. coli
tggtagtggccattattctgttcac

SEQ ID NO: 6970 - DNA, 25 bp, E. coli
gccaatattctgatcactatgtcca

SEQ ID NO: 6971 - DNA, 25 bp, E. coli
gccagacttgaaagtggaataagaa

SEQ ID NO: 6972 - DNA, 25 bp, E. coli
gcctgttaccacgttaagtatccca

SEQ ID NO: 6973 - DNA, 25 bp, E. coli
gcctgttaccaccttaagtatccca

SEQ ID NO: 6974 - DNA, 25 bp, E. coli
gccagacttgaatgtggaataagaa

SEQ ID NO: 6975 - DNA, 25 bp, E. coli
gccaatattctgttcactatgtcca

SEQ ID NO: 6976 - DNA, 25 bp, E. coli
gattttcagttgtaccggtgagagg

SEQ ID NO: 6977 - DNA, 25 bp, E. coli
gattttcagttgaaccggtgagagg

SEQ ID NO: 6978 - DNA, 25 bp, E. coli
tggtagtggccaatattctgttcac

SEQ ID NO: 6979 - DNA, 25 bp, E. coli
taagaatatccattggtagtggcca

SEQ ID NO: 6980 - DNA, 25 bp, E. coli
taagtatcccaagtatatctcaatt

SEQ ID NO: 6981 - DNA, 25 bp, E. coli
taagaatatccaatggtagtggcca

SEQ ID NO: 6982 - DNA, 25 bp, E. coli
taagtatcccaactatatctcaatt

SEQ ID NO: 6983 - DNA, 25 bp, E. coli
gagaggaggctttctggataggcta

SEQ ID NO: 6984 - DNA, 25 bp, E. coli
gagaggaggcttactggataggcta

SEQ ID NO: 6985 - DNA, 25 bp, E. coli
caatttgccgttgacacattcgggc

SEQ ID NO: 6986 - DNA, 25 bp, E. coli
caatttgccgttcacacattcgggc

SEQ ID NO: 6987 - DNA, 25 bp, E. coli
cacattcgggcgcaattcatatgat

SEQ ID NO: 6988 - DNA, 25 bp, E. coli
cacattcgggcggaattcatatgat

SEQ ID NO: 6989 - DNA, 25 bp, E. coli
caggaaaccgtgacatgaataacta

SEQ ID NO: 6990 - DNA, 25 bp, E. coli
caggaaaccgtgtcatgaataacta

SEQ ID NO: 6991 - DNA, 25 bp, E. coli
acaattccctgattgtatgtgggtc

SEQ ID NO: 6992 - DNA, 25 bp, E. coli
acaattccctgaatgtatgtgggtc

SEQ ID NO: 6993 - DNA, 25 bp, E. coli
tataacaccactatacaggaaaccg

SEQ ID NO: 6994 - DNA, 25 bp, E. coli
tataacaccactttacaggaaaccg

SEQ ID NO: 6995 - DNA, 25 bp, E. coli
tgaataactactgaatgcgagcggt

SEQ ID NO: 6996 - DNA, 25 bp, E. coli
tgaaactacacgatgcaatttgccg

SEQ ID NO: 6997 - DNA, 25 bp, E. coli
tgaataactactcaatgcgagcggt

SEQ ID NO: 6998 - DNA, 25 bp, E. coli
tgaaactacacgttgcaatttgccg

SEQ ID NO: 6999 - DNA, 25 bp, E. coli
tgcctgatttttgagcgattgaaac

SEQ ID NO: 7000 - DNA, 25 bp, E. coli
tgcctgatttttcagcgattgaaac

SEQ ID NO: 7001 - DNA, 25 bp, E. coli
gcgagcggttttgcaaaattgttca

SEQ ID NO: 7002 - DNA, 25 bp, E. coli
gcgagcggttttccaaaattgttca

SEQ ID NO: 7003 - DNA, 25 bp, E. coli
gaattcatatgatgccgcccgtcaa

SEQ ID NO: 7004 - DNA, 25 bp, E. coli
gaattcatatgaagccgcccgtcaa

SEQ ID NO: 7005 - DNA, 25 bp, E. coli
cgtcaactcgacaagctttacgtga

SEQ ID NO: 7006 - DNA, 25 bp, E. coli
cgtcaactcgactagctttacgtga

SEQ ID NO: 7007 - DNA, 25 bp, E. coli
caatcgcaaacactaatcaaccagg

SEQ ID NO: 7008 - DNA, 25 bp, E. coli
caatcgcaaacagtaatcaaccagg

SEQ ID NO: 7009 - DNA, 25 bp, E. coli
caataactcatgtcctgcgccatcg

SEQ ID NO: 7010 - DNA, 25 bp, E. coli
caataactcatgacctgcgccatcg

SEQ ID NO: 7011 - DNA, 25 bp, E. coli
cagcaatcaaaatggcgggctatac

SEQ ID NO: 7012 - DNA, 25 bp, E. coli
catgaagattttggccggtagtgaa

SEQ ID NO: 7013 - DNA, 25 bp, E. coli
cagcaatcaaaaaggcgggctatac

SEQ ID NO: 7014 - DNA, 25 bp, E. coli
catgaagattttcgccggtagtgaa

SEQ ID NO: 7015 - DNA, 25 bp, E. coli
actcgtgtggtggtagtgcgctatt

SEQ ID NO: 7016 - DNA, 25 bp, E. coli
actcgtgtggtgctagtgcgctatt

SEQ ID NO: 7017 - DNA, 25 bp, E. coli
tatgtcggtgttagaagagcgtaca

SEQ ID NO: 7018 - DNA, 25 bp, E. coli
tatgtcggtgtttgaagagcgtaca

SEQ ID NO: 7019 - DNA, 25 bp, E. coli
tattgatcctcacctgtctgttgcc

SEQ ID NO: 7020 - DNA, 25 bp, E. coli
tattgatcctcagctgtctgttgcc

SEQ ID NO: 7021 - DNA, 25 bp, E. coli
tcggttcgatctatgcagcaatcaa

SEQ ID NO: 7022 - DNA, 25 bp, E. coli
tcggttcgatctttgcagcaatcaa

SEQ ID NO: 7023 - DNA, 25 bp, E. coli
gaagagcgtacaacacggattatca

SEQ ID NO: 7024 - DNA, 25 bp, E. coli
gaagagcgtacatcacggattatca

SEQ ID NO: 7025 - DNA, 25 bp, E. coli
gaaaatgatatccatgccagcggta

SEQ ID NO: 7026 - DNA, 25 bp, E. coli
gaaaatgatatcgatgccagcggta

SEQ ID NO: 7027 - DNA, 25 bp, E. coli
tcaaccaggcggcactggcagaatt

SEQ ID NO: 7028 - DNA, 25 bp, E. coli
tcaaccaggcgggactggcagaatt

SEQ ID NO: 7029 - DNA, 25 bp, E. coli
tatgatcagtggattccgctacggc

SEQ ID NO: 7030 - DNA, 25 bp, E. coli
tatgatcagtggtttccgctacggc

SEQ ID NO: 7031 - DNA, 25 bp, E. coli
tattggcgatatccatggcttcagc

SEQ ID NO: 7032 - DNA, 25 bp, E. coli
tattggcgatatgcatggcttcagc

SEQ ID NO: 7033 - DNA, 25 bp, E. coli
tatcaatgatgttccgctggtcact

SEQ ID NO: 7034 - DNA, 25 bp, E. coli
tattgaagagctgctggtagcgccg

SEQ ID NO: 7035 - DNA, 25 bp, E. coli
tattgaagagctcctggtagcgccg

SEQ ID NO: 7036 - DNA, 25 bp, E. coli
tatcaatgatgtaccgctggtcact

SEQ ID NO: 7037 - DNA, 25 bp, E. coli
tgttaacgccacacacgtatttggg

SEQ ID NO: 7038 - DNA, 25 bp, E. coli
tgttaacgccactcacgtatttggg

SEQ ID NO: 7039 - DNA, 25 bp, E. coli
tgccaaaacgttcgatgacatcagc

SEQ ID NO: 7040 - DNA, 25 bp, E. coli
tgccaaaacgttggatgacatcagc

SEQ ID NO: 7041 - DNA, 25 bp, E. coli
ccaacgtggacgtggtttgcgtagc

SEQ ID NO: 7042 - DNA, 25 bp, E. coli
ccaacgtggacgaggtttgcgtagc

SEQ ID NO: 7043 - DNA, 25 bp, E. coli
gctacggcttcctcggtatcaatga

SEQ ID NO: 7044 - DNA, 25 bp, E. coli
gcatctgggcgaaagagatccatcg

SEQ ID NO: 7045 - DNA, 25 bp, E. coli
gctacggcttccacggtatcaatga

SEQ ID NO: 7046 - DNA, 25 bp, E. coli
gcatctgggcgatagagatccatcg

SEQ ID NO: 7047 - DNA, 25 bp, E. coli
gacatcagcctgctgccaacctttg

SEQ ID NO: 7048 - DNA, 25 bp, E. coli
gacatcagcctggtgccaacctttg

SEQ ID NO: 7049 - DNA, 25 bp, E. coli
gatgcatctttagtgggtggcgcta

SEQ ID NO: 7050 - DNA, 25 bp, E. coli
gatgcatctttactgggtggcgcta

SEQ ID NO: 7051 - DNA, 25 bp, E. coli
cagataaagagtcccctgccctggt

SEQ ID NO: 7052 - DNA, 25 bp, E. coli
cagataaagagtgccctgccctggt

SEQ ID NO: 7053 - DNA, 25 bp, E. coli
taaagagtgccctgccctggtggct

SEQ ID NO: 7054 - DNA, 25 bp, E. coli
taaagagtgcccagccctggtggct

SEQ ID NO: 7055 - DNA, 25 bp, E. coli
acctgaccgggcgtcgttttgagca

SEQ ID NO: 7056 - DNA, 25 bp, E. coli
ataaagagtgccctgccctggtggc

SEQ ID NO: 7057 - DNA, 25 bp, E. coli
acctgaccgggcctcgttttgagca

SEQ ID NO: 7058 - DNA, 25 bp, E. coli
ataaagagtgccgtgccctggtggc

SEQ ID NO: 7059 - DNA, 25 bp, E. coli
aaagagtgccctcccctggtggctg

SEQ ID NO: 7060 - DNA, 25 bp, E. coli
aaagagtgccctgccctggtggctg

SEQ ID NO: 7061 - DNA, 25 bp, E. coli
tgcagataaagactgccctgccctg

SEQ ID NO: 7062 - DNA, 25 bp, E. coli
tgcagataaagagtgccctgccctg

SEQ ID NO: 7063 - DNA, 25 bp, E. coli
ccatctggcgggcataacgctgccg

SEQ ID NO: 7064 - DNA, 25 bp, E. coli
cctgaccgggcgtcgttttgagcac

SEQ ID NO: 7065 - DNA, 25 bp, E. coli
ccatctggcggggataacgctgccg

SEQ ID NO: 7066 - DNA, 25 bp, E. coli
cctgaccgggcgacgttttgagcac

SEQ ID NO: 7067 - DNA, 25 bp, E. coli
gctgcagataaagagtgccctgccc

SEQ ID NO: 7068 - DNA, 25 bp, E. coli
gctgcagataaacagtgccctgccc

SEQ ID NO: 7069 - DNA, 25 bp, E. coli
cggctgcagataaagagtgccctgc

SEQ ID NO: 7070 - DNA, 25 bp, E. coli
cggctgcagatatagagtgccctgc

SEQ ID NO: 7071 - DNA, 25 bp, E. coli
gtgccgcacctgaccgggcgtcgtt

SEQ ID NO: 7072 - DNA, 25 bp, E. coli
gtgccgcacctgtccgggcgtcgtt

SEQ ID NO: 7073 - DNA, 25 bp, E. coli
cacattctcggttggcataacggga

SEQ ID NO: 7074 - DNA, 25 bp, E. coli
cacattctcggtaggcataacggga

SEQ ID NO: 7075 - DNA, 25 bp, E. coli
tacgcggtgaaaaaatcggtcagca

SEQ ID NO: 7076 - DNA, 25 bp, E. coli
tacgcggtgaaataatcggtcagca

SEQ ID NO: 7077 - DNA, 25 bp, E. coli
tgattgtcagcgaagccttacgcgg

SEQ ID NO: 7078 - DNA, 25 bp, E. coli
tgacgacgaactccaacccgttgtg

SEQ ID NO: 7079 - DNA, 25 bp, E. coli
tgattgtcagcgtagccttacgcgg

SEQ ID NO: 7080 - DNA, 25 bp, E. coli
tgacgacgaactgcaacccgttgtg

SEQ ID NO: 7081 - DNA, 25 bp, E. coli
tcggtcagcaatagatgagtaaggc

SEQ ID NO: 7082 - DNA, 25 bp, E. coli
tcggtcagcaattgatgagtaaggc

SEQ ID NO: 7083 - DNA, 25 bp, E. coli
gcataacgggactctggtggcgtat

SEQ ID NO: 7084 - DNA, 25 bp, E. coli
gcataacgggacactggtggcgtat

SEQ ID NO: 7085 - DNA, 25 bp, E. coli
cgctggccggagaagccgatttatc

SEQ ID NO: 7086 - DNA, 25 bp, E. coli
cgcaggcgcattaacaaaactttta

SEQ ID NO: 7087 - DNA, 25 bp, E. coli
cgctggccggagtagccgatttatc

SEQ ID NO: 7088 - DNA, 25 bp, E. coli
cgcaggcgcatttacaaaactttta

SEQ ID NO: 7089 - DNA, 25 bp, E. coli
ggaacaaaactgaccttaccaggat

SEQ ID NO: 7090 - DNA, 25 bp, E. coli
ggaacaaaactgtccttaccaggat

SEQ ID NO: 7091 - DNA, 25 bp, E. coli
taaggcgctggattcgtgtactcgc

SEQ ID NO: 7092 - DNA, 25 bp, E. coli
taaggcgctggaatcgtgtactcgc

SEQ ID NO: 7093 - DNA, 25 bp, E. coli
gatctggagggacaaaatcgccaca

SEQ ID NO: 7094 - DNA, 25 bp, E. coli
gatctggagggagaaaatcgccaca

SEQ ID NO: 7095 - DNA, 25 bp, E. coli
caaacagattgacctggtgcgcagc

SEQ ID NO: 7096 - DNA, 25 bp, E. coli
caaacagattgagctggtgcgcagc

SEQ ID NO: 7097 - DNA, 25 bp, E. coli
cacagaaattcgaaaagttccggcg

SEQ ID NO: 7098 - DNA, 25 bp, E. coli
cacagaaattcgtaaagttccggcg

SEQ ID NO: 7099 - DNA, 25 bp, E. coli
tacagtgttcacagctcggacttga

SEQ ID NO: 7100 - DNA, 25 bp, E. coli
tacagtgttcactgctcggacttga

SEQ ID NO: 7101 - DNA, 25 bp, E. coli
aaaactcagggaaaccgtgcaccag

SEQ ID NO: 7102 - DNA, 25 bp, E. coli
aaaactcagggataccgtgcaccag

SEQ ID NO: 7103 - DNA, 25 bp, E. coli
tccggcgttaggtaactgtgacact

SEQ ID NO: 7104 - DNA, 25 bp, E. coli
tcgcaagactgaaagacggaggtac

SEQ ID NO: 7105 - DNA, 25 bp, E. coli
tccggcgttaggaaactgtgacact

SEQ ID NO: 7106 - DNA, 25 bp, E. coli
tcgcaagactgatagacggaggtac

SEQ ID NO: 7107 - DNA, 25 bp, E. coli
gcatgattgatctggctcgccgttc

SEQ ID NO: 7108 - DNA, 25 bp, E. coli
gcatgattgatcaggctcgccgttc

SEQ ID NO: 7109 - DNA, 25 bp, E. coli
cccgtgttgtccctgaaggtgacga

SEQ ID NO: 7110 - DNA, 25 bp, E. coli
cccgtgttgtccgtgaaggtgacga

SEQ ID NO: 7111 - DNA, 25 bp, E. coli
gtatcaattgagatccagcgtgcag

SEQ ID NO: 7112 - DNA, 25 bp, E. coli
gtatcaattgagttccagcgtgcag

SEQ ID NO: 7113 - DNA, 25 bp, E. coli
taactcactgggtagaaatggcaaa

SEQ ID NO: 7114 - DNA, 25 bp, E. coli
taaagctggtaaaaacgggccgtgg

SEQ ID NO: 7115 - DNA, 25 bp, E. coli
taaagctggtaataacgggccgtgg

SEQ ID NO: 7116 - DNA, 25 bp, E. coli
taactcactgggaagaaatggcaaa

SEQ ID NO: 7117 - DNA, 25 bp, E. coli
cacgaaacagcgatggtccccatat

SEQ ID NO: 7118 - DNA, 25 bp, E. coli
cacgaaacagcgttggtccccatat

SEQ ID NO: 7119 - DNA, 25 bp, E. coli
taaatctcccgtggctaacgacatc

SEQ ID NO: 7120 - DNA, 25 bp, E. coli
taaatctcccgtcgctaacgacatc

SEQ ID NO: 7121 - DNA, 25 bp, E. coli
aaacagcgttggaccccatataccg

SEQ ID NO: 7122 - DNA, 25 bp, E. coli
aaacagcgttggtccccatataccg

SEQ ID NO: 7123 - DNA, 25 bp, E. coli
ttgccacggcacacgaaacagcgtt

SEQ ID NO: 7124 - DNA, 25 bp, E. coli
ttgccacggcactcgaaacagcgtt

SEQ ID NO: 7125 - DNA, 25 bp, E. coli
tgagataaatctgccgtggctaacg

SEQ ID NO: 7126 - DNA, 25 bp, E. coli
tgagataaatctcccgtggctaacg

SEQ ID NO: 7127 - DNA, 25 bp, E. coli
gaagtttaaggtaggcacctccagg

SEQ ID NO: 7128 - DNA, 25 bp, E. coli
gaagtttaaggttggcacctccagg

SEQ ID NO: 7129 - DNA, 25 bp, E. coli
gaaactgcagcgtagcagttagcag

SEQ ID NO: 7130 - DNA, 25 bp, E. coli
gaaactgcagcgaagcagttagcag

SEQ ID NO: 7131 - DNA, 25 bp, E. coli
ccccgtcgttgtctatagaatattc

SEQ ID NO: 7132 - DNA, 25 bp, E. coli
ccccgtcgttgtgtatagaatattc

SEQ ID NO: 7133 - DNA, 25 bp, E. coli
cgtcgttgtgtatagaatattcccc

SEQ ID NO: 7134 - DNA, 25 bp, E. coli
cgtcgttgtgtaaagaatattcccc

SEQ ID NO: 7135 - DNA, 25 bp, E. coli
gttggcacctccaggttgccacggc

SEQ ID NO: 7136 - DNA, 25 bp, E. coli
gttggcacctcctggttgccacggc

SEQ ID NO: 7137 - DNA, 25 bp, E. coli
taaggttggcacgtccaggttgcca

SEQ ID NO: 7138 - DNA, 25 bp, E. coli
taaggttggcacctccaggttgcca

SEQ ID NO: 7139 - DNA, 25 bp, E. coli
aattatcgatcctacgggtgcaggc

SEQ ID NO: 7140 - DNA, 25 bp, E. coli
aattatcgatccaacgggtgcaggc

SEQ ID NO: 7141 - DNA, 25 bp, E. coli
cacggcggcgtaaaacatgtggcga

SEQ ID NO: 7142 - DNA, 25 bp, E. coli
caacaactatctccgctatgggcga

SEQ ID NO: 7143 - DNA, 25 bp, E. coli
cacggcggcgtataacatgtggcga

SEQ ID NO: 7144 - DNA, 25 bp, E. coli
caacaactatctgcgctatgggcga

SEQ ID NO: 7145 - DNA, 25 bp, E. coli
cattacacgcccagcatgttgcagg

SEQ ID NO: 7146 - DNA, 25 bp, E. coli
agttatcaaaatgcccagcagcggg

SEQ ID NO: 7147 - DNA, 25 bp, E. coli
agttatcaaaatccccagcagcggg

SEQ ID NO: 7148 - DNA, 25 bp, E. coli
tatttttatccccagcgaaagcgaa

SEQ ID NO: 7149 - DNA, 25 bp, E. coli
tatttttatcccgagcgaaagcgaa

SEQ ID NO: 7150 - DNA, 25 bp, E. coli
ttgttagcgatcttctccacggcgg

SEQ ID NO: 7151 - DNA, 25 bp, E. coli
ttgttagcgatcatctccacggcgg

SEQ ID NO: 7152 - DNA, 25 bp, E. coli
tttaatatccctaacagcgcctgcg

SEQ ID NO: 7153 - DNA, 25 bp, E. coli
tttaatatcccttacagcgcctgcg

SEQ ID NO: 7154 - DNA, 25 bp, E. coli
gaagggatatcctcactggcagaca

SEQ ID NO: 7155 - DNA, 25 bp, E. coli
gaagggatatccacactggcagaca

SEQ ID NO: 7156 - DNA, 25 bp, E. coli
cattacacgccctgcatgttgcagg

SEQ ID NO: 7157 - DNA, 25 bp, E. coli
taacgacgatcatatcggctggcgg

SEQ ID NO: 7158 - DNA, 25 bp, E. coli
taacgacgatcaaatcggctggcgg

SEQ ID NO: 7159 - DNA, 25 bp, E. coli
gagcgtctccgtcatgaaggtgtca

SEQ ID NO: 7160 - DNA, 25 bp, E. coli
gagcgtctccgtgatgaaggtgtca

SEQ ID NO: 7161 - DNA, 25 bp, E. coli
aatatgtcgaaactaagcgttatgc

SEQ ID NO: 7162 - DNA, 25 bp, E. coli
aatatgtcgaaagtaagcgttatgc

SEQ ID NO: 7163 - DNA, 25 bp, E. coli
caaatatgccaggattatgcaggcc

SEQ ID NO: 7164 - DNA, 25 bp, E. coli
caaatatgccagcattatgcaggcc

SEQ ID NO: 7165 - DNA, 25 bp, E. coli
tatgcctgttcccagatgaagcgaa

SEQ ID NO: 7166 - DNA, 25 bp, E. coli
tatgcctgttccgagatgaagcgaa

SEQ ID NO: 7167 - DNA, 25 bp, E. coli
tatgcaggcctggactatattagtg

SEQ ID NO: 7168 - DNA, 25 bp, E. coli
tatgcaggcctgcactatattagtg

SEQ ID NO: 7169 - DNA, 25 bp, E. coli
tatagacccgcacatgatgattaca

SEQ ID NO: 7170 - DNA, 25 bp, E. coli
tatagacccgcagatgatgattaca

SEQ ID NO: 7171 - DNA, 25 bp, E. coli
tgcggtggcgtaagtaaaggaaaaa

SEQ ID NO: 7172 - DNA, 25 bp, E. coli
tgaatcccgataacatcatgaagca

SEQ ID NO: 7173 - DNA, 25 bp, E. coli
tgaatcccgatatcatcatgaagca

SEQ ID NO: 7174 - DNA, 25 bp, E. coli
tgcggtggcgtatgtaaaggaaaaa

SEQ ID NO: 7175 - DNA, 25 bp, E. coli
tcgtacgcgacaacaaagactctct

SEQ ID NO: 7176 - DNA, 25 bp, E. coli
tcttaatgctgacgatgagcactac

SEQ ID NO: 7177 - DNA, 25 bp, E. coli
tcttaatgctgaggatgagcactac

SEQ ID NO: 7178 - DNA, 25 bp, E. coli
tcgtacgcgacatcaaagactctct

SEQ ID NO: 7179 - DNA, 25 bp, E. coli
taatcgtttcccacggacatgaaga

SEQ ID NO: 7180 - DNA, 25 bp, E. coli
taatcgtttccctcggacatgaaga

SEQ ID NO: 7181 - DNA, 25 bp, E. coli
gagcactacaagattatcgtacgcg

SEQ ID NO: 7182 - DNA, 25 bp, E. coli
gagcactacaagtttatcgtacgcg

SEQ ID NO: 7183 - DNA, 25 bp, E. coli
caccagtagtggtttcgcagccatg

SEQ ID NO: 7184 - DNA, 25 bp, E. coli
cacctgagagtgtatcgcaatgcag

SEQ ID NO: 7185 - DNA, 25 bp, E. coli
caccagtagtggattcgcagccatg

SEQ ID NO: 7186 - DNA, 25 bp, E. coli
cacctgagagtgaatcgcaatgcag

SEQ ID NO: 7187 - DNA, 25 bp, E. coli
caaaaaccgccaatagctcatcagg

SEQ ID NO: 7188 - DNA, 25 bp, E. coli
caaaaaccgccattagctcatcagg

SEQ ID NO: 7189 - DNA, 25 bp, E. coli
tgcaagttgttattccacctgagag

SEQ ID NO: 7190 - DNA, 25 bp, E. coli
tgcaagttgttaatccacctgagag

SEQ ID NO: 7191 - DNA, 25 bp, E. coli
tcagaaagggttgcacctgcaagtt

SEQ ID NO: 7192 - DNA, 25 bp, E. coli
tctgtatatctgaatgccaactggc

SEQ ID NO: 7193 - DNA, 25 bp, E. coli
tcagaaagggttccacctgcaagtt

SEQ ID NO: 7194 - DNA, 25 bp, E. coli
tcatcaggaagaccagacgacaacc

SEQ ID NO: 7195 - DNA, 25 bp, E. coli
tctgtatatctgtatgccaactggc

SEQ ID NO: 7196 - DNA, 25 bp, E. coli
tcatcaggaagagcagacgacaacc

SEQ ID NO: 7197 - DNA, 25 bp, E. coli
gctgtaaggctcatatcaaaaaccg

SEQ ID NO: 7198 - DNA, 25 bp, E. coli
gctgtaaggctcttatcaaaaaccg

SEQ ID NO: 7199 - DNA, 25 bp, E. coli
gcatcgcactcaagcctgacagaaa

SEQ ID NO: 7200 - DNA, 25 bp, E. coli
gcatcgcactcatgcctgacagaaa

SEQ ID NO: 7201 - DNA, 25 bp, E. coli
cgcagccatgcgctgtataaaaaat

SEQ ID NO: 7202 - DNA, 25 bp, E. coli
cgcagccatgcggtgtataaaaaat

SEQ ID NO: 7203 - DNA, 25 bp, E. coli
gatattttgttgagatcggcgacac

SEQ ID NO: 7204 - DNA, 25 bp, E. coli
gatattttgttgtgatcggcgacac

SEQ ID NO: 7205 - DNA, 25 bp, E. coli
caaagaaatgcttgactctgtagcg

SEQ ID NO: 7206 - DNA, 25 bp, E. coli
caaagaaatgctagactctgtagcg

SEQ ID NO: 7207 - DNA, 25 bp, E. coli
accccgcgccgctgagaaaaagcga

SEQ ID NO: 7208 - DNA, 25 bp, E. coli
accccgcgccgcagagaaaaagcga

SEQ ID NO: 7209 - DNA, 25 bp, E. coli
tagcggaaggcgtattatgcacacc

SEQ ID NO: 7210 - DNA, 25 bp, E. coli
tagcggaaggcgaattatgcacacc

SEQ ID NO: 7211 - DNA, 25 bp, E. coli
tgtctataagtttgacggaaaagac

SEQ ID NO: 7212 - DNA, 25 bp, E. coli
tgtctataagttagacggaaaagac

SEQ ID NO: 7213 - DNA, 25 bp, E. coli
tgagaaaaagcgtagcggcactgct

SEQ ID NO: 7214 - DNA, 25 bp, E. coli
tgagaaaaagcgaagcggcactgct

SEQ ID NO: 7215 - DNA, 25 bp, E. coli
gcgaagcggcactgctctttaacaa

SEQ ID NO: 7216 - DNA, 25 bp, E. coli
gcgaagcggcacagctctttaacaa

SEQ ID NO: 7217 - DNA, 25 bp, E. coli
gcttgactctgtagcggaaggcgta

SEQ ID NO: 7218 - DNA, 25 bp, E. coli
gcttgactctgttgcggaaggcgta

SEQ ID NO: 7219 - DNA, 25 bp, E. coli
gaaggcgtattaagcacaccccgcg

SEQ ID NO: 7220 - DNA, 25 bp, E. coli
gaaggcgtattatgcacaccccgcg

SEQ ID NO: 7221 - DNA, 25 bp, E. coli
gggctcgtttttgtctataagttag

SEQ ID NO: 7222 - DNA, 25 bp, E. coli
gggctcgtttttctctataagttag

SEQ ID NO: 7223 - DNA, 25 bp, E. coli
ggttctcctgagaatctcaacagag

SEQ ID NO: 7224 - DNA, 25 bp, E. coli
ggttctcctgagtatctcaacagag

SEQ ID NO: 7225 - DNA, 25 bp, E. coli
tcaacagagaaaagcaaagaaatgc

SEQ ID NO: 7226 - DNA, 25 bp, E. coli
tcaacagagaaatgcaaagaaatgc

SEQ ID NO: 7227 - DNA, 25 bp, E. coli
caaaaaacggacaactgatgatgcc

SEQ ID NO: 7228 - DNA, 25 bp, E. coli
caaaaaacggactactgatgatgcc

SEQ ID NO: 7229 - DNA, 25 bp, E. coli
tacgtgaaacagatgcagggcaagg

SEQ ID NO: 7230 - DNA, 25 bp, E. coli
taacagtgcggataagatacgctgg

SEQ ID NO: 7231 - DNA, 25 bp, E. coli
taacagtgcggaaaagatacgctgg

SEQ ID NO: 7232 - DNA, 25 bp, E. coli
tacgctggagcagagacgagatgca

SEQ ID NO: 7233 - DNA, 25 bp, E. coli
tacgtgaaacagttgcagggcaagg

SEQ ID NO: 7234 - DNA, 25 bp, E. coli
tacgctggagcacagacgagatgca

SEQ ID NO: 7235 - DNA, 25 bp, E. coli
tatcaccctcagtatttgcaacgga

SEQ ID NO: 7236 - DNA, 25 bp, E. coli
tatcaccctcagaatttgcaacgga

SEQ ID NO: 7237 - DNA, 25 bp, E. coli
tctgaccggaaatgcatcatcaagc

SEQ ID NO: 7238 - DNA, 25 bp, E. coli
tctgaccggaaaagcatcatcaagc

SEQ ID NO: 7239 - DNA, 25 bp, E. coli
gaataaaacgactgaatctcaggct

SEQ ID NO: 7240 - DNA, 25 bp, E. coli
gaataaaacgacagaatctcaggct

SEQ ID NO: 7241 - DNA, 25 bp, E. coli
gaaatgaccgttgcgctacgtgaaa

SEQ ID NO: 7242 - DNA, 25 bp, E. coli
gaaatgaccgttccgctacgtgaaa

SEQ ID NO: 7243 - DNA, 25 bp, E. coli
gttggattgataccactctgaccgg

SEQ ID NO: 7244 - DNA, 25 bp, E. coli
gattcagtaacttcaagggacgtca

SEQ ID NO: 7245 - DNA, 25 bp, E. coli
gattcagtaactacaagggacgtca

SEQ ID NO: 7246 - DNA, 25 bp, E. coli
gttggattgatagcactctgaccgg

SEQ ID NO: 7247 - DNA, 25 bp, E. coli
taagatgggtctggataagatcgcg

SEQ ID NO: 7248 - DNA, 25 bp, E. coli
taagatgggtctcgataagatcgcg

SEQ ID NO: 7249 - DNA, 25 bp, E. coli
atgacttttttaatacgtactacag

SEQ ID NO: 7250 - DNA, 25 bp, E. coli
atgttttttgattaaagtaccgatg

SEQ ID NO: 7251 - DNA, 25 bp, E. coli
atgttttttgataaaagtaccgatg

SEQ ID NO: 7252 - DNA, 25 bp, E. coli
atgacttttttattacgtactacag

SEQ ID NO: 7253 - DNA, 25 bp, E. coli
cttttttattacgtactacagtgcg

SEQ ID NO: 7254 - DNA, 25 bp, E. coli
cttttttattacctactacagtgcg

SEQ ID NO: 7255 - DNA, 25 bp, E. coli
tttttattacgtactacagtgcgtg

SEQ ID NO: 7256 - DNA, 25 bp, E. coli
tttttattacgttctacagtgcgtg

SEQ ID NO: 7257 - DNA, 25 bp, E. coli
ttttattacgtactacagtgcgtga

SEQ ID NO: 7258 - DNA, 25 bp, E. coli
ttttattacgtagtacagtgcgtga

SEQ ID NO: 7259 - DNA, 25 bp, E. coli
ttttttattacgtactacagtgcgt

SEQ ID NO: 7260 - DNA, 25 bp, E. coli
ttttttgataaatgtaccgatgact

SEQ ID NO: 7261 - DNA, 25 bp, E. coli
ttttttgataaaagtaccgatgact

SEQ ID NO: 7262 - DNA, 25 bp, E. coli
ttttttattacgaactacagtgcgt

SEQ ID NO: 7263 - DNA, 25 bp, E. coli
tgacttttttataacgtactacagt

SEQ ID NO: 7264 - DNA, 25 bp, E. coli
tgttttttgataaaagtaccgatga

SEQ ID NO: 7265 - DNA, 25 bp, E. coli
tgttttttgatataagtaccgatga

SEQ ID NO: 7266 - DNA, 25 bp, E. coli
tgacttttttattacgtactacagt

SEQ ID NO: 7267 - DNA, 25 bp, E. coli
gatgactttttttttacgtactaca

SEQ ID NO: 7268 - DNA, 25 bp, E. coli
gatgacttttttattacgtactaca

SEQ ID NO: 7269 - DNA, 25 bp, E. coli
gacttttttatttcgtactacagtg

SEQ ID NO: 7270 - DNA, 25 bp, E. coli
gacttttttattacgtactacagtg

SEQ ID NO: 7271 - DNA, 25 bp, E. coli
caagcgtattataattgcgagtcga

SEQ ID NO: 7272 - DNA, 25 bp, E. coli
caagcgtattattattgcgagtcga

SEQ ID NO: 7273 - DNA, 25 bp, E. coli
tactgaacagaaacaagcgtattat

SEQ ID NO: 7274 - DNA, 25 bp, E. coli
tactgaacagaatcaagcgtattat

SEQ ID NO: 7275 - DNA, 25 bp, E. coli
agtcgataatcgtcatttatttacg

SEQ ID NO: 7276 - DNA, 25 bp, E. coli
agtcgataatcgacatttatttacg

SEQ ID NO: 7277 - DNA, 25 bp, E. coli
tttcgtactgaacagaatcaagcgt

SEQ ID NO: 7278 - DNA, 25 bp, E. coli
tattcagttatttcgtactgaacag

SEQ ID NO: 7279 - DNA, 25 bp, E. coli
tattcagttattacgtactgaacag

SEQ ID NO: 7280 - DNA, 25 bp, E. coli
tttcgtactgaagagaatcaagcgt

SEQ ID NO: 7281 - DNA, 25 bp, E. coli
tatttcgtactgtacagaatcaagc

SEQ ID NO: 7282 - DNA, 25 bp, E. coli
tatttcgtactgaacagaatcaagc

SEQ ID NO: 7283 - DNA, 25 bp, E. coli
ttataattgcgactcgataatcgac

SEQ ID NO: 7284 - DNA, 25 bp, E. coli
ttataattgcgagtcgataatcgac

SEQ ID NO: 7285 - DNA, 25 bp, E. coli
gcgtattataatagcgagtcgataa

SEQ ID NO: 7286 - DNA, 25 bp, E. coli
gcgtattataattgcgagtcgataa

SEQ ID NO: 7287 - DNA, 25 bp, E. coli
gaatcaagcgtaatataattgcgag

SEQ ID NO: 7288 - DNA, 25 bp, E. coli
gaatcaagcgtattataattgcgag

SEQ ID NO: 7289 - DNA, 25 bp, E. coli
cgtactgaacagtatcaagcgtatt

SEQ ID NO: 7290 - DNA, 25 bp, E. coli
cgtactgaacagaatcaagcgtatt

SEQ ID NO: 7291 - DNA, 25 bp, E. coli
taattgcgagtcgataatcgacatt

SEQ ID NO: 7292 - DNA, 25 bp, E. coli
taattgcgagtccataatcgacatt

SEQ ID NO: 7293 - DNA, 25 bp, E. coli
cagataacaactcgcgtttagcacc

SEQ ID NO: 7294 - DNA, 25 bp, E. coli
cagataacaactggcgtttagcacc

SEQ ID NO: 7295 - DNA, 25 bp, E. coli
attgctgatgagacgaaacgtgcgg

SEQ ID NO: 7296 - DNA, 25 bp, E. coli
attgctgatgagtcgaaacgtgcgg

SEQ ID NO: 7297 - DNA, 25 bp, E. coli
tattaaagagaatgggcagtatccg

SEQ ID NO: 7298 - DNA, 25 bp, E. coli
tattaaagagaaagggcagtatccg

SEQ ID NO: 7299 - DNA, 25 bp, E. coli
tcgcgaccgatgttatcgggtttgc

SEQ ID NO: 7300 - DNA, 25 bp, E. coli
tcgggtttgcgatttatcaggtgga

SEQ ID NO: 7301 - DNA, 25 bp, E. coli
tcgcgaccgatgatatcgggtttgc

SEQ ID NO: 7302 - DNA, 25 bp, E. coli
tcgggtttgcgaattatcaggtgga

SEQ ID NO: 7303 - DNA, 25 bp, E. coli
gcgtggattgctcatgagtcgaaac

SEQ ID NO: 7304 - DNA, 25 bp, E. coli
gcggcagataacaactggcgtttag

SEQ ID NO: 7305 - DNA, 25 bp, E. coli
gcggcagataactactggcgtttag

SEQ ID NO: 7306 - DNA, 25 bp, E. coli
gcgtggattgctgatgagtcgaaac

SEQ ID NO: 7307 - DNA, 25 bp, E. coli
gcagtatccgatgaataaagtcgcg

SEQ ID NO: 7308 - DNA, 25 bp, E. coli
gcagtatccgatcaataaagtcgcg

SEQ ID NO: 7309 - DNA, 25 bp, E. coli
cgatgaataaagtcgcgaccgatga

SEQ ID NO: 7310 - DNA, 25 bp, E. coli
cgatgaataaagacgcgaccgatga

SEQ ID NO: 7311 - DNA, 25 bp, E. coli
gataagaaactggatatccgtttcg

SEQ ID NO: 7312 - DNA, 25 bp, E. coli
gataagaaactgcatatccgtttcg

SEQ ID NO: 7313 - DNA, 25 bp, E. coli
gggaaattcacccggcggcagataa

SEQ ID NO: 7314 - DNA, 25 bp, E. coli
gggaaattcaccgggcggcagataa

SEQ ID NO: 7315 - DNA, 25 bp, E. coli
cactgaccgtcaaggcaatggatgt

SEQ ID NO: 7316 - DNA, 25 bp, E. coli
cactgaccgtcatggcaatggatgt

SEQ ID NO: 7317 - DNA, 25 bp, E. coli
catcatttatgcaggcgcgagccag

SEQ ID NO: 7318 - DNA, 25 bp, E. coli
catcatttatgctggcgcgagccag

SEQ ID NO: 7319 - DNA, 25 bp, E. coli
tagttggtgcccttgcaggcgtaac

SEQ ID NO: 7320 - DNA, 25 bp, E. coli
tagttggtgcccatgcaggcgtaac

SEQ ID NO: 7321 - DNA, 25 bp, E. coli
tggtacgcaatattcgccgctggag

SEQ ID NO: 7322 - DNA, 25 bp, E. coli
tggtacgcaataatcgccgctggag

SEQ ID NO: 7323 - DNA, 25 bp, E. coli
tgggattctctcctctcgaaagcgt

SEQ ID NO: 7324 - DNA, 25 bp, E. coli
tgggattctctcgtctcgaaagcgt

SEQ ID NO: 7325 - DNA, 25 bp, E. coli
tgacggatgaggattttgccgccgc

SEQ ID NO: 7326 - DNA, 25 bp, E. coli
tgacggatgaggtttttgccgccgc

SEQ ID NO: 7327 - DNA, 25 bp, E. coli
gcccgtcactgcgtagccgtattat

SEQ ID NO: 7328 - DNA, 25 bp, E. coli
gcccgtcactgcctagccgtattat

SEQ ID NO: 7329 - DNA, 25 bp, E. coli
gctgcaaggttatcccgccgttgaa

SEQ ID NO: 7330 - DNA, 25 bp, E. coli
gctgcaaggttaacccgccgttgaa

SEQ ID NO: 7331 - DNA, 25 bp, E. coli
gagccagttcgtgattaccgcgatg

SEQ ID NO: 7332 - DNA, 25 bp, E. coli
gagccagttcgtcattaccgcgatg

SEQ ID NO: 7333 - DNA, 25 bp, E. coli
ggctgcctcactgcgttaatccagg

SEQ ID NO: 7334 - DNA, 25 bp, E. coli
ggctgcctcactccgttaatccagg

SEQ ID NO: 7335 - DNA, 25 bp, E. coli
taatccaggcatactggcaaggagc

SEQ ID NO: 7336 - DNA, 25 bp, E. coli
taatccaggcattctggcaaggagc

SEQ ID NO: 7337 - DNA, 25 bp, E. coli
caacgcgatagataatatgacagac

SEQ ID NO: 7338 - DNA, 25 bp, E. coli
caacgcgatagaaaatatgacagac

SEQ ID NO: 7339 - DNA, 25 bp, E. coli
taacacaccaatcttgatggaagct

SEQ ID NO: 7340 - DNA, 25 bp, E. coli
aaggaattcgcattttcctcgcccg

SEQ ID NO: 7341 - DNA, 25 bp, E. coli
aaggaattcgcaatttcctcgcccg

SEQ ID NO: 7342 - DNA, 25 bp, E. coli
tgaatacgctccaggagcacgcgcc

SEQ ID NO: 7343 - DNA, 25 bp, E. coli
tgaatacgctcctggagcacgcgcc

SEQ ID NO: 7344 - DNA, 25 bp, E. coli
tgatggaagctgaagagagaattgc

SEQ ID NO: 7345 - DNA, 25 bp, E. coli
tgatggaagctgtagagagaattgc

SEQ ID NO: 7346 - DNA, 25 bp, E. coli
tcctcgcccgtcacgatattgacga

SEQ ID NO: 7347 - DNA, 25 bp, E. coli
tcgacaaatcatcaacgcgatagat

SEQ ID NO: 7348 - DNA, 25 bp, E. coli
tcgacaaatcatgaacgcgatagat

SEQ ID NO: 7349 - DNA, 25 bp, E. coli
tcctcgcccgtctcgatattgacga

SEQ ID NO: 7350 - DNA, 25 bp, E. coli
tctcgatattgacgaatcagcataa

SEQ ID NO: 7351 - DNA, 25 bp, E. coli
tctcgatattgaggaatcagcataa

SEQ ID NO: 7352 - DNA, 25 bp, E. coli
gccccggcgtatcgacaaatcatca

SEQ ID NO: 7353 - DNA, 25 bp, E. coli
gccccggcgtatggacaaatcatca

SEQ ID NO: 7354 - DNA, 25 bp, E. coli
taatatgacagacattgagcaggaa

SEQ ID NO: 7355 - DNA, 25 bp, E. coli
taatatgacagagattgagcaggaa

SEQ ID NO: 7356 - DNA, 25 bp, E. coli
taacacaccaatgttgatggaagct

SEQ ID NO: 7357 - DNA, 25 bp, E. coli
gagaattgctgattacgctcctgga

SEQ ID NO: 7358 - DNA, 25 bp, E. coli
gagaattgctgaatacgctcctgga

SEQ ID NO: 7359 - DNA, 25 bp, E. coli
aatgatcatagtgacatcgaacgcg

SEQ ID NO: 7360 - DNA, 25 bp, E. coli
aatgatcatagtcacatcgaacgcg

SEQ ID NO: 7361 - DNA, 25 bp, E. coli
catcgaacgcgaatctggcggtgcc

SEQ ID NO: 7362 - DNA, 25 bp, E. coli
catcgaacgcgattctggcggtgcc

SEQ ID NO: 7363 - DNA, 25 bp, E. coli
tactctgaggctggtcaatcatcac

SEQ ID NO: 7364 - DNA, 25 bp, E. coli
tactctgaggctcgtcaatcatcac

SEQ ID NO: 7365 - DNA, 25 bp, E. coli
tagtaatgccgaactgttatgaacg

SEQ ID NO: 7366 - DNA, 25 bp, E. coli
tagtaatgccgatctgttatgaacg

SEQ ID NO: 7367 - DNA, 25 bp, E. coli
tattcattttctctgagagaagggc

SEQ ID NO: 7368 - DNA, 25 bp, E. coli
tattcattttctgtgagagaagggc

SEQ ID NO: 7369 - DNA, 25 bp, E. coli
tttagatcaaagcagtactcaccga

SEQ ID NO: 7370 - DNA, 25 bp, E. coli
tttagatcaaaggagtactcaccga

SEQ ID NO: 7371 - DNA, 25 bp, E. coli
tgccccgaatggaacactctttaag

SEQ ID NO: 7372 - DNA, 25 bp, E. coli
tgccccgaatggtacactctttaag

SEQ ID NO: 7373 - DNA, 25 bp, E. coli
gaatgtaaaaaagagtgccccgaat

SEQ ID NO: 7374 - DNA, 25 bp, E. coli
gaatgtaaaaaacagtgccccgaat

SEQ ID NO: 7375 - DNA, 25 bp, E. coli
gaacggtggtgtgatcaatactctg

SEQ ID NO: 7376 - DNA, 25 bp, E. coli
gaacggtggtgtcatcaatactctg

SEQ ID NO: 7377 - DNA, 25 bp, E. coli
gtcaatcatcacagaaaaccagcct

SEQ ID NO: 7378 - DNA, 25 bp, E. coli
gtcaatcatcactgaaaaccagcct

SEQ ID NO: 7379 - DNA, 25 bp, E. coli
ggcggtgccgcaattttatttattc

SEQ ID NO: 7380 - DNA, 25 bp, E. coli
ggcggtgccgcatttttatttattc

SEQ ID NO: 7381 - DNA, 25 bp, E. coli
aatgccaccacggtgggagatatca

SEQ ID NO: 7382 - DNA, 25 bp, E. coli
aatgccaccacgctgggagatatca

SEQ ID NO: 7383 - DNA, 25 bp, E. coli
caaaatgccaccacgctgggagata

SEQ ID NO: 7384 - DNA, 25 bp, E. coli
caaaatgccacctcgctgggagata

SEQ ID NO: 7385 - DNA, 25 bp, E. coli
caccacgctgggtgatatcaccgtg

SEQ ID NO: 7386 - DNA, 25 bp, E. coli
caccacgctgggagatatcaccgtg

SEQ ID NO: 7387 - DNA, 25 bp, E. coli
agttgcccggcgcattggtctgttg

SEQ ID NO: 7388 - DNA, 25 bp, E. coli
acgccagtaaagtagttgcccggcg

SEQ ID NO: 7389 - DNA, 25 bp, E. coli
agtaaagaagttccccggcggattg

SEQ ID NO: 7390 - DNA, 25 bp, E. coli
agtaaagaagttgcccggcggattg

SEQ ID NO: 7391 - DNA, 25 bp, E. coli
acgccagtaaagaagttgcccggcg

SEQ ID NO: 7392 - DNA, 25 bp, E. coli
agttgcccggcggattggtctgttg

SEQ ID NO: 7393 - DNA, 25 bp, E. coli
tttccggtgggcaacgccagcgagc

SEQ ID NO: 7394 - DNA, 25 bp, E. coli
tttccggtgggctacgccagcgagc

SEQ ID NO: 7395 - DNA, 25 bp, E. coli
ccagtaaagaagttgcccggcggat

SEQ ID NO: 7396 - DNA, 25 bp, E. coli
ccagtaaagaagatgcccggcggat

SEQ ID NO: 7397 - DNA, 25 bp, E. coli
gcaaaatgccaccacgctgggagat

SEQ ID NO: 7398 - DNA, 25 bp, E. coli
gcaaaatgccacgacgctgggagat

SEQ ID NO: 7399 - DNA, 25 bp, E. coli
ggcgcaaaatgcgaccacgctggga

SEQ ID NO: 7400 - DNA, 25 bp, E. coli
tggataccctttccggtgggcaacg

SEQ ID NO: 7401 - DNA, 25 bp, E. coli
tggataccctttgcggtgggcaacg

SEQ ID NO: 7402 - DNA, 25 bp, E. coli
ggcgcaaaatgccaccacgctggga

SEQ ID NO: 7403 - DNA, 25 bp, E. coli
cagctcaaggcatcaaaagcgtctt

SEQ ID NO: 7404 - DNA, 25 bp, E. coli
caaatggcgcagaagattttccagc

SEQ ID NO: 7405 - DNA, 25 bp, E. coli
caaatggcgcagtagattttccagc

SEQ ID NO: 7406 - DNA, 25 bp, E. coli
cagctcaaggcaacaaaagcgtctt

SEQ ID NO: 7407 - DNA, 25 bp, E. coli
cagtagattttcgagcgccgtagta

SEQ ID NO: 7408 - DNA, 25 bp, E. coli
cagtagattttccagcgccgtagta

SEQ ID NO: 7409 - DNA, 25 bp, E. coli
tgctgactggccagccagctcaagg

SEQ ID NO: 7410 - DNA, 25 bp, E. coli
tgctgactggcctgccagctcaagg

SEQ ID NO: 7411 - DNA, 25 bp, E. coli
tcttcatcaccattacgttgttgcc

SEQ ID NO: 7412 - DNA, 25 bp, E. coli
tctttgagagggaaaggaatatcga

SEQ ID NO: 7413 - DNA, 25 bp, E. coli
tcttcatcaccaatacgttgttgcc

SEQ ID NO: 7414 - DNA, 25 bp, E. coli
tctttgagagggtaaggaatatcga

SEQ ID NO: 7415 - DNA, 25 bp, E. coli
ccagcgccgtagtaagtgattgcac

SEQ ID NO: 7416 - DNA, 25 bp, E. coli
ccagcgccgtagaaagtgattgcac

SEQ ID NO: 7417 - DNA, 25 bp, E. coli
gaatatcgataagccgaatgccggg

SEQ ID NO: 7418 - DNA, 25 bp, E. coli
gaatgccgggtgtcgccggaatctc

SEQ ID NO: 7419 - DNA, 25 bp, E. coli
gaatatcgataacccgaatgccggg

SEQ ID NO: 7420 - DNA, 25 bp, E. coli
gaatgccgggtgacgccggaatctc

SEQ ID NO: 7421 - DNA, 25 bp, E. coli
cgttgttgccagtagaattgcgggt

SEQ ID NO: 7422 - DNA, 25 bp, E. coli
cgttgttgccagaagaattgcgggt

SEQ ID NO: 7423 - DNA, 25 bp, E. coli
ccggaatctcttgcgacaaatggcg

SEQ ID NO: 7424 - DNA, 25 bp, E. coli
ccggaatctcttccgacaaatggcg

SEQ ID NO: 7425 - DNA, 25 bp, E. coli
caggcaaaggaagggaaaaggacat

SEQ ID NO: 7426 - DNA, 25 bp, E. coli
caggcaaaggaacggaaaaggacat

SEQ ID NO: 7427 - DNA, 25 bp, E. coli
tacaattagctacagcgaagcgcgt

SEQ ID NO: 7428 - DNA, 25 bp, E. coli
tactcgtcagaatggagaggcttgt

SEQ ID NO: 7429 - DNA, 25 bp, E. coli
tacaattagctagagcgaagcgcgt

SEQ ID NO: 7430 - DNA, 25 bp, E. coli
tactcgtcagaaaggagaggcttgt

SEQ ID NO: 7431 - DNA, 25 bp, E. coli
tttgtcggcaactatgatgaaagcc

SEQ ID NO: 7432 - DNA, 25 bp, E. coli
tttgtcggcaacaatgatgaaagcc

SEQ ID NO: 7433 - DNA, 25 bp, E. coli
gaagcgcgtcagtatttgtcggcaa

SEQ ID NO: 7434 - DNA, 25 bp, E. coli
gaagcgcgtcagaatttgtcggcaa

SEQ ID NO: 7435 - DNA, 25 bp, E. coli
cgaagaatacaagtcgctggaagag

SEQ ID NO: 7436 - DNA, 25 bp, E. coli
cgaagaatacaactcgctggaagag

SEQ ID NO: 7437 - DNA, 25 bp, E. coli
ggcttgtgttctgatgtcactcgaa

SEQ ID NO: 7438 - DNA, 25 bp, E. coli
tggaagagacgggttatctactgcg

SEQ ID NO: 7439 - DNA, 25 bp, E. coli
tggaagagacggcttatctactgcg

SEQ ID NO: 7440 - DNA, 25 bp, E. coli
ggcttgtgttctcatgtcactcgaa

SEQ ID NO: 7441 - DNA, 25 bp, E. coli
taacgcccggagattgatggactca

SEQ ID NO: 7442 - DNA, 25 bp, E. coli
taacgcccggagtttgatggactca

SEQ ID NO: 7443 - DNA, 25 bp, E. coli
gatggactcaatggatagcctgaaa

SEQ ID NO: 7444 - DNA, 25 bp, E. coli
gatgaaagccgtagaagatcatgcc

SEQ ID NO: 7445 - DNA, 25 bp, E. coli
gatggactcaatcgatagcctgaaa

SEQ ID NO: 7446 - DNA, 25 bp, E. coli
gatgaaagccgttgaagatcatgcc

SEQ ID NO: 7447 - DNA, 25 bp, E. coli
cagtatactaatcaaatgatgccag

SEQ ID NO: 7448 - DNA, 25 bp, E. coli
cagtatactaatgaaatgatgccag

SEQ ID NO: 7449 - DNA, 25 bp, E. coli
catactgcgattttttcaatttcag

SEQ ID NO: 7450 - DNA, 25 bp, E. coli
catactgcgattatttcaatttcag

SEQ ID NO: 7451 - DNA, 25 bp, E. coli
aactgccagattaggtaggaccaaa

SEQ ID NO: 7452 - DNA, 25 bp, E. coli
aaatggctgatcatatttccagtaa

SEQ ID NO: 7453 - DNA, 25 bp, E. coli
aaatggctgatcttatttccagtaa

SEQ ID NO: 7454 - DNA, 25 bp, E. coli
aactgccagatttggtaggaccaaa

SEQ ID NO: 7455 - DNA, 25 bp, E. coli
tgataataagtatatgcagcacgaa

SEQ ID NO: 7456 - DNA, 25 bp, E. coli
tgatgccagactgtttcttagcgca

SEQ ID NO: 7457 - DNA, 25 bp, E. coli
tgataataagtaaatgcagcacgaa

SEQ ID NO: 7458 - DNA, 25 bp, E. coli
tgatgccagactctttcttagcgca

SEQ ID NO: 7459 - DNA, 25 bp, E. coli
tccacaaagtagatttgcataacag

SEQ ID NO: 7460 - DNA, 25 bp, E. coli
tccacaaagtagttttgcataacag

SEQ ID NO: 7461 - DNA, 25 bp, E. coli
gcacgaatatattttcgcacagcgt

SEQ ID NO: 7462 - DNA, 25 bp, E. coli
gcacgaatatatattcgcacagcgt

SEQ ID NO: 7463 - DNA, 25 bp, E. coli
cgcacagcgtatagcttatgtttat

SEQ ID NO: 7464 - DNA, 25 bp, E. coli
cgcacagcgtattgcttatgtttat

SEQ ID NO: 7465 - DNA, 25 bp, E. coli
gtttcttagcgcaaaaactgccaga

SEQ ID NO: 7466 - DNA, 25 bp, E. coli
gtttcttagcgctaaaactgccaga

SEQ ID NO: 7467 - DNA, 25 bp, E. coli
ggaccaaaatttatccacaaagtag

SEQ ID NO: 7468 - DNA, 25 bp, E. coli
ggaccaaaatttttccacaaagtag

SEQ ID NO: 7469 - DNA, 25 bp, E. coli
catgacgtggcgtttcaaaagcttc

SEQ ID NO: 7470 - DNA, 25 bp, E. coli
catgacgtggcgattcaaaagcttc

SEQ ID NO: 7471 - DNA, 25 bp, E. coli
attcccggatcggtacttcgacgtg

SEQ ID NO: 7472 - DNA, 25 bp, E. coli
attcccggatcgctacttcgacgtg

SEQ ID NO: 7473 - DNA, 25 bp, E. coli
acttcgacgtgggaattgccgagca

SEQ ID NO: 7474 - DNA, 25 bp, E. coli
acttcgacgtggcaattgccgagca

SEQ ID NO: 7475 - DNA, 25 bp, E. coli
gctacttcgacgaggcaattgccga

SEQ ID NO: 7476 - DNA, 25 bp, E. coli
gctacttcgacgtggcaattgccga

SEQ ID NO: 7477 - DNA, 25 bp, E. coli
gacgtggcgattcaaaagcttccgg

SEQ ID NO: 7478 - DNA, 25 bp, E. coli
cgacgtggcaattgccgagcaacac

SEQ ID NO: 7479 - DNA, 25 bp, E. coli
cgattcaaaagcttccggtcctgtt

SEQ ID NO: 7480 - DNA, 25 bp, E. coli
cgacgtggcaatagccgagcaacac

SEQ ID NO: 7481 - DNA, 25 bp, E. coli
ccggatcgctacatcgacgtggcaa

SEQ ID NO: 7482 - DNA, 25 bp, E. coli
ccggatcgctacttcgacgtggcaa

SEQ ID NO: 7483 - DNA, 25 bp, E. coli
cgattcaaaagcatccggtcctgtt

SEQ ID NO: 7484 - DNA, 25 bp, E. coli
gtggcgattcaatagcttccggtcc

SEQ ID NO: 7485 - DNA, 25 bp, E. coli
ggcgattcaaaaccttccggtcctg

SEQ ID NO: 7486 - DNA, 25 bp, E. coli
ggcgattcaaaagcttccggtcctg

SEQ ID NO: 7487 - DNA, 25 bp, E. coli
gtggcgattcaaaagcttccggtcc

SEQ ID NO: 7488 - DNA, 25 bp, E. coli
gatcgctacttccacgtggcaattg

SEQ ID NO: 7489 - DNA, 25 bp, E. coli
gatcgctacttcgacgtggcaattg

SEQ ID NO: 7490 - DNA, 25 bp, E. coli
gacgtggcgattgaaaagcttccgg

SEQ ID NO: 7491 - DNA, 25 bp, E. coli
cagggttatcagcttattgcagaca

SEQ ID NO: 7492 - DNA, 25 bp, E. coli
cagggttatcaggttattgcagaca

SEQ ID NO: 7493 - DNA, 25 bp, E. coli
agcgtatccggctcgatgcaggtca

SEQ ID NO: 7494 - DNA, 25 bp, E. coli
agcgtatccggcacgatgcaggtca

SEQ ID NO: 7495 - DNA, 25 bp, E. coli
aaaggcgacgttgccagcgtatccg

SEQ ID NO: 7496 - DNA, 25 bp, E. coli
aaaggcgacgttcccagcgtatccg

SEQ ID NO: 7497 - DNA, 25 bp, E. coli
tatcgttgccatgtagtcaggcgca

SEQ ID NO: 7498 - DNA, 25 bp, E. coli
tatcgttgccatctagtcaggcgca

SEQ ID NO: 7499 - DNA, 25 bp, E. coli
tgcaggtcagcctgtggaccggaca

SEQ ID NO: 7500 - DNA, 25 bp, E. coli
tgcagacagcgttatcagtgcccgt

SEQ ID NO: 7501 - DNA, 25 bp, E. coli
tgcaggtcagccagtggaccggaca

SEQ ID NO: 7502 - DNA, 25 bp, E. coli
tgcagacagcgtaatcagtgcccgt

SEQ ID NO: 7503 - DNA, 25 bp, E. coli
gcatttggtaaggaggccgacttcc

SEQ ID NO: 7504 - DNA, 25 bp, E. coli
gcatttggtaagcaggccgacttcc

SEQ ID NO: 7505 - DNA, 25 bp, E. coli
ggcgggaacagacgcaaaaccacag

SEQ ID NO: 7506 - DNA, 25 bp, E. coli
ggcgggaacagaggcaaaaccacag

SEQ ID NO: 7507 - DNA, 25 bp, E. coli
tggacgacccgcaggtaaaacagac

SEQ ID NO: 7508 - DNA, 25 bp, E. coli
ggcacacagggtaatcagccaccag

SEQ ID NO: 7509 - DNA, 25 bp, E. coli
tggacgacccgctggtaaaacagac

SEQ ID NO: 7510 - DNA, 25 bp, E. coli
tggctaaacatctaaaaggcgacgt

SEQ ID NO: 7511 - DNA, 25 bp, E. coli
ggcacacagggttatcagccaccag

SEQ ID NO: 7512 - DNA, 25 bp, E. coli
tggctaaacatcaaaaaggcgacgt

SEQ ID NO: 7513 - DNA, 25 bp, E. coli
cgtttgtcgactacttccgtaacag

SEQ ID NO: 7514 - DNA, 25 bp, E. coli
cgtttgtcgacttcttccgtaacag

SEQ ID NO: 7515 - DNA, 25 bp, E. coli
attttcctctccagcgccagcaatt

SEQ ID NO: 7516 - DNA, 25 bp, E. coli
attttcctctcctgcgccagcaatt

SEQ ID NO: 7517 - DNA, 25 bp, E. coli
tttgcgtcgattttcctctccagcg

SEQ ID NO: 7518 - DNA, 25 bp, E. coli
tttgcgtcgattatcctctccagcg

SEQ ID NO: 7519 - DNA, 25 bp, E. coli
tgtgatgctgatcacctcgttcaag

SEQ ID NO: 7520 - DNA, 25 bp, E. coli
tgttcagtacgcgagattacatctg

SEQ ID NO: 7521 - DNA, 25 bp, E. coli
tgttcagtacgccagattacatctg

SEQ ID NO: 7522 - DNA, 25 bp, E. coli
tgtgatgctgatgacctcgttcaag

SEQ ID NO: 7523 - DNA, 25 bp, E. coli
tgaacgcgctgtacagtacgccaga

SEQ ID NO: 7524 - DNA, 25 bp, E. coli
tgaacgcgctgttcagtacgccaga

SEQ ID NO: 7525 - DNA, 25 bp, E. coli
ggatgaccatcatcgccagctttta

SEQ ID NO: 7526 - DNA, 25 bp, E. coli
ggatgaccatcaacgccagctttta

SEQ ID NO: 7527 - DNA, 25 bp, E. coli
ggcgctgtttctcatcatcacgctg

SEQ ID NO: 7528 - DNA, 25 bp, E. coli
ggcaacaaataaacgcacactcagt

SEQ ID NO: 7529 - DNA, 25 bp, E. coli
tggtttcatccgaggtggcggtatt

SEQ ID NO: 7530 - DNA, 25 bp, E. coli
tggtttcatccgtggtggcggtatt

SEQ ID NO: 7531 - DNA, 25 bp, E. coli
ggcgctgtttctgatcatcacgctg

SEQ ID NO: 7532 - DNA, 25 bp, E. coli
ggcaacaaataatcgcacactcagt

SEQ ID NO: 7533 - DNA, 25 bp, E. coli
tcaacgccagctattacacggtgta

SEQ ID NO: 7534 - DNA, 25 bp, E. coli
tcaacgccagcttttacacggtgta

SEQ ID NO: 7535 - DNA, 25 bp, E. coli
tacgttgccgggatttgatcgagta

SEQ ID NO: 7536 - DNA, 25 bp, E. coli
tacgttgccgggttttgatcgagta

SEQ ID NO: 7537 - DNA, 25 bp, E. coli
gcggtttagcgtgcgattcgtataa

SEQ ID NO: 7538 - DNA, 25 bp, E. coli
gcgcgtggtgttatatgattacgac

SEQ ID NO: 7539 - DNA, 25 bp, E. coli
gcggtttagcgtccgattcgtataa

SEQ ID NO: 7540 - DNA, 25 bp, E. coli
gcgcgtggtgttttatgattacgac

SEQ ID NO: 7541 - DNA, 25 bp, E. coli
gcagcaattgcgtgatgccattgaa

SEQ ID NO: 7542 - DNA, 25 bp, E. coli
gcagcaattgcgagatgccattgaa

SEQ ID NO: 7543 - DNA, 25 bp, E. coli
gaacgacggatgctgccgcttaata

SEQ ID NO: 7544 - DNA, 25 bp, E. coli
gaacgacggatggtgccgcttaata

SEQ ID NO: 7545 - DNA, 25 bp, E. coli
ccgcttaatatctggcttgagcaag

SEQ ID NO: 7546 - DNA, 25 bp, E. coli
ccgcaataaggctgcctggctggtg

SEQ ID NO: 7547 - DNA, 25 bp, E. coli
ccgcaataaggcagcctggctggtg

SEQ ID NO: 7548 - DNA, 25 bp, E. coli
cgccatctctatttcgaacgacgga

SEQ ID NO: 7549 - DNA, 25 bp, E. coli
cgcaggcagcggtttagcgtccgat

SEQ ID NO: 7550 - DNA, 25 bp, E. coli
ccgcttaatatcaggcttgagcaag

SEQ ID NO: 7551 - DNA, 25 bp, E. coli
cgcaggcagcggattagcgtccgat

SEQ ID NO: 7552 - DNA, 25 bp, E. coli
cgccatctctatatcgaacgacgga

SEQ ID NO: 7553 - DNA, 25 bp, E. coli
gtgacattcatttcatcgttcgcca

SEQ ID NO: 7554 - DNA, 25 bp, E. coli
gtgacattcattacatcgttcgcca

SEQ ID NO: 7555 - DNA, 25 bp, E. coli
gagttccgtcactggttatgtgccg

SEQ ID NO: 7556 - DNA, 25 bp, E. coli
gagttccgtcacaggttatgtgccg

SEQ ID NO: 7557 - DNA, 25 bp, E. coli
caagaatgtagcagaaggtgccttc

SEQ ID NO: 7558 - DNA, 25 bp, E. coli
caagaatgtagctgaaggtgccttc

SEQ ID NO: 7559 - DNA, 25 bp, E. coli
taaagggactgttgttgacgctccg

SEQ ID NO: 7560 - DNA, 25 bp, E. coli
tactgattcgagtggaaaacgggtg

SEQ ID NO: 7561 - DNA, 25 bp, E. coli
taaagggactgtagttgacgctccg

SEQ ID NO: 7562 - DNA, 25 bp, E. coli
tactgattcgagaggaaaacgggtg

SEQ ID NO: 7563 - DNA, 25 bp, E. coli
aaatttgatggagccactgagaccg

SEQ ID NO: 7564 - DNA, 25 bp, E. coli
aaatttgatggacccactgagaccg

SEQ ID NO: 7565 - DNA, 25 bp, E. coli
tgcagctgcatcaatccctcaagga

SEQ ID NO: 7566 - DNA, 25 bp, E. coli
tgcagctgcatctatccctcaagga

SEQ ID NO: 7567 - DNA, 25 bp, E. coli
gaaactcagtctccaaaacaggaaa

SEQ ID NO: 7568 - DNA, 25 bp, E. coli
gaaactcagtctgcaaaacaggaaa

SEQ ID NO: 7569 - DNA, 25 bp, E. coli
cgctccgtgtggaattgaaactcag

SEQ ID NO: 7570 - DNA, 25 bp, E. coli
ccctcaaggacaaggtgaagtaagt

SEQ ID NO: 7571 - DNA, 25 bp, E. coli
ccctcaaggacatggtgaagtaagt

SEQ ID NO: 7572 - DNA, 25 bp, E. coli
cgctccgtgtggtattgaaactcag

SEQ ID NO: 7573 - DNA, 25 bp, E. coli
gggcagctaaaaaaggtacagtgtc

SEQ ID NO: 7574 - DNA, 25 bp, E. coli
gggcagctaaaataggtacagtgtc

SEQ ID NO: 7575 - DNA, 25 bp, E. coli
taatttcaaacagcttcaaggcggg

SEQ ID NO: 7576 - DNA, 25 bp, E. coli
taatttcaaacaccttcaaggcggg

SEQ ID NO: 7577 - DNA, 25 bp, E. coli
gatgacatgctgcaaacagttggag

SEQ ID NO: 7578 - DNA, 25 bp, E. coli
gatgacatgctggaaacagttggag

SEQ ID NO: 7579 - DNA, 25 bp, E. coli
caattactcgtaatgaaatcggctg

SEQ ID NO: 7580 - DNA, 25 bp, E. coli
caattactcgtattgaaatcggctg

SEQ ID NO: 7581 - DNA, 25 bp, E. coli
cagcgacagctgtcaataaaagtat

SEQ ID NO: 7582 - DNA, 25 bp, E. coli
cagcgacagctgacaataaaagtat

SEQ ID NO: 7583 - DNA, 25 bp, E. coli
caataaaagtatcttcaatggtaag

SEQ ID NO: 7584 - DNA, 25 bp, E. coli
actcttattaaggaattactcgtaa

SEQ ID NO: 7585 - DNA, 25 bp, E. coli
agggccaaaccgtagaacagcgaca

SEQ ID NO: 7586 - DNA, 25 bp, E. coli
actcttattaagcaattactcgtaa

SEQ ID NO: 7587 - DNA, 25 bp, E. coli
agggccaaaccgaagaacagcgaca

SEQ ID NO: 7588 - DNA, 25 bp, E. coli
caataaaagtatgttcaatggtaag

SEQ ID NO: 7589 - DNA, 25 bp, E. coli
tagtgattcaggtgggccaaaccga

SEQ ID NO: 7590 - DNA, 25 bp, E. coli
tagtgattcaggagggccaaaccga

SEQ ID NO: 7591 - DNA, 25 bp, E. coli
ttagcaatagtgattcaggagggcc

SEQ ID NO: 7592 - DNA, 25 bp, E. coli
ttagcaatagtgtttcaggagggcc

SEQ ID NO: 7593 - DNA, 25 bp, E. coli
tgaggaagatgctttccgacgcgat

SEQ ID NO: 7594 - DNA, 25 bp, E. coli
tgaggaagatgcattccgacgcgat

SEQ ID NO: 7595 - DNA, 25 bp, E. coli
ccgacgcgattttattgacagcata

SEQ ID NO: 7596 - DNA, 25 bp, E. coli
gacagcataattggtgattttagca

SEQ ID NO: 7597 - DNA, 25 bp, E. coli
gacagcataattcgtgattttagca

SEQ ID NO: 7598 - DNA, 25 bp, E. coli
ccgacgcgatttaattgacagcata

SEQ ID NO: 7599 - DNA, 25 bp, E. coli
taatgaaatcgggtgaggaagatgc

SEQ ID NO: 7600 - DNA, 25 bp, E. coli
taatgaaatcggctgaggaagatgc

SEQ ID NO: 7601 - DNA, 25 bp, E. coli
tacatgcatcttttcagtggtgagg

SEQ ID NO: 7602 - DNA, 25 bp, E. coli
tacatgcatcttatcagtggtgagg

SEQ ID NO: 7603 - DNA, 25 bp, E. coli
agcgtcttgattggttgctggccca

SEQ ID NO: 7604 - DNA, 25 bp, E. coli
agcgtcttgattcgttgctggccca

SEQ ID NO: 7605 - DNA, 25 bp, E. coli
tatgaattcagcgatatggcggaag

SEQ ID NO: 7606 - DNA, 25 bp, E. coli
tatgaattcagccatatggcggaag

SEQ ID NO: 7607 - DNA, 25 bp, E. coli
tcagtcaatggtgtagtcacggcct

SEQ ID NO: 7608 - DNA, 25 bp, E. coli
gcctgtaatcagtaaacgaaccgtg

SEQ ID NO: 7609 - DNA, 25 bp, E. coli
gcctgtaatcagaaaacgaaccgtg

SEQ ID NO: 7610 - DNA, 25 bp, E. coli
ccgtgaaccggtgatgaatctgagt

SEQ ID NO: 7611 - DNA, 25 bp, E. coli
ccgtgaaccggtcatgaatctgagt

SEQ ID NO: 7612 - DNA, 25 bp, E. coli
gaatttggcgatctgaaactgagcg

SEQ ID NO: 7613 - DNA, 25 bp, E. coli
gaatttggcgatgtgaaactgagcg

SEQ ID NO: 7614 - DNA, 25 bp, E. coli
cgcgccgcgcgattgtatgaattca

SEQ ID NO: 7615 - DNA, 25 bp, E. coli
cgaacgcggttgacggtgatttaca

SEQ ID NO: 7616 - DNA, 25 bp, E. coli
cgcgccgcgcgaatgtatgaattca

SEQ ID NO: 7617 - DNA, 25 bp, E. coli
cgttgttattgcctggtgcccagac

SEQ ID NO: 7618 - DNA, 25 bp, E. coli
cgaacgcggttgtcggtgatttaca

SEQ ID NO: 7619 - DNA, 25 bp, E. coli
cgttgttattgcgtggtgcccagac

SEQ ID NO: 7620 - DNA, 25 bp, E. coli
gtccttttgtggtgcgtctggcccg

SEQ ID NO: 7621 - DNA, 25 bp, E. coli
gtccttttgtggagcgtctggcccg

SEQ ID NO: 7622 - DNA, 25 bp, E. coli
tcagtcaatggtctagtcacggcct

SEQ ID NO: 7623 - DNA, 25 bp, E. coli
caaacaaagaaaagagtgacattac

SEQ ID NO: 7624 - DNA, 25 bp, E. coli
caaacaaagaaatgagtgacattac

SEQ ID NO: 7625 - DNA, 25 bp, E. coli
attgaagcctgccgccggagactgt

SEQ ID NO: 7626 - DNA, 25 bp, E. coli
attgaagcctgcggccggagactgt

SEQ ID NO: 7627 - DNA, 25 bp, E. coli
ttgctcagaaaacaggtcagaccag

SEQ ID NO: 7628 - DNA, 25 bp, E. coli
ttgctcagaaaagaggtcagaccag

SEQ ID NO: 7629 - DNA, 25 bp, E. coli
tgaagcaaacaaagaaaagagtgac

SEQ ID NO: 7630 - DNA, 25 bp, E. coli
tgaagcaaacaatgaaaagagtgac

SEQ ID NO: 7631 - DNA, 25 bp, E. coli
tgccgccggagactgtgctcagaaa

SEQ ID NO: 7632 - DNA, 25 bp, E. coli
tgccgccggagagtgtgctcagaaa

SEQ ID NO: 7633 - DNA, 25 bp, E. coli
ccggagactgtggtcagaaaaaaga

SEQ ID NO: 7634 - DNA, 25 bp, E. coli
ccggagactgtgctcagaaaaaaga

SEQ ID NO: 7635 - DNA, 25 bp, E. coli
gctcagaaaacaggtcagaccagat

SEQ ID NO: 7636 - DNA, 25 bp, E. coli
gctcagaaaacacgtcagaccagat

SEQ ID NO: 7637 - DNA, 25 bp, E. coli
gaattgctcagataacaggtcagac

SEQ ID NO: 7638 - DNA, 25 bp, E. coli
gaattgctcagaaaacaggtcagac

SEQ ID NO: 7639 - DNA, 25 bp, E. coli
gactgtgctcagaaaaaagagtttc

SEQ ID NO: 7640 - DNA, 25 bp, E. coli
gaaaagagtgactttactgaattgc

SEQ ID NO: 7641 - DNA, 25 bp, E. coli
gaaaagagtgacattactgaattgc

SEQ ID NO: 7642 - DNA, 25 bp, E. coli
gactgtgctcagtaaaaagagtttc

SEQ ID NO: 7643 - DNA, 25 bp, E. coli
gagtgacattactgaattgctcaga

SEQ ID NO: 7644 - DNA, 25 bp, E. coli
gagtgacattacagaattgctcaga

SEQ ID NO: 7645 - DNA, 25 bp, E. coli
caatgggcgtgaacgtgacaggtaa

SEQ ID NO: 7646 - DNA, 25 bp, E. coli
aacgacgcggaaggtgctgaagcct

SEQ ID NO: 7647 - DNA, 25 bp, E. coli
aacgacgcggaacgtgctgaagcct

SEQ ID NO: 7648 - DNA, 25 bp, E. coli
caatgggcgtgatcgtgacaggtaa

SEQ ID NO: 7649 - DNA, 25 bp, E. coli
tatgttaacgaaattaggtatggcg

SEQ ID NO: 7650 - DNA, 25 bp, E. coli
tatgttaacgaatttaggtatggcg

SEQ ID NO: 7651 - DNA, 25 bp, E. coli
tgaagcctgcattaacgccatccgt

SEQ ID NO: 7652 - DNA, 25 bp, E. coli
tgaagcctgcataaacgccatccgt

SEQ ID NO: 7653 - DNA, 25 bp, E. coli
tgcctgtggcttaactaacccgatc

SEQ ID NO: 7654 - DNA, 25 bp, E. coli
tgcctgtggctttactaacccgatc

SEQ ID NO: 7655 - DNA, 25 bp, E. coli
tcggcgctgattcattgactgatgc

SEQ ID NO: 7656 - DNA, 25 bp, E. coli
tcggcgctgattgattgactgatgc

SEQ ID NO: 7657 - DNA, 25 bp, E. coli
ccttctgtgaatgtcatcggcgctg

SEQ ID NO: 7658 - DNA, 25 bp, E. coli
ccttctgtgaatctcatcggcgctg

SEQ ID NO: 7659 - DNA, 25 bp, E. coli
gcgatattcgcgattacgaaggcgt

SEQ ID NO: 7660 - DNA, 25 bp, E. coli
gcgatattcgcgtttacgaaggcgt

SEQ ID NO: 7661 - DNA, 25 bp, E. coli
gaacgtgacaggtaaaaacgacgcg

SEQ ID NO: 7662 - DNA, 25 bp, E. coli
gaacgtgacaggaaaaaacgacgcg

SEQ ID NO: 7663 - DNA, 25 bp, E. coli
ctgtgccgctgctatgggcgtgaac

SEQ ID NO: 7664 - DNA, 25 bp, E. coli
ctgtgccgctgcaatgggcgtgaac

SEQ ID NO: 7665 - DNA, 25 bp, E. coli
gtggcagccaatcgcggcgatattc

SEQ ID NO: 7666 - DNA, 25 bp, E. coli
gtggcagccaatggcggcgatattc

SEQ ID NO: 7667 - DNA, 25 bp, E. coli
caatatcagcgttcagttcagcggt

SEQ ID NO: 7668 - DNA, 25 bp, E. coli
caatatcagcgtacagttcagcggt

SEQ ID NO: 7669 - DNA, 25 bp, E. coli
aagatattaaactgctgcgcgccga

SEQ ID NO: 7670 - DNA, 25 bp, E. coli
aagatattaaacagctgcgcgccga

SEQ ID NO: 7671 - DNA, 25 bp, E. coli
tatctgatgtgaacggaaagcgggc

SEQ ID NO: 7672 - DNA, 25 bp, E. coli
tatctgatgtgatcggaaagcgggc

SEQ ID NO: 7673 - DNA, 25 bp, E. coli
tattatgctggcctcactggtggcg

SEQ ID NO: 7674 - DNA, 25 bp, E. coli
tattatgctggcgtcactggtggcg

SEQ ID NO: 7675 - DNA, 25 bp, E. coli
ttacgacgaagaagagaagattgcc

SEQ ID NO: 7676 - DNA, 25 bp, E. coli
ttctcaggagaatgtgcgcgcgacc

SEQ ID NO: 7677 - DNA, 25 bp, E. coli
ttacgacgaagatgagaagattgcc

SEQ ID NO: 7678 - DNA, 25 bp, E. coli
ttgatgaactgatgaagcgcccggt

SEQ ID NO: 7679 - DNA, 25 bp, E. coli
ttgatgaactgaagaagcgcccggt

SEQ ID NO: 7680 - DNA, 25 bp, E. coli
ttctcaggagaaagtgcgcgcgacc

SEQ ID NO: 7681 - DNA, 25 bp, E. coli
ccattttgcgtgtacagggcgagcc

SEQ ID NO: 7682 - DNA, 25 bp, E. coli
ccattttgcgtgaacagggcgagcc

SEQ ID NO: 7683 - DNA, 25 bp, E. coli
gaagcaacgttttctcaccgggctg

SEQ ID NO: 7684 - DNA, 25 bp, E. coli
gaagcaacgtttactcaccgggctg

SEQ ID NO: 7685 - DNA, 25 bp, E. coli
gataaaatcgtccaactggcgctgc

SEQ ID NO: 7686 - DNA, 25 bp, E. coli
gataaaatcgtcgaactggcgctgc

SEQ ID NO: 7687 - DNA, 25 bp, E. coli
gaggagttactctccgacatggcgc

SEQ ID NO: 7688 - DNA, 25 bp, E. coli
gaggagttactcaccgacatggcgc

SEQ ID NO: 7689 - DNA, 25 bp, E. coli
aatctgctggtgctgaaaggtgctc

SEQ ID NO: 7690 - DNA, 25 bp, E. coli
aatctgctggtggtgaaaggtgctc

SEQ ID NO: 7691 - DNA, 25 bp, E. coli
cacctatctgtaccagggcatcgct

SEQ ID NO: 7692 - DNA, 25 bp, E. coli
cacctatctgtagcagggcatcgct

SEQ ID NO: 7693 - DNA, 25 bp, E. coli
aacattcatgttggtggtgctaacc

SEQ ID NO: 7694 - DNA, 25 bp, E. coli
aacattcatgttcgtggtgctaacc

SEQ ID NO: 7695 - DNA, 25 bp, E. coli
taccgcattgctttcgctgtggctg

SEQ ID NO: 7696 - DNA, 25 bp, E. coli
taccgcattgctatcgctgtggctg

SEQ ID NO: 7697 - DNA, 25 bp, E. coli
ttagaaaacaaccagagccagagta

SEQ ID NO: 7698 - DNA, 25 bp, E. coli
tatcgatctcgatcgcgtgattccg

SEQ ID NO: 7699 - DNA, 25 bp, E. coli
tatcgatctcgaacgcgtgattccg

SEQ ID NO: 7700 - DNA, 25 bp, E. coli
ttagaaaacaacgagagccagagta

SEQ ID NO: 7701 - DNA, 25 bp, E. coli
tgctcacgccgacgaacaaaaagag

SEQ ID NO: 7702 - DNA, 25 bp, E. coli
tgctgagagcgaactggaaattacc

SEQ ID NO: 7703 - DNA, 25 bp, E. coli
tgctcacgccgaggaacaaaaagag

SEQ ID NO: 7704 - DNA, 25 bp, E. coli
tgctgagagcgatctggaaattacc

SEQ ID NO: 7705 - DNA, 25 bp, E. coli
gagtaatggcgggtaccctccgtat

SEQ ID NO: 7706 - DNA, 25 bp, E. coli
gaagcgaaaaaagcgcgccgtatcg

SEQ ID NO: 7707 - DNA, 25 bp, E. coli
gaagcgaaaaaaccgcgccgtatcg

SEQ ID NO: 7708 - DNA, 25 bp, E. coli
gagtaatggcggctaccctccgtat

SEQ ID NO: 7709 - DNA, 25 bp, E. coli
gggcatcgctgaacgcaactttgaa

SEQ ID NO: 7710 - DNA, 25 bp, E. coli
gggcatcgctgatcgcaactttgaa

SEQ ID NO: 7711 - DNA, 25 bp, E. coli
cagggaaaatgcgagctagcagaat

SEQ ID NO: 7712 - DNA, 25 bp, E. coli
cagggaaaatgccagctagcagaat

SEQ ID NO: 7713 - DNA, 25 bp, E. coli
aaaacattatctctcagcgccacgc

SEQ ID NO: 7714 - DNA, 25 bp, E. coli
aaaacattatctgtcagcgccacgc

SEQ ID NO: 7715 - DNA, 25 bp, E. coli
tattaccgtgatgccgagacgctgg

SEQ ID NO: 7716 - DNA, 25 bp, E. coli
tattaccgtgatcccgagacgctgg

SEQ ID NO: 7717 - DNA, 25 bp, E. coli
ttcgtgattaaacccagcagcaaac

SEQ ID NO: 7718 - DNA, 25 bp, E. coli
ttcgtgattaaagccagcagcaaac

SEQ ID NO: 7719 - DNA, 25 bp, E. coli
tgatgaaggagttaaacccgccgtc

SEQ ID NO: 7720 - DNA, 25 bp, E. coli
tgatgaaggagtaaaacccgccgtc

SEQ ID NO: 7721 - DNA, 25 bp, E. coli
tgagcaaggtgatgtgacgaaacgt

SEQ ID NO: 7722 - DNA, 25 bp, E. coli
tgagcaaggtgaagtgacgaaacgt

SEQ ID NO: 7723 - DNA, 25 bp, E. coli
gaattcgattttgatccgctgcgtg

SEQ ID NO: 7724 - DNA, 25 bp, E. coli
gaattcgattttcatccgctgcgtg

SEQ ID NO: 7725 - DNA, 25 bp, E. coli
gccgtcgaacgggtttacaccatca

SEQ ID NO: 7726 - DNA, 25 bp, E. coli
gccgtcgaacggctttacaccatca

SEQ ID NO: 7727 - DNA, 25 bp, E. coli
ctggatctggaaaataataccgtgg

SEQ ID NO: 7728 - DNA, 25 bp, E. coli
ctggatctggaatataataccgtgg

SEQ ID NO: 7729 - DNA, 25 bp, E. coli
gtactggacgcctattattaccgtg

SEQ ID NO: 7730 - DNA, 25 bp, E. coli
gtactggacgccaattattaccgtg

SEQ ID NO: 7731 - DNA, 25 bp, E. coli
tcacaggatgtgaccgcacagaggt

SEQ ID NO: 7732 - DNA, 25 bp, E. coli
tcacaggatgtgtccgcacagaggt

SEQ ID NO: 7733 - DNA, 25 bp, E. coli
cactttcggaaatattgacatggga

SEQ ID NO: 7734 - DNA, 25 bp, E. coli
cactttcggaaaaattgacatggga

SEQ ID NO: 7735 - DNA, 25 bp, E. coli
taaatcggatcctaacgtagaaggt

SEQ ID NO: 7736 - DNA, 25 bp, E. coli
taaatcagatgaatacccgtggagc

SEQ ID NO: 7737 - DNA, 25 bp, E. coli
taaatcggatccaaacgtagaaggt

SEQ ID NO: 7738 - DNA, 25 bp, E. coli
taaatcagatgattacccgtggagc

SEQ ID NO: 7739 - DNA, 25 bp, E. coli
agtccttgattcttgggattcagca

SEQ ID NO: 7740 - DNA, 25 bp, E. coli
agtccttgattcatgggattcagca

SEQ ID NO: 7741 - DNA, 25 bp, E. coli
tgtggcaccctaagatttatctact

SEQ ID NO: 7742 - DNA, 25 bp, E. coli
tgtggcaccctatgatttatctact

SEQ ID NO: 7743 - DNA, 25 bp, E. coli
tcagaagtacttatttgtggcaccc

SEQ ID NO: 7744 - DNA, 25 bp, E. coli
tcagaagtacttttttgtggcaccc

SEQ ID NO: 7745 - DNA, 25 bp, E. coli
ccatgattggcttattgtctgtaaa

SEQ ID NO: 7746 - DNA, 25 bp, E. coli
ccatgattggctaattgtctgtaaa

SEQ ID NO: 7747 - DNA, 25 bp, E. coli
ctggagataaaggtagagacgttgt

SEQ ID NO: 7748 - DNA, 25 bp, E. coli
ctggagataaagctagagacgttgt

SEQ ID NO: 7749 - DNA, 25 bp, E. coli
ggtgattatcccatccctcagaagt

SEQ ID NO: 7750 - DNA, 25 bp, E. coli
ggtgattatcccttccctcagaagt

SEQ ID NO: 7751 - DNA, 25 bp, E. coli
gattacccgtggagcgaacgtttgg

SEQ ID NO: 7752 - DNA, 25 bp, E. coli
gattacccgtggtgcgaacgtttgg

SEQ ID NO: 7753 - DNA, 25 bp, E. coli
gagacgttgttgcatataaatcgga

SEQ ID NO: 7754 - DNA, 25 bp, E. coli
gagacgttgttggatataaatcgga

SEQ ID NO: 7755 - DNA, 25 bp, E. coli
cagcaacagtgaaatggcattttga

SEQ ID NO: 7756 - DNA, 25 bp, E. coli
cagcaacagtgatatggcattttga

SEQ ID NO: 7757 - DNA, 25 bp, E. coli
catttttcctaattgctgatgggaa

SEQ ID NO: 7758 - DNA, 25 bp, E. coli
catttttcctaaatgctgatgggaa

SEQ ID NO: 7759 - DNA, 25 bp, E. coli
tttcagcagcgtgagcagccaatca

SEQ ID NO: 7760 - DNA, 25 bp, E. coli
tttcagcagcgtcagcagccaatca

SEQ ID NO: 7761 - DNA, 25 bp, E. coli
tatcagcaatttgatttcagcagcg

SEQ ID NO: 7762 - DNA, 25 bp, E. coli
tatcagcaatttcatttcagcagcg

SEQ ID NO: 7763 - DNA, 25 bp, E. coli
ttgctgatgggataatccgttatca

SEQ ID NO: 7764 - DNA, 25 bp, E. coli
ttgctgatgggaaaatccgttatca

SEQ ID NO: 7765 - DNA, 25 bp, E. coli
tttcatttcagctgcgtcagcagcc

SEQ ID NO: 7766 - DNA, 25 bp, E. coli
tttcatttcagcagcgtcagcagcc

SEQ ID NO: 7767 - DNA, 25 bp, E. coli
tcctaattgctgttgggaaaatccg

SEQ ID NO: 7768 - DNA, 25 bp, E. coli
tcctaattgctgatgggaaaatccg

SEQ ID NO: 7769 - DNA, 25 bp, E. coli
gcaatttcatttgagcagcgtcagc

SEQ ID NO: 7770 - DNA, 25 bp, E. coli
gcagccaatcagcaacagtgaaatg

SEQ ID NO: 7771 - DNA, 25 bp, E. coli
gcaatttcatttcagcagcgtcagc

SEQ ID NO: 7772 - DNA, 25 bp, E. coli
gcagccaatcaggaacagtgaaatg

SEQ ID NO: 7773 - DNA, 25 bp, E. coli
cgtcagcagccaatcagcaacagtg

SEQ ID NO: 7774 - DNA, 25 bp, E. coli
cgtcagcagccattcagcaacagtg

SEQ ID NO: 7775 - DNA, 25 bp, E. coli
gggaaaatccgttatcagcaatttc

SEQ ID NO: 7776 - DNA, 25 bp, E. coli
gggaaaatccgtaatcagcaatttc

SEQ ID NO: 7777 - DNA, 25 bp, E. coli
aacgctcggccggtattatcaatga

SEQ ID NO: 7778 - DNA, 25 bp, E. coli
cagacagtggaatggcagacatcgt

SEQ ID NO: 7779 - DNA, 25 bp, E. coli
cactggttacgtcaagcaataagcc

SEQ ID NO: 7780 - DNA, 25 bp, E. coli
cactggttacgtgaagcaataagcc

SEQ ID NO: 7781 - DNA, 25 bp, E. coli
catgttaccggctgagggcgtactt

SEQ ID NO: 7782 - DNA, 25 bp, E. coli
catgttaccggcagagggcgtactt

SEQ ID NO: 7783 - DNA, 25 bp, E. coli
cagacagtggaaaggcagacatcgt

SEQ ID NO: 7784 - DNA, 25 bp, E. coli
aacgctcggccgctattatcaatga

SEQ ID NO: 7785 - DNA, 25 bp, E. coli
tatccacattctgcaaagcgactgg

SEQ ID NO: 7786 - DNA, 25 bp, E. coli
tatccacattctccaaagcgactgg

SEQ ID NO: 7787 - DNA, 25 bp, E. coli
tatcatcgaacagtcgcgtaacgcg

SEQ ID NO: 7788 - DNA, 25 bp, E. coli
tatcatcgaacactcgcgtaacgcg

SEQ ID NO: 7789 - DNA, 25 bp, E. coli
gccgttatttgtttcgccagcgacc

SEQ ID NO: 7790 - DNA, 25 bp, E. coli
cctttggtgaaacgcagctgactga

SEQ ID NO: 7791 - DNA, 25 bp, E. coli
gccgttatttgtatcgccagcgacc

SEQ ID NO: 7792 - DNA, 25 bp, E. coli
cctttggtgaaaggcagctgactga

SEQ ID NO: 7793 - DNA, 25 bp, E. coli
gcaatccgccgtttattgacgagca

SEQ ID NO: 7794 - DNA, 25 bp, E. coli
gcaatccgccgtatattgacgagca

SEQ ID NO: 7795 - DNA, 25 bp, E. coli
cccgcggcgtgatgctgaaatcctg

SEQ ID NO: 7796 - DNA, 25 bp, E. coli
cccgcggcgtgaagctgaaatcctg

SEQ ID NO: 7797 - DNA, 25 bp, E. coli
taagccaacttctggcgagcgaaag

SEQ ID NO: 7798 - DNA, 25 bp, E. coli
taagccaacttcaggcgagcgaaag

SEQ ID NO: 7799 - DNA, 25 bp, E. coli
tagcactccggtgagacggtttaaa

SEQ ID NO: 7800 - DNA, 25 bp, E. coli
tagcactccggtcagacggtttaaa

SEQ ID NO: 7801 - DNA, 25 bp, E. coli
agacgcccgtactcggactggtggt

SEQ ID NO: 7802 - DNA, 25 bp, E. coli
agacgcccgtacacggactggtggt

SEQ ID NO: 7803 - DNA, 25 bp, E. coli
aaactgcgcagaaaaaggatgctac

SEQ ID NO: 7804 - DNA, 25 bp, E. coli
aaactgcgcagataaaggatgctac

SEQ ID NO: 7805 - DNA, 25 bp, E. coli
acagaagcgactcgcgccgggatta

SEQ ID NO: 7806 - DNA, 25 bp, E. coli
acagaagcgactggcgccgggatta

SEQ ID NO: 7807 - DNA, 25 bp, E. coli
ttgtggtaccaaggaacggagacga

SEQ ID NO: 7808 - DNA, 25 bp, E. coli
ttgtggtaccaacgaacggagacga

SEQ ID NO: 7809 - DNA, 25 bp, E. coli
gacattgtaccacttgattgatcag

SEQ ID NO: 7810 - DNA, 25 bp, E. coli
gacattgtaccagttgattgatcag

SEQ ID NO: 7811 - DNA, 25 bp, E. coli
gaactgctgttctagcgaggcttcc

SEQ ID NO: 7812 - DNA, 25 bp, E. coli
gaactgctgttcaagcgaggcttcc

SEQ ID NO: 7813 - DNA, 25 bp, E. coli
ctccaatagcgactttgtaccgctg

SEQ ID NO: 7814 - DNA, 25 bp, E. coli
ctccaatagcgagtttgtaccgctg

SEQ ID NO: 7815 - DNA, 25 bp, E. coli
gattgatcaggcacgtagcactccg

SEQ ID NO: 7816 - DNA, 25 bp, E. coli
gattgatcaggctcgtagcactccg

SEQ ID NO: 7817 - DNA, 25 bp, E. coli
ggatgctacagttaagcgtgactga

SEQ ID NO: 7818 - DNA, 25 bp, E. coli
ggatgctacagtaaagcgtgactga

SEQ ID NO: 7819 - DNA, 25 bp, E. coli
gatcgatcgtctacgctccaatagc

SEQ ID NO: 7820 - DNA, 25 bp, E. coli
gatcgatcgtcttcgctccaatagc

SEQ ID NO: 7821 - DNA, 25 bp, E. coli
aattgccgaccgctttggtgccaaa

SEQ ID NO: 7822 - DNA, 25 bp, E. coli
aattgccgaccggtttggtgccaaa

SEQ ID NO: 7823 - DNA, 25 bp, E. coli
cagccagagcttccgtggatgatgc

SEQ ID NO: 7824 - DNA, 25 bp, E. coli
cagccagagcttgcgtggatgatgc

SEQ ID NO: 7825 - DNA, 25 bp, E. coli
tacaagtgatgcagatgctgccaat

SEQ ID NO: 7826 - DNA, 25 bp, E. coli
tacaagtgatgctgatgctgccaat

SEQ ID NO: 7827 - DNA, 25 bp, E. coli
aaagcattttcgtctggaacaccgg

SEQ ID NO: 7828 - DNA, 25 bp, E. coli
aaagcattttcgactggaacaccgg

SEQ ID NO: 7829 - DNA, 25 bp, E. coli
tatcgcccgctggagtgaaaagcat

SEQ ID NO: 7830 - DNA, 25 bp, E. coli
tatccgcttcgttgatcaaatgggc

SEQ ID NO: 7831 - DNA, 25 bp, E. coli
tatccgcttcgtagatcaaatgggc

SEQ ID NO: 7832 - DNA, 25 bp, E. coli
tatcgcccgctgcagtgaaaagcat

SEQ ID NO: 7833 - DNA, 25 bp, E. coli
tatatcgggtcgatcattgccgagc

SEQ ID NO: 7834 - DNA, 25 bp, E. coli
tatatcgggtcgttcattgccgagc

SEQ ID NO: 7835 - DNA, 25 bp, E. coli
gattcgccacaatgggtatcgccca

SEQ ID NO: 7836 - DNA, 25 bp, E. coli
gattcgccacaaagggtatcgccca

SEQ ID NO: 7837 - DNA, 25 bp, E. coli
ggcgcgccctctgccgttaaatgga

SEQ ID NO: 7838 - DNA, 25 bp, E. coli
ggcgcgccctctcccgttaaatgga

SEQ ID NO: 7839 - DNA, 25 bp, E. coli
tggcagtttagccagaaacgcgccg

SEQ ID NO: 7840 - DNA, 25 bp, E. coli
tggcagtttagcgagaaacgcgccg

SEQ ID NO: 7841 - DNA, 25 bp, E. coli
gagcctgcgcgtgaaaccttaagtg

SEQ ID NO: 7842 - DNA, 25 bp, E. coli
gagcctgcgcgtcaaaccttaagtg

SEQ ID NO: 7843 - DNA, 25 bp, E. coli
caattgagcagctgtgaaccttgcg

SEQ ID NO: 7844 - DNA, 25 bp, E. coli
caattgagcagcagtgaaccttgcg

SEQ ID NO: 7845 - DNA, 25 bp, E. coli
cagttcgctatgtttaagccccagc

SEQ ID NO: 7846 - DNA, 25 bp, E. coli
cagttcgctatgattaagccccagc

SEQ ID NO: 7847 - DNA, 25 bp, E. coli
taacaaaaatatgactcaggtggcg

SEQ ID NO: 7848 - DNA, 25 bp, E. coli
taacaaaaatatcactcaggtggcg

SEQ ID NO: 7849 - DNA, 25 bp, E. coli
tatatcttacgctgcagcgtccgcg

SEQ ID NO: 7850 - DNA, 25 bp, E. coli
tatatcttacgcagcagcgtccgcg

SEQ ID NO: 7851 - DNA, 25 bp, E. coli
tgtcatagccgttcaccggaagtgt

SEQ ID NO: 7852 - DNA, 25 bp, E. coli
tgtcatagccgtacaccggaagtgt

SEQ ID NO: 7853 - DNA, 25 bp, E. coli
tctaactttcttgagcaatcgcggt

SEQ ID NO: 7854 - DNA, 25 bp, E. coli
tctaactttcttcagcaatcgcggt

SEQ ID NO: 7855 - DNA, 25 bp, E. coli
ccagctatagccagattgtcacaga

SEQ ID NO: 7856 - DNA, 25 bp, E. coli
ccagctatagcctgattgtcacaga

SEQ ID NO: 7857 - DNA, 25 bp, E. coli
gccttcgcgtgcaacaataacgtca

SEQ ID NO: 7858 - DNA, 25 bp, E. coli
gccttcgcgtgctacaataacgtca

SEQ ID NO: 7859 - DNA, 25 bp, E. coli
gcaattatgtggctatagcagcacg

SEQ ID NO: 7860 - DNA, 25 bp, E. coli
gcaattatgtgggtatagcagcacg

SEQ ID NO: 7861 - DNA, 25 bp, E. coli
gaaccttgcgtgctgatcctgaccg

SEQ ID NO: 7862 - DNA, 25 bp, E. coli
gaaccttgcgtggtgatcctgaccg

SEQ ID NO: 7863 - DNA, 25 bp, E. coli
taacctgtgtaaagccctggtcgcg

SEQ ID NO: 7864 - DNA, 25 bp, E. coli
taacctgtgtaatgccctggtcgcg

SEQ ID NO: 7865 - DNA, 25 bp, E. coli
taaaactgatcaacgtaatttgccc

SEQ ID NO: 7866 - DNA, 25 bp, E. coli
taaaactgatcatcgtaatttgccc

SEQ ID NO: 7867 - DNA, 25 bp, E. coli
aacaattaactctgagcgcgcggca

SEQ ID NO: 7868 - DNA, 25 bp, E. coli
aacaattaactcagagcgcgcggca

SEQ ID NO: 7869 - DNA, 25 bp, E. coli
tatgcgaattgcacataaagtgacg

SEQ ID NO: 7870 - DNA, 25 bp, E. coli
tatgcgaattgctcataaagtgacg

SEQ ID NO: 7871 - DNA, 25 bp, E. coli
tcataaagtgacgtaaaggcggata

SEQ ID NO: 7872 - DNA, 25 bp, E. coli
tcataaagtgacctaaaggcggata

SEQ ID NO: 7873 - DNA, 25 bp, E. coli
cctggtcgccagtattcgtttctgt

SEQ ID NO: 7874 - DNA, 25 bp, E. coli
cctggtcgccagaattcgtttctgt

SEQ ID NO: 7875 - DNA, 25 bp, E. coli
gcgcggcaacgctattcgactggta

SEQ ID NO: 7876 - DNA, 25 bp, E. coli
gcgcggcaacgcaattcgactggta

SEQ ID NO: 7877 - DNA, 25 bp, E. coli
gctttatccgcaagacctggtcgcc

SEQ ID NO: 7878 - DNA, 25 bp, E. coli
gctttatccgcatgacctggtcgcc

SEQ ID NO: 7879 - DNA, 25 bp, E. coli
gactggtatcagacggatgaaatcc

SEQ ID NO: 7880 - DNA, 25 bp, E. coli
cgtttctgtgttaatgctagtacaa

SEQ ID NO: 7881 - DNA, 25 bp, E. coli
cgtttctgtgtttatgctagtacaa

SEQ ID NO: 7882 - DNA, 25 bp, E. coli
ggcggataatttgcgcaactgcgtt

SEQ ID NO: 7883 - DNA, 25 bp, E. coli
ggcggataatttccgcaactgcgtt

SEQ ID NO: 7884 - DNA, 25 bp, E. coli
gatgaaatccctttaattgccgcgt

SEQ ID NO: 7885 - DNA, 25 bp, E. coli
gactggtatcagtcggatgaaatcc

SEQ ID NO: 7886 - DNA, 25 bp, E. coli
gatgaaatccctataattgccgcgt

SEQ ID NO: 7887 - DNA, 25 bp, E. coli
caggctgggatgttctctccagaac

SEQ ID NO: 7888 - DNA, 25 bp, E. coli
caggctgggatgatctctccagaac

SEQ ID NO: 7889 - DNA, 25 bp, E. coli
tgttctctccagtactcagaacctt

SEQ ID NO: 7890 - DNA, 25 bp, E. coli
tgttcaggctgggatgttctctcca

SEQ ID NO: 7891 - DNA, 25 bp, E. coli
tgttctctccagaactcagaacctt

SEQ ID NO: 7892 - DNA, 25 bp, E. coli
tgggatgttctctccagaactcaga

SEQ ID NO: 7893 - DNA, 25 bp, E. coli
tgttcaggctggcatgttctctcca

SEQ ID NO: 7894 - DNA, 25 bp, E. coli
tgggatgttctcaccagaactcaga

SEQ ID NO: 7895 - DNA, 25 bp, E. coli
tccagaactcagtacctttaccaaa

SEQ ID NO: 7896 - DNA, 25 bp, E. coli
tccagaactcagaacctttaccaaa

SEQ ID NO: 7897 - DNA, 25 bp, E. coli
tctctccagaacacagaacctttac

SEQ ID NO: 7898 - DNA, 25 bp, E. coli
tctctccagaactcagaacctttac

SEQ ID NO: 7899 - DNA, 25 bp, E. coli
tcaggctgggatgttctctccagaa

SEQ ID NO: 7900 - DNA, 25 bp, E. coli
tcaggctgggatcttctctccagaa

SEQ ID NO: 7901 - DNA, 25 bp, E. coli
gctgggatgttctctccagaactca

SEQ ID NO: 7902 - DNA, 25 bp, E. coli
gctgggatgttcactccagaactca

SEQ ID NO: 7903 - DNA, 25 bp, E. coli
gttcaggctgggatgttctctccag

SEQ ID NO: 7904 - DNA, 25 bp, E. coli
gttcaggctgggttgttctctccag

SEQ ID NO: 7905 - DNA, 25 bp, E. coli
gggatgttctctgcagaactcagaa

SEQ ID NO: 7906 - DNA, 25 bp, E. coli
gggatgttctctccagaactcagaa

SEQ ID NO: 7907 - DNA, 25 bp, E. coli
gatgttctctccagaactcagaacc

SEQ ID NO: 7908 - DNA, 25 bp, E. coli
gatgttctctcctgaactcagaacc

SEQ ID NO: 7909 - DNA, 25 bp, E. coli
atggccgaccataccgttaccgata

SEQ ID NO: 7910 - DNA, 25 bp, E. coli
accgataattgcgagtctgactttg

SEQ ID NO: 7911 - DNA, 25 bp, E. coli
accgataattgccagtctgactttg

SEQ ID NO: 7912 - DNA, 25 bp, E. coli
atggccgaccattccgttaccgata

SEQ ID NO: 7913 - DNA, 25 bp, E. coli
ttaccgataattgcgagtctgactt

SEQ ID NO: 7914 - DNA, 25 bp, E. coli
ttaccgataattccgagtctgactt

SEQ ID NO: 7915 - DNA, 25 bp, E. coli
ccgttaccgatatttgcgagtctga

SEQ ID NO: 7916 - DNA, 25 bp, E. coli
cgttaccgataattgcgagtctgac

SEQ ID NO: 7917 - DNA, 25 bp, E. coli
cgataattgcgactctgactttgct

SEQ ID NO: 7918 - DNA, 25 bp, E. coli
ccgttaccgataattgcgagtctga

SEQ ID NO: 7919 - DNA, 25 bp, E. coli
ccgataattgcgagtctgactttgc

SEQ ID NO: 7920 - DNA, 25 bp, E. coli
ccgataattgcgtgtctgactttgc

SEQ ID NO: 7921 - DNA, 25 bp, E. coli
cgataattgcgagtctgactttgct

SEQ ID NO: 7922 - DNA, 25 bp, E. coli
cgttaccgataaatgcgagtctgac

SEQ ID NO: 7923 - DNA, 25 bp, E. coli
gataattgcgagactgactttgctc

SEQ ID NO: 7924 - DNA, 25 bp, E. coli
gttaccgataattgcgagtctgact

SEQ ID NO: 7925 - DNA, 25 bp, E. coli
gataattgcgagtctgactttgctc

SEQ ID NO: 7926 - DNA, 25 bp, E. coli
gttaccgataatagcgagtctgact

SEQ ID NO: 7927 - DNA, 25 bp, E. coli
tggccgaccatagcgttaccgataa

SEQ ID NO: 7928 - DNA, 25 bp, E. coli
tggccgaccataccgttaccgataa

SEQ ID NO: 7929 - DNA, 25 bp, E. coli
taattgcgagtctgactttgctcat

SEQ ID NO: 7930 - DNA, 25 bp, E. coli
taattgcgagtcagactttgctcat

SEQ ID NO: 7931 - DNA, 25 bp, E. coli
aatttggcctcgggattgtcatcgg

SEQ ID NO: 7932 - DNA, 25 bp, E. coli
aatttggcctcgcgattgtcatcgg

SEQ ID NO: 7933 - DNA, 25 bp, E. coli
catgaaagcagtctcagttggatgt

SEQ ID NO: 7934 - DNA, 25 bp, E. coli
catgaaagcagtgtcagttggatgt

SEQ ID NO: 7935 - DNA, 25 bp, E. coli
cagtgtcagttgcatgttcgtggtc

SEQ ID NO: 7936 - DNA, 25 bp, E. coli
cagtgtcagttggatgttcgtggtc

SEQ ID NO: 7937 - DNA, 25 bp, E. coli
acgcggcgcggtgccgattattctg

SEQ ID NO: 7938 - DNA, 25 bp, E. coli
acgcggcgcggtcccgattattctg

SEQ ID NO: 7939 - DNA, 25 bp, E. coli
tttactgctgcaaatgattaatcgc

SEQ ID NO: 7940 - DNA, 25 bp, E. coli
tattctgcagcattttggcctcggg

SEQ ID NO: 7941 - DNA, 25 bp, E. coli
tattctgcagcaatttggcctcggg

SEQ ID NO: 7942 - DNA, 25 bp, E. coli
tttactgctgcatatgattaatcgc

SEQ ID NO: 7943 - DNA, 25 bp, E. coli
ttttgctttaacgacggcgctggaa

SEQ ID NO: 7944 - DNA, 25 bp, E. coli
ttttgctttaaccacggcgctggaa

SEQ ID NO: 7945 - DNA, 25 bp, E. coli
tctgcagcaatttggcctcgggatt

SEQ ID NO: 7946 - DNA, 25 bp, E. coli
tctgcagcaattaggcctcgggatt

SEQ ID NO: 7947 - DNA, 25 bp, E. coli
ctggcattaagcggcggtattttaa

SEQ ID NO: 7948 - DNA, 25 bp, E. coli
ctggcattaagccgcggtattttaa

SEQ ID NO: 7949 - DNA, 25 bp, E. coli
gttcgtggtcgaaattctgcagcaa

SEQ ID NO: 7950 - DNA, 25 bp, E. coli
gttcgtggtcgatattctgcagcaa

SEQ ID NO: 7951 - DNA, 25 bp, E. coli
taatttttgcttaaaccacggcgct

SEQ ID NO: 7952 - DNA, 25 bp, E. coli
taatttttgctttaaccacggcgct

SEQ ID NO: 7953 - DNA, 25 bp, E. coli
caaccggcctgggtaaatatggcgc

SEQ ID NO: 7954 - DNA, 25 bp, E. coli
caaccggcctggctaaatatggcgc

SEQ ID NO: 7955 - DNA, 25 bp, E. coli
cacctgttgtttgttgatggcggca

SEQ ID NO: 7956 - DNA, 25 bp, E. coli
cacctgttgtttcttgatggcggca

SEQ ID NO: 7957 - DNA, 25 bp, E. coli
catatcgaaaagcacatcggcccca

SEQ ID NO: 7958 - DNA, 25 bp, E. coli
catatcgaaaaggacatcggcccca

SEQ ID NO: 7959 - DNA, 25 bp, E. coli
taaaaatgctcagccgcggcatgtg

SEQ ID NO: 7960 - DNA, 25 bp, E. coli
taaagcactggttgaggacgaagcc

SEQ ID NO: 7961 - DNA, 25 bp, E. coli
taaagcactggtagaggacgaagcc

SEQ ID NO: 7962 - DNA, 25 bp, E. coli
taaaaatgctcacccgcggcatgtg

SEQ ID NO: 7963 - DNA, 25 bp, E. coli
ttaatgatattagtgccgaacgcgc

SEQ ID NO: 7964 - DNA, 25 bp, E. coli
ttaatgatattactgccgaacgcgc

SEQ ID NO: 7965 - DNA, 25 bp, E. coli
tccaccaggagggtattcaggccgt

SEQ ID NO: 7966 - DNA, 25 bp, E. coli
tccaccaggaggctattcaggccgt

SEQ ID NO: 7967 - DNA, 25 bp, E. coli
gaacgatctattttcactggcagga

SEQ ID NO: 7968 - DNA, 25 bp, E. coli
gaacgatctattatcactggcagga

SEQ ID NO: 7969 - DNA, 25 bp, E. coli
gattaccggttcagcacagggcatt

SEQ ID NO: 7970 - DNA, 25 bp, E. coli
gatgccgccgttcaacatatcgaaa

SEQ ID NO: 7971 - DNA, 25 bp, E. coli
gattaccggttctgcacagggcatt

SEQ ID NO: 7972 - DNA, 25 bp, E. coli
gatgtgatcgcagtaaaccagaccg

SEQ ID NO: 7973 - DNA, 25 bp, E. coli
gatgtgatcgcactaaaccagaccg

SEQ ID NO: 7974 - DNA, 25 bp, E. coli
gatgccgccgttgaacatatcgaaa

SEQ ID NO: 7975 - DNA, 25 bp, E. coli
caagccgactcaggaagtgacggat

SEQ ID NO: 7976 - DNA, 25 bp, E. coli
aatgatggcaaccatcgaccgcatg

SEQ ID NO: 7977 - DNA, 25 bp, E. coli
caagccgactcacgaagtgacggat

SEQ ID NO: 7978 - DNA, 25 bp, E. coli
aatgatggcaacgatcgaccgcatg

SEQ ID NO: 7979 - DNA, 25 bp, E. coli
taccggcattcggacaatcatgttg

SEQ ID NO: 7980 - DNA, 25 bp, E. coli
tacctacgcttcaatgatggcaacc

SEQ ID NO: 7981 - DNA, 25 bp, E. coli
tacctacgcttctatgatggcaacc

SEQ ID NO: 7982 - DNA, 25 bp, E. coli
taccggcattcgcacaatcatgttg

SEQ ID NO: 7983 - DNA, 25 bp, E. coli
tgttgaccggcctcatcatgttcca

SEQ ID NO: 7984 - DNA, 25 bp, E. coli
tgttgaccggccacatcatgttcca

SEQ ID NO: 7985 - DNA, 25 bp, E. coli
tcgcattaccggcattcgcacaatc

SEQ ID NO: 7986 - DNA, 25 bp, E. coli
tcgcattaccgggattcgcacaatc

SEQ ID NO: 7987 - DNA, 25 bp, E. coli
gcattcgcacaatcatgttgaccgg

SEQ ID NO: 7988 - DNA, 25 bp, E. coli
gcattcgcacaaacatgttgaccgg

SEQ ID NO: 7989 - DNA, 25 bp, E. coli
gcaatttccgattcctacgcttcaa

SEQ ID NO: 7990 - DNA, 25 bp, E. coli
gcaatttccgatacctacgcttcaa

SEQ ID NO: 7991 - DNA, 25 bp, E. coli
gcacaatcatgtagaccggccacat

SEQ ID NO: 7992 - DNA, 25 bp, E. coli
gcacaatcatgttgaccggccacat

SEQ ID NO: 7993 - DNA, 25 bp, E. coli
cgatacctacgcttcaatgatggca

SEQ ID NO: 7994 - DNA, 25 bp, E. coli
ccgactcaggaagtgacggatggct

SEQ ID NO: 7995 - DNA, 25 bp, E. coli
cgatacctacgcatcaatgatggca

SEQ ID NO: 7996 - DNA, 25 bp, E. coli
ccgactcaggaactgacggatggct

SEQ ID NO: 7997 - DNA, 25 bp, E. coli
caggttctgccgtattcttccgccg

SEQ ID NO: 7998 - DNA, 25 bp, E. coli
caggttctgccgaattcttccgccg

SEQ ID NO: 7999 - DNA, 25 bp, E. coli
cggcctgggcgacacagtaacttcc

SEQ ID NO: 8000 - DNA, 25 bp, E. coli
cggcctgggcgagacagtaacttcc

SEQ ID NO: 8001 - DNA, 25 bp, E. coli
acgtggtgagttcggtattatgggc

SEQ ID NO: 8002 - DNA, 25 bp, E. coli
acccgttcggcctgggcgagacagt

SEQ ID NO: 8003 - DNA, 25 bp, E. coli
acgtggtgagttgggtattatgggc

SEQ ID NO: 8004 - DNA, 25 bp, E. coli
acccgttcggccagggcgagacagt

SEQ ID NO: 8005 - DNA, 25 bp, E. coli
tagcaattggtaacccgttcggcct

SEQ ID NO: 8006 - DNA, 25 bp, E. coli
tagcaattggtatcccgttcggcct

SEQ ID NO: 8007 - DNA, 25 bp, E. coli
ttcttccgccgccaaagcgggcatt

SEQ ID NO: 8008 - DNA, 25 bp, E. coli
ttccgccgcgaaagcgggcattaaa

SEQ ID NO: 8009 - DNA, 25 bp, E. coli
ttcttccgccgcgaaagcgggcatt

SEQ ID NO: 8010 - DNA, 25 bp, E. coli
ttccgccgcgaatgcgggcattaaa

SEQ ID NO: 8011 - DNA, 25 bp, E. coli
ttcggcctgggccagacagtaactt

SEQ ID NO: 8012 - DNA, 25 bp, E. coli
ttcggcctgggcgagacagtaactt

SEQ ID NO: 8013 - DNA, 25 bp, E. coli
gttctgccgaatacttccgccgcga

SEQ ID NO: 8014 - DNA, 25 bp, E. coli
gttctgccgaattcttccgccgcga

SEQ ID NO: 8015 - DNA, 25 bp, E. coli
gggtaactcaggtggtgcgttggtt

SEQ ID NO: 8016 - DNA, 25 bp, E. coli
gggtaactcaggaggtgcgttggtt

SEQ ID NO: 8017 - DNA, 25 bp, E. coli
gacgtagcggccagaacgctgaaaa

SEQ ID NO: 8018 - DNA, 25 bp, E. coli
gacgtagcggcctgaacgctgaaaa

SEQ ID NO: 8019 - DNA, 25 bp, E. coli
actggtggcaggacgacaaaccgtg

SEQ ID NO: 8020 - DNA, 25 bp, E. coli
attgttgatgacattgaagggcgac

SEQ ID NO: 8021 - DNA, 25 bp, E. coli
attgttgatgactttgaagggcgac

SEQ ID NO: 8022 - DNA, 25 bp, E. coli
actggtggcaggtcgacaaaccgtg

SEQ ID NO: 8023 - DNA, 25 bp, E. coli
ttgatgacattgaagggcgacttga

SEQ ID NO: 8024 - DNA, 25 bp, E. coli
ttgatgacattgtagggcgacttga

SEQ ID NO: 8025 - DNA, 25 bp, E. coli
tgttgatgacatagaagggcgactt

SEQ ID NO: 8026 - DNA, 25 bp, E. coli
tgttgatgacattgaagggcgactt

SEQ ID NO: 8027 - DNA, 25 bp, E. coli
tgatgacattgaagggcgacttgat

SEQ ID NO: 8028 - DNA, 25 bp, E. coli
tgatgacattgatgggcgacttgat

SEQ ID NO: 8029 - DNA, 25 bp, E. coli
gcaggacgacaatccgtggctgcgt

SEQ ID NO: 8030 - DNA, 25 bp, E. coli
gcaggacgacaaaccgtggctgcgt

SEQ ID NO: 8031 - DNA, 25 bp, E. coli
gcactttacgatctcaacgcgctgg

SEQ ID NO: 8032 - DNA, 25 bp, E. coli
gcactttacgatgtcaacgcgctgg

SEQ ID NO: 8033 - DNA, 25 bp, E. coli
gactggtggcaggacgacaaaccgt

SEQ ID NO: 8034 - DNA, 25 bp, E. coli
gactggtggcagcacgacaaaccgt

SEQ ID NO: 8035 - DNA, 25 bp, E. coli
gttgatgacattcaagggcgacttg

SEQ ID NO: 8036 - DNA, 25 bp, E. coli
gttgatgacattgaagggcgacttg

SEQ ID NO: 8037 - DNA, 25 bp, E. coli
ggacgacaaaccctggctgcgtgaa

SEQ ID NO: 8038 - DNA, 25 bp, E. coli
ggacgacaaaccgtggctgcgtgaa

SEQ ID NO: 8039 - DNA, 25 bp, E. coli
tggcaggacgactaaccgtggctgc

SEQ ID NO: 8040 - DNA, 25 bp, E. coli
tggcaggacgacaaaccgtggctgc

SEQ ID NO: 8041 - DNA, 25 bp, E. coli
cagtgattgatgtggccgaaaaggc

SEQ ID NO: 8042 - DNA, 25 bp, E. coli
cagtgattgatgaggccgaaaaggc

SEQ ID NO: 8043 - DNA, 25 bp, E. coli
aaaccagccagcaagactacgccat

SEQ ID NO: 8044 - DNA, 25 bp, E. coli
aaaaggccggcatcagtcgcatgat

SEQ ID NO: 8045 - DNA, 25 bp, E. coli
aaaccagccagctagactacgccat

SEQ ID NO: 8046 - DNA, 25 bp, E. coli
aaaaggccggcaacagtcgcatgat

SEQ ID NO: 8047 - DNA, 25 bp, E. coli
tgatgaggccgataaggccggcatc

SEQ ID NO: 8048 - DNA, 25 bp, E. coli
tgcttgacggcggagcaacaggcaa

SEQ ID NO: 8049 - DNA, 25 bp, E. coli
tgcttgacggcgcagcaacaggcaa

SEQ ID NO: 8050 - DNA, 25 bp, E. coli
tgatgaggccgaaaaggccggcatc

SEQ ID NO: 8051 - DNA, 25 bp, E. coli
tctggtgacctcattgggatgcggc

SEQ ID NO: 8052 - DNA, 25 bp, E. coli
tctggtgacctctttgggatgcggc

SEQ ID NO: 8053 - DNA, 25 bp, E. coli
cgcagcaacagggaaagcacaacgg

SEQ ID NO: 8054 - DNA, 25 bp, E. coli
cgcagcaacaggcaaagcacaacgg

SEQ ID NO: 8055 - DNA, 25 bp, E. coli
ccctggtggtctccttgacggcgca

SEQ ID NO: 8056 - DNA, 25 bp, E. coli
ccctggtggtctgcttgacggcgca

SEQ ID NO: 8057 - DNA, 25 bp, E. coli
cggcatcagtcgcatgattctggtg

SEQ ID NO: 8058 - DNA, 25 bp, E. coli
cggcatcagtcggatgattctggtg

SEQ ID NO: 8059 - DNA, 25 bp, E. coli
gttttgtccgccgtgccgatgtcgc

SEQ ID NO: 8060 - DNA, 25 bp, E. coli
gttttgtccgccctgccgatgtcgc

SEQ ID NO: 8061 - DNA, 25 bp, E. coli
gagtgtcatggttttgtccgccgtg

SEQ ID NO: 8062 - DNA, 25 bp, E. coli
gagtgtcatggtattgtccgccgtg

SEQ ID NO: 8063 - DNA, 25 bp, E. coli
attgtgtcgaagaagagcgcgccgg

SEQ ID NO: 8064 - DNA, 25 bp, E. coli
attgtgtcgaagtagagcgcgccgg

SEQ ID NO: 8065 - DNA, 25 bp, E. coli
atgccattgtgtcgaagaagagcgc

SEQ ID NO: 8066 - DNA, 25 bp, E. coli
atgccattgtgtggaagaagagcgc

SEQ ID NO: 8067 - DNA, 25 bp, E. coli
tgtcgaagaagagcgcgccgggaac

SEQ ID NO: 8068 - DNA, 25 bp, E. coli
tgtcgaagaagaccgcgccgggaac

SEQ ID NO: 8069 - DNA, 25 bp, E. coli
tgccattgtgtccaagaagagcgcg

SEQ ID NO: 8070 - DNA, 25 bp, E. coli
tgccattgtgtcgaagaagagcgcg

SEQ ID NO: 8071 - DNA, 25 bp, E. coli
ccattgtgtcgaagaagagcgcgcc

SEQ ID NO: 8072 - DNA, 25 bp, E. coli
gccattgtgtcgtagaagagcgcgc

SEQ ID NO: 8073 - DNA, 25 bp, E. coli
gccattgtgtcgaagaagagcgcgc

SEQ ID NO: 8074 - DNA, 25 bp, E. coli
ccattgtgtcgatgaagagcgcgcc

SEQ ID NO: 8075 - DNA, 25 bp, E. coli
cggatgccattgtgtcgaagaagag

SEQ ID NO: 8076 - DNA, 25 bp, E. coli
cattgtgtcgaacaagagcgcgccg

SEQ ID NO: 8077 - DNA, 25 bp, E. coli
cggatgccattgagtcgaagaagag

SEQ ID NO: 8078 - DNA, 25 bp, E. coli
cattgtgtcgaagaagagcgcgccg

SEQ ID NO: 8079 - DNA, 25 bp, E. coli
ggatgccattgtgtcgaagaagagc

SEQ ID NO: 8080 - DNA, 25 bp, E. coli
ggatgccattgtctcgaagaagagc

SEQ ID NO: 8081 - DNA, 25 bp, E. coli
tgtgtcgaagaacagcgcgccggga

SEQ ID NO: 8082 - DNA, 25 bp, E. coli
tgtgtcgaagaagagcgcgccggga

SEQ ID NO: 8083 - DNA, 25 bp, E. coli
gatgccattgtgacgaagaagagcg

SEQ ID NO: 8084 - DNA, 25 bp, E. coli
gatgccattgtgtcgaagaagagcg

SEQ ID NO: 8085 - DNA, 25 bp, E. coli
caaaatcttcatgggcctggcgacc

SEQ ID NO: 8086 - DNA, 25 bp, E. coli
caaaatcttcatcggcctggcgacc

SEQ ID NO: 8087 - DNA, 25 bp, E. coli
tcaaaaatcggtcccggtccgtggg

SEQ ID NO: 8088 - DNA, 25 bp, E. coli
tcaaaaatcggtgccggtccgtggg

SEQ ID NO: 8089 - DNA, 25 bp, E. coli
catcgttaaactccacggcggcgaa

SEQ ID NO: 8090 - DNA, 25 bp, E. coli
catcgttaaactgcacggcggcgaa

SEQ ID NO: 8091 - DNA, 25 bp, E. coli
tacgttgcgctgcacggtaacatcg

SEQ ID NO: 8092 - DNA, 25 bp, E. coli
tacgtctggaaggtaacaacgccga

SEQ ID NO: 8093 - DNA, 25 bp, E. coli
tacgttgcgctggacggtaacatcg

SEQ ID NO: 8094 - DNA, 25 bp, E. coli
tacgtctggaagctaacaacgccga

SEQ ID NO: 8095 - DNA, 25 bp, E. coli
aaatgtcaggttgacgctggtggcc

SEQ ID NO: 8096 - DNA, 25 bp, E. coli
aaatgtcaggttcacgctggtggcc

SEQ ID NO: 8097 - DNA, 25 bp, E. coli
gcttttgcagaaaactggctgggca

SEQ ID NO: 8098 - DNA, 25 bp, E. coli
gcttttgcagaatactggctgggca

SEQ ID NO: 8099 - DNA, 25 bp, E. coli
ggttatgcctgtactactccgcgcg

SEQ ID NO: 8100 - DNA, 25 bp, E. coli
ggttatgcctgttctactccgcgcg

SEQ ID NO: 8101 - DNA, 25 bp, E. coli
ggcggcgcaacctaagaacgtgtaa

SEQ ID NO: 8102 - DNA, 25 bp, E. coli
ggcggcgcaaccaaagaacgtgtaa

SEQ ID NO: 8103 - DNA, 25 bp, E. coli
tctttatggcctgcaccgaaggcgg

SEQ ID NO: 8104 - DNA, 25 bp, E. coli
tctttatggcctccaccgaaggcgg

SEQ ID NO: 8105 - DNA, 25 bp, E. coli
gatgccaatggccaaccggttaacc

SEQ ID NO: 8106 - DNA, 25 bp, E. coli
gatgccaatggcgaaccggttaacc

SEQ ID NO: 8107 - DNA, 25 bp, E. coli
caacatttcatcaacgtgatcgaga

SEQ ID NO: 8108 - DNA, 25 bp, E. coli
caacatttcatctacgtgatcgaga

SEQ ID NO: 8109 - DNA, 25 bp, E. coli
ctatcgactggagcgattccggcta

SEQ ID NO: 8110 - DNA, 25 bp, E. coli
ctatcgactggaccgattccggcta

SEQ ID NO: 8111 - DNA, 25 bp, E. coli
tacaggttccgtgtatcgactggag

SEQ ID NO: 8112 - DNA, 25 bp, E. coli
tacaggttccgtctatcgactggag

SEQ ID NO: 8113 - DNA, 25 bp, E. coli
aggttccgtctaacgactggagcga

SEQ ID NO: 8114 - DNA, 25 bp, E. coli
aggttccgtctatcgactggagcga

SEQ ID NO: 8115 - DNA, 25 bp, E. coli
tatttacaggttccgtctatcgact

SEQ ID NO: 8116 - DNA, 25 bp, E. coli
tatttacaggttgcgtctatcgact

SEQ ID NO: 8117 - DNA, 25 bp, E. coli
ttcatcaacgtgatcgagaagatgc

SEQ ID NO: 8118 - DNA, 25 bp, E. coli
ttcatcaacgtgttcgagaagatgc

SEQ ID NO: 8119 - DNA, 25 bp, E. coli
tgctctgaattaattacaggttccg

SEQ ID NO: 8120 - DNA, 25 bp, E. coli
tgctctgaattatttacaggttccg

SEQ ID NO: 8121 - DNA, 25 bp, E. coli
tccgtctatcgactggagcgattcc

SEQ ID NO: 8122 - DNA, 25 bp, E. coli
tccgtctatcgagtggagcgattcc

SEQ ID NO: 8123 - DNA, 25 bp, E. coli
tctgaattatttacaggttccgtct

SEQ ID NO: 8124 - DNA, 25 bp, E. coli
tctgaattattttcaggttccgtct

SEQ ID NO: 8125 - DNA, 25 bp, E. coli
ccataaatgctctgaattatttaca

SEQ ID NO: 8126 - DNA, 25 bp, E. coli
ccataaatgctcagaattatttaca

SEQ ID NO: 8127 - DNA, 25 bp, E. coli
cgtctatcgactggagcgattccgg

SEQ ID NO: 8128 - DNA, 25 bp, E. coli
cgtctatcgactcgagcgattccgg

SEQ ID NO: 8129 - DNA, 25 bp, E. coli
cactggatgcgaataccgaagctca

SEQ ID NO: 8130 - DNA, 25 bp, E. coli
caacgctggctgatatcaccgaaca

SEQ ID NO: 8131 - DNA, 25 bp, E. coli
caacgctggctgttatcaccgaaca

SEQ ID NO: 8132 - DNA, 25 bp, E. coli
cactggatgcgattaccgaagctca

SEQ ID NO: 8133 - DNA, 25 bp, E. coli
tactttcatatcaggatcggcaagg

SEQ ID NO: 8134 - DNA, 25 bp, E. coli
tactttcatatctggatcggcaagg

SEQ ID NO: 8135 - DNA, 25 bp, E. coli
taccagcgttctcttagatatgggc

SEQ ID NO: 8136 - DNA, 25 bp, E. coli
taccagcgttctgttagatatgggc

SEQ ID NO: 8137 - DNA, 25 bp, E. coli
tatcaacgaataagctaccagcgtt

SEQ ID NO: 8138 - DNA, 25 bp, E. coli
tatcaacgaatatgctaccagcgtt

SEQ ID NO: 8139 - DNA, 25 bp, E. coli
tgcgcagcggtttgaagcagcatcg

SEQ ID NO: 8140 - DNA, 25 bp, E. coli
tgcgcagcggttagaagcagcatcg

SEQ ID NO: 8141 - DNA, 25 bp, E. coli
tctgcctacgtattgcgggtgtact

SEQ ID NO: 8142 - DNA, 25 bp, E. coli
tctgcctacgtaatgcgggtgtact

SEQ ID NO: 8143 - DNA, 25 bp, E. coli
gctttttcaaacagcactctgccta

SEQ ID NO: 8144 - DNA, 25 bp, E. coli
gctttttcaaactgcactctgccta

SEQ ID NO: 8145 - DNA, 25 bp, E. coli
gaagctcaacgctttgcctttgccc

SEQ ID NO: 8146 - DNA, 25 bp, E. coli
gaagctcaacgcattgcctttgccc

SEQ ID NO: 8147 - DNA, 25 bp, E. coli
gaacaggattctcttagcgcactgg

SEQ ID NO: 8148 - DNA, 25 bp, E. coli
gaacaggattctgttagcgcactgg

SEQ ID NO: 8149 - DNA, 25 bp, E. coli
gatcggcaaggcaaacatggcgcaa

SEQ ID NO: 8150 - DNA, 25 bp, E. coli
gatcggcaaggctaacatggcgcaa

SEQ ID NO: 8151 - DNA, 25 bp, E. coli
caaggtaacattttctaagccgggt

SEQ ID NO: 8152 - DNA, 25 bp, E. coli
caaggtaacattatctaagccgggt

SEQ ID NO: 8153 - DNA, 25 bp, E. coli
cactgcaagcggagagcctatggca

SEQ ID NO: 8154 - DNA, 25 bp, E. coli
cactgcaagcggtgagcctatggca

SEQ ID NO: 8155 - DNA, 25 bp, E. coli
caaaagtggagagaaacaggcccca

SEQ ID NO: 8156 - DNA, 25 bp, E. coli
cagaagatgacactaccggaggaat

SEQ ID NO: 8157 - DNA, 25 bp, E. coli
caaaagtggagacaaacaggcccca

SEQ ID NO: 8158 - DNA, 25 bp, E. coli
cagaagatgacagtaccggaggaat

SEQ ID NO: 8159 - DNA, 25 bp, E. coli
taaaaaatggcggaacagcggttcc

SEQ ID NO: 8160 - DNA, 25 bp, E. coli
taaaaaatggcgcaacagcggttcc

SEQ ID NO: 8161 - DNA, 25 bp, E. coli
tgttatacagcatgtgccggcaccg

SEQ ID NO: 8162 - DNA, 25 bp, E. coli
tgttatacagcaagtgccggcaccg

SEQ ID NO: 8163 - DNA, 25 bp, E. coli
tcgggtaaacgttatggcgggcata

SEQ ID NO: 8164 - DNA, 25 bp, E. coli
tcgggtaaacgtaatggcgggcata

SEQ ID NO: 8165 - DNA, 25 bp, E. coli
tctcagttaaatagcgcttcaggtg

SEQ ID NO: 8166 - DNA, 25 bp, E. coli
tcttggtggcggaatcaacgggcac

SEQ ID NO: 8167 - DNA, 25 bp, E. coli
tcttggtggcggtatcaacgggcac

SEQ ID NO: 8168 - DNA, 25 bp, E. coli
tctcagttaaattgcgcttcaggtg

SEQ ID NO: 8169 - DNA, 25 bp, E. coli
tggatccccgaatgtgaagccactc

SEQ ID NO: 8170 - DNA, 25 bp, E. coli
tggatccccgaaagtgaagccactc

SEQ ID NO: 8171 - DNA, 25 bp, E. coli
taagccgggtggttatctctactca

SEQ ID NO: 8172 - DNA, 25 bp, E. coli
taagccgggtggatatctctactca

SEQ ID NO: 8173 - DNA, 25 bp, E. coli
aataatggctggtcatgctttaatg

SEQ ID NO: 8174 - DNA, 25 bp, E. coli
aataatggctggacatgctttaatg

SEQ ID NO: 8175 - DNA, 25 bp, E. coli
catttgagctacaattcaagctgaa

SEQ ID NO: 8176 - DNA, 25 bp, E. coli
catccgtttatttaattactcatgg

SEQ ID NO: 8177 - DNA, 25 bp, E. coli
catccgtttattaaattactcatgg

SEQ ID NO: 8178 - DNA, 25 bp, E. coli
taaattactcatcgattgtcgctgt

SEQ ID NO: 8179 - DNA, 25 bp, E. coli
taaattactcatggattgtcgctgt

SEQ ID NO: 8180 - DNA, 25 bp, E. coli
tcagttaattatctaaaaacatccg

SEQ ID NO: 8181 - DNA, 25 bp, E. coli
tctgaacaaacttaataaaccatta

SEQ ID NO: 8182 - DNA, 25 bp, E. coli
tcagttaattatgtaaaaacatccg

SEQ ID NO: 8183 - DNA, 25 bp, E. coli
tctgaacaaactaaataaaccatta

SEQ ID NO: 8184 - DNA, 25 bp, E. coli
gctttaatgttgcagtgtatcccgg

SEQ ID NO: 8185 - DNA, 25 bp, E. coli
gctttaatgttggagtgtatcccgg

SEQ ID NO: 8186 - DNA, 25 bp, E. coli
ctgaataaatatacagcacaggaga

SEQ ID NO: 8187 - DNA, 25 bp, E. coli
catttgagctactattcaagctgaa

SEQ ID NO: 8188 - DNA, 25 bp, E. coli
ctgaataaatattcagcacaggaga

SEQ ID NO: 8189 - DNA, 25 bp, E. coli
gattgtcgctgtagctcatttgagc

SEQ ID NO: 8190 - DNA, 25 bp, E. coli
gtatcccggatcgtttctgaacaaa

SEQ ID NO: 8191 - DNA, 25 bp, E. coli
gattgtcgctgttgctcatttgagc

SEQ ID NO: 8192 - DNA, 25 bp, E. coli
gtatcccggatcctttctgaacaaa

SEQ ID NO: 8193 - DNA, 25 bp, E. coli
taatgttgcagtgtatcccggatcg

SEQ ID NO: 8194 - DNA, 25 bp, E. coli
taatgttgcagtctatcccggatcg

SEQ ID NO: 8195 - DNA, 25 bp, E. coli
aagataaagcatggagcggtgactc

SEQ ID NO: 8196 - DNA, 25 bp, E. coli
aagataaagcatcgagcggtgactc

SEQ ID NO: 8197 - DNA, 25 bp, E. coli
cagttttgtggtgaaatatccctcc

SEQ ID NO: 8198 - DNA, 25 bp, E. coli
cagttttgtggtcaaatatccctcc

SEQ ID NO: 8199 - DNA, 25 bp, E. coli
tatggcgatccgtcaacaaccggat

SEQ ID NO: 8200 - DNA, 25 bp, E. coli
tatggcgatccgacaacaaccggat

SEQ ID NO: 8201 - DNA, 25 bp, E. coli
tttcacagatgggagaagtgggctt

SEQ ID NO: 8202 - DNA, 25 bp, E. coli
ttacagttccaatgggatcgccgcg

SEQ ID NO: 8203 - DNA, 25 bp, E. coli
tttcacagatggcagaagtgggctt

SEQ ID NO: 8204 - DNA, 25 bp, E. coli
ttcaccggcgctaatgttggcatgg

SEQ ID NO: 8205 - DNA, 25 bp, E. coli
ttacagttccaaagggatcgccgcg

SEQ ID NO: 8206 - DNA, 25 bp, E. coli
ttcaccggcgcttatgttggcatgg

SEQ ID NO: 8207 - DNA, 25 bp, E. coli
gcgatttggcataaaaaccgtcatg

SEQ ID NO: 8208 - DNA, 25 bp, E. coli
gcgatttggcattaaaaccgtcatg

SEQ ID NO: 8209 - DNA, 25 bp, E. coli
gactggcaaactatctggctggtgt

SEQ ID NO: 8210 - DNA, 25 bp, E. coli
gactggcaaactttctggctggtgt

SEQ ID NO: 8211 - DNA, 25 bp, E. coli
cgtaacccggagattgctgacagtt

SEQ ID NO: 8212 - DNA, 25 bp, E. coli
cgtaacccggagtttgctgacagtt

SEQ ID NO: 8213 - DNA, 25 bp, E. coli
gggatcatcgcagacaaatggctgc

SEQ ID NO: 8214 - DNA, 25 bp, E. coli
gggatcatcgcacacaaatggctgc

SEQ ID NO: 8215 - DNA, 25 bp, E. coli
taatactcttcaattcaccggcgct

SEQ ID NO: 8216 - DNA, 25 bp, E. coli
taatactcttcatttcaccggcgct

SEQ ID NO: 8217 - DNA, 25 bp, E. coli
caaaaatagtcattagtaggatgcc

SEQ ID NO: 8218 - DNA, 25 bp, E. coli
caaaaatagtcaatagtaggatgcc

SEQ ID NO: 8219 - DNA, 25 bp, E. coli
caaatggaacgctaaataaacacct

SEQ ID NO: 8220 - DNA, 25 bp, E. coli
caaatggaacgcaaaataaacacct

SEQ ID NO: 8221 - DNA, 25 bp, E. coli
tagcgttacgtgatctttccctggg

SEQ ID NO: 8222 - DNA, 25 bp, E. coli
tagtacaaaaaagtagcgttacgtg

SEQ ID NO: 8223 - DNA, 25 bp, E. coli
tagcgttacgtgttctttccctggg

SEQ ID NO: 8224 - DNA, 25 bp, E. coli
tagtacaaaaaactagcgttacgtg

SEQ ID NO: 8225 - DNA, 25 bp, E. coli
tctgacaatttaagcaccactttcc

SEQ ID NO: 8226 - DNA, 25 bp, E. coli
tctttccctgggttacaactctggc

SEQ ID NO: 8227 - DNA, 25 bp, E. coli
tctttccctgggatacaactctggc

SEQ ID NO: 8228 - DNA, 25 bp, E. coli
tctgacaatttatgcaccactttcc

SEQ ID NO: 8229 - DNA, 25 bp, E. coli
gctttagacaataagtagtatctca

SEQ ID NO: 8230 - DNA, 25 bp, E. coli
gctttagacaattagtagtatctca

SEQ ID NO: 8231 - DNA, 25 bp, E. coli
gcgttacgtgatgtttccctgcaaa

SEQ ID NO: 8232 - DNA, 25 bp, E. coli
gcgttacgtgatctttccctgcaaa

SEQ ID NO: 8233 - DNA, 25 bp, E. coli
gtaggatgcctgacaatttatgctc

SEQ ID NO: 8234 - DNA, 25 bp, E. coli
gattaatttgttatctcaggaagag

SEQ ID NO: 8235 - DNA, 25 bp, E. coli
gattaatttgttttctcaggaagag

SEQ ID NO: 8236 - DNA, 25 bp, E. coli
gtaggatgcctgtcaatttatgctc

SEQ ID NO: 8237 - DNA, 25 bp, E. coli
gatctttccctgcaaatggaacgca

SEQ ID NO: 8238 - DNA, 25 bp, E. coli
gatctttccctggaaatggaacgca

SEQ ID NO: 8239 - DNA, 25 bp, E. coli
caacccgtgcgggtgcgaatgtgct

SEQ ID NO: 8240 - DNA, 25 bp, E. coli
caacccgtgcggctgcgaatgtgct

SEQ ID NO: 8241 - DNA, 25 bp, E. coli
cagccgcgatttgcagcttctgagt

SEQ ID NO: 8242 - DNA, 25 bp, E. coli
cagccgcgatttccagcttctgagt

SEQ ID NO: 8243 - DNA, 25 bp, E. coli
ataaccgggtgcagcgtgaggcaac

SEQ ID NO: 8244 - DNA, 25 bp, E. coli
ataaccgggtgctgcgtgaggcaac

SEQ ID NO: 8245 - DNA, 25 bp, E. coli
aaaataaccgggtgctgcgtgaggc

SEQ ID NO: 8246 - DNA, 25 bp, E. coli
aaaataaccgggagctgcgtgaggc

SEQ ID NO: 8247 - DNA, 25 bp, E. coli
tgatcgaaacccagctggatttttc

SEQ ID NO: 8248 - DNA, 25 bp, E. coli
tgatcgaaaccctgctggatttttc

SEQ ID NO: 8249 - DNA, 25 bp, E. coli
gccgcaatgtggaggtcctttcccg

SEQ ID NO: 8250 - DNA, 25 bp, E. coli
gccgcaatgtggtggtcctttcccg

SEQ ID NO: 8251 - DNA, 25 bp, E. coli
gcgatttgcagcatctgagtggtgc

SEQ ID NO: 8252 - DNA, 25 bp, E. coli
tcgaaaccctgctggatttttcggg

SEQ ID NO: 8253 - DNA, 25 bp, E. coli
tcgaaaccctgcaggatttttcggg

SEQ ID NO: 8254 - DNA, 25 bp, E. coli
gcgatttgcagcttctgagtggtgc

SEQ ID NO: 8255 - DNA, 25 bp, E. coli
gacatcagccgccatttgcagcttc

SEQ ID NO: 8256 - DNA, 25 bp, E. coli
gacatcagccgcgatttgcagcttc

SEQ ID NO: 8257 - DNA, 25 bp, E. coli
cgggtgcgaatgagctgaaagaaga

SEQ ID NO: 8258 - DNA, 25 bp, E. coli
cgggtgcgaatgtgctgaaagaaga

SEQ ID NO: 8259 - DNA, 25 bp, E. coli
ggctggaggacaacagccgcgattt

SEQ ID NO: 8260 - DNA, 25 bp, E. coli
ggctggaggacatcagccgcgattt

SEQ ID NO: 8261 - DNA, 25 bp, E. coli
agtgagactctaaacgaaattggtg

SEQ ID NO: 8262 - DNA, 25 bp, E. coli
agtgagactctatacgaaattggtg

SEQ ID NO: 8263 - DNA, 25 bp, E. coli
aaaataaacgaaagcgtatgcaacc

SEQ ID NO: 8264 - DNA, 25 bp, E. coli
aaaataaacgaatgcgtatgcaacc

SEQ ID NO: 8265 - DNA, 25 bp, E. coli
tagtgttgcgtgatattttaaccag

SEQ ID NO: 8266 - DNA, 25 bp, E. coli
tatgcaaccccgaaattttggtgag

SEQ ID NO: 8267 - DNA, 25 bp, E. coli
tatgcaaccccgtaattttggtgag

SEQ ID NO: 8268 - DNA, 25 bp, E. coli
tagtgttgcgtgttattttaaccag

SEQ ID NO: 8269 - DNA, 25 bp, E. coli
tgtgaaaaatgggtttaactcggtt

SEQ ID NO: 8270 - DNA, 25 bp, E. coli
ttggtgagaccctaaatcgattttg

SEQ ID NO: 8271 - DNA, 25 bp, E. coli
tgttcatatcataatgcatctcaga

SEQ ID NO: 8272 - DNA, 25 bp, E. coli
tgttcatatcattatgcatctcaga

SEQ ID NO: 8273 - DNA, 25 bp, E. coli
ttggtgagacccaaaatcgattttg

SEQ ID NO: 8274 - DNA, 25 bp, E. coli
tcgtggaaaagtggagcaaaatgtt

SEQ ID NO: 8275 - DNA, 25 bp, E. coli
tcgtggaaaagtcgagcaaaatgtt

SEQ ID NO: 8276 - DNA, 25 bp, E. coli
ccgggcggactctaggaagaagaat

SEQ ID NO: 8277 - DNA, 25 bp, E. coli
ccgggcggactcaaggaagaagaat

SEQ ID NO: 8278 - DNA, 25 bp, E. coli
gcatatttgtatgtacacgttcgaa

SEQ ID NO: 8279 - DNA, 25 bp, E. coli
gcatatttgtatctacacgttcgaa

SEQ ID NO: 8280 - DNA, 25 bp, E. coli
gatttcaagttgattggtcgtggaa

SEQ ID NO: 8281 - DNA, 25 bp, E. coli
gatttcaagttgtttggtcgtggaa

SEQ ID NO: 8282 - DNA, 25 bp, E. coli
tgtgaaaaatggctttaactcggtt

SEQ ID NO: 8283 - DNA, 25 bp, E. coli
caagcaaatcattctgtctctttag

SEQ ID NO: 8284 - DNA, 25 bp, E. coli
aagtgttatttaagcaacaagcaaa

SEQ ID NO: 8285 - DNA, 25 bp, E. coli
caaatcattctgactctttagacaa

SEQ ID NO: 8286 - DNA, 25 bp, E. coli
caaatcattctgtctctttagacaa

SEQ ID NO: 8287 - DNA, 25 bp, E. coli
aagtgttatttatgcaacaagcaaa

SEQ ID NO: 8288 - DNA, 25 bp, E. coli
caagcaaatcatactgtctctttag

SEQ ID NO: 8289 - DNA, 25 bp, E. coli
caaagtgttatttaagcaacaagca

SEQ ID NO: 8290 - DNA, 25 bp, E. coli
caaagtgttattaaagcaacaagca

SEQ ID NO: 8291 - DNA, 25 bp, E. coli
agcaaatcattctgtctctttagac

SEQ ID NO: 8292 - DNA, 25 bp, E. coli
agcaaatcattcagtctctttagac

SEQ ID NO: 8293 - DNA, 25 bp, E. coli
ttctgtctcttttgacaaattttga

SEQ ID NO: 8294 - DNA, 25 bp, E. coli
ttctgtctctttagacaaattttga

SEQ ID NO: 8295 - DNA, 25 bp, E. coli
tttaagcaacaagcaaatcattctg

SEQ ID NO: 8296 - DNA, 25 bp, E. coli
tttaagcaacaaccaaatcattctg

SEQ ID NO: 8297 - DNA, 25 bp, E. coli
gcaacaagcaaaacattctgtctct

SEQ ID NO: 8298 - DNA, 25 bp, E. coli
gcaacaagcaaatcattctgtctct

SEQ ID NO: 8299 - DNA, 25 bp, E. coli
gttatttaagcatcaagcaaatcat

SEQ ID NO: 8300 - DNA, 25 bp, E. coli
gttatttaagcaacaagcaaatcat

SEQ ID NO: 8301 - DNA, 25 bp, E. coli
taagcaacaagcaaatcattctgtc

SEQ ID NO: 8302 - DNA, 25 bp, E. coli
taagcaacaagctaatcattctgtc

SEQ ID NO: 8303 - DNA, 25 bp, E. coli
gtgttatttaaggaacaagcaaatc

SEQ ID NO: 8304 - DNA, 25 bp, E. coli
gtgttatttaagcaacaagcaaatc

SEQ ID NO: 8305 - DNA, 25 bp, E. coli
aatgcgttgcagttttgtagccgaa

SEQ ID NO: 8306 - DNA, 25 bp, E. coli
aatgcgttgcagatttgtagccgaa

SEQ ID NO: 8307 - DNA, 25 bp, E. coli
cagaacattgttttctcacccacgg

SEQ ID NO: 8308 - DNA, 25 bp, E. coli
cagaacattgttatctcacccacgg

SEQ ID NO: 8309 - DNA, 25 bp, E. coli
tactccggacgagtttattacagcg

SEQ ID NO: 8310 - DNA, 25 bp, E. coli
tactccggacgactttattacagcg

SEQ ID NO: 8311 - DNA, 25 bp, E. coli
atgcgtcaggcactccttatgggag

SEQ ID NO: 8312 - DNA, 25 bp, E. coli
atgcgtcaggcagtccttatgggag

SEQ ID NO: 8313 - DNA, 25 bp, E. coli
tagtgtcaaaacgatgcctgatgca

SEQ ID NO: 8314 - DNA, 25 bp, E. coli
tagtgtcaaaaccatgcctgatgca

SEQ ID NO: 8315 - DNA, 25 bp, E. coli
ttacgaaatgatcgcgcaatactgc

SEQ ID NO: 8316 - DNA, 25 bp, E. coli
ttacgaaatgatggcgcaatactgc

SEQ ID NO: 8317 - DNA, 25 bp, E. coli
tgcacgaacgttatgcgaaccagag

SEQ ID NO: 8318 - DNA, 25 bp, E. coli
tgcacgaacgttttgcgaaccagag

SEQ ID NO: 8319 - DNA, 25 bp, E. coli
ccggccatccgaatttagtgtcaaa

SEQ ID NO: 8320 - DNA, 25 bp, E. coli
ccggctatcgtggtaatgaactgca

SEQ ID NO: 8321 - DNA, 25 bp, E. coli
ccggccatccgattttagtgtcaaa

SEQ ID NO: 8322 - DNA, 25 bp, E. coli
ccggctatcgtgctaatgaactgca

SEQ ID NO: 8323 - DNA, 25 bp, E. coli
gcaatggaaaatcatgttaccctgg

SEQ ID NO: 8324 - DNA, 25 bp, E. coli
gaattattttagacaccggctatcg

SEQ ID NO: 8325 - DNA, 25 bp, E. coli
gcaatggaaaatgatgttaccctgg

SEQ ID NO: 8326 - DNA, 25 bp, E. coli
gaattattttagtcaccggctatcg

SEQ ID NO: 8327 - DNA, 25 bp, E. coli
aagcgtgacgcatcagcggttaatc

SEQ ID NO: 8328 - DNA, 25 bp, E. coli
aatcaacatgttctggcgatcctcg

SEQ ID NO: 8329 - DNA, 25 bp, E. coli
aagcgtgacgcaacagcggttaatc

SEQ ID NO: 8330 - DNA, 25 bp, E. coli
aatcaacatgttgtggcgatcctcg

SEQ ID NO: 8331 - DNA, 25 bp, E. coli
catccaaaactctaactggttgccg

SEQ ID NO: 8332 - DNA, 25 bp, E. coli
catccaaaactcaaactggttgccg

SEQ ID NO: 8333 - DNA, 25 bp, E. coli
catataggcggaatacgcgcttcgt

SEQ ID NO: 8334 - DNA, 25 bp, E. coli
catataggcggattacgcgcttcgt

SEQ ID NO: 8335 - DNA, 25 bp, E. coli
tatgtaaagtcaaaggcaatggcgt

SEQ ID NO: 8336 - DNA, 25 bp, E. coli
tatgtaaagtcataggcaatggcgt

SEQ ID NO: 8337 - DNA, 25 bp, E. coli
gaagcggtgtcagaaattcgtggca

SEQ ID NO: 8338 - DNA, 25 bp, E. coli
gaagcggtgtcacaaattcgtggca

SEQ ID NO: 8339 - DNA, 25 bp, E. coli
gaactggtcaatttccgccgcactg

SEQ ID NO: 8340 - DNA, 25 bp, E. coli
gaactggtcaatatccgccgcactg

SEQ ID NO: 8341 - DNA, 25 bp, E. coli
cgcgtcgttacccatgaagcggtag

SEQ ID NO: 8342 - DNA, 25 bp, E. coli
cccggcggaagtggatgaactcaca

SEQ ID NO: 8343 - DNA, 25 bp, E. coli
cgcgtcgttaccgatgaagcggtag

SEQ ID NO: 8344 - DNA, 25 bp, E. coli
cccggcggaagtcgatgaactcaca

SEQ ID NO: 8345 - DNA, 25 bp, E. coli
gatcaacaggcccatctgagccaac

SEQ ID NO: 8346 - DNA, 25 bp, E. coli
gatcaacaggccgatctgagccaac

SEQ ID NO: 8347 - DNA, 25 bp, E. coli
tcacaggctgtgtcttcggcgcgat

SEQ ID NO: 8348 - DNA, 25 bp, E. coli
tcacaggctgtgacttcggcgcgat

SEQ ID NO: 8349 - DNA, 25 bp, E. coli
accgctgctcggagcgaaagaaaag

SEQ ID NO: 8350 - DNA, 25 bp, E. coli
accgctgctcggtgcgaaagaaaag

SEQ ID NO: 8351 - DNA, 25 bp, E. coli
tgattctgccttatacctgcaacag

SEQ ID NO: 8352 - DNA, 25 bp, E. coli
tgattctgccttttacctgcaacag

SEQ ID NO: 8353 - DNA, 25 bp, E. coli
ccttttacctgcaacagatgcagca

SEQ ID NO: 8354 - DNA, 25 bp, E. coli
ccttttacctgctacagatgcagca

SEQ ID NO: 8355 - DNA, 25 bp, E. coli
gcaacagatgcaccaaagttctgat

SEQ ID NO: 8356 - DNA, 25 bp, E. coli
gcagcagaatattgacgccacatgg

SEQ ID NO: 8357 - DNA, 25 bp, E. coli
gcagcagaatatagacgccacatgg

SEQ ID NO: 8358 - DNA, 25 bp, E. coli
gcaacagatgcagcaaagttctgat

SEQ ID NO: 8359 - DNA, 25 bp, E. coli
cggtgcgaaagataagcagcagaat

SEQ ID NO: 8360 - DNA, 25 bp, E. coli
cggtgcgaaagaaaagcagcagaat

SEQ ID NO: 8361 - DNA, 25 bp, E. coli
ggtggcccaggtagcagccgcacct

SEQ ID NO: 8362 - DNA, 25 bp, E. coli
ggtggcccaggttgcagccgcacct

SEQ ID NO: 8363 - DNA, 25 bp, E. coli
gtgttgtttcatagtgtcgtccgta

SEQ ID NO: 8364 - DNA, 25 bp, E. coli
gtgttgtttcattgtgtcgtccgta

SEQ ID NO: 8365 - DNA, 25 bp, E. coli
tggatacattatcgtaccctcaaca

SEQ ID NO: 8366 - DNA, 25 bp, E. coli
tggatacattatggtaccctcaaca

SEQ ID NO: 8367 - DNA, 25 bp, E. coli
tcactggatacattatggtaccctc

SEQ ID NO: 8368 - DNA, 25 bp, E. coli
tcactggatacaatatggtaccctc

SEQ ID NO: 8369 - DNA, 25 bp, E. coli
tcagccagtggtggcccaggtagca

SEQ ID NO: 8370 - DNA, 25 bp, E. coli
tcagccagtggtcgcccaggtagca

SEQ ID NO: 8371 - DNA, 25 bp, E. coli
cagaatgcaatggaaaatcaggaag

SEQ ID NO: 8372 - DNA, 25 bp, E. coli
cagaatgcaatgcaaaatcaggaag

SEQ ID NO: 8373 - DNA, 25 bp, E. coli
taaatcgccgcatcggcagaatgca

SEQ ID NO: 8374 - DNA, 25 bp, E. coli
taaatcgccgcaacggcagaatgca

SEQ ID NO: 8375 - DNA, 25 bp, E. coli
aaggaagattcctgaatttctttgc

SEQ ID NO: 8376 - DNA, 25 bp, E. coli
atagcactaaatcgccgcaacggca

SEQ ID NO: 8377 - DNA, 25 bp, E. coli
aaggaagattccagaatttctttgc

SEQ ID NO: 8378 - DNA, 25 bp, E. coli
atagcactaaatggccgcaacggca

SEQ ID NO: 8379 - DNA, 25 bp, E. coli
aaatagcactaaatcgccgcaacgg

SEQ ID NO: 8380 - DNA, 25 bp, E. coli
aaatagcactaattcgccgcaacgg

SEQ ID NO: 8381 - DNA, 25 bp, E. coli
tcgccgcaacgggagaatgcaatgc

SEQ ID NO: 8382 - DNA, 25 bp, E. coli
tcgccgcaacggcagaatgcaatgc

SEQ ID NO: 8383 - DNA, 25 bp, E. coli
tcaggaaggaagattccagaatttc

SEQ ID NO: 8384 - DNA, 25 bp, E. coli
tcaggaaggaagtttccagaatttc

SEQ ID NO: 8385 - DNA, 25 bp, E. coli
gccgcaacggcacaatgcaatgcaa

SEQ ID NO: 8386 - DNA, 25 bp, E. coli
gccgcaacggcagaatgcaatgcaa

SEQ ID NO: 8387 - DNA, 25 bp, E. coli
gctcgaaaataggactaaatcgccg

SEQ ID NO: 8388 - DNA, 25 bp, E. coli
gctcgaaaatagcactaaatcgccg

SEQ ID NO: 8389 - DNA, 25 bp, E. coli
gcaacggcagaaagcaatgcaaaat

SEQ ID NO: 8390 - DNA, 25 bp, E. coli
gcaacggcagaatgcaatgcaaaat

SEQ ID NO: 8391 - DNA, 25 bp, E. coli
cggcagaatgcaatgcaaaatcagg

SEQ ID NO: 8392 - DNA, 25 bp, E. coli
cggcagaatgcattgcaaaatcagg

SEQ ID NO: 8393 - DNA, 25 bp, E. coli
aattactggcgggagttccggtcgc

SEQ ID NO: 8394 - DNA, 25 bp, E. coli
aattactggcggcagttccggtcgc

SEQ ID NO: 8395 - DNA, 25 bp, E. coli
attgttggcgaatccggctccggta

SEQ ID NO: 8396 - DNA, 25 bp, E. coli
attgttggcgaaaccggctccggta

SEQ ID NO: 8397 - DNA, 25 bp, E. coli
aaagtgatcattgccgacgaagccg

SEQ ID NO: 8398 - DNA, 25 bp, E. coli
aaagtgatcattcccgacgaagccg

SEQ ID NO: 8399 - DNA, 25 bp, E. coli
ttgttgaaattggtccacggcgcgc

SEQ ID NO: 8400 - DNA, 25 bp, E. coli
ttgttgaaattgctccacggcgcgc

SEQ ID NO: 8401 - DNA, 25 bp, E. coli
tgatctctggcctggcgaaacgcta

SEQ ID NO: 8402 - DNA, 25 bp, E. coli
tgatctctggccaggcgaaacgcta

SEQ ID NO: 8403 - DNA, 25 bp, E. coli
gaagtgcatgccgttgagaaagtca

SEQ ID NO: 8404 - DNA, 25 bp, E. coli
gaagtgcatgcccttgagaaagtca

SEQ ID NO: 8405 - DNA, 25 bp, E. coli
gaacagatttttgatgcaccgcaac

SEQ ID NO: 8406 - DNA, 25 bp, E. coli
gaacagatttttcatgcaccgcaac

SEQ ID NO: 8407 - DNA, 25 bp, E. coli
cgcagggcggcgtaattatctttaa

SEQ ID NO: 8408 - DNA, 25 bp, E. coli
cgcagggcggcgaaattatctttaa

SEQ ID NO: 8409 - DNA, 25 bp, E. coli
gatctccagcgtcatttcggcattg

SEQ ID NO: 8410 - DNA, 25 bp, E. coli
tggatgtcactaatcaggcgcagat

SEQ ID NO: 8411 - DNA, 25 bp, E. coli
tggatgtcactattcaggcgcagat

SEQ ID NO: 8412 - DNA, 25 bp, E. coli
tcagaacgccagtcgtgaagaagcg

SEQ ID NO: 8413 - DNA, 25 bp, E. coli
tcagaacgccagacgtgaagaagcg

SEQ ID NO: 8414 - DNA, 25 bp, E. coli
gatctccagcgtgatttcggcattg

SEQ ID NO: 8415 - DNA, 25 bp, E. coli
cacaactgctggtactggagtgcgt

SEQ ID NO: 8416 - DNA, 25 bp, E. coli
cacaactgctggaactggagtgcgt

SEQ ID NO: 8417 - DNA, 25 bp, E. coli
taaaaagcgttttgcgaccatcacc

SEQ ID NO: 8418 - DNA, 25 bp, E. coli
taaaaagcgtttagcgaccatcacc

SEQ ID NO: 8419 - DNA, 25 bp, E. coli
taccggttaccgttgctgatatcgc

SEQ ID NO: 8420 - DNA, 25 bp, E. coli
taccggttaccgatgctgatatcgc

SEQ ID NO: 8421 - DNA, 25 bp, E. coli
tttgccgaagaacgacttaacgtca

SEQ ID NO: 8422 - DNA, 25 bp, E. coli
tttgccgaagaaggacttaacgtca

SEQ ID NO: 8423 - DNA, 25 bp, E. coli
gaaatgcaagcaggataaaaagcgt

SEQ ID NO: 8424 - DNA, 25 bp, E. coli
gaaatgcaagcacgataaaaagcgt

SEQ ID NO: 8425 - DNA, 25 bp, E. coli
cgcaacggtaatgcgtgccggagcc

SEQ ID NO: 8426 - DNA, 25 bp, E. coli
cgcaacggtaatccgtgccggagcc

SEQ ID NO: 8427 - DNA, 25 bp, E. coli
cgtgccgttccagtttgtggtcatt

SEQ ID NO: 8428 - DNA, 25 bp, E. coli
cgtgccgttccactttgtggtcatt

SEQ ID NO: 8429 - DNA, 25 bp, E. coli
gttagcagacctgccatttatggcg

SEQ ID NO: 8430 - DNA, 25 bp, E. coli
gtgcgccaaactgccttctgttagc

SEQ ID NO: 8431 - DNA, 25 bp, E. coli
gtgcgccaaactcccttctgttagc

SEQ ID NO: 8432 - DNA, 25 bp, E. coli
gttagcagacctcccatttatggcg

SEQ ID NO: 8433 - DNA, 25 bp, E. coli
gggcatgactccacgctaccggtta

SEQ ID NO: 8434 - DNA, 25 bp, E. coli
ggtcatttaggcgtaaccccacagt

SEQ ID NO: 8435 - DNA, 25 bp, E. coli
ggtcatttaggcctaaccccacagt

SEQ ID NO: 8436 - DNA, 25 bp, E. coli
gggcatgactcctcgctaccggtta

SEQ ID NO: 8437 - DNA, 25 bp, E. coli
caagcaataattctgccagtgttga

SEQ ID NO: 8438 - DNA, 25 bp, E. coli
caagcaataattgtgccagtgttga

SEQ ID NO: 8439 - DNA, 25 bp, E. coli
catctttagctttaaaatctcttta

SEQ ID NO: 8440 - DNA, 25 bp, E. coli
catctttagcttaaaaatctcttta

SEQ ID NO: 8441 - DNA, 25 bp, E. coli
catctctgttaatcgggtaacctga

SEQ ID NO: 8442 - DNA, 25 bp, E. coli
catctctgttaaacgggtaacctga

SEQ ID NO: 8443 - DNA, 25 bp, E. coli
atcgcctcccattaactattgccag

SEQ ID NO: 8444 - DNA, 25 bp, E. coli
atcgcctcccataaactattgccag

SEQ ID NO: 8445 - DNA, 25 bp, E. coli
aaaatgcttaaacctggcatctctg

SEQ ID NO: 8446 - DNA, 25 bp, E. coli
aaagctggcatcactgttaaacggg

SEQ ID NO: 8447 - DNA, 25 bp, E. coli
aaaatgcttaaagctggcatctctg

SEQ ID NO: 8448 - DNA, 25 bp, E. coli
aaagctggcatctctgttaaacggg

SEQ ID NO: 8449 - DNA, 25 bp, E. coli
tgccagctacaagcaataattgtgc

SEQ ID NO: 8450 - DNA, 25 bp, E. coli
tgccagctacaaccaataattgtgc

SEQ ID NO: 8451 - DNA, 25 bp, E. coli
ccattaactattgccagctacaagc

SEQ ID NO: 8452 - DNA, 25 bp, E. coli
ccattaactattcccagctacaagc

SEQ ID NO: 8453 - DNA, 25 bp, E. coli
gctggcatctctcttaaacgggtaa

SEQ ID NO: 8454 - DNA, 25 bp, E. coli
gctggcatctctgttaaacgggtaa

SEQ ID NO: 8455 - DNA, 25 bp, E. coli
gacgaaattcatgtttagcttaaaa

SEQ ID NO: 8456 - DNA, 25 bp, E. coli
gacgaaattcatctttagcttaaaa

SEQ ID NO: 8457 - DNA, 25 bp, E. coli
cggcgacgaaatacatctttagctt

SEQ ID NO: 8458 - DNA, 25 bp, E. coli
cggcgacgaaattcatctttagctt

SEQ ID NO: 8459 - DNA, 25 bp, E. coli
caacaggaattgatgccgaaggccc

SEQ ID NO: 8460 - DNA, 25 bp, E. coli
caacaggaattgttgccgaaggccc

SEQ ID NO: 8461 - DNA, 25 bp, E. coli
tatgggccgggctagataaacaggt

SEQ ID NO: 8462 - DNA, 25 bp, E. coli
tatgggccgggcaagataaacaggt

SEQ ID NO: 8463 - DNA, 25 bp, E. coli
tataacgcaccaggaaatcagggac

SEQ ID NO: 8464 - DNA, 25 bp, E. coli
tataacgcaccacgaaatcagggac

SEQ ID NO: 8465 - DNA, 25 bp, E. coli
tccttcggttaaagggcacgcctac

SEQ ID NO: 8466 - DNA, 25 bp, E. coli
tccttcggttaatgggcacgcctac

SEQ ID NO: 8467 - DNA, 25 bp, E. coli
gcatttttagcagcgagtcccgcgg

SEQ ID NO: 8468 - DNA, 25 bp, E. coli
gctacgctgggaaaaacgaccttat

SEQ ID NO: 8469 - DNA, 25 bp, E. coli
gctacgctgggataaacgaccttat

SEQ ID NO: 8470 - DNA, 25 bp, E. coli
gcatttttagcaccgagtcccgcgg

SEQ ID NO: 8471 - DNA, 25 bp, E. coli
cccgcggcgaagagtgctgttaata

SEQ ID NO: 8472 - DNA, 25 bp, E. coli
cccgcggcgaagtgtgctgttaata

SEQ ID NO: 8473 - DNA, 25 bp, E. coli
gtcatcagcaataaccagcgcgtgg

SEQ ID NO: 8474 - DNA, 25 bp, E. coli
gtcatcagcaattaccagcgcgtgg

SEQ ID NO: 8475 - DNA, 25 bp, E. coli
taacgttacaagaatggcagcaggc

SEQ ID NO: 8476 - DNA, 25 bp, E. coli
taagcagcttaactctggagcaccg

SEQ ID NO: 8477 - DNA, 25 bp, E. coli
taagcagcttaagtctggagcaccg

SEQ ID NO: 8478 - DNA, 25 bp, E. coli
taacgttacaagtatggcagcaggc

SEQ ID NO: 8479 - DNA, 25 bp, E. coli
tcaatcatgagcataaacccggcgc

SEQ ID NO: 8480 - DNA, 25 bp, E. coli
tcaatcatgagcttaaacccggcgc

SEQ ID NO: 8481 - DNA, 25 bp, E. coli
atgacaccgggcctaccacggctga

SEQ ID NO: 8482 - DNA, 25 bp, E. coli
atgacaccgggcgtaccacggctga

SEQ ID NO: 8483 - DNA, 25 bp, E. coli
acaccgggcgtaccacggctgagat

SEQ ID NO: 8484 - DNA, 25 bp, E. coli
acaccgggcgtagcacggctgagat

SEQ ID NO: 8485 - DNA, 25 bp, E. coli
tcgtgccggacggtgacttttatcg

SEQ ID NO: 8486 - DNA, 25 bp, E. coli
tcgtgccggacgctgacttttatcg

SEQ ID NO: 8487 - DNA, 25 bp, E. coli
ccgggcgtaccacggctgagatcat

SEQ ID NO: 8488 - DNA, 25 bp, E. coli
gccggacggtgagttttatcgctat

SEQ ID NO: 8489 - DNA, 25 bp, E. coli
gccggacggtgacttttatcgctat

SEQ ID NO: 8490 - DNA, 25 bp, E. coli
ccgggcgtaccagggctgagatcat

SEQ ID NO: 8491 - DNA, 25 bp, E. coli
gacttttatcgcaatgcgctgacaa

SEQ ID NO: 8492 - DNA, 25 bp, E. coli
gacttttatcgctatgcgctgacaa

SEQ ID NO: 8493 - DNA, 25 bp, E. coli
cggacggtgacttttatcgctatgc

SEQ ID NO: 8494 - DNA, 25 bp, E. coli
cggacggtgactattatcgctatgc

SEQ ID NO: 8495 - DNA, 25 bp, E. coli
cttttatcgctatgcgctgacaaaa

SEQ ID NO: 8496 - DNA, 25 bp, E. coli
cttttatcgctaagcgctgacaaaa

SEQ ID NO: 8497 - DNA, 25 bp, E. coli
ggtgacttttatggctatgcgctga

SEQ ID NO: 8498 - DNA, 25 bp, E. coli
ggtgacttttatcgctatgcgctga

SEQ ID NO: 8499 - DNA, 25 bp, E. coli
gtgccggacggtgacttttatcgct

SEQ ID NO: 8500 - DNA, 25 bp, E. coli
gtgccggacggtcacttttatcgct

SEQ ID NO: 8501 - DNA, 25 bp, E. coli
gacggtgacttttatcgctatgcgc

SEQ ID NO: 8502 - DNA, 25 bp, E. coli
gacggtgactttaatcgctatgcgc

SEQ ID NO: 8503 - DNA, 25 bp, E. coli
aacgcaacgtcacgcgctgtatcgc

SEQ ID NO: 8504 - DNA, 25 bp, E. coli
catgacgaaacgcaacgtcaggcgc

SEQ ID NO: 8505 - DNA, 25 bp, E. coli
catgacgaaacggaacgtcaggcgc

SEQ ID NO: 8506 - DNA, 25 bp, E. coli
atgacgaaacgcaacgtcaggcgct

SEQ ID NO: 8507 - DNA, 25 bp, E. coli
atgacgaaacgctacgtcaggcgct

SEQ ID NO: 8508 - DNA, 25 bp, E. coli
acgcaacgtcaggcgctgtatcgcg

SEQ ID NO: 8509 - DNA, 25 bp, E. coli
aaacgcaacgtcaggcgctgtatcg

SEQ ID NO: 8510 - DNA, 25 bp, E. coli
acgcaacgtcagccgctgtatcgcg

SEQ ID NO: 8511 - DNA, 25 bp, E. coli
acgaaacgcaacgtcaggcgctgta

SEQ ID NO: 8512 - DNA, 25 bp, E. coli
aacgcaacgtcaggcgctgtatcgc

SEQ ID NO: 8513 - DNA, 25 bp, E. coli
aaacgcaacgtctggcgctgtatcg

SEQ ID NO: 8514 - DNA, 25 bp, E. coli
acgaaacgcaacctcaggcgctgta

SEQ ID NO: 8515 - DNA, 25 bp, E. coli
tgacgaaacgcatcgtcaggcgctg

SEQ ID NO: 8516 - DNA, 25 bp, E. coli
tgacgaaacgcaacgtcaggcgctg

SEQ ID NO: 8517 - DNA, 25 bp, E. coli
gacgaaacgcaaggtcaggcgctgt

SEQ ID NO: 8518 - DNA, 25 bp, E. coli
gaaacgcaacgtcaggcgctgtatc

SEQ ID NO: 8519 - DNA, 25 bp, E. coli
gaaacgcaacgtgaggcgctgtatc

SEQ ID NO: 8520 - DNA, 25 bp, E. coli
gacgaaacgcaacgtcaggcgctgt

SEQ ID NO: 8521 - DNA, 25 bp, E. coli
cgaaacgcaacgacaggcgctgtat

SEQ ID NO: 8522 - DNA, 25 bp, E. coli
cgaaacgcaacgtcaggcgctgtat

SEQ ID NO: 8523 - DNA, 25 bp, E. coli
gcgattaaaaagttcacctttaacg

SEQ ID NO: 8524 - DNA, 25 bp, E. coli
gcgattaaaaagatcacctttaacg

SEQ ID NO: 8525 - DNA, 25 bp, E. coli
cactttctgcttccgtagtcacagc

SEQ ID NO: 8526 - DNA, 25 bp, E. coli
cactttctgcttgcgtagtcacagc

SEQ ID NO: 8527 - DNA, 25 bp, E. coli
tacactttctgcttccgtagtcaca

SEQ ID NO: 8528 - DNA, 25 bp, E. coli
tacactttctgcatccgtagtcaca

SEQ ID NO: 8529 - DNA, 25 bp, E. coli
acctgtacacttactgcttccgtag

SEQ ID NO: 8530 - DNA, 25 bp, E. coli
agtcacagcttcagagaatgaccag

SEQ ID NO: 8531 - DNA, 25 bp, E. coli
agtcacagcttctgagaatgaccag

SEQ ID NO: 8532 - DNA, 25 bp, E. coli
acctgtacactttctgcttccgtag

SEQ ID NO: 8533 - DNA, 25 bp, E. coli
aacacctgtacagtttctgcttccg

SEQ ID NO: 8534 - DNA, 25 bp, E. coli
aacacctgtacactttctgcttccg

SEQ ID NO: 8535 - DNA, 25 bp, E. coli
tgtttctcagaagacctgtacactt

SEQ ID NO: 8536 - DNA, 25 bp, E. coli
tgtttctcagaacacctgtacactt

SEQ ID NO: 8537 - DNA, 25 bp, E. coli
tgaaaactgtttgtcagaacacctg

SEQ ID NO: 8538 - DNA, 25 bp, E. coli
tgaaaactgtttctcagaacacctg

SEQ ID NO: 8539 - DNA, 25 bp, E. coli
tccgtagtcacaccttcagagaatg

SEQ ID NO: 8540 - DNA, 25 bp, E. coli
tccgtagtcacagcttcagagaatg

SEQ ID NO: 8541 - DNA, 25 bp, E. coli
tctgcttccgtactcacagcttcag

SEQ ID NO: 8542 - DNA, 25 bp, E. coli
tctgcttccgtagtcacagcttcag

SEQ ID NO: 8543 - DNA, 25 bp, E. coli
gcttccgtagtcacagcttcagaga

SEQ ID NO: 8544 - DNA, 25 bp, E. coli
gcttccgtagtctcagcttcagaga

SEQ ID NO: 8545 - DNA, 25 bp, E. coli
cgtagtcacagcttcagagaatgac

SEQ ID NO: 8546 - DNA, 25 bp, E. coli
cgtagtcacagcatcagagaatgac

SEQ ID NO: 8547 - DNA, 25 bp, E. coli
tatatactgctactggtgagtgcgt

SEQ ID NO: 8548 - DNA, 25 bp, E. coli
tatatactgctagtggtgagtgcgt

SEQ ID NO: 8549 - DNA, 25 bp, E. coli
tgtcggttttgatcgtaccgcgaat

SEQ ID NO: 8550 - DNA, 25 bp, E. coli
tgtcggttttgaacgtaccgcgaat

SEQ ID NO: 8551 - DNA, 25 bp, E. coli
tgaacgtaccgccaatcacgataat

SEQ ID NO: 8552 - DNA, 25 bp, E. coli
tgaacgtaccgcgaatcacgataat

SEQ ID NO: 8553 - DNA, 25 bp, E. coli
tgctactggtgactgcgttacgcca

SEQ ID NO: 8554 - DNA, 25 bp, E. coli
tgctactggtgagtgcgttacgcca

SEQ ID NO: 8555 - DNA, 25 bp, E. coli
tgcgttacgccaggccgtgaactgg

SEQ ID NO: 8556 - DNA, 25 bp, E. coli
tgaaacccacttaatatactgctac

SEQ ID NO: 8557 - DNA, 25 bp, E. coli
tgaaacccactttatatactgctac

SEQ ID NO: 8558 - DNA, 25 bp, E. coli
tgcgttacgccacgccgtgaactgg

SEQ ID NO: 8559 - DNA, 25 bp, E. coli
tccgctgtcgatgttaccgggcgat

SEQ ID NO: 8560 - DNA, 25 bp, E. coli
tccgctgtcgatcttaccgggcgat

SEQ ID NO: 8561 - DNA, 25 bp, E. coli
cgacagcaaagtcgtgttgatcgat

SEQ ID NO: 8562 - DNA, 25 bp, E. coli
cgatagtgactcctttcagattaac

SEQ ID NO: 8563 - DNA, 25 bp, E. coli
cgaacgaagcggtaacgcctgcaga

SEQ ID NO: 8564 - DNA, 25 bp, E. coli
cgacagcaaagtggtgttgatcgat

SEQ ID NO: 8565 - DNA, 25 bp, E. coli
cgaacgaagcggaaacgcctgcaga

SEQ ID NO: 8566 - DNA, 25 bp, E. coli
cgatagtgactcgtttcagattaac

SEQ ID NO: 8567 - DNA, 25 bp, E. coli
gtggtgttgatcgatagtgactcct

SEQ ID NO: 8568 - DNA, 25 bp, E. coli
gtggtgttgatccatagtgactcct

SEQ ID NO: 8569 - DNA, 25 bp, E. coli
aacgtatcgattcgcgctaacgcgg

SEQ ID NO: 8570 - DNA, 25 bp, E. coli
caaaatcggtgcaggttcgcgtctc

SEQ ID NO: 8571 - DNA, 25 bp, E. coli
caaattttagattccacgccgcagc

SEQ ID NO: 8572 - DNA, 25 bp, E. coli
caaaatcggtgctggttcgcgtctc

SEQ ID NO: 8573 - DNA, 25 bp, E. coli
cagaattgcctgttccagtccggaa

SEQ ID NO: 8574 - DNA, 25 bp, E. coli
caaattttagataccacgccgcagc

SEQ ID NO: 8575 - DNA, 25 bp, E. coli
cagaattgcctgatccagtccggaa

SEQ ID NO: 8576 - DNA, 25 bp, E. coli
catttaggcttgtgccaggcgtccg

SEQ ID NO: 8577 - DNA, 25 bp, E. coli
aaagtctggcgctaaaccgctgcac

SEQ ID NO: 8578 - DNA, 25 bp, E. coli
aaagtctggcgcaaaaccgctgcac

SEQ ID NO: 8579 - DNA, 25 bp, E. coli
aacgtatcgattggcgctaacgcgg

SEQ ID NO: 8580 - DNA, 25 bp, E. coli
tatgcgacaaagagacggttacggg

SEQ ID NO: 8581 - DNA, 25 bp, E. coli
tatgcgacaaagtgacggttacggg

SEQ ID NO: 8582 - DNA, 25 bp, E. coli
gaagatcccacagattggtcgcgta

SEQ ID NO: 8583 - DNA, 25 bp, E. coli
gaagatcccacacattggtcgcgta

SEQ ID NO: 8584 - DNA, 25 bp, E. coli
gaaccaggcgtctattcctcaggca

SEQ ID NO: 8585 - DNA, 25 bp, E. coli
gaaccaggcgtcaattcctcaggca

SEQ ID NO: 8586 - DNA, 25 bp, E. coli
cgttactgcatgttcggcggagcca

SEQ ID NO: 8587 - DNA, 25 bp, E. coli
cgttactgcatgatcggcggagcca

SEQ ID NO: 8588 - DNA, 25 bp, E. coli
catttaggcttgagccaggcgtccg

SEQ ID NO: 8589 - DNA, 25 bp, E. coli
gatatcgtcatctccggcgttgcgt

SEQ ID NO: 8590 - DNA, 25 bp, E. coli
gatatcgtcatcaccggcgttgcgt

SEQ ID NO: 8591 - DNA, 25 bp, E. coli
caccggcaggcgatctgtacgttca

SEQ ID NO: 8592 - DNA, 25 bp, E. coli
caacaacctgtaatgcgaagtcccg

SEQ ID NO: 8593 - DNA, 25 bp, E. coli
caccggcaggcgttctgtacgttca

SEQ ID NO: 8594 - DNA, 25 bp, E. coli
caacaacctgtattgcgaagtcccg

SEQ ID NO: 8595 - DNA, 25 bp, E. coli
catggtcgtgttcagcgcagcaaaa

SEQ ID NO: 8596 - DNA, 25 bp, E. coli
catggtcgtgttgagcgcagcaaaa

SEQ ID NO: 8597 - DNA, 25 bp, E. coli
tacgtggcgtgaccaaagagatccg

SEQ ID NO: 8598 - DNA, 25 bp, E. coli
taaaggcgtcaactctgtccgcggt

SEQ ID NO: 8599 - DNA, 25 bp, E. coli
taaaggcgtcaagtctgtccgcggt

SEQ ID NO: 8600 - DNA, 25 bp, E. coli
tacgtggcgtgagcaaagagatccg

SEQ ID NO: 8601 - DNA, 25 bp, E. coli
ttttcgagcgtgtaggcaacaacct

SEQ ID NO: 8602 - DNA, 25 bp, E. coli
ttttcgagcgtgaaggcaacaacct

SEQ ID NO: 8603 - DNA, 25 bp, E. coli
gccgcggtacgcagatcaaagatcc

SEQ ID NO: 8604 - DNA, 25 bp, E. coli
gccgcggtacgctgatcaaagatcc

SEQ ID NO: 8605 - DNA, 25 bp, E. coli
cgtaaccagggtcacaaagaggccg

SEQ ID NO: 8606 - DNA, 25 bp, E. coli
cgtaaccagggtgacaaagaggccg

SEQ ID NO: 8607 - DNA, 25 bp, E. coli
gatcaacttcgcaatggcggcgctg

SEQ ID NO: 8608 - DNA, 25 bp, E. coli
gatcaacttcgctatggcggcgctg

SEQ ID NO: 8609 - DNA, 25 bp, E. coli
ggttaaacagcagccgattttcgag

SEQ ID NO: 8610 - DNA, 25 bp, E. coli
ggttaaacagcacccgattttcgag

SEQ ID NO: 8611 - DNA, 25 bp, E. coli
tcaaactgaaagagcctggcgaaac

SEQ ID NO: 8612 - DNA, 25 bp, E. coli
tcaaactgaaagtgcctggcgaaac

SEQ ID NO: 8613 - DNA, 25 bp, E. coli
cagattggtctgcagcaacgttcac

SEQ ID NO: 8614 - DNA, 25 bp, E. coli
cagattggtctggagcaacgttcac

SEQ ID NO: 8615 - DNA, 25 bp, E. coli
aaagtgacctccaactccgtgatga

SEQ ID NO: 8616 - DNA, 25 bp, E. coli
aaagctattgcatcaccggatcgcg

SEQ ID NO: 8617 - DNA, 25 bp, E. coli
aaagtgacctcctactccgtgatga

SEQ ID NO: 8618 - DNA, 25 bp, E. coli
aaagctattgcaacaccggatcgcg

SEQ ID NO: 8619 - DNA, 25 bp, E. coli
tctgcgctgttagatcccaaaggac

SEQ ID NO: 8620 - DNA, 25 bp, E. coli
tctgcgctgttacatcccaaaggac

SEQ ID NO: 8621 - DNA, 25 bp, E. coli
cctggaagtaccgtgcgagcaataa

SEQ ID NO: 8622 - DNA, 25 bp, E. coli
cctggaagtaccctgcgagcaataa

SEQ ID NO: 8623 - DNA, 25 bp, E. coli
gcgttcgaaaaactggccgcgccta

SEQ ID NO: 8624 - DNA, 25 bp, E. coli
gcgttcgaaaaagtggccgcgccta

SEQ ID NO: 8625 - DNA, 25 bp, E. coli
gaatgaaatcgctttcccggcgaac

SEQ ID NO: 8626 - DNA, 25 bp, E. coli
gaatgaaatcgcattcccggcgaac

SEQ ID NO: 8627 - DNA, 25 bp, E. coli
gaaatggttcttcatctacccggaa

SEQ ID NO: 8628 - DNA, 25 bp, E. coli
gaaatggttcttgatctacccggaa

SEQ ID NO: 8629 - DNA, 25 bp, E. coli
tggacatgacccagccagaaggtga

SEQ ID NO: 8630 - DNA, 25 bp, E. coli
tggacatgaccctgccagaaggtga

SEQ ID NO: 8631 - DNA, 25 bp, E. coli
gagaagcccatttccatcgaagtgg

SEQ ID NO: 8632 - DNA, 25 bp, E. coli
gatgctaagtacagcccgaactggt

SEQ ID NO: 8633 - DNA, 25 bp, E. coli
gagaagcccattaccatcgaagtgg

SEQ ID NO: 8634 - DNA, 25 bp, E. coli
gatgctaagtactgcccgaactggt

SEQ ID NO: 8635 - DNA, 25 bp, E. coli
aatttacctctgttgatttgctggg

SEQ ID NO: 8636 - DNA, 25 bp, E. coli
aatttacctctgatgatttgctggg

SEQ ID NO: 8637 - DNA, 25 bp, E. coli
aagccagcgatgaagtggaacgtat

SEQ ID NO: 8638 - DNA, 25 bp, E. coli
aagccagcgatgtagtggaacgtat

SEQ ID NO: 8639 - DNA, 25 bp, E. coli
cagcgatgaagtggaacgtattggt

SEQ ID NO: 8640 - DNA, 25 bp, E. coli
cagcgatgaagtcgaacgtattggt

SEQ ID NO: 8641 - DNA, 25 bp, E. coli
agccagcgatgaagtggaacgtatt

SEQ ID NO: 8642 - DNA, 25 bp, E. coli
agccagcgatgatgtggaacgtatt

SEQ ID NO: 8643 - DNA, 25 bp, E. coli
gccagcgatgaactggaacgtattg

SEQ ID NO: 8644 - DNA, 25 bp, E. coli
gccagcgatgaagtggaacgtattg

SEQ ID NO: 8645 - DNA, 25 bp, E. coli
ccagcgatgaagtggaacgtattgg

SEQ ID NO: 8646 - DNA, 25 bp, E. coli
ccagcgatgaagaggaacgtattgg

SEQ ID NO: 8647 - DNA, 25 bp, E. coli
gcgatgaagtggtacgtattggtat

SEQ ID NO: 8648 - DNA, 25 bp, E. coli
gcgatgaagtggaacgtattggtat

SEQ ID NO: 8649 - DNA, 25 bp, E. coli
gaatttacctctgatgatttgctgg

SEQ ID NO: 8650 - DNA, 25 bp, E. coli
gaatttacctctcatgatttgctgg

SEQ ID NO: 8651 - DNA, 25 bp, E. coli
cgatgaagtggaacgtattggtatc

SEQ ID NO: 8652 - DNA, 25 bp, E. coli
cgatgaagtggatcgtattggtatc

SEQ ID NO: 8653 - DNA, 25 bp, E. coli
gggaatttacctgtgatgatttgct

SEQ ID NO: 8654 - DNA, 25 bp, E. coli
gggaatttacctctgatgatttgct

SEQ ID NO: 8655 - DNA, 25 bp, E. coli
ggaatttacctctgatgatttgctg

SEQ ID NO: 8656 - DNA, 25 bp, E. coli
ggaatttacctcagatgatttgctg

SEQ ID NO: 8657 - DNA, 25 bp, E. coli
caatgtggtgcatgacgcttcgcat

SEQ ID NO: 8658 - DNA, 25 bp, E. coli
caacctgcatggcttggctactggc

SEQ ID NO: 8659 - DNA, 25 bp, E. coli
caatgtggtgcaagacgcttcgcat

SEQ ID NO: 8660 - DNA, 25 bp, E. coli
caacctgcatgggttggctactggc

SEQ ID NO: 8661 - DNA, 25 bp, E. coli
tacgcagttacctccagaagagggc

SEQ ID NO: 8662 - DNA, 25 bp, E. coli
tacgcagttaccaccagaagagggc

SEQ ID NO: 8663 - DNA, 25 bp, E. coli
tttcttagccgggaaactggcgcat

SEQ ID NO: 8664 - DNA, 25 bp, E. coli
tatatctgggtactggactggctcg

SEQ ID NO: 8665 - DNA, 25 bp, E. coli
tatatctgggtagtggactggctcg

SEQ ID NO: 8666 - DNA, 25 bp, E. coli
ttgattattggaacgcactgggcga

SEQ ID NO: 8667 - DNA, 25 bp, E. coli
tttcttagccggcaaactggcgcat

SEQ ID NO: 8668 - DNA, 25 bp, E. coli
ttgattattggatcgcactgggcga

SEQ ID NO: 8669 - DNA, 25 bp, E. coli
tgttaccaccttagactggacgccg

SEQ ID NO: 8670 - DNA, 25 bp, E. coli
gctacagcagcagtttttacggcga

SEQ ID NO: 8671 - DNA, 25 bp, E. coli
gctacagcagcactttttacggcga

SEQ ID NO: 8672 - DNA, 25 bp, E. coli
gaattttacgatgcagacacagcag

SEQ ID NO: 8673 - DNA, 25 bp, E. coli
gaattttacgatccagacacagcag

SEQ ID NO: 8674 - DNA, 25 bp, E. coli
gaaaatggcattgttcgccagacgc

SEQ ID NO: 8675 - DNA, 25 bp, E. coli
gaaaatggcattcttcgccagacgc

SEQ ID NO: 8676 - DNA, 25 bp, E. coli
ggcagactggcggatacctttgtta

SEQ ID NO: 8677 - DNA, 25 bp, E. coli
ggcagactggcgcatacctttgtta

SEQ ID NO: 8678 - DNA, 25 bp, E. coli
tgttaccacctttgactggacgccg

SEQ ID NO: 8679 - DNA, 25 bp, E. coli
caaaccgaagagagagaaacctatg

SEQ ID NO: 8680 - DNA, 25 bp, E. coli
caagaagacatgttgcgtctgctgc

SEQ ID NO: 8681 - DNA, 25 bp, E. coli
caagaagacatgatgcgtctgctgc

SEQ ID NO: 8682 - DNA, 25 bp, E. coli
caaaccgaagagtgagaaacctatg

SEQ ID NO: 8683 - DNA, 25 bp, E. coli
cagcaaaggtcatgcaaaagcgcgt

SEQ ID NO: 8684 - DNA, 25 bp, E. coli
cagcaaaggtcaagcaaaagcgcgt

SEQ ID NO: 8685 - DNA, 25 bp, E. coli
taaaacccctattccattgggcgtg

SEQ ID NO: 8686 - DNA, 25 bp, E. coli
taaaacccctataccattgggcgtg

SEQ ID NO: 8687 - DNA, 25 bp, E. coli
agtcaccaaacagcacaaaccgaag

SEQ ID NO: 8688 - DNA, 25 bp, E. coli
agtcaccaaacaccacaaaccgaag

SEQ ID NO: 8689 - DNA, 25 bp, E. coli
aaacctatgcttacaccgcaggcgg

SEQ ID NO: 8690 - DNA, 25 bp, E. coli
aaacctatgctttcaccgcaggcgg

SEQ ID NO: 8691 - DNA, 25 bp, E. coli
aaacggatgagcctctggatgcgct

SEQ ID NO: 8692 - DNA, 25 bp, E. coli
aaacggatgagcgtctggatgcgct

SEQ ID NO: 8693 - DNA, 25 bp, E. coli
tcagaaaaaacgtcgtggtcatgcg

SEQ ID NO: 8694 - DNA, 25 bp, E. coli
tcagaaaaaacgacgtggtcatgcg

SEQ ID NO: 8695 - DNA, 25 bp, E. coli
gatccacgtattcgcagtaaaaccc

SEQ ID NO: 8696 - DNA, 25 bp, E. coli
gtcaggcagcaaaggccagaacgca

SEQ ID NO: 8697 - DNA, 25 bp, E. coli
gtcaggcagcaatggccagaacgca

SEQ ID NO: 8698 - DNA, 25 bp, E. coli
tggaacgtctggtagcaggcgaaac

SEQ ID NO: 8699 - DNA, 25 bp, E. coli
tggaacgtctggaagcaggcgaaac

SEQ ID NO: 8700 - DNA, 25 bp, E. coli
gatccacgtattggcagtaaaaccc

SEQ ID NO: 8701 - DNA, 25 bp, E. coli
caaacaaaccgattcagagatgccg

SEQ ID NO: 8702 - DNA, 25 bp, E. coli
caaacaaaccgaatcagagatgccg

SEQ ID NO: 8703 - DNA, 25 bp, E. coli
agagtgaacggctgtgatattgagc

SEQ ID NO: 8704 - DNA, 25 bp, E. coli
agagtgaacggcagtgatattgagc

SEQ ID NO: 8705 - DNA, 25 bp, E. coli
tatgaaggtgagagggagcactacc

SEQ ID NO: 8706 - DNA, 25 bp, E. coli
tatgaaggtgagtgggagcactacc

SEQ ID NO: 8707 - DNA, 25 bp, E. coli
tgccggtacggtatgcaaacaaacc

SEQ ID NO: 8708 - DNA, 25 bp, E. coli
tgccggtacggtttgcaaacaaacc

SEQ ID NO: 8709 - DNA, 25 bp, E. coli
tctttccgctatcaaggtgagtggg

SEQ ID NO: 8710 - DNA, 25 bp, E. coli
tcagagatgccgtaagagtggacaa

SEQ ID NO: 8711 - DNA, 25 bp, E. coli
tcagagatgccgaaagagtggacaa

SEQ ID NO: 8712 - DNA, 25 bp, E. coli
tctttccgctatgaaggtgagtggg

SEQ ID NO: 8713 - DNA, 25 bp, E. coli
gaatgggcgcgaaacctctatctga

SEQ ID NO: 8714 - DNA, 25 bp, E. coli
gaatgggcgcgatacctctatctga

SEQ ID NO: 8715 - DNA, 25 bp, E. coli
gaaacctctatctgatggaattacc

SEQ ID NO: 8716 - DNA, 25 bp, E. coli
gaaacctctatcagatggaattacc

SEQ ID NO: 8717 - DNA, 25 bp, E. coli
gttagccagagtcaacggcagtgat

SEQ ID NO: 8718 - DNA, 25 bp, E. coli
gttagccagagtgaacggcagtgat

SEQ ID NO: 8719 - DNA, 25 bp, E. coli
gagtggacaattaaccgaggactgt

SEQ ID NO: 8720 - DNA, 25 bp, E. coli
gagcactaccctgaatgggcgcgaa

SEQ ID NO: 8721 - DNA, 25 bp, E. coli
gagtggacaatttaccgaggactgt

SEQ ID NO: 8722 - DNA, 25 bp, E. coli
gagcactaccctcaatgggcgcgaa

SEQ ID NO: 8723 - DNA, 25 bp, E. coli
caaactgggcgaagagctggatgca

SEQ ID NO: 8724 - DNA, 25 bp, E. coli
caaactgggcgatgagctggatgca

SEQ ID NO: 8725 - DNA, 25 bp, E. coli
tacgacctggaagtatggatcccgg

SEQ ID NO: 8726 - DNA, 25 bp, E. coli
agtcgctgaaaaactggcacgccgg

SEQ ID NO: 8727 - DNA, 25 bp, E. coli
agtcgctgaaaatctggcacgccgg

SEQ ID NO: 8728 - DNA, 25 bp, E. coli
tacgacctggaactatggatcccgg

SEQ ID NO: 8729 - DNA, 25 bp, E. coli
ttgaaatggtgctgatcgtgcgccc

SEQ ID NO: 8730 - DNA, 25 bp, E. coli
ttgaaatggtgcagatcgtgcgccc

SEQ ID NO: 8731 - DNA, 25 bp, E. coli
tccgctggaagatgaagcagacacc

SEQ ID NO: 8732 - DNA, 25 bp, E. coli
tccgctggaagaagaagcagacacc

SEQ ID NO: 8733 - DNA, 25 bp, E. coli
gaaaacctgcaagcggagcgtaact

SEQ ID NO: 8734 - DNA, 25 bp, E. coli
gaaaacctgcaaccggagcgtaact

SEQ ID NO: 8735 - DNA, 25 bp, E. coli
gatttccaggcaggtcgtatgcagg

SEQ ID NO: 8736 - DNA, 25 bp, E. coli
gatttccaggcacgtcgtatgcagg

SEQ ID NO: 8737 - DNA, 25 bp, E. coli
ggtgaaatgcactctggcctcgact

SEQ ID NO: 8738 - DNA, 25 bp, E. coli
ggtgaaatgcacactggcctcgact

SEQ ID NO: 8739 - DNA, 25 bp, E. coli
ggcgcttgcaaatcttacgacctgg

SEQ ID NO: 8740 - DNA, 25 bp, E. coli
ggcgcttgcaaaacttacgacctgg

SEQ ID NO: 8741 - DNA, 25 bp, E. coli
taatgagccagacgcagtcgctgaa

SEQ ID NO: 8742 - DNA, 25 bp, E. coli
taatgagccagaggcagtcgctgaa

SEQ ID NO: 8743 - DNA, 25 bp, E. coli
gatcgaaatccaatggccaggcgaa

SEQ ID NO: 8744 - DNA, 25 bp, E. coli
gatcgaaatccattggccaggcgaa

SEQ ID NO: 8745 - DNA, 25 bp, E. coli
caagcggtgtgccagaaatgaaaaa

SEQ ID NO: 8746 - DNA, 25 bp, E. coli
cacagtgcgttacatttttgcacca

SEQ ID NO: 8747 - DNA, 25 bp, E. coli
cactatgacagtccacagtgcgtta

SEQ ID NO: 8748 - DNA, 25 bp, E. coli
caagcggtgtgcgagaaatgaaaaa

SEQ ID NO: 8749 - DNA, 25 bp, E. coli
cactatgacagtgcacagtgcgtta

SEQ ID NO: 8750 - DNA, 25 bp, E. coli
cacagtgcgttagatttttgcacca

SEQ ID NO: 8751 - DNA, 25 bp, E. coli
tacacgaagaaggtattgcaagcgg

SEQ ID NO: 8752 - DNA, 25 bp, E. coli
tacacgaagaagctattgcaagcgg

SEQ ID NO: 8753 - DNA, 25 bp, E. coli
agaaggtattgcaagcggtgtgcca

SEQ ID NO: 8754 - DNA, 25 bp, E. coli
agaaggtattgctagcggtgtgcca

SEQ ID NO: 8755 - DNA, 25 bp, E. coli
tgaaaatgaaaaggcactatgacag

SEQ ID NO: 8756 - DNA, 25 bp, E. coli
tgaaaatgaaaacgcactatgacag

SEQ ID NO: 8757 - DNA, 25 bp, E. coli
gcgttacatttttgcaccaacgatg

SEQ ID NO: 8758 - DNA, 25 bp, E. coli
gcgttacattttagcaccaacgatg

SEQ ID NO: 8759 - DNA, 25 bp, E. coli
gagaaagagagcaggaagttaagaa

SEQ ID NO: 8760 - DNA, 25 bp, E. coli
gaaaaacgagaaagagagcaggaag

SEQ ID NO: 8761 - DNA, 25 bp, E. coli
gaaaaacgagaatgagagcaggaag

SEQ ID NO: 8762 - DNA, 25 bp, E. coli
gagaaagagagctggaagttaagaa

SEQ ID NO: 8763 - DNA, 25 bp, E. coli
ggtgtgccagaaatgaaaaacgaga

SEQ ID NO: 8764 - DNA, 25 bp, E. coli
ggtgtgccagaattgaaaaacgaga

SEQ ID NO: 8765 - DNA, 25 bp, E. coli
tggttctgctacacgaagaaggtat

SEQ ID NO: 8766 - DNA, 25 bp, E. coli
tggttctgctactcgaagaaggtat

SEQ ID NO: 8767 - DNA, 25 bp, E. coli
accggcagcgatacgtggtaatgct

SEQ ID NO: 8768 - DNA, 25 bp, E. coli
agctctcaaacaccctggacgcttg

SEQ ID NO: 8769 - DNA, 25 bp, E. coli
accggcagcgattcgtggtaatgct

SEQ ID NO: 8770 - DNA, 25 bp, E. coli
agctctcaaacagcctggacgcttg

SEQ ID NO: 8771 - DNA, 25 bp, E. coli
aaaaagctctcatacaccctggacg

SEQ ID NO: 8772 - DNA, 25 bp, E. coli
aaagctctcaaacaccctggacgct

SEQ ID NO: 8773 - DNA, 25 bp, E. coli
aaagctctcaaagaccctggacgct

SEQ ID NO: 8774 - DNA, 25 bp, E. coli
aaaaagctctcaaacaccctggacg

SEQ ID NO: 8775 - DNA, 25 bp, E. coli
ttatcttttaaaccggcagcgatac

SEQ ID NO: 8776 - DNA, 25 bp, E. coli
ttttatcttttaaaccggcagcgat

SEQ ID NO: 8777 - DNA, 25 bp, E. coli
ttttatcttttataccggcagcgat

SEQ ID NO: 8778 - DNA, 25 bp, E. coli
ttatcttttaaagcggcagcgatac

SEQ ID NO: 8779 - DNA, 25 bp, E. coli
tcatgaacttttatcttttaaaccg

SEQ ID NO: 8780 - DNA, 25 bp, E. coli
tcatgaacttttttcttttaaaccg

SEQ ID NO: 8781 - DNA, 25 bp, E. coli
ccgttgagcaaggaaaaagctctca

SEQ ID NO: 8782 - DNA, 25 bp, E. coli
gccatttttgtcttgaacttttatc

SEQ ID NO: 8783 - DNA, 25 bp, E. coli
ccgttgagcaagcaaaaagctctca

SEQ ID NO: 8784 - DNA, 25 bp, E. coli
gccatttttgtcatgaacttttatc

SEQ ID NO: 8785 - DNA, 25 bp, E. coli
gcaaaaagctctcaaacaccctgga

SEQ ID NO: 8786 - DNA, 25 bp, E. coli
gcaaaaagctctgaaacaccctgga

SEQ ID NO: 8787 - DNA, 25 bp, E. coli
ctctcaaacaccctggacgcttgat

SEQ ID NO: 8788 - DNA, 25 bp, E. coli
ctctcaaacaccgtggacgcttgat

SEQ ID NO: 8789 - DNA, 25 bp, E. coli
cactggatgtgtagatctactcggc

SEQ ID NO: 8790 - DNA, 25 bp, E. coli
cactggatgtgttgatctactcggc

SEQ ID NO: 8791 - DNA, 25 bp, E. coli
aaagaaacggtggatctggctgatg

SEQ ID NO: 8792 - DNA, 25 bp, E. coli
aaagaaacggtgcatctggctgatg

SEQ ID NO: 8793 - DNA, 25 bp, E. coli
tatcgcgctgatagtgaagtacttt

SEQ ID NO: 8794 - DNA, 25 bp, E. coli
tatcgcgctgattgtgaagtacttt

SEQ ID NO: 8795 - DNA, 25 bp, E. coli
tatattgggatcaccgccattgtgc

SEQ ID NO: 8796 - DNA, 25 bp, E. coli
tatattgggatctccgccattgtgc

SEQ ID NO: 8797 - DNA, 25 bp, E. coli
tgtgtaattcgatacggctgaagcg

SEQ ID NO: 8798 - DNA, 25 bp, E. coli
tgtgtaattcgaaacggctgaagcg

SEQ ID NO: 8799 - DNA, 25 bp, E. coli
tgcagaccgtactcaatcttggcct

SEQ ID NO: 8800 - DNA, 25 bp, E. coli
tgcagaccgtacacaatcttggcct

SEQ ID NO: 8801 - DNA, 25 bp, E. coli
ccattgtgcgctagatcatcgtcga

SEQ ID NO: 8802 - DNA, 25 bp, E. coli
ccattgtgcgcttgatcatcgtcga

SEQ ID NO: 8803 - DNA, 25 bp, E. coli
gtcgatcataaatcgccactggatg

SEQ ID NO: 8804 - DNA, 25 bp, E. coli
gtcgatcataaaacgccactggatg

SEQ ID NO: 8805 - DNA, 25 bp, E. coli
ggctgatgtgctgttcgcgccagaa

SEQ ID NO: 8806 - DNA, 25 bp, E. coli
ggctgatgtgctcttcgcgccagaa

SEQ ID NO: 8807 - DNA, 25 bp, E. coli
tgtcttcctcggcaaagaaacggtg

SEQ ID NO: 8808 - DNA, 25 bp, E. coli
tgtcttcctcgggaaagaaacggtg

SEQ ID NO: 8809 - DNA, 25 bp, E. coli
gagtttatctcctccattttgcaga

SEQ ID NO: 8810 - DNA, 25 bp, E. coli
gagtttatctccaccattttgcaga

SEQ ID NO: 8811 - DNA, 25 bp, E. coli
aagtcagcgcccctatagccaaagt

SEQ ID NO: 8812 - DNA, 25 bp, E. coli
aatacattggcaataaaagggccgg

SEQ ID NO: 8813 - DNA, 25 bp, E. coli
aatacattggcattaaaagggccgg

SEQ ID NO: 8814 - DNA, 25 bp, E. coli
aagtcagcgcccgtatagccaaagt

SEQ ID NO: 8815 - DNA, 25 bp, E. coli
tacggcatgtcacaatccgtgctgg

SEQ ID NO: 8816 - DNA, 25 bp, E. coli
tagtgaggttgaagccattgccgtc

SEQ ID NO: 8817 - DNA, 25 bp, E. coli
tagtgaggttgatgccattgccgtc

SEQ ID NO: 8818 - DNA, 25 bp, E. coli
tacggcatgtcagaatccgtgctgg

SEQ ID NO: 8819 - DNA, 25 bp, E. coli
tgccgtcatggtgaaagcccgtgaa

SEQ ID NO: 8820 - DNA, 25 bp, E. coli
tgccgtcatggtcaaagcccgtgaa

SEQ ID NO: 8821 - DNA, 25 bp, E. coli
ccgtgctggcacttacaatgggaat

SEQ ID NO: 8822 - DNA, 25 bp, E. coli
ccgtgctggcacatacaatgggaat

SEQ ID NO: 8823 - DNA, 25 bp, E. coli
gcggcccggcactacgtattttgaa

SEQ ID NO: 8824 - DNA, 25 bp, E. coli
gcggcccggcacaacgtattttgaa

SEQ ID NO: 8825 - DNA, 25 bp, E. coli
gctggaagatgcaaaggaactgaat

SEQ ID NO: 8826 - DNA, 25 bp, E. coli
gctggaagatgctaaggaactgaat

SEQ ID NO: 8827 - DNA, 25 bp, E. coli
tgcactgggcctcatgtctgatagt

SEQ ID NO: 8828 - DNA, 25 bp, E. coli
tgcactgggcctgatgtctgatagt

SEQ ID NO: 8829 - DNA, 25 bp, E. coli
ggtgaagagatctaagccatccgca

SEQ ID NO: 8830 - DNA, 25 bp, E. coli
ggtgaagagatcaaagccatccgca

SEQ ID NO: 8831 - DNA, 25 bp, E. coli
taatgaaataaatccgagcggcccg

SEQ ID NO: 8832 - DNA, 25 bp, E. coli
taatgaaataaaaccgagcggcccg

SEQ ID NO: 8833 - DNA, 25 bp, E. coli
aatctgttctcttatgttaactccc

SEQ ID NO: 8834 - DNA, 25 bp, E. coli
aatctgttctctaatgttaactccc

SEQ ID NO: 8835 - DNA, 25 bp, E. coli
taacggtcatttagcagtgaagcca

SEQ ID NO: 8836 - DNA, 25 bp, E. coli
tactaatttgttccttttgatcaca

SEQ ID NO: 8837 - DNA, 25 bp, E. coli
tactaatttgttgcttttgatcaca

SEQ ID NO: 8838 - DNA, 25 bp, E. coli
cctaacctgttgctttagttattca

SEQ ID NO: 8839 - DNA, 25 bp, E. coli
cctaacctgttggtttagttattca

SEQ ID NO: 8840 - DNA, 25 bp, E. coli
gaagccatttacagttttttatcga

SEQ ID NO: 8841 - DNA, 25 bp, E. coli
gaagccatttactgttttttatcga

SEQ ID NO: 8842 - DNA, 25 bp, E. coli
tattcatttcctgtctcactttgcc

SEQ ID NO: 8843 - DNA, 25 bp, E. coli
tattcatttcctctctcactttgcc

SEQ ID NO: 8844 - DNA, 25 bp, E. coli
tttaatgttatatctgccccgataa

SEQ ID NO: 8845 - DNA, 25 bp, E. coli
tttaatgttataactgccccgataa

SEQ ID NO: 8846 - DNA, 25 bp, E. coli
tttatcgaccagataatctgttctc

SEQ ID NO: 8847 - DNA, 25 bp, E. coli
tttatcgaccagttaatctgttctc

SEQ ID NO: 8848 - DNA, 25 bp, E. coli
tcactttgccttaataccctacgtt

SEQ ID NO: 8849 - DNA, 25 bp, E. coli
tcactttgcctttataccctacgtt

SEQ ID NO: 8850 - DNA, 25 bp, E. coli
gcttttgatcacaataagaaaacaa

SEQ ID NO: 8851 - DNA, 25 bp, E. coli
gcttttgatcactataagaaaacaa

SEQ ID NO: 8852 - DNA, 25 bp, E. coli
gggcagataataagtttagtttact

SEQ ID NO: 8853 - DNA, 25 bp, E. coli
gggcagataatatgtttagtttact

SEQ ID NO: 8854 - DNA, 25 bp, E. coli
taacggtcattttgcagtgaagcca

SEQ ID NO: 8855 - DNA, 25 bp, E. coli
cagggctttaatacagaaactactt

SEQ ID NO: 8856 - DNA, 25 bp, E. coli
cagggctttaattcagaaactactt

SEQ ID NO: 8857 - DNA, 25 bp, E. coli
tacttagtgttcaggagagagactc

SEQ ID NO: 8858 - DNA, 25 bp, E. coli
tacttagtgttctggagagagactc

SEQ ID NO: 8859 - DNA, 25 bp, E. coli
taaactactttgaatgctgtctgtc

SEQ ID NO: 8860 - DNA, 25 bp, E. coli
taaactactttgtatgctgtctgtc

SEQ ID NO: 8861 - DNA, 25 bp, E. coli
tgggcctttcggcaaacagggcttt

SEQ ID NO: 8862 - DNA, 25 bp, E. coli
tgggcctttcgggaaacagggcttt

SEQ ID NO: 8863 - DNA, 25 bp, E. coli
tattaaccccgtttagtgcagcgca

SEQ ID NO: 8864 - DNA, 25 bp, E. coli
tattaaccccgtatagtgcagcgca

SEQ ID NO: 8865 - DNA, 25 bp, E. coli
tgtctgtctttcaaaccgacgcagc

SEQ ID NO: 8866 - DNA, 25 bp, E. coli
tgtctgtctttctaaccgacgcagc

SEQ ID NO: 8867 - DNA, 25 bp, E. coli
tacttccttcatattgggcctttcg

SEQ ID NO: 8868 - DNA, 25 bp, E. coli
tacttccttcattttgggcctttcg

SEQ ID NO: 8869 - DNA, 25 bp, E. coli
gccgtccggcggtcttaaatatcgc

SEQ ID NO: 8870 - DNA, 25 bp, E. coli
ccgacgcagctaataacgcatgata

SEQ ID NO: 8871 - DNA, 25 bp, E. coli
gccgtccggcggacttaaatatcgc

SEQ ID NO: 8872 - DNA, 25 bp, E. coli
gcagcgcagtatattcagtaaggaa

SEQ ID NO: 8873 - DNA, 25 bp, E. coli
gcagcgcagtattttcagtaaggaa

SEQ ID NO: 8874 - DNA, 25 bp, E. coli
ccgacgcagctattaacgcatgata

SEQ ID NO: 8875 - DNA, 25 bp, E. coli
gataatgcctgataatgagaactgc

SEQ ID NO: 8876 - DNA, 25 bp, E. coli
gataatgcctgaaaatgagaactgc

SEQ ID NO: 8877 - DNA, 25 bp, E. coli
catcatacaggatgcgtaagatcaa

SEQ ID NO: 8878 - DNA, 25 bp, E. coli
catcatacaggaagcgtaagatcaa

SEQ ID NO: 8879 - DNA, 25 bp, E. coli
agagagcgccccgttttggagtaat

SEQ ID NO: 8880 - DNA, 25 bp, E. coli
taccaacgttgatagggttagtctg

SEQ ID NO: 8881 - DNA, 25 bp, E. coli
taccaacgttgaaagggttagtctg

SEQ ID NO: 8882 - DNA, 25 bp, E. coli
agagagcgcccccttttggagtaat

SEQ ID NO: 8883 - DNA, 25 bp, E. coli
ttttggagtaattgccgaaagccgt

SEQ ID NO: 8884 - DNA, 25 bp, E. coli
ttttggagtaatagccgaaagccgt

SEQ ID NO: 8885 - DNA, 25 bp, E. coli
tctgcgggaaataataccaacgttg

SEQ ID NO: 8886 - DNA, 25 bp, E. coli
tctgcgggaaattataccaacgttg

SEQ ID NO: 8887 - DNA, 25 bp, E. coli
cgttgatagggtaagtctgcttgca

SEQ ID NO: 8888 - DNA, 25 bp, E. coli
ccgaaagccgttagattctggcaat

SEQ ID NO: 8889 - DNA, 25 bp, E. coli
ccgaaagccgtttgattctggcaat

SEQ ID NO: 8890 - DNA, 25 bp, E. coli
cgttgatagggttagtctgcttgca

SEQ ID NO: 8891 - DNA, 25 bp, E. coli
gttagattctgggaattaagacaac

SEQ ID NO: 8892 - DNA, 25 bp, E. coli
gttagattctggcaattaagacaac

SEQ ID NO: 8893 - DNA, 25 bp, E. coli
gttagtctgcttgcatcatacagga

SEQ ID NO: 8894 - DNA, 25 bp, E. coli
gttagtctgcttccatcatacagga

SEQ ID NO: 8895 - DNA, 25 bp, E. coli
ggagtaattgccgaaagccgttaga

SEQ ID NO: 8896 - DNA, 25 bp, E. coli
ggagtaattgcccaaagccgttaga

SEQ ID NO: 8897 - DNA, 25 bp, E. coli
taagatcaataatagagagcgcccc

SEQ ID NO: 8898 - DNA, 25 bp, E. coli
taagatcaataaaagagagcgcccc

SEQ ID NO: 8899 - DNA, 25 bp, E. coli
tagttacggtcaacgggtgatggcc

SEQ ID NO: 8900 - DNA, 25 bp, E. coli
tagttacggtcatcgggtgatggcc

SEQ ID NO: 8901 - DNA, 25 bp, E. coli
aaaactgggctaaggctctccttcg

SEQ ID NO: 8902 - DNA, 25 bp, E. coli
aaaactgggctatggctctccttcg

SEQ ID NO: 8903 - DNA, 25 bp, E. coli
tacccgtatgcgagatgagcaacag

SEQ ID NO: 8904 - DNA, 25 bp, E. coli
tacccgtatgcgtgatgagcaacag

SEQ ID NO: 8905 - DNA, 25 bp, E. coli
tttacgctgttttccgactggctgg

SEQ ID NO: 8906 - DNA, 25 bp, E. coli
tttacgctgtttaccgactggctgg

SEQ ID NO: 8907 - DNA, 25 bp, E. coli
tgaacacctgtggatagtcgcccgt

SEQ ID NO: 8908 - DNA, 25 bp, E. coli
tgaacacctgtgcatagtcgcccgt

SEQ ID NO: 8909 - DNA, 25 bp, E. coli
tgaagagcgtcaccgcgggttaacc

SEQ ID NO: 8910 - DNA, 25 bp, E. coli
tgaagagcgtcagcgcgggttaacc

SEQ ID NO: 8911 - DNA, 25 bp, E. coli
tcggtacgccagcatcgcaagataa

SEQ ID NO: 8912 - DNA, 25 bp, E. coli
tcggtacgccaggatcgcaagataa

SEQ ID NO: 8913 - DNA, 25 bp, E. coli
ccggtgagcgtcgtgtattaaaaca

SEQ ID NO: 8914 - DNA, 25 bp, E. coli
ccggtgagcgtcctgtattaaaaca

SEQ ID NO: 8915 - DNA, 25 bp, E. coli
ttaaccgcaagacccgggaagtcat

SEQ ID NO: 8916 - DNA, 25 bp, E. coli
gataattactactggctgcgggacg

SEQ ID NO: 8917 - DNA, 25 bp, E. coli
gataattactacaggctgcgggacg

SEQ ID NO: 8918 - DNA, 25 bp, E. coli
ttaaccgcaagagccgggaagtcat

SEQ ID NO: 8919 - DNA, 25 bp, E. coli
ggcatatttatgtaccaggctgtga

SEQ ID NO: 8920 - DNA, 25 bp, E. coli
ggcatatttatgaaccaggctgtga

SEQ ID NO: 8921 - DNA, 25 bp, E. coli
taaagccagaggaaaactcccgctg

SEQ ID NO: 8922 - DNA, 25 bp, E. coli
taaagccagaggtaaactcccgctg

SEQ ID NO: 8923 - DNA, 25 bp, E. coli
tatcgccgttgatgccagtgatctg

SEQ ID NO: 8924 - DNA, 25 bp, E. coli
tatcgccgttgaagccagtgatctg

SEQ ID NO: 8925 - DNA, 25 bp, E. coli
tcattattcttcttagcgaccccga

SEQ ID NO: 8926 - DNA, 25 bp, E. coli
tcattattcttcatagcgaccccga

SEQ ID NO: 8927 - DNA, 25 bp, E. coli
gaaactacgcctccacttgaggtct

SEQ ID NO: 8928 - DNA, 25 bp, E. coli
gcgtgcgctctaatcgccggatgaa

SEQ ID NO: 8929 - DNA, 25 bp, E. coli
gctgcttgggaatacggaaactacg

SEQ ID NO: 8930 - DNA, 25 bp, E. coli
gaaactacgcctgcacttgaggtct

SEQ ID NO: 8931 - DNA, 25 bp, E. coli
gctgcttgggaaaacggaaactacg

SEQ ID NO: 8932 - DNA, 25 bp, E. coli
gcgtgcgctctattcgccggatgaa

SEQ ID NO: 8933 - DNA, 25 bp, E. coli
gaatgcaccatgaacagcaacaggc

SEQ ID NO: 8934 - DNA, 25 bp, E. coli
gaatgcaccatgtacagcaacaggc

SEQ ID NO: 8935 - DNA, 25 bp, E. coli
gaatgcacaatatgccgcgctgtaa

SEQ ID NO: 8936 - DNA, 25 bp, E. coli
gaatgcacaataagccgcgctgtaa

SEQ ID NO: 8937 - DNA, 25 bp, E. coli
ggtaatgtgcttatccgcgctctgg

SEQ ID NO: 8938 - DNA, 25 bp, E. coli
ggtaatgtgcttttccgcgctctgg

SEQ ID NO: 8939 - DNA, 25 bp, E. coli
gagtgttgtggtacgcagtcaccga

SEQ ID NO: 8940 - DNA, 25 bp, E. coli
gaggtctatcgtatgttccagccaa

SEQ ID NO: 8941 - DNA, 25 bp, E. coli
gagtgttgtggttcgcagtcaccga

SEQ ID NO: 8942 - DNA, 25 bp, E. coli
gaggtctatcgtttgttccagccaa

SEQ ID NO: 8943 - DNA, 25 bp, E. coli
caaaaaatcggagcaaacaacaggt

SEQ ID NO: 8944 - DNA, 25 bp, E. coli
caaaaaatcggaccaaacaacaggt

SEQ ID NO: 8945 - DNA, 25 bp, E. coli
caacaggtatctcgttgggaagagc

SEQ ID NO: 8946 - DNA, 25 bp, E. coli
caacaggtatctggttgggaagagc

SEQ ID NO: 8947 - DNA, 25 bp, E. coli
cagaacctgatgaattacgcgatat

SEQ ID NO: 8948 - DNA, 25 bp, E. coli
cagaacctgatgtattacgcgatat

SEQ ID NO: 8949 - DNA, 25 bp, E. coli
gaacccgtacttgactggccattaa

SEQ ID NO: 8950 - DNA, 25 bp, E. coli
gaacccgtacttcactggccattaa

SEQ ID NO: 8951 - DNA, 25 bp, E. coli
tagtggaagaattaacgagcgccgt

SEQ ID NO: 8952 - DNA, 25 bp, E. coli
tagtggaagaataaacgagcgccgt

SEQ ID NO: 8953 - DNA, 25 bp, E. coli
tcgagcctggcatcaactggataat

SEQ ID NO: 8954 - DNA, 25 bp, E. coli
tcgagcctggcaacaactggataat

SEQ ID NO: 8955 - DNA, 25 bp, E. coli
cctgagcgcaggaaagaatgtcatc

SEQ ID NO: 8956 - DNA, 25 bp, E. coli
cctgcgttttataggctggtgcaac

SEQ ID NO: 8957 - DNA, 25 bp, E. coli
cctgagcgcaggtaagaatgtcatc

SEQ ID NO: 8958 - DNA, 25 bp, E. coli
gccattaatggccaggatgttgacc

SEQ ID NO: 8959 - DNA, 25 bp, E. coli
cctgcgttttattggctggtgcaac

SEQ ID NO: 8960 - DNA, 25 bp, E. coli
gccattaatggcgaggatgttgacc

SEQ ID NO: 8961 - DNA, 25 bp, E. coli
gacagaacagccgatatggtccagt

SEQ ID NO: 8962 - DNA, 25 bp, E. coli
gacagaacagcccatatggtccagt

SEQ ID NO: 8963 - DNA, 25 bp, E. coli
gattacttactcacgccgaacccgt

SEQ ID NO: 8964 - DNA, 25 bp, E. coli
gattacttactctcgccgaacccgt

SEQ ID NO: 8965 - DNA, 25 bp, E. coli
catcaaatggatgcaggatcaagcg

SEQ ID NO: 8966 - DNA, 25 bp, E. coli
catcggaaaaactgatcgttgcggc

SEQ ID NO: 8967 - DNA, 25 bp, E. coli
catcaaatggatccaggatcaagcg

SEQ ID NO: 8968 - DNA, 25 bp, E. coli
cagtcccacgcgcaaaaaattaaga

SEQ ID NO: 8969 - DNA, 25 bp, E. coli
catcggaaaaacagatcgttgcggc

SEQ ID NO: 8970 - DNA, 25 bp, E. coli
cagtcccacgcggaaaaaattaaga

SEQ ID NO: 8971 - DNA, 25 bp, E. coli
ttgccggaaacgtagagatcaccct

SEQ ID NO: 8972 - DNA, 25 bp, E. coli
ttgccggaaacgaagagatcaccct

SEQ ID NO: 8973 - DNA, 25 bp, E. coli
tggtgggcagaataatccacatcgg

SEQ ID NO: 8974 - DNA, 25 bp, E. coli
tggtgggcagaaaaatccacatcgg

SEQ ID NO: 8975 - DNA, 25 bp, E. coli
gcatttgtccttgagggagcaacaa

SEQ ID NO: 8976 - DNA, 25 bp, E. coli
gcttacgcagccgatcaaaaatatc

SEQ ID NO: 8977 - DNA, 25 bp, E. coli
gcttacgcagcccatcaaaaatatc

SEQ ID NO: 8978 - DNA, 25 bp, E. coli
gcatttgtccttcagggagcaacaa

SEQ ID NO: 8979 - DNA, 25 bp, E. coli
cggtattgttatagaagaccttcag

SEQ ID NO: 8980 - DNA, 25 bp, E. coli
cggtattgttattgaagaccttcag

SEQ ID NO: 8981 - DNA, 25 bp, E. coli
ggatcaagcgagcacccatggttta

SEQ ID NO: 8982 - DNA, 25 bp, E. coli
tggcggttctctggctcggcgtttt

SEQ ID NO: 8983 - DNA, 25 bp, E. coli
tggcggttctctcgctcggcgtttt

SEQ ID NO: 8984 - DNA, 25 bp, E. coli
ggatcaagcgaggacccatggttta

SEQ ID NO: 8985 - DNA, 25 bp, E. coli
gaccttcagtttactcttgccggaa

SEQ ID NO: 8986 - DNA, 25 bp, E. coli
gaccttcagttttctcttgccggaa

SEQ ID NO: 8987 - DNA, 25 bp, E. coli
catgaacagtaaccaatggcccggt

SEQ ID NO: 8988 - DNA, 25 bp, E. coli
cagagggatgggttttatcagacgc

SEQ ID NO: 8989 - DNA, 25 bp, E. coli
cagagggatgggatttatcagacgc

SEQ ID NO: 8990 - DNA, 25 bp, E. coli
catgaacagtaagcaatggcccggt

SEQ ID NO: 8991 - DNA, 25 bp, E. coli
tattgccggagaagatgggctgcct

SEQ ID NO: 8992 - DNA, 25 bp, E. coli
tattgccggagatgatgggctgcct

SEQ ID NO: 8993 - DNA, 25 bp, E. coli
tgaaccgccacaaggaaaaatccgt

SEQ ID NO: 8994 - DNA, 25 bp, E. coli
tgaaccgccacatggaaaaatccgt

SEQ ID NO: 8995 - DNA, 25 bp, E. coli
tcagtgagtttaaggctgaaccgcc

SEQ ID NO: 8996 - DNA, 25 bp, E. coli
tcagtgagtttatggctgaaccgcc

SEQ ID NO: 8997 - DNA, 25 bp, E. coli
ccacccacgcatgaagagcttattg

SEQ ID NO: 8998 - DNA, 25 bp, E. coli
gcctgcgtgggcagatattcctcca

SEQ ID NO: 8999 - DNA, 25 bp, E. coli
ccacccacgcatcaagagcttattg

SEQ ID NO: 9000 - DNA, 25 bp, E. coli
ccaggccaacgattacatgaacagt

SEQ ID NO: 9001 - DNA, 25 bp, E. coli
gcctgcgtgggctgatattcctcca

SEQ ID NO: 9002 - DNA, 25 bp, E. coli
ccaggccaacgaatacatgaacagt

SEQ ID NO: 9003 - DNA, 25 bp, E. coli
gacagctactaattaaccaggccaa

SEQ ID NO: 9004 - DNA, 25 bp, E. coli
gacagctactaaataaccaggccaa

SEQ ID NO: 9005 - DNA, 25 bp, E. coli
ggcataatgcttatttccctgtgga

SEQ ID NO: 9006 - DNA, 25 bp, E. coli
ggcataatgcttttttccctgtgga

SEQ ID NO: 9007 - DNA, 25 bp, E. coli
gacgaatatgttaatagcgcaaggc

SEQ ID NO: 9008 - DNA, 25 bp, E. coli
gacgaatatgtttatagcgcaaggc

SEQ ID NO: 9009 - DNA, 25 bp, E. coli
caatgtttgccatcgtcgcgtttgg

SEQ ID NO: 9010 - DNA, 25 bp, E. coli
caatgtttgccaacgtcgcgtttgg

SEQ ID NO: 9011 - DNA, 25 bp, E. coli
catcgtcgcgttaggcttgcttgtc

SEQ ID NO: 9012 - DNA, 25 bp, E. coli
cagataacaaaagcgcattgtggtg

SEQ ID NO: 9013 - DNA, 25 bp, E. coli
catcgtcgcgtttggcttgcttgtc

SEQ ID NO: 9014 - DNA, 25 bp, E. coli
cagataacaaaaccgcattgtggtg

SEQ ID NO: 9015 - DNA, 25 bp, E. coli
taacaaaaccgcattgtggtgcacg

SEQ ID NO: 9016 - DNA, 25 bp, E. coli
taacaaaaccgctttgtggtgcacg

SEQ ID NO: 9017 - DNA, 25 bp, E. coli
aaaaccgcattgtggtgcacggctg

SEQ ID NO: 9018 - DNA, 25 bp, E. coli
aaaaccgcattgaggtgcacggctg

SEQ ID NO: 9019 - DNA, 25 bp, E. coli
ttggcttgcttgtctgctggagtaa

SEQ ID NO: 9020 - DNA, 25 bp, E. coli
ttggcttgcttgactgctggagtaa

SEQ ID NO: 9021 - DNA, 25 bp, E. coli
tgcacggctggaacgcttaccggat

SEQ ID NO: 9022 - DNA, 25 bp, E. coli
tgcacggctggatcgcttaccggat

SEQ ID NO: 9023 - DNA, 25 bp, E. coli
gcttaccggattcccgctggcattc

SEQ ID NO: 9024 - DNA, 25 bp, E. coli
gcttaccggattgccgctggcattc

SEQ ID NO: 9025 - DNA, 25 bp, E. coli
ccgcattgtggtgcacggctggatc

SEQ ID NO: 9026 - DNA, 25 bp, E. coli
ccgcattgtggtccacggctggatc

SEQ ID NO: 9027 - DNA, 25 bp, E. coli
gatcgcttaccgcattgccgctggc

SEQ ID NO: 9028 - DNA, 25 bp, E. coli
ggctggatcgcttaccggattgccg

SEQ ID NO: 9029 - DNA, 25 bp, E. coli
ggctggatcgctaaccggattgccg

SEQ ID NO: 9030 - DNA, 25 bp, E. coli
gatcgcttaccggattgccgctggc

SEQ ID NO: 9031 - DNA, 25 bp, E. coli
catctccagggcctaccggtggtat

SEQ ID NO: 9032 - DNA, 25 bp, E. coli
catctccagggcgtaccggtggtat

SEQ ID NO: 9033 - DNA, 25 bp, E. coli
cataacccgctgatttgcatagata

SEQ ID NO: 9034 - DNA, 25 bp, E. coli
cataacccgctgttttgcatagata

SEQ ID NO: 9035 - DNA, 25 bp, E. coli
taacgatgatcgatttggagagcgc

SEQ ID NO: 9036 - DNA, 25 bp, E. coli
tgcggagctctcaaagcagaacttc

SEQ ID NO: 9037 - DNA, 25 bp, E. coli
tgcggagctctctaagcagaacttc

SEQ ID NO: 9038 - DNA, 25 bp, E. coli
ccaatatggcggaaggtttaagcga

SEQ ID NO: 9039 - DNA, 25 bp, E. coli
ccaatatggcggtaggtttaagcga

SEQ ID NO: 9040 - DNA, 25 bp, E. coli
gaaattgtcacaagcgcaaacgctg

SEQ ID NO: 9041 - DNA, 25 bp, E. coli
gaaattgtcacatgcgcaaacgctg

SEQ ID NO: 9042 - DNA, 25 bp, E. coli
gacgcaattcgttcctttaagctgc

SEQ ID NO: 9043 - DNA, 25 bp, E. coli
gacgcaattcgtacctttaagctgc

SEQ ID NO: 9044 - DNA, 25 bp, E. coli
gcttcccggtaactacggtacatgg

SEQ ID NO: 9045 - DNA, 25 bp, E. coli
gcttcccggtaagtacggtacatgg

SEQ ID NO: 9046 - DNA, 25 bp, E. coli
gatcatatcaacaccatgcccggta

SEQ ID NO: 9047 - DNA, 25 bp, E. coli
gatcatatcaactccatgcccggta

SEQ ID NO: 9048 - DNA, 25 bp, E. coli
ggagagcgcttcttctcactggcaa

SEQ ID NO: 9049 - DNA, 25 bp, E. coli
ggaatgaccattatgactgacgcaa

SEQ ID NO: 9050 - DNA, 25 bp, E. coli
ggaatgaccattttgactgacgcaa

SEQ ID NO: 9051 - DNA, 25 bp, E. coli
ggagagcgcttcatctcactggcaa

SEQ ID NO: 9052 - DNA, 25 bp, E. coli
taacgatgatcgttttggagagcgc

SEQ ID NO: 9053 - DNA, 25 bp, E. coli
catccggtggttgaacaggtgctga

SEQ ID NO: 9054 - DNA, 25 bp, E. coli
catccggtggttcaacaggtgctga

SEQ ID NO: 9055 - DNA, 25 bp, E. coli
ttgcagccggtactacgtcaggtcg

SEQ ID NO: 9056 - DNA, 25 bp, E. coli
ttgcagccggtagtacgtcaggtcg

SEQ ID NO: 9057 - DNA, 25 bp, E. coli
tgaccgaaaccgctaatattctgca

SEQ ID NO: 9058 - DNA, 25 bp, E. coli
tgaccgaaaccggtaatattctgca

SEQ ID NO: 9059 - DNA, 25 bp, E. coli
tctgcataacgcgaccgagtacagt

SEQ ID NO: 9060 - DNA, 25 bp, E. coli
tctgcataacgccaccgagtacagt

SEQ ID NO: 9061 - DNA, 25 bp, E. coli
gccggatgttgattattaccggtcc

SEQ ID NO: 9062 - DNA, 25 bp, E. coli
gccggatgttgaatattaccggtcc

SEQ ID NO: 9063 - DNA, 25 bp, E. coli
gcagcgccggatcttgattattacc

SEQ ID NO: 9064 - DNA, 25 bp, E. coli
gcagcgccggatgttgattattacc

SEQ ID NO: 9065 - DNA, 25 bp, E. coli
ccgcagcgccggttgttgattatta

SEQ ID NO: 9066 - DNA, 25 bp, E. coli
gccgccatccggtggttgaacaggt

SEQ ID NO: 9067 - DNA, 25 bp, E. coli
gccgccatccggaggttgaacaggt

SEQ ID NO: 9068 - DNA, 25 bp, E. coli
ccgcagcgccggatgttgattatta

SEQ ID NO: 9069 - DNA, 25 bp, E. coli
ctgatggatgagattgggcgcggaa

SEQ ID NO: 9070 - DNA, 25 bp, E. coli
ctgatggatgagtttgggcgcggaa

SEQ ID NO: 9071 - DNA, 25 bp, E. coli
ggtgctgaacgagccatttatcgcc

SEQ ID NO: 9072 - DNA, 25 bp, E. coli
ggtgctgaacgacccatttatcgcc

SEQ ID NO: 9073 - DNA, 25 bp, E. coli
taatattctgcataacgccaccgag

SEQ ID NO: 9074 - DNA, 25 bp, E. coli
taatattctgcaaaacgccaccgag

SEQ ID NO: 9075 - DNA, 25 bp, E. coli
aacgatgataaacgccgcgaactgc

SEQ ID NO: 9076 - DNA, 25 bp, E. coli
cactacgctgaactggatagccgaa

SEQ ID NO: 9077 - DNA, 25 bp, E. coli
cactacgctgaagtggatagccgaa

SEQ ID NO: 9078 - DNA, 25 bp, E. coli
cagtaggtggctttcttggtaacga

SEQ ID NO: 9079 - DNA, 25 bp, E. coli
cagtaggtggctatcttggtaacga

SEQ ID NO: 9080 - DNA, 25 bp, E. coli
tactgctccacttcgctgaactgga

SEQ ID NO: 9081 - DNA, 25 bp, E. coli
tactgctccactacgctgaactgga

SEQ ID NO: 9082 - DNA, 25 bp, E. coli
aacgatgataaaggccgcgaactgc

SEQ ID NO: 9083 - DNA, 25 bp, E. coli
tcttggtaacgatgataaaggccgc

SEQ ID NO: 9084 - DNA, 25 bp, E. coli
tcttggtaacgaagataaaggccgc

SEQ ID NO: 9085 - DNA, 25 bp, E. coli
gcctttactgctgcactacgctgaa

SEQ ID NO: 9086 - DNA, 25 bp, E. coli
ccagacggtttaagctcagtaggtg

SEQ ID NO: 9087 - DNA, 25 bp, E. coli
gcctttactgctccactacgctgaa

SEQ ID NO: 9088 - DNA, 25 bp, E. coli
ccagacggtttatgctcagtaggtg

SEQ ID NO: 9089 - DNA, 25 bp, E. coli
gctgaactggatagccgaatcaacg

SEQ ID NO: 9090 - DNA, 25 bp, E. coli
gctgaactggattgccgaatcaacg

SEQ ID NO: 9091 - DNA, 25 bp, E. coli
ggtacatcgccctggcgccagacgg

SEQ ID NO: 9092 - DNA, 25 bp, E. coli
ggtacatcgcccaggcgccagacgg

SEQ ID NO: 9093 - DNA, 25 bp, E. coli
tggcgccagacgctttaagctcagt

SEQ ID NO: 9094 - DNA, 25 bp, E. coli
tggcgccagacggtttaagctcagt

SEQ ID NO: 9095 - DNA, 25 bp, E. coli
taagctcagtagctggctatcttgg

SEQ ID NO: 9096 - DNA, 25 bp, E. coli
taagctcagtaggtggctatcttgg

SEQ ID NO: 9097 - DNA, 25 bp, E. coli
cactctttcaagatcgcaggacagg

SEQ ID NO: 9098 - DNA, 25 bp, E. coli
cactctttcaagttcgcaggacagg

SEQ ID NO: 9099 - DNA, 25 bp, E. coli
catcatcaatggaactaaaggctct

SEQ ID NO: 9100 - DNA, 25 bp, E. coli
cagggtcacttacgattggcggtca

SEQ ID NO: 9101 - DNA, 25 bp, E. coli
cagggtcacttaggattggcggtca

SEQ ID NO: 9102 - DNA, 25 bp, E. coli
catcatcaatggtactaaaggctct

SEQ ID NO: 9103 - DNA, 25 bp, E. coli
taactggccggatcattatgtcatc

SEQ ID NO: 9104 - DNA, 25 bp, E. coli
tatcctctgtggagcaaaacctgaa

SEQ ID NO: 9105 - DNA, 25 bp, E. coli
tatcctctgtggtgcaaaacctgaa

SEQ ID NO: 9106 - DNA, 25 bp, E. coli
tatgcaagaaacagcagggtcactt

SEQ ID NO: 9107 - DNA, 25 bp, E. coli
tatgacctcagaaatggatggcgct

SEQ ID NO: 9108 - DNA, 25 bp, E. coli
tatgcaagaaactgcagggtcactt

SEQ ID NO: 9109 - DNA, 25 bp, E. coli
tatgacctcagatatggatggcgct

SEQ ID NO: 9110 - DNA, 25 bp, E. coli
gaaatttggcccattctggtccagg

SEQ ID NO: 9111 - DNA, 25 bp, E. coli
gaaatttggccctttctggtccagg

SEQ ID NO: 9112 - DNA, 25 bp, E. coli
ctggtgtgacctttatggccgggca

SEQ ID NO: 9113 - DNA, 25 bp, E. coli
ctggtgtgacctatatggccgggca

SEQ ID NO: 9114 - DNA, 25 bp, E. coli
ggcgctatagcatatggtcatccag

SEQ ID NO: 9115 - DNA, 25 bp, E. coli
ggcgctatagcaaatggtcatccag

SEQ ID NO: 9116 - DNA, 25 bp, E. coli
taactggccggaacattatgtcatc

SEQ ID NO: 9117 - DNA, 25 bp, E. coli
gaccttctcaatggtgaggcggcca

SEQ ID NO: 9118 - DNA, 25 bp, E. coli
gaccttctcaatcgtgaggcggcca

SEQ ID NO: 9119 - DNA, 25 bp, E. coli
cacctatggtctggcgaagggcaaa

SEQ ID NO: 9120 - DNA, 25 bp, E. coli
cacctatggtctcgcgaagggcaaa

SEQ ID NO: 9121 - DNA, 25 bp, E. coli
tatgcaaagcacgagcagatgggct

SEQ ID NO: 9122 - DNA, 25 bp, E. coli
tatgaaccagcatccaaaggcctgt

SEQ ID NO: 9123 - DNA, 25 bp, E. coli
tatgaaccagcaaccaaaggcctgt

SEQ ID NO: 9124 - DNA, 25 bp, E. coli
tatgcaaagcaccagcagatgggct

SEQ ID NO: 9125 - DNA, 25 bp, E. coli
tataaaggagcttactggcgacgtg

SEQ ID NO: 9126 - DNA, 25 bp, E. coli
tataaaggagctaactggcgacgtg

SEQ ID NO: 9127 - DNA, 25 bp, E. coli
tgtgggatatcatagctaaagcggc

SEQ ID NO: 9128 - DNA, 25 bp, E. coli
tgtgggatatcaaagctaaagcggc

SEQ ID NO: 9129 - DNA, 25 bp, E. coli
tcgcacgactggtagatggcacatt

SEQ ID NO: 9130 - DNA, 25 bp, E. coli
tcgcacgactggaagatggcacatt

SEQ ID NO: 9131 - DNA, 25 bp, E. coli
tctgattcgccaccataccgtgacg

SEQ ID NO: 9132 - DNA, 25 bp, E. coli
tctgattcgccagcataccgtgacg

SEQ ID NO: 9133 - DNA, 25 bp, E. coli
ccaaactttggcgttcaggagtaca

SEQ ID NO: 9134 - DNA, 25 bp, E. coli
ccaaactttggccttcaggagtaca

SEQ ID NO: 9135 - DNA, 25 bp, E. coli
gaaggttatatggacccaggcgatg

SEQ ID NO: 9136 - DNA, 25 bp, E. coli
gaaggttatatgcacccaggcgatg

SEQ ID NO: 9137 - DNA, 25 bp, E. coli
cgaaatatccgtatgacccggcgta

SEQ ID NO: 9138 - DNA, 25 bp, E. coli
cgaaatatccgtttgacccggcgta

SEQ ID NO: 9139 - DNA, 25 bp, E. coli
cattaccgggatccgacggattgcc

SEQ ID NO: 9140 - DNA, 25 bp, E. coli
cattaccgggatgcgacggattgcc

SEQ ID NO: 9141 - DNA, 25 bp, E. coli
aggtggtcgcgcacgcaaaacagga

SEQ ID NO: 9142 - DNA, 25 bp, E. coli
aggtggtcgcgctcgcaaaacagga

SEQ ID NO: 9143 - DNA, 25 bp, E. coli
ttaaccagctacagaaggaagccag

SEQ ID NO: 9144 - DNA, 25 bp, E. coli
ttaaccagctactgaaggaagccag

SEQ ID NO: 9145 - DNA, 25 bp, E. coli
tgaataccccaagcacagccattaa

SEQ ID NO: 9146 - DNA, 25 bp, E. coli
tgaataccccaaccacagccattaa

SEQ ID NO: 9147 - DNA, 25 bp, E. coli
tcgcaaaacaggaggccaggcttct

SEQ ID NO: 9148 - DNA, 25 bp, E. coli
tcgcaaaacaggtggccaggcttct

SEQ ID NO: 9149 - DNA, 25 bp, E. coli
gcgcggcggctttgtcatcagaaca

SEQ ID NO: 9150 - DNA, 25 bp, E. coli
gcgcggcggcttagtcatcagaaca

SEQ ID NO: 9151 - DNA, 25 bp, E. coli
gaacaaaccgcagcacaggtggtcg

SEQ ID NO: 9152 - DNA, 25 bp, E. coli
gaacaaaccgcaccacaggtggtcg

SEQ ID NO: 9153 - DNA, 25 bp, E. coli
tggactacatcgctactcatccggg

SEQ ID NO: 9154 - DNA, 25 bp, E. coli
tggactacatcggtactcatccggg

SEQ ID NO: 9155 - DNA, 25 bp, E. coli
taatgctgagtttcgccgactttgg

SEQ ID NO: 9156 - DNA, 25 bp, E. coli
taatgctgagttacgccgactttgg

SEQ ID NO: 9157 - DNA, 25 bp, E. coli
gatgccgttcggctgtagcaatcca

SEQ ID NO: 9158 - DNA, 25 bp, E. coli
gaggccaggcttcttaccacgtaaa

SEQ ID NO: 9159 - DNA, 25 bp, E. coli
gatgccgttcgggtgtagcaatcca

SEQ ID NO: 9160 - DNA, 25 bp, E. coli
gagagatcgccgcagcactgaatac

SEQ ID NO: 9161 - DNA, 25 bp, E. coli
gaggccaggcttgttaccacgtaaa

SEQ ID NO: 9162 - DNA, 25 bp, E. coli
gagagatcgccggagcactgaatac

SEQ ID NO: 9163 - DNA, 25 bp, E. coli
aatacggcgagctcgcaacaggtcc

SEQ ID NO: 9164 - DNA, 25 bp, E. coli
aatacggcgagcacgcaacaggtcc

SEQ ID NO: 9165 - DNA, 25 bp, E. coli
cacccagcgtggttacggacgcaat

SEQ ID NO: 9166 - DNA, 25 bp, E. coli
cacccagcgtggatacggacgcaat

SEQ ID NO: 9167 - DNA, 25 bp, E. coli
caacaggtccgggacaggatgaaga

SEQ ID NO: 9168 - DNA, 25 bp, E. coli
caacaggtccggcacaggatgaaga

SEQ ID NO: 9169 - DNA, 25 bp, E. coli
tttacacgcggcaatgggctggtgt

SEQ ID NO: 9170 - DNA, 25 bp, E. coli
ttgcaggcaccggaatacggcgagc

SEQ ID NO: 9171 - DNA, 25 bp, E. coli
ttgcaggcaccgcaatacggcgagc

SEQ ID NO: 9172 - DNA, 25 bp, E. coli
tttacacgcggctatgggctggtgt

SEQ ID NO: 9173 - DNA, 25 bp, E. coli
tcccgcctgcaacaattaatgcgcg

SEQ ID NO: 9174 - DNA, 25 bp, E. coli
tcccgcctgcaagaattaatgcgcg

SEQ ID NO: 9175 - DNA, 25 bp, E. coli
gccggatgaaccaccgcattttaca

SEQ ID NO: 9176 - DNA, 25 bp, E. coli
gccggatgaacctccgcattttaca

SEQ ID NO: 9177 - DNA, 25 bp, E. coli
gcaacaattaatccgcggcgacgaa

SEQ ID NO: 9178 - DNA, 25 bp, E. coli
gcaacaattaatgcgcggcgacgaa

SEQ ID NO: 9179 - DNA, 25 bp, E. coli
cgtatttcagcattttataaagaca

SEQ ID NO: 9180 - DNA, 25 bp, E. coli
cgtatttcagcaatttataaagaca

SEQ ID NO: 9181 - DNA, 25 bp, E. coli
ctggttgaccgtccgttgcaggcac

SEQ ID NO: 9182 - DNA, 25 bp, E. coli
ctggttgaccgtgcgttgcaggcac

SEQ ID NO: 9183 - DNA, 25 bp, E. coli
tggttacggacggaatcatccgttc

SEQ ID NO: 9184 - DNA, 25 bp, E. coli
tggttacggacgcaatcatccgttc

SEQ ID NO: 9185 - DNA, 25 bp, E. coli
caatgtggatgagctgatgtccgcc

SEQ ID NO: 9186 - DNA, 25 bp, E. coli
caatgtggatgacctgatgtccgcc

SEQ ID NO: 9187 - DNA, 25 bp, E. coli
tacgtcgtggcgaagtgctcggcat

SEQ ID NO: 9188 - DNA, 25 bp, E. coli
agtcccggtagctaaagtggtggca

SEQ ID NO: 9189 - DNA, 25 bp, E. coli
agtcccggtagcaaaagtggtggca

SEQ ID NO: 9190 - DNA, 25 bp, E. coli
aaattgtggatcaggccgtgctgga

SEQ ID NO: 9191 - DNA, 25 bp, E. coli
aaattgtggatctggccgtgctgga

SEQ ID NO: 9192 - DNA, 25 bp, E. coli
tacgtcgtggcgtagtgctcggcat

SEQ ID NO: 9193 - DNA, 25 bp, E. coli
tatcaacggcgacaaaatcacgcgc

SEQ ID NO: 9194 - DNA, 25 bp, E. coli
tatcaacggcgagaaaatcacgcgc

SEQ ID NO: 9195 - DNA, 25 bp, E. coli
tgatttatgtcagccaccggatgga

SEQ ID NO: 9196 - DNA, 25 bp, E. coli
tgatttatgtcacccaccggatgga

SEQ ID NO: 9197 - DNA, 25 bp, E. coli
gaaaatacagtgctgaccaatcggc

SEQ ID NO: 9198 - DNA, 25 bp, E. coli
gaaacgcggcataggctatacgcca

SEQ ID NO: 9199 - DNA, 25 bp, E. coli
gaaacgcggcattggctatacgcca

SEQ ID NO: 9200 - DNA, 25 bp, E. coli
gaaaatacagtggtgaccaatcggc

SEQ ID NO: 9201 - DNA, 25 bp, E. coli
cgcgactggaagctgacgaagctac

SEQ ID NO: 9202 - DNA, 25 bp, E. coli
cgcgactggaaggtgacgaagctac

SEQ ID NO: 9203 - DNA, 25 bp, E. coli
gttacgccataagcccaagctggag

SEQ ID NO: 9204 - DNA, 25 bp, E. coli
gttacgccataaccccaagctggag

SEQ ID NO: 9205 - DNA, 25 bp, E. coli
gagccgcgcgtgctcattcttgatg

SEQ ID NO: 9206 - DNA, 25 bp, E. coli
gagccgcgcgtggtcattcttgatg

SEQ ID NO: 9207 - DNA, 25 bp, E. coli
cagcaaaccggcgatggtagcggaa

SEQ ID NO: 9208 - DNA, 25 bp, E. coli
caaaccggcgatggtagcggaagac

SEQ ID NO: 9209 - DNA, 25 bp, E. coli
caaaccggcgatcgtagcggaagac

SEQ ID NO: 9210 - DNA, 25 bp, E. coli
cagcaaaccggccatggtagcggaa

SEQ ID NO: 9211 - DNA, 25 bp, E. coli
agcctgctgggtgggatcatgaaaa

SEQ ID NO: 9212 - DNA, 25 bp, E. coli
accggcgatggtagcggaagactac

SEQ ID NO: 9213 - DNA, 25 bp, E. coli
agcctgctgggtcggatcatgaaaa

SEQ ID NO: 9214 - DNA, 25 bp, E. coli
aaattaccacgttgccgaaagcact

SEQ ID NO: 9215 - DNA, 25 bp, E. coli
accggcgatggttgcggaagactac

SEQ ID NO: 9216 - DNA, 25 bp, E. coli
aaattaccacgtagccgaaagcact

SEQ ID NO: 9217 - DNA, 25 bp, E. coli
tgctggcgaccgttcgcgcaccagg

SEQ ID NO: 9218 - DNA, 25 bp, E. coli
tgctggcgaccgatcgcgcaccagg

SEQ ID NO: 9219 - DNA, 25 bp, E. coli
tcatttttacggttcggacagcgac

SEQ ID NO: 9220 - DNA, 25 bp, E. coli
tcatttttacggatcggacagcgac

SEQ ID NO: 9221 - DNA, 25 bp, E. coli
cctggctgagtaaagctctcatttt

SEQ ID NO: 9222 - DNA, 25 bp, E. coli
cctggctgagtatagctctcatttt

SEQ ID NO: 9223 - DNA, 25 bp, E. coli
gcgatgctggcgtccgatcgcgcac

SEQ ID NO: 9224 - DNA, 25 bp, E. coli
gcgatgctggcgaccgatcgcgcac

SEQ ID NO: 9225 - DNA, 25 bp, E. coli
gctgagtatagcactcatttttacg

SEQ ID NO: 9226 - DNA, 25 bp, E. coli
gctgagtatagctctcatttttacg

SEQ ID NO: 9227 - DNA, 25 bp, E. coli
cgctgcatagcctgctgggtcggat

SEQ ID NO: 9228 - DNA, 25 bp, E. coli
cgctgcatagccagctgggtcggat

SEQ ID NO: 9229 - DNA, 25 bp, E. coli
caacactggttgctcatgccatgaa

SEQ ID NO: 9230 - DNA, 25 bp, E. coli
caacactggttggtcatgccatgaa

SEQ ID NO: 9231 - DNA, 25 bp, E. coli
agcgttactcttcggcgtctggcaa

SEQ ID NO: 9232 - DNA, 25 bp, E. coli
agcgttactcttgggcgtctggcaa

SEQ ID NO: 9233 - DNA, 25 bp, E. coli
acgtcaggtgctcggatattacaca

SEQ ID NO: 9234 - DNA, 25 bp, E. coli
acgtcaggtgctgggatattacaca

SEQ ID NO: 9235 - DNA, 25 bp, E. coli
tagagattctgaccgatgatgcaga

SEQ ID NO: 9236 - DNA, 25 bp, E. coli
tagagattctgagcgatgatgcaga

SEQ ID NO: 9237 - DNA, 25 bp, E. coli
tattcacggtctttttgtcgaggcg

SEQ ID NO: 9238 - DNA, 25 bp, E. coli
tattcacggtctatttgtcgaggcg

SEQ ID NO: 9239 - DNA, 25 bp, E. coli
tgttttgaacgacccgcattgccct

SEQ ID NO: 9240 - DNA, 25 bp, E. coli
tgcggcgaggaaccgttaaatctct

SEQ ID NO: 9241 - DNA, 25 bp, E. coli
tgtcgcaacactgcagaacgtcagg

SEQ ID NO: 9242 - DNA, 25 bp, E. coli
tgtcgcaacactccagaacgtcagg

SEQ ID NO: 9243 - DNA, 25 bp, E. coli
tgtcgaggcgctcaatgaaaaagcc

SEQ ID NO: 9244 - DNA, 25 bp, E. coli
tgttttgaacgagccgcattgccct

SEQ ID NO: 9245 - DNA, 25 bp, E. coli
tgcggcgaggaagcgttaaatctct

SEQ ID NO: 9246 - DNA, 25 bp, E. coli
tgtcgaggcgctgaatgaaaaagcc

SEQ ID NO: 9247 - DNA, 25 bp, E. coli
tctttagcggtacgtattcacggtc

SEQ ID NO: 9248 - DNA, 25 bp, E. coli
tctacagcgattcgactgcggcgag

SEQ ID NO: 9249 - DNA, 25 bp, E. coli
tctttagcggtaggtattcacggtc

SEQ ID NO: 9250 - DNA, 25 bp, E. coli
tctacagcgattggactgcggcgag

SEQ ID NO: 9251 - DNA, 25 bp, E. coli
caccggtgccgaagctgaattgatg

SEQ ID NO: 9252 - DNA, 25 bp, E. coli
caccggtgccgatgctgaattgatg

SEQ ID NO: 9253 - DNA, 25 bp, E. coli
taaacagcgcgtcgaaattgcccat

SEQ ID NO: 9254 - DNA, 25 bp, E. coli
taaacagcgcgtggaaattgcccat

SEQ ID NO: 9255 - DNA, 25 bp, E. coli
agcatatggccagcgacgatctcga

SEQ ID NO: 9256 - DNA, 25 bp, E. coli
agcatatggccaccgacgatctcga

SEQ ID NO: 9257 - DNA, 25 bp, E. coli
tatatgggccgctgaagtgcgcaac

SEQ ID NO: 9258 - DNA, 25 bp, E. coli
tatatgggccgcagaagtgcgcaac

SEQ ID NO: 9259 - DNA, 25 bp, E. coli
tgatgttgccgatcgcctggtgaag

SEQ ID NO: 9260 - DNA, 25 bp, E. coli
tgaaactgacttgcgcattggcgcg

SEQ ID NO: 9261 - DNA, 25 bp, E. coli
tgatgttgccgaacgcctggtgaag

SEQ ID NO: 9262 - DNA, 25 bp, E. coli
tgaaactgacttccgcattggcgcg

SEQ ID NO: 9263 - DNA, 25 bp, E. coli
tccgaccatgcgtgtgttccataag

SEQ ID NO: 9264 - DNA, 25 bp, E. coli
tccgaccatgcgagtgttccataag

SEQ ID NO: 9265 - DNA, 25 bp, E. coli
gttgaagcccacgttacgctcggaa

SEQ ID NO: 9266 - DNA, 25 bp, E. coli
gttgaagcccaccttacgctcggaa

SEQ ID NO: 9267 - DNA, 25 bp, E. coli
tcagaccctaatggaaagcgcctcg

SEQ ID NO: 9268 - DNA, 25 bp, E. coli
tcagaccctaatcgaaagcgcctcg

SEQ ID NO: 9269 - DNA, 25 bp, E. coli
gagaatacgccaaagccgtcgaaag

SEQ ID NO: 9270 - DNA, 25 bp, E. coli
gagaatacgccatagccgtcgaaag

SEQ ID NO: 9271 - DNA, 25 bp, E. coli
gaccgcgcggaacacatgttcaatc

SEQ ID NO: 9272 - DNA, 25 bp, E. coli
gaccgcgcggaagacatgttcaatc

SEQ ID NO: 9273 - DNA, 25 bp, E. coli
cagaagccagttttgttaccggcgc

SEQ ID NO: 9274 - DNA, 25 bp, E. coli
cagaagccagttatgttaccggcgc

SEQ ID NO: 9275 - DNA, 25 bp, E. coli
cagggccaattgataccgacgctaa

SEQ ID NO: 9276 - DNA, 25 bp, E. coli
cagggccaattgttaccgacgctaa

SEQ ID NO: 9277 - DNA, 25 bp, E. coli
tatggtcgcatgcttagcagggcca

SEQ ID NO: 9278 - DNA, 25 bp, E. coli
taccggcgcgatccataccattgat

SEQ ID NO: 9279 - DNA, 25 bp, E. coli
taccggcgcgatgcataccattgat

SEQ ID NO: 9280 - DNA, 25 bp, E. coli
tatggtcgcatggttagcagggcca

SEQ ID NO: 9281 - DNA, 25 bp, E. coli
ccaatgtacgattcacctatgcggg

SEQ ID NO: 9282 - DNA, 25 bp, E. coli
ccgtgattttggaccgcgtgggatc

SEQ ID NO: 9283 - DNA, 25 bp, E. coli
ccaatgtacgatacacctatgcggg

SEQ ID NO: 9284 - DNA, 25 bp, E. coli
ccgtgattttggtccgcgtgggatc

SEQ ID NO: 9285 - DNA, 25 bp, E. coli
gctatcaaaagagatgggcaaccgg

SEQ ID NO: 9286 - DNA, 25 bp, E. coli
gctatcaaaagacatgggcaaccgg

SEQ ID NO: 9287 - DNA, 25 bp, E. coli
cattgatgtcgtacgtaagagcggc

SEQ ID NO: 9288 - DNA, 25 bp, E. coli
cattgatgtcgttcgtaagagcggc

SEQ ID NO: 9289 - DNA, 25 bp, E. coli
taatcatcggctccgtgaatggcga

SEQ ID NO: 9290 - DNA, 25 bp, E. coli
taagagcggcgcattggatatcctg

SEQ ID NO: 9291 - DNA, 25 bp, E. coli
taatcatcggctgcgtgaatggcga

SEQ ID NO: 9292 - DNA, 25 bp, E. coli
taagacagttctgatcctcggtggc

SEQ ID NO: 9293 - DNA, 25 bp, E. coli
taagacagttctcatcctcggtggc

SEQ ID NO: 9294 - DNA, 25 bp, E. coli
taagagcggcgctttggatatcctg

SEQ ID NO: 9295 - DNA, 25 bp, E. coli
aatgagcccttaagatgcagcctgt

SEQ ID NO: 9296 - DNA, 25 bp, E. coli
aatgagcccttatgatgcagcctgt

SEQ ID NO: 9297 - DNA, 25 bp, E. coli
caaagcgatcggaattgatgtcacg

SEQ ID NO: 9298 - DNA, 25 bp, E. coli
caaagcgatcggtattgatgtcacg

SEQ ID NO: 9299 - DNA, 25 bp, E. coli
aaaaatgagcccatatgatgcagcc

SEQ ID NO: 9300 - DNA, 25 bp, E. coli
aaaaatgagcccttatgatgcagcc

SEQ ID NO: 9301 - DNA, 25 bp, E. coli
ttgcttgggcaataaatgagccctt

SEQ ID NO: 9302 - DNA, 25 bp, E. coli
ttgcttgggcaaaaaatgagccctt

SEQ ID NO: 9303 - DNA, 25 bp, E. coli
tgtcacgctgctcgcccaggaaagt

SEQ ID NO: 9304 - DNA, 25 bp, E. coli
tgtcacgctgctggcccaggaaagt

SEQ ID NO: 9305 - DNA, 25 bp, E. coli
tcggtattgatgacacgctgctggc

SEQ ID NO: 9306 - DNA, 25 bp, E. coli
taatactcacccagcgccgattgtg

SEQ ID NO: 9307 - DNA, 25 bp, E. coli
taatactcaccctgcgccgattgtg

SEQ ID NO: 9308 - DNA, 25 bp, E. coli
tcggtattgatgtcacgctgctggc

SEQ ID NO: 9309 - DNA, 25 bp, E. coli
gctgctggcccaggaaagtgacaaa

SEQ ID NO: 9310 - DNA, 25 bp, E. coli
gctgctggcccacgaaagtgacaaa

SEQ ID NO: 9311 - DNA, 25 bp, E. coli
ctggcccaggaaagtgacaaaccgt

SEQ ID NO: 9312 - DNA, 25 bp, E. coli
ctggcccaggaatgtgacaaaccgt

SEQ ID NO: 9313 - DNA, 25 bp, E. coli
gtattgatgtcacgctgctggccca

SEQ ID NO: 9314 - DNA, 25 bp, E. coli
gtattgatgtcaggctgctggccca

SEQ ID NO: 9315 - DNA, 25 bp, E. coli
tggccaaagcgaacggtattgatgt

SEQ ID NO: 9316 - DNA, 25 bp, E. coli
tggccaaagcgatcggtattgatgt

SEQ ID NO: 9317 - DNA, 25 bp, E. coli
caggcgtttcataccacggatggag

SEQ ID NO: 9318 - DNA, 25 bp, E. coli
caggcgtttcattccacggatggag

SEQ ID NO: 9319 - DNA, 25 bp, E. coli
catgtgggagtgaaatgacgccaac

SEQ ID NO: 9320 - DNA, 25 bp, E. coli
catgtgggagtgtaatgacgccaac

SEQ ID NO: 9321 - DNA, 25 bp, E. coli
taccacggatggagaaaatcgaact

SEQ ID NO: 9322 - DNA, 25 bp, E. coli
taccacggatggtgaaaatcgaact

SEQ ID NO: 9323 - DNA, 25 bp, E. coli
aaatcgaactgggagttcttcaggc

SEQ ID NO: 9324 - DNA, 25 bp, E. coli
aaatcgaactggcagttcttcaggc

SEQ ID NO: 9325 - DNA, 25 bp, E. coli
tacgctcgtcagaacgatggagagt

SEQ ID NO: 9326 - DNA, 25 bp, E. coli
tacgctcgtcagtacgatggagagt

SEQ ID NO: 9327 - DNA, 25 bp, E. coli
ttgatgcccgacttccatgtgggag

SEQ ID NO: 9328 - DNA, 25 bp, E. coli
ttgatgcccgacatccatgtgggag

SEQ ID NO: 9329 - DNA, 25 bp, E. coli
tggtcgaaaaagtagttgatgcccg

SEQ ID NO: 9330 - DNA, 25 bp, E. coli
tgaaaaagagattatcaggcgtttc

SEQ ID NO: 9331 - DNA, 25 bp, E. coli
tgaaaaagagataatcaggcgtttc

SEQ ID NO: 9332 - DNA, 25 bp, E. coli
gccgttgttaatctgcgtacgctcg

SEQ ID NO: 9333 - DNA, 25 bp, E. coli
gccgttgttaatgtgcgtacgctcg

SEQ ID NO: 9334 - DNA, 25 bp, E. coli
cgatggagagtaagctgactgaaaa

SEQ ID NO: 9335 - DNA, 25 bp, E. coli
cgatggagagtatgctgactgaaaa

SEQ ID NO: 9336 - DNA, 25 bp, E. coli
tggtcgaaaaagaagttgatgcccg

SEQ ID NO: 9337 - DNA, 25 bp, E. coli
taacggctaagatcgtggtcgaaaa

SEQ ID NO: 9338 - DNA, 25 bp, E. coli
taacggctaagaacgtggtcgaaaa

SEQ ID NO: 9339 - DNA, 25 bp, E. coli
agttgctatttaaggttgtgacaac

SEQ ID NO: 9340 - DNA, 25 bp, E. coli
agttgctatttatggttgtgacaac

SEQ ID NO: 9341 - DNA, 25 bp, E. coli
tattggcataggtctggcaggaagt

SEQ ID NO: 9342 - DNA, 25 bp, E. coli
tattggcataggactggcaggaagt

SEQ ID NO: 9343 - DNA, 25 bp, E. coli
tgttatccgtaatatcaaagctcgt

SEQ ID NO: 9344 - DNA, 25 bp, E. coli
tgttatccgtaaaatcaaagctcgt

SEQ ID NO: 9345 - DNA, 25 bp, E. coli
tcacgggatcagattgtcggcaact

SEQ ID NO: 9346 - DNA, 25 bp, E. coli
tcacgggatcagtttgtcggcaact

SEQ ID NO: 9347 - DNA, 25 bp, E. coli
gaatgtagcaatgaacgatcgcgac

SEQ ID NO: 9348 - DNA, 25 bp, E. coli
gcaactgatccatgttgaaaatggt

SEQ ID NO: 9349 - DNA, 25 bp, E. coli
gaatgtagcaatcaacgatcgcgac

SEQ ID NO: 9350 - DNA, 25 bp, E. coli
gcaactgatccaagttgaaaatggt

SEQ ID NO: 9351 - DNA, 25 bp, E. coli
gactggcaggaactacttacgataa

SEQ ID NO: 9352 - DNA, 25 bp, E. coli
gactggcaggaagtacttacgataa

SEQ ID NO: 9353 - DNA, 25 bp, E. coli
cgccattgaatgcaatgtagcaatc

SEQ ID NO: 9354 - DNA, 25 bp, E. coli
cgccattgaatggaatgtagcaatc

SEQ ID NO: 9355 - DNA, 25 bp, E. coli
gatcgcgacattatgatatccgacc

SEQ ID NO: 9356 - DNA, 25 bp, E. coli
gatcgcgacattttgatatccgacc

SEQ ID NO: 9357 - DNA, 25 bp, E. coli
gattgtcggcaactgatccatgttg

SEQ ID NO: 9358 - DNA, 25 bp, E. coli
gattgtcggcaagtgatccatgttg

SEQ ID NO: 9359 - DNA, 25 bp, E. coli
taattatccggaaaaccaggcagtg

SEQ ID NO: 9360 - DNA, 25 bp, E. coli
taattatccggataaccaggcagtg

SEQ ID NO: 9361 - DNA, 25 bp, E. coli
cacctttgaagtcgcggagctggtt

SEQ ID NO: 9362 - DNA, 25 bp, E. coli
cacctttgaagtggcggagctggtt

SEQ ID NO: 9363 - DNA, 25 bp, E. coli
taaaaagcaacgacgtgcgtgaacc

SEQ ID NO: 9364 - DNA, 25 bp, E. coli
taaaaagcaacgtcgtgcgtgaacc

SEQ ID NO: 9365 - DNA, 25 bp, E. coli
tgtttcgccgtggacactaaggtaa

SEQ ID NO: 9366 - DNA, 25 bp, E. coli
tgtttcgccgtgcacactaaggtaa

SEQ ID NO: 9367 - DNA, 25 bp, E. coli
taaagtcgcctaaatccgttttgcc

SEQ ID NO: 9368 - DNA, 25 bp, E. coli
taaagtcgcctatatccgttttgcc

SEQ ID NO: 9369 - DNA, 25 bp, E. coli
tctcgtgggcgacggttcatccgta

SEQ ID NO: 9370 - DNA, 25 bp, E. coli
tctcgtgggcgagggttcatccgta

SEQ ID NO: 9371 - DNA, 25 bp, E. coli
tccgatgacgtcgaaatggcaatca

SEQ ID NO: 9372 - DNA, 25 bp, E. coli
tccgatgacgtccaaatggcaatca

SEQ ID NO: 9373 - DNA, 25 bp, E. coli
gcgcgaagtgcccagcaagatgatt

SEQ ID NO: 9374 - DNA, 25 bp, E. coli
gcgcgaagtgccgagcaagatgatt

SEQ ID NO: 9375 - DNA, 25 bp, E. coli
gaatttggcgaacagatcgcgcgcc

SEQ ID NO: 9376 - DNA, 25 bp, E. coli
gaatttggcgaagagatcgcgcgcc

SEQ ID NO: 9377 - DNA, 25 bp, E. coli
gaaaaacgtccggtgagttccgatg

SEQ ID NO: 9378 - DNA, 25 bp, E. coli
gaaaaacgtccgctgagttccgatg

SEQ ID NO: 9379 - DNA, 25 bp, E. coli
ggttatgccgcgagttgtaaaaagc

SEQ ID NO: 9380 - DNA, 25 bp, E. coli
ggttatgccgcgtgttgtaaaaagc

SEQ ID NO: 9381 - DNA, 25 bp, E. coli
taattgactctcctctcgtgggcga

SEQ ID NO: 9382 - DNA, 25 bp, E. coli
taattgactctcgtctcgtgggcga

SEQ ID NO: 9383 - DNA, 25 bp, E. coli
tagcgttacgttaccctctcgatga

SEQ ID NO: 9384 - DNA, 25 bp, E. coli
tagaggaaatcagttcaagcgacaa

SEQ ID NO: 9385 - DNA, 25 bp, E. coli
tagaggaaatcacttcaagcgacaa

SEQ ID NO: 9386 - DNA, 25 bp, E. coli
tagcgttacgtttccctctcgatga

SEQ ID NO: 9387 - DNA, 25 bp, E. coli
tttgcagagaatggtgggccatatc

SEQ ID NO: 9388 - DNA, 25 bp, E. coli
tttgcagagaatcgtgggccatatc

SEQ ID NO: 9389 - DNA, 25 bp, E. coli
ttatggtgtctgagggaaattcccg

SEQ ID NO: 9390 - DNA, 25 bp, E. coli
ttatggtgtctgtgggaaattcccg

SEQ ID NO: 9391 - DNA, 25 bp, E. coli
tgaggctggagcacaatcgctgttg

SEQ ID NO: 9392 - DNA, 25 bp, E. coli
tgaggctggagctcaatcgctgttg

SEQ ID NO: 9393 - DNA, 25 bp, E. coli
tgatgctaccccagaaaaactcgag

SEQ ID NO: 9394 - DNA, 25 bp, E. coli
tgatgctacccctgaaaaactcgag

SEQ ID NO: 9395 - DNA, 25 bp, E. coli
gccatatctgtgctatgaggctgga

SEQ ID NO: 9396 - DNA, 25 bp, E. coli
gccatatctgtggtatgaggctgga

SEQ ID NO: 9397 - DNA, 25 bp, E. coli
cgttgttaagtctatggaaaacctg

SEQ ID NO: 9398 - DNA, 25 bp, E. coli
cgttgttaagtcaatggaaaacctg

SEQ ID NO: 9399 - DNA, 25 bp, E. coli
gataactctaacttcgctcttgaga

SEQ ID NO: 9400 - DNA, 25 bp, E. coli
gataactctaacatcgctcttgaga

SEQ ID NO: 9401 - DNA, 25 bp, E. coli
gggaaattcccgacagataactcta

SEQ ID NO: 9402 - DNA, 25 bp, E. coli
gggaaattcccgtcagataactcta

SEQ ID NO: 9403 - DNA, 25 bp, E. coli
gatgccaatgaccaatatatgatga

SEQ ID NO: 9404 - DNA, 25 bp, E. coli
gatgccaatgacgaatatatgatga

SEQ ID NO: 9405 - DNA, 25 bp, E. coli
aatgttcagggcgtcgatgtgcgta

SEQ ID NO: 9406 - DNA, 25 bp, E. coli
aatgttcagggcctcgatgtgcgta

SEQ ID NO: 9407 - DNA, 25 bp, E. coli
aaacatcttggcgttgaggcgtcac

SEQ ID NO: 9408 - DNA, 25 bp, E. coli
aaacatcttggccttgaggcgtcac

SEQ ID NO: 9409 - DNA, 25 bp, E. coli
tgctggcgtcgcaggactctaaacg

SEQ ID NO: 9410 - DNA, 25 bp, E. coli
tgctggcgtcgctggactctaaacg

SEQ ID NO: 9411 - DNA, 25 bp, E. coli
tctgggcaccaagtatgaagagtgg

SEQ ID NO: 9412 - DNA, 25 bp, E. coli
tctgggcaccaactatgaagagtgg

SEQ ID NO: 9413 - DNA, 25 bp, E. coli
gaagtggaatttccccaacagctgg

SEQ ID NO: 9414 - DNA, 25 bp, E. coli
gaagtggaatttgcccaacagctgg

SEQ ID NO: 9415 - DNA, 25 bp, E. coli
gaaattagcacaactgggacgtcag

SEQ ID NO: 9416 - DNA, 25 bp, E. coli
gaaaaccaacgatacgctggcagta

SEQ ID NO: 9417 - DNA, 25 bp, E. coli
gaaattagcacatctgggacgtcag

SEQ ID NO: 9418 - DNA, 25 bp, E. coli
gaaaaccaacgaaacgctggcagta

SEQ ID NO: 9419 - DNA, 25 bp, E. coli
gtacctatgatgatgacccgaccaa

SEQ ID NO: 9420 - DNA, 25 bp, E. coli
gtacctatgatgttgacccgaccaa

SEQ ID NO: 9421 - DNA, 25 bp, E. coli
tggcagtaaccgctgaagcattctc

SEQ ID NO: 9422 - DNA, 25 bp, E. coli
tggcagtaaccggtgaagcattctc

SEQ ID NO: 9423 - DNA, 25 bp, E. coli
tcactaaaaccgaccaaatgggacg

SEQ ID NO: 9424 - DNA, 25 bp, E. coli
tcactaaaaccgtccaaatgggacg

SEQ ID NO: 9425 - DNA, 25 bp, E. coli
gaccaaatatcaggatctgcgcgta

SEQ ID NO: 9426 - DNA, 25 bp, E. coli
gaccaaatatcacgatctgcgcgta

SEQ ID NO: 9427 - DNA, 25 bp, E. coli
catttagcctggcagatagcgagca

SEQ ID NO: 9428 - DNA, 25 bp, E. coli
atcatgtccggttcgccagctgaga

SEQ ID NO: 9429 - DNA, 25 bp, E. coli
atcatgtccggtacgccagctgaga

SEQ ID NO: 9430 - DNA, 25 bp, E. coli
ttgcaggtcatgagtacccgcgacg

SEQ ID NO: 9431 - DNA, 25 bp, E. coli
ttcaagagcatctacgatacctggg

SEQ ID NO: 9432 - DNA, 25 bp, E. coli
ttgcaggtcatgtgtacccgcgacg

SEQ ID NO: 9433 - DNA, 25 bp, E. coli
ttcaagagcatcaacgatacctggg

SEQ ID NO: 9434 - DNA, 25 bp, E. coli
tgtcgttcaatagtgcgccgctgga

SEQ ID NO: 9435 - DNA, 25 bp, E. coli
tgtcgttcaatactgcgccgctgga

SEQ ID NO: 9436 - DNA, 25 bp, E. coli
tgctgccttccagcgcgatgttgat

SEQ ID NO: 9437 - DNA, 25 bp, E. coli
tgctgccttccaccgcgatgttgat

SEQ ID NO: 9438 - DNA, 25 bp, E. coli
gaatttgataacagtcggcggcata

SEQ ID NO: 9439 - DNA, 25 bp, E. coli
gaatttgataactgtcggcggcata

SEQ ID NO: 9440 - DNA, 25 bp, E. coli
cgtaatgggcgttaacgtgctgcct

SEQ ID NO: 9441 - DNA, 25 bp, E. coli
catttagcctgggagatagcgagca

SEQ ID NO: 9442 - DNA, 25 bp, E. coli
cgtaatgggcgtaaacgtgctgcct

SEQ ID NO: 9443 - DNA, 25 bp, E. coli
gattgtggcgctaacccgacagtta

SEQ ID NO: 9444 - DNA, 25 bp, E. coli
gattgtggcgcttacccgacagtta

SEQ ID NO: 9445 - DNA, 25 bp, E. coli
tggcggaacataaacgcaggttgca

SEQ ID NO: 9446 - DNA, 25 bp, E. coli
tggcggaacatatacgcaggttgca

SEQ ID NO: 9447 - DNA, 25 bp, E. coli
taaccgacgtcattgggaaactatg

SEQ ID NO: 9448 - DNA, 25 bp, E. coli
taaccgacgtcaatgggaaactatg

SEQ ID NO: 9449 - DNA, 25 bp, E. coli
aattcgcactttggcctttgtcgag

SEQ ID NO: 9450 - DNA, 25 bp, E. coli
aattcgcactttcgcctttgtcgag

SEQ ID NO: 9451 - DNA, 25 bp, E. coli
cactttcgccttagtcgagcacgat

SEQ ID NO: 9452 - DNA, 25 bp, E. coli
cactttcgcctttgtcgagcacgat

SEQ ID NO: 9453 - DNA, 25 bp, E. coli
tatggtgcagcctcacttgctggcg

SEQ ID NO: 9454 - DNA, 25 bp, E. coli
tatggtgcagccacacttgctggcg

SEQ ID NO: 9455 - DNA, 25 bp, E. coli
ttcccgtgaatccattgcaaatacg

SEQ ID NO: 9456 - DNA, 25 bp, E. coli
ttcccgtgaatcgattgcaaatacg

SEQ ID NO: 9457 - DNA, 25 bp, E. coli
tcgagcacgataaggtgcagccaca

SEQ ID NO: 9458 - DNA, 25 bp, E. coli
tcgcctttgtcgagcacgatatggt

SEQ ID NO: 9459 - DNA, 25 bp, E. coli
tcgagcacgatatggtgcagccaca

SEQ ID NO: 9460 - DNA, 25 bp, E. coli
tcgcctttgtcgtgcacgatatggt

SEQ ID NO: 9461 - DNA, 25 bp, E. coli
tgcgtaagcgcaagaaatttcccgt

SEQ ID NO: 9462 - DNA, 25 bp, E. coli
tgcgtaagcgcatgaaatttcccgt

SEQ ID NO: 9463 - DNA, 25 bp, E. coli
gcccatgcaactcgaaattcgcact

SEQ ID NO: 9464 - DNA, 25 bp, E. coli
gcccatgcaactggaaattcgcact

SEQ ID NO: 9465 - DNA, 25 bp, E. coli
gcgcatgaaattacccgtgaatcga

SEQ ID NO: 9466 - DNA, 25 bp, E. coli
gcgcatgaaatttcccgtgaatcga

SEQ ID NO: 9467 - DNA, 25 bp, E. coli
gcgtggcccatggaactggaaattc

SEQ ID NO: 9468 - DNA, 25 bp, E. coli
gcgtggcccatgcaactggaaattc

SEQ ID NO: 9469 - DNA, 25 bp, E. coli
gaaatttcccgtcaatcgattgcaa

SEQ ID NO: 9470 - DNA, 25 bp, E. coli
gaaatttcccgtgaatcgattgcaa

SEQ ID NO: 9471 - DNA, 25 bp, E. coli
aattcaggcatcgaaaggaactggc

SEQ ID NO: 9472 - DNA, 25 bp, E. coli
aattcaggcatccaaaggaactggc

SEQ ID NO: 9473 - DNA, 25 bp, E. coli
catcgaaaggaactggctggtttcc

SEQ ID NO: 9474 - DNA, 25 bp, E. coli
catcgaaaggaagtggctggtttcc

SEQ ID NO: 9475 - DNA, 25 bp, E. coli
taaactatgggaacaaattcaggca

SEQ ID NO: 9476 - DNA, 25 bp, E. coli
taaactatgggatcaaattcaggca

SEQ ID NO: 9477 - DNA, 25 bp, E. coli
tcaggcatcgaaaggaactggctgg

SEQ ID NO: 9478 - DNA, 25 bp, E. coli
tcaggcatcgaatggaactggctgg

SEQ ID NO: 9479 - DNA, 25 bp, E. coli
gaattaaccattgcggataaactat

SEQ ID NO: 9480 - DNA, 25 bp, E. coli
gaattaaccattccggataaactat

SEQ ID NO: 9481 - DNA, 25 bp, E. coli
cattccggataatctatgggatcaa

SEQ ID NO: 9482 - DNA, 25 bp, E. coli
cattccggataaactatgggatcaa

SEQ ID NO: 9483 - DNA, 25 bp, E. coli
ctatgggatcaatttcaggcatcga

SEQ ID NO: 9484 - DNA, 25 bp, E. coli
ctatgggatcaaattcaggcatcga

SEQ ID NO: 9485 - DNA, 25 bp, E. coli
gggatcaaattcaggcatcgaaagg

SEQ ID NO: 9486 - DNA, 25 bp, E. coli
gggatcaaattctggcatcgaaagg

SEQ ID NO: 9487 - DNA, 25 bp, E. coli
tggctggtttcccttaatggattaa

SEQ ID NO: 9488 - DNA, 25 bp, E. coli
tggctggtttccgttaatggattaa

SEQ ID NO: 9489 - DNA, 25 bp, E. coli
tcaaattcaggcttcgaaaggaact

SEQ ID NO: 9490 - DNA, 25 bp, E. coli
tcaaattcaggcatcgaaaggaact

SEQ ID NO: 9491 - DNA, 25 bp, E. coli
taaccattccggttaaactatggga

SEQ ID NO: 9492 - DNA, 25 bp, E. coli
taaccattccggataaactatggga

SEQ ID NO: 9493 - DNA, 25 bp, E. coli
caggtcgttcttgaggttcagaaac

SEQ ID NO: 9494 - DNA, 25 bp, E. coli
caggtcgttcttcaggttcagaaac

SEQ ID NO: 9495 - DNA, 25 bp, E. coli
ttttcaggtcgtacttcaggttcag

SEQ ID NO: 9496 - DNA, 25 bp, E. coli
tttcaggtcgttcttcaggttcaga

SEQ ID NO: 9497 - DNA, 25 bp, E. coli
tttcaggtcgttgttcaggttcaga

SEQ ID NO: 9498 - DNA, 25 bp, E. coli
ttttcaggtcgttcttcaggttcag

SEQ ID NO: 9499 - DNA, 25 bp, E. coli
tttttcaggtcgttcttcaggttca

SEQ ID NO: 9500 - DNA, 25 bp, E. coli
tttttcaggtcgatcttcaggttca

SEQ ID NO: 9501 - DNA, 25 bp, E. coli
tgactttttcaggtcgttcttcagg

SEQ ID NO: 9502 - DNA, 25 bp, E. coli
tgactttttcagctcgttcttcagg

SEQ ID NO: 9503 - DNA, 25 bp, E. coli
tcttcaggttcacaaaccttcattc

SEQ ID NO: 9504 - DNA, 25 bp, E. coli
tcaggtcgttcttcaggttcagaaa

SEQ ID NO: 9505 - DNA, 25 bp, E. coli
tcaggttcagaatccttcattcatc

SEQ ID NO: 9506 - DNA, 25 bp, E. coli
tcaggtcgttctacaggttcagaaa

SEQ ID NO: 9507 - DNA, 25 bp, E. coli
tcttcaggttcagaaaccttcattc

SEQ ID NO: 9508 - DNA, 25 bp, E. coli
tcaggttcagaaaccttcattcatc

SEQ ID NO: 9509 - DNA, 25 bp, E. coli
gactttttcaggacgttcttcaggt

SEQ ID NO: 9510 - DNA, 25 bp, E. coli
gactttttcaggtcgttcttcaggt

SEQ ID NO: 9511 - DNA, 25 bp, E. coli
cgttcttcaggttcagaaaccttca

SEQ ID NO: 9512 - DNA, 25 bp, E. coli
cgttcttcaggtacagaaaccttca

SEQ ID NO: 9513 - DNA, 25 bp, E. coli
ggtcgttcttcaggttcagaaacct

SEQ ID NO: 9514 - DNA, 25 bp, E. coli
ggtcgttcttcacgttcagaaacct

SEQ ID NO: 9515 - DNA, 25 bp, E. coli
cacggtgagacatcgttactgacgg

SEQ ID NO: 9516 - DNA, 25 bp, E. coli
cacggtgagacaacgttactgacgg

SEQ ID NO: 9517 - DNA, 25 bp, E. coli
caggcgtgctcaatgggcgctatcg

SEQ ID NO: 9518 - DNA, 25 bp, E. coli
caggcgtgctcattgggcgctatcg

SEQ ID NO: 9519 - DNA, 25 bp, E. coli
gaaagttactgacgaaaagagtacg

SEQ ID NO: 9520 - DNA, 25 bp, E. coli
gaaagttactgaggaaaagagtacg

SEQ ID NO: 9521 - DNA, 25 bp, E. coli
gcaatgtgtgctggtggatctgttt

SEQ ID NO: 9522 - DNA, 25 bp, E. coli
gcaatgtgtgctcgtggatctgttt

SEQ ID NO: 9523 - DNA, 25 bp, E. coli
ccgctgaagaaagttactgaggaaa

SEQ ID NO: 9524 - DNA, 25 bp, E. coli
ccgctgaagaaacttactgaggaaa

SEQ ID NO: 9525 - DNA, 25 bp, E. coli
cattatcatggcagccgggttaccg

SEQ ID NO: 9526 - DNA, 25 bp, E. coli
cattatcatggctgccgggttaccg

SEQ ID NO: 9527 - DNA, 25 bp, E. coli
gatctgtttgctggttatccgctga

SEQ ID NO: 9528 - DNA, 25 bp, E. coli
gggcgcgcaacacgatcaactgtat

SEQ ID NO: 9529 - DNA, 25 bp, E. coli
gggcgcgcaacaggatcaactgtat

SEQ ID NO: 9530 - DNA, 25 bp, E. coli
tcaaaccaggcgtgctcaatgggcg

SEQ ID NO: 9531 - DNA, 25 bp, E. coli
tcaaaccaggcgagctcaatgggcg

SEQ ID NO: 9532 - DNA, 25 bp, E. coli
gatctgtttgctcgttatccgctga

SEQ ID NO: 9533 - DNA, 25 bp, E. coli
gagacaacgttactgacggtaaagg

SEQ ID NO: 9534 - DNA, 25 bp, E. coli
gagtacgacggcattcaaaccaggc

SEQ ID NO: 9535 - DNA, 25 bp, E. coli
gagtacgacggctttcaaaccaggc

SEQ ID NO: 9536 - DNA, 25 bp, E. coli
gagacaacgttagtgacggtaaagg

SEQ ID NO: 9537 - DNA, 25 bp, E. coli
cactatgggcggctgatgcagaaac

SEQ ID NO: 9538 - DNA, 25 bp, E. coli
cactatgggcgggtgatgcagaaac

SEQ ID NO: 9539 - DNA, 25 bp, E. coli
cacggcgaaacctgaagttcaggac

SEQ ID NO: 9540 - DNA, 25 bp, E. coli
acgaaactcttgtcacttacgccga

SEQ ID NO: 9541 - DNA, 25 bp, E. coli
acgaaactcttgacacttacgccga

SEQ ID NO: 9542 - DNA, 25 bp, E. coli
cacggcgaaaccagaagttcaggac

SEQ ID NO: 9543 - DNA, 25 bp, E. coli
atggttcactgctgccacgctggcg

SEQ ID NO: 9544 - DNA, 25 bp, E. coli
atggttcactgcagccacgctggcg

SEQ ID NO: 9545 - DNA, 25 bp, E. coli
cactttcggcaggacagcttgaacg

SEQ ID NO: 9546 - DNA, 25 bp, E. coli
cactttcggcagcacagcttgaacg

SEQ ID NO: 9547 - DNA, 25 bp, E. coli
tataagctctccagcccgattactg

SEQ ID NO: 9548 - DNA, 25 bp, E. coli
tataagctctcctgcccgattactg

SEQ ID NO: 9549 - DNA, 25 bp, E. coli
tgcgggtacacctgactttgcagcg

SEQ ID NO: 9550 - DNA, 25 bp, E. coli
tgcgggtacaccagactttgcagcg

SEQ ID NO: 9551 - DNA, 25 bp, E. coli
gcgctttcaatcgatggccaatgag

SEQ ID NO: 9552 - DNA, 25 bp, E. coli
gcgctttcaatccatggccaatgag

SEQ ID NO: 9553 - DNA, 25 bp, E. coli
gaagaagcgcgtattgactggtcac

SEQ ID NO: 9554 - DNA, 25 bp, E. coli
gaagaagcgcgttttgactggtcac

SEQ ID NO: 9555 - DNA, 25 bp, E. coli
gataccagtggtacgctgtacgaca

SEQ ID NO: 9556 - DNA, 25 bp, E. coli
gataccagtggttcgctgtacgaca

SEQ ID NO: 9557 - DNA, 25 bp, E. coli
ggtaaaaaactgttgcccagcccgg

SEQ ID NO: 9558 - DNA, 25 bp, E. coli
ggtaaaaaactgatgcccagcccgg

SEQ ID NO: 9559 - DNA, 25 bp, E. coli
caatagtgtaaaaaacgagccgctg

SEQ ID NO: 9560 - DNA, 25 bp, E. coli
caatagtgtaaataacgagccgctg

SEQ ID NO: 9561 - DNA, 25 bp, E. coli
agagattcacgtcccgaacgcacaa

SEQ ID NO: 9562 - DNA, 25 bp, E. coli
atttttcaaccaccagagattcacg

SEQ ID NO: 9563 - DNA, 25 bp, E. coli
atttttcaaccagcagagattcacg

SEQ ID NO: 9564 - DNA, 25 bp, E. coli
agagattcacgtgccgaacgcacaa

SEQ ID NO: 9565 - DNA, 25 bp, E. coli
aaaaatccttcaacgcatagtgcag

SEQ ID NO: 9566 - DNA, 25 bp, E. coli
aaaaatccttcatcgcatagtgcag

SEQ ID NO: 9567 - DNA, 25 bp, E. coli
tattcctccccatgaatcgatgtgg

SEQ ID NO: 9568 - DNA, 25 bp, E. coli
tattcctccccaagaatcgatgtgg

SEQ ID NO: 9569 - DNA, 25 bp, E. coli
tctaattatcctggagtcgtcaagg

SEQ ID NO: 9570 - DNA, 25 bp, E. coli
tctaattatcctcgagtcgtcaagg

SEQ ID NO: 9571 - DNA, 25 bp, E. coli
gcgtgtcacagaacaagaaaatact

SEQ ID NO: 9572 - DNA, 25 bp, E. coli
gcgtgtcacagatcaagaaaatact

SEQ ID NO: 9573 - DNA, 25 bp, E. coli
gaacgcacaaattatcgcctgaaaa

SEQ ID NO: 9574 - DNA, 25 bp, E. coli
gaacgcacaaataatcgcctgaaaa

SEQ ID NO: 9575 - DNA, 25 bp, E. coli
cgtgaagagcagagaatctggcgct

SEQ ID NO: 9576 - DNA, 25 bp, E. coli
cattgcttcacaacggacacgattc

SEQ ID NO: 9577 - DNA, 25 bp, E. coli
cgtgaagagcagtgaatctggcgct

SEQ ID NO: 9578 - DNA, 25 bp, E. coli
cattgcttcacatcggacacgattc

SEQ ID NO: 9579 - DNA, 25 bp, E. coli
gatgtggcgtccttctgccgtgaag

SEQ ID NO: 9580 - DNA, 25 bp, E. coli
gatgtggcgtccatctgccgtgaag

SEQ ID NO: 9581 - DNA, 25 bp, E. coli
cagcagcatttactggcagcgatta

SEQ ID NO: 9582 - DNA, 25 bp, E. coli
cagcagcatttagtggcagcgatta

SEQ ID NO: 9583 - DNA, 25 bp, E. coli
gcccgcacgttatacaaccgttttg

SEQ ID NO: 9584 - DNA, 25 bp, E. coli
gcccgcacgttaaacaaccgttttg

SEQ ID NO: 9585 - DNA, 25 bp, E. coli
aaaacagcagcatttactggcagcg

SEQ ID NO: 9586 - DNA, 25 bp, E. coli
aaaacagcagcaattactggcagcg

SEQ ID NO: 9587 - DNA, 25 bp, E. coli
ttccgtttttacctccgcgtgacat

SEQ ID NO: 9588 - DNA, 25 bp, E. coli
ttccgtttttacgtccgcgtgacat

SEQ ID NO: 9589 - DNA, 25 bp, E. coli
ttttcaccacgacgttgcataccct

SEQ ID NO: 9590 - DNA, 25 bp, E. coli
ttttcaccacgaggttgcataccct

SEQ ID NO: 9591 - DNA, 25 bp, E. coli
tgctgtgccccaatccgtttttacg

SEQ ID NO: 9592 - DNA, 25 bp, E. coli
tgctgtgccccattccgtttttacg

SEQ ID NO: 9593 - DNA, 25 bp, E. coli
gcagcgattaccgattattaccaac

SEQ ID NO: 9594 - DNA, 25 bp, E. coli
gcaggagccacctgtctggctggat

SEQ ID NO: 9595 - DNA, 25 bp, E. coli
gcaggagccaccagtctggctggat

SEQ ID NO: 9596 - DNA, 25 bp, E. coli
gcagcgattacccattattaccaac

SEQ ID NO: 9597 - DNA, 25 bp, E. coli
cgcgatgtatcggaggagccacctg

SEQ ID NO: 9598 - DNA, 25 bp, E. coli
cgcgatgtatcgcaggagccacctg

SEQ ID NO: 9599 - DNA, 25 bp, E. coli
gattaccgattattaccaacaacac

SEQ ID NO: 9600 - DNA, 25 bp, E. coli
gattaccgattaataccaacaacac

SEQ ID NO: 9601 - DNA, 25 bp, E. coli
ggcgcagtgctgagccccattccgt

SEQ ID NO: 9602 - DNA, 25 bp, E. coli
ggcgcagtgctgtgccccattccgt

SEQ ID NO: 9603 - DNA, 25 bp, E. coli
aatgactggcgttccaaaagatcag

SEQ ID NO: 9604 - DNA, 25 bp, E. coli
aatgactggcgtaccaaaagatcag

SEQ ID NO: 9605 - DNA, 25 bp, E. coli
caaaagatcagctggaacaactggc

SEQ ID NO: 9606 - DNA, 25 bp, E. coli
caaaagatcagcaggaacaactggc

SEQ ID NO: 9607 - DNA, 25 bp, E. coli
aaaaaccgctgatatgactggcgta

SEQ ID NO: 9608 - DNA, 25 bp, E. coli
aaaccgctgaaatgactggcgtacc

SEQ ID NO: 9609 - DNA, 25 bp, E. coli
aaaaaccgctgaaatgactggcgta

SEQ ID NO: 9610 - DNA, 25 bp, E. coli
aaaccgctgaaaagactggcgtacc

SEQ ID NO: 9611 - DNA, 25 bp, E. coli
taccaaaagatctgctggaacaact

SEQ ID NO: 9612 - DNA, 25 bp, E. coli
taccaaaagatcagctggaacaact

SEQ ID NO: 9613 - DNA, 25 bp, E. coli
gcgtaccaaaagttcagctggaaca

SEQ ID NO: 9614 - DNA, 25 bp, E. coli
gctgaaatgactggcgtaccaaaag

SEQ ID NO: 9615 - DNA, 25 bp, E. coli
gctgaaatgactcgcgtaccaaaag

SEQ ID NO: 9616 - DNA, 25 bp, E. coli
gcgtaccaaaagatcagctggaaca

SEQ ID NO: 9617 - DNA, 25 bp, E. coli
gactggcgtacctaaagatcagctg

SEQ ID NO: 9618 - DNA, 25 bp, E. coli
gactggcgtaccaaaagatcagctg

SEQ ID NO: 9619 - DNA, 25 bp, E. coli
gaaatgactggcctaccaaaagatc

SEQ ID NO: 9620 - DNA, 25 bp, E. coli
gaaatgactggcgtaccaaaagatc

SEQ ID NO: 9621 - DNA, 25 bp, E. coli
ccgctgaaatgagtggcgtaccaaa

SEQ ID NO: 9622 - DNA, 25 bp, E. coli
ccgctgaaatgactggcgtaccaaa

SEQ ID NO: 9623 - DNA, 25 bp, E. coli
tggcgtaccaaatgatcagctggaa

SEQ ID NO: 9624 - DNA, 25 bp, E. coli
tggcgtaccaaaagatcagctggaa

SEQ ID NO: 9625 - DNA, 25 bp, E. coli
aattgatcgatcgacgtaggcctga

SEQ ID NO: 9626 - DNA, 25 bp, E. coli
caataaattgatggatccacgtagg

SEQ ID NO: 9627 - DNA, 25 bp, E. coli
aattgatcgatccacgtaggcctga

SEQ ID NO: 9628 - DNA, 25 bp, E. coli
caataaattgatcgatccacgtagg

SEQ ID NO: 9629 - DNA, 25 bp, E. coli
taaattgatcgatccacgtaggcct

SEQ ID NO: 9630 - DNA, 25 bp, E. coli
taaattgatcgaaccacgtaggcct

SEQ ID NO: 9631 - DNA, 25 bp, E. coli
aaatctcagcccgatgataaatcca

SEQ ID NO: 9632 - DNA, 25 bp, E. coli
aaatctcagccccatgataaatcca

SEQ ID NO: 9633 - DNA, 25 bp, E. coli
tgtcataaatctcagcccgatgata

SEQ ID NO: 9634 - DNA, 25 bp, E. coli
tgtcataaatctgagcccgatgata

SEQ ID NO: 9635 - DNA, 25 bp, E. coli
tctcagcccgatgataaatccatcg

SEQ ID NO: 9636 - DNA, 25 bp, E. coli
tcgggctagactgttgacaaagtgc

SEQ ID NO: 9637 - DNA, 25 bp, E. coli
tctcagcccgatcataaatccatcg

SEQ ID NO: 9638 - DNA, 25 bp, E. coli
tcgggctagactcttgacaaagtgc

SEQ ID NO: 9639 - DNA, 25 bp, E. coli
gccatcgggctacactgttgacaaa

SEQ ID NO: 9640 - DNA, 25 bp, E. coli
gccatcgggctagactgttgacaaa

SEQ ID NO: 9641 - DNA, 25 bp, E. coli
gcgtttgtcatatatctcagcccga

SEQ ID NO: 9642 - DNA, 25 bp, E. coli
gcgtttgtcataaatctcagcccga

SEQ ID NO: 9643 - DNA, 25 bp, E. coli
cccgatgataaatccatcgggctat

SEQ ID NO: 9644 - DNA, 25 bp, E. coli
cccgatgataaaaccatcgggctat

SEQ ID NO: 9645 - DNA, 25 bp, E. coli
gatggtgatgccatcgggctagact

SEQ ID NO: 9646 - DNA, 25 bp, E. coli
gatggtgatgccttcgggctagact

SEQ ID NO: 9647 - DNA, 25 bp, E. coli
atgtttgcgtggagcgccccacttc

SEQ ID NO: 9648 - DNA, 25 bp, E. coli
atgtttgcgtggtgcgccccacttc

SEQ ID NO: 9649 - DNA, 25 bp, E. coli
tttgcgtggtgcgccccacttcagg

SEQ ID NO: 9650 - DNA, 25 bp, E. coli
tttgcgtggtgccccccacttcagg

SEQ ID NO: 9651 - DNA, 25 bp, E. coli
ttgcgtggtgcggcccacttcagga

SEQ ID NO: 9652 - DNA, 25 bp, E. coli
ttgcgtggtgcgccccacttcagga

SEQ ID NO: 9653 - DNA, 25 bp, E. coli
tgtttgcgtggtccgccccacttca

SEQ ID NO: 9654 - DNA, 25 bp, E. coli
tgtttgcgtggtgcgccccacttca

SEQ ID NO: 9655 - DNA, 25 bp, E. coli
tgcgtggtgcgccccacttcaggat

SEQ ID NO: 9656 - DNA, 25 bp, E. coli
tgcgtggtgcgcgccacttcaggat

SEQ ID NO: 9657 - DNA, 25 bp, E. coli
tgatgtttgcgtggtgcgccccact

SEQ ID NO: 9658 - DNA, 25 bp, E. coli
tgatgtttgcgtcgtgcgccccact

SEQ ID NO: 9659 - DNA, 25 bp, E. coli
gtttgcgtggtgcgccccacttcag

SEQ ID NO: 9660 - DNA, 25 bp, E. coli
gtttgcgtggtgggccccacttcag

SEQ ID NO: 9661 - DNA, 25 bp, E. coli
cgtggtgcgcccgacttcaggatgc

SEQ ID NO: 9662 - DNA, 25 bp, E. coli
cgtggtgcgccccacttcaggatgc

SEQ ID NO: 9663 - DNA, 25 bp, E. coli
gtgatgtttgcgtggtgcgccccac

SEQ ID NO: 9664 - DNA, 25 bp, E. coli
gtggtgcgcccctcttcaggatgct

SEQ ID NO: 9665 - DNA, 25 bp, E. coli
gtgatgtttgcgaggtgcgccccac

SEQ ID NO: 9666 - DNA, 25 bp, E. coli
gtggtgcgccccacttcaggatgct

SEQ ID NO: 9667 - DNA, 25 bp, E. coli
gatgtttgcgtggtgcgccccactt

SEQ ID NO: 9668 - DNA, 25 bp, E. coli
gatgtttgcgtgctgcgccccactt

SEQ ID NO: 9669 - DNA, 25 bp, E. coli
caatagtgacgctccataacgtccc

SEQ ID NO: 9670 - DNA, 25 bp, E. coli
caatagtgacgcaccataacgtccc

SEQ ID NO: 9671 - DNA, 25 bp, E. coli
caaacgaggtgaaaacccaggtgcc

SEQ ID NO: 9672 - DNA, 25 bp, E. coli
caaacgaggtgataacccaggtgcc

SEQ ID NO: 9673 - DNA, 25 bp, E. coli
cataacgtcccaccggttaatggtg

SEQ ID NO: 9674 - DNA, 25 bp, E. coli
cataacgtcccagcggttaatggtg

SEQ ID NO: 9675 - DNA, 25 bp, E. coli
tagtggaatccatcatttgcataaa

SEQ ID NO: 9676 - DNA, 25 bp, E. coli
tagtggaatccaacatttgcataaa

SEQ ID NO: 9677 - DNA, 25 bp, E. coli
tattgtcggtatagcgacgttagaa

SEQ ID NO: 9678 - DNA, 25 bp, E. coli
tattgtcggtattgcgacgttagaa

SEQ ID NO: 9679 - DNA, 25 bp, E. coli
tgttgatgctccgagaaagccagat

SEQ ID NO: 9680 - DNA, 25 bp, E. coli
tgttgatgctcccagaaagccagat

SEQ ID NO: 9681 - DNA, 25 bp, E. coli
tgcgacgttagaaatagtggaatcc

SEQ ID NO: 9682 - DNA, 25 bp, E. coli
tgcgacgttagatatagtggaatcc

SEQ ID NO: 9683 - DNA, 25 bp, E. coli
cccaggtgccttggtctgttgatgc

SEQ ID NO: 9684 - DNA, 25 bp, E. coli
cccaggtgccttcgtctgttgatgc

SEQ ID NO: 9685 - DNA, 25 bp, E. coli
cttaattcgccttttctttgtgcca

SEQ ID NO: 9686 - DNA, 25 bp, E. coli
cttaattcgcctattctttgtgcca

SEQ ID NO: 9687 - DNA, 25 bp, E. coli
gtaacagggatcgcaatggcatttg

SEQ ID NO: 9688 - DNA, 25 bp, E. coli
gtaacagggatcccaatggcatttg

SEQ ID NO: 9689 - DNA, 25 bp, E. coli
taatgacaatgctatagtgacgcac

SEQ ID NO: 9690 - DNA, 25 bp, E. coli
taatgacaatgcaatagtgacgcac

SEQ ID NO: 9691 - DNA, 25 bp, E. coli
aatggcaaccttagcctctagcgga

SEQ ID NO: 9692 - DNA, 25 bp, E. coli
aatggcaacctttgcctctagcgga

SEQ ID NO: 9693 - DNA, 25 bp, E. coli
cacgcgaatggctacctttgcctct

SEQ ID NO: 9694 - DNA, 25 bp, E. coli
cacgcgaatggcaacctttgcctct

SEQ ID NO: 9695 - DNA, 25 bp, E. coli
atttctggcgcgacgtatatttgaa

SEQ ID NO: 9696 - DNA, 25 bp, E. coli
atttctggcgcgtcgtatatttgaa

SEQ ID NO: 9697 - DNA, 25 bp, E. coli
tttctggcgcgaggtatatttgaat

SEQ ID NO: 9698 - DNA, 25 bp, E. coli
tttctggcgcgacgtatatttgaat

SEQ ID NO: 9699 - DNA, 25 bp, E. coli
tgagcagattgataaagtagcgatt

SEQ ID NO: 9700 - DNA, 25 bp, E. coli
tgagcagattgaaaaagtagcgatt

SEQ ID NO: 9701 - DNA, 25 bp, E. coli
tctggcgcgacgaatatttgaatta

SEQ ID NO: 9702 - DNA, 25 bp, E. coli
tctggcgcgacgtatatttgaatta

SEQ ID NO: 9703 - DNA, 25 bp, E. coli
tcacgcgaatggcaacctttgcctc

SEQ ID NO: 9704 - DNA, 25 bp, E. coli
tcacgcgaatgggaacctttgcctc

SEQ ID NO: 9705 - DNA, 25 bp, E. coli
gcgaatggcaacgtttgcctctagc

SEQ ID NO: 9706 - DNA, 25 bp, E. coli
gcgaatggcaacctttgcctctagc

SEQ ID NO: 9707 - DNA, 25 bp, E. coli
gaatggcaacctttgcctctagcgg

SEQ ID NO: 9708 - DNA, 25 bp, E. coli
gaatggcaacctatgcctctagcgg

SEQ ID NO: 9709 - DNA, 25 bp, E. coli
cgcgaatggcaagctttgcctctag

SEQ ID NO: 9710 - DNA, 25 bp, E. coli
cgcgaatggcaacctttgcctctag

SEQ ID NO: 9711 - DNA, 25 bp, E. coli
ctggcgcgacgtatatttgaattaa

SEQ ID NO: 9712 - DNA, 25 bp, E. coli
ctggcgcgacgtttatttgaattaa

SEQ ID NO: 9713 - DNA, 25 bp, E. coli
aatttattaaaatcgctggccgccg

SEQ ID NO: 9714 - DNA, 25 bp, E. coli
aatctttggcgcagggatggcaacc

SEQ ID NO: 9715 - DNA, 25 bp, E. coli
aatctttggcgctgggatggcaacc

SEQ ID NO: 9716 - DNA, 25 bp, E. coli
aatttattaaaaacgctggccgccg

SEQ ID NO: 9717 - DNA, 25 bp, E. coli
taaaagtaagcacggtgaagacgcc

SEQ ID NO: 9718 - DNA, 25 bp, E. coli
taaaagtaagcagggtgaagacgcc

SEQ ID NO: 9719 - DNA, 25 bp, E. coli
tacgccgaccgcataatggagtttc

SEQ ID NO: 9720 - DNA, 25 bp, E. coli
tacgccgaccgcttaatggagtttc

SEQ ID NO: 9721 - DNA, 25 bp, E. coli
tatcttgctgatgtccctggcgtcg

SEQ ID NO: 9722 - DNA, 25 bp, E. coli
tatcttgctgatctccctggcgtcg

SEQ ID NO: 9723 - DNA, 25 bp, E. coli
tgttacgccgtaactttgccgaagg

SEQ ID NO: 9724 - DNA, 25 bp, E. coli
tgttacgccgtatctttgccgaagg

SEQ ID NO: 9725 - DNA, 25 bp, E. coli
tccgttgaaacaagccgggctgtca

SEQ ID NO: 9726 - DNA, 25 bp, E. coli
tccgttgaaacatgccgggctgtca

SEQ ID NO: 9727 - DNA, 25 bp, E. coli
cattaacttccacgatgccggagca

SEQ ID NO: 9728 - DNA, 25 bp, E. coli
cattaacttccaggatgccggagca

SEQ ID NO: 9729 - DNA, 25 bp, E. coli
gattccggcgtttgctccaacactg

SEQ ID NO: 9730 - DNA, 25 bp, E. coli
gattccggcgttagctccaacactg

SEQ ID NO: 9731 - DNA, 25 bp, E. coli
gattctgaatacctggaaccgcttc

SEQ ID NO: 9732 - DNA, 25 bp, E. coli
gattctgaatacgtggaaccgcttc

SEQ ID NO: 9733 - DNA, 25 bp, E. coli
tcactttctattggtctggcggcgt

SEQ ID NO: 9734 - DNA, 25 bp, E. coli
tcactttctattcgtctggcggcgt

SEQ ID NO: 9735 - DNA, 25 bp, E. coli
caagtgcagtgagggcaatcgtgac

SEQ ID NO: 9736 - DNA, 25 bp, E. coli
caagtgcagtgacggcaatcgtgac

SEQ ID NO: 9737 - DNA, 25 bp, E. coli
caaagaagctaacgttaatctcggg

SEQ ID NO: 9738 - DNA, 25 bp, E. coli
cactgttaatggtcgggtagtcgct

SEQ ID NO: 9739 - DNA, 25 bp, E. coli
cactgttaatggacgggtagtcgct

SEQ ID NO: 9740 - DNA, 25 bp, E. coli
caaagaagctaaggttaatctcggg

SEQ ID NO: 9741 - DNA, 25 bp, E. coli
caggttcaactgtcaatacgggtta

SEQ ID NO: 9742 - DNA, 25 bp, E. coli
caggttcaactgacaatacgggtta

SEQ ID NO: 9743 - DNA, 25 bp, E. coli
tactttgtcatttaccgattgtccg

SEQ ID NO: 9744 - DNA, 25 bp, E. coli
taaaaaatggcgttagcaaaacggt

SEQ ID NO: 9745 - DNA, 25 bp, E. coli
taaaaaatggcgatagcaaaacggt

SEQ ID NO: 9746 - DNA, 25 bp, E. coli
tactttgtcattaaccgattgtccg

SEQ ID NO: 9747 - DNA, 25 bp, E. coli
acaacctggttctgcatctggctgg

SEQ ID NO: 9748 - DNA, 25 bp, E. coli
acaacctggttcagcatctggctgg

SEQ ID NO: 9749 - DNA, 25 bp, E. coli
tatcacggtgaaaggaaacgcaagc

SEQ ID NO: 9750 - DNA, 25 bp, E. coli
tatcacggtgaatggaaacgcaagc

SEQ ID NO: 9751 - DNA, 25 bp, E. coli
tgaaaagacttctcaagaggttcct

SEQ ID NO: 9752 - DNA, 25 bp, E. coli
tgaaaagacttcacaagaggttcct

SEQ ID NO: 9753 - DNA, 25 bp, E. coli
tccacttaaggctagagctatcacg

SEQ ID NO: 9754 - DNA, 25 bp, E. coli
tccacttaaggcaagagctatcacg

SEQ ID NO: 9755 - DNA, 25 bp, E. coli
cgatcgaggcgctaatcaatgtgat

SEQ ID NO: 9756 - DNA, 25 bp, E. coli
cgatcgaggcgcaaatcaatgtgat

SEQ ID NO: 9757 - DNA, 25 bp, E. coli
cagcaaaaatatgcgcgcgattgcc

SEQ ID NO: 9758 - DNA, 25 bp, E. coli
cagcaaaaatatccgcgcgattgcc

SEQ ID NO: 9759 - DNA, 25 bp, E. coli
taaaaatgttgagcgcgatcgccgc

SEQ ID NO: 9760 - DNA, 25 bp, E. coli
taaaaatgttgaccgcgatcgccgc

SEQ ID NO: 9761 - DNA, 25 bp, E. coli
taccgagcgtctcgaagagtggatc

SEQ ID NO: 9762 - DNA, 25 bp, E. coli
taccgagcgtctggaagagtggatc

SEQ ID NO: 9763 - DNA, 25 bp, E. coli
tttcgcgttcaggacgccagtctgc

SEQ ID NO: 9764 - DNA, 25 bp, E. coli
tttcgcgttcagcacgccagtctgc

SEQ ID NO: 9765 - DNA, 25 bp, E. coli
tgtcgttgatgaatatcgctgcgtg

SEQ ID NO: 9766 - DNA, 25 bp, E. coli
tgtcgttgatgattatcgctgcgtg

SEQ ID NO: 9767 - DNA, 25 bp, E. coli
tctggctggagaagataggtaaaaa

SEQ ID NO: 9768 - DNA, 25 bp, E. coli
tctggctggagatgataggtaaaaa

SEQ ID NO: 9769 - DNA, 25 bp, E. coli
gctgcttctggcttcatcatcactg

SEQ ID NO: 9770 - DNA, 25 bp, E. coli
gctatctgtttatagtgcctgcgac

SEQ ID NO: 9771 - DNA, 25 bp, E. coli
gctatctgtttaaagtgcctgcgac

SEQ ID NO: 9772 - DNA, 25 bp, E. coli
gctgcttctggcatcatcatcactg

SEQ ID NO: 9773 - DNA, 25 bp, E. coli
cgaaccgagttctggctggagaaga

SEQ ID NO: 9774 - DNA, 25 bp, E. coli
cgattgccacgcgtgatacggcgat

SEQ ID NO: 9775 - DNA, 25 bp, E. coli
cgattgccacgcctgatacggcgat

SEQ ID NO: 9776 - DNA, 25 bp, E. coli
cgaaccgagttcaggctggagaaga

SEQ ID NO: 9777 - DNA, 25 bp, E. coli
gatgaagcgctttccgagcgtctgg

SEQ ID NO: 9778 - DNA, 25 bp, E. coli
gatgaagcgcttaccgagcgtctgg

SEQ ID NO: 9779 - DNA, 25 bp, E. coli
taaagaggataaaagcaaaccgcca

SEQ ID NO: 9780 - DNA, 25 bp, E. coli
tacgcagatgtcgatggctacggct

SEQ ID NO: 9781 - DNA, 25 bp, E. coli
taaagaggataatagcaaaccgcca

SEQ ID NO: 9782 - DNA, 25 bp, E. coli
tacgcagatgtccatggctacggct

SEQ ID NO: 9783 - DNA, 25 bp, E. coli
tcgcattgaaccacagcaagagaaa

SEQ ID NO: 9784 - DNA, 25 bp, E. coli
tcgggagtccgttttctggttgaac

SEQ ID NO: 9785 - DNA, 25 bp, E. coli
tcgggagtccgtattctggttgaac

SEQ ID NO: 9786 - DNA, 25 bp, E. coli
tcgcattgaacctcagcaagagaaa

SEQ ID NO: 9787 - DNA, 25 bp, E. coli
tctattgcagacttgggttgatcca

SEQ ID NO: 9788 - DNA, 25 bp, E. coli
tctattgcagacatgggttgatcca

SEQ ID NO: 9789 - DNA, 25 bp, E. coli
gcattttaaaaacggctggcgagtt

SEQ ID NO: 9790 - DNA, 25 bp, E. coli
gcattttaaaaagggctggcgagtt

SEQ ID NO: 9791 - DNA, 25 bp, E. coli
gcaaaccgccatattctgtgatacc

SEQ ID NO: 9792 - DNA, 25 bp, E. coli
gcaaaccgccattttctgtgatacc

SEQ ID NO: 9793 - DNA, 25 bp, E. coli
gatacctcccgtatctcgcattgaa

SEQ ID NO: 9794 - DNA, 25 bp, E. coli
gatacctcccgtttctcgcattgaa

SEQ ID NO: 9795 - DNA, 25 bp, E. coli
ggtgacaaacctgataccacaatct

SEQ ID NO: 9796 - DNA, 25 bp, E. coli
ggtgacaaacctcataccacaatct

SEQ ID NO: 9797 - DNA, 25 bp, E. coli
tggttgaacgtgtaaaacatccctc

SEQ ID NO: 9798 - DNA, 25 bp, E. coli
tggttgaacgtgaaaaacatccctc

SEQ ID NO: 9799 - DNA, 25 bp, E. coli
gagttaccaaaagatcgggagtccg

SEQ ID NO: 9800 - DNA, 25 bp, E. coli
gagttaccaaaacatcgggagtccg

SEQ ID NO: 9801 - DNA, 25 bp, E. coli
aagatgagttcaaaagcccttctga

SEQ ID NO: 9802 - DNA, 25 bp, E. coli
aagatgagttcataagcccttctga

SEQ ID NO: 9803 - DNA, 25 bp, E. coli
cataagcccttcagatgacaaaaaa

SEQ ID NO: 9804 - DNA, 25 bp, E. coli
cataagcccttctgatgacaaaaaa

SEQ ID NO: 9805 - DNA, 25 bp, E. coli
tgatgacaaaaaattttcaaaggcg

SEQ ID NO: 9806 - DNA, 25 bp, E. coli
tgatgacaaaaatttttcaaaggcg

SEQ ID NO: 9807 - DNA, 25 bp, E. coli
tgaaaaagcgcgaggaagtaagcaa

SEQ ID NO: 9808 - DNA, 25 bp, E. coli
tgaaaaagcgcgtggaagtaagcaa

SEQ ID NO: 9809 - DNA, 25 bp, E. coli
tctacatctctataagataaatact

SEQ ID NO: 9810 - DNA, 25 bp, E. coli
tctacatctctaaaagataaatact

SEQ ID NO: 9811 - DNA, 25 bp, E. coli
gcctcgcagacgagatgcagcatta

SEQ ID NO: 9812 - DNA, 25 bp, E. coli
gcctcgcagacgtgatgcagcatta

SEQ ID NO: 9813 - DNA, 25 bp, E. coli
gcggttccctacaaaaaagatgagt

SEQ ID NO: 9814 - DNA, 25 bp, E. coli
gcggttccctactaaaaagatgagt

SEQ ID NO: 9815 - DNA, 25 bp, E. coli
gcgaaaagttttacatctacatctc

SEQ ID NO: 9816 - DNA, 25 bp, E. coli
gcgaaaagtttttcatctacatctc

SEQ ID NO: 9817 - DNA, 25 bp, E. coli
gaagtaagcaaggtgcctcgcagac

SEQ ID NO: 9818 - DNA, 25 bp, E. coli
gaagtaagcaagctgcctcgcagac

SEQ ID NO: 9819 - DNA, 25 bp, E. coli
gatgcagcattagcggttccctaca

SEQ ID NO: 9820 - DNA, 25 bp, E. coli
ttcaaaggcgaatagttttacatct

SEQ ID NO: 9821 - DNA, 25 bp, E. coli
ttcaaaggcgaaaagttttacatct

SEQ ID NO: 9822 - DNA, 25 bp, E. coli
gatgcagcattaccggttccctaca

SEQ ID NO: 9823 - DNA, 25 bp, E. coli
caagaaggtaagaatgcactgaagt

SEQ ID NO: 9824 - DNA, 25 bp, E. coli
caagaaggtaagtatgcactgaagt

SEQ ID NO: 9825 - DNA, 25 bp, E. coli
taactggcatctcaccattatcgat

SEQ ID NO: 9826 - DNA, 25 bp, E. coli
attatgaaactattatgattgcccc

SEQ ID NO: 9827 - DNA, 25 bp, E. coli
attatgaaactaatatgattgcccc

SEQ ID NO: 9828 - DNA, 25 bp, E. coli
aaatgactcagctaattgggtgacg

SEQ ID NO: 9829 - DNA, 25 bp, E. coli
aaatgactcagcaaattgggtgacg

SEQ ID NO: 9830 - DNA, 25 bp, E. coli
tgcagttgatgaaccagggaaaccg

SEQ ID NO: 9831 - DNA, 25 bp, E. coli
tgcagttgatgatccagggaaaccg

SEQ ID NO: 9832 - DNA, 25 bp, E. coli
gcactgaagtttgcgatgcaaaaca

SEQ ID NO: 9833 - DNA, 25 bp, E. coli
gcactgaagtttccgatgcaaaaca

SEQ ID NO: 9834 - DNA, 25 bp, E. coli
gacgatttcggatgtcaaagctaat

SEQ ID NO: 9835 - DNA, 25 bp, E. coli
gacgatttcggaagtcaaagctaat

SEQ ID NO: 9836 - DNA, 25 bp, E. coli
ccccttagaaagtcagagtgttaat

SEQ ID NO: 9837 - DNA, 25 bp, E. coli
ccccttagaaagacagagtgttaat

SEQ ID NO: 9838 - DNA, 25 bp, E. coli
ctatggtccttcctgcacatgccgg

SEQ ID NO: 9839 - DNA, 25 bp, E. coli
ctatggtccttcgtgcacatgccgg

SEQ ID NO: 9840 - DNA, 25 bp, E. coli
taactggcatctgaccattatcgat

SEQ ID NO: 9841 - DNA, 25 bp, E. coli
taacgccaccagtggcaaaaatagg

SEQ ID NO: 9842 - DNA, 25 bp, E. coli
taacgccaccagaggcaaaaatagg

SEQ ID NO: 9843 - DNA, 25 bp, E. coli
gatggcgatacgtcattaccaccag

SEQ ID NO: 9844 - DNA, 25 bp, E. coli
gatggcgatacgacattaccaccag

SEQ ID NO: 9845 - DNA, 25 bp, E. coli
caaatatctctgaaaattctggagt

SEQ ID NO: 9846 - DNA, 25 bp, E. coli
caaatatctctgtaaattctggagt

SEQ ID NO: 9847 - DNA, 25 bp, E. coli
tatgccattgtacttctttgaaaca

SEQ ID NO: 9848 - DNA, 25 bp, E. coli
tatgccattgtagttctttgaaaca

SEQ ID NO: 9849 - DNA, 25 bp, E. coli
tgtagattcaccttctaacgaggat

SEQ ID NO: 9850 - DNA, 25 bp, E. coli
tgtagattcaccatctaacgaggat

SEQ ID NO: 9851 - DNA, 25 bp, E. coli
tgctgcccactagaaatatctctgt

SEQ ID NO: 9852 - DNA, 25 bp, E. coli
tgaaagtcctgtagattcaccatct

SEQ ID NO: 9853 - DNA, 25 bp, E. coli
tgctgcccactacaaatatctctgt

SEQ ID NO: 9854 - DNA, 25 bp, E. coli
tgaagttgccctggaaaagtggtgt

SEQ ID NO: 9855 - DNA, 25 bp, E. coli
tgaagttgccctcgaaaagtggtgt

SEQ ID NO: 9856 - DNA, 25 bp, E. coli
tgaaagtcctgttgattcaccatct

SEQ ID NO: 9857 - DNA, 25 bp, E. coli
tgccctcgaaaagtggtgtgctgag

SEQ ID NO: 9858 - DNA, 25 bp, E. coli
tgccctcgaaaactggtgtgctgag

SEQ ID NO: 9859 - DNA, 25 bp, E. coli
tctaacgaggatcttgaagttgccc

SEQ ID NO: 9860 - DNA, 25 bp, E. coli
tctaacgaggatgttgaagttgccc

SEQ ID NO: 9861 - DNA, 25 bp, E. coli
gctgagggagaaattagcgaaaatc

SEQ ID NO: 9862 - DNA, 25 bp, E. coli
gctgagggagaatttagcgaaaatc

SEQ ID NO: 9863 - DNA, 25 bp, E. coli
gcgaaaatcgtcttgaggttgcatc

SEQ ID NO: 9864 - DNA, 25 bp, E. coli
gcgaaaatcgtcatgaggttgcatc

SEQ ID NO: 9865 - DNA, 25 bp, E. coli
tctggagtaataacttttgaaagtc

SEQ ID NO: 9866 - DNA, 25 bp, E. coli
tctggagtaatatcttttgaaagtc

SEQ ID NO: 9867 - DNA, 25 bp, E. coli
tatctgcgcgaggagggctttaaca

SEQ ID NO: 9868 - DNA, 25 bp, E. coli
tatctgcgcgagcagggctttaaca

SEQ ID NO: 9869 - DNA, 25 bp, E. coli
ttctataaactgtgcaccaaatttg

SEQ ID NO: 9870 - DNA, 25 bp, E. coli
ttctataaactgagcaccaaatttg

SEQ ID NO: 9871 - DNA, 25 bp, E. coli
tgtggtttctctcccgttctataaa

SEQ ID NO: 9872 - DNA, 25 bp, E. coli
tgtggtttctctgccgttctataaa

SEQ ID NO: 9873 - DNA, 25 bp, E. coli
tgcgcgagcagggctttaacaatgt

SEQ ID NO: 9874 - DNA, 25 bp, E. coli
tgcgcgagcaggcctttaacaatgt

SEQ ID NO: 9875 - DNA, 25 bp, E. coli
tctgcgcgagcagggctttaacaat

SEQ ID NO: 9876 - DNA, 25 bp, E. coli
tctctgccgttcaataaactgagca

SEQ ID NO: 9877 - DNA, 25 bp, E. coli
tctctgccgttctataaactgagca

SEQ ID NO: 9878 - DNA, 25 bp, E. coli
tctgcgcgagcacggctttaacaat

SEQ ID NO: 9879 - DNA, 25 bp, E. coli
tctgccgttctaaaaactgagcacc

SEQ ID NO: 9880 - DNA, 25 bp, E. coli
tctgccgttctataaactgagcacc

SEQ ID NO: 9881 - DNA, 25 bp, E. coli
gccgttctataaactgagcaccaaa

SEQ ID NO: 9882 - DNA, 25 bp, E. coli
gccgttctataatctgagcaccaaa

SEQ ID NO: 9883 - DNA, 25 bp, E. coli
ctatctgcgcgagcagggctttaac

SEQ ID NO: 9884 - DNA, 25 bp, E. coli
cgttctataaacagagcaccaaatt

SEQ ID NO: 9885 - DNA, 25 bp, E. coli
cgttctataaactgagcaccaaatt

SEQ ID NO: 9886 - DNA, 25 bp, E. coli
ctatctgcgcgaccagggctttaac

SEQ ID NO: 9887 - DNA, 25 bp, E. coli
ggtttctctgcccttctataaactg

SEQ ID NO: 9888 - DNA, 25 bp, E. coli
ggtttctctgccgttctataaactg

SEQ ID NO: 9889 - DNA, 25 bp, E. coli
cattaatccgttaatgatgtggccg

SEQ ID NO: 9890 - DNA, 25 bp, E. coli
tctaataacggaaaatgaacaataa

SEQ ID NO: 9891 - DNA, 25 bp, E. coli
tctaataacggataatgaacaataa

SEQ ID NO: 9892 - DNA, 25 bp, E. coli
tctgatccacttatcattaatccgt

SEQ ID NO: 9893 - DNA, 25 bp, E. coli
tctgatccacttttcattaatccgt

SEQ ID NO: 9894 - DNA, 25 bp, E. coli
ccagtctaataagggataatgaaca

SEQ ID NO: 9895 - DNA, 25 bp, E. coli
ccagtctaataacggataatgaaca

SEQ ID NO: 9896 - DNA, 25 bp, E. coli
cgttaatgatgtcgccgggcgaacc

SEQ ID NO: 9897 - DNA, 25 bp, E. coli
cattaatccgtttatgatgtggccg

SEQ ID NO: 9898 - DNA, 25 bp, E. coli
cgttaatgatgtggccgggcgaacc

SEQ ID NO: 9899 - DNA, 25 bp, E. coli
gggccagtctaaaaacggataatga

SEQ ID NO: 9900 - DNA, 25 bp, E. coli
gggccagtctaataacggataatga

SEQ ID NO: 9901 - DNA, 25 bp, E. coli
tgtggccgggcgaacccggccaaat

SEQ ID NO: 9902 - DNA, 25 bp, E. coli
tgtggccgggcgtacccggccaaat

SEQ ID NO: 9903 - DNA, 25 bp, E. coli
taattttttatagatctgatccact

SEQ ID NO: 9904 - DNA, 25 bp, E. coli
taacggataatgaacaataaatatt

SEQ ID NO: 9905 - DNA, 25 bp, E. coli
taatcaattcgcatattgtggttaa

SEQ ID NO: 9906 - DNA, 25 bp, E. coli
taattttttatacatctgatccact

SEQ ID NO: 9907 - DNA, 25 bp, E. coli
taatcaattcgcttattgtggttaa

SEQ ID NO: 9908 - DNA, 25 bp, E. coli
taatccgttaatcatgtggccgggc

SEQ ID NO: 9909 - DNA, 25 bp, E. coli
taatccgttaatgatgtggccgggc

SEQ ID NO: 9910 - DNA, 25 bp, E. coli
taacggataatgtacaataaatatt

SEQ ID NO: 9911 - DNA, 25 bp, E. coli
tacagtcggtgtatcgcattgagcc

SEQ ID NO: 9912 - DNA, 25 bp, E. coli
tactcgacaccgatatgctggcaaa

SEQ ID NO: 9913 - DNA, 25 bp, E. coli
tacagtcggtgtttcgcattgagcc

SEQ ID NO: 9914 - DNA, 25 bp, E. coli
tactcgacaccgttatgctggcaaa

SEQ ID NO: 9915 - DNA, 25 bp, E. coli
tatcagatccaatacgtggtactcg

SEQ ID NO: 9916 - DNA, 25 bp, E. coli
tatcagatccaaaacgtggtactcg

SEQ ID NO: 9917 - DNA, 25 bp, E. coli
ttaaaaccttctcggcacttggcgc

SEQ ID NO: 9918 - DNA, 25 bp, E. coli
ttaaaaccttctgggcacttggcgc

SEQ ID NO: 9919 - DNA, 25 bp, E. coli
tgtttacccgcgtgggtgaacaacg

SEQ ID NO: 9920 - DNA, 25 bp, E. coli
tgtttacccgcgagggtgaacaacg

SEQ ID NO: 9921 - DNA, 25 bp, E. coli
gccgacacgctgcaagttggtcacg

SEQ ID NO: 9922 - DNA, 25 bp, E. coli
gccgacacgctggaagttggtcacg

SEQ ID NO: 9923 - DNA, 25 bp, E. coli
gaattaacgctcagacgattgccgg

SEQ ID NO: 9924 - DNA, 25 bp, E. coli
gcaaaatacccgaggcgtacagtcg

SEQ ID NO: 9925 - DNA, 25 bp, E. coli
gaattaacgctctgacgattgccgg

SEQ ID NO: 9926 - DNA, 25 bp, E. coli
gcaaaatacccgtggcgtacagtcg

SEQ ID NO: 9927 - DNA, 25 bp, E. coli
ccgtacaggagggaaaaagctggct

SEQ ID NO: 9928 - DNA, 25 bp, E. coli
ccgtacaggaggcaaaaagctggct

SEQ ID NO: 9929 - DNA, 25 bp, E. coli
cattgagcctgattttgtcgccgcc

SEQ ID NO: 9930 - DNA, 25 bp, E. coli
cattgagcctgaatttgtcgccgcc

SEQ ID NO: 9931 - DNA, 25 bp, E. coli
taataacgccaaacttgcccgaagc

SEQ ID NO: 9932 - DNA, 25 bp, E. coli
taataacgccaatcttgcccgaagc

SEQ ID NO: 9933 - DNA, 25 bp, E. coli
aattatcctactcgtctctacgtcc

SEQ ID NO: 9934 - DNA, 25 bp, E. coli
aattatcctactggtctctacgtcc

SEQ ID NO: 9935 - DNA, 25 bp, E. coli
aaatgagaccctatcgattatccga

SEQ ID NO: 9936 - DNA, 25 bp, E. coli
aaatgagaccctttcgattatccga

SEQ ID NO: 9937 - DNA, 25 bp, E. coli
tagagcatccggcaaaagagtgagt

SEQ ID NO: 9938 - DNA, 25 bp, E. coli
tatcttcagaagatcgccgctaatg

SEQ ID NO: 9939 - DNA, 25 bp, E. coli
tatcttcagaagttcgccgctaatg

SEQ ID NO: 9940 - DNA, 25 bp, E. coli
tagagcatccgggaaaagagtgagt

SEQ ID NO: 9941 - DNA, 25 bp, E. coli
ttctgaactcatgggagaaatgtcg

SEQ ID NO: 9942 - DNA, 25 bp, E. coli
ttctgaactcatcggagaaatgtcg

SEQ ID NO: 9943 - DNA, 25 bp, E. coli
ttatccgacttaacaaaaatgcttg

SEQ ID NO: 9944 - DNA, 25 bp, E. coli
ttatccgacttatcaaaaatgcttg

SEQ ID NO: 9945 - DNA, 25 bp, E. coli
tgcgtcatattctactcattgcgtg

SEQ ID NO: 9946 - DNA, 25 bp, E. coli
tgcgtcatattcaactcattgcgtg

SEQ ID NO: 9947 - DNA, 25 bp, E. coli
tcttatatctgataaacagtcgctt

SEQ ID NO: 9948 - DNA, 25 bp, E. coli
tcttatatctgaaaaacagtcgctt

SEQ ID NO: 9949 - DNA, 25 bp, E. coli
gaactcacctggtagacgctctcaa

SEQ ID NO: 9950 - DNA, 25 bp, E. coli
gaactcacctggaagacgctctcaa

SEQ ID NO: 9951 - DNA, 25 bp, E. coli
cattgcgtgcacaaggctatgataa

SEQ ID NO: 9952 - DNA, 25 bp, E. coli
cattgcgtgcactaggctatgataa

SEQ ID NO: 9953 - DNA, 25 bp, E. coli
taatctggcacaaatcgcaaccaac

SEQ ID NO: 9954 - DNA, 25 bp, E. coli
taatctggcacatatcgcaaccaac

SEQ ID NO: 9955 - DNA, 25 bp, E. coli
cagagccagagccaataagatcctc

SEQ ID NO: 9956 - DNA, 25 bp, E. coli
catcattgaatgtacaacccatttc

SEQ ID NO: 9957 - DNA, 25 bp, E. coli
cagagccagagcgaataagatcctc

SEQ ID NO: 9958 - DNA, 25 bp, E. coli
catcattgaatgaacaacccatttc

SEQ ID NO: 9959 - DNA, 25 bp, E. coli
tactgagactgtagaaatgaacagt

SEQ ID NO: 9960 - DNA, 25 bp, E. coli
tactgagactgttgaaatgaacagt

SEQ ID NO: 9961 - DNA, 25 bp, E. coli
tattacattgaaaatgatctgtctg

SEQ ID NO: 9962 - DNA, 25 bp, E. coli
tattacattgaatatgatctgtctg

SEQ ID NO: 9963 - DNA, 25 bp, E. coli
tctttaaaggaaaatactgagactg

SEQ ID NO: 9964 - DNA, 25 bp, E. coli
tctttaaaggaatatactgagactg

SEQ ID NO: 9965 - DNA, 25 bp, E. coli
tcattagattttagttctcctttgc

SEQ ID NO: 9966 - DNA, 25 bp, E. coli
tcattagatttttgttctcctttgc

SEQ ID NO: 9967 - DNA, 25 bp, E. coli
gcaggaggctgaaaaagataatcac

SEQ ID NO: 9968 - DNA, 25 bp, E. coli
gcaggaggctgataaagataatcac

SEQ ID NO: 9969 - DNA, 25 bp, E. coli
gaacaacccatttcattatctgata

SEQ ID NO: 9970 - DNA, 25 bp, E. coli
gaacagtaaagtatgcaggaggctg

SEQ ID NO: 9971 - DNA, 25 bp, E. coli
gaacaacccattacattatctgata

SEQ ID NO: 9972 - DNA, 25 bp, E. coli
gaacagtaaagtttgcaggaggctg

SEQ ID NO: 9973 - DNA, 25 bp, E. coli
gagccaataagatcctctttaaagg

SEQ ID NO: 9974 - DNA, 25 bp, E. coli
gatctgtctgtaacatcattgaatg

SEQ ID NO: 9975 - DNA, 25 bp, E. coli
gatctgtctgtatcatcattgaatg

SEQ ID NO: 9976 - DNA, 25 bp, E. coli
gagccaataagaacctctttaaagg

SEQ ID NO: 9977 - DNA, 25 bp, E. coli
aatccggatttggtgttactcgaca

SEQ ID NO: 9978 - DNA, 25 bp, E. coli
aatccggatttgctgttactcgaca

SEQ ID NO: 9979 - DNA, 25 bp, E. coli
caaggacggcatgaccatttgtcgt

SEQ ID NO: 9980 - DNA, 25 bp, E. coli
caaggacggcatcaccatttgtcgt

SEQ ID NO: 9981 - DNA, 25 bp, E. coli
cactggaaatgggtgcctgcgacta

SEQ ID NO: 9982 - DNA, 25 bp, E. coli
cactggaaatggctgcctgcgacta

SEQ ID NO: 9983 - DNA, 25 bp, E. coli
catggaccgcgaagcattgctgaaa

SEQ ID NO: 9984 - DNA, 25 bp, E. coli
catcatgctaccaggcaaggacggc

SEQ ID NO: 9985 - DNA, 25 bp, E. coli
catcatgctacctggcaaggacggc

SEQ ID NO: 9986 - DNA, 25 bp, E. coli
catggaccgcgatgcattgctgaaa

SEQ ID NO: 9987 - DNA, 25 bp, E. coli
tgaaatctcgctgtcgacagctgat

SEQ ID NO: 9988 - DNA, 25 bp, E. coli
tgaaatctcgctctcgacagctgat

SEQ ID NO: 9989 - DNA, 25 bp, E. coli
gcatttcggcacgttgaccatcgat

SEQ ID NO: 9990 - DNA, 25 bp, E. coli
gcatttcggcaccttgaccatcgat

SEQ ID NO: 9991 - DNA, 25 bp, E. coli
gacgtggctattacgcggttaagaa

SEQ ID NO: 9992 - DNA, 25 bp, E. coli
gacgtggctatttcgcggttaagaa

SEQ ID NO: 9993 - DNA, 25 bp, E. coli
cattgctgaaaattttacgcggcgt

SEQ ID NO: 9994 - DNA, 25 bp, E. coli
cattgctgaaaaatttacgcggcgt

SEQ ID NO: 9995 - DNA, 25 bp, E. coli
gatatgaaccacatcctggcactgg

SEQ ID NO: 9996 - DNA, 25 bp, E. coli
gatatgaaccacttcctggcactgg

SEQ ID NO: 9997 - DNA, 25 bp, E. coli
gggaattagctacccatgccgggca

SEQ ID NO: 9998 - DNA, 25 bp, E. coli
gggaattagctagccatgccgggca

SEQ ID NO: 9999 - DNA, 25 bp, E. coli
caccgccgtcggcaagatagacaaa

SEQ ID NO: 10000 - DNA, 25 bp, E. coli
caccgccgtcgggaagatagacaaa

SEQ ID NO: 10001 - DNA, 25 bp, E. coli
aaatcgagtttctggaccactggcc

SEQ ID NO: 10002 - DNA, 25 bp, E. coli
aaatcgagtttcaggaccactggcc

SEQ ID NO: 10003 - DNA, 25 bp, E. coli
tttatcatcgcgcagcaggtgccaa

SEQ ID NO: 10004 - DNA, 25 bp, E. coli
tttatcatcgcggagcaggtgccaa

SEQ ID NO: 10005 - DNA, 25 bp, E. coli
tgcgtcaacaacagacccgtatggg

SEQ ID NO: 10006 - DNA, 25 bp, E. coli
tgcgtcaacaactgacccgtatggg

SEQ ID NO: 10007 - DNA, 25 bp, E. coli
gcaggtgccaactgactatcagcag

SEQ ID NO: 10008 - DNA, 25 bp, E. coli
gcggatttgcgcctttatcatcgcg

SEQ ID NO: 10009 - DNA, 25 bp, E. coli
gcggatttgcgcgtttatcatcgcg

SEQ ID NO: 10010 - DNA, 25 bp, E. coli
gcaggtgccaacagactatcagcag

SEQ ID NO: 10011 - DNA, 25 bp, E. coli
gacacgctgcttcgcgagcggattt

SEQ ID NO: 10012 - DNA, 25 bp, E. coli
gactatcagcagttgcgtcaacaac

SEQ ID NO: 10013 - DNA, 25 bp, E. coli
gactatcagcagatgcgtcaacaac

SEQ ID NO: 10014 - DNA, 25 bp, E. coli
gacacgctgcttggcgagcggattt

SEQ ID NO: 10015 - DNA, 25 bp, E. coli
gatagacaaaaatcgcctgacggct

SEQ ID NO: 10016 - DNA, 25 bp, E. coli
gatagacaaaaaacgcctgacggct

SEQ ID NO: 10017 - DNA, 25 bp, E. coli
tggaaaattcctgaccaaatcgagt

SEQ ID NO: 10018 - DNA, 25 bp, E. coli
tggaaaattcctcaccaaatcgagt

SEQ ID NO: 10019 - DNA, 25 bp, E. coli
gaccgttatcgcgattctgcccaat

SEQ ID NO: 10020 - DNA, 25 bp, E. coli
gaccgttatcgccattctgcccaat

SEQ ID NO: 10021 - DNA, 25 bp, E. coli
caaggcttgcctccgcaaagtcgta

SEQ ID NO: 10022 - DNA, 25 bp, E. coli
caaggcttgcctgcgcaaagtcgta

SEQ ID NO: 10023 - DNA, 25 bp, E. coli
cagcggcctgactctgatgcagatc

SEQ ID NO: 10024 - DNA, 25 bp, E. coli
cagcggcctgacactgatgcagatc

SEQ ID NO: 10025 - DNA, 25 bp, E. coli
tacaggtgttacattgccctgggca

SEQ ID NO: 10026 - DNA, 25 bp, E. coli
tacaggtgttactttgccctgggca

SEQ ID NO: 10027 - DNA, 25 bp, E. coli
tttggtctggaagagtgccagccgc

SEQ ID NO: 10028 - DNA, 25 bp, E. coli
tttggtctggaacagtgccagccgc

SEQ ID NO: 10029 - DNA, 25 bp, E. coli
tcctggcggcgaagcggaaaaaatc

SEQ ID NO: 10030 - DNA, 25 bp, E. coli
tcctggcggcgatgcggaaaaaatc

SEQ ID NO: 10031 - DNA, 25 bp, E. coli
gaagatgagttcaggctgcaaggct

SEQ ID NO: 10032 - DNA, 25 bp, E. coli
gaaggcgataccttcagcataggga

SEQ ID NO: 10033 - DNA, 25 bp, E. coli
gaagatgagttctggctgcaaggct

SEQ ID NO: 10034 - DNA, 25 bp, E. coli
gaaggcgataccatcagcataggga

SEQ ID NO: 10035 - DNA, 25 bp, E. coli
gtcatctggacctcgttggcgcagc

SEQ ID NO: 10036 - DNA, 25 bp, E. coli
gtcatctggaccacgttggcgcagc

SEQ ID NO: 10037 - DNA, 25 bp, E. coli
tggcgcaacatttcggcgtgccggt

SEQ ID NO: 10038 - DNA, 25 bp, E. coli
tggcgcaacattacggcgtgccggt

SEQ ID NO: 10039 - DNA, 25 bp, E. coli
tcaaagataaatagctgccactggg

SEQ ID NO: 10040 - DNA, 25 bp, E. coli
tcaaagataaattgctgccactggg

SEQ ID NO: 10041 - DNA, 25 bp, E. coli
taatcccttcctccaagacgaaatg

SEQ ID NO: 10042 - DNA, 25 bp, E. coli
taatcccttcctgcaagacgaaatg

SEQ ID NO: 10043 - DNA, 25 bp, E. coli
caatgtctcatttaccggtgcggta

SEQ ID NO: 10044 - DNA, 25 bp, E. coli
caatgtctcattaaccggtgcggta

SEQ ID NO: 10045 - DNA, 25 bp, E. coli
taaaactgggttggctgacaccgcg

SEQ ID NO: 10046 - DNA, 25 bp, E. coli
tactaatctggcaaatctcggcggc

SEQ ID NO: 10047 - DNA, 25 bp, E. coli
tactaatctggctaatctcggcggc

SEQ ID NO: 10048 - DNA, 25 bp, E. coli
taaaactgggttcgctgacaccgcg

SEQ ID NO: 10049 - DNA, 25 bp, E. coli
tttaccgggcatgggcaaacggcgt

SEQ ID NO: 10050 - DNA, 25 bp, E. coli
tttaccgggcatcggcaaacggcgt

SEQ ID NO: 10051 - DNA, 25 bp, E. coli
ttccagactttacagcagatgcgtg

SEQ ID NO: 10052 - DNA, 25 bp, E. coli
ttccagactttagagcagatgcgtg

SEQ ID NO: 10053 - DNA, 25 bp, E. coli
tgatgtcgacgaccgtacccgtaaa

SEQ ID NO: 10054 - DNA, 25 bp, E. coli
tgatgtcgacgagcgtacccgtaaa

SEQ ID NO: 10055 - DNA, 25 bp, E. coli
tgtcattaaataggccgcccggaga

SEQ ID NO: 10056 - DNA, 25 bp, E. coli
tgtcattaaatacgccgcccggaga

SEQ ID NO: 10057 - DNA, 25 bp, E. coli
tgccaactggataacgcgaacgtga

SEQ ID NO: 10058 - DNA, 25 bp, E. coli
tgccaactggattacgcgaacgtga

SEQ ID NO: 10059 - DNA, 25 bp, E. coli
gcaactgatgcaggatgtcacccca

SEQ ID NO: 10060 - DNA, 25 bp, E. coli
gaactcaaggtgagcgccgacaatg

SEQ ID NO: 10061 - DNA, 25 bp, E. coli
gaactcaaggtgtgcgccgacaatg

SEQ ID NO: 10062 - DNA, 25 bp, E. coli
gcaactgatgcacgatgtcacccca

SEQ ID NO: 10063 - DNA, 25 bp, E. coli
taacgcaggcataaccatcggaact

SEQ ID NO: 10064 - DNA, 25 bp, E. coli
taacgcaggcattaccatcggaact

SEQ ID NO: 10065 - DNA, 25 bp, E. coli
caacgctctttggtgttttatgtcc

SEQ ID NO: 10066 - DNA, 25 bp, E. coli
caacgctctttgctgttttatgtcc

SEQ ID NO: 10067 - DNA, 25 bp, E. coli
agatatatctcaacgctctttggtg

SEQ ID NO: 10068 - DNA, 25 bp, E. coli
agatatatctcatcgctctttggtg

SEQ ID NO: 10069 - DNA, 25 bp, E. coli
aacgctctttggtgttttatgtcca

SEQ ID NO: 10070 - DNA, 25 bp, E. coli
aacgctctttggagttttatgtcca

SEQ ID NO: 10071 - DNA, 25 bp, E. coli
tatctcaacgctctttggtgtttta

SEQ ID NO: 10072 - DNA, 25 bp, E. coli
ttttcagaaagatatatctcaacgc

SEQ ID NO: 10073 - DNA, 25 bp, E. coli
tatatctcaacgctctttggtgttt

SEQ ID NO: 10074 - DNA, 25 bp, E. coli
tatatctcaacggtctttggtgttt

SEQ ID NO: 10075 - DNA, 25 bp, E. coli
tatctcaacgctgtttggtgtttta

SEQ ID NO: 10076 - DNA, 25 bp, E. coli
ttttcagaaagaaatatctcaacgc

SEQ ID NO: 10077 - DNA, 25 bp, E. coli
tcagaaagatatttctcaacgctct

SEQ ID NO: 10078 - DNA, 25 bp, E. coli
tcagaaagatatatctcaacgctct

SEQ ID NO: 10079 - DNA, 25 bp, E. coli
gctctttggtgtattatgtccataa

SEQ ID NO: 10080 - DNA, 25 bp, E. coli
gctctttggtgttttatgtccataa

SEQ ID NO: 10081 - DNA, 25 bp, E. coli
gaaagatatatctcaacgctctttg

SEQ ID NO: 10082 - DNA, 25 bp, E. coli
gaaagatatatcacaacgctctttg

SEQ ID NO: 10083 - DNA, 25 bp, E. coli
cgctctttggtgatttatgtccata

SEQ ID NO: 10084 - DNA, 25 bp, E. coli
cgctctttggtgttttatgtccata

SEQ ID NO: 10085 - DNA, 25 bp, E. coli
gatatatctcaaggctctttggtgt

SEQ ID NO: 10086 - DNA, 25 bp, E. coli
gatatatctcaacgctctttggtgt

SEQ ID NO: 10087 - DNA, 25 bp, E. coli
caaagtgcgaccgtggttccagcat

SEQ ID NO: 10088 - DNA, 25 bp, E. coli
caccgatcgcgactggttgcgcaaa

SEQ ID NO: 10089 - DNA, 25 bp, E. coli
caacaaagcctgagaagaagacacc

SEQ ID NO: 10090 - DNA, 25 bp, E. coli
cagcgacgccgtcgcaaaaaataac

SEQ ID NO: 10091 - DNA, 25 bp, E. coli
caaagtgcgaccctggttccagcat

SEQ ID NO: 10092 - DNA, 25 bp, E. coli
caccgatcgcgagtggttgcgcaaa

SEQ ID NO: 10093 - DNA, 25 bp, E. coli
cagcgacgccgtggcaaaaaataac

SEQ ID NO: 10094 - DNA, 25 bp, E. coli
caacaaagcctgtgaagaagacacc

SEQ ID NO: 10095 - DNA, 25 bp, E. coli
caggcgctactgcatgagcacgtga

SEQ ID NO: 10096 - DNA, 25 bp, E. coli
caggacaaagacgtcacgcgcattt

SEQ ID NO: 10097 - DNA, 25 bp, E. coli
caggacaaagacctcacgcgcattt

SEQ ID NO: 10098 - DNA, 25 bp, E. coli
caggcgctactggatgagcacgtga

SEQ ID NO: 10099 - DNA, 25 bp, E. coli
aactttgccttgttgcgggcaccga

SEQ ID NO: 10100 - DNA, 25 bp, E. coli
aactttgccttgatgcgggcaccga

SEQ ID NO: 10101 - DNA, 25 bp, E. coli
ttttcagcttgatcaaactcgccgc

SEQ ID NO: 10102 - DNA, 25 bp, E. coli
ttttcagcttgaacaaactcgccgc

SEQ ID NO: 10103 - DNA, 25 bp, E. coli
tcaggtcatgcgtaccgatcagcgt

SEQ ID NO: 10104 - DNA, 25 bp, E. coli
tcaggtcatgcgaaccgatcagcgt

SEQ ID NO: 10105 - DNA, 25 bp, E. coli
ccgggtagcgcagaatcgataggca

SEQ ID NO: 10106 - DNA, 25 bp, E. coli
ccgggtagcgcacaatcgataggca

SEQ ID NO: 10107 - DNA, 25 bp, E. coli
gatcagcgtcgctatttcggtcacc

SEQ ID NO: 10108 - DNA, 25 bp, E. coli
gatcagcgtcgcaatttcggtcacc

SEQ ID NO: 10109 - DNA, 25 bp, E. coli
aattgccgccacgacaaatccaggt

SEQ ID NO: 10110 - DNA, 25 bp, E. coli
aattgccgccaccacaaatccaggt

SEQ ID NO: 10111 - DNA, 25 bp, E. coli
acagcatattgaaaaggcacttcct

SEQ ID NO: 10112 - DNA, 25 bp, E. coli
acagcatattgataaggcacttcct

SEQ ID NO: 10113 - DNA, 25 bp, E. coli
ttgcccgcagccttggaattgccgc

SEQ ID NO: 10114 - DNA, 25 bp, E. coli
ttcaacagtggcgtaaacacacctg

SEQ ID NO: 10115 - DNA, 25 bp, E. coli
ttcaacagtggcctaaacacacctg

SEQ ID NO: 10116 - DNA, 25 bp, E. coli
ttgcccgcagccatggaattgccgc

SEQ ID NO: 10117 - DNA, 25 bp, E. coli
gccaccacaaatccaggtttgaata

SEQ ID NO: 10118 - DNA, 25 bp, E. coli
gccaccacaaatgcaggtttgaata

SEQ ID NO: 10119 - DNA, 25 bp, E. coli
gaaggagctggccaaggcatcttaa

SEQ ID NO: 10120 - DNA, 25 bp, E. coli
gaaggagctggcgaaggcatcttaa

SEQ ID NO: 10121 - DNA, 25 bp, E. coli
cgtaaacacacctgaagcagtaagg

SEQ ID NO: 10122 - DNA, 25 bp, E. coli
cgtaaacacaccagaagcagtaagg

SEQ ID NO: 10123 - DNA, 25 bp, E. coli
gataagctgtatttcaacagtggcg

SEQ ID NO: 10124 - DNA, 25 bp, E. coli
gataagctgtatatcaacagtggcg

SEQ ID NO: 10125 - DNA, 25 bp, E. coli
ggcgctggcaattgcccgcagccat

SEQ ID NO: 10126 - DNA, 25 bp, E. coli
tggcgtaaacacacctgaagcagta

SEQ ID NO: 10127 - DNA, 25 bp, E. coli
tggcgtaaacactcctgaagcagta

SEQ ID NO: 10128 - DNA, 25 bp, E. coli
ggcgctggcaatagcccgcagccat

SEQ ID NO: 10129 - DNA, 25 bp, E. coli
taatcaacagcaaattgataaggca

SEQ ID NO: 10130 - DNA, 25 bp, E. coli
taatcaacagcatattgataaggca

SEQ ID NO: 10131 - DNA, 25 bp, E. coli
aattaatcatcgtcacaggtcgcca

SEQ ID NO: 10132 - DNA, 25 bp, E. coli
aattaatcatcgacacaggtcgcca

SEQ ID NO: 10133 - DNA, 25 bp, E. coli
cacgcgtgattgctctcgacttaga

SEQ ID NO: 10134 - DNA, 25 bp, E. coli
cacgcgtgattggtctcgacttaga

SEQ ID NO: 10135 - DNA, 25 bp, E. coli
tagacggcacctaattgaccccgaa

SEQ ID NO: 10136 - DNA, 25 bp, E. coli
tagacggcaccttattgaccccgaa

SEQ ID NO: 10137 - DNA, 25 bp, E. coli
aaagcgcgcgcctacattgtgattg

SEQ ID NO: 10138 - DNA, 25 bp, E. coli
aaagcgcgcgccaacattgtgattg

SEQ ID NO: 10139 - DNA, 25 bp, E. coli
ttaacgccgtatcgaagttcgccct

SEQ ID NO: 10140 - DNA, 25 bp, E. coli
ttaacgccgtatggaagttcgccct

SEQ ID NO: 10141 - DNA, 25 bp, E. coli
tgcaaaaaccgtgctggaagcggac

SEQ ID NO: 10142 - DNA, 25 bp, E. coli
tgcaaaaaccgtcctggaagcggac

SEQ ID NO: 10143 - DNA, 25 bp, E. coli
tcctttttatcacgcgctggcgctg

SEQ ID NO: 10144 - DNA, 25 bp, E. coli
tcctttttatcaggcgctggcgctg

SEQ ID NO: 10145 - DNA, 25 bp, E. coli
tcaggttgatattgcacgcggcggc

SEQ ID NO: 10146 - DNA, 25 bp, E. coli
tcaggttgatatagcacgcggcggc

SEQ ID NO: 10147 - DNA, 25 bp, E. coli
gctggcgctggaaacacctgctatt

SEQ ID NO: 10148 - DNA, 25 bp, E. coli
gctggcgctggatacacctgctatt

SEQ ID NO: 10149 - DNA, 25 bp, E. coli
cgcggcggcaactgcaaaggtaaac

SEQ ID NO: 10150 - DNA, 25 bp, E. coli
cgcggcggcaacagcaaaggtaaac

SEQ ID NO: 10151 - DNA, 25 bp, E. coli
cttctctggctgaaacggcgcaaca

SEQ ID NO: 10152 - DNA, 25 bp, E. coli
cttctctggctgtaacggcgcaaca

SEQ ID NO: 10153 - DNA, 25 bp, E. coli
caacgttgtcgtcggcggtaatcca

SEQ ID NO: 10154 - DNA, 25 bp, E. coli
caacgttgtcgtgggcggtaatcca

SEQ ID NO: 10155 - DNA, 25 bp, E. coli
caacgtttcgctctgactatggcta

SEQ ID NO: 10156 - DNA, 25 bp, E. coli
caacgtttcgctgtgactatggcta

SEQ ID NO: 10157 - DNA, 25 bp, E. coli
catcggtaataaggtctggattggc

SEQ ID NO: 10158 - DNA, 25 bp, E. coli
catcggtaataacgtctggattggc

SEQ ID NO: 10159 - DNA, 25 bp, E. coli
tgtgaccattggtgataacgtcgtg

SEQ ID NO: 10160 - DNA, 25 bp, E. coli
tgtgaccattggagataacgtcgtg

SEQ ID NO: 10161 - DNA, 25 bp, E. coli
tcgaccctgtaggacgtaatagcgg

SEQ ID NO: 10162 - DNA, 25 bp, E. coli
tcgaccctgtagcacgtaatagcgg

SEQ ID NO: 10163 - DNA, 25 bp, E. coli
gcagttgtcacaaaagatgtcccgg

SEQ ID NO: 10164 - DNA, 25 bp, E. coli
gcagttgtcacataagatgtcccgg

SEQ ID NO: 10165 - DNA, 25 bp, E. coli
cgatacaatcattccctggcggaag

SEQ ID NO: 10166 - DNA, 25 bp, E. coli
cgatacaatcataccctggcggaag

SEQ ID NO: 10167 - DNA, 25 bp, E. coli
ggcgttcatatcaacacggcaacac

SEQ ID NO: 10168 - DNA, 25 bp, E. coli
ggcgttcatatctacacggcaacac

SEQ ID NO: 10169 - DNA, 25 bp, E. coli
ggaagagcacacattacgccagcaa

SEQ ID NO: 10170 - DNA, 25 bp, E. coli
ggaagagcacactttacgccagcaa

SEQ ID NO: 10171 - DNA, 25 bp, E. coli
taacgtcgtggtagcctcaggtgca

SEQ ID NO: 10172 - DNA, 25 bp, E. coli
taacgtcgtggttgcctcaggtgca

SEQ ID NO: 10173 - DNA, 25 bp, E. coli
gatgcttgatgtctgccctattcgc

SEQ ID NO: 10174 - DNA, 25 bp, E. coli
gatgcttgatgtgtgccctattcgc

SEQ ID NO: 10175 - DNA, 25 bp, E. coli
caactgatttggcagggcgatacgc

SEQ ID NO: 10176 - DNA, 25 bp, E. coli
caccgccgtgggatctaaaacctgg

SEQ ID NO: 10177 - DNA, 25 bp, E. coli
caaaaaacaactatctgcgggcgag

SEQ ID NO: 10178 - DNA, 25 bp, E. coli
caccgccgtgggttctaaaacctgg

SEQ ID NO: 10179 - DNA, 25 bp, E. coli
caaaaaacaactttctgcgggcgag

SEQ ID NO: 10180 - DNA, 25 bp, E. coli
caactgatttgggagggcgatacgc

SEQ ID NO: 10181 - DNA, 25 bp, E. coli
tactggcgagcacgcaaaagctttc

SEQ ID NO: 10182 - DNA, 25 bp, E. coli
tactggcgagcaggcaaaagctttc

SEQ ID NO: 10183 - DNA, 25 bp, E. coli
taaaacctggcgaaacagtgccgct

SEQ ID NO: 10184 - DNA, 25 bp, E. coli
taaaacctggcgtaacagtgccgct

SEQ ID NO: 10185 - DNA, 25 bp, E. coli
ttgtcaaacgaccaactgcgctggg

SEQ ID NO: 10186 - DNA, 25 bp, E. coli
ttgtcaaacgacgaactgcgctggg

SEQ ID NO: 10187 - DNA, 25 bp, E. coli
tgtgacggcccagcataaacagggt

SEQ ID NO: 10188 - DNA, 25 bp, E. coli
tgtgacggcccaccataaacagggt

SEQ ID NO: 10189 - DNA, 25 bp, E. coli
cgactcttgagttccgacagcgaaa

SEQ ID NO: 10190 - DNA, 25 bp, E. coli
cgactcttgagtaccgacagcgaaa

SEQ ID NO: 10191 - DNA, 25 bp, E. coli
gatattaagtttcacgccgggcgca

SEQ ID NO: 10192 - DNA, 25 bp, E. coli
gatattaagtttgacgccgggcgca

SEQ ID NO: 10193 - DNA, 25 bp, E. coli
gatcgttatctctcctggagccagc

SEQ ID NO: 10194 - DNA, 25 bp, E. coli
gatcgttatctcacctggagccagc

SEQ ID NO: 10195 - DNA, 25 bp, E. coli
ggttatcacaatgccgtcgcgttga

SEQ ID NO: 10196 - DNA, 25 bp, E. coli
ggttatcacaatcccgtcgcgttga

SEQ ID NO: 10197 - DNA, 25 bp, E. coli
ttatcgcggcgggtgtgaccctgct

SEQ ID NO: 10198 - DNA, 25 bp, E. coli
ttatcgcggcggctgtgaccctgct

SEQ ID NO: 10199 - DNA, 25 bp, E. coli
tgtaaacgtctgcaagaagtcggct

SEQ ID NO: 10200 - DNA, 25 bp, E. coli
tgtaaacgtctggaagaagtcggct

SEQ ID NO: 10201 - DNA, 25 bp, E. coli
gccgatccggtattgtgtaaacgtc

SEQ ID NO: 10202 - DNA, 25 bp, E. coli
gccgaaacgctggtacaacagggat

SEQ ID NO: 10203 - DNA, 25 bp, E. coli
gccgatccggtaatgtgtaaacgtc

SEQ ID NO: 10204 - DNA, 25 bp, E. coli
gccgaaacgctgctacaacagggat

SEQ ID NO: 10205 - DNA, 25 bp, E. coli
gctatcctcgaagcgcttatcgcgg

SEQ ID NO: 10206 - DNA, 25 bp, E. coli
gctatcctcgaaccgcttatcgcgg

SEQ ID NO: 10207 - DNA, 25 bp, E. coli
gaaacccgcgccttgctggagatta

SEQ ID NO: 10208 - DNA, 25 bp, E. coli
gaaacccgcgccatgctggagatta

SEQ ID NO: 10209 - DNA, 25 bp, E. coli
cggtgttagtgaatacggcgattgc

SEQ ID NO: 10210 - DNA, 25 bp, E. coli
cggtgttagtgattacggcgattgc

SEQ ID NO: 10211 - DNA, 25 bp, E. coli
gatttgtcgtgcagccttactgcgg

SEQ ID NO: 10212 - DNA, 25 bp, E. coli
gatttgtcgtgctgccttactgcgg

SEQ ID NO: 10213 - DNA, 25 bp, E. coli
ggacgatcccgtgaacatggcgaag

SEQ ID NO: 10214 - DNA, 25 bp, E. coli
ggacgatcccgtcaacatggcgaag

SEQ ID NO: 10215 - DNA, 25 bp, E. coli
tggctgttgcccgatcccatcgaaa

SEQ ID NO: 10216 - DNA, 25 bp, E. coli
tggctgttgccccatcccatcgaaa

SEQ ID NO: 10217 - DNA, 25 bp, E. coli
gatgaaacgtgtggacttgcgccag

SEQ ID NO: 10218 - DNA, 25 bp, E. coli
gatgaaacgtgtcgacttgcgccag

SEQ ID NO: 10219 - DNA, 25 bp, E. coli
aaggcactgtttccgctcatagaga

SEQ ID NO: 10220 - DNA, 25 bp, E. coli
aaggcactgtttgcgctcatagaga

SEQ ID NO: 10221 - DNA, 25 bp, E. coli
aattgaaatggagacgctggcacgc

SEQ ID NO: 10222 - DNA, 25 bp, E. coli
aattgaaatggacacgctggcacgc

SEQ ID NO: 10223 - DNA, 25 bp, E. coli
taaagaagacggttcacagcgtgcc

SEQ ID NO: 10224 - DNA, 25 bp, E. coli
taaagaagacggatcacagcgtgcc

SEQ ID NO: 10225 - DNA, 25 bp, E. coli
tacgatcggctggtcaaaacctggc

SEQ ID NO: 10226 - DNA, 25 bp, E. coli
tacgatcggctgctcaaaacctggc

SEQ ID NO: 10227 - DNA, 25 bp, E. coli
tttctgacaaggaacaggcggctca

SEQ ID NO: 10228 - DNA, 25 bp, E. coli
tttctgcctgaagacaaagctgccg

SEQ ID NO: 10229 - DNA, 25 bp, E. coli
ttattctggaagtcgtgactggcgc

SEQ ID NO: 10230 - DNA, 25 bp, E. coli
tttctgcctgaacacaaagctgccg

SEQ ID NO: 10231 - DNA, 25 bp, E. coli
tttctgacaaggtacaggcggctca

SEQ ID NO: 10232 - DNA, 25 bp, E. coli
ttattctggaagacgtgactggcgc

SEQ ID NO: 10233 - DNA, 25 bp, E. coli
tgtggatgtccataactaccgggca

SEQ ID NO: 10234 - DNA, 25 bp, E. coli
tgtggatgtccaaaactaccgggca

SEQ ID NO: 10235 - DNA, 25 bp, E. coli
gaaaagctgtcgacacgtctggctg

SEQ ID NO: 10236 - DNA, 25 bp, E. coli
gaaaagctgtcgtcacgtctggctg

SEQ ID NO: 10237 - DNA, 25 bp, E. coli
taatgccggaaggatttgcccgcag

SEQ ID NO: 10238 - DNA, 25 bp, E. coli
taatgccggaagcatttgcccgcag

SEQ ID NO: 10239 - DNA, 25 bp, E. coli
gatgattacccctggctgacgcatg

SEQ ID NO: 10240 - DNA, 25 bp, E. coli
gatgattaccccaggctgacgcatg

SEQ ID NO: 10241 - DNA, 25 bp, E. coli
caacggaaagtctttcataacggga

SEQ ID NO: 10242 - DNA, 25 bp, E. coli
caacattgaagccatgactgacgat

SEQ ID NO: 10243 - DNA, 25 bp, E. coli
caacggaaagtcattcataacggga

SEQ ID NO: 10244 - DNA, 25 bp, E. coli
caacattgaagcgatgactgacgat

SEQ ID NO: 10245 - DNA, 25 bp, E. coli
tacccacgccttaccgttatgcatg

SEQ ID NO: 10246 - DNA, 25 bp, E. coli
tacccacgcctttccgttatgcatg

SEQ ID NO: 10247 - DNA, 25 bp, E. coli
tgatgaacacagtgcagagcctgat

SEQ ID NO: 10248 - DNA, 25 bp, E. coli
tgatgaacacagagcagagcctgat

SEQ ID NO: 10249 - DNA, 25 bp, E. coli
tcatcttgataaaggaacgcgcccg

SEQ ID NO: 10250 - DNA, 25 bp, E. coli
tcatcttgataatggaacgcgcccg

SEQ ID NO: 10251 - DNA, 25 bp, E. coli
cctccagaaaagaggcacaacattg

SEQ ID NO: 10252 - DNA, 25 bp, E. coli
gccggaatattcgaacgtcatcttg

SEQ ID NO: 10253 - DNA, 25 bp, E. coli
gccggaatattccaacgtcatcttg

SEQ ID NO: 10254 - DNA, 25 bp, E. coli
cctccagaaaagtggcacaacattg

SEQ ID NO: 10255 - DNA, 25 bp, E. coli
gcagtttgcggtgttccctccagaa

SEQ ID NO: 10256 - DNA, 25 bp, E. coli
gcagtttgcggtcttccctccagaa

SEQ ID NO: 10257 - DNA, 25 bp, E. coli
cgcctttctggaataaacaaactgc

SEQ ID NO: 10258 - DNA, 25 bp, E. coli
cgcctttctggattaaacaaactgc

SEQ ID NO: 10259 - DNA, 25 bp, E. coli
gatcaggtgatcgttatcgaagcgg

SEQ ID NO: 10260 - DNA, 25 bp, E. coli
ggtcaaatatctgggctacgctgat

SEQ ID NO: 10261 - DNA, 25 bp, E. coli
ggtcaaatatctcggctacgctgat

SEQ ID NO: 10262 - DNA, 25 bp, E. coli
gatcaggtgatccttatcgaagcgg

SEQ ID NO: 10263 - DNA, 25 bp, E. coli
cagtacgagagatgagacagccgaa

SEQ ID NO: 10264 - DNA, 25 bp, E. coli
cagtacgagagaagagacagccgaa

SEQ ID NO: 10265 - DNA, 25 bp, E. coli
taaacagtacgacagaagagacagc

SEQ ID NO: 10266 - DNA, 25 bp, E. coli
taaacagtacgagagaagagacagc

SEQ ID NO: 10267 - DNA, 25 bp, E. coli
agagacagccgataaggtagaataa

SEQ ID NO: 10268 - DNA, 25 bp, E. coli
agagacagccgaaaaggtagaataa

SEQ ID NO: 10269 - DNA, 25 bp, E. coli
tttcgccaggacagagacgcactgc

SEQ ID NO: 10270 - DNA, 25 bp, E. coli
tttcgccaggactgagacgcactgc

SEQ ID NO: 10271 - DNA, 25 bp, E. coli
tgcatttgaaaccttattgtcgggc

SEQ ID NO: 10272 - DNA, 25 bp, E. coli
tgcatttgaaacgttattgtcgggc

SEQ ID NO: 10273 - DNA, 25 bp, E. coli
gcgcggaacaaatacttaaacagta

SEQ ID NO: 10274 - DNA, 25 bp, E. coli
gcgcggaacaaaaacttaaacagta

SEQ ID NO: 10275 - DNA, 25 bp, E. coli
ccaggacagagaggcactgcttgaa

SEQ ID NO: 10276 - DNA, 25 bp, E. coli
ccaggacagagacgcactgcttgaa

SEQ ID NO: 10277 - DNA, 25 bp, E. coli
gcttgaagcgcggaacaaatactta

SEQ ID NO: 10278 - DNA, 25 bp, E. coli
gcttgaagcgcgcaacaaatactta

SEQ ID NO: 10279 - DNA, 25 bp, E. coli
tgggttatttcctgcatttgaaacg

SEQ ID NO: 10280 - DNA, 25 bp, E. coli
tgggttatttccagcatttgaaacg

SEQ ID NO: 10281 - DNA, 25 bp, E. coli
gagagaagagacagccgaaaaggta

SEQ ID NO: 10282 - DNA, 25 bp, E. coli
gagacgcactgcttgaagcgcggaa

SEQ ID NO: 10283 - DNA, 25 bp, E. coli
gagagaagagactgccgaaaaggta

SEQ ID NO: 10284 - DNA, 25 bp, E. coli
gagacgcactgcatgaagcgcggaa

SEQ ID NO: 10285 - DNA, 25 bp, E. coli
cagaaaatgcagcaagagatcgcgc

SEQ ID NO: 10286 - DNA, 25 bp, E. coli
cagaaaatgcaggaagagatcgcgc

SEQ ID NO: 10287 - DNA, 25 bp, E. coli
tgtatcctccggtatgcagctgccg

SEQ ID NO: 10288 - DNA, 25 bp, E. coli
tgtatcctccggaatgcagctgccg

SEQ ID NO: 10289 - DNA, 25 bp, E. coli
tgcagcattcaacgacgcagcacgt

SEQ ID NO: 10290 - DNA, 25 bp, E. coli
tgcagcattcaaggacgcagcacgt

SEQ ID NO: 10291 - DNA, 25 bp, E. coli
tctgggtaacctgatgaagcaagcc

SEQ ID NO: 10292 - DNA, 25 bp, E. coli
tctgggtaacctcatgaagcaagcc

SEQ ID NO: 10293 - DNA, 25 bp, E. coli
gcagcacgtcgtattgaagaaacgc

SEQ ID NO: 10294 - DNA, 25 bp, E. coli
gcagcacgtcgttttgaagaaacgc

SEQ ID NO: 10295 - DNA, 25 bp, E. coli
gaagcaagcccaccagatgcaagaa

SEQ ID NO: 10296 - DNA, 25 bp, E. coli
gaagcaagcccagcagatgcaagaa

SEQ ID NO: 10297 - DNA, 25 bp, E. coli
cgaatctggcgctggtctggtaaaa

SEQ ID NO: 10298 - DNA, 25 bp, E. coli
cgaatctggcgcaggtctggtaaaa

SEQ ID NO: 10299 - DNA, 25 bp, E. coli
cgacaaagagatgctggaagacctg

SEQ ID NO: 10300 - DNA, 25 bp, E. coli
cgacaaagagatcctggaagacctg

SEQ ID NO: 10301 - DNA, 25 bp, E. coli
ggtaaaagtgaccatcaacggtgca

SEQ ID NO: 10302 - DNA, 25 bp, E. coli
ggaagacctggtggctgcagcattc

SEQ ID NO: 10303 - DNA, 25 bp, E. coli
ggtaaaagtgacgatcaacggtgca

SEQ ID NO: 10304 - DNA, 25 bp, E. coli
ggaagacctggtcgctgcagcattc

SEQ ID NO: 10305 - DNA, 25 bp, E. coli
gagcctgctggatgacgacaaagag

SEQ ID NO: 10306 - DNA, 25 bp, E. coli
gagcctgctggaagacgacaaagag

SEQ ID NO: 10307 - DNA, 25 bp, E. coli
caagggtgatttatattcaggatcg

SEQ ID NO: 10308 - DNA, 25 bp, E. coli
caagggtgatttttattcaggatcg

SEQ ID NO: 10309 - DNA, 25 bp, E. coli
caggatcgcattaacatctgataca

SEQ ID NO: 10310 - DNA, 25 bp, E. coli
caggatcgcatttacatctgataca

SEQ ID NO: 10311 - DNA, 25 bp, E. coli
taaaggcacacacatgcagcaaagg

SEQ ID NO: 10312 - DNA, 25 bp, E. coli
tacacttaggtaccaataaaggcac

SEQ ID NO: 10313 - DNA, 25 bp, E. coli
taaaggcacacagatgcagcaaagg

SEQ ID NO: 10314 - DNA, 25 bp, E. coli
tacacttaggtagcaataaaggcac

SEQ ID NO: 10315 - DNA, 25 bp, E. coli
taaacagagttgtttgccaccatct

SEQ ID NO: 10316 - DNA, 25 bp, E. coli
taaacagagttgattgccaccatct

SEQ ID NO: 10317 - DNA, 25 bp, E. coli
ttctgcgctatttcgaccgtttgca

SEQ ID NO: 10318 - DNA, 25 bp, E. coli
ttctgcgctattacgaccgtttgca

SEQ ID NO: 10319 - DNA, 25 bp, E. coli
tctgatacaaccgaataattcgtgt

SEQ ID NO: 10320 - DNA, 25 bp, E. coli
tctgatacaacccaataattcgtgt

SEQ ID NO: 10321 - DNA, 25 bp, E. coli
ccatctcaaatcagtcgtggataaa

SEQ ID NO: 10322 - DNA, 25 bp, E. coli
ccatctcaaatctgtcgtggataaa

SEQ ID NO: 10323 - DNA, 25 bp, E. coli
cgaccgtttgcacagcttttaagca

SEQ ID NO: 10324 - DNA, 25 bp, E. coli
cgaccgtttgcagagcttttaagca

SEQ ID NO: 10325 - DNA, 25 bp, E. coli
cgtggataaatcgtccgtagccttt

SEQ ID NO: 10326 - DNA, 25 bp, E. coli
cgtggataaatcctccgtagccttt

SEQ ID NO: 10327 - DNA, 25 bp, E. coli
ggtggcaagagggaaaacgtaattt

SEQ ID NO: 10328 - DNA, 25 bp, E. coli
ggtggcaagaggcaaaacgtaattt

SEQ ID NO: 10329 - DNA, 25 bp, E. coli
tacgtcatattctgagcaatcctgg

SEQ ID NO: 10330 - DNA, 25 bp, E. coli
tacgtcatattcagagcaatcctgg

SEQ ID NO: 10331 - DNA, 25 bp, E. coli
tagttaagctaacaaacgagagggc

SEQ ID NO: 10332 - DNA, 25 bp, E. coli
tagtgtcaccaatttcatctggcga

SEQ ID NO: 10333 - DNA, 25 bp, E. coli
tatgaaaaagtgtgtcctgtcccgc

SEQ ID NO: 10334 - DNA, 25 bp, E. coli
tagttaagctaagaaacgagagggc

SEQ ID NO: 10335 - DNA, 25 bp, E. coli
tagtgtcaccaaattcatctggcga

SEQ ID NO: 10336 - DNA, 25 bp, E. coli
tatgaaaaagtgagtcctgtcccgc

SEQ ID NO: 10337 - DNA, 25 bp, E. coli
tgtaatcactaacgccgcgtaagcg

SEQ ID NO: 10338 - DNA, 25 bp, E. coli
tgtaatcactaaggccgcgtaagcg

SEQ ID NO: 10339 - DNA, 25 bp, E. coli
tccatcccgaaacgtgtccgttagt

SEQ ID NO: 10340 - DNA, 25 bp, E. coli
tccatcccgaaaggtgtccgttagt

SEQ ID NO: 10341 - DNA, 25 bp, E. coli
gcaaactgcttttacctgctgcggg

SEQ ID NO: 10342 - DNA, 25 bp, E. coli
gcaaactgctttaacctgctgcggg

SEQ ID NO: 10343 - DNA, 25 bp, E. coli
cgatgaaaacctgcaaagagtggct

SEQ ID NO: 10344 - DNA, 25 bp, E. coli
cgagagggcaagaccaggtcagtaa

SEQ ID NO: 10345 - DNA, 25 bp, E. coli
cgatgaaaacctccaaagagtggct

SEQ ID NO: 10346 - DNA, 25 bp, E. coli
cgagagggcaagtccaggtcagtaa

SEQ ID NO: 10347 - DNA, 25 bp, E. coli
taagcggccttttttatgcataacc

SEQ ID NO: 10348 - DNA, 25 bp, E. coli
taattgaaccacgaactcaggatct

SEQ ID NO: 10349 - DNA, 25 bp, E. coli
taattgaaccaccaactcaggatct

SEQ ID NO: 10350 - DNA, 25 bp, E. coli
taagcggcctttattatgcataacc

SEQ ID NO: 10351 - DNA, 25 bp, E. coli
cagcaggtaatgcaagggcagattg

SEQ ID NO: 10352 - DNA, 25 bp, E. coli
cagcaggtaatggaagggcagattg

SEQ ID NO: 10353 - DNA, 25 bp, E. coli
agggcagattggaggatttctcctg

SEQ ID NO: 10354 - DNA, 25 bp, E. coli
agggcagattggtggatttctcctg

SEQ ID NO: 10355 - DNA, 25 bp, E. coli
tatcatcgacttgattcgcgaatga

SEQ ID NO: 10356 - DNA, 25 bp, E. coli
tatcatcgacttcattcgcgaatga

SEQ ID NO: 10357 - DNA, 25 bp, E. coli
tatatatcatcgacttcattcgcga

SEQ ID NO: 10358 - DNA, 25 bp, E. coli
tatatatcatcgtcttcattcgcga

SEQ ID NO: 10359 - DNA, 25 bp, E. coli
tgcctggattagtatcatatatatc

SEQ ID NO: 10360 - DNA, 25 bp, E. coli
tgcctggattagaatcatatatatc

SEQ ID NO: 10361 - DNA, 25 bp, E. coli
tcatcgacttcaatcgcgaatgaga

SEQ ID NO: 10362 - DNA, 25 bp, E. coli
tcattcgcgaatgagatggcggaga

SEQ ID NO: 10363 - DNA, 25 bp, E. coli
tcatcgacttcattcgcgaatgaga

SEQ ID NO: 10364 - DNA, 25 bp, E. coli
tcattcgcgaatcagatggcggaga

SEQ ID NO: 10365 - DNA, 25 bp, E. coli
gaagggcagattcgtggatttctcc

SEQ ID NO: 10366 - DNA, 25 bp, E. coli
gaagggcagattggtggatttctcc

SEQ ID NO: 10367 - DNA, 25 bp, E. coli
gacttcattcgccaatgagatggcg

SEQ ID NO: 10368 - DNA, 25 bp, E. coli
gacttcattcgcgaatgagatggcg

SEQ ID NO: 10369 - DNA, 25 bp, E. coli
gattagtatcatatatatcatcgac

SEQ ID NO: 10370 - DNA, 25 bp, E. coli
gattagtatcatttatatcatcgac

SEQ ID NO: 10371 - DNA, 25 bp, E. coli
tggcggagatgcctcagcaggtaat

SEQ ID NO: 10372 - DNA, 25 bp, E. coli
tggcggagatgcgtcagcaggtaat

SEQ ID NO: 10373 - DNA, 25 bp, E. coli
catcggtcatcggacaggttgtcat

SEQ ID NO: 10374 - DNA, 25 bp, E. coli
catcggtcatcgcacaggttgtcat

SEQ ID NO: 10375 - DNA, 25 bp, E. coli
tatattccggcacaggtcgtggtca

SEQ ID NO: 10376 - DNA, 25 bp, E. coli
taaaaaatgcgaatcgctggccggg

SEQ ID NO: 10377 - DNA, 25 bp, E. coli
taaaaaatgcgattcgctggccggg

SEQ ID NO: 10378 - DNA, 25 bp, E. coli
tatattccggcagaggtcgtggtca

SEQ ID NO: 10379 - DNA, 25 bp, E. coli
tgaggctccttgttacccggaaagg

SEQ ID NO: 10380 - DNA, 25 bp, E. coli
tgaggctccttgatacccggaaagg

SEQ ID NO: 10381 - DNA, 25 bp, E. coli
tgaaaaggttatcccgccagctgag

SEQ ID NO: 10382 - DNA, 25 bp, E. coli
tgcagatgaaacgtccctgaggctc

SEQ ID NO: 10383 - DNA, 25 bp, E. coli
tgaaaaggttatgccgccagctgag

SEQ ID NO: 10384 - DNA, 25 bp, E. coli
tgcagatgaaacctccctgaggctc

SEQ ID NO: 10385 - DNA, 25 bp, E. coli
gccacgagcttcagacacgggatgt

SEQ ID NO: 10386 - DNA, 25 bp, E. coli
gccacgagcttctgacacgggatgt

SEQ ID NO: 10387 - DNA, 25 bp, E. coli
gaaatctcggcgcatctggacaaac

SEQ ID NO: 10388 - DNA, 25 bp, E. coli
gaaatctcggcggatctggacaaac

SEQ ID NO: 10389 - DNA, 25 bp, E. coli
cgtcagcggagatagagtaagcgtc

SEQ ID NO: 10390 - DNA, 25 bp, E. coli
cgtcagcggagaaagagtaagcgtc

SEQ ID NO: 10391 - DNA, 25 bp, E. coli
ggatgcagcgttccctgttcgaaga

SEQ ID NO: 10392 - DNA, 25 bp, E. coli
ggatgcagcgttgcctgttcgaaga

SEQ ID NO: 10393 - DNA, 25 bp, E. coli
ggacaaactgcttcctcagaccggg

SEQ ID NO: 10394 - DNA, 25 bp, E. coli
ggacaaactgctacctcagaccggg

SEQ ID NO: 10395 - DNA, 25 bp, E. coli
caccgctgcttagatcggtaacggc

SEQ ID NO: 10396 - DNA, 25 bp, E. coli
cactatttctctgacaacaaagatg

SEQ ID NO: 10397 - DNA, 25 bp, E. coli
cactatttctctcacaacaaagatg

SEQ ID NO: 10398 - DNA, 25 bp, E. coli
caccgctgcttacatcggtaacggc

SEQ ID NO: 10399 - DNA, 25 bp, E. coli
tactgatgctcacaacaccgctgct

SEQ ID NO: 10400 - DNA, 25 bp, E. coli
tactgatgctcagaacaccgctgct

SEQ ID NO: 10401 - DNA, 25 bp, E. coli
acaacaaagatgtagatggcgacca

SEQ ID NO: 10402 - DNA, 25 bp, E. coli
aacctgggtcgtggctacgacgacg

SEQ ID NO: 10403 - DNA, 25 bp, E. coli
acaacaaagatgaagatggcgacca

SEQ ID NO: 10404 - DNA, 25 bp, E. coli
aacctgggtcgtcgctacgacgacg

SEQ ID NO: 10405 - DNA, 25 bp, E. coli
tagtggcgtaactaacaacggtcgt

SEQ ID NO: 10406 - DNA, 25 bp, E. coli
tagtggcgtaacaaacaacggtcgt

SEQ ID NO: 10407 - DNA, 25 bp, E. coli
tttcggtatcggaggtgcgatctcc

SEQ ID NO: 10408 - DNA, 25 bp, E. coli
tttcggtatcggtggtgcgatctcc

SEQ ID NO: 10409 - DNA, 25 bp, E. coli
tggtgaaggcttaactagtggcgta

SEQ ID NO: 10410 - DNA, 25 bp, E. coli
tggtgaaggctttactagtggcgta

SEQ ID NO: 10411 - DNA, 25 bp, E. coli
gtggtgcgatctgcagctccaaacg

SEQ ID NO: 10412 - DNA, 25 bp, E. coli
gtggtgcgatctccagctccaaacg

SEQ ID NO: 10413 - DNA, 25 bp, E. coli
ggtaaaaacggcaacccatctggtg

SEQ ID NO: 10414 - DNA, 25 bp, E. coli
ggtaaaaacggctacccatctggtg

SEQ ID NO: 10415 - DNA, 25 bp, E. coli
ggcaacccatctcgtgaaggcttta

SEQ ID NO: 10416 - DNA, 25 bp, E. coli
ggcaacccatctggtgaaggcttta

SEQ ID NO: 10417 - DNA, 25 bp, E. coli
cattttccttttcagtatctccctg

SEQ ID NO: 10418 - DNA, 25 bp, E. coli
cattttccttttgagtatctccctg

SEQ ID NO: 10419 - DNA, 25 bp, E. coli
actccgctccctcatgacattgtgg

SEQ ID NO: 10420 - DNA, 25 bp, E. coli
actccgctccctgatgacattgtgg

SEQ ID NO: 10421 - DNA, 25 bp, E. coli
tatgcgctgcgtgacaaaaactgct

SEQ ID NO: 10422 - DNA, 25 bp, E. coli
tatgcgctgcgtcacaaaaactgct

SEQ ID NO: 10423 - DNA, 25 bp, E. coli
gcgtcacaaaaactgctacactccg

SEQ ID NO: 10424 - DNA, 25 bp, E. coli
gcgtcacaaaaagtgctacactccg

SEQ ID NO: 10425 - DNA, 25 bp, E. coli
gcaacgccagtcacagggataattt

SEQ ID NO: 10426 - DNA, 25 bp, E. coli
gcaacgccagtctcagggataattt

SEQ ID NO: 10427 - DNA, 25 bp, E. coli
gacattgtggtttttgtcattttcc

SEQ ID NO: 10428 - DNA, 25 bp, E. coli
gacattgtggttattgtcattttcc

SEQ ID NO: 10429 - DNA, 25 bp, E. coli
gtatctccctgaaaactacaccggt

SEQ ID NO: 10430 - DNA, 25 bp, E. coli
gattgattaagaatatgactccata

SEQ ID NO: 10431 - DNA, 25 bp, E. coli
gattgattaagattatgactccata

SEQ ID NO: 10432 - DNA, 25 bp, E. coli
gggataatttatgcgctgcgtcaca

SEQ ID NO: 10433 - DNA, 25 bp, E. coli
gtatctccctgataactacaccggt

SEQ ID NO: 10434 - DNA, 25 bp, E. coli
gggagttgtccagtatggctaagaa

SEQ ID NO: 10435 - DNA, 25 bp, E. coli
gggataatttatccgctgcgtcaca

SEQ ID NO: 10436 - DNA, 25 bp, E. coli
gggagttgtccactatggctaagaa

SEQ ID NO: 10437 - DNA, 25 bp, E. coli
taagaattttaggaacgccagtcac

SEQ ID NO: 10438 - DNA, 25 bp, E. coli
taagaattttagcaacgccagtcac

SEQ ID NO: 10439 - DNA, 25 bp, E. coli
aagtcactgcatggttgaaagatcc

SEQ ID NO: 10440 - DNA, 25 bp, E. coli
aagtcactgcatcgttgaaagatcc

SEQ ID NO: 10441 - DNA, 25 bp, E. coli
cacaagattgttacgcttcatggga

SEQ ID NO: 10442 - DNA, 25 bp, E. coli
cacaagattgtttcgcttcatggga

SEQ ID NO: 10443 - DNA, 25 bp, E. coli
caacaaagagacctaagtgggcatt

SEQ ID NO: 10444 - DNA, 25 bp, E. coli
caacaaagagacgtaagtgggcatt

SEQ ID NO: 10445 - DNA, 25 bp, E. coli
cttaccaaagcaacgaagatttccg

SEQ ID NO: 10446 - DNA, 25 bp, E. coli
cttaccaaagcatcgaagatttccg

SEQ ID NO: 10447 - DNA, 25 bp, E. coli
aactcgttgcatcgccggtttaggc

SEQ ID NO: 10448 - DNA, 25 bp, E. coli
aactcgttgcatggccggtttaggc

SEQ ID NO: 10449 - DNA, 25 bp, E. coli
tatgccagtgcttatgttcgcgccc

SEQ ID NO: 10450 - DNA, 25 bp, E. coli
tatgccagtgctaatgttcgcgccc

SEQ ID NO: 10451 - DNA, 25 bp, E. coli
tatattacagcggtgggctacaggg

SEQ ID NO: 10452 - DNA, 25 bp, E. coli
tatattacagcgctgggctacaggg

SEQ ID NO: 10453 - DNA, 25 bp, E. coli
tgttcgcgcccgtcaaaaatggtta

SEQ ID NO: 10454 - DNA, 25 bp, E. coli
tgttcgcgcccgacaaaaatggtta

SEQ ID NO: 10455 - DNA, 25 bp, E. coli
gctacagggcttggtaattctccac

SEQ ID NO: 10456 - DNA, 25 bp, E. coli
gctacagggcttcgtaattctccac

SEQ ID NO: 10457 - DNA, 25 bp, E. coli
ggtgcgatgaaatccaggcctggat

SEQ ID NO: 10458 - DNA, 25 bp, E. coli
ggtgcgatgaaaaccaggcctggat

SEQ ID NO: 10459 - DNA, 25 bp, E. coli
taatcaaggacataagacgagcaac

SEQ ID NO: 10460 - DNA, 25 bp, E. coli
taatcaaggacaaaagacgagcaac

SEQ ID NO: 10461 - DNA, 25 bp, E. coli
taaatgcgggttatgcagactggaa

SEQ ID NO: 10462 - DNA, 25 bp, E. coli
taaatgcgggttttgcagactggaa

SEQ ID NO: 10463 - DNA, 25 bp, E. coli
tatggccaatgggataactcatggg

SEQ ID NO: 10464 - DNA, 25 bp, E. coli
tatggccaatggcataactcatggg

SEQ ID NO: 10465 - DNA, 25 bp, E. coli
tatttcgataattagctgggctacg

SEQ ID NO: 10466 - DNA, 25 bp, E. coli
tatttcgataataagctgggctacg

SEQ ID NO: 10467 - DNA, 25 bp, E. coli
tgctgtagcagggagaaatcatacg

SEQ ID NO: 10468 - DNA, 25 bp, E. coli
tgctgtagcaggcagaaatcatacg

SEQ ID NO: 10469 - DNA, 25 bp, E. coli
gaacctttggttgaataaatgcggg

SEQ ID NO: 10470 - DNA, 25 bp, E. coli
gaagttctatcctcgctggaaagca

SEQ ID NO: 10471 - DNA, 25 bp, E. coli
gaacctttggttcaataaatgcggg

SEQ ID NO: 10472 - DNA, 25 bp, E. coli
gaagttctatccacgctggaaagca

SEQ ID NO: 10473 - DNA, 25 bp, E. coli
gaactggacaggtacgatgcttaca

SEQ ID NO: 10474 - DNA, 25 bp, E. coli
gaactggacaggaacgatgcttaca

SEQ ID NO: 10475 - DNA, 25 bp, E. coli
cttacacggagctgcaatttggccg

SEQ ID NO: 10476 - DNA, 25 bp, E. coli
cttacacggagcagcaatttggccg

SEQ ID NO: 10477 - DNA, 25 bp, E. coli
gattcggttacctcggctggaacgg

SEQ ID NO: 10478 - DNA, 25 bp, E. coli
gattcggttaccacggctggaacgg

SEQ ID NO: 10479 - DNA, 25 bp, E. coli
gatttgtaaacagtcaccgtggtga

SEQ ID NO: 10480 - DNA, 25 bp, E. coli
gatttgtaaacactcaccgtggtga

SEQ ID NO: 10481 - DNA, 25 bp, E. coli
ggctacgatggctttggcgatcaaa

SEQ ID NO: 10482 - DNA, 25 bp, E. coli
ggctacgatggcattggcgatcaaa

SEQ ID NO: 10483 - DNA, 25 bp, E. coli
gaacaggaattacaggaaggcccgc

SEQ ID NO: 10484 - DNA, 25 bp, E. coli
gaacaggaattagaggaaggcccgc

SEQ ID NO: 10485 - DNA, 25 bp, E. coli
caaactctttgcgacggatatctgg

SEQ ID NO: 10486 - DNA, 25 bp, E. coli
cacgcgggcgttttttactcattca

SEQ ID NO: 10487 - DNA, 25 bp, E. coli
cacgcgggcgttatttactcattca

SEQ ID NO: 10488 - DNA, 25 bp, E. coli
caaactctttgccacggatatctgg

SEQ ID NO: 10489 - DNA, 25 bp, E. coli
catttttgcgttagcacaggccgtg

SEQ ID NO: 10490 - DNA, 25 bp, E. coli
tagcaggttccacgcatatcgagat

SEQ ID NO: 10491 - DNA, 25 bp, E. coli
tagcaggttccaggcatatcgagat

SEQ ID NO: 10492 - DNA, 25 bp, E. coli
tctctcactgctcgtattggcgctg

SEQ ID NO: 10493 - DNA, 25 bp, E. coli
tctctcactgctggtattggcgctg

SEQ ID NO: 10494 - DNA, 25 bp, E. coli
ccgtgggtattattcagcagcatgc

SEQ ID NO: 10495 - DNA, 25 bp, E. coli
ccgtgggtattaatcagcagcatgc

SEQ ID NO: 10496 - DNA, 25 bp, E. coli
catttttgcgtttgcacaggccgtg

SEQ ID NO: 10497 - DNA, 25 bp, E. coli
tgtttaaacgccaggaagttgcgcc

SEQ ID NO: 10498 - DNA, 25 bp, E. coli
tgtttaaacgcctggaagttgcgcc

SEQ ID NO: 10499 - DNA, 25 bp, E. coli
tggcctcaatcggagaaaacacgct

SEQ ID NO: 10500 - DNA, 25 bp, E. coli
tggcctcaatcgcagaaaacacgct

SEQ ID NO: 10501 - DNA, 25 bp, E. coli
gacgctcggcattctggtcgaacca

SEQ ID NO: 10502 - DNA, 25 bp, E. coli
gatgttccgcctgatgccgtgggta

SEQ ID NO: 10503 - DNA, 25 bp, E. coli
gatgttccgcctcatgccgtgggta

SEQ ID NO: 10504 - DNA, 25 bp, E. coli
gacgctcggcatactggtcgaacca

SEQ ID NO: 10505 - DNA, 25 bp, E. coli
cacaggtaatgcaatggctgggcag

SEQ ID NO: 10506 - DNA, 25 bp, E. coli
cacaggtaatgctatggctgggcag

SEQ ID NO: 10507 - DNA, 25 bp, E. coli
caggaaatggttacagagtgacagc

SEQ ID NO: 10508 - DNA, 25 bp, E. coli
caggaaatggtttcagagtgacagc

SEQ ID NO: 10509 - DNA, 25 bp, E. coli
tatcgttgcttctgacatcggtcgc

SEQ ID NO: 10510 - DNA, 25 bp, E. coli
tatcgttgcttcagacatcggtcgc

SEQ ID NO: 10511 - DNA, 25 bp, E. coli
tatcagggaaaacgaatgtcaacac

SEQ ID NO: 10512 - DNA, 25 bp, E. coli
tatcagggaaaaggaatgtcaacac

SEQ ID NO: 10513 - DNA, 25 bp, E. coli
cctgtacgtataagagtggctcacc

SEQ ID NO: 10514 - DNA, 25 bp, E. coli
cctgtacgtatatgagtggctcacc

SEQ ID NO: 10515 - DNA, 25 bp, E. coli
gcaggtctggactcagcacgttcaa

SEQ ID NO: 10516 - DNA, 25 bp, E. coli
gaatattaatccagagcacgtggac

SEQ ID NO: 10517 - DNA, 25 bp, E. coli
gaatattaatcctgagcacgtggac

SEQ ID NO: 10518 - DNA, 25 bp, E. coli
gcaggtctggacacagcacgttcaa

SEQ ID NO: 10519 - DNA, 25 bp, E. coli
cggtcgctgtacaggctgatgtgca

SEQ ID NO: 10520 - DNA, 25 bp, E. coli
cggtcgctgtactggctgatgtgca

SEQ ID NO: 10521 - DNA, 25 bp, E. coli
gatttccggacctcggccagtatga

SEQ ID NO: 10522 - DNA, 25 bp, E. coli
gatttccggaccacggccagtatga

SEQ ID NO: 10523 - DNA, 25 bp, E. coli
ggctcaccctggttaaaggtcacag

SEQ ID NO: 10524 - DNA, 25 bp, E. coli
ggctcaccctggataaaggtcacag

SEQ ID NO: 10525 - DNA, 25 bp, E. coli
taatggcagcaggacactgaatggc

SEQ ID NO: 10526 - DNA, 25 bp, E. coli
taatggcagcagcacactgaatggc

SEQ ID NO: 10527 - DNA, 25 bp, E. coli
cagctggtccgcagccggtgttgcc

SEQ ID NO: 10528 - DNA, 25 bp, E. coli
catgagtcgcccagtgaaacagctg

SEQ ID NO: 10529 - DNA, 25 bp, E. coli
catgagtcgccctgtgaaacagctg

SEQ ID NO: 10530 - DNA, 25 bp, E. coli
cagctggtccgctgccggtgttgcc

SEQ ID NO: 10531 - DNA, 25 bp, E. coli
tcgccctgtgaatcagctgaaaggc

SEQ ID NO: 10532 - DNA, 25 bp, E. coli
tcgccctgtgaaacagctgaaaggc

SEQ ID NO: 10533 - DNA, 25 bp, E. coli
tcagactgtcagcttcccgatcgat

SEQ ID NO: 10534 - DNA, 25 bp, E. coli
gcgcgagggtgcgacggtagtgcag

SEQ ID NO: 10535 - DNA, 25 bp, E. coli
gcgcgagggtgccacggtagtgcag

SEQ ID NO: 10536 - DNA, 25 bp, E. coli
gaagcctccagccggaccgatatca

SEQ ID NO: 10537 - DNA, 25 bp, E. coli
gaagcctccagcgggaccgatatca

SEQ ID NO: 10538 - DNA, 25 bp, E. coli
gactgtcagcttcccgatcgatatt

SEQ ID NO: 10539 - DNA, 25 bp, E. coli
gactgtcagcttgccgatcgatatt

SEQ ID NO: 10540 - DNA, 25 bp, E. coli
ccctgtgaaacacctgaaaggcttt

SEQ ID NO: 10541 - DNA, 25 bp, E. coli
ccctgtgaaacagctgaaaggcttt

SEQ ID NO: 10542 - DNA, 25 bp, E. coli
gtccgcagccggtgttgccgatcaa

SEQ ID NO: 10543 - DNA, 25 bp, E. coli
gtccgcagccggagttgccgatcaa

SEQ ID NO: 10544 - DNA, 25 bp, E. coli
tcagactgtcaggttcccgatcgat

SEQ ID NO: 10545 - DNA, 25 bp, E. coli
gagtcgccctgtgaaacagctgaaa

SEQ ID NO: 10546 - DNA, 25 bp, E. coli
gagtcgccctgtcaaacagctgaaa

SEQ ID NO: 10547 - DNA, 25 bp, E. coli
gacgaacaccggtaagcgcgagggt

SEQ ID NO: 10548 - DNA, 25 bp, E. coli
gacgaacaccggaaagcgcgagggt

SEQ ID NO: 10549 - DNA, 25 bp, E. coli
catcatattcagagctacggcaacc

SEQ ID NO: 10550 - DNA, 25 bp, E. coli
catcatattcagtgctacggcaacc

SEQ ID NO: 10551 - DNA, 25 bp, E. coli
tacggcaacccagtggagcaaacct

SEQ ID NO: 10552 - DNA, 25 bp, E. coli
tacggcaacccactggagcaaacct

SEQ ID NO: 10553 - DNA, 25 bp, E. coli
ttttacgcggcgctgccaatggacg

SEQ ID NO: 10554 - DNA, 25 bp, E. coli
ttttacgcggcggtgccaatggacg

SEQ ID NO: 10555 - DNA, 25 bp, E. coli
tgctggcaggcgatactggcaaagt

SEQ ID NO: 10556 - DNA, 25 bp, E. coli
tgctggcaggcgttactggcaaagt

SEQ ID NO: 10557 - DNA, 25 bp, E. coli
tcgtgcccacgatttatggctcaac

SEQ ID NO: 10558 - DNA, 25 bp, E. coli
tctgcttaagcgattgatcaaggcg

SEQ ID NO: 10559 - DNA, 25 bp, E. coli
tctgcttaagcgtttgatcaaggcg

SEQ ID NO: 10560 - DNA, 25 bp, E. coli
tcgtgcccacgaattatggctcaac

SEQ ID NO: 10561 - DNA, 25 bp, E. coli
gctgaattgctggttcgtgcccacg

SEQ ID NO: 10562 - DNA, 25 bp, E. coli
gctgaattgctgcttcgtgcccacg

SEQ ID NO: 10563 - DNA, 25 bp, E. coli
cgcgggtctggtagattttgctgaa

SEQ ID NO: 10564 - DNA, 25 bp, E. coli
cgcgggtctggttgattttgctgaa

SEQ ID NO: 10565 - DNA, 25 bp, E. coli
gatcaaggcgatgaatctcgacgag

SEQ ID NO: 10566 - DNA, 25 bp, E. coli
gatcaaggcgatcaatctcgacgag

SEQ ID NO: 10567 - DNA, 25 bp, E. coli
ggtggatgaattgcaggacactaac

SEQ ID NO: 10568 - DNA, 25 bp, E. coli
ggtggatgaattccaggacactaac

SEQ ID NO: 10569 - DNA, 25 bp, E. coli
tggctcaacaaagcgcatatccttc

SEQ ID NO: 10570 - DNA, 25 bp, E. coli
tggctcaacaaaccgcatatccttc

SEQ ID NO: 10571 - DNA, 25 bp, E. coli
tatttatgacgaattgcgcaagggc

SEQ ID NO: 10572 - DNA, 25 bp, E. coli
tataacgcgacgaattccggtccgg

SEQ ID NO: 10573 - DNA, 25 bp, E. coli
tatttatgacgatttgcgcaagggc

SEQ ID NO: 10574 - DNA, 25 bp, E. coli
tataacgcgacgtattccggtccgg

SEQ ID NO: 10575 - DNA, 25 bp, E. coli
tgagtttttccagtgcggcgcgtaa

SEQ ID NO: 10576 - DNA, 25 bp, E. coli
tgagtttttccactgcggcgcgtaa

SEQ ID NO: 10577 - DNA, 25 bp, E. coli
ccggtgtaccggtcatggctgaata

SEQ ID NO: 10578 - DNA, 25 bp, E. coli
ccggtgtaccggacatggctgaata

SEQ ID NO: 10579 - DNA, 25 bp, E. coli
gcgcgtaactattacggcacctaca

SEQ ID NO: 10580 - DNA, 25 bp, E. coli
gcgcgtaactataacggcacctaca

SEQ ID NO: 10581 - DNA, 25 bp, E. coli
gcaggactgtttaattggcgcggta

SEQ ID NO: 10582 - DNA, 25 bp, E. coli
gcaggactgttttattggcgcggta

SEQ ID NO: 10583 - DNA, 25 bp, E. coli
gaagcctggagatttcagatccggg

SEQ ID NO: 10584 - DNA, 25 bp, E. coli
gaagcctggagaattcagatccggg

SEQ ID NO: 10585 - DNA, 25 bp, E. coli
ggatatcggcatcgtcaaatctgac

SEQ ID NO: 10586 - DNA, 25 bp, E. coli
tgaaactttccgcaacggccagttg

SEQ ID NO: 10587 - DNA, 25 bp, E. coli
ggatatcggcatggtcaaatctgac

SEQ ID NO: 10588 - DNA, 25 bp, E. coli
tgaaactttccggaacggccagttg

SEQ ID NO: 10589 - DNA, 25 bp, E. coli
ggaagtccatatgaccccgggtatt

SEQ ID NO: 10590 - DNA, 25 bp, E. coli
ggaagtccatatcaccccgggtatt

SEQ ID NO: 10591 - DNA, 25 bp, E. coli
tcaaagagaccgtgcgggaagtcca

SEQ ID NO: 10592 - DNA, 25 bp, E. coli
tcaaagagaccgagcgggaagtcca

SEQ ID NO: 10593 - DNA, 25 bp, E. coli
aggatgacgaactgcccgccgatgc

SEQ ID NO: 10594 - DNA, 25 bp, E. coli
acggcacgtcggacggcgaactgct

SEQ ID NO: 10595 - DNA, 25 bp, E. coli
aggatgacgaacagcccgccgatgc

SEQ ID NO: 10596 - DNA, 25 bp, E. coli
acggcacgtcggtcggcgaactgct

SEQ ID NO: 10597 - DNA, 25 bp, E. coli
ataaagcccaggttgacgaactgcc

SEQ ID NO: 10598 - DNA, 25 bp, E. coli
ataaagcccaggatgacgaactgcc

SEQ ID NO: 10599 - DNA, 25 bp, E. coli
ttattgaaggccttaaagcccagga

SEQ ID NO: 10600 - DNA, 25 bp, E. coli
ttattgaaggccataaagcccagga

SEQ ID NO: 10601 - DNA, 25 bp, E. coli
tgggaaccatcctcggcacgtcggt

SEQ ID NO: 10602 - DNA, 25 bp, E. coli
tgggaaccatccacggcacgtcggt

SEQ ID NO: 10603 - DNA, 25 bp, E. coli
cctagcaaaggccagatggtgctga

SEQ ID NO: 10604 - DNA, 25 bp, E. coli
cctagcaaaggcgagatggtgctga

SEQ ID NO: 10605 - DNA, 25 bp, E. coli
gaaggccataaaccccaggatgacg

SEQ ID NO: 10606 - DNA, 25 bp, E. coli
gaaggccataaagcccaggatgacg

SEQ ID NO: 10607 - DNA, 25 bp, E. coli
gaactgctggcgaggatcaaagaag

SEQ ID NO: 10608 - DNA, 25 bp, E. coli
gaactgctggcgtggatcaaagaag

SEQ ID NO: 10609 - DNA, 25 bp, E. coli
gtgatgaacaccggcctgggaacca

SEQ ID NO: 10610 - DNA, 25 bp, E. coli
gtgatgaacacccgcctgggaacca

SEQ ID NO: 10611 - DNA, 25 bp, E. coli
gagatggtgctgtttattgaaggcc

SEQ ID NO: 10612 - DNA, 25 bp, E. coli
gatgaaaaccctagcaaaggcgaga

SEQ ID NO: 10613 - DNA, 25 bp, E. coli
gatgaaaacccttgcaaaggcgaga

SEQ ID NO: 10614 - DNA, 25 bp, E. coli
gagatggtgctgattattgaaggcc

SEQ ID NO: 10615 - DNA, 25 bp, E. coli
aaattactcagaacctggccggcgg

SEQ ID NO: 10616 - DNA, 25 bp, E. coli
aaattactcagatcctggccggcgg

SEQ ID NO: 10617 - DNA, 25 bp, E. coli
tatcactatggaacgtcagcaggac

SEQ ID NO: 10618 - DNA, 25 bp, E. coli
tatcactatggatcgtcagcaggac

SEQ ID NO: 10619 - DNA, 25 bp, E. coli
ttttggtgtggagaacgcaccacgc

SEQ ID NO: 10620 - DNA, 25 bp, E. coli
ttgtgaacagataggcgatccggcg

SEQ ID NO: 10621 - DNA, 25 bp, E. coli
ttgtgaacagattggcgatccggcg

SEQ ID NO: 10622 - DNA, 25 bp, E. coli
ttgaacctgcaaattggcacccgag

SEQ ID NO: 10623 - DNA, 25 bp, E. coli
ttttggtgtggacaacgcaccacgc

SEQ ID NO: 10624 - DNA, 25 bp, E. coli
ttgaacctgcaatttggcacccgag

SEQ ID NO: 10625 - DNA, 25 bp, E. coli
tctggcaaataacatcaaagcgttg

SEQ ID NO: 10626 - DNA, 25 bp, E. coli
tctggcaaataagatcaaagcgttg

SEQ ID NO: 10627 - DNA, 25 bp, E. coli
gcgttacattattccggagctgaaa

SEQ ID NO: 10628 - DNA, 25 bp, E. coli
gcgttacattataccggagctgaaa

SEQ ID NO: 10629 - DNA, 25 bp, E. coli
gaagatttcgcccagatgtcgctga

SEQ ID NO: 10630 - DNA, 25 bp, E. coli
gaagatttcgccgagatgtcgctga

SEQ ID NO: 10631 - DNA, 25 bp, E. coli
gactgcactgtaacgccgatgggta

SEQ ID NO: 10632 - DNA, 25 bp, E. coli
gaactgcaacgttcgaatccagcgg

SEQ ID NO: 10633 - DNA, 25 bp, E. coli
gactgcactgtatcgccgatgggta

SEQ ID NO: 10634 - DNA, 25 bp, E. coli
gaactgcaacgtacgaatccagcgg

SEQ ID NO: 10635 - DNA, 25 bp, E. coli
gatgtcgctgattgaaggtcgccgc

SEQ ID NO: 10636 - DNA, 25 bp, E. coli
gatgtcgctgatagaaggtcgccgc

SEQ ID NO: 10637 - DNA, 25 bp, E. coli
aatggcacgggctggtcttctggtt

SEQ ID NO: 10638 - DNA, 25 bp, E. coli
aatggcacgggcaggtcttctggtt

SEQ ID NO: 10639 - DNA, 25 bp, E. coli
aatagcttctgtgcgccggacgttg

SEQ ID NO: 10640 - DNA, 25 bp, E. coli
aatagcttctgtccgccggacgttg

SEQ ID NO: 10641 - DNA, 25 bp, E. coli
cacgggcaggtcatctggttatcga

SEQ ID NO: 10642 - DNA, 25 bp, E. coli
cacgggcaggtcttctggttatcga

SEQ ID NO: 10643 - DNA, 25 bp, E. coli
cataatagcttcagtgcgccggacg

SEQ ID NO: 10644 - DNA, 25 bp, E. coli
ctggttatcgaacgtaaggtctggc

SEQ ID NO: 10645 - DNA, 25 bp, E. coli
cataatagcttctgtgcgccggacg

SEQ ID NO: 10646 - DNA, 25 bp, E. coli
ctggttatcgaaggtaaggtctggc

SEQ ID NO: 10647 - DNA, 25 bp, E. coli
tattggcggtatttggagttaaaag

SEQ ID NO: 10648 - DNA, 25 bp, E. coli
tattggcggtatatggagttaaaag

SEQ ID NO: 10649 - DNA, 25 bp, E. coli
tgcgccggacgtagccgcgctaaca

SEQ ID NO: 10650 - DNA, 25 bp, E. coli
tgcgccggacgttgccgcgctaaca

SEQ ID NO: 10651 - DNA, 25 bp, E. coli
cgctaacaggcgcaacagtaaccag

SEQ ID NO: 10652 - DNA, 25 bp, E. coli
cgctaacaggcggaacagtaaccag

SEQ ID NO: 10653 - DNA, 25 bp, E. coli
ctaacaggcgcatcagtaaccagca

SEQ ID NO: 10654 - DNA, 25 bp, E. coli
ctaacaggcgcaacagtaaccagca

SEQ ID NO: 10655 - DNA, 25 bp, E. coli
ggcggtatatggagttaaaagatga

SEQ ID NO: 10656 - DNA, 25 bp, E. coli
ggcggtatatggtgttaaaagatga

SEQ ID NO: 10657 - DNA, 25 bp, E. coli
gacgcataatagcttctgtgcgccg

SEQ ID NO: 10658 - DNA, 25 bp, E. coli
gacgcataataggttctgtgcgccg

SEQ ID NO: 10659 - DNA, 25 bp, E. coli
cagcgctacaaaagatggcggcgca

SEQ ID NO: 10660 - DNA, 25 bp, E. coli
cagcgctacaaatgatggcggcgca

SEQ ID NO: 10661 - DNA, 25 bp, E. coli
cataggtacgttcgacgaagcattc

SEQ ID NO: 10662 - DNA, 25 bp, E. coli
cataggtacgttggacgaagcattc

SEQ ID NO: 10663 - DNA, 25 bp, E. coli
tacgttggacgatgcattccgcggg

SEQ ID NO: 10664 - DNA, 25 bp, E. coli
tacgttggacgaagcattccgcggg

SEQ ID NO: 10665 - DNA, 25 bp, E. coli
ataacggcgcatggcgcatctttgg

SEQ ID NO: 10666 - DNA, 25 bp, E. coli
ataacggcgcatcgcgcatctttgg

SEQ ID NO: 10667 - DNA, 25 bp, E. coli
ttgaccagcatacgtacgttggacg

SEQ ID NO: 10668 - DNA, 25 bp, E. coli
ttgaccagcataggtacgttggacg

SEQ ID NO: 10669 - DNA, 25 bp, E. coli
tgtgatgtcaccaatccgctggtgg

SEQ ID NO: 10670 - DNA, 25 bp, E. coli
tgtgatgtcacctatccgctggtgg

SEQ ID NO: 10671 - DNA, 25 bp, E. coli
tgatgtcaccaatccgctggtgggc

SEQ ID NO: 10672 - DNA, 25 bp, E. coli
tgatgtcaccaaaccgctggtgggc

SEQ ID NO: 10673 - DNA, 25 bp, E. coli
gctacaaatgatcgcggcgcaggca

SEQ ID NO: 10674 - DNA, 25 bp, E. coli
gcgataacggcggatcgcgcatctt

SEQ ID NO: 10675 - DNA, 25 bp, E. coli
gctacaaatgatggcggcgcaggca

SEQ ID NO: 10676 - DNA, 25 bp, E. coli
gcgataacggcgcatcgcgcatctt

SEQ ID NO: 10677 - DNA, 25 bp, E. coli
cgtattgaccaggataggtacgttg

SEQ ID NO: 10678 - DNA, 25 bp, E. coli
cgtattgaccagcataggtacgttg

SEQ ID NO: 10679 - DNA, 25 bp, E. coli
tggcggcagcgctacaaatgatggc

SEQ ID NO: 10680 - DNA, 25 bp, E. coli
tggcggcagcgcaacaaatgatggc

SEQ ID NO: 10681 - DNA, 25 bp, E. coli
aatttctatcgcgtcgacggtgccg

SEQ ID NO: 10682 - DNA, 25 bp, E. coli
aatttctatcgcctcgacggtgccg

SEQ ID NO: 10683 - DNA, 25 bp, E. coli
caggacatgatctaactcgagcaga

SEQ ID NO: 10684 - DNA, 25 bp, E. coli
caggacatgatcaaactcgagcaga

SEQ ID NO: 10685 - DNA, 25 bp, E. coli
acgtgctgctggaaaccggttttga

SEQ ID NO: 10686 - DNA, 25 bp, E. coli
acgtgctgctggtaaccggttttga

SEQ ID NO: 10687 - DNA, 25 bp, E. coli
aaaggcgtcgattttcacctgcacg

SEQ ID NO: 10688 - DNA, 25 bp, E. coli
aaaggcgtcgatattcacctgcacg

SEQ ID NO: 10689 - DNA, 25 bp, E. coli
tagccgccgtgattttctgagccag

SEQ ID NO: 10690 - DNA, 25 bp, E. coli
tagccgccgtgaatttctgagccag

SEQ ID NO: 10691 - DNA, 25 bp, E. coli
ttttgactacgaaaatggcgtggcg

SEQ ID NO: 10692 - DNA, 25 bp, E. coli
ttttgactacgataatggcgtggcg

SEQ ID NO: 10693 - DNA, 25 bp, E. coli
gcagccactgcaatatcgaaccggt

SEQ ID NO: 10694 - DNA, 25 bp, E. coli
gcagccactgcattatcgaaccggt

SEQ ID NO: 10695 - DNA, 25 bp, E. coli
cgacaccatgttccagattgcgctg

SEQ ID NO: 10696 - DNA, 25 bp, E. coli
cgacaccatgttgcagattgcgctg

SEQ ID NO: 10697 - DNA, 25 bp, E. coli
tcaaacagttgctcgacaaaggcgt

SEQ ID NO: 10698 - DNA, 25 bp, E. coli
tcaaacagttgcacgacaaaggcgt

SEQ ID NO: 10699 - DNA, 25 bp, E. coli
gagccagagcggtaagatggtcacc

SEQ ID NO: 10700 - DNA, 25 bp, E. coli
gatggcgcgatggaaaaatccctcg

SEQ ID NO: 10701 - DNA, 25 bp, E. coli
gagccagagcggaaagatggtcacc

SEQ ID NO: 10702 - DNA, 25 bp, E. coli
gatggcgcgatgcaaaaatccctcg

SEQ ID NO: 10703 - DNA, 25 bp, E. coli
cagtttcagggtttcaagggaagca

SEQ ID NO: 10704 - DNA, 25 bp, E. coli
cagtttcagggtatcaagggaagca

SEQ ID NO: 10705 - DNA, 25 bp, E. coli
tttcaagggaagcactcacattgtc

SEQ ID NO: 10706 - DNA, 25 bp, E. coli
tttcgcattcatctcgctaacttcg

SEQ ID NO: 10707 - DNA, 25 bp, E. coli
tttcgcattcatgtcgctaacttcg

SEQ ID NO: 10708 - DNA, 25 bp, E. coli
tttcaagggaaggactcacattgtc

SEQ ID NO: 10709 - DNA, 25 bp, E. coli
tgtcatcaatctacgcaacaaggac

SEQ ID NO: 10710 - DNA, 25 bp, E. coli
tgtcatcaatcttcgcaacaaggac

SEQ ID NO: 10711 - DNA, 25 bp, E. coli
tctcgctaacttcgcttattatggg

SEQ ID NO: 10712 - DNA, 25 bp, E. coli
tctcgctaacttggcttattatggg

SEQ ID NO: 10713 - DNA, 25 bp, E. coli
tcttcgcaacaaggacctcggaaaa

SEQ ID NO: 10714 - DNA, 25 bp, E. coli
tcttcgcaacaacgacctcggaaaa

SEQ ID NO: 10715 - DNA, 25 bp, E. coli
tcagggtttcaagggaagcactcac

SEQ ID NO: 10716 - DNA, 25 bp, E. coli
tcagggtttcaacggaagcactcac

SEQ ID NO: 10717 - DNA, 25 bp, E. coli
gaatttctccgcgtttttttcgcat

SEQ ID NO: 10718 - DNA, 25 bp, E. coli
gaatttctccgcctttttttcgcat

SEQ ID NO: 10719 - DNA, 25 bp, E. coli
gggaagcactcagattgtcatcaat

SEQ ID NO: 10720 - DNA, 25 bp, E. coli
ggatcagtttcagggtttcaaggga

SEQ ID NO: 10721 - DNA, 25 bp, E. coli
ggatcagtttcacggtttcaaggga

SEQ ID NO: 10722 - DNA, 25 bp, E. coli
gggaagcactcacattgtcatcaat

SEQ ID NO: 10723 - DNA, 25 bp, E. coli
tcaatcttcgcaacaaggacctcgg

SEQ ID NO: 10724 - DNA, 25 bp, E. coli
tcaatcttcgcatcaaggacctcgg

SEQ ID NO: 10725 - DNA, 25 bp, E. coli
tagccgccttgcactgacgcgaaat

SEQ ID NO: 10726 - DNA, 25 bp, E. coli
tagccgccttgctctgacgcgaaat

SEQ ID NO: 10727 - DNA, 25 bp, E. coli
tttcttccccgcaccatgatgcaag

SEQ ID NO: 10728 - DNA, 25 bp, E. coli
tttcttccccgctccatgatgcaag

SEQ ID NO: 10729 - DNA, 25 bp, E. coli
tcggaaattcacctaattcttcggg

SEQ ID NO: 10730 - DNA, 25 bp, E. coli
tccttcgtctttcacgccatagcgg

SEQ ID NO: 10731 - DNA, 25 bp, E. coli
tcggaaattcacgtaattcttcggg

SEQ ID NO: 10732 - DNA, 25 bp, E. coli
tccttcgtctttgacgccatagcgg

SEQ ID NO: 10733 - DNA, 25 bp, E. coli
tctttcacgccatagcggcgttggc

SEQ ID NO: 10734 - DNA, 25 bp, E. coli
tctttcacgccaaagcggcgttggc

SEQ ID NO: 10735 - DNA, 25 bp, E. coli
ccaggtagccgcagaggccgcttgc

SEQ ID NO: 10736 - DNA, 25 bp, E. coli
ccaggtagccgctgaggccgcttgc

SEQ ID NO: 10737 - DNA, 25 bp, E. coli
gctctgacgcgaaatacttcggaaa

SEQ ID NO: 10738 - DNA, 25 bp, E. coli
gctctgacgcgatatacttcggaaa

SEQ ID NO: 10739 - DNA, 25 bp, E. coli
ctaattcttcggctgctgcggcacc

SEQ ID NO: 10740 - DNA, 25 bp, E. coli
ctaattcttcgggtgctgcggcacc

SEQ ID NO: 10741 - DNA, 25 bp, E. coli
ggtgctgcggcagccgattttcttc

SEQ ID NO: 10742 - DNA, 25 bp, E. coli
ggtgctgcggcacccgattttcttc

SEQ ID NO: 10743 - DNA, 25 bp, E. coli
gggattcacagggtagccgccttgc

SEQ ID NO: 10744 - DNA, 25 bp, E. coli
gggattcacaggctagccgccttgc

SEQ ID NO: 10745 - DNA, 25 bp, E. coli
gatgcaagctgcttccaggtagccg

SEQ ID NO: 10746 - DNA, 25 bp, E. coli
gatgcaagctgcatccaggtagccg

SEQ ID NO: 10747 - DNA, 25 bp, E. coli
caccctttgggaccgttgcgacttg

SEQ ID NO: 10748 - DNA, 25 bp, E. coli
caccctttgggagcgttgcgacttg

SEQ ID NO: 10749 - DNA, 25 bp, E. coli
ttatgacgggcaacgcgggtctgct

SEQ ID NO: 10750 - DNA, 25 bp, E. coli
ttatgacgggcatcgcgggtctgct

SEQ ID NO: 10751 - DNA, 25 bp, E. coli
tggtgctcggaatgtatgaacgcct

SEQ ID NO: 10752 - DNA, 25 bp, E. coli
tggtgctcggaaagtatgaacgcct

SEQ ID NO: 10753 - DNA, 25 bp, E. coli
tgaacacgccgacgtgctgagtctg

SEQ ID NO: 10754 - DNA, 25 bp, E. coli
tgaacacgccgaggtgctgagtctg

SEQ ID NO: 10755 - DNA, 25 bp, E. coli
tgaacgcctgggttatgaacacgcc

SEQ ID NO: 10756 - DNA, 25 bp, E. coli
tgaacgcctgggatatgaacacgcc

SEQ ID NO: 10757 - DNA, 25 bp, E. coli
tgccggaagataacgacatggtgct

SEQ ID NO: 10758 - DNA, 25 bp, E. coli
tgccggaagatatcgacatggtgct

SEQ ID NO: 10759 - DNA, 25 bp, E. coli
gcgacttgctgcgtccgtggaacga

SEQ ID NO: 10760 - DNA, 25 bp, E. coli
gcgacttgctgcctccgtggaacga

SEQ ID NO: 10761 - DNA, 25 bp, E. coli
gaagatttcgaacaggtcatcaccc

SEQ ID NO: 10762 - DNA, 25 bp, E. coli
gaagatttcgaagaggtcatcaccc

SEQ ID NO: 10763 - DNA, 25 bp, E. coli
cgtaagatgaaccatgacgtcagtt

SEQ ID NO: 10764 - DNA, 25 bp, E. coli
cgtaagatgaacgatgacgtcagtt

SEQ ID NO: 10765 - DNA, 25 bp, E. coli
cggctggagaaaaagctgattgctc

SEQ ID NO: 10766 - DNA, 25 bp, E. coli
cggctggagaaatagctgattgctc

SEQ ID NO: 10767 - DNA, 25 bp, E. coli
gagatacgcgtatttcgccaggaag

SEQ ID NO: 10768 - DNA, 25 bp, E. coli
gagatacgcgtaattcgccaggaag

SEQ ID NO: 10769 - DNA, 25 bp, E. coli
aaccaggcgaaactcgacgtctgcg

SEQ ID NO: 10770 - DNA, 25 bp, E. coli
cacgttggctttgccatgagcgtaa

SEQ ID NO: 10771 - DNA, 25 bp, E. coli
cacgttggctttcccatgagcgtaa

SEQ ID NO: 10772 - DNA, 25 bp, E. coli
atgaagccgaagcacgcgacactct

SEQ ID NO: 10773 - DNA, 25 bp, E. coli
atgtgcataggcgttcccggccaga

SEQ ID NO: 10774 - DNA, 25 bp, E. coli
atgtgcataggccttcccggccaga

SEQ ID NO: 10775 - DNA, 25 bp, E. coli
atgaagccgaaggacgcgacactct

SEQ ID NO: 10776 - DNA, 25 bp, E. coli
aaagtcgacgtctgcggcattcagc

SEQ ID NO: 10777 - DNA, 25 bp, E. coli
aaccaggcgaaagtcgacgtctgcg

SEQ ID NO: 10778 - DNA, 25 bp, E. coli
aaagtcgacgtcagcggcattcagc

SEQ ID NO: 10779 - DNA, 25 bp, E. coli
tcggcagctgcgatgaaaacggtca

SEQ ID NO: 10780 - DNA, 25 bp, E. coli
tcggcagctgcgttgaaaacggtca

SEQ ID NO: 10781 - DNA, 25 bp, E. coli
gccatgagcgtaattaatgaagccg

SEQ ID NO: 10782 - DNA, 25 bp, E. coli
gccatgagcgtatttaatgaagccg

SEQ ID NO: 10783 - DNA, 25 bp, E. coli
cgcgctgttgtatggcgaggaaaaa

SEQ ID NO: 10784 - DNA, 25 bp, E. coli
cgcgctgttgtaaggcgaggaaaaa

SEQ ID NO: 10785 - DNA, 25 bp, E. coli
cattcagcgcgaagtcgatttaacg

SEQ ID NO: 10786 - DNA, 25 bp, E. coli
cattcagcgcgatgtcgatttaacg

SEQ ID NO: 10787 - DNA, 25 bp, E. coli
gatttaacgttagtcggcagctgcg

SEQ ID NO: 10788 - DNA, 25 bp, E. coli
gatttaacgttactcggcagctgcg

SEQ ID NO: 10789 - DNA, 25 bp, E. coli
gtaattaatgaagccgaagcacgcg

SEQ ID NO: 10790 - DNA, 25 bp, E. coli
gtaattaatgaacccgaagcacgcg

SEQ ID NO: 10791 - DNA, 25 bp, E. coli
caattcagaaagtaccggcaatgcg

SEQ ID NO: 10792 - DNA, 25 bp, E. coli
caattcagaaagaaccggcaatgcg

SEQ ID NO: 10793 - DNA, 25 bp, E. coli
catgtggatgctcggcctttacggc

SEQ ID NO: 10794 - DNA, 25 bp, E. coli
catgtggatgctgggcctttacggc

SEQ ID NO: 10795 - DNA, 25 bp, E. coli
acctgggcgcacgtgaaggcttcaa

SEQ ID NO: 10796 - DNA, 25 bp, E. coli
acctgggcgcacctgaaggcttcaa

SEQ ID NO: 10797 - DNA, 25 bp, E. coli
aaagactctcgttgtgcctggcgca

SEQ ID NO: 10798 - DNA, 25 bp, E. coli
aaagactctcgtagtgcctggcgca

SEQ ID NO: 10799 - DNA, 25 bp, E. coli
gcactggaaacggtgtctctggaca

SEQ ID NO: 10800 - DNA, 25 bp, E. coli
gaagaacactttggtattggcgcag

SEQ ID NO: 10801 - DNA, 25 bp, E. coli
gaagaacactttcgtattggcgcag

SEQ ID NO: 10802 - DNA, 25 bp, E. coli
gcactggaaacgctgtctctggaca

SEQ ID NO: 10803 - DNA, 25 bp, E. coli
tggcattcgcactcatcatgatggt

SEQ ID NO: 10804 - DNA, 25 bp, E. coli
tggcattcgcacacatcatgatggt

SEQ ID NO: 10805 - DNA, 25 bp, E. coli
ggcgcaagacagtcaccatgtggat

SEQ ID NO: 10806 - DNA, 25 bp, E. coli
ggcgcaagacagacaccatgtggat

SEQ ID NO: 10807 - DNA, 25 bp, E. coli
taacgacctggattgttgccaccct

SEQ ID NO: 10808 - DNA, 25 bp, E. coli
taacgacctggaatgttgccaccct

SEQ ID NO: 10809 - DNA, 25 bp, E. coli
gatgatcctgttcctgatgccgatg

SEQ ID NO: 10810 - DNA, 25 bp, E. coli
gatgatcctgttgctgatgccgatg

SEQ ID NO: 10811 - DNA, 25 bp, E. coli
gatgacgttttttgctcaccgcggc

SEQ ID NO: 10812 - DNA, 25 bp, E. coli
gatgacgtttttagctcaccgcggc

SEQ ID NO: 10813 - DNA, 25 bp, E. coli
caggcaacgacacaaacagcaggta

SEQ ID NO: 10814 - DNA, 25 bp, E. coli
caggcaacgacagaaacagcaggta

SEQ ID NO: 10815 - DNA, 25 bp, E. coli
tattcgttttgccagtgcggttgcc

SEQ ID NO: 10816 - DNA, 25 bp, E. coli
tattcgttttgcgagtgcggttgcc

SEQ ID NO: 10817 - DNA, 25 bp, E. coli
ttatcttgagataggtggcggcccg

SEQ ID NO: 10818 - DNA, 25 bp, E. coli
tttagacgccgaaatgacaccgcag

SEQ ID NO: 10819 - DNA, 25 bp, E. coli
ttatcttgagattggtggcggcccg

SEQ ID NO: 10820 - DNA, 25 bp, E. coli
tttagacgccgatatgacaccgcag

SEQ ID NO: 10821 - DNA, 25 bp, E. coli
tcgggccggcattcctaatcgtgag

SEQ ID NO: 10822 - DNA, 25 bp, E. coli
tcgggccggcatacctaatcgtgag

SEQ ID NO: 10823 - DNA, 25 bp, E. coli
gcgatgaaatgtacccagcctggcg

SEQ ID NO: 10824 - DNA, 25 bp, E. coli
gcgatgaaatgttcccagcctggcg

SEQ ID NO: 10825 - DNA, 25 bp, E. coli
gaagaaggtttgatccaggcaacga

SEQ ID NO: 10826 - DNA, 25 bp, E. coli
gaagaaggtttgttccaggcaacga

SEQ ID NO: 10827 - DNA, 25 bp, E. coli
gaaaaagcattctcgctagcgcgcc

SEQ ID NO: 10828 - DNA, 25 bp, E. coli
gaaaaagcattcacgctagcgcgcc

SEQ ID NO: 10829 - DNA, 25 bp, E. coli
ctcgcggtagcgttggcagaaaaaa

SEQ ID NO: 10830 - DNA, 25 bp, E. coli
cgtgggtatcactgttcaggacaga

SEQ ID NO: 10831 - DNA, 25 bp, E. coli
ctcgcggtagcgatggcagaaaaaa

SEQ ID NO: 10832 - DNA, 25 bp, E. coli
cgtgggtatcacagttcaggacaga

SEQ ID NO: 10833 - DNA, 25 bp, E. coli
gatcctcgttgatcagcatggcgaa

SEQ ID NO: 10834 - DNA, 25 bp, E. coli
gatcctcgttgaacagcatggcgaa

SEQ ID NO: 10835 - DNA, 25 bp, E. coli
aataccgtgaagacatggcgctggc

SEQ ID NO: 10836 - DNA, 25 bp, E. coli
aataccgtgaagtcatggcgctggc

SEQ ID NO: 10837 - DNA, 25 bp, E. coli
tttaattctggcgtcggtgacctgg

SEQ ID NO: 10838 - DNA, 25 bp, E. coli
tttaattctggcctcggtgacctgg

SEQ ID NO: 10839 - DNA, 25 bp, E. coli
tgtcgcctggaatcaaacaacggat

SEQ ID NO: 10840 - DNA, 25 bp, E. coli
tgtcgcctggaaacaaacaacggat

SEQ ID NO: 10841 - DNA, 25 bp, E. coli
tgatggatattttccacacggcgca

SEQ ID NO: 10842 - DNA, 25 bp, E. coli
tgatggatatttaccacacggcgca

SEQ ID NO: 10843 - DNA, 25 bp, E. coli
gctgaacaaactggcgctggcacta

SEQ ID NO: 10844 - DNA, 25 bp, E. coli
gctgaacaaactcgcgctggcacta

SEQ ID NO: 10845 - DNA, 25 bp, E. coli
gaagatctcctggaatcgtcggtga

SEQ ID NO: 10846 - DNA, 25 bp, E. coli
gaagatctcctgcaatcgtcggtga

SEQ ID NO: 10847 - DNA, 25 bp, E. coli
gaaatttgctggttaacgccgtgcg

SEQ ID NO: 10848 - DNA, 25 bp, E. coli
gaaatttgctggataacgccgtgcg

SEQ ID NO: 10849 - DNA, 25 bp, E. coli
gataaccttcagcacgtcgcggaga

SEQ ID NO: 10850 - DNA, 25 bp, E. coli
gatctcaacgaaatcaacgcggcgg

SEQ ID NO: 10851 - DNA, 25 bp, E. coli
gatctcaacgaattcaacgcggcgg

SEQ ID NO: 10852 - DNA, 25 bp, E. coli
gataaccttcaggacgtcgcggaga

SEQ ID NO: 10853 - DNA, 25 bp, E. coli
ggtactactgggtcgtgaactcgcg

SEQ ID NO: 10854 - DNA, 25 bp, E. coli
ggtactactgggacgtgaactcgcg

SEQ ID NO: 10855 - DNA, 25 bp, E. coli
ggcgctgaaagtgcaaaccgaagtt

SEQ ID NO: 10856 - DNA, 25 bp, E. coli
ggcgctgaaagtccaaaccgaagtt

SEQ ID NO: 10857 - DNA, 25 bp, E. coli
caaactttacgatcgtgttcccgct

SEQ ID NO: 10858 - DNA, 25 bp, E. coli
cacgcgcgttattagcttactccag

SEQ ID NO: 10859 - DNA, 25 bp, E. coli
cacgcgcgttataagcttactccag

SEQ ID NO: 10860 - DNA, 25 bp, E. coli
caaactttacgaacgtgttcccgct

SEQ ID NO: 10861 - DNA, 25 bp, E. coli
tactccagaggacatggaagccttc

SEQ ID NO: 10862 - DNA, 25 bp, E. coli
tacgatcgtgttgccgcttcagtct

SEQ ID NO: 10863 - DNA, 25 bp, E. coli
tactccagaggagatggaagccttc

SEQ ID NO: 10864 - DNA, 25 bp, E. coli
tacgatcgtgttcccgcttcagtct

SEQ ID NO: 10865 - DNA, 25 bp, E. coli
tttcccacgcgccttataagcttac

SEQ ID NO: 10866 - DNA, 25 bp, E. coli
tttcccacgcgcgttataagcttac

SEQ ID NO: 10867 - DNA, 25 bp, E. coli
tccagaggagatggaagccttcaac

SEQ ID NO: 10868 - DNA, 25 bp, E. coli
tccagaggagatcgaagccttcaac

SEQ ID NO: 10869 - DNA, 25 bp, E. coli
tcgtgttcccgcttcagtctggaaa

SEQ ID NO: 10870 - DNA, 25 bp, E. coli
tcgtgttcccgcatcagtctggaaa

SEQ ID NO: 10871 - DNA, 25 bp, E. coli
cgttataagcttactccagaggaga

SEQ ID NO: 10872 - DNA, 25 bp, E. coli
cgcttcagtctgcaaatatgttacc

SEQ ID NO: 10873 - DNA, 25 bp, E. coli
cgttataagctttctccagaggaga

SEQ ID NO: 10874 - DNA, 25 bp, E. coli
cgcttcagtctggaaatatgttacc

SEQ ID NO: 10875 - DNA, 25 bp, E. coli
taagcttactccagaggagatggaa

SEQ ID NO: 10876 - DNA, 25 bp, E. coli
taagcttactcctgaggagatggaa

SEQ ID NO: 10877 - DNA, 25 bp, E. coli
gaggagatggaagccttcaactctg

SEQ ID NO: 10878 - DNA, 25 bp, E. coli
gaggagatggaacccttcaactctg

SEQ ID NO: 10879 - DNA, 25 bp, E. coli
caaatgttggaaccgttaaacgttg

SEQ ID NO: 10880 - DNA, 25 bp, E. coli
caaatgttggaagcgttaaacgttg

SEQ ID NO: 10881 - DNA, 25 bp, E. coli
acaaccttttactgcgtgcactgcg

SEQ ID NO: 10882 - DNA, 25 bp, E. coli
acaaccttttacagcgtgcactgcg

SEQ ID NO: 10883 - DNA, 25 bp, E. coli
tttactgcgtgctctgcgtcaggcc

SEQ ID NO: 10884 - DNA, 25 bp, E. coli
tttactgcgtgcactgcgtcaggcc

SEQ ID NO: 10885 - DNA, 25 bp, E. coli
tgcactgcgtcacgccggacttaag

SEQ ID NO: 10886 - DNA, 25 bp, E. coli
tgcactgcgtcaggccggacttaag

SEQ ID NO: 10887 - DNA, 25 bp, E. coli
tccgcaaatgttcgaagcgttaaac

SEQ ID NO: 10888 - DNA, 25 bp, E. coli
tccgcaaatgttggaagcgttaaac

SEQ ID NO: 10889 - DNA, 25 bp, E. coli
gttccccgcgggtccgcaaatgttg

SEQ ID NO: 10890 - DNA, 25 bp, E. coli
gcttagcgtctctacttttgcggtt

SEQ ID NO: 10891 - DNA, 25 bp, E. coli
gttccccgcgggaccgcaaatgttg

SEQ ID NO: 10892 - DNA, 25 bp, E. coli
gcttagcgtctcaacttttgcggtt

SEQ ID NO: 10893 - DNA, 25 bp, E. coli
taagtttaccgaaatccaacccact

SEQ ID NO: 10894 - DNA, 25 bp, E. coli
taagtttaccgatatccaacccact

SEQ ID NO: 10895 - DNA, 25 bp, E. coli
ccgcgggtccgctaatgttggaagc

SEQ ID NO: 10896 - DNA, 25 bp, E. coli
ccgcgggtccgcaaatgttggaagc

SEQ ID NO: 10897 - DNA, 25 bp, E. coli
cgtctctactttagcggttgctgca

SEQ ID NO: 10898 - DNA, 25 bp, E. coli
cgtctctacttttgcggttgctgca

SEQ ID NO: 10899 - DNA, 25 bp, E. coli
ctacttttgcggatgctgcagaatc

SEQ ID NO: 10900 - DNA, 25 bp, E. coli
ctacttttgcggttgctgcagaatc

SEQ ID NO: 10901 - DNA, 25 bp, E. coli
caaaagcatggctccgttacctgaa

SEQ ID NO: 10902 - DNA, 25 bp, E. coli
caacagaacgcatcgctggtgcagg

SEQ ID NO: 10903 - DNA, 25 bp, E. coli
caacagaacgcaacgctggtgcagg

SEQ ID NO: 10904 - DNA, 25 bp, E. coli
caaaagcatggcaccgttacctgaa

SEQ ID NO: 10905 - DNA, 25 bp, E. coli
catcggatgaacagagccgtggcat

SEQ ID NO: 10906 - DNA, 25 bp, E. coli
catcggatgaactgagccgtggcat

SEQ ID NO: 10907 - DNA, 25 bp, E. coli
taccggttcggtgctggtcgaaagc

SEQ ID NO: 10908 - DNA, 25 bp, E. coli
taccggttcggtcctggtcgaaagc

SEQ ID NO: 10909 - DNA, 25 bp, E. coli
ttatttcgctcacccaacccaggga

SEQ ID NO: 10910 - DNA, 25 bp, E. coli
ttatttcgctcagccaacccaggga

SEQ ID NO: 10911 - DNA, 25 bp, E. coli
tgcaaaatgcaatgggcgaagcgtt

SEQ ID NO: 10912 - DNA, 25 bp, E. coli
tgcaaacgcgcattaacctgagtcg

SEQ ID NO: 10913 - DNA, 25 bp, E. coli
tgcaaaatgcaaagggcgaagcgtt

SEQ ID NO: 10914 - DNA, 25 bp, E. coli
tgcaaacgcgcaataacctgagtcg

SEQ ID NO: 10915 - DNA, 25 bp, E. coli
gccacgactgcgtattgctgaacaa

SEQ ID NO: 10916 - DNA, 25 bp, E. coli
gccacgactgcgaattgctgaacaa

SEQ ID NO: 10917 - DNA, 25 bp, E. coli
gctcgatagcgccaggaaaacattg

SEQ ID NO: 10918 - DNA, 25 bp, E. coli
gctcgatagcgcgaggaaaacattg

SEQ ID NO: 10919 - DNA, 25 bp, E. coli
gaataccctgaccattgacgggcgc

SEQ ID NO: 10920 - DNA, 25 bp, E. coli
gaataccctgacgattgacgggcgc

SEQ ID NO: 10921 - DNA, 25 bp, E. coli
gattaaccgtatgcgcgtagtcacg

SEQ ID NO: 10922 - DNA, 25 bp, E. coli
gattaaccgtatccgcgtagtcacg

SEQ ID NO: 10923 - DNA, 25 bp, E. coli
cacagttccttggtgtctacctggg

SEQ ID NO: 10924 - DNA, 25 bp, E. coli
cacagttccttgctgtctacctggg

SEQ ID NO: 10925 - DNA, 25 bp, E. coli
cactaagttggctaatccggcaccg

SEQ ID NO: 10926 - DNA, 25 bp, E. coli
cactaagttggcaaatccggcaccg

SEQ ID NO: 10927 - DNA, 25 bp, E. coli
catgggcattttctacggcggcatc

SEQ ID NO: 10928 - DNA, 25 bp, E. coli
catgggcattttgtacggcggcatc

SEQ ID NO: 10929 - DNA, 25 bp, E. coli
aaaggcgcacgccttctgcaattcg

SEQ ID NO: 10930 - DNA, 25 bp, E. coli
aaaggcgcacgcgttctgcaattcg

SEQ ID NO: 10931 - DNA, 25 bp, E. coli
tgaacgagcagtttggtcgcaccgt

SEQ ID NO: 10932 - DNA, 25 bp, E. coli
tgaccgatgcgcgaaatgcacagtt

SEQ ID NO: 10933 - DNA, 25 bp, E. coli
tgaccgatgcgccaaatgcacagtt

SEQ ID NO: 10934 - DNA, 25 bp, E. coli
tgaacgagcagtatggtcgcaccgt

SEQ ID NO: 10935 - DNA, 25 bp, E. coli
tcttacggttctatctggctgacgc

SEQ ID NO: 10936 - DNA, 25 bp, E. coli
tcttacggttctttctggctgacgc

SEQ ID NO: 10937 - DNA, 25 bp, E. coli
gctggagtacaataaaggcaacact

SEQ ID NO: 10938 - DNA, 25 bp, E. coli
gctggagtacaaaaaaggcaacact

SEQ ID NO: 10939 - DNA, 25 bp, E. coli
gacggtattattcttgccatgggca

SEQ ID NO: 10940 - DNA, 25 bp, E. coli
gacggtattattgttgccatgggca

SEQ ID NO: 10941 - DNA, 25 bp, E. coli
gatcggtaacattgccggtaacgcc

SEQ ID NO: 10942 - DNA, 25 bp, E. coli
gatcggtaacatagccggtaacgcc

SEQ ID NO: 10943 - DNA, 25 bp, E. coli
gatgggcttcgggatgaccaccatt

SEQ ID NO: 10944 - DNA, 25 bp, E. coli
gatgggcttcggcatgaccaccatt

SEQ ID NO: 10945 - DNA, 25 bp, E. coli
caattaaccgtgtgttatgcgagtc

SEQ ID NO: 10946 - DNA, 25 bp, E. coli
caattaaccgtgagttatgcgagtc

SEQ ID NO: 10947 - DNA, 25 bp, E. coli
caaataaccgtctattaaccgtgag

SEQ ID NO: 10948 - DNA, 25 bp, E. coli
caaataaccgtcaattaaccgtgag

SEQ ID NO: 10949 - DNA, 25 bp, E. coli
attaaccgtgagatatgcgagtcgt

SEQ ID NO: 10950 - DNA, 25 bp, E. coli
accgtgagttatgcgagtcgttacc

SEQ ID NO: 10951 - DNA, 25 bp, E. coli
attaaccgtgagttatgcgagtcgt

SEQ ID NO: 10952 - DNA, 25 bp, E. coli
aaccgtcaattaaccgtgagttatg

SEQ ID NO: 10953 - DNA, 25 bp, E. coli
accgtgagttatccgagtcgttacc

SEQ ID NO: 10954 - DNA, 25 bp, E. coli
aaccgtcaattatccgtgagttatg

SEQ ID NO: 10955 - DNA, 25 bp, E. coli
tgcgggtaaacacaaagttgcctga

SEQ ID NO: 10956 - DNA, 25 bp, E. coli
tgcgggtaaacagaaagttgcctga

SEQ ID NO: 10957 - DNA, 25 bp, E. coli
cgtcaattaaccgtgagttatgcga

SEQ ID NO: 10958 - DNA, 25 bp, E. coli
cgtcaattaaccctgagttatgcga

SEQ ID NO: 10959 - DNA, 25 bp, E. coli
gattgcgggtaaacagaaagttgcc

SEQ ID NO: 10960 - DNA, 25 bp, E. coli
gattgcgggtaatcagaaagttgcc

SEQ ID NO: 10961 - DNA, 25 bp, E. coli
gtgagttatgcgtgtcgttacccgg

SEQ ID NO: 10962 - DNA, 25 bp, E. coli
gtgagttatgcgagtcgttacccgg

SEQ ID NO: 10963 - DNA, 25 bp, E. coli
ttgcgggtaaactgaaagttgcctg

SEQ ID NO: 10964 - DNA, 25 bp, E. coli
ggcaaataaccgacaattaaccgtg

SEQ ID NO: 10965 - DNA, 25 bp, E. coli
ggcaaataaccgtcaattaaccgtg

SEQ ID NO: 10966 - DNA, 25 bp, E. coli
ttgcgggtaaacagaaagttgcctg

SEQ ID NO: 10967 - DNA, 25 bp, E. coli
caaccggcgagggtattttggacct

SEQ ID NO: 10968 - DNA, 25 bp, E. coli
caaccggcgaggctattttggacct

SEQ ID NO: 10969 - DNA, 25 bp, E. coli
cacgaaccgatggtggtcattgccg

SEQ ID NO: 10970 - DNA, 25 bp, E. coli
cagcgaattaaatgcgcgggcacgg

SEQ ID NO: 10971 - DNA, 25 bp, E. coli
cacgaaccgatgctggtcattgccg

SEQ ID NO: 10972 - DNA, 25 bp, E. coli
cagcgaattaaaagcgcgggcacgg

SEQ ID NO: 10973 - DNA, 25 bp, E. coli
taaaaaagaagccactgaacggacg

SEQ ID NO: 10974 - DNA, 25 bp, E. coli
taaacctgggcaactatcgggcggt

SEQ ID NO: 10975 - DNA, 25 bp, E. coli
taaacctgggcatctatcgggcggt

SEQ ID NO: 10976 - DNA, 25 bp, E. coli
taaaaaagaagcgactgaacggacg

SEQ ID NO: 10977 - DNA, 25 bp, E. coli
tattgataaaccgaccagcggaacg

SEQ ID NO: 10978 - DNA, 25 bp, E. coli
tattgataaacccaccagcggaacg

SEQ ID NO: 10979 - DNA, 25 bp, E. coli
tgacgattaatcagcagaccggcac

SEQ ID NO: 10980 - DNA, 25 bp, E. coli
tgacgattaatctgcagaccggcac

SEQ ID NO: 10981 - DNA, 25 bp, E. coli
gaaatttagaccaggcaaccggcga

SEQ ID NO: 10982 - DNA, 25 bp, E. coli
gaaatttagacctggcaaccggcga

SEQ ID NO: 10983 - DNA, 25 bp, E. coli
gaacggacgctgcattatctcgata

SEQ ID NO: 10984 - DNA, 25 bp, E. coli
gaacggacgctggattatctcgata

SEQ ID NO: 10985 - DNA, 25 bp, E. coli
gaatttctcgcagtgtgtgggccgt

SEQ ID NO: 10986 - DNA, 25 bp, E. coli
gaatttctcgcactgtgtgggccgt

SEQ ID NO: 10987 - DNA, 25 bp, E. coli
gataacgtttatatcccactggtgc

SEQ ID NO: 10988 - DNA, 25 bp, E. coli
gataacgtttatttcccactggtgc

SEQ ID NO: 10989 - DNA, 25 bp, E. coli
tacagctactgggattcgcatcagg

SEQ ID NO: 10990 - DNA, 25 bp, E. coli
tactgttttcgcgtcaggatgctgc

SEQ ID NO: 10991 - DNA, 25 bp, E. coli
tactgttttcgcctcaggatgctgc

SEQ ID NO: 10992 - DNA, 25 bp, E. coli
tacagctactggcattcgcatcagg

SEQ ID NO: 10993 - DNA, 25 bp, E. coli
tgtgccagcgcaggttacagctact

SEQ ID NO: 10994 - DNA, 25 bp, E. coli
tgattacgcgattagcaagaaaagc

SEQ ID NO: 10995 - DNA, 25 bp, E. coli
tgattacgcgataagcaagaaaagc

SEQ ID NO: 10996 - DNA, 25 bp, E. coli
tgattgccgagaataaaaccacact

SEQ ID NO: 10997 - DNA, 25 bp, E. coli
tgattgccgagattaaaaccacact

SEQ ID NO: 10998 - DNA, 25 bp, E. coli
tgtgccagcgcacgttacagctact

SEQ ID NO: 10999 - DNA, 25 bp, E. coli
tgagtgagtattagccggaagtccg

SEQ ID NO: 11000 - DNA, 25 bp, E. coli
tgagtgagtatttgccggaagtccg

SEQ ID NO: 11001 - DNA, 25 bp, E. coli
tgccgtactggccacagaagaaggc

SEQ ID NO: 11002 - DNA, 25 bp, E. coli
tgccgtactggcgacagaagaaggc

SEQ ID NO: 11003 - DNA, 25 bp, E. coli
gccgggcaaccgaaacaggatgtca

SEQ ID NO: 11004 - DNA, 25 bp, E. coli
gccgggcaaccgtaacaggatgtca

SEQ ID NO: 11005 - DNA, 25 bp, E. coli
gaaggcaagaaatacctgattgccg

SEQ ID NO: 11006 - DNA, 25 bp, E. coli
gcaagcgatcgcattggatcccgat

SEQ ID NO: 11007 - DNA, 25 bp, E. coli
gaaggcaagaaaaacctgattgccg

SEQ ID NO: 11008 - DNA, 25 bp, E. coli
gcaagcgatcgctttggatcccgat

SEQ ID NO: 11009 - DNA, 25 bp, E. coli
gtattcattaccctcgcggcctgtg

SEQ ID NO: 11010 - DNA, 25 bp, E. coli
gtattcattaccgtcgcggcctgtg

SEQ ID NO: 11011 - DNA, 25 bp, E. coli
caataatatgatggccatatcctga

SEQ ID NO: 11012 - DNA, 25 bp, E. coli
caataatatgatcgccatatcctga

SEQ ID NO: 11013 - DNA, 25 bp, E. coli
catcatcgtcaataatatgatggcc

SEQ ID NO: 11014 - DNA, 25 bp, E. coli
catcatcgtcaaaaatatgatggcc

SEQ ID NO: 11015 - DNA, 25 bp, E. coli
catcccggaaatgaatatcagccaa

SEQ ID NO: 11016 - DNA, 25 bp, E. coli
catcccggaaatcaatatcagccaa

SEQ ID NO: 11017 - DNA, 25 bp, E. coli
ttcagctttatagatgatgaggtca

SEQ ID NO: 11018 - DNA, 25 bp, E. coli
ttcagctttatacatgatgaggtca

SEQ ID NO: 11019 - DNA, 25 bp, E. coli
tgaccaatggaatgaacattacctt

SEQ ID NO: 11020 - DNA, 25 bp, E. coli
tgaccaatggaaagaacattacctt

SEQ ID NO: 11021 - DNA, 25 bp, E. coli
tgaaggccacatgccggaaatcaat

SEQ ID NO: 11022 - DNA, 25 bp, E. coli
tgaaggccacatcccggaaatcaat

SEQ ID NO: 11023 - DNA, 25 bp, E. coli
tcattaccttctggcctgaaggcca

SEQ ID NO: 11024 - DNA, 25 bp, E. coli
tcattaccttctcgcctgaaggcca

SEQ ID NO: 11025 - DNA, 25 bp, E. coli
gccaaactgagtatatcgtctttcc

SEQ ID NO: 11026 - DNA, 25 bp, E. coli
gccaaactgagtttatcgtctttcc

SEQ ID NO: 11027 - DNA, 25 bp, E. coli
ggaaagaacattaccttcagcttta

SEQ ID NO: 11028 - DNA, 25 bp, E. coli
ggaaagaacatttccttcagcttta

SEQ ID NO: 11029 - DNA, 25 bp, E. coli
ggaaatcaatatcagccaaactgag

SEQ ID NO: 11030 - DNA, 25 bp, E. coli
ggaaatcaatatgagccaaactgag

SEQ ID NO: 11031 - DNA, 25 bp, E. coli
gatgaggtcatttccttctcgcctg

SEQ ID NO: 11032 - DNA, 25 bp, E. coli
gatgaggtcattaccttctcgcctg

SEQ ID NO: 11033 - DNA, 25 bp, E. coli
cagacggcggtcatcggctgttcaa

SEQ ID NO: 11034 - DNA, 25 bp, E. coli
cagacggcggtcttcggctgttcaa

SEQ ID NO: 11035 - DNA, 25 bp, E. coli
tagcctgcgaacctggatcaaagag

SEQ ID NO: 11036 - DNA, 25 bp, E. coli
tagcctgcgaacgtggatcaaagag

SEQ ID NO: 11037 - DNA, 25 bp, E. coli
tgctgaaaccgctacggacagacgg

SEQ ID NO: 11038 - DNA, 25 bp, E. coli
tgctgaaaccgcaacggacagacgg

SEQ ID NO: 11039 - DNA, 25 bp, E. coli
tcgacggcgtactgatcaactacat

SEQ ID NO: 11040 - DNA, 25 bp, E. coli
tcgacggcgtacagatcaactacat

SEQ ID NO: 11041 - DNA, 25 bp, E. coli
tctgtttattccactgcgccgacgg

SEQ ID NO: 11042 - DNA, 25 bp, E. coli
tctgtttattcctctgcgccgacgg

SEQ ID NO: 11043 - DNA, 25 bp, E. coli
gctggattgccagtcaacaaggatg

SEQ ID NO: 11044 - DNA, 25 bp, E. coli
gctggattgccactcaacaaggatg

SEQ ID NO: 11045 - DNA, 25 bp, E. coli
gaaaatgttgatgtgcagaacggct

SEQ ID NO: 11046 - DNA, 25 bp, E. coli
gaaaatgttgatctgcagaacggct

SEQ ID NO: 11047 - DNA, 25 bp, E. coli
ggcgcgatcagctagaaacattact

SEQ ID NO: 11048 - DNA, 25 bp, E. coli
ggcgcgatcagcaagaaacattact

SEQ ID NO: 11049 - DNA, 25 bp, E. coli
tcaaagagcgcgctcaggattaccc

SEQ ID NO: 11050 - DNA, 25 bp, E. coli
tcaaacgctggaacgacaacggcgt

SEQ ID NO: 11051 - DNA, 25 bp, E. coli
tcaaacgctggatcgacaacggcgt

SEQ ID NO: 11052 - DNA, 25 bp, E. coli
tcaaagagcgcggtcaggattaccc

SEQ ID NO: 11053 - DNA, 25 bp, E. coli
gatgccgatattgaccggatccgcg

SEQ ID NO: 11054 - DNA, 25 bp, E. coli
gatgccgatattcaccggatccgcg

SEQ ID NO: 11055 - DNA, 25 bp, E. coli
tacaagccccagattaagaaggaat

SEQ ID NO: 11056 - DNA, 25 bp, E. coli
tttatcacaatcgtacaggagcggg

SEQ ID NO: 11057 - DNA, 25 bp, E. coli
tttatcacaatcctacaggagcggg

SEQ ID NO: 11058 - DNA, 25 bp, E. coli
tcttgcacgctaagacggtcgtttg

SEQ ID NO: 11059 - DNA, 25 bp, E. coli
tcttgcacgctatgacggtcgtttg

SEQ ID NO: 11060 - DNA, 25 bp, E. coli
tctggacattctctcttattgctgg

SEQ ID NO: 11061 - DNA, 25 bp, E. coli
tctggacattctgtcttattgctgg

SEQ ID NO: 11062 - DNA, 25 bp, E. coli
gctaggtattaccttcttgcacgct

SEQ ID NO: 11063 - DNA, 25 bp, E. coli
gctaggtattacgttcttgcacgct

SEQ ID NO: 11064 - DNA, 25 bp, E. coli
gacactccactaagagaatgctagg

SEQ ID NO: 11065 - DNA, 25 bp, E. coli
gacactccactatgagaatgctagg

SEQ ID NO: 11066 - DNA, 25 bp, E. coli
ctcttattgctgcttggtacaagcc

SEQ ID NO: 11067 - DNA, 25 bp, E. coli
ctcttattgctggttggtacaagcc

SEQ ID NO: 11068 - DNA, 25 bp, E. coli
gatttcgtttattcgtcgtcaccgg

SEQ ID NO: 11069 - DNA, 25 bp, E. coli
gatttcgtttatacgtcgtcaccgg

SEQ ID NO: 11070 - DNA, 25 bp, E. coli
taagaaggaatatcagacactccac

SEQ ID NO: 11071 - DNA, 25 bp, E. coli
taatcaatggcggacatagactttg

SEQ ID NO: 11072 - DNA, 25 bp, E. coli
tcaccggattgactgcatgatggcg

SEQ ID NO: 11073 - DNA, 25 bp, E. coli
tcaccggattgagtgcatgatggcg

SEQ ID NO: 11074 - DNA, 25 bp, E. coli
tacaagccccagtttaagaaggaat

SEQ ID NO: 11075 - DNA, 25 bp, E. coli
taatcaatggcgcacatagactttg

SEQ ID NO: 11076 - DNA, 25 bp, E. coli
taagaaggaataacagacactccac

SEQ ID NO: 11077 - DNA, 25 bp, E. coli
caagtcgttgagtataaagtgcagg

SEQ ID NO: 11078 - DNA, 25 bp, E. coli
caagtcgttgagaataaagtgcagg

SEQ ID NO: 11079 - DNA, 25 bp, E. coli
ctcaagcggcctctttacggtgggt

SEQ ID NO: 11080 - DNA, 25 bp, E. coli
ctcaagcggcctgtttacggtgggt

SEQ ID NO: 11081 - DNA, 25 bp, E. coli
cttaaagaaagcgtagctatactcg

SEQ ID NO: 11082 - DNA, 25 bp, E. coli
aaattcgctttctcgttagctgcgc

SEQ ID NO: 11083 - DNA, 25 bp, E. coli
aaattcgctttcacgttagctgcgc

SEQ ID NO: 11084 - DNA, 25 bp, E. coli
ttcccgacgcaatgtgattaaaagg

SEQ ID NO: 11085 - DNA, 25 bp, E. coli
ttcccgacgcaaagtgattaaaagg

SEQ ID NO: 11086 - DNA, 25 bp, E. coli
ttaaactgggtatagcggcatcgtc

SEQ ID NO: 11087 - DNA, 25 bp, E. coli
ttaaactgggtaaagcggcatcgtc

SEQ ID NO: 11088 - DNA, 25 bp, E. coli
gcttttattaaagtctgcgcgatta

SEQ ID NO: 11089 - DNA, 25 bp, E. coli
gcttttattaaactctgcgcgatta

SEQ ID NO: 11090 - DNA, 25 bp, E. coli
cttaaagaaagcctagctatactcg

SEQ ID NO: 11091 - DNA, 25 bp, E. coli
ccgtggtttcaggtacaaaattcgc

SEQ ID NO: 11092 - DNA, 25 bp, E. coli
ccgtggtttcagctacaaaattcgc

SEQ ID NO: 11093 - DNA, 25 bp, E. coli
gggagccaatacaggcaagtcgttg

SEQ ID NO: 11094 - DNA, 25 bp, E. coli
gggagccaatactggcaagtcgttg

SEQ ID NO: 11095 - DNA, 25 bp, E. coli
ggcatcgtcttaattccctcaagcg

SEQ ID NO: 11096 - DNA, 25 bp, E. coli
ggcatcgtcttatttccctcaagcg

SEQ ID NO: 11097 - DNA, 25 bp, E. coli
taagaatgtgcttaaccgtggtttc

SEQ ID NO: 11098 - DNA, 25 bp, E. coli
taagaatgtgctaaaccgtggtttc

SEQ ID NO: 11099 - DNA, 25 bp, E. coli
cagttctggtcaggcgaatgatgct

SEQ ID NO: 11100 - DNA, 25 bp, E. coli
cagttctggtcacgcgaatgatgct

SEQ ID NO: 11101 - DNA, 25 bp, E. coli
cacgctggaggtaaactggccgatt

SEQ ID NO: 11102 - DNA, 25 bp, E. coli
cacgctggaggttaactggccgatt

SEQ ID NO: 11103 - DNA, 25 bp, E. coli
actgcccggaaaaactggtgcctgg

SEQ ID NO: 11104 - DNA, 25 bp, E. coli
actgcccggaaatactggtgcctgg

SEQ ID NO: 11105 - DNA, 25 bp, E. coli
tttccagcgctatcgtgggatggct

SEQ ID NO: 11106 - DNA, 25 bp, E. coli
tttccagcgctaacgtgggatggct

SEQ ID NO: 11107 - DNA, 25 bp, E. coli
gcggcactcttagttggaccgatga

SEQ ID NO: 11108 - DNA, 25 bp, E. coli
gcggcactcttacttggaccgatga

SEQ ID NO: 11109 - DNA, 25 bp, E. coli
ctatagctcactccccggaaatact

SEQ ID NO: 11110 - DNA, 25 bp, E. coli
ctatagctcactgcccggaaatact

SEQ ID NO: 11111 - DNA, 25 bp, E. coli
gattgcgcaaaacttgaccggttcg

SEQ ID NO: 11112 - DNA, 25 bp, E. coli
gttcgatcctgaccacgctggaggt

SEQ ID NO: 11113 - DNA, 25 bp, E. coli
gattgcgcaaaagttgaccggttcg

SEQ ID NO: 11114 - DNA, 25 bp, E. coli
gttcgatcctgagcacgctggaggt

SEQ ID NO: 11115 - DNA, 25 bp, E. coli
ggatggctactggtgcgctatagct

SEQ ID NO: 11116 - DNA, 25 bp, E. coli
ggatggctactgctgcgctatagct

SEQ ID NO: 11117 - DNA, 25 bp, E. coli
tggccgattgtgttagctattttac

SEQ ID NO: 11118 - DNA, 25 bp, E. coli
tggtttcctcggattacatctcccg

SEQ ID NO: 11119 - DNA, 25 bp, E. coli
tggtttcctcggtttacatctcccg

SEQ ID NO: 11120 - DNA, 25 bp, E. coli
tggccgattgtgatagctattttac

SEQ ID NO: 11121 - DNA, 25 bp, E. coli
cacaggttaaagctgttgataagtt

SEQ ID NO: 11122 - DNA, 25 bp, E. coli
cacaggttaaaggtgttgataagtt

SEQ ID NO: 11123 - DNA, 25 bp, E. coli
cagcgaccagactgtggatgtggcc

SEQ ID NO: 11124 - DNA, 25 bp, E. coli
cagcgaccagacagtggatgtggcc

SEQ ID NO: 11125 - DNA, 25 bp, E. coli
tatggatgaaagagaaatgtggcag

SEQ ID NO: 11126 - DNA, 25 bp, E. coli
tatggatgaaagtgaaatgtggcag

SEQ ID NO: 11127 - DNA, 25 bp, E. coli
tgtggatgtggcctctccgttcaaa

SEQ ID NO: 11128 - DNA, 25 bp, E. coli
tgtggatgtggcgtctccgttcaaa

SEQ ID NO: 11129 - DNA, 25 bp, E. coli
gctcttcagcgagcagactgtggat

SEQ ID NO: 11130 - DNA, 25 bp, E. coli
gctcttcagcgaccagactgtggat

SEQ ID NO: 11131 - DNA, 25 bp, E. coli
gataaaacgctcttcagcgaccaga

SEQ ID NO: 11132 - DNA, 25 bp, E. coli
ggcctctccgttcaaaccgttctga

SEQ ID NO: 11133 - DNA, 25 bp, E. coli
gataaaacgctcatcagcgaccaga

SEQ ID NO: 11134 - DNA, 25 bp, E. coli
ggcctctccgttgaaaccgttctga

SEQ ID NO: 11135 - DNA, 25 bp, E. coli
tggcagggcggacataaaacgctct

SEQ ID NO: 11136 - DNA, 25 bp, E. coli
tggcagggcggagataaaacgctct

SEQ ID NO: 11137 - DNA, 25 bp, E. coli
ggcggagataaatcgctcttcagcg

SEQ ID NO: 11138 - DNA, 25 bp, E. coli
ggcggagataaaacgctcttcagcg

SEQ ID NO: 11139 - DNA, 25 bp, E. coli
gaccagactgtggatgtggcctctc

SEQ ID NO: 11140 - DNA, 25 bp, E. coli
gaccagactgtgcatgtggcctctc

SEQ ID NO: 11141 - DNA, 25 bp, E. coli
gatgtggcctctgcgttcaaaccgt

SEQ ID NO: 11142 - DNA, 25 bp, E. coli
gatgtggcctctccgttcaaaccgt

SEQ ID NO: 11143 - DNA, 25 bp, E. coli
caaaaccgtcagtgtctgaacagcc

SEQ ID NO: 11144 - DNA, 25 bp, E. coli
cactggcgtgcagagtgcgagttac

SEQ ID NO: 11145 - DNA, 25 bp, E. coli
caaaaccgtcagagtctgaacagcc

SEQ ID NO: 11146 - DNA, 25 bp, E. coli
cactggcgtgcacagtgcgagttac

SEQ ID NO: 11147 - DNA, 25 bp, E. coli
taccctgacccacgaaattcgcaat

SEQ ID NO: 11148 - DNA, 25 bp, E. coli
taccctgacccaggaaattcgcaat

SEQ ID NO: 11149 - DNA, 25 bp, E. coli
tatttttgagcagagcaatcgccgg

SEQ ID NO: 11150 - DNA, 25 bp, E. coli
tatttttgagcacagcaatcgccgg

SEQ ID NO: 11151 - DNA, 25 bp, E. coli
tgagcacagcaaacgccgggttgat

SEQ ID NO: 11152 - DNA, 25 bp, E. coli
tgagcacagcaatcgccgggttgat

SEQ ID NO: 11153 - DNA, 25 bp, E. coli
tcgccgctacgtcaacaactggacg

SEQ ID NO: 11154 - DNA, 25 bp, E. coli
tcgccgctacgtgaacaactggacg

SEQ ID NO: 11155 - DNA, 25 bp, E. coli
tcaggacagcttgggtaaagaagca

SEQ ID NO: 11156 - DNA, 25 bp, E. coli
tcaggacagcttcggtaaagaagca

SEQ ID NO: 11157 - DNA, 25 bp, E. coli
ccacgaaattcgcaatctccagcaa

SEQ ID NO: 11158 - DNA, 25 bp, E. coli
ccacgaaattcggaatctccagcaa

SEQ ID NO: 11159 - DNA, 25 bp, E. coli
gtgcgagttactgaataacgaagtg

SEQ ID NO: 11160 - DNA, 25 bp, E. coli
gtgcgagttactcaataacgaagtg

SEQ ID NO: 11161 - DNA, 25 bp, E. coli
cggtaaagaagcacaagaacgccat

SEQ ID NO: 11162 - DNA, 25 bp, E. coli
ctgaacagcctgatgtcgccgctac

SEQ ID NO: 11163 - DNA, 25 bp, E. coli
ctgaacagcctgttgtcgccgctac

SEQ ID NO: 11164 - DNA, 25 bp, E. coli
cggtaaagaagctcaagaacgccat

SEQ ID NO: 11165 - DNA, 25 bp, E. coli
caaggcggaatctaccccggagaat

SEQ ID NO: 11166 - DNA, 25 bp, E. coli
caaggcggaatcaaccccggagaat

SEQ ID NO: 11167 - DNA, 25 bp, E. coli
cagagcaggcgaagtaccgtgaatt

SEQ ID NO: 11168 - DNA, 25 bp, E. coli
cagagcaggcgatgtaccgtgaatt

SEQ ID NO: 11169 - DNA, 25 bp, E. coli
tacaccagagttagacggctggcga

SEQ ID NO: 11170 - DNA, 25 bp, E. coli
tacaccagagtttgacggctggcga

SEQ ID NO: 11171 - DNA, 25 bp, E. coli
aactggttgcgctacaaattaccga

SEQ ID NO: 11172 - DNA, 25 bp, E. coli
aactggttgcgcaacaaattaccga

SEQ ID NO: 11173 - DNA, 25 bp, E. coli
tatgcaaaccaggagtacaccagag

SEQ ID NO: 11174 - DNA, 25 bp, E. coli
tatgcaaaccagcagtacaccagag

SEQ ID NO: 11175 - DNA, 25 bp, E. coli
ttctcttgcagcaggtgagcggcga

SEQ ID NO: 11176 - DNA, 25 bp, E. coli
ttctcttgcagctggtgagcggcga

SEQ ID NO: 11177 - DNA, 25 bp, E. coli
tgattgatgacgatggctaccgccc

SEQ ID NO: 11178 - DNA, 25 bp, E. coli
tgattgatgacgttggctaccgccc

SEQ ID NO: 11179 - DNA, 25 bp, E. coli
tgatgtcactgctggaaaatacgcc

SEQ ID NO: 11180 - DNA, 25 bp, E. coli
tgatgtcactgcaggaaaatacgcc

SEQ ID NO: 11181 - DNA, 25 bp, E. coli
gaatccttgcttgaacgcgtaactg

SEQ ID NO: 11182 - DNA, 25 bp, E. coli
gaatccttgcttcaacgcgtaactg

SEQ ID NO: 11183 - DNA, 25 bp, E. coli
ggattaagccgcaaagacgttcgaa

SEQ ID NO: 11184 - DNA, 25 bp, E. coli
ggattaagccgctaagacgttcgaa

SEQ ID NO: 11185 - DNA, 25 bp, E. coli
ggcgatttggtctgcactcctggca

SEQ ID NO: 11186 - DNA, 25 bp, E. coli
ggcgatttggtcagcactcctggca

SEQ ID NO: 11187 - DNA, 25 bp, E. coli
aatgtcgtggtgtcgctggatcgcc

SEQ ID NO: 11188 - DNA, 25 bp, E. coli
aatgtcgtggtgacgctggatcgcc

SEQ ID NO: 11189 - DNA, 25 bp, E. coli
acatcgttgatgagacgctggcggc

SEQ ID NO: 11190 - DNA, 25 bp, E. coli
acatcgttgatgtgacgctggcggc

SEQ ID NO: 11191 - DNA, 25 bp, E. coli
tttgaagcggcgacacgcgcaattg

SEQ ID NO: 11192 - DNA, 25 bp, E. coli
tttgaagcggcgtcacgcgcaattg

SEQ ID NO: 11193 - DNA, 25 bp, E. coli
tctcaactggactggctggttccgc

SEQ ID NO: 11194 - DNA, 25 bp, E. coli
tctcaactggacaggctggttccgc

SEQ ID NO: 11195 - DNA, 25 bp, E. coli
ccgagcgcagctagtcagattcaaa

SEQ ID NO: 11196 - DNA, 25 bp, E. coli
gcatttgacgttgcagcagcctgcg

SEQ ID NO: 11197 - DNA, 25 bp, E. coli
gctatctgcccgaacaagtgcggac

SEQ ID NO: 11198 - DNA, 25 bp, E. coli
gctatctgcccgtacaagtgcggac

SEQ ID NO: 11199 - DNA, 25 bp, E. coli
gcatttgacgttccagcagcctgcg

SEQ ID NO: 11200 - DNA, 25 bp, E. coli
cgatggcgggcatcgaagtcttcaa

SEQ ID NO: 11201 - DNA, 25 bp, E. coli
cgaagattattgctactggcagcta

SEQ ID NO: 11202 - DNA, 25 bp, E. coli
cgaagattattggtactggcagcta

SEQ ID NO: 11203 - DNA, 25 bp, E. coli
cgatggcgggcaacgaagtcttcaa

SEQ ID NO: 11204 - DNA, 25 bp, E. coli
ccgagcgcagcttgtcagattcaaa

SEQ ID NO: 11205 - DNA, 25 bp, E. coli
gattgtcactcgaaccggtatccgc

SEQ ID NO: 11206 - DNA, 25 bp, E. coli
gattgtcactcgtaccggtatccgc

SEQ ID NO: 11207 - DNA, 25 bp, E. coli
tcaaggttgcggaaacggaactggc

SEQ ID NO: 11208 - DNA, 25 bp, E. coli
tcaaggttgcggtaacggaactggc

SEQ ID NO: 11209 - DNA, 25 bp, E. coli
caataatggagctggatgagcgtca

SEQ ID NO: 11210 - DNA, 25 bp, E. coli
caataatggagcaggatgagcgtca

SEQ ID NO: 11211 - DNA, 25 bp, E. coli
tacaggagagcatgaataatccggc

SEQ ID NO: 11212 - DNA, 25 bp, E. coli
tacaggagagcaagaataatccggc

SEQ ID NO: 11213 - DNA, 25 bp, E. coli
accccgcagtggataatgagtttca

SEQ ID NO: 11214 - DNA, 25 bp, E. coli
accccgcagtggttaatgagtttca

SEQ ID NO: 11215 - DNA, 25 bp, E. coli
tatctgcgcagaaagactggacgct

SEQ ID NO: 11216 - DNA, 25 bp, E. coli
tatctgcgcagatagactggacgct

SEQ ID NO: 11217 - DNA, 25 bp, E. coli
gaatttatcccggacctggcaggaa

SEQ ID NO: 11218 - DNA, 25 bp, E. coli
gaatttatcccgcacctggcaggaa

SEQ ID NO: 11219 - DNA, 25 bp, E. coli
gaaagtgaagctgcgctacaggcga

SEQ ID NO: 11220 - DNA, 25 bp, E. coli
gaaattttaccgcacgcctgctgac

SEQ ID NO: 11221 - DNA, 25 bp, E. coli
gaaattttaccggacgcctgctgac

SEQ ID NO: 11222 - DNA, 25 bp, E. coli
gaaagtgaagctccgctacaggcga

SEQ ID NO: 11223 - DNA, 25 bp, E. coli
cgaagagatattacgcccggagtgg

SEQ ID NO: 11224 - DNA, 25 bp, E. coli
cgaagagatatttcgcccggagtgg

SEQ ID NO: 11225 - DNA, 25 bp, E. coli
gggaatctgttcaacctcgtcgtga

SEQ ID NO: 11226 - DNA, 25 bp, E. coli
gggaatctgttctacctcgtcgtga

SEQ ID NO: 11227 - DNA, 25 bp, E. coli
taagcaacgcttagggatgacgcca

SEQ ID NO: 11228 - DNA, 25 bp, E. coli
taagcaacgctttgggatgacgcca

SEQ ID NO: 11229 - DNA, 25 bp, E. coli
gacgccaggcgactatcgacgtaaa

SEQ ID NO: 11230 - DNA, 25 bp, E. coli
gacgccaggcgagtatcgacgtaaa

SEQ ID NO: 11231 - DNA, 25 bp, E. coli
aacgtgcggccaatcttcaggacaa

SEQ ID NO: 11232 - DNA, 25 bp, E. coli
caaaaatgttgctggatacgctggc

SEQ ID NO: 11233 - DNA, 25 bp, E. coli
caaaaatgttgcaggatacgctggc

SEQ ID NO: 11234 - DNA, 25 bp, E. coli
tacagcttgttcagacgcctgcaaa

SEQ ID NO: 11235 - DNA, 25 bp, E. coli
tacagcttgttctgacgcctgcaaa

SEQ ID NO: 11236 - DNA, 25 bp, E. coli
aacgttgttacggagaatccccgcg

SEQ ID NO: 11237 - DNA, 25 bp, E. coli
attgtctttaagaacctgccccgcg

SEQ ID NO: 11238 - DNA, 25 bp, E. coli
aacgttgttacgcagaatccccgcg

SEQ ID NO: 11239 - DNA, 25 bp, E. coli
attaatatcacacccgtggtcccgg

SEQ ID NO: 11240 - DNA, 25 bp, E. coli
attaatatcacagccgtggtcccgg

SEQ ID NO: 11241 - DNA, 25 bp, E. coli
attgtctttaagtacctgccccgcg

SEQ ID NO: 11242 - DNA, 25 bp, E. coli
aacgtgcggccattcttcaggacaa

SEQ ID NO: 11243 - DNA, 25 bp, E. coli
tacgctggcgtggatacttgaaaaa

SEQ ID NO: 11244 - DNA, 25 bp, E. coli
tacgctggcgtgcatacttgaaaaa

SEQ ID NO: 11245 - DNA, 25 bp, E. coli
tctgcgggaaatagcaatggcaccg

SEQ ID NO: 11246 - DNA, 25 bp, E. coli
tctgcgggaaattgcaatggcaccg

SEQ ID NO: 11247 - DNA, 25 bp, E. coli
gaagattgcgcaggtcagtaagcct

SEQ ID NO: 11248 - DNA, 25 bp, E. coli
gaagattgcgcacgtcagtaagcct

SEQ ID NO: 11249 - DNA, 25 bp, E. coli
gaaaatcgaagacgcacaacgtgcg

SEQ ID NO: 11250 - DNA, 25 bp, E. coli
gaaaaactcggtgtgcttccggatg

SEQ ID NO: 11251 - DNA, 25 bp, E. coli
gaaaaactcggtctgcttccggatg

SEQ ID NO: 11252 - DNA, 25 bp, E. coli
gaaaatcgaagaggcacaacgtgcg

SEQ ID NO: 11253 - DNA, 25 bp, E. coli
aaatgccgccgctaatgacgctgag

SEQ ID NO: 11254 - DNA, 25 bp, E. coli
aaacgctggcagctttgctgtacac

SEQ ID NO: 11255 - DNA, 25 bp, E. coli
aaacgctggcaggtttgctgtacac

SEQ ID NO: 11256 - DNA, 25 bp, E. coli
aaatgccgccgcaaatgacgctgag

SEQ ID NO: 11257 - DNA, 25 bp, E. coli
tttttactccgcgagcaaatgccgc

SEQ ID NO: 11258 - DNA, 25 bp, E. coli
tttttactccgccagcaaatgccgc

SEQ ID NO: 11259 - DNA, 25 bp, E. coli
tgctcatgggttcgcgcactctgct

SEQ ID NO: 11260 - DNA, 25 bp, E. coli
tgctcatgggttggcgcactctgct

SEQ ID NO: 11261 - DNA, 25 bp, E. coli
tgaatattgctgtgttaaaccacgg

SEQ ID NO: 11262 - DNA, 25 bp, E. coli
tgaatattgctgagttaaaccacgg

SEQ ID NO: 11263 - DNA, 25 bp, E. coli
tcggcctggcgtctgtgaatattgc

SEQ ID NO: 11264 - DNA, 25 bp, E. coli
tcggcctggcgtgtgtgaatattgc

SEQ ID NO: 11265 - DNA, 25 bp, E. coli
gaatacccggcgatgttgcagtcga

SEQ ID NO: 11266 - DNA, 25 bp, E. coli
gaatacccggcgttgttgcagtcga

SEQ ID NO: 11267 - DNA, 25 bp, E. coli
cgacagtgattcacgggccgctgat

SEQ ID NO: 11268 - DNA, 25 bp, E. coli
cgacagtgattctcgggccgctgat

SEQ ID NO: 11269 - DNA, 25 bp, E. coli
gttaattgcgctccccattgcctgg

SEQ ID NO: 11270 - DNA, 25 bp, E. coli
gttaattgcgctgcccattgcctgg

SEQ ID NO: 11271 - DNA, 25 bp, E. coli
ggaaaatcccgacaaacatccgatg

SEQ ID NO: 11272 - DNA, 25 bp, E. coli
ggaaaatcccgagaaacatccgatg

SEQ ID NO: 11273 - DNA, 25 bp, E. coli
gatgattatcgggaccctgccggtg

SEQ ID NO: 11274 - DNA, 25 bp, E. coli
gatgattatcggcaccctgccggtg

SEQ ID NO: 11275 - DNA, 25 bp, E. coli
aataaacttgaacaactgagcgcag

SEQ ID NO: 11276 - DNA, 25 bp, E. coli
aataaacttgaagaactgagcgcag

SEQ ID NO: 11277 - DNA, 25 bp, E. coli
aatgcgacctgtccaaccatcgtga

SEQ ID NO: 11278 - DNA, 25 bp, E. coli
aatgcgacctgtgcaaccatcgtga

SEQ ID NO: 11279 - DNA, 25 bp, E. coli
caaaacctgcgttgtggcttgcccg

SEQ ID NO: 11280 - DNA, 25 bp, E. coli
caaaacctgcgtagtggcttgcccg

SEQ ID NO: 11281 - DNA, 25 bp, E. coli
caggaaaatcagcactgtgcatcgc

SEQ ID NO: 11282 - DNA, 25 bp, E. coli
caggaaaatcaggactgtgcatcgc

SEQ ID NO: 11283 - DNA, 25 bp, E. coli
taaaggtgtgaagatttccacggcg

SEQ ID NO: 11284 - DNA, 25 bp, E. coli
taaaggtgtgaacatttccacggcg

SEQ ID NO: 11285 - DNA, 25 bp, E. coli
taccgcgtatccatgtcattaaagg

SEQ ID NO: 11286 - DNA, 25 bp, E. coli
taccgcgtatccttgtcattaaagg

SEQ ID NO: 11287 - DNA, 25 bp, E. coli
tgtacgggctgagaaagccgaagcc

SEQ ID NO: 11288 - DNA, 25 bp, E. coli
tgtacgggctgacaaagccgaagcc

SEQ ID NO: 11289 - DNA, 25 bp, E. coli
tgcgctaacgtcagcccgaatggtg

SEQ ID NO: 11290 - DNA, 25 bp, E. coli
tgcgctaacgtctgcccgaatggtg

SEQ ID NO: 11291 - DNA, 25 bp, E. coli
gccgaagccaataaatgcgacctgt

SEQ ID NO: 11292 - DNA, 25 bp, E. coli
gccgaagccaattaatgcgacctgt

SEQ ID NO: 11293 - DNA, 25 bp, E. coli
cgacagtttgccgtcagtgtgaaga

SEQ ID NO: 11294 - DNA, 25 bp, E. coli
cgacagtttgccctcagtgtgaaga

SEQ ID NO: 11295 - DNA, 25 bp, E. coli
cgtgcgtggtttgtcatcaggaaaa

SEQ ID NO: 11296 - DNA, 25 bp, E. coli
cgtgcgtggtttctcatcaggaaaa

SEQ ID NO: 11297 - DNA, 25 bp, E. coli
catgcattatgtcagcttccggaca

SEQ ID NO: 11298 - DNA, 25 bp, E. coli
catgcattatgtgagcttccggaca

SEQ ID NO: 11299 - DNA, 25 bp, E. coli
tacaccggaaggaagctggctaaca

SEQ ID NO: 11300 - DNA, 25 bp, E. coli
tacaccggaaggtagctggctaaca

SEQ ID NO: 11301 - DNA, 25 bp, E. coli
cctctaggagaagaacgggcaaata

SEQ ID NO: 11302 - DNA, 25 bp, E. coli
cctctaggagaacaacgggcaaata

SEQ ID NO: 11303 - DNA, 25 bp, E. coli
tatcgcacgtgatatgggagaaatc

SEQ ID NO: 11304 - DNA, 25 bp, E. coli
tatcgcacgtgaaatgggagaaatc

SEQ ID NO: 11305 - DNA, 25 bp, E. coli
tatatatccggtttaaccagaggag

SEQ ID NO: 11306 - DNA, 25 bp, E. coli
ttatatccggaaaacgcccaatggg

SEQ ID NO: 11307 - DNA, 25 bp, E. coli
tatatatccggtataaccagaggag

SEQ ID NO: 11308 - DNA, 25 bp, E. coli
ttatatccggaatacgcccaatggg

SEQ ID NO: 11309 - DNA, 25 bp, E. coli
tgtacagaaatgacagccctctagg

SEQ ID NO: 11310 - DNA, 25 bp, E. coli
tgttactaatactcagggcgtgtcc

SEQ ID NO: 11311 - DNA, 25 bp, E. coli
tgttactaatacacagggcgtgtcc

SEQ ID NO: 11312 - DNA, 25 bp, E. coli
tgtacagaaatgtcagccctctagg

SEQ ID NO: 11313 - DNA, 25 bp, E. coli
tgttaacgagaatgccagacggttt

SEQ ID NO: 11314 - DNA, 25 bp, E. coli
tgttaacgagaaagccagacggttt

SEQ ID NO: 11315 - DNA, 25 bp, E. coli
tccagaaatgaacccagtacaccgg

SEQ ID NO: 11316 - DNA, 25 bp, E. coli
tccagaaatgaagccagtacaccgg

SEQ ID NO: 11317 - DNA, 25 bp, E. coli
gagaaatctttagctacatgcctgg

SEQ ID NO: 11318 - DNA, 25 bp, E. coli
gagaaatctttacctacatgcctgg

SEQ ID NO: 11319 - DNA, 25 bp, E. coli
catggctttagttcgcgtgttgcgc

SEQ ID NO: 11320 - DNA, 25 bp, E. coli
catggctttagtacgcgtgttgcgc

SEQ ID NO: 11321 - DNA, 25 bp, E. coli
taaaacttgcgaacattaccagcaa

SEQ ID NO: 11322 - DNA, 25 bp, E. coli
taaaacttgcgatcattaccagcaa

SEQ ID NO: 11323 - DNA, 25 bp, E. coli
tatgtctatgtttatcgcgaagcgc

SEQ ID NO: 11324 - DNA, 25 bp, E. coli
tatgtctatgttaatcgcgaagcgc

SEQ ID NO: 11325 - DNA, 25 bp, E. coli
tatttacgaccagacgaggtggcgc

SEQ ID NO: 11326 - DNA, 25 bp, E. coli
tatttacgaccacacgaggtggcgc

SEQ ID NO: 11327 - DNA, 25 bp, E. coli
tgtcgatgtggttacccagaaagcg

SEQ ID NO: 11328 - DNA, 25 bp, E. coli
tgtcgatgtggtaacccagaaagcg

SEQ ID NO: 11329 - DNA, 25 bp, E. coli
tgaatggtttatatggcgaagccag

SEQ ID NO: 11330 - DNA, 25 bp, E. coli
tgaatggtttatttggcgaagccag

SEQ ID NO: 11331 - DNA, 25 bp, E. coli
tcgcgaagcgcgaatgggacgtacc

SEQ ID NO: 11332 - DNA, 25 bp, E. coli
tcgcgaagcgcgtatgggacgtacc

SEQ ID NO: 11333 - DNA, 25 bp, E. coli
ccagaaagcgtatggttaccgccgt

SEQ ID NO: 11334 - DNA, 25 bp, E. coli
ccagaaagcgtaaggttaccgccgt

SEQ ID NO: 11335 - DNA, 25 bp, E. coli
ggtggcgcgcgttcttgaaaaagtc

SEQ ID NO: 11336 - DNA, 25 bp, E. coli
ggtggcgcgcgtacttgaaaaagtc

SEQ ID NO: 11337 - DNA, 25 bp, E. coli
tggctgaacccgcttccgatattaa

SEQ ID NO: 11338 - DNA, 25 bp, E. coli
tggctgaacccggttccgatattaa

SEQ ID NO: 11339 - DNA, 25 bp, E. coli
gagcattacggtatcccgcatggct

SEQ ID NO: 11340 - DNA, 25 bp, E. coli
gagcattacggtttcccgcatggct

SEQ ID NO: 11341 - DNA, 25 bp, E. coli
ctggttggttttcccctgcgctgcc

SEQ ID NO: 11342 - DNA, 25 bp, E. coli
tacttctctttgatggcgctcaggc

SEQ ID NO: 11343 - DNA, 25 bp, E. coli
tacttctctttgttggcgctcaggc

SEQ ID NO: 11344 - DNA, 25 bp, E. coli
taacggcgcgcggaaatttttgcat

SEQ ID NO: 11345 - DNA, 25 bp, E. coli
tcagtgcctcatgccaggaaacagg

SEQ ID NO: 11346 - DNA, 25 bp, E. coli
tcagtgcctcatcccaggaaacagg

SEQ ID NO: 11347 - DNA, 25 bp, E. coli
tctggatggcatgcggaccgtactt

SEQ ID NO: 11348 - DNA, 25 bp, E. coli
tcaggcgctcggcaacgtaattcag

SEQ ID NO: 11349 - DNA, 25 bp, E. coli
tcaggcgctcgggaacgtaattcag

SEQ ID NO: 11350 - DNA, 25 bp, E. coli
tctggatggcatccggaccgtactt

SEQ ID NO: 11351 - DNA, 25 bp, E. coli
gccataataaccgttcagacacagg

SEQ ID NO: 11352 - DNA, 25 bp, E. coli
gccataataacccttcagacacagg

SEQ ID NO: 11353 - DNA, 25 bp, E. coli
gattttgccgttttcgacgaccagg

SEQ ID NO: 11354 - DNA, 25 bp, E. coli
gaaacaggttcgagtttgccgccac

SEQ ID NO: 11355 - DNA, 25 bp, E. coli
gattttgccgttatcgacgaccagg

SEQ ID NO: 11356 - DNA, 25 bp, E. coli
gaaacaggttcgtgtttgccgccac

SEQ ID NO: 11357 - DNA, 25 bp, E. coli
cgagcgcagcagacaacgttattgg

SEQ ID NO: 11358 - DNA, 25 bp, E. coli
cgagcgcagcagtcaacgttattgg

SEQ ID NO: 11359 - DNA, 25 bp, E. coli
ctggttggttttgccctgcgctgcc

SEQ ID NO: 11360 - DNA, 25 bp, E. coli
ggtatcgttaatgaagtcccagcca

SEQ ID NO: 11361 - DNA, 25 bp, E. coli
ggtatcgttaatcaagtcccagcca

SEQ ID NO: 11362 - DNA, 25 bp, E. coli
taacggcgcgcgcaaatttttgcat

SEQ ID NO: 11363 - DNA, 25 bp, E. coli
cagatggtcagttgcagctaccgcc

SEQ ID NO: 11364 - DNA, 25 bp, E. coli
cagatggtcagtagcagctaccgcc

SEQ ID NO: 11365 - DNA, 25 bp, E. coli
catgcaattgctcagtcagggcaca

SEQ ID NO: 11366 - DNA, 25 bp, E. coli
catgcaattgctgagtcagggcaca

SEQ ID NO: 11367 - DNA, 25 bp, E. coli
taaaacgctgtcaggcgtggcagag

SEQ ID NO: 11368 - DNA, 25 bp, E. coli
taaaacgctgtctggcgtggcagag

SEQ ID NO: 11369 - DNA, 25 bp, E. coli
agtgccggattttgatattctcgcg

SEQ ID NO: 11370 - DNA, 25 bp, E. coli
agtgccggatttagatattctcgcg

SEQ ID NO: 11371 - DNA, 25 bp, E. coli
tattctcgcggagggtaaaacgctg

SEQ ID NO: 11372 - DNA, 25 bp, E. coli
tattctcgcggacggtaaaacgctg

SEQ ID NO: 11373 - DNA, 25 bp, E. coli
tgatgagcctgtgactgaccgacaa

SEQ ID NO: 11374 - DNA, 25 bp, E. coli
tgatgagcctgtcactgaccgacaa

SEQ ID NO: 11375 - DNA, 25 bp, E. coli
tcattggctggataggagaaccgct

SEQ ID NO: 11376 - DNA, 25 bp, E. coli
tcagggcacagaccacgtgaaagtg

SEQ ID NO: 11377 - DNA, 25 bp, E. coli
tcattggctggaaaggagaaccgct

SEQ ID NO: 11378 - DNA, 25 bp, E. coli
tcagggcacagagcacgtgaaagtg

SEQ ID NO: 11379 - DNA, 25 bp, E. coli
gatttgaggcggaccagctcaccat

SEQ ID NO: 11380 - DNA, 25 bp, E. coli
gatttgaggcggtccagctcaccat

SEQ ID NO: 11381 - DNA, 25 bp, E. coli
tcacgctggatgttgcagatggtca

SEQ ID NO: 11382 - DNA, 25 bp, E. coli
tcacgctggatgatgcagatggtca

SEQ ID NO: 11383 - DNA, 25 bp, E. coli
gagaaccgctgagagaaaaaggcac

SEQ ID NO: 11384 - DNA, 25 bp, E. coli
gagaaccgctgacagaaaaaggcac

SEQ ID NO: 11385 - DNA, 25 bp, E. coli
aaccgcgtgtccttctggtgttgcc

SEQ ID NO: 11386 - DNA, 25 bp, E. coli
aaccgcgtgtccatctggtgttgcc

SEQ ID NO: 11387 - DNA, 25 bp, E. coli
cagtaaccgcgtgtccatctggtgt

SEQ ID NO: 11388 - DNA, 25 bp, E. coli
cagtaaccgcgtctccatctggtgt

SEQ ID NO: 11389 - DNA, 25 bp, E. coli
agtaaccgcgtgaccatctggtgtt

SEQ ID NO: 11390 - DNA, 25 bp, E. coli
agtaaccgcgtgtccatctggtgtt

SEQ ID NO: 11391 - DNA, 25 bp, E. coli
tgcagtaaccgcgtgtccatctggt

SEQ ID NO: 11392 - DNA, 25 bp, E. coli
tgcagtaaccgcctgtccatctggt

SEQ ID NO: 11393 - DNA, 25 bp, E. coli
gcagtaaccgcgagtccatctggtg

SEQ ID NO: 11394 - DNA, 25 bp, E. coli
gcagtaaccgcgtgtccatctggtg

SEQ ID NO: 11395 - DNA, 25 bp, E. coli
gcgtgtccatctggtgttgcccata

SEQ ID NO: 11396 - DNA, 25 bp, E. coli
gcgtgtccatctcgtgttgcccata

SEQ ID NO: 11397 - DNA, 25 bp, E. coli
ccgcgtgtccatctggtgttgccca

SEQ ID NO: 11398 - DNA, 25 bp, E. coli
cgcgtgtccatctggtgttgcccat

SEQ ID NO: 11399 - DNA, 25 bp, E. coli
ccgcgtgtccatgtggtgttgccca

SEQ ID NO: 11400 - DNA, 25 bp, E. coli
cgcgtgtccatcaggtgttgcccat

SEQ ID NO: 11401 - DNA, 25 bp, E. coli
cgtgtccatctggtgttgcccatac

SEQ ID NO: 11402 - DNA, 25 bp, E. coli
cgtgtccatctgctgttgcccatac

SEQ ID NO: 11403 - DNA, 25 bp, E. coli
gtgtccatctggagttgcccatact

SEQ ID NO: 11404 - DNA, 25 bp, E. coli
gtgtccatctggtgttgcccatact

SEQ ID NO: 11405 - DNA, 25 bp, E. coli
taaccgcgtgtccatctggtgttgc

SEQ ID NO: 11406 - DNA, 25 bp, E. coli
taaccgcgtgtcgatctggtgttgc

SEQ ID NO: 11407 - DNA, 25 bp, E. coli
aacgccatcactggtgttgatggtg

SEQ ID NO: 11408 - DNA, 25 bp, E. coli
aaactgtgtggtttcgcctgcccgt

SEQ ID NO: 11409 - DNA, 25 bp, E. coli
aaactgtgtggtatcgcctgcccgt

SEQ ID NO: 11410 - DNA, 25 bp, E. coli
aacgccatcactcgtgttgatggtg

SEQ ID NO: 11411 - DNA, 25 bp, E. coli
actgtgtggtatggcctgcccgttt

SEQ ID NO: 11412 - DNA, 25 bp, E. coli
actgtgtggtatcgcctgcccgttt

SEQ ID NO: 11413 - DNA, 25 bp, E. coli
tgcaaactgtgtcgtatcgcctgcc

SEQ ID NO: 11414 - DNA, 25 bp, E. coli
tgcaaactgtgtggtatcgcctgcc

SEQ ID NO: 11415 - DNA, 25 bp, E. coli
tgcgtaagctgcaaactgtgtggta

SEQ ID NO: 11416 - DNA, 25 bp, E. coli
tgcgtaagctgctaactgtgtggta

SEQ ID NO: 11417 - DNA, 25 bp, E. coli
gctgcaaactgtgtggtatcgcctg

SEQ ID NO: 11418 - DNA, 25 bp, E. coli
gctgcaaactgtctggtatcgcctg

SEQ ID NO: 11419 - DNA, 25 bp, E. coli
gcaaactgtgtggtatcgcctgccc

SEQ ID NO: 11420 - DNA, 25 bp, E. coli
gcaaactgtgtgctatcgcctgccc

SEQ ID NO: 11421 - DNA, 25 bp, E. coli
cgtaagctgcaatctgtgtggtatc

SEQ ID NO: 11422 - DNA, 25 bp, E. coli
cgccatcactcgtgttgatggtgct

SEQ ID NO: 11423 - DNA, 25 bp, E. coli
cgccatcactcgagttgatggtgct

SEQ ID NO: 11424 - DNA, 25 bp, E. coli
cgtaagctgcaaactgtgtggtatc

SEQ ID NO: 11425 - DNA, 25 bp, E. coli
gtgttgatggtgctgtgcagttgaa

SEQ ID NO: 11426 - DNA, 25 bp, E. coli
gtgttgatggtggtgtgcagttgaa

SEQ ID NO: 11427 - DNA, 25 bp, E. coli
taagctgcaaacagtgtggtatcgc

SEQ ID NO: 11428 - DNA, 25 bp, E. coli
taagctgcaaactgtgtggtatcgc

SEQ ID NO: 11429 - DNA, 25 bp, E. coli
caaaaaatcattcatgccgggaaag

SEQ ID NO: 11430 - DNA, 25 bp, E. coli
caaaaaatcattgatgccgggaaag

SEQ ID NO: 11431 - DNA, 25 bp, E. coli
acgtattgattggacggctggctgc

SEQ ID NO: 11432 - DNA, 25 bp, E. coli
acgtattgattgcacggctggctgc

SEQ ID NO: 11433 - DNA, 25 bp, E. coli
tacgcgccagaagcaggcgaagaca

SEQ ID NO: 11434 - DNA, 25 bp, E. coli
tacgcgccagaaccaggcgaagaca

SEQ ID NO: 11435 - DNA, 25 bp, E. coli
tgcacggctggctgcggaattactg

SEQ ID NO: 11436 - DNA, 25 bp, E. coli
tgcacggctggcagcggaattactg

SEQ ID NO: 11437 - DNA, 25 bp, E. coli
tctattgttgaagatcatcaggtgg

SEQ ID NO: 11438 - DNA, 25 bp, E. coli
tctattgttgaacatcatcaggtgg

SEQ ID NO: 11439 - DNA, 25 bp, E. coli
cctgcaaggtgtggttgaagtgctc

SEQ ID NO: 11440 - DNA, 25 bp, E. coli
cctgcaaggtgtcgttgaagtgctc

SEQ ID NO: 11441 - DNA, 25 bp, E. coli
gcgatttactgctaaaacagctcga

SEQ ID NO: 11442 - DNA, 25 bp, E. coli
gcgatttactgcaaaaacagctcga

SEQ ID NO: 11443 - DNA, 25 bp, E. coli
ccgttcaggcgcaaaaatggcaaat

SEQ ID NO: 11444 - DNA, 25 bp, E. coli
ccgttcaggcgctaaaatggcaaat

SEQ ID NO: 11445 - DNA, 25 bp, E. coli
tggcccatgtttcgcgtcgcaaagt

SEQ ID NO: 11446 - DNA, 25 bp, E. coli
tggcccatgtttggcgtcgcaaagt

SEQ ID NO: 11447 - DNA, 25 bp, E. coli
taatatttcccaacatagcctgctg

SEQ ID NO: 11448 - DNA, 25 bp, E. coli
taatatttcccatcatagcctgctg

SEQ ID NO: 11449 - DNA, 25 bp, E. coli
taatacgatctttcttgagccgtcg

SEQ ID NO: 11450 - DNA, 25 bp, E. coli
taatacgatcttacttgagccgtcg

SEQ ID NO: 11451 - DNA, 25 bp, E. coli
catggaatattgcaaagagcaaggt

SEQ ID NO: 11452 - DNA, 25 bp, E. coli
catggaatattggaaagagcaaggt

SEQ ID NO: 11453 - DNA, 25 bp, E. coli
tactgacggcgttgcactggtagtt

SEQ ID NO: 11454 - DNA, 25 bp, E. coli
tactgacggcgtagcactggtagtt

SEQ ID NO: 11455 - DNA, 25 bp, E. coli
atattgcaaagaccaaggtcttaac

SEQ ID NO: 11456 - DNA, 25 bp, E. coli
atattgcaaagagcaaggtcttaac

SEQ ID NO: 11457 - DNA, 25 bp, E. coli
tacctggaaatactgacggcgtagc

SEQ ID NO: 11458 - DNA, 25 bp, E. coli
tacctggaaatagtgacggcgtagc

SEQ ID NO: 11459 - DNA, 25 bp, E. coli
tcccggtggtgatcggcttgccgat

SEQ ID NO: 11460 - DNA, 25 bp, E. coli
tcccggtggtgaacggcttgccgat

SEQ ID NO: 11461 - DNA, 25 bp, E. coli
tctttacctggatatactgacggcg

SEQ ID NO: 11462 - DNA, 25 bp, E. coli
tctttacctggaaatactgacggcg

SEQ ID NO: 11463 - DNA, 25 bp, E. coli
gcgtagcactggtagtttcaacaac

SEQ ID NO: 11464 - DNA, 25 bp, E. coli
gcgtagcactggaagtttcaacaac

SEQ ID NO: 11465 - DNA, 25 bp, E. coli
gcactggtagtttcaacaactaaag

SEQ ID NO: 11466 - DNA, 25 bp, E. coli
gcactggtagttacaacaactaaag

SEQ ID NO: 11467 - DNA, 25 bp, E. coli
cgttgcctctttacctggaaatact

SEQ ID NO: 11468 - DNA, 25 bp, E. coli
cgttgcctcttttcctggaaatact

SEQ ID NO: 11469 - DNA, 25 bp, E. coli
ggtgaacggcttcccgattattacc

SEQ ID NO: 11470 - DNA, 25 bp, E. coli
ggtgaacggcttgccgattattacc

SEQ ID NO: 11471 - DNA, 25 bp, E. coli
tggaaatactgagggcgtagcactg

SEQ ID NO: 11472 - DNA, 25 bp, E. coli
tggaaatactgacggcgtagcactg

SEQ ID NO: 11473 - DNA, 25 bp, E. coli
aattacgctgtacggcgtcggcagc

SEQ ID NO: 11474 - DNA, 25 bp, E. coli
aattacgctgtagggcgtcggcagc

SEQ ID NO: 11475 - DNA, 25 bp, E. coli
cacaaacctcgggtgaacacactaa

SEQ ID NO: 11476 - DNA, 25 bp, E. coli
cacaaacctcggctgaacacactaa

SEQ ID NO: 11477 - DNA, 25 bp, E. coli
taaaatagtcggcaaggcgctggat

SEQ ID NO: 11478 - DNA, 25 bp, E. coli
taaaatagtcgggaaggcgctggat

SEQ ID NO: 11479 - DNA, 25 bp, E. coli
tacagacagtaaataacccaggaat

SEQ ID NO: 11480 - DNA, 25 bp, E. coli
tacagacagtaattaacccaggaat

SEQ ID NO: 11481 - DNA, 25 bp, E. coli
tgtggtgatcgtgctggataccgcc

SEQ ID NO: 11482 - DNA, 25 bp, E. coli
tgtggtgatcgtcctggataccgcc

SEQ ID NO: 11483 - DNA, 25 bp, E. coli
tgatggctgagctactacagacagt

SEQ ID NO: 11484 - DNA, 25 bp, E. coli
tgatggctgagcaactacagacagt

SEQ ID NO: 11485 - DNA, 25 bp, E. coli
ccttgcgttaatgagatcacctttg

SEQ ID NO: 11486 - DNA, 25 bp, E. coli
ccttgcgttaatcagatcacctttg

SEQ ID NO: 11487 - DNA, 25 bp, E. coli
gaacacactaaagcggatgtggtga

SEQ ID NO: 11488 - DNA, 25 bp, E. coli
gaacacactaaaccggatgtggtga

SEQ ID NO: 11489 - DNA, 25 bp, E. coli
ctgcgcgatgatcgctgagctacta

SEQ ID NO: 11490 - DNA, 25 bp, E. coli
ctgcgcgatgatggctgagctacta

SEQ ID NO: 11491 - DNA, 25 bp, E. coli
ctggataatcgcttcggctgcgcga

SEQ ID NO: 11492 - DNA, 25 bp, E. coli
ctggataatcgcatcggctgcgcga

SEQ ID NO: 11493 - DNA, 25 bp, E. coli
taacccaggaattacgctgtacggc

SEQ ID NO: 11494 - DNA, 25 bp, E. coli
taacccaggaataacgctgtacggc

SEQ ID NO: 11495 - DNA, 25 bp, E. coli
tacgtcgcacccagaaagaagaaga

SEQ ID NO: 11496 - DNA, 25 bp, E. coli
tacgtcgcaccctgaaagaagaaga

SEQ ID NO: 11497 - DNA, 25 bp, E. coli
atgacgcggtacgtcgcaccctgaa

SEQ ID NO: 11498 - DNA, 25 bp, E. coli
atgacgcggtacctcgcaccctgaa

SEQ ID NO: 11499 - DNA, 25 bp, E. coli
taaattagcgaatggccgtccggag

SEQ ID NO: 11500 - DNA, 25 bp, E. coli
taaattagcgaaaggccgtccggag

SEQ ID NO: 11501 - DNA, 25 bp, E. coli
tcgcaccctgaaagaagaagaaaag

SEQ ID NO: 11502 - DNA, 25 bp, E. coli
tcgcaccctgaatgaagaagaaaag

SEQ ID NO: 11503 - DNA, 25 bp, E. coli
tcataaattagcgaaaggccgtccg

SEQ ID NO: 11504 - DNA, 25 bp, E. coli
tcataaattagccaaaggccgtccg

SEQ ID NO: 11505 - DNA, 25 bp, E. coli
cctgaaagaagatgaaaagctggtc

SEQ ID NO: 11506 - DNA, 25 bp, E. coli
cctgaaagaagaagaaaagctggtc

SEQ ID NO: 11507 - DNA, 25 bp, E. coli
gaatgtaccagtcaccgaattgcgt

SEQ ID NO: 11508 - DNA, 25 bp, E. coli
gaatgtaccagtgaccgaattgcgt

SEQ ID NO: 11509 - DNA, 25 bp, E. coli
ccgtgcgatcggacataaattagcg

SEQ ID NO: 11510 - DNA, 25 bp, E. coli
gcggtacgtcgcaccctgaaagaag

SEQ ID NO: 11511 - DNA, 25 bp, E. coli
gcggtacgtcgctccctgaaagaag

SEQ ID NO: 11512 - DNA, 25 bp, E. coli
ccgtgcgatcggtcataaattagcg

SEQ ID NO: 11513 - DNA, 25 bp, E. coli
gttagaccatcctgccaacgaacac

SEQ ID NO: 11514 - DNA, 25 bp, E. coli
gttagaccatccagccaacgaacac

SEQ ID NO: 11515 - DNA, 25 bp, E. coli
gtggcgctgttacaccatccagcca

SEQ ID NO: 11516 - DNA, 25 bp, E. coli
gtggcgctgttagaccatccagcca

SEQ ID NO: 11517 - DNA, 25 bp, E. coli
cacttggatgggaggacatagatct

SEQ ID NO: 11518 - DNA, 25 bp, E. coli
cacttggatgggtggacatagatct

SEQ ID NO: 11519 - DNA, 25 bp, E. coli
aaactggtgtttacgactatgcaaa

SEQ ID NO: 11520 - DNA, 25 bp, E. coli
aaactggtgttttcgactatgcaaa

SEQ ID NO: 11521 - DNA, 25 bp, E. coli
tatactggagttggccctggtgagc

SEQ ID NO: 11522 - DNA, 25 bp, E. coli
tatactggagttcgccctggtgagc

SEQ ID NO: 11523 - DNA, 25 bp, E. coli
tgacagctggtgctaacccggcatt

SEQ ID NO: 11524 - DNA, 25 bp, E. coli
tgacagctggtggtaacccggcatt

SEQ ID NO: 11525 - DNA, 25 bp, E. coli
tcaggagaaatttagcaaaagaccg

SEQ ID NO: 11526 - DNA, 25 bp, E. coli
tcaggagaaattaagcaaaagaccg

SEQ ID NO: 11527 - DNA, 25 bp, E. coli
tcaggtatacggtaaatggatgtct

SEQ ID NO: 11528 - DNA, 25 bp, E. coli
tcacttcagagagtatggcagaaca

SEQ ID NO: 11529 - DNA, 25 bp, E. coli
tcaggtatacggaaaatggatgtct

SEQ ID NO: 11530 - DNA, 25 bp, E. coli
gcagcgataaaacgtgccggactcc

SEQ ID NO: 11531 - DNA, 25 bp, E. coli
gcagcgataaaaggtgccggactcc

SEQ ID NO: 11532 - DNA, 25 bp, E. coli
ggcgggaaccaatcgggtcattcat

SEQ ID NO: 11533 - DNA, 25 bp, E. coli
cggactccgccaacgaaaatcatat

SEQ ID NO: 11534 - DNA, 25 bp, E. coli
cggactccgccatcgaaaatcatat

SEQ ID NO: 11535 - DNA, 25 bp, E. coli
ggcgggaaccaaacgggtcattcat

SEQ ID NO: 11536 - DNA, 25 bp, E. coli
ggcaaatccacacgtgaactacgct

SEQ ID NO: 11537 - DNA, 25 bp, E. coli
ggcaaatccacaggtgaactacgct

SEQ ID NO: 11538 - DNA, 25 bp, E. coli
tcacttcagagactatggcagaaca

SEQ ID NO: 11539 - DNA, 25 bp, E. coli
caagtgaaagggattggcgaccatc

SEQ ID NO: 11540 - DNA, 25 bp, E. coli
caagtgaaagggtttggcgaccatc

SEQ ID NO: 11541 - DNA, 25 bp, E. coli
caggccgaatgatgcgataacgcca

SEQ ID NO: 11542 - DNA, 25 bp, E. coli
caggccgaatgaagcgataacgcca

SEQ ID NO: 11543 - DNA, 25 bp, E. coli
tactgattgataccgactcctttca

SEQ ID NO: 11544 - DNA, 25 bp, E. coli
tacatcgacaggagaattgaccact

SEQ ID NO: 11545 - DNA, 25 bp, E. coli
tactgattgatagcgactcctttca

SEQ ID NO: 11546 - DNA, 25 bp, E. coli
tacatcgacaggtgaattgaccact

SEQ ID NO: 11547 - DNA, 25 bp, E. coli
ttgaccactcttggccgtgaactgg

SEQ ID NO: 11548 - DNA, 25 bp, E. coli
tttagtccgccagatccagcaggta

SEQ ID NO: 11549 - DNA, 25 bp, E. coli
ttgaccactcttcgccgtgaactgg

SEQ ID NO: 11550 - DNA, 25 bp, E. coli
tttagtccgccacatccagcaggta

SEQ ID NO: 11551 - DNA, 25 bp, E. coli
tccgctatcgatcttaccgagtgat

SEQ ID NO: 11552 - DNA, 25 bp, E. coli
tccgctatcgatgttaccgagtgat

SEQ ID NO: 11553 - DNA, 25 bp, E. coli
ccagatccagcaggtaggcggcctg

SEQ ID NO: 11554 - DNA, 25 bp, E. coli
ccagatccagcacgtaggcggcctg

SEQ ID NO: 11555 - DNA, 25 bp, E. coli
cgacagcaaagtggtactgattgat

SEQ ID NO: 11556 - DNA, 25 bp, E. coli
cgacagcaaagtcgtactgattgat

SEQ ID NO: 11557 - DNA, 25 bp, E. coli
ggttttgaacgcacagaaaatcacg

SEQ ID NO: 11558 - DNA, 25 bp, E. coli
ggtagcggcactcgactctctacgc

SEQ ID NO: 11559 - DNA, 25 bp, E. coli
ggtagcggcactggactctctacgc

SEQ ID NO: 11560 - DNA, 25 bp, E. coli
ggttttgaacgctcagaaaatcacg

SEQ ID NO: 11561 - DNA, 25 bp, E. coli
cagccgtagccggaaaggttatgga

SEQ ID NO: 11562 - DNA, 25 bp, E. coli
cagccgtagccgcaaaggttatgga

SEQ ID NO: 11563 - DNA, 25 bp, E. coli
catatgctcgccagttggatcgtgc

SEQ ID NO: 11564 - DNA, 25 bp, E. coli
catatgctcgcctgttggatcgtgc

SEQ ID NO: 11565 - DNA, 25 bp, E. coli
tacgagcgcgttattgcctggtgcc

SEQ ID NO: 11566 - DNA, 25 bp, E. coli
taaactcgcggctccgattatgggc

SEQ ID NO: 11567 - DNA, 25 bp, E. coli
taaactcgcggcaccgattatgggc

SEQ ID NO: 11568 - DNA, 25 bp, E. coli
tacgagcgcgtttttgcctggtgcc

SEQ ID NO: 11569 - DNA, 25 bp, E. coli
tgagcaagaactccgacgtaaactc

SEQ ID NO: 11570 - DNA, 25 bp, E. coli
tgagcaagaactgcgacgtaaactc

SEQ ID NO: 11571 - DNA, 25 bp, E. coli
tgaatgtgacatcgactggtgcgca

SEQ ID NO: 11572 - DNA, 25 bp, E. coli
tgaatgtgacatggactggtgcgca

SEQ ID NO: 11573 - DNA, 25 bp, E. coli
tcagaaaggtatatcccgcgaagcg

SEQ ID NO: 11574 - DNA, 25 bp, E. coli
tcagaaaaagttaagatccagcgtt

SEQ ID NO: 11575 - DNA, 25 bp, E. coli
tcagaaaggtatttcccgcgaagcg

SEQ ID NO: 11576 - DNA, 25 bp, E. coli
cgaagcgacagaaaaagcgatgcgt

SEQ ID NO: 11577 - DNA, 25 bp, E. coli
cgaagcgacagataaagcgatgcgt

SEQ ID NO: 11578 - DNA, 25 bp, E. coli
cattctggcggtccgcgatcacagt

SEQ ID NO: 11579 - DNA, 25 bp, E. coli
cattctggcggtgcgcgatcacagt

SEQ ID NO: 11580 - DNA, 25 bp, E. coli
tcagaaaaagtttagatccagcgtt

SEQ ID NO: 11581 - DNA, 25 bp, E. coli
gatgacagccgatttgttgcgcgct

SEQ ID NO: 11582 - DNA, 25 bp, E. coli
gatgacagccgaattgttgcgcgct

SEQ ID NO: 11583 - DNA, 25 bp, E. coli
caatggaacgctgactgccggtaaa

SEQ ID NO: 11584 - DNA, 25 bp, E. coli
caatggaacgctcactgccggtaaa

SEQ ID NO: 11585 - DNA, 25 bp, E. coli
caaacctgtgatcaatgccgacggc

SEQ ID NO: 11586 - DNA, 25 bp, E. coli
caaacctgtgatgaatgccgacggc

SEQ ID NO: 11587 - DNA, 25 bp, E. coli
cagattttcactcgatggccgggaa

SEQ ID NO: 11588 - DNA, 25 bp, E. coli
cagattttcactggatggccgggaa

SEQ ID NO: 11589 - DNA, 25 bp, E. coli
tacgttaagtcagcagaccggcgga

SEQ ID NO: 11590 - DNA, 25 bp, E. coli
tacgttaagtcaccagaccggcgga

SEQ ID NO: 11591 - DNA, 25 bp, E. coli
tatggctgcggaaaataacgtggtc

SEQ ID NO: 11592 - DNA, 25 bp, E. coli
tatggctgcggataataacgtggtc

SEQ ID NO: 11593 - DNA, 25 bp, E. coli
tatcatcaacgatgtgaccggcggt

SEQ ID NO: 11594 - DNA, 25 bp, E. coli
tatcatcaacgaagtgaccggcggt

SEQ ID NO: 11595 - DNA, 25 bp, E. coli
tattgctggcgaaaagtcatgcggg

SEQ ID NO: 11596 - DNA, 25 bp, E. coli
tattgctggcgataagtcatgcggg

SEQ ID NO: 11597 - DNA, 25 bp, E. coli
ttgataatcagctgaacggcacgct

SEQ ID NO: 11598 - DNA, 25 bp, E. coli
ttgataatcagcagaacggcacgct

SEQ ID NO: 11599 - DNA, 25 bp, E. coli
tgacaatgaatgaggccggtaccct

SEQ ID NO: 11600 - DNA, 25 bp, E. coli
tgacaatgaatgtggccggtaccct

SEQ ID NO: 11601 - DNA, 25 bp, E. coli
tgcaaaaaatctgaccctgaaggcg

SEQ ID NO: 11602 - DNA, 25 bp, E. coli
tgcaaaaaatctcaccctgaaggcg

SEQ ID NO: 11603 - DNA, 25 bp, E. coli
ggaaattcactggataaccgcggca

SEQ ID NO: 11604 - DNA, 25 bp, E. coli
ggaaattcactgcataaccgcggca

SEQ ID NO: 11605 - DNA, 25 bp, E. coli
aagaaacagctcattgagaaactgg

SEQ ID NO: 11606 - DNA, 25 bp, E. coli
aatccggagatcttatccgccacgg

SEQ ID NO: 11607 - DNA, 25 bp, E. coli
caacggttcatttgtcattgcctgg

SEQ ID NO: 11608 - DNA, 25 bp, E. coli
aatccggagatcatatccgccacgg

SEQ ID NO: 11609 - DNA, 25 bp, E. coli
caacggttcattagtcattgcctgg

SEQ ID NO: 11610 - DNA, 25 bp, E. coli
aagaaacagctctttgagaaactgg

SEQ ID NO: 11611 - DNA, 25 bp, E. coli
tatccgagaaagtacgactgctact

SEQ ID NO: 11612 - DNA, 25 bp, E. coli
tatcgttacttggaggcgttcccgg

SEQ ID NO: 11613 - DNA, 25 bp, E. coli
tatccgagaaagaacgactgctact

SEQ ID NO: 11614 - DNA, 25 bp, E. coli
tatcgttacttgcaggcgttcccgg

SEQ ID NO: 11615 - DNA, 25 bp, E. coli
tattttctttcagtacaatccggag

SEQ ID NO: 11616 - DNA, 25 bp, E. coli
tattttctttcactacaatccggag

SEQ ID NO: 11617 - DNA, 25 bp, E. coli
ttcagagcgatattactttctggcg

SEQ ID NO: 11618 - DNA, 25 bp, E. coli
ttcagagcgataatactttctggcg

SEQ ID NO: 11619 - DNA, 25 bp, E. coli
tctgcaagagttcggtacaacggtt

SEQ ID NO: 11620 - DNA, 25 bp, E. coli
tctgcaagagttgggtacaacggtt

SEQ ID NO: 11621 - DNA, 25 bp, E. coli
gaacgactgctactcaagctgctga

SEQ ID NO: 11622 - DNA, 25 bp, E. coli
gaacgactgctagtcaagctgctga

SEQ ID NO: 11623 - DNA, 25 bp, E. coli
gaaaaagagtgtgtgaacctggtta

SEQ ID NO: 11624 - DNA, 25 bp, E. coli
gaaaaagagtgtctgaacctggtta

SEQ ID NO: 11625 - DNA, 25 bp, E. coli
cattgcctggtagcgtatccgagaa

SEQ ID NO: 11626 - DNA, 25 bp, E. coli
cattgcctggtaccgtatccgagaa

SEQ ID NO: 11627 - DNA, 25 bp, E. coli
cacagcgagaaaatgatcgcgctga

SEQ ID NO: 11628 - DNA, 25 bp, E. coli
cacagcgagaaattgatcgcgctga

SEQ ID NO: 11629 - DNA, 25 bp, E. coli
tactcatcaacctgtcaacgcttac

SEQ ID NO: 11630 - DNA, 25 bp, E. coli
tactcatcaaccagtcaacgcttac

SEQ ID NO: 11631 - DNA, 25 bp, E. coli
attgatcgcgctcaaactgatttac

SEQ ID NO: 11632 - DNA, 25 bp, E. coli
attgatcgcgctgaaactgatttac

SEQ ID NO: 11633 - DNA, 25 bp, E. coli
agcgagaaattgttcgcgctgaaac

SEQ ID NO: 11634 - DNA, 25 bp, E. coli
agcgagaaattgatcgcgctgaaac

SEQ ID NO: 11635 - DNA, 25 bp, E. coli
gcgctgaaactgttttactcatcaa

SEQ ID NO: 11636 - DNA, 25 bp, E. coli
gcgctgaaactgatttactcatcaa

SEQ ID NO: 11637 - DNA, 25 bp, E. coli
gaaactgatttagtcatcaacctgt

SEQ ID NO: 11638 - DNA, 25 bp, E. coli
gaaactgatttactcatcaacctgt

SEQ ID NO: 11639 - DNA, 25 bp, E. coli
cgagaaattgatggcgctgaaactg

SEQ ID NO: 11640 - DNA, 25 bp, E. coli
cgagaaattgatcgcgctgaaactg

SEQ ID NO: 11641 - DNA, 25 bp, E. coli
ctgtcaacgcttacccagcgcggtc

SEQ ID NO: 11642 - DNA, 25 bp, E. coli
ctgtcaacgctttcccagcgcggtc

SEQ ID NO: 11643 - DNA, 25 bp, E. coli
gatttactcatctacctgtcaacgc

SEQ ID NO: 11644 - DNA, 25 bp, E. coli
gatttactcatcaacctgtcaacgc

SEQ ID NO: 11645 - DNA, 25 bp, E. coli
gatcgcgctgaatctgatttactca

SEQ ID NO: 11646 - DNA, 25 bp, E. coli
taagcaaattgaaatgcaattctga

SEQ ID NO: 11647 - DNA, 25 bp, E. coli
taagcaaattgatatgcaattctga

SEQ ID NO: 11648 - DNA, 25 bp, E. coli
gatcgcgctgaaactgatttactca

SEQ ID NO: 11649 - DNA, 25 bp, E. coli
caccgggatatggttgccgggattt

SEQ ID NO: 11650 - DNA, 25 bp, E. coli
cagcagagccgatagttgaatcggt

SEQ ID NO: 11651 - DNA, 25 bp, E. coli
cagcagagccgaaagttgaatcggt

SEQ ID NO: 11652 - DNA, 25 bp, E. coli
caccgggatatgcttgccgggattt

SEQ ID NO: 11653 - DNA, 25 bp, E. coli
tacagaaagatggaacacaggaaga

SEQ ID NO: 11654 - DNA, 25 bp, E. coli
tacagaaagatgcaacacaggaaga

SEQ ID NO: 11655 - DNA, 25 bp, E. coli
aaatcgcgaactgcgtagggcgaag

SEQ ID NO: 11656 - DNA, 25 bp, E. coli
aaatcgcgaactccgtagggcgaag

SEQ ID NO: 11657 - DNA, 25 bp, E. coli
aacagccagcgcgagaagaaaccac

SEQ ID NO: 11658 - DNA, 25 bp, E. coli
aacagccagcgccagaagaaaccac

SEQ ID NO: 11659 - DNA, 25 bp, E. coli
ttcggtacaacatcccgcaaagttg

SEQ ID NO: 11660 - DNA, 25 bp, E. coli
ttcggtacaacaacccgcaaagttg

SEQ ID NO: 11661 - DNA, 25 bp, E. coli
tcgtttactgcaacgcgagaagatg

SEQ ID NO: 11662 - DNA, 25 bp, E. coli
tcgtttactgcatcgcgagaagatg

SEQ ID NO: 11663 - DNA, 25 bp, E. coli
gcgttaccggtagagaaagatgcaa

SEQ ID NO: 11664 - DNA, 25 bp, E. coli
gcgttaccggtacagaaagatgcaa

SEQ ID NO: 11665 - DNA, 25 bp, E. coli
gaactggctacggtgttcggtacaa

SEQ ID NO: 11666 - DNA, 25 bp, E. coli
gaactggctacgctgttcggtacaa

SEQ ID NO: 11667 - DNA, 25 bp, E. coli
gatttgtcggaagtccgggcaatga

SEQ ID NO: 11668 - DNA, 25 bp, E. coli
gatttgtcggaactccgggcaatga

SEQ ID NO: 11669 - DNA, 25 bp, E. coli
gatgatttgattttgccatcgctgc

SEQ ID NO: 11670 - DNA, 25 bp, E. coli
gatgatttgattatgccatcgctgc

SEQ ID NO: 11671 - DNA, 25 bp, E. coli
caacaacaactgatattacaggtca

SEQ ID NO: 11672 - DNA, 25 bp, E. coli
caacaacaactgttattacaggtca

SEQ ID NO: 11673 - DNA, 25 bp, E. coli
catttttagcactgatgaattcatc

SEQ ID NO: 11674 - DNA, 25 bp, E. coli
catttttagcacagatgaattcatc

SEQ ID NO: 11675 - DNA, 25 bp, E. coli
taaacaaggcgtaccattcaaccag

SEQ ID NO: 11676 - DNA, 25 bp, E. coli
taaacaaggcgttccattcaaccag

SEQ ID NO: 11677 - DNA, 25 bp, E. coli
cattcaaccagatcgccccttattt

SEQ ID NO: 11678 - DNA, 25 bp, E. coli
cattcaaccagaacgccccttattt

SEQ ID NO: 11679 - DNA, 25 bp, E. coli
aaatgacacacaagaccagctaatg

SEQ ID NO: 11680 - DNA, 25 bp, E. coli
aaatgacacacatgaccagctaatg

SEQ ID NO: 11681 - DNA, 25 bp, E. coli
tattgttcatatccctgtgttagca

SEQ ID NO: 11682 - DNA, 25 bp, E. coli
tttaaaatcaataaactccaccgat

SEQ ID NO: 11683 - DNA, 25 bp, E. coli
tttaaaatcaattaactccaccgat

SEQ ID NO: 11684 - DNA, 25 bp, E. coli
tattgttcatatgcctgtgttagca

SEQ ID NO: 11685 - DNA, 25 bp, E. coli
tccaccgattcacattaatatcagc

SEQ ID NO: 11686 - DNA, 25 bp, E. coli
tccaccgattcagattaatatcagc

SEQ ID NO: 11687 - DNA, 25 bp, E. coli
tcagcaatagaatgataggaaatca

SEQ ID NO: 11688 - DNA, 25 bp, E. coli
tcagcaatagaaagataggaaatca

SEQ ID NO: 11689 - DNA, 25 bp, E. coli
ggataatatccattcaacgcatatg

SEQ ID NO: 11690 - DNA, 25 bp, E. coli
ggaaatcaccaaatcaataacatca

SEQ ID NO: 11691 - DNA, 25 bp, E. coli
ggataatatccaatcaacgcatatg

SEQ ID NO: 11692 - DNA, 25 bp, E. coli
ggaaatcaccaattcaataacatca

SEQ ID NO: 11693 - DNA, 25 bp, E. coli
aagatagtgcagatttaccatgggc

SEQ ID NO: 11694 - DNA, 25 bp, E. coli
cagacatgggctgcggatacttcaa

SEQ ID NO: 11695 - DNA, 25 bp, E. coli
cagacatgggctccggatacttcaa

SEQ ID NO: 11696 - DNA, 25 bp, E. coli
aagatagtgcagttttaccatgggc

SEQ ID NO: 11697 - DNA, 25 bp, E. coli
taccatgggcagctgcaggtcttgc

SEQ ID NO: 11698 - DNA, 25 bp, E. coli
taccatgggcaggtgcaggtcttgc

SEQ ID NO: 11699 - DNA, 25 bp, E. coli
tataccttaagtgacgatgacaatc

SEQ ID NO: 11700 - DNA, 25 bp, E. coli
tataccttaagtcacgatgacaatc

SEQ ID NO: 11701 - DNA, 25 bp, E. coli
tattcattccctcagcaaagagcag

SEQ ID NO: 11702 - DNA, 25 bp, E. coli
tattcattccctgagcaaagagcag

SEQ ID NO: 11703 - DNA, 25 bp, E. coli
gctagaaaatttatccgcggagtgc

SEQ ID NO: 11704 - DNA, 25 bp, E. coli
gctacgggaattgctatatatacct

SEQ ID NO: 11705 - DNA, 25 bp, E. coli
gctagaaaatttttccgcggagtgc

SEQ ID NO: 11706 - DNA, 25 bp, E. coli
gctacgggaattcctatatatacct

SEQ ID NO: 11707 - DNA, 25 bp, E. coli
gatacttcaatacccgactcaaccg

SEQ ID NO: 11708 - DNA, 25 bp, E. coli
gatacttcaatagccgactcaaccg

SEQ ID NO: 11709 - DNA, 25 bp, E. coli
ggtcttgctgcagtagctacgggaa

SEQ ID NO: 11710 - DNA, 25 bp, E. coli
ggtcttgctgcactagctacgggaa

SEQ ID NO: 11711 - DNA, 25 bp, E. coli
taataactccccagttccggatgat

SEQ ID NO: 11712 - DNA, 25 bp, E. coli
taagtccagtaacataacatgtccg

SEQ ID NO: 11713 - DNA, 25 bp, E. coli
taataactcccctgttccggatgat

SEQ ID NO: 11714 - DNA, 25 bp, E. coli
taagtccagtaagataacatgtccg

SEQ ID NO: 11715 - DNA, 25 bp, E. coli
caatgatgctgattgcgcccgtggc

SEQ ID NO: 11716 - DNA, 25 bp, E. coli
caatgatgctgaatgcgcccgtggc

SEQ ID NO: 11717 - DNA, 25 bp, E. coli
taaaatcgacctgtacagagagcgg

SEQ ID NO: 11718 - DNA, 25 bp, E. coli
taaaatcgacctctacagagagcgg

SEQ ID NO: 11719 - DNA, 25 bp, E. coli
tatggtcgcagttaccttagtgctg

SEQ ID NO: 11720 - DNA, 25 bp, E. coli
tatggtcgcagtaaccttagtgctg

SEQ ID NO: 11721 - DNA, 25 bp, E. coli
tggtcgcgccggttgaacgattgcc

SEQ ID NO: 11722 - DNA, 25 bp, E. coli
tctggtggcggataacttaggtcat

SEQ ID NO: 11723 - DNA, 25 bp, E. coli
tctggtggcggaaaacttaggtcat

SEQ ID NO: 11724 - DNA, 25 bp, E. coli
gaacgattgccgattgctcagacgg

SEQ ID NO: 11725 - DNA, 25 bp, E. coli
gaacgattgccgtttgctcagacgg

SEQ ID NO: 11726 - DNA, 25 bp, E. coli
cattggcctggtcgtgatgaaaatc

SEQ ID NO: 11727 - DNA, 25 bp, E. coli
cattggcctggtggtgatgaaaatc

SEQ ID NO: 11728 - DNA, 25 bp, E. coli
gattttactctcgtcagccatgctg

SEQ ID NO: 11729 - DNA, 25 bp, E. coli
gattttactctcctcagccatgctg

SEQ ID NO: 11730 - DNA, 25 bp, E. coli
tggtcgcgccggatgaacgattgcc

SEQ ID NO: 11731 - DNA, 25 bp, E. coli
taatgggcgttcaacacgcggtggc

SEQ ID NO: 11732 - DNA, 25 bp, E. coli
taatgggcgttctacacgcggtggc

SEQ ID NO: 11733 - DNA, 25 bp, E. coli
gatgaccggacgcaatatggacccg

SEQ ID NO: 11734 - DNA, 25 bp, E. coli
gatgaccaacgttttagggctggga

SEQ ID NO: 11735 - DNA, 25 bp, E. coli
gatgaccaacgtattagggctggga

SEQ ID NO: 11736 - DNA, 25 bp, E. coli
gatgaccggacggaatatggacccg

SEQ ID NO: 11737 - DNA, 25 bp, E. coli
atgccacgaatttttgatttagtgt

SEQ ID NO: 11738 - DNA, 25 bp, E. coli
atgccacgaattattgatttagtgt

SEQ ID NO: 11739 - DNA, 25 bp, E. coli
aactttctcatctatttatctttat

SEQ ID NO: 11740 - DNA, 25 bp, E. coli
aactttctcatcaatttatctttat

SEQ ID NO: 11741 - DNA, 25 bp, E. coli
tatagagatttgttcattttttggt

SEQ ID NO: 11742 - DNA, 25 bp, E. coli
tagagatttgttcattttttggttt

SEQ ID NO: 11743 - DNA, 25 bp, E. coli
tagagatttgttgattttttggttt

SEQ ID NO: 11744 - DNA, 25 bp, E. coli
tatagagatttgatcattttttggt

SEQ ID NO: 11745 - DNA, 25 bp, E. coli
tatctttatatacagatttgttcat

SEQ ID NO: 11746 - DNA, 25 bp, E. coli
tatctttatatagagatttgttcat

SEQ ID NO: 11747 - DNA, 25 bp, E. coli
ttattctgttacgattttggcgttt

SEQ ID NO: 11748 - DNA, 25 bp, E. coli
tattcaaattaagtttctcatctat

SEQ ID NO: 11749 - DNA, 25 bp, E. coli
tattcaaattaactttctcatctat

SEQ ID NO: 11750 - DNA, 25 bp, E. coli
ttttattctgtttcgattttggcgt

SEQ ID NO: 11751 - DNA, 25 bp, E. coli
tttattctgttaggattttggcgtt

SEQ ID NO: 11752 - DNA, 25 bp, E. coli
ttattctgttaccattttggcgttt

SEQ ID NO: 11753 - DNA, 25 bp, E. coli
tttattctgttacgattttggcgtt

SEQ ID NO: 11754 - DNA, 25 bp, E. coli
ttttattctgttacgattttggcgt

SEQ ID NO: 11755 - DNA, 25 bp, E. coli
tattctgttacgtttttggcgtttt

SEQ ID NO: 11756 - DNA, 25 bp, E. coli
tattctgttacgattttggcgtttt

SEQ ID NO: 11757 - DNA, 25 bp, E. coli
tttttattctgtaacgattttggcg

SEQ ID NO: 11758 - DNA, 25 bp, E. coli
tttttattctgttacgattttggcg

SEQ ID NO: 11759 - DNA, 25 bp, E. coli
aacgctcatttacccggcgttacag

SEQ ID NO: 11760 - DNA, 25 bp, E. coli
aaatgctattcgacgcctatgaggg

SEQ ID NO: 11761 - DNA, 25 bp, E. coli
aaatgctattcgtcgcctatgaggg

SEQ ID NO: 11762 - DNA, 25 bp, E. coli
aacgctcatttagccggcgttacag

SEQ ID NO: 11763 - DNA, 25 bp, E. coli
tagatgcttattttcctcgcagggt

SEQ ID NO: 11764 - DNA, 25 bp, E. coli
tagatgcttattatcctcgcagggt

SEQ ID NO: 11765 - DNA, 25 bp, E. coli
tcgcggcgatcagcaattattcgtt

SEQ ID NO: 11766 - DNA, 25 bp, E. coli
tcgcggcgatcaccaattattcgtt

SEQ ID NO: 11767 - DNA, 25 bp, E. coli
tctttgtctgacgttatcgcggcga

SEQ ID NO: 11768 - DNA, 25 bp, E. coli
tctttgtctgaccttatcgcggcga

SEQ ID NO: 11769 - DNA, 25 bp, E. coli
gaagcaacattcagtggcctacgcc

SEQ ID NO: 11770 - DNA, 25 bp, E. coli
gaagcaacattctgtggcctacgcc

SEQ ID NO: 11771 - DNA, 25 bp, E. coli
cgcagggttctttcgcactatcaaa

SEQ ID NO: 11772 - DNA, 25 bp, E. coli
cgcagggttcttacgcactatcaaa

SEQ ID NO: 11773 - DNA, 25 bp, E. coli
gatcctcaacactaaatgctattcg

SEQ ID NO: 11774 - DNA, 25 bp, E. coli
ggcgttacagtatacgaagcaacat

SEQ ID NO: 11775 - DNA, 25 bp, E. coli
ggcctacgccgaacaaaagctctgt

SEQ ID NO: 11776 - DNA, 25 bp, E. coli
ggcgttacagtaaacgaagcaacat

SEQ ID NO: 11777 - DNA, 25 bp, E. coli
ggcctacgccgatcaaaagctctgt

SEQ ID NO: 11778 - DNA, 25 bp, E. coli
tcaaaagctctgtgaaaatttccct

SEQ ID NO: 11779 - DNA, 25 bp, E. coli
tcaaaagctctgagaaaatttccct

SEQ ID NO: 11780 - DNA, 25 bp, E. coli
gatcctcaacacaaaatgctattcg

SEQ ID NO: 11781 - DNA, 25 bp, E. coli
caatgctgcaattcaggatcgccgc

SEQ ID NO: 11782 - DNA, 25 bp, E. coli
caatgctgcaatacaggatcgccgc

SEQ ID NO: 11783 - DNA, 25 bp, E. coli
caatacccgaataggtgcgatggga

SEQ ID NO: 11784 - DNA, 25 bp, E. coli
caatacccgaattggtgcgatggga

SEQ ID NO: 11785 - DNA, 25 bp, E. coli
caaatggatgagtgacgacctgtac

SEQ ID NO: 11786 - DNA, 25 bp, E. coli
caccgggttacggtactttgcgcag

SEQ ID NO: 11787 - DNA, 25 bp, E. coli
caccgggttacgctactttgcgcag

SEQ ID NO: 11788 - DNA, 25 bp, E. coli
caaatggatgagagacgacctgtac

SEQ ID NO: 11789 - DNA, 25 bp, E. coli
accatatggcggaagtgtacctgac

SEQ ID NO: 11790 - DNA, 25 bp, E. coli
accatatggcggtagtgtacctgac

SEQ ID NO: 11791 - DNA, 25 bp, E. coli
tatgccactggcaccaatgaaggag

SEQ ID NO: 11792 - DNA, 25 bp, E. coli
tatgccactggctccaatgaaggag

SEQ ID NO: 11793 - DNA, 25 bp, E. coli
tatcacattgttgaaggcgcaaacc

SEQ ID NO: 11794 - DNA, 25 bp, E. coli
tatcacattgttcaaggcgcaaacc

SEQ ID NO: 11795 - DNA, 25 bp, E. coli
gaaccagcgatattagcagcggaga

SEQ ID NO: 11796 - DNA, 25 bp, E. coli
gaaccagcgataatagcagcggaga

SEQ ID NO: 11797 - DNA, 25 bp, E. coli
cgcagtatccaagagcaccgggtta

SEQ ID NO: 11798 - DNA, 25 bp, E. coli
cgcagtatccaacagcaccgggtta

SEQ ID NO: 11799 - DNA, 25 bp, E. coli
cgtcaggcctggcagtattaccaca

SEQ ID NO: 11800 - DNA, 25 bp, E. coli
cgtcaggcctgggagtattaccaca

SEQ ID NO: 11801 - DNA, 25 bp, E. coli
gatcgccgcatctaggccatcggta

SEQ ID NO: 11802 - DNA, 25 bp, E. coli
gatcgccgcatcaaggccatcggta

SEQ ID NO: 11803 - DNA, 25 bp, E. coli
catgcgcgacatgctcaaggctggt

SEQ ID NO: 11804 - DNA, 25 bp, E. coli
catgcgcgacatcctcaaggctggt

SEQ ID NO: 11805 - DNA, 25 bp, E. coli
tactaaacgcgcagcaagcgaagcg

SEQ ID NO: 11806 - DNA, 25 bp, E. coli
tactaaacgcgctgcaagcgaagcg

SEQ ID NO: 11807 - DNA, 25 bp, E. coli
tatcaaagaagcaaacaacctgggt

SEQ ID NO: 11808 - DNA, 25 bp, E. coli
tatcaaagacatcggcggtctgccg

SEQ ID NO: 11809 - DNA, 25 bp, E. coli
tatcaaagaagctaacaacctgggt

SEQ ID NO: 11810 - DNA, 25 bp, E. coli
tatcaaagacatgggcggtctgccg

SEQ ID NO: 11811 - DNA, 25 bp, E. coli
ttgctgcaaccgtacgtgaaggccg

SEQ ID NO: 11812 - DNA, 25 bp, E. coli
ttgctgcaaccgaacgtgaaggccg

SEQ ID NO: 11813 - DNA, 25 bp, E. coli
tctcaggacggttctttcgacaagc

SEQ ID NO: 11814 - DNA, 25 bp, E. coli
tctcaggacggtactttcgacaagc

SEQ ID NO: 11815 - DNA, 25 bp, E. coli
tcttcgtgaaccttcgctggctggg

SEQ ID NO: 11816 - DNA, 25 bp, E. coli
tcttcggtgcgcctaacaaagttca

SEQ ID NO: 11817 - DNA, 25 bp, E. coli
tcttcgtgaaccatcgctggctggg

SEQ ID NO: 11818 - DNA, 25 bp, E. coli
tcttcggtgcgcgtaacaaagttca

SEQ ID NO: 11819 - DNA, 25 bp, E. coli
gaagctctggctgaactgaacaaga

SEQ ID NO: 11820 - DNA, 25 bp, E. coli
gaagctctggctcaactgaacaaga

SEQ ID NO: 11821 - DNA, 25 bp, E. coli
gataccaactctgatccggacggtg

SEQ ID NO: 11822 - DNA, 25 bp, E. coli
gataccaactctcatccggacggtg

SEQ ID NO: 11823 - DNA, 25 bp, E. coli
taacgacgacgcaatccgtgctgtg

SEQ ID NO: 11824 - DNA, 25 bp, E. coli
taacgacgacgctatccgtgctgtg

SEQ ID NO: 11825 - DNA, 25 bp, E. coli
caactggcggatgatcagtttgcca

SEQ ID NO: 11826 - DNA, 25 bp, E. coli
caaggtttgtgaatgtgttgccgga

SEQ ID NO: 11827 - DNA, 25 bp, E. coli
caaggtttgtgattgtgttgccgga

SEQ ID NO: 11828 - DNA, 25 bp, E. coli
cacggttgcggtaacgtcaaatgcg

SEQ ID NO: 11829 - DNA, 25 bp, E. coli
caactggcggatcatcagtttgcca

SEQ ID NO: 11830 - DNA, 25 bp, E. coli
cacggttgcggttacgtcaaatgcg

SEQ ID NO: 11831 - DNA, 25 bp, E. coli
agtttgccagttcgcccactggttg

SEQ ID NO: 11832 - DNA, 25 bp, E. coli
agtttgccagttggcccactggttg

SEQ ID NO: 11833 - DNA, 25 bp, E. coli
tgcgcgcgatgccatacccgataaa

SEQ ID NO: 11834 - DNA, 25 bp, E. coli
tacgccacccggtgaggctattgta

SEQ ID NO: 11835 - DNA, 25 bp, E. coli
tgcgcgcgatgcgatacccgataaa

SEQ ID NO: 11836 - DNA, 25 bp, E. coli
tacgccacccggagaggctattgta

SEQ ID NO: 11837 - DNA, 25 bp, E. coli
cctgatatccgcgagtttgcgcgcg

SEQ ID NO: 11838 - DNA, 25 bp, E. coli
cctgatatccgccagtttgcgcgcg

SEQ ID NO: 11839 - DNA, 25 bp, E. coli
gttacgtcaaatccgcgggggacaa

SEQ ID NO: 11840 - DNA, 25 bp, E. coli
gttacgtcaaatgcgcgggggacaa

SEQ ID NO: 11841 - DNA, 25 bp, E. coli
ggctattgtagtccgctgccagacg

SEQ ID NO: 11842 - DNA, 25 bp, E. coli
ggctattgtagtgcgctgccagacg

SEQ ID NO: 11843 - DNA, 25 bp, E. coli
gatgatcagtttgccagttggccca

SEQ ID NO: 11844 - DNA, 25 bp, E. coli
gagtttgcgcgccatgccatacccg

SEQ ID NO: 11845 - DNA, 25 bp, E. coli
gagtttgcgcgcgatgccatacccg

SEQ ID NO: 11846 - DNA, 25 bp, E. coli
gatgatcagtttcccagttggccca

SEQ ID NO: 11847 - DNA, 25 bp, E. coli
aagccaggcaaggtagcgctcttgg

SEQ ID NO: 11848 - DNA, 25 bp, E. coli
aagccaggcaagctagcgctcttgg

SEQ ID NO: 11849 - DNA, 25 bp, E. coli
caaaagccaggctaggtagcgctct

SEQ ID NO: 11850 - DNA, 25 bp, E. coli
caaaagccaggcaaggtagcgctct

SEQ ID NO: 11851 - DNA, 25 bp, E. coli
caggcaaggtagggctcttgggatt

SEQ ID NO: 11852 - DNA, 25 bp, E. coli
caggcaaggtagcgctcttgggatt

SEQ ID NO: 11853 - DNA, 25 bp, E. coli
agccaggcaaggtagcgctcttggg

SEQ ID NO: 11854 - DNA, 25 bp, E. coli
agccaggcaaggaagcgctcttggg

SEQ ID NO: 11855 - DNA, 25 bp, E. coli
aaagccaggcaaggtagcgctcttg

SEQ ID NO: 11856 - DNA, 25 bp, E. coli
aaaagccaggcaaggtagcgctctt

SEQ ID NO: 11857 - DNA, 25 bp, E. coli
aaagccaggcaacgtagcgctcttg

SEQ ID NO: 11858 - DNA, 25 bp, E. coli
aaaagccaggcatggtagcgctctt

SEQ ID NO: 11859 - DNA, 25 bp, E. coli
ttccaaaagccacgcaaggtagcgc

SEQ ID NO: 11860 - DNA, 25 bp, E. coli
tttccaaaagccaggcaaggtagcg

SEQ ID NO: 11861 - DNA, 25 bp, E. coli
tttccaaaagcctggcaaggtagcg

SEQ ID NO: 11862 - DNA, 25 bp, E. coli
ttccaaaagccaggcaaggtagcgc

SEQ ID NO: 11863 - DNA, 25 bp, E. coli
ccaaaagccaggcaaggtagcgctc

SEQ ID NO: 11864 - DNA, 25 bp, E. coli
ccaggcaaggtaccgctcttgggat

SEQ ID NO: 11865 - DNA, 25 bp, E. coli
ccaggcaaggtagcgctcttgggat

SEQ ID NO: 11866 - DNA, 25 bp, E. coli
ccaaaagccagggaaggtagcgctc

SEQ ID NO: 11867 - DNA, 25 bp, E. coli
ctttccaaaagccaggcaaggtagc

SEQ ID NO: 11868 - DNA, 25 bp, E. coli
ctttccaaaagcgaggcaaggtagc

SEQ ID NO: 11869 - DNA, 25 bp, E. coli
aggaaagccggaaacacgaagctgg

SEQ ID NO: 11870 - DNA, 25 bp, E. coli
aggaaagccggatacacgaagctgg

SEQ ID NO: 11871 - DNA, 25 bp, E. coli
agacgctggagctggtgttcaccgc

SEQ ID NO: 11872 - DNA, 25 bp, E. coli
agacgctggagcaggtgttcaccgc

SEQ ID NO: 11873 - DNA, 25 bp, E. coli
taccctgctgacacagggcggcaga

SEQ ID NO: 11874 - DNA, 25 bp, E. coli
taccctgctgactcagggcggcaga

SEQ ID NO: 11875 - DNA, 25 bp, E. coli
tgaccaacaatctgttcgggctggg

SEQ ID NO: 11876 - DNA, 25 bp, E. coli
tgaccaacaatcagttcgggctggg

SEQ ID NO: 11877 - DNA, 25 bp, E. coli
ccgttcctgatgctgtggcgatgac

SEQ ID NO: 11878 - DNA, 25 bp, E. coli
ccgttcctgatggtgtggcgatgac

SEQ ID NO: 11879 - DNA, 25 bp, E. coli
gctcccgttcctcatggtgtggcga

SEQ ID NO: 11880 - DNA, 25 bp, E. coli
gcatcacaggaatgccggaaacacg

SEQ ID NO: 11881 - DNA, 25 bp, E. coli
gctcccgttcctgatggtgtggcga

SEQ ID NO: 11882 - DNA, 25 bp, E. coli
gcatcacaggaaagccggaaacacg

SEQ ID NO: 11883 - DNA, 25 bp, E. coli
gaatctgatgcaacacaggaaagcc

SEQ ID NO: 11884 - DNA, 25 bp, E. coli
gaatctgatgcatcacaggaaagcc

SEQ ID NO: 11885 - DNA, 25 bp, E. coli
ccggtaatccgttcctgatgtcgta

SEQ ID NO: 11886 - DNA, 25 bp, E. coli
ccggtaatccgtacctgatgtcgta

SEQ ID NO: 11887 - DNA, 25 bp, E. coli
gtggatgacgcaattaccctgctga

SEQ ID NO: 11888 - DNA, 25 bp, E. coli
gtggatgacgcatttaccctgctga

SEQ ID NO: 11889 - DNA, 25 bp, E. coli
tggcgatgacgggtaccggtaatcc

SEQ ID NO: 11890 - DNA, 25 bp, E. coli
tggcgatgacggctaccggtaatcc

SEQ ID NO: 11891 - DNA, 25 bp, E. coli
tatgatctgattagtaaggcatccg

SEQ ID NO: 11892 - DNA, 25 bp, E. coli
tatgatctgatttgtaaggcatccg

SEQ ID NO: 11893 - DNA, 25 bp, E. coli
tataacgttggatttggcgctaaga

SEQ ID NO: 11894 - DNA, 25 bp, E. coli
tatcatgtcccggttttacagcacg

SEQ ID NO: 11895 - DNA, 25 bp, E. coli
tatcatgtcccgcttttacagcacg

SEQ ID NO: 11896 - DNA, 25 bp, E. coli
tataacgttggaattggcgctaaga

SEQ ID NO: 11897 - DNA, 25 bp, E. coli
tttattcctgaggtggccacaaacg

SEQ ID NO: 11898 - DNA, 25 bp, E. coli
tttattcctgagctggccacaaacg

SEQ ID NO: 11899 - DNA, 25 bp, E. coli
tgacactgaaggtcaaaatcccgct

SEQ ID NO: 11900 - DNA, 25 bp, E. coli
tgaagaagagctgaacctgacactg

SEQ ID NO: 11901 - DNA, 25 bp, E. coli
tgacactgaaggacaaaatcccgct

SEQ ID NO: 11902 - DNA, 25 bp, E. coli
tgaagaagagctcaacctgacactg

SEQ ID NO: 11903 - DNA, 25 bp, E. coli
gaacttgaagtcatctaccgcaacg

SEQ ID NO: 11904 - DNA, 25 bp, E. coli
gaaaaactttgcgacctatgatctg

SEQ ID NO: 11905 - DNA, 25 bp, E. coli
gaacttgaagtcttctaccgcaacg

SEQ ID NO: 11906 - DNA, 25 bp, E. coli
gaaaaactttgccacctatgatctg

SEQ ID NO: 11907 - DNA, 25 bp, E. coli
cggtcatcagcatacagatcttcgg

SEQ ID NO: 11908 - DNA, 25 bp, E. coli
cggtcatcagcaaacagatcttcgg

SEQ ID NO: 11909 - DNA, 25 bp, E. coli
taatcgcccgacatggttataacgt

SEQ ID NO: 11910 - DNA, 25 bp, E. coli
taatcgcccgacttggttataacgt

SEQ ID NO: 11911 - DNA, 25 bp, E. coli
gatcttcggaagtaactggtacgca

SEQ ID NO: 11912 - DNA, 25 bp, E. coli
gatcttcggaagaaactggtacgca

SEQ ID NO: 11913 - DNA, 25 bp, E. coli
aagacccgttcttaagccatcctgg

SEQ ID NO: 11914 - DNA, 25 bp, E. coli
aagacccgttctaaagccatcctgg

SEQ ID NO: 11915 - DNA, 25 bp, E. coli
tttgcgtcatcgacgtggtctcccg

SEQ ID NO: 11916 - DNA, 25 bp, E. coli
tttgcgtcatcgtcgtggtctcccg

SEQ ID NO: 11917 - DNA, 25 bp, E. coli
tgatggatcttggttgctatcgcgg

SEQ ID NO: 11918 - DNA, 25 bp, E. coli
tgatggatcttgcttgctatcgcgg

SEQ ID NO: 11919 - DNA, 25 bp, E. coli
tcgttgaaggtgttctgcgccgtga

SEQ ID NO: 11920 - DNA, 25 bp, E. coli
tcgttgaaggtgatctgcgccgtga

SEQ ID NO: 11921 - DNA, 25 bp, E. coli
tctgaaggacaaatcgacacgctgc

SEQ ID NO: 11922 - DNA, 25 bp, E. coli
tctgaaggacaattcgacacgctgc

SEQ ID NO: 11923 - DNA, 25 bp, E. coli
gctgcgtgacgaagttgccaaattt

SEQ ID NO: 11924 - DNA, 25 bp, E. coli
gctgcgtgacgatgttgccaaattt

SEQ ID NO: 11925 - DNA, 25 bp, E. coli
gaaatcagcatgtgcatcaagcgcc

SEQ ID NO: 11926 - DNA, 25 bp, E. coli
gaaatcagcatgagcatcaagcgcc

SEQ ID NO: 11927 - DNA, 25 bp, E. coli
cattcctgatcataagcatgccgta

SEQ ID NO: 11928 - DNA, 25 bp, E. coli
cattcctgatcaaaagcatgccgta

SEQ ID NO: 11929 - DNA, 25 bp, E. coli
gatttatggcgtgggcaagacccgt

SEQ ID NO: 11930 - DNA, 25 bp, E. coli
gatttatggcgtcggcaagacccgt

SEQ ID NO: 11931 - DNA, 25 bp, E. coli
gggtccgcgcaaaccgatcaagaaa

SEQ ID NO: 11932 - DNA, 25 bp, E. coli
gtggcccgtataccaggcattaaca

SEQ ID NO: 11933 - DNA, 25 bp, E. coli
gtggcccgtatagcaggcattaaca

SEQ ID NO: 11934 - DNA, 25 bp, E. coli
gggtccgcgcaatccgatcaagaaa

SEQ ID NO: 11935 - DNA, 25 bp, E. coli
aaaactggaacaggcggtgccgatg

SEQ ID NO: 11936 - DNA, 25 bp, E. coli
aaaactggaacacgcggtgccgatg

SEQ ID NO: 11937 - DNA, 25 bp, E. coli
taccgtgactacctggcgctgaaaa

SEQ ID NO: 11938 - DNA, 25 bp, E. coli
taccgtgactacgtggcgctgaaaa

SEQ ID NO: 11939 - DNA, 25 bp, E. coli
tgaaagctgctaccgaagggactat

SEQ ID NO: 11940 - DNA, 25 bp, E. coli
tgctatcgccaatgaagtgcctgaa

SEQ ID NO: 11941 - DNA, 25 bp, E. coli
tgaaagctgctagcgaagggactat

SEQ ID NO: 11942 - DNA, 25 bp, E. coli
tgctatcgccaaagaagtgcctgaa

SEQ ID NO: 11943 - DNA, 25 bp, E. coli
tctggaagtgacactgcgtaccgag

SEQ ID NO: 11944 - DNA, 25 bp, E. coli
tccacagcagctggcagaagtcact

SEQ ID NO: 11945 - DNA, 25 bp, E. coli
tccacagcagctcgcagaagtcact

SEQ ID NO: 11946 - DNA, 25 bp, E. coli
tgccggtacggtcctgaatccacag

SEQ ID NO: 11947 - DNA, 25 bp, E. coli
tgccggtacggtgctgaatccacag

SEQ ID NO: 11948 - DNA, 25 bp, E. coli
tctggaagtgactctgcgtaccgag

SEQ ID NO: 11949 - DNA, 25 bp, E. coli
tcttcccggctgaagctaacggcgg

SEQ ID NO: 11950 - DNA, 25 bp, E. coli
tcttcccggctgtagctaacggcgg

SEQ ID NO: 11951 - DNA, 25 bp, E. coli
cgaactgatgctcggtatggactac

SEQ ID NO: 11952 - DNA, 25 bp, E. coli
cgaactgatgctgggtatggactac

SEQ ID NO: 11953 - DNA, 25 bp, E. coli
cgcgtgaagctgaagaaggcgctaa

SEQ ID NO: 11954 - DNA, 25 bp, E. coli
cgcgtgaagctgtagaaggcgctaa

SEQ ID NO: 11955 - DNA, 25 bp, E. coli
gattacgaccgcattactaagctgg

SEQ ID NO: 11956 - DNA, 25 bp, E. coli
gattacgaccgctttactaagctgg

SEQ ID NO: 11957 - DNA, 25 bp, E. coli
catcaaaccgttcagcgctgaagtt

SEQ ID NO: 11958 - DNA, 25 bp, E. coli
catcaaaccgttgagcgctgaagtt

SEQ ID NO: 11959 - DNA, 25 bp, E. coli
tacacttgctgttgccgcggagtct

SEQ ID NO: 11960 - DNA, 25 bp, E. coli
tacacttgctgtagccgcggagtct

SEQ ID NO: 11961 - DNA, 25 bp, E. coli
tcgtatctggatcatcgtcctccca

SEQ ID NO: 11962 - DNA, 25 bp, E. coli
tcttttactgcgagcccttcgccag

SEQ ID NO: 11963 - DNA, 25 bp, E. coli
tcttttactgcgtgcccttcgccag

SEQ ID NO: 11964 - DNA, 25 bp, E. coli
tcgtatctggatgatcgtcctccca

SEQ ID NO: 11965 - DNA, 25 bp, E. coli
gccaggccgggcataaattcacgga

SEQ ID NO: 11966 - DNA, 25 bp, E. coli
ccacagatgctggaggcgttaaacg

SEQ ID NO: 11967 - DNA, 25 bp, E. coli
gccaggccgggcttaaattcacgga

SEQ ID NO: 11968 - DNA, 25 bp, E. coli
ccacagatgctgcaggcgttaaacg

SEQ ID NO: 11969 - DNA, 25 bp, E. coli
ggatattcagcccacttacctgacg

SEQ ID NO: 11970 - DNA, 25 bp, E. coli
ggatattcagccgacttacctgacg

SEQ ID NO: 11971 - DNA, 25 bp, E. coli
ggcgggtttactaagcgtctctaca

SEQ ID NO: 11972 - DNA, 25 bp, E. coli
ggcaccggttattgcctcgtatctg

SEQ ID NO: 11973 - DNA, 25 bp, E. coli
ggcgggtttacttagcgtctctaca

SEQ ID NO: 11974 - DNA, 25 bp, E. coli
ggcaccggttatagcctcgtatctg

SEQ ID NO: 11975 - DNA, 25 bp, E. coli
gagtcttcgccacaggcgttacgta

SEQ ID NO: 11976 - DNA, 25 bp, E. coli
gagcgctgaagttgccgccttacag

SEQ ID NO: 11977 - DNA, 25 bp, E. coli
gagcgctgaagtagccgccttacag

SEQ ID NO: 11978 - DNA, 25 bp, E. coli
gagtcttcgccagaggcgttacgta

SEQ ID NO: 11979 - DNA, 25 bp, E. coli
aattacccggcgttggcgcaggatc

SEQ ID NO: 11980 - DNA, 25 bp, E. coli
aattacccggcgatggcgcaggatc

SEQ ID NO: 11981 - DNA, 25 bp, E. coli
catgtgattgcaggcgcgggtcact

SEQ ID NO: 11982 - DNA, 25 bp, E. coli
catgtgattgcacgcgcgggtcact

SEQ ID NO: 11983 - DNA, 25 bp, E. coli
tactggctcgcgttctggtaaacga

SEQ ID NO: 11984 - DNA, 25 bp, E. coli
tactggctcgcgatctggtaaacga

SEQ ID NO: 11985 - DNA, 25 bp, E. coli
aaaccggatgcgctattacgcgcta

SEQ ID NO: 11986 - DNA, 25 bp, E. coli
aaaccggatgcggtattacgcgcta

SEQ ID NO: 11987 - DNA, 25 bp, E. coli
tttggcagcctccacaaccttggcg

SEQ ID NO: 11988 - DNA, 25 bp, E. coli
tttggcagcctcgacaaccttggcg

SEQ ID NO: 11989 - DNA, 25 bp, E. coli
tgaaattgaataaccgcgcgcaaac

SEQ ID NO: 11990 - DNA, 25 bp, E. coli
tgaaattgaatatccgcgcgcaaac

SEQ ID NO: 11991 - DNA, 25 bp, E. coli
tccaggttgataagcgtaaccacgg

SEQ ID NO: 11992 - DNA, 25 bp, E. coli
tccaggttgatatgcgtaaccacgg

SEQ ID NO: 11993 - DNA, 25 bp, E. coli
tgcgccagcatcataatgaagaagg

SEQ ID NO: 11994 - DNA, 25 bp, E. coli
tgcgccagcatcttaatgaagaagg

SEQ ID NO: 11995 - DNA, 25 bp, E. coli
cgtatgttagcgtgcagtaccgtga

SEQ ID NO: 11996 - DNA, 25 bp, E. coli
cgtatgttagcgagcagtaccgtga

SEQ ID NO: 11997 - DNA, 25 bp, E. coli
tggatgcacagcagatcgacaaagc

SEQ ID NO: 11998 - DNA, 25 bp, E. coli
tggatgcacagctgatcgacaaagc

SEQ ID NO: 11999 - DNA, 25 bp, E. coli
taaccacggtctatcaccgagagat

SEQ ID NO: 12000 - DNA, 25 bp, E. coli
taaccacggtctttcaccgagagat

SEQ ID NO: 12001 - DNA, 25 bp, E. coli
caggactttcttatgattacacatt

SEQ ID NO: 12002 - DNA, 25 bp, E. coli
caggactttcttttgattacacatt

SEQ ID NO: 12003 - DNA, 25 bp, E. coli
tgagacaggactttcttatgattac

SEQ ID NO: 12004 - DNA, 25 bp, E. coli
tgagacaggactatcttatgattac

SEQ ID NO: 12005 - DNA, 25 bp, E. coli
tgccgacctgcaagattttcattcc

SEQ ID NO: 12006 - DNA, 25 bp, E. coli
tgccgacctgcatgattttcattcc

SEQ ID NO: 12007 - DNA, 25 bp, E. coli
gcgtgccgacctccatgattttcat

SEQ ID NO: 12008 - DNA, 25 bp, E. coli
gcgtgccgacctgcatgattttcat

SEQ ID NO: 12009 - DNA, 25 bp, E. coli
gacaggactttcatatgattacaca

SEQ ID NO: 12010 - DNA, 25 bp, E. coli
gacaggactttcttatgattacaca

SEQ ID NO: 12011 - DNA, 25 bp, E. coli
cgacctgcatgattttcattcccag

SEQ ID NO: 12012 - DNA, 25 bp, E. coli
cgcgtgccgaccagcatgattttca

SEQ ID NO: 12013 - DNA, 25 bp, E. coli
cgcgtgccgacctgcatgattttca

SEQ ID NO: 12014 - DNA, 25 bp, E. coli
cgacctgcatgaatttcattcccag

SEQ ID NO: 12015 - DNA, 25 bp, E. coli
cgtgccgacctggatgattttcatt

SEQ ID NO: 12016 - DNA, 25 bp, E. coli
cgtgccgacctgcatgattttcatt

SEQ ID NO: 12017 - DNA, 25 bp, E. coli
ggactttcttatgattacacatttc

SEQ ID NO: 12018 - DNA, 25 bp, E. coli
ggactttcttatcattacacatttc

SEQ ID NO: 12019 - DNA, 25 bp, E. coli
gagacaggacttacttatgattaca

SEQ ID NO: 12020 - DNA, 25 bp, E. coli
gacctgcatgatattcattcccagc

SEQ ID NO: 12021 - DNA, 25 bp, E. coli
gagacaggactttcttatgattaca

SEQ ID NO: 12022 - DNA, 25 bp, E. coli
gacctgcatgattttcattcccagc

SEQ ID NO: 12023 - DNA, 25 bp, E. coli
tacgcgtaacggtaatcagctccgc

SEQ ID NO: 12024 - DNA, 25 bp, E. coli
attaaatatcactttacccgccggg

SEQ ID NO: 12025 - DNA, 25 bp, E. coli
attaaatatcacattacccgccggg

SEQ ID NO: 12026 - DNA, 25 bp, E. coli
aaagaagcctcggtgaccgtacaga

SEQ ID NO: 12027 - DNA, 25 bp, E. coli
aaagaagcctcgctgaccgtacaga

SEQ ID NO: 12028 - DNA, 25 bp, E. coli
tatcgcccggcacgtttaaagggtg

SEQ ID NO: 12029 - DNA, 25 bp, E. coli
tatcgcccggcaggtttaaagggtg

SEQ ID NO: 12030 - DNA, 25 bp, E. coli
tacgcgtaacggaaatcagctccgc

SEQ ID NO: 12031 - DNA, 25 bp, E. coli
tattgtgaatattacgcccggcctg

SEQ ID NO: 12032 - DNA, 25 bp, E. coli
tattgtgaatataacgcccggcctg

SEQ ID NO: 12033 - DNA, 25 bp, E. coli
ttcacagtcagtactggcgggtggc

SEQ ID NO: 12034 - DNA, 25 bp, E. coli
ttcacagtcagttctggcgggtggc

SEQ ID NO: 12035 - DNA, 25 bp, E. coli
tgaaaaagcaggcatggtacccgct

SEQ ID NO: 12036 - DNA, 25 bp, E. coli
tgaaaaagcagggatggtacccgct

SEQ ID NO: 12037 - DNA, 25 bp, E. coli
tccatctaaaagtgacgacagcgaa

SEQ ID NO: 12038 - DNA, 25 bp, E. coli
tccatctaaaagagacgacagcgaa

SEQ ID NO: 12039 - DNA, 25 bp, E. coli
gaagagtttcttttccaatcctggg

SEQ ID NO: 12040 - DNA, 25 bp, E. coli
gaagagtttcttatccaatcctggg

SEQ ID NO: 12041 - DNA, 25 bp, E. coli
gtgatgtaaaaaccgcgccaaatga

SEQ ID NO: 12042 - DNA, 25 bp, E. coli
gtgatgtaaaaagcgcgccaaatga

SEQ ID NO: 12043 - DNA, 25 bp, E. coli
gatcgcgaatcggtctactgggtta

SEQ ID NO: 12044 - DNA, 25 bp, E. coli
gatcgcgaatcgctctactgggtta

SEQ ID NO: 12045 - DNA, 25 bp, E. coli
catggtcgcccaatgctgccggatt

SEQ ID NO: 12046 - DNA, 25 bp, E. coli
catggtcgcccattgctgccggatt

SEQ ID NO: 12047 - DNA, 25 bp, E. coli
tacatggtcgcccattgctgccgga

SEQ ID NO: 12048 - DNA, 25 bp, E. coli
taactatgaggaagttacatggtcg

SEQ ID NO: 12049 - DNA, 25 bp, E. coli
tacatggtcgccgattgctgccgga

SEQ ID NO: 12050 - DNA, 25 bp, E. coli
aggatgttacatggtcgcccattgc

SEQ ID NO: 12051 - DNA, 25 bp, E. coli
actatgaggatgttacatggtcgcc

SEQ ID NO: 12052 - DNA, 25 bp, E. coli
atggtcgcccatagctgccggattt

SEQ ID NO: 12053 - DNA, 25 bp, E. coli
atggtcgcccattgctgccggattt

SEQ ID NO: 12054 - DNA, 25 bp, E. coli
aggatgttacatcgtcgcccattgc

SEQ ID NO: 12055 - DNA, 25 bp, E. coli
actatgaggatgatacatggtcgcc

SEQ ID NO: 12056 - DNA, 25 bp, E. coli
tatgaggatgtttcatggtcgccca

SEQ ID NO: 12057 - DNA, 25 bp, E. coli
tatgaggatgttacatggtcgccca

SEQ ID NO: 12058 - DNA, 25 bp, E. coli
tgttgggggagaggttcatggcgtt

SEQ ID NO: 12059 - DNA, 25 bp, E. coli
tgttgggggagacgttcatggcgtt

SEQ ID NO: 12060 - DNA, 25 bp, E. coli
ggcaaataactaagaggatgttaca

SEQ ID NO: 12061 - DNA, 25 bp, E. coli
ggcaaataactatgaggatgttaca

SEQ ID NO: 12062 - DNA, 25 bp, E. coli
taactatgaggatgttacatggtcg

SEQ ID NO: 12063 - DNA, 25 bp, E. coli
gatgttacatggacgcccattgctg

SEQ ID NO: 12064 - DNA, 25 bp, E. coli
gatgttacatggtcgcccattgctg

SEQ ID NO: 12065 - DNA, 25 bp, E. coli
gaggatgttacatggtcgcccattg

SEQ ID NO: 12066 - DNA, 25 bp, E. coli
gaggatgttacaaggtcgcccattg

SEQ ID NO: 12067 - DNA, 25 bp, E. coli
taaaaaaggatactgacgtatgcgc

SEQ ID NO: 12068 - DNA, 25 bp, E. coli
tacggattatccagaaatgcgtttc

SEQ ID NO: 12069 - DNA, 25 bp, E. coli
tacggattatcctgaaatgcgtttc

SEQ ID NO: 12070 - DNA, 25 bp, E. coli
taaaaaaggatagtgacgtatgcgc

SEQ ID NO: 12071 - DNA, 25 bp, E. coli
tgttgcgctcaggtgaatcgcgcca

SEQ ID NO: 12072 - DNA, 25 bp, E. coli
tgttgcgctcagctgaatcgcgcca

SEQ ID NO: 12073 - DNA, 25 bp, E. coli
tgcgtaaaatgagcgccagattaaa

SEQ ID NO: 12074 - DNA, 25 bp, E. coli
tgcgtaaaatgaccgccagattaaa

SEQ ID NO: 12075 - DNA, 25 bp, E. coli
tcgcgccagcaatttacggattatc

SEQ ID NO: 12076 - DNA, 25 bp, E. coli
tcgcgccagcaaattacggattatc

SEQ ID NO: 12077 - DNA, 25 bp, E. coli
ccagattaaaaatggatagtgacgt

SEQ ID NO: 12078 - DNA, 25 bp, E. coli
ccagattaaaaaaggatagtgacgt

SEQ ID NO: 12079 - DNA, 25 bp, E. coli
gaaatgcgtttcacacttgcccgac

SEQ ID NO: 12080 - DNA, 25 bp, E. coli
gacatatgcgtataatgagcgccag

SEQ ID NO: 12081 - DNA, 25 bp, E. coli
gaaatgcgtttctcacttgcccgac

SEQ ID NO: 12082 - DNA, 25 bp, E. coli
gacatatgcgtaaaatgagcgccag

SEQ ID NO: 12083 - DNA, 25 bp, E. coli
ggatagtgacgtatgcgcattcata

SEQ ID NO: 12084 - DNA, 25 bp, E. coli
ggtgaatcgcgccagcaaattacgg

SEQ ID NO: 12085 - DNA, 25 bp, E. coli
ggtgaatcgcgcgagcaaattacgg

SEQ ID NO: 12086 - DNA, 25 bp, E. coli
ggatagtgacgtttgcgcattcata

SEQ ID NO: 12087 - DNA, 25 bp, E. coli
tcacttgcccgagatatgcgtaaaa

SEQ ID NO: 12088 - DNA, 25 bp, E. coli
tcacttgcccgacatatgcgtaaaa

SEQ ID NO: 12089 - DNA, 25 bp, E. coli
ctaacggtccggacagcaaaatgca

SEQ ID NO: 12090 - DNA, 25 bp, E. coli
ctaacggtccggtcagcaaaatgca

SEQ ID NO: 12091 - DNA, 25 bp, E. coli
aggccgatgccgtgcacgtttaccg

SEQ ID NO: 12092 - DNA, 25 bp, E. coli
aggccgatgccgagcacgtttaccg

SEQ ID NO: 12093 - DNA, 25 bp, E. coli
tttaccgcgcagtagtagcacgtct

SEQ ID NO: 12094 - DNA, 25 bp, E. coli
tttaccgcgcagaagtagcacgtct

SEQ ID NO: 12095 - DNA, 25 bp, E. coli
tgcattctggtccatgactccagcg

SEQ ID NO: 12096 - DNA, 25 bp, E. coli
tgcattctggtcgatgactccagcg

SEQ ID NO: 12097 - DNA, 25 bp, E. coli
tcgcaggagcgatcgaattgctggc

SEQ ID NO: 12098 - DNA, 25 bp, E. coli
tcgcaggagcgaacgaattgctggc

SEQ ID NO: 12099 - DNA, 25 bp, E. coli
tcatcagtaaagtacagggcgtgac

SEQ ID NO: 12100 - DNA, 25 bp, E. coli
tcatcagtaaagaacagggcgtgac

SEQ ID NO: 12101 - DNA, 25 bp, E. coli
gcgcctatgtcaggatgttcaggga

SEQ ID NO: 12102 - DNA, 25 bp, E. coli
gcgcctatgtcacgatgttcaggga

SEQ ID NO: 12103 - DNA, 25 bp, E. coli
cgttggaagcccgatccggcattaa

SEQ ID NO: 12104 - DNA, 25 bp, E. coli
cgttggaagccccatccggcattaa

SEQ ID NO: 12105 - DNA, 25 bp, E. coli
cattaacgtgccgatgtgcgtcgtc

SEQ ID NO: 12106 - DNA, 25 bp, E. coli
cattaacgtgcccatgtgcgtcgtc

SEQ ID NO: 12107 - DNA, 25 bp, E. coli
gtagcacgtctgtttgataccgaac

SEQ ID NO: 12108 - DNA, 25 bp, E. coli
gataccgaacttgaggacatcgcag

SEQ ID NO: 12109 - DNA, 25 bp, E. coli
gataccgaacttcaggacatcgcag

SEQ ID NO: 12110 - DNA, 25 bp, E. coli
gtagcacgtctgattgataccgaac

SEQ ID NO: 12111 - DNA, 25 bp, E. coli
acaagcgtgtcgcagtacggcagat

SEQ ID NO: 12112 - DNA, 25 bp, E. coli
acaagcgtgtcggagtacggcagat

SEQ ID NO: 12113 - DNA, 25 bp, E. coli
taccggaagcaatactgccgttcgt

SEQ ID NO: 12114 - DNA, 25 bp, E. coli
taccggaagcaaaactgccgttcgt

SEQ ID NO: 12115 - DNA, 25 bp, E. coli
ttaccgaaatgcactggaccgtgcc

SEQ ID NO: 12116 - DNA, 25 bp, E. coli
ttaccgaaatgctctggaccgtgcc

SEQ ID NO: 12117 - DNA, 25 bp, E. coli
tgccggacggtacaactgaggttat

SEQ ID NO: 12118 - DNA, 25 bp, E. coli
tgccggacggtagaactgaggttat

SEQ ID NO: 12119 - DNA, 25 bp, E. coli
tcagcgagtgggattttaccgaaat

SEQ ID NO: 12120 - DNA, 25 bp, E. coli
tcagcgagtgggtttttaccgaaat

SEQ ID NO: 12121 - DNA, 25 bp, E. coli
gaaggtggcaattttccggcccata

SEQ ID NO: 12122 - DNA, 25 bp, E. coli
gaagtgaaacagcaaacaagcgtgt

SEQ ID NO: 12123 - DNA, 25 bp, E. coli
gaacacagcaaatcgaaggtggcaa

SEQ ID NO: 12124 - DNA, 25 bp, E. coli
gaagtgaaacaggaaacaagcgtgt

SEQ ID NO: 12125 - DNA, 25 bp, E. coli
gaaggtggcaatattccggcccata

SEQ ID NO: 12126 - DNA, 25 bp, E. coli
gaacacagcaaaacgaaggtggcaa

SEQ ID NO: 12127 - DNA, 25 bp, E. coli
ctgaggttatcggagatcagcgagt

SEQ ID NO: 12128 - DNA, 25 bp, E. coli
ctgaggttatcgcagatcagcgagt

SEQ ID NO: 12129 - DNA, 25 bp, E. coli
gtcacgcagctgctggagcagaaca

SEQ ID NO: 12130 - DNA, 25 bp, E. coli
gtcacgcagctggtggagcagaaca

SEQ ID NO: 12131 - DNA, 25 bp, E. coli
tggaccgtgccgtaagaacacagca

SEQ ID NO: 12132 - DNA, 25 bp, E. coli
tggaccgtgccgaaagaacacagca

SEQ ID NO: 12133 - DNA, 25 bp, E. coli
gcaaaagaaaaacatcttgggactt

SEQ ID NO: 12134 - DNA, 25 bp, E. coli
gcaaaagaaaaagatcttgggactt

SEQ ID NO: 12135 - DNA, 25 bp, E. coli
taaaaggttataggtatgattcgat

SEQ ID NO: 12136 - DNA, 25 bp, E. coli
taaaaggttatacgtatgattcgat

SEQ ID NO: 12137 - DNA, 25 bp, E. coli
ttaaaactgaaaaaatcactcgcgg

SEQ ID NO: 12138 - DNA, 25 bp, E. coli
ttaaaactgaaataatcactcgcgg

SEQ ID NO: 12139 - DNA, 25 bp, E. coli
tgtttaatgttgaagacaaaaaagt

SEQ ID NO: 12140 - DNA, 25 bp, E. coli
tgtttaatgttgtagacaaaaaagt

SEQ ID NO: 12141 - DNA, 25 bp, E. coli
tgaacgaagcaaaagaaaaagatct

SEQ ID NO: 12142 - DNA, 25 bp, E. coli
tgaacgaagcaatagaaaaagatct

SEQ ID NO: 12143 - DNA, 25 bp, E. coli
tccaagaggtttttgtgtttaatgt

SEQ ID NO: 12144 - DNA, 25 bp, E. coli
tccaagaggtttatgtgtttaatgt

SEQ ID NO: 12145 - DNA, 25 bp, E. coli
gcggattattttgaaacgatgaaat

SEQ ID NO: 12146 - DNA, 25 bp, E. coli
gcggattattttcaaacgatgaaat

SEQ ID NO: 12147 - DNA, 25 bp, E. coli
gatcttgggactaataaaaaatcaa

SEQ ID NO: 12148 - DNA, 25 bp, E. coli
gatcttgggacttataaaaaatcaa

SEQ ID NO: 12149 - DNA, 25 bp, E. coli
ctgaaaaaatcactcgcggattatt

SEQ ID NO: 12150 - DNA, 25 bp, E. coli
ctgaaaaaatcagtcgcggattatt

SEQ ID NO: 12151 - DNA, 25 bp, E. coli
tcagaatattcaaaaagaattgtcc

SEQ ID NO: 12152 - DNA, 25 bp, E. coli
tcagaatattcataaagaattgtcc

SEQ ID NO: 12153 - DNA, 25 bp, E. coli
tcaaaaagaattctccaagaggttt

SEQ ID NO: 12154 - DNA, 25 bp, E. coli
tcaaaaagaattgtccaagaggttt

SEQ ID NO: 12155 - DNA, 25 bp, E. coli
aaggtctccttaccgccttattgcg

SEQ ID NO: 12156 - DNA, 25 bp, E. coli
aatttgccttcgcacatcaacctgg

SEQ ID NO: 12157 - DNA, 25 bp, E. coli
aatttgccttcggacatcaacctgg

SEQ ID NO: 12158 - DNA, 25 bp, E. coli
aaggtctccttagcgccttattgcg

SEQ ID NO: 12159 - DNA, 25 bp, E. coli
tagcgccttattgcgtaagactgcc

SEQ ID NO: 12160 - DNA, 25 bp, E. coli
tagcgccttattccgtaagactgcc

SEQ ID NO: 12161 - DNA, 25 bp, E. coli
tttggctcgccggtctgtgaaagag

SEQ ID NO: 12162 - DNA, 25 bp, E. coli
tttggctcgccgctctgtgaaagag

SEQ ID NO: 12163 - DNA, 25 bp, E. coli
taagactgccggaacttaaatttgc

SEQ ID NO: 12164 - DNA, 25 bp, E. coli
taagactgccggtacttaaatttgc

SEQ ID NO: 12165 - DNA, 25 bp, E. coli
gccttcgcacatgaacctggcttta

SEQ ID NO: 12166 - DNA, 25 bp, E. coli
ccttattgcgtaagactgccggaac

SEQ ID NO: 12167 - DNA, 25 bp, E. coli
ccttattgcgtatgactgccggaac

SEQ ID NO: 12168 - DNA, 25 bp, E. coli
gccttcgcacatcaacctggcttta

SEQ ID NO: 12169 - DNA, 25 bp, E. coli
cctgggtacagacctctgggcgctt

SEQ ID NO: 12170 - DNA, 25 bp, E. coli
cctgggtacagagctctgggcgctt

SEQ ID NO: 12171 - DNA, 25 bp, E. coli
gccggaacttaaatttgccttcgca

SEQ ID NO: 12172 - DNA, 25 bp, E. coli
gccggaacttaattttgccttcgca

SEQ ID NO: 12173 - DNA, 25 bp, E. coli
ctctgggcgcttccaggtaaaggat

SEQ ID NO: 12174 - DNA, 25 bp, E. coli
ctctgggcgcttgcaggtaaaggat

SEQ ID NO: 12175 - DNA, 25 bp, E. coli
gggaaaacctgggtacagagctctg

SEQ ID NO: 12176 - DNA, 25 bp, E. coli
gggaaaacctggctacagagctctg

SEQ ID NO: 12177 - DNA, 25 bp, E. coli
ctacatgcttgccagtggtttcagc

SEQ ID NO: 12178 - DNA, 25 bp, E. coli
cataaacgtgtcgtgagctacatgc

SEQ ID NO: 12179 - DNA, 25 bp, E. coli
catcttctggatgctggcattagcg

SEQ ID NO: 12180 - DNA, 25 bp, E. coli
cataaacgtgtcctgagctacatgc

SEQ ID NO: 12181 - DNA, 25 bp, E. coli
ctacatgcttgcgagtggtttcagc

SEQ ID NO: 12182 - DNA, 25 bp, E. coli
catcttctggatcctggcattagcg

SEQ ID NO: 12183 - DNA, 25 bp, E. coli
tcctgagctacaagcttgccagtgg

SEQ ID NO: 12184 - DNA, 25 bp, E. coli
tcctgagctacatgcttgccagtgg

SEQ ID NO: 12185 - DNA, 25 bp, E. coli
tgcggccagcgtcgtcattaacgcc

SEQ ID NO: 12186 - DNA, 25 bp, E. coli
tgcggccagcgtggtcattaacgcc

SEQ ID NO: 12187 - DNA, 25 bp, E. coli
gccctgatgcgcgatatttacccga

SEQ ID NO: 12188 - DNA, 25 bp, E. coli
gccctgatgcgccatatttacccga

SEQ ID NO: 12189 - DNA, 25 bp, E. coli
cgtggtcattaacgccctgatgcgc

SEQ ID NO: 12190 - DNA, 25 bp, E. coli
cgtggtcattaaggccctgatgcgc

SEQ ID NO: 12191 - DNA, 25 bp, E. coli
ctgatgcgcgatttttacccgaaag

SEQ ID NO: 12192 - DNA, 25 bp, E. coli
ctgatgcgcgatatttacccgaaag

SEQ ID NO: 12193 - DNA, 25 bp, E. coli
gttccgccataatcgtgtcctgagc

SEQ ID NO: 12194 - DNA, 25 bp, E. coli
gttccgccataaacgtgtcctgagc

SEQ ID NO: 12195 - DNA, 25 bp, E. coli
ggcaatgattttgttcctgattaaa

SEQ ID NO: 12196 - DNA, 25 bp, E. coli
ggcaatgattttcttcctgattaaa

SEQ ID NO: 12197 - DNA, 25 bp, E. coli
gatcctggcatttgcggcgattctg

SEQ ID NO: 12198 - DNA, 25 bp, E. coli
gatcctggcattagcggcgattctg

SEQ ID NO: 12199 - DNA, 25 bp, E. coli
tacggttattcgtggtggcactgcc

SEQ ID NO: 12200 - DNA, 25 bp, E. coli
tacggttattcgaggtggcactgcc

SEQ ID NO: 12201 - DNA, 25 bp, E. coli
tatgtcgctggtggtgcaagcaacg

SEQ ID NO: 12202 - DNA, 25 bp, E. coli
tatgtcgctggtcgtgcaagcaacg

SEQ ID NO: 12203 - DNA, 25 bp, E. coli
tgttgcccaggacagcgaaattccg

SEQ ID NO: 12204 - DNA, 25 bp, E. coli
tgttgcccaggagagcgaaattccg

SEQ ID NO: 12205 - DNA, 25 bp, E. coli
tgaagctaacgtagctaccccggac

SEQ ID NO: 12206 - DNA, 25 bp, E. coli
tgaacaagcgatggaacgtgctggc

SEQ ID NO: 12207 - DNA, 25 bp, E. coli
tgaacaagcgatcgaacgtgctggc

SEQ ID NO: 12208 - DNA, 25 bp, E. coli
tgaagctaacgttgctaccccggac

SEQ ID NO: 12209 - DNA, 25 bp, E. coli
ccaaagctggcatcaaaggtgcaga

SEQ ID NO: 12210 - DNA, 25 bp, E. coli
ccaaagctggcaacaaaggtgcaga

SEQ ID NO: 12211 - DNA, 25 bp, E. coli
gcactgaccgcggttgaaatgatta

SEQ ID NO: 12212 - DNA, 25 bp, E. coli
gcactgaccgcgcttgaaatgatta

SEQ ID NO: 12213 - DNA, 25 bp, E. coli
ccggtaaatacgtcgcggtgattgc

SEQ ID NO: 12214 - DNA, 25 bp, E. coli
ccggtaaatacgacgcggtgattgc

SEQ ID NO: 12215 - DNA, 25 bp, E. coli
ggtgcactggctaaaaccggtaaat

SEQ ID NO: 12216 - DNA, 25 bp, E. coli
ggtgcactggcttaaaccggtaaat

SEQ ID NO: 12217 - DNA, 25 bp, E. coli
tcaatgacagcctgctggaaggtgc

SEQ ID NO: 12218 - DNA, 25 bp, E. coli
tcaatgacagccagctggaaggtgc

SEQ ID NO: 12219 - DNA, 25 bp, E. coli
gaccactgaaagcattgaacaagcg

SEQ ID NO: 12220 - DNA, 25 bp, E. coli
gaccactgaaaggattgaacaagcg

SEQ ID NO: 12221 - DNA, 25 bp, E. coli
tacagcaacgaagtgatcctgatgc

SEQ ID NO: 12222 - DNA, 25 bp, E. coli
tacagcaacgaactgatcctgatgc

SEQ ID NO: 12223 - DNA, 25 bp, E. coli
tacctatatttttcgcggtacgccg

SEQ ID NO: 12224 - DNA, 25 bp, E. coli
tacgccgctgtaagttcagttgctg

SEQ ID NO: 12225 - DNA, 25 bp, E. coli
tacgccgctgtatgttcagttgctg

SEQ ID NO: 12226 - DNA, 25 bp, E. coli
tacctatattttacgcggtacgccg

SEQ ID NO: 12227 - DNA, 25 bp, E. coli
ttaacacctgcggttacactaccga

SEQ ID NO: 12228 - DNA, 25 bp, E. coli
ttaacacctgcgcttacactaccga

SEQ ID NO: 12229 - DNA, 25 bp, E. coli
tgtgaaaccttcatcaacgcactga

SEQ ID NO: 12230 - DNA, 25 bp, E. coli
tgtgaaaccttcttcaacgcactga

SEQ ID NO: 12231 - DNA, 25 bp, E. coli
tgctggcgctgaggcttaacacctg

SEQ ID NO: 12232 - DNA, 25 bp, E. coli
tgctggcgctgacgcttaacacctg

SEQ ID NO: 12233 - DNA, 25 bp, E. coli
tcagttgctggtgttctattccggc

SEQ ID NO: 12234 - DNA, 25 bp, E. coli
ccacggtgccggttctgctgaaaat

SEQ ID NO: 12235 - DNA, 25 bp, E. coli
ccacggtgccggatctgctgaaaat

SEQ ID NO: 12236 - DNA, 25 bp, E. coli
gcattgccgcggtgctctatttaat

SEQ ID NO: 12237 - DNA, 25 bp, E. coli
gcattgccgcggagctctatttaat

SEQ ID NO: 12238 - DNA, 25 bp, E. coli
gaaaaacgctggttgcagcatgtga

SEQ ID NO: 12239 - DNA, 25 bp, E. coli
gaaaaacgctggatgcagcatgtga

SEQ ID NO: 12240 - DNA, 25 bp, E. coli
cattattttgccttctgcgctgcgt

SEQ ID NO: 12241 - DNA, 25 bp, E. coli
cattattttgccatctgcgctgcgt

SEQ ID NO: 12242 - DNA, 25 bp, E. coli
tcagttgctggtcttctattccggc

SEQ ID NO: 12243 - DNA, 25 bp, E. coli
caattgttgaagagctgtcgcccgg

SEQ ID NO: 12244 - DNA, 25 bp, E. coli
caattgttgaagtgctgtcgcccgg

SEQ ID NO: 12245 - DNA, 25 bp, E. coli
tattccagtagatagcgccagcatt

SEQ ID NO: 12246 - DNA, 25 bp, E. coli
tattccagtagaaagcgccagcatt

SEQ ID NO: 12247 - DNA, 25 bp, E. coli
ttaccgccgctgcaaggatacacct

SEQ ID NO: 12248 - DNA, 25 bp, E. coli
tttattctcgacgtcgccagcggga

SEQ ID NO: 12249 - DNA, 25 bp, E. coli
tttattctcgacctcgccagcggga

SEQ ID NO: 12250 - DNA, 25 bp, E. coli
ttaccgccgctggaaggatacacct

SEQ ID NO: 12251 - DNA, 25 bp, E. coli
tgaacgaagaggacggcaaacggct

SEQ ID NO: 12252 - DNA, 25 bp, E. coli
tgaacgaagaggtcggcaaacggct

SEQ ID NO: 12253 - DNA, 25 bp, E. coli
tctgtggcacgctacaggtggcttc

SEQ ID NO: 12254 - DNA, 25 bp, E. coli
tcggctccattggtaaatcgggtaa

SEQ ID NO: 12255 - DNA, 25 bp, E. coli
tctgtggcacgcaacaggtggcttc

SEQ ID NO: 12256 - DNA, 25 bp, E. coli
tcattgaacgcgttctgctaccgaa

SEQ ID NO: 12257 - DNA, 25 bp, E. coli
tcggctccattgctaaatcgggtaa

SEQ ID NO: 12258 - DNA, 25 bp, E. coli
tcattgaacgcgatctgctaccgaa

SEQ ID NO: 12259 - DNA, 25 bp, E. coli
gaaatacccgaaggtcgatggcgtg

SEQ ID NO: 12260 - DNA, 25 bp, E. coli
gaaatacccgaacgtcgatggcgtg

SEQ ID NO: 12261 - DNA, 25 bp, E. coli
cggattaatttacgccgcgacgcca

SEQ ID NO: 12262 - DNA, 25 bp, E. coli
cggattaatttaggccgcgacgcca

SEQ ID NO: 12263 - DNA, 25 bp, E. coli
tggcggtacccgtcattaaaatggc

SEQ ID NO: 12264 - DNA, 25 bp, E. coli
tggcggtacccgacattaaaatggc

SEQ ID NO: 12265 - DNA, 25 bp, E. coli
caatttatggcgctaacctgccctc

SEQ ID NO: 12266 - DNA, 25 bp, E. coli
aagctctgccgggatccgtacgcag

SEQ ID NO: 12267 - DNA, 25 bp, E. coli
aagctctgccggcatccgtacgcag

SEQ ID NO: 12268 - DNA, 25 bp, E. coli
caatttatggcggtaacctgccctc

SEQ ID NO: 12269 - DNA, 25 bp, E. coli
cagacgggtgccgtttcaacatcgt

SEQ ID NO: 12270 - DNA, 25 bp, E. coli
cagacgggtgccctttcaacatcgt

SEQ ID NO: 12271 - DNA, 25 bp, E. coli
ttgcaaccggtatatccgcacagcg

SEQ ID NO: 12272 - DNA, 25 bp, E. coli
ttgcaaccggtaaatccgcacagcg

SEQ ID NO: 12273 - DNA, 25 bp, E. coli
tgcccaggcagatccgctctatctg

SEQ ID NO: 12274 - DNA, 25 bp, E. coli
tgcccaggcagaaccgctctatctg

SEQ ID NO: 12275 - DNA, 25 bp, E. coli
tctatctggatgaaatgaccgcact

SEQ ID NO: 12276 - DNA, 25 bp, E. coli
tctatctggatgtaatgaccgcact

SEQ ID NO: 12277 - DNA, 25 bp, E. coli
gcgtggcggtacaggacagaaccaa

SEQ ID NO: 12278 - DNA, 25 bp, E. coli
gcgtggcggtactggacagaaccaa

SEQ ID NO: 12279 - DNA, 25 bp, E. coli
cgtagaagaagttccgttgcaaccg

SEQ ID NO: 12280 - DNA, 25 bp, E. coli
ctctctatttgaagataatgccgaa

SEQ ID NO: 12281 - DNA, 25 bp, E. coli
cgtagaagaagtaccgttgcaaccg

SEQ ID NO: 12282 - DNA, 25 bp, E. coli
ctctctatttgatgataatgccgaa

SEQ ID NO: 12283 - DNA, 25 bp, E. coli
tggacagaaccatagaacccggtgc

SEQ ID NO: 12284 - DNA, 25 bp, E. coli
tggacagaaccaaagaacccggtgc

SEQ ID NO: 12285 - DNA, 25 bp, E. coli
tggcgctttgcacacgggtgccctt

SEQ ID NO: 12286 - DNA, 25 bp, E. coli
tggcgctttgcagacgggtgccctt

SEQ ID NO: 12287 - DNA, 25 bp, E. coli
catggcgacattcctattaatagtg

SEQ ID NO: 12288 - DNA, 25 bp, E. coli
catggcgacattgctattaatagtg

SEQ ID NO: 12289 - DNA, 25 bp, E. coli
catcaacgactggatgctgagaggg

SEQ ID NO: 12290 - DNA, 25 bp, E. coli
catcaacgactgcatgctgagaggg

SEQ ID NO: 12291 - DNA, 25 bp, E. coli
taactgcaaggttaatgtgcatggc

SEQ ID NO: 12292 - DNA, 25 bp, E. coli
tagcctgcggatcaaatcaattttt

SEQ ID NO: 12293 - DNA, 25 bp, E. coli
tagtgcacaggataattactctgcc

SEQ ID NO: 12294 - DNA, 25 bp, E. coli
tagtgcacaggaaaattactctgcc

SEQ ID NO: 12295 - DNA, 25 bp, E. coli
tagcctgcggatgaaatcaattttt

SEQ ID NO: 12296 - DNA, 25 bp, E. coli
tcagtgtattggtagctaaaaagcc

SEQ ID NO: 12297 - DNA, 25 bp, E. coli
tcagtgtattggaagctaaaaagcc

SEQ ID NO: 12298 - DNA, 25 bp, E. coli
gaattattctgtgaatagcctgcgg

SEQ ID NO: 12299 - DNA, 25 bp, E. coli
gaattattctgtcaatagcctgcgg

SEQ ID NO: 12300 - DNA, 25 bp, E. coli
cggtagcgtgtcaggatgcctgaaa

SEQ ID NO: 12301 - DNA, 25 bp, E. coli
cggtagcgtgtctggatgcctgaaa

SEQ ID NO: 12302 - DNA, 25 bp, E. coli
gtaacacttcctcctgcattattgg

SEQ ID NO: 12303 - DNA, 25 bp, E. coli
gtaacacttcctgctgcattattgg

SEQ ID NO: 12304 - DNA, 25 bp, E. coli
tggatgcctgaaagaccagtctgaa

SEQ ID NO: 12305 - DNA, 25 bp, E. coli
tggatgcctgaatgaccagtctgaa

SEQ ID NO: 12306 - DNA, 25 bp, E. coli
taactgcaaggtaaatgtgcatggc

SEQ ID NO: 12307 - DNA, 25 bp, E. coli
taagaaatatcggatgtggagacac

SEQ ID NO: 12308 - DNA, 25 bp, E. coli
taagaaatatcgcatgtggagacac

SEQ ID NO: 12309 - DNA, 25 bp, E. coli
caatctgggcggactgatgaaatcg

SEQ ID NO: 12310 - DNA, 25 bp, E. coli
caatctgggcggtctgatgaaatcg

SEQ ID NO: 12311 - DNA, 25 bp, E. coli
aatgctgagtctgtacaacgccagg

SEQ ID NO: 12312 - DNA, 25 bp, E. coli
aatgctgagtctctacaacgccagg

SEQ ID NO: 12313 - DNA, 25 bp, E. coli
cacaagcggcgtcattatggttaca

SEQ ID NO: 12314 - DNA, 25 bp, E. coli
cacaagcggcgtgattatggttaca

SEQ ID NO: 12315 - DNA, 25 bp, E. coli
tacttcacgcagttctacggcgagc

SEQ ID NO: 12316 - DNA, 25 bp, E. coli
tacttcacgcagatctacggcgagc

SEQ ID NO: 12317 - DNA, 25 bp, E. coli
aaactactgactattcgctggcgcg

SEQ ID NO: 12318 - DNA, 25 bp, E. coli
aaactactgacttttcgctggcgcg

SEQ ID NO: 12319 - DNA, 25 bp, E. coli
tatggttacacaacaacccggtgtc

SEQ ID NO: 12320 - DNA, 25 bp, E. coli
tatggttacacatcaacccggtgtc

SEQ ID NO: 12321 - DNA, 25 bp, E. coli
tccagcggcgaaaaacaacgtatcg

SEQ ID NO: 12322 - DNA, 25 bp, E. coli
tccagcggcgaataacaacgtatcg

SEQ ID NO: 12323 - DNA, 25 bp, E. coli
gaacagcgccctacgaataagccta

SEQ ID NO: 12324 - DNA, 25 bp, E. coli
gaacagcgcccttcgaataagccta

SEQ ID NO: 12325 - DNA, 25 bp, E. coli
cgtttaatgaatcgtcagcggtggc

SEQ ID NO: 12326 - DNA, 25 bp, E. coli
cgtttaatgaatggtcagcggtggc

SEQ ID NO: 12327 - DNA, 25 bp, E. coli
gattttttcaatccgctaagccaga

SEQ ID NO: 12328 - DNA, 25 bp, E. coli
gattttttcaatgcgctaagccaga

SEQ ID NO: 12329 - DNA, 25 bp, E. coli
taaccctgaccatcgtatcgctgaa

SEQ ID NO: 12330 - DNA, 25 bp, E. coli
taaccctgaccaacgtatcgctgaa

SEQ ID NO: 12331 - DNA, 25 bp, E. coli
taaaaaatggttgcgactggcagca

SEQ ID NO: 12332 - DNA, 25 bp, E. coli
taaaaaatggttccgactggcagca

SEQ ID NO: 12333 - DNA, 25 bp, E. coli
taaacctgagctgaagccatccgaa

SEQ ID NO: 12334 - DNA, 25 bp, E. coli
taaacctgagctcaagccatccgaa

SEQ ID NO: 12335 - DNA, 25 bp, E. coli
atggctacaccggttattcgtgtca

SEQ ID NO: 12336 - DNA, 25 bp, E. coli
atggctacaccgcttattcgtgtca

SEQ ID NO: 12337 - DNA, 25 bp, E. coli
aacactgctcggatataccgccagc

SEQ ID NO: 12338 - DNA, 25 bp, E. coli
aacactgctcggttataccgccagc

SEQ ID NO: 12339 - DNA, 25 bp, E. coli
taccaacactgctcggatataccgc

SEQ ID NO: 12340 - DNA, 25 bp, E. coli
taccaacactgcacggatataccgc

SEQ ID NO: 12341 - DNA, 25 bp, E. coli
tgagctgaagccttccgaaatacca

SEQ ID NO: 12342 - DNA, 25 bp, E. coli
tgagctgaagccatccgaaatacca

SEQ ID NO: 12343 - DNA, 25 bp, E. coli
tcgtgtcatgaacggacacatctac

SEQ ID NO: 12344 - DNA, 25 bp, E. coli
tcgtgtcatgaagggacacatctac

SEQ ID NO: 12345 - DNA, 25 bp, E. coli
gaagccatccgatataccaacactg

SEQ ID NO: 12346 - DNA, 25 bp, E. coli
gaagccatccgaaataccaacactg

SEQ ID NO: 12347 - DNA, 25 bp, E. coli
cgcttattcgtgacatgaacggaca

SEQ ID NO: 12348 - DNA, 25 bp, E. coli
cgcttattcgtgtcatgaacggaca

SEQ ID NO: 12349 - DNA, 25 bp, E. coli
tggttgataaaatatggttgcgact

SEQ ID NO: 12350 - DNA, 25 bp, E. coli
tggttgataaaaaatggttgcgact

SEQ ID NO: 12351 - DNA, 25 bp, E. coli
taagcgtaaacctgagctgaagcca

SEQ ID NO: 12352 - DNA, 25 bp, E. coli
taagcgtaaaccagagctgaagcca

SEQ ID NO: 12353 - DNA, 25 bp, E. coli
tattgcgctcctactggcgactggc

SEQ ID NO: 12354 - DNA, 25 bp, E. coli
tattgcgctccttctggcgactggc

SEQ ID NO: 12355 - DNA, 25 bp, E. coli
ttttttatcgactgcgcaccagctc

SEQ ID NO: 12356 - DNA, 25 bp, E. coli
ttttttatcgacagcgcaccagctc

SEQ ID NO: 12357 - DNA, 25 bp, E. coli
tgattatcaacaggcgcaggtaagc

SEQ ID NO: 12358 - DNA, 25 bp, E. coli
tgattatcaacacgcgcaggtaagc

SEQ ID NO: 12359 - DNA, 25 bp, E. coli
gcgacgggatacgtgaaagacaaca

SEQ ID NO: 12360 - DNA, 25 bp, E. coli
gcgacgggatacctgaaagacaaca

SEQ ID NO: 12361 - DNA, 25 bp, E. coli
gacatgctcgggataaccatcggcg

SEQ ID NO: 12362 - DNA, 25 bp, E. coli
gacatgctcgggttaaccatcggcg

SEQ ID NO: 12363 - DNA, 25 bp, E. coli
cattcgtcgccggagtattctgcgc

SEQ ID NO: 12364 - DNA, 25 bp, E. coli
ctctgaccattgaggcgacgctgaa

SEQ ID NO: 12365 - DNA, 25 bp, E. coli
ctctgaccattgtggcgacgctgaa

SEQ ID NO: 12366 - DNA, 25 bp, E. coli
cattcgtcgccgcagtattctgcgc

SEQ ID NO: 12367 - DNA, 25 bp, E. coli
ggtagtttccattccctgtgcgctg

SEQ ID NO: 12368 - DNA, 25 bp, E. coli
ggtagtttccataccctgtgcgctg

SEQ ID NO: 12369 - DNA, 25 bp, E. coli
tttctggtcctgaaaggttgggcac

SEQ ID NO: 12370 - DNA, 25 bp, E. coli
ggcattattactggagccactgcag

SEQ ID NO: 12371 - DNA, 25 bp, E. coli
ggcattattactcgagccactgcag

SEQ ID NO: 12372 - DNA, 25 bp, E. coli
tttctggtcctgtaaggttgggcac

SEQ ID NO: 12373 - DNA, 25 bp, E. coli
taagcggtttgcatacgagatggct

SEQ ID NO: 12374 - DNA, 25 bp, E. coli
taagcggtttgcttacgagatggct

SEQ ID NO: 12375 - DNA, 25 bp, E. coli
catgaaggatgaaatacacagtacc

SEQ ID NO: 12376 - DNA, 25 bp, E. coli
catggacagccacatgctcaatggg

SEQ ID NO: 12377 - DNA, 25 bp, E. coli
catggacagccagatgctcaatggg

SEQ ID NO: 12378 - DNA, 25 bp, E. coli
catgaaggatgatatacacagtacc

SEQ ID NO: 12379 - DNA, 25 bp, E. coli
taaatcctcagaagaggcactcgcc

SEQ ID NO: 12380 - DNA, 25 bp, E. coli
taaatcctcagatgaggcactcgcc

SEQ ID NO: 12381 - DNA, 25 bp, E. coli
atgggatatccaagcaacttcaggg

SEQ ID NO: 12382 - DNA, 25 bp, E. coli
atgggatatccatgcaacttcaggg

SEQ ID NO: 12383 - DNA, 25 bp, E. coli
tgagcagtttctcgcccttatgaac

SEQ ID NO: 12384 - DNA, 25 bp, E. coli
tgagcagtttctggcccttatgaac

SEQ ID NO: 12385 - DNA, 25 bp, E. coli
ccatgctgagtacgctttgttacaa

SEQ ID NO: 12386 - DNA, 25 bp, E. coli
ccatgctgagtaggctttgttacaa

SEQ ID NO: 12387 - DNA, 25 bp, E. coli
gcacatatcggtattctgggttaca

SEQ ID NO: 12388 - DNA, 25 bp, E. coli
gcacatatcggttttctgggttaca

SEQ ID NO: 12389 - DNA, 25 bp, E. coli
gaaaggccaggcaagaatattcact

SEQ ID NO: 12390 - DNA, 25 bp, E. coli
gacatgcggtatgcattccatggac

SEQ ID NO: 12391 - DNA, 25 bp, E. coli
gaaaggccaggctagaatattcact

SEQ ID NO: 12392 - DNA, 25 bp, E. coli
gacatgcggtatccattccatggac

SEQ ID NO: 12393 - DNA, 25 bp, E. coli
gttacaacctgatgatgacatgcgg

SEQ ID NO: 12394 - DNA, 25 bp, E. coli
gttacaacctgaagatgacatgcgg

SEQ ID NO: 12395 - DNA, 25 bp, E. coli
gggattgatattcccgaaaggccag

SEQ ID NO: 12396 - DNA, 25 bp, E. coli
gggattgatattgccgaaaggccag

SEQ ID NO: 12397 - DNA, 25 bp, E. coli
aataaagacattcacgcatcccgcc

SEQ ID NO: 12398 - DNA, 25 bp, E. coli
aataaagacattgacgcatcccgcc

SEQ ID NO: 12399 - DNA, 25 bp, E. coli
cagaaatgaaaaatatcacccggct

SEQ ID NO: 12400 - DNA, 25 bp, E. coli
cagaaatgaaaattatcacccggct

SEQ ID NO: 12401 - DNA, 25 bp, E. coli
tacagtagtctgatcttgccagcag

SEQ ID NO: 12402 - DNA, 25 bp, E. coli
tacagtagtctgttcttgccagcag

SEQ ID NO: 12403 - DNA, 25 bp, E. coli
tatttgtcgctgcataggctgctga

SEQ ID NO: 12404 - DNA, 25 bp, E. coli
tatttgtcgctggataggctgctga

SEQ ID NO: 12405 - DNA, 25 bp, E. coli
tgctcacgtggcgttctggcgacga

SEQ ID NO: 12406 - DNA, 25 bp, E. coli
tgctcacgtggccttctggcgacga

SEQ ID NO: 12407 - DNA, 25 bp, E. coli
tcccgcccggcttactatgaattag

SEQ ID NO: 12408 - DNA, 25 bp, E. coli
tcccgcccggctaactatgaattag

SEQ ID NO: 12409 - DNA, 25 bp, E. coli
tcacccggctaataaatagaataga

SEQ ID NO: 12410 - DNA, 25 bp, E. coli
tcacccggctaaaaaatagaataga

SEQ ID NO: 12411 - DNA, 25 bp, E. coli
gccagcagatcaatactgattcagg

SEQ ID NO: 12412 - DNA, 25 bp, E. coli
gccagcagatcattactgattcagg

SEQ ID NO: 12413 - DNA, 25 bp, E. coli
gaatagaagcattcgccataatgac

SEQ ID NO: 12414 - DNA, 25 bp, E. coli
gaatagaagcatacgccataatgac

SEQ ID NO: 12415 - DNA, 25 bp, E. coli
gattcaggctatgaatatttgtcgc

SEQ ID NO: 12416 - DNA, 25 bp, E. coli
gattcaggctatcaatatttgtcgc

SEQ ID NO: 12417 - DNA, 25 bp, E. coli
gttctcttatcttgtgctcacgtgg

SEQ ID NO: 12418 - DNA, 25 bp, E. coli
gttctcttatctagtgctcacgtgg

SEQ ID NO: 12419 - DNA, 25 bp, E. coli
taacagtggtaaggaaacgctctgc

SEQ ID NO: 12420 - DNA, 25 bp, E. coli
tacgcggtaaaagtgccagatggtc

SEQ ID NO: 12421 - DNA, 25 bp, E. coli
taacagtggtaacgaaacgctctgc

SEQ ID NO: 12422 - DNA, 25 bp, E. coli
aaaatgccggattcagcgttgatgg

SEQ ID NO: 12423 - DNA, 25 bp, E. coli
aaaatgccggatacagcgttgatgg

SEQ ID NO: 12424 - DNA, 25 bp, E. coli
tacgcggtaaaactgccagatggtc

SEQ ID NO: 12425 - DNA, 25 bp, E. coli
ttaaaaccaggcgatcgtgccagcg

SEQ ID NO: 12426 - DNA, 25 bp, E. coli
ttaaaaccaggccatcgtgccagcg

SEQ ID NO: 12427 - DNA, 25 bp, E. coli
cctgcaatacgcgaagaatgtcttt

SEQ ID NO: 12428 - DNA, 25 bp, E. coli
cctgcaatacgccaagaatgtcttt

SEQ ID NO: 12429 - DNA, 25 bp, E. coli
ccgaaaaggaggtactatgaaggct

SEQ ID NO: 12430 - DNA, 25 bp, E. coli
cgaagccctgctgaaaatggagtgt

SEQ ID NO: 12431 - DNA, 25 bp, E. coli
ccgaaaaggaggaactatgaaggct

SEQ ID NO: 12432 - DNA, 25 bp, E. coli
cgaagccctgctcaaaatggagtgt

SEQ ID NO: 12433 - DNA, 25 bp, E. coli
ctcactgaaacatggcgaagccctg

SEQ ID NO: 12434 - DNA, 25 bp, E. coli
ctcactgaaacaaggcgaagccctg

SEQ ID NO: 12435 - DNA, 25 bp, E. coli
gattgctatctacggtcttggcggt

SEQ ID NO: 12436 - DNA, 25 bp, E. coli
gattgctatctagggtcttggcggt

SEQ ID NO: 12437 - DNA, 25 bp, E. coli
tggaagaaggcataatccgtggccg

SEQ ID NO: 12438 - DNA, 25 bp, E. coli
tggaagaaggcaaaatccgtggccg

SEQ ID NO: 12439 - DNA, 25 bp, E. coli
gatgcggtcattccgaatactgtaa

SEQ ID NO: 12440 - DNA, 25 bp, E. coli
gatgcggtcattgcgaatactgtaa

SEQ ID NO: 12441 - DNA, 25 bp, E. coli
tccggcggcacagttgagcgcaaat

SEQ ID NO: 12442 - DNA, 25 bp, E. coli
tccggcggcacacttgagcgcaaat

SEQ ID NO: 12443 - DNA, 25 bp, E. coli
tctcaatgaattacagacgcagggt

SEQ ID NO: 12444 - DNA, 25 bp, E. coli
tctcaatgaatttcagacgcagggt

SEQ ID NO: 12445 - DNA, 25 bp, E. coli
gcataaagcagaaatcgcgcgcgag

SEQ ID NO: 12446 - DNA, 25 bp, E. coli
gcataaagcagatatcgcgcgcgag

SEQ ID NO: 12447 - DNA, 25 bp, E. coli
cgatagtcgacctgctgctgaacca

SEQ ID NO: 12448 - DNA, 25 bp, E. coli
cgatagtcgaccagctgctgaacca

SEQ ID NO: 12449 - DNA, 25 bp, E. coli
gatttgccatgatctcggtaaacgc

SEQ ID NO: 12450 - DNA, 25 bp, E. coli
gatttgccatgaactcggtaaacgc

SEQ ID NO: 12451 - DNA, 25 bp, E. coli
ggtgatagccttagacgccagttca

SEQ ID NO: 12452 - DNA, 25 bp, E. coli
ggtgatagcctttgacgccagttca

SEQ ID NO: 12453 - DNA, 25 bp, E. coli
gtcagtaaagaaaccattcgtcgcg

SEQ ID NO: 12454 - DNA, 25 bp, E. coli
gtcagtaaagaatccattcgtcgcg

SEQ ID NO: 12455 - DNA, 25 bp, E. coli
ggcatctggatgaggtaacgcacat

SEQ ID NO: 12456 - DNA, 25 bp, E. coli
ggctgttacgtctatccctcgctga

SEQ ID NO: 12457 - DNA, 25 bp, E. coli
ggctgttacgtcaatccctcgctga

SEQ ID NO: 12458 - DNA, 25 bp, E. coli
ggcatctggatgtggtaacgcacat

SEQ ID NO: 12459 - DNA, 25 bp, E. coli
tcaaaatcaagacagtggcgatccc

SEQ ID NO: 12460 - DNA, 25 bp, E. coli
tcaaaatcaagagagtggcgatccc

SEQ ID NO: 12461 - DNA, 25 bp, E. coli
gaccacggaagctctctctgaacag

SEQ ID NO: 12462 - DNA, 25 bp, E. coli
gaccacggaagcactctctgaacag

SEQ ID NO: 12463 - DNA, 25 bp, E. coli
agccattttggtatgctggtggatg

SEQ ID NO: 12464 - DNA, 25 bp, E. coli
attttggtttgcaggtggatgtgcc

SEQ ID NO: 12465 - DNA, 25 bp, E. coli
agccattttggtttgctggtggatg

SEQ ID NO: 12466 - DNA, 25 bp, E. coli
atttatcgctacaggtcatcgggtc

SEQ ID NO: 12467 - DNA, 25 bp, E. coli
atttatcgctactggtcatcgggtc

SEQ ID NO: 12468 - DNA, 25 bp, E. coli
attttggtttgctggtggatgtgcc

SEQ ID NO: 12469 - DNA, 25 bp, E. coli
tttggtttgctgctggatgtgccga

SEQ ID NO: 12470 - DNA, 25 bp, E. coli
tttggtttgctggtggatgtgccga

SEQ ID NO: 12471 - DNA, 25 bp, E. coli
tatttatcgctactggtcatcgggt

SEQ ID NO: 12472 - DNA, 25 bp, E. coli
tatttatcgctagtggtcatcgggt

SEQ ID NO: 12473 - DNA, 25 bp, E. coli
gccattttggttagctggtggatgt

SEQ ID NO: 12474 - DNA, 25 bp, E. coli
gccattttggtttgctggtggatgt

SEQ ID NO: 12475 - DNA, 25 bp, E. coli
ccattttggtttgctggtggatgtg

SEQ ID NO: 12476 - DNA, 25 bp, E. coli
ccattttggtttcctggtggatgtg

SEQ ID NO: 12477 - DNA, 25 bp, E. coli
gctatttatcgctactggtcatcgg

SEQ ID NO: 12478 - DNA, 25 bp, E. coli
gctatttatcgcaactggtcatcgg

SEQ ID NO: 12479 - DNA, 25 bp, E. coli
cgctatttatcggtactggtcatcg

SEQ ID NO: 12480 - DNA, 25 bp, E. coli
cccgctatttatggctactggtcat

SEQ ID NO: 12481 - DNA, 25 bp, E. coli
cgctatttatcgctactggtcatcg

SEQ ID NO: 12482 - DNA, 25 bp, E. coli
cccgctatttatcgctactggtcat

SEQ ID NO: 12483 - DNA, 25 bp, E. coli
ctatttatcgcttctggtcatcggg

SEQ ID NO: 12484 - DNA, 25 bp, E. coli
ctatttatcgctactggtcatcggg

SEQ ID NO: 12485 - DNA, 25 bp, E. coli
aacggttcgacggatgcaggcatga

SEQ ID NO: 12486 - DNA, 25 bp, E. coli
aacgattccacttatttattccatg

SEQ ID NO: 12487 - DNA, 25 bp, E. coli
cataccataagcctaatggagcgaa

SEQ ID NO: 12488 - DNA, 25 bp, E. coli
cataccataagcgtaatggagcgaa

SEQ ID NO: 12489 - DNA, 25 bp, E. coli
aacgattccactaatttattccatg

SEQ ID NO: 12490 - DNA, 25 bp, E. coli
aacggttcgacgcatgcaggcatga

SEQ ID NO: 12491 - DNA, 25 bp, E. coli
tattccatgtcacacttttcgcatc

SEQ ID NO: 12492 - DNA, 25 bp, E. coli
tattccatgtcagacttttcgcatc

SEQ ID NO: 12493 - DNA, 25 bp, E. coli
tttcagataaaaagcgcaatcattc

SEQ ID NO: 12494 - DNA, 25 bp, E. coli
tttcagataaaatgcgcaatcattc

SEQ ID NO: 12495 - DNA, 25 bp, E. coli
tgttttataatcacttaatcgcgca

SEQ ID NO: 12496 - DNA, 25 bp, E. coli
tgaccttgccggtggcggccttagc

SEQ ID NO: 12497 - DNA, 25 bp, E. coli
tgaccttgccggaggcggccttagc

SEQ ID NO: 12498 - DNA, 25 bp, E. coli
tgttttataatctcttaatcgcgca

SEQ ID NO: 12499 - DNA, 25 bp, E. coli
tcgcgcataaaatacggctaaattc

SEQ ID NO: 12500 - DNA, 25 bp, E. coli
tcgcgcataaaaaacggctaaattc

SEQ ID NO: 12501 - DNA, 25 bp, E. coli
gcatgaaaccgcgtcttttttcaga

SEQ ID NO: 12502 - DNA, 25 bp, E. coli
gcgcaatcattcataaaccctctgt

SEQ ID NO: 12503 - DNA, 25 bp, E. coli
gctaaattcttgagtaaacgattcc

SEQ ID NO: 12504 - DNA, 25 bp, E. coli
gctaaattcttgtgtaaacgattcc

SEQ ID NO: 12505 - DNA, 25 bp, E. coli
gcgcaatcattcttaaaccctctgt

SEQ ID NO: 12506 - DNA, 25 bp, E. coli
gcatgaaaccgcctcttttttcaga

SEQ ID NO: 12507 - DNA, 25 bp, E. coli
taccgtggtataaggtcatcggccc

SEQ ID NO: 12508 - DNA, 25 bp, E. coli
tatggatctggtggaaaggcccgac

SEQ ID NO: 12509 - DNA, 25 bp, E. coli
tatggatctggtcgaaaggcccgac

SEQ ID NO: 12510 - DNA, 25 bp, E. coli
taccgtggtatatggtcatcggccc

SEQ ID NO: 12511 - DNA, 25 bp, E. coli
tattgccctggtgtggcttaccgtc

SEQ ID NO: 12512 - DNA, 25 bp, E. coli
tattgccctggtctggcttaccgtc

SEQ ID NO: 12513 - DNA, 25 bp, E. coli
ttaccttgaccgctggctgctgcgc

SEQ ID NO: 12514 - DNA, 25 bp, E. coli
ttaccttgaccggtggctgctgcgc

SEQ ID NO: 12515 - DNA, 25 bp, E. coli
tccgggtaatgatgcgcctgcaact

SEQ ID NO: 12516 - DNA, 25 bp, E. coli
tccgggtaatgaagcgcctgcaact

SEQ ID NO: 12517 - DNA, 25 bp, E. coli
tcagtgtggagctgaacgcccagca

SEQ ID NO: 12518 - DNA, 25 bp, E. coli
tcagtgtggagcagaacgcccagca

SEQ ID NO: 12519 - DNA, 25 bp, E. coli
gaagaggccattcatccgctcagtg

SEQ ID NO: 12520 - DNA, 25 bp, E. coli
gaagaggccattgatccgctcagtg

SEQ ID NO: 12521 - DNA, 25 bp, E. coli
gaaaaacagcaaaaacagcagcgcg

SEQ ID NO: 12522 - DNA, 25 bp, E. coli
gacaaccgccgtttcctgtggcagt

SEQ ID NO: 12523 - DNA, 25 bp, E. coli
gaaaaacagcaataacagcagcgcg

SEQ ID NO: 12524 - DNA, 25 bp, E. coli
gacaaccgccgtatcctgtggcagt

SEQ ID NO: 12525 - DNA, 25 bp, E. coli
ccgacgtggacggtgtatgaagaac

SEQ ID NO: 12526 - DNA, 25 bp, E. coli
ccgacgtggacgctgtatgaagaac

SEQ ID NO: 12527 - DNA, 25 bp, E. coli
gatactggcgtggatttttctgctg

SEQ ID NO: 12528 - DNA, 25 bp, E. coli
gatactggcgtgcatttttctgctg

SEQ ID NO: 12529 - DNA, 25 bp, E. coli
aggcgcgtattgcacagtcccgtcc

SEQ ID NO: 12530 - DNA, 25 bp, E. coli
aggcgcgtattggacagtcccgtcc

SEQ ID NO: 12531 - DNA, 25 bp, E. coli
aaaagtgaagtgcaagcctggctgc

SEQ ID NO: 12532 - DNA, 25 bp, E. coli
aaaagtgaagtggaagcctggctgc

SEQ ID NO: 12533 - DNA, 25 bp, E. coli
aaagtgaagtggaagcctggctgca

SEQ ID NO: 12534 - DNA, 25 bp, E. coli
aaagtgaagtggtagcctggctgca

SEQ ID NO: 12535 - DNA, 25 bp, E. coli
tgaagtggaagcgtggctgcaggcg

SEQ ID NO: 12536 - DNA, 25 bp, E. coli
tgaagtggaagcctggctgcaggcg

SEQ ID NO: 12537 - DNA, 25 bp, E. coli
tgaaaagtgaagaggaagcctggct

SEQ ID NO: 12538 - DNA, 25 bp, E. coli
tgaaaagtgaagtggaagcctggct

SEQ ID NO: 12539 - DNA, 25 bp, E. coli
tgcaggcgcgtaatgcacagtcccg

SEQ ID NO: 12540 - DNA, 25 bp, E. coli
tgcaggcgcgtattgcacagtcccg

SEQ ID NO: 12541 - DNA, 25 bp, E. coli
gctgcaggcgcgtattgcacagtcc

SEQ ID NO: 12542 - DNA, 25 bp, E. coli
gcgtattgcacagtcccgtccgtaa

SEQ ID NO: 12543 - DNA, 25 bp, E. coli
gctgcaggcgcgaattgcacagtcc

SEQ ID NO: 12544 - DNA, 25 bp, E. coli
gcgtattgcacactcccgtccgtaa

SEQ ID NO: 12545 - DNA, 25 bp, E. coli
ctgaaaagtgaagtggaagcctggc

SEQ ID NO: 12546 - DNA, 25 bp, E. coli
ctgaaaagtgaactggaagcctggc

SEQ ID NO: 12547 - DNA, 25 bp, E. coli
ggctgcaggcgcgtattgcacagtc

SEQ ID NO: 12548 - DNA, 25 bp, E. coli
ggctgcaggcgcctattgcacagtc

SEQ ID NO: 12549 - DNA, 25 bp, E. coli
tggctgaaaagtgaagtggaagcct

SEQ ID NO: 12550 - DNA, 25 bp, E. coli
tggctgaaaagtcaagtggaagcct

SEQ ID NO: 12551 - DNA, 25 bp, E. coli
taacgtcagtaagggatggcggcca

SEQ ID NO: 12552 - DNA, 25 bp, E. coli
agcacttcggtctgcggcataacgt

SEQ ID NO: 12553 - DNA, 25 bp, E. coli
agatcgtcaaccgtcaggctgtcgg

SEQ ID NO: 12554 - DNA, 25 bp, E. coli
agcacttcggtcagcggcataacgt

SEQ ID NO: 12555 - DNA, 25 bp, E. coli
agatcgtcaaccctcaggctgtcgg

SEQ ID NO: 12556 - DNA, 25 bp, E. coli
tttataccgccattccagcacttcg

SEQ ID NO: 12557 - DNA, 25 bp, E. coli
tttataccgccaatccagcacttcg

SEQ ID NO: 12558 - DNA, 25 bp, E. coli
tgttatcactcaacgttggccccgc

SEQ ID NO: 12559 - DNA, 25 bp, E. coli
tgttatcactcatcgttggccccgc

SEQ ID NO: 12560 - DNA, 25 bp, E. coli
tgcagacgcaggttgttatcactca

SEQ ID NO: 12561 - DNA, 25 bp, E. coli
tgcagacgcaggatgttatcactca

SEQ ID NO: 12562 - DNA, 25 bp, E. coli
cggccagtgaaaaatggtggcgata

SEQ ID NO: 12563 - DNA, 25 bp, E. coli
cggccagtgaaatatggtggcgata

SEQ ID NO: 12564 - DNA, 25 bp, E. coli
cattaagaatgacctgcagacgcag

SEQ ID NO: 12565 - DNA, 25 bp, E. coli
cattaagaatgagctgcagacgcag

SEQ ID NO: 12566 - DNA, 25 bp, E. coli
gttggccccgctactctgaatcgct

SEQ ID NO: 12567 - DNA, 25 bp, E. coli
gttggccccgcttctctgaatcgct

SEQ ID NO: 12568 - DNA, 25 bp, E. coli
gatatctgccaccagatcgtcaacc

SEQ ID NO: 12569 - DNA, 25 bp, E. coli
gatatctgccacgagatcgtcaacc

SEQ ID NO: 12570 - DNA, 25 bp, E. coli
gtgagcttgtcaaccgcattaagaa

SEQ ID NO: 12571 - DNA, 25 bp, E. coli
gtgagcttgtcatccgcattaagaa

SEQ ID NO: 12572 - DNA, 25 bp, E. coli
taacgtcagtaacggatggcggcca

SEQ ID NO: 12573 - DNA, 25 bp, E. coli
cacacaaccggtcgtggtgtctgag

SEQ ID NO: 12574 - DNA, 25 bp, E. coli
cacacaaccggtggtggtgtctgag

SEQ ID NO: 12575 - DNA, 25 bp, E. coli
ttacaatcctaatgtcatggcgccg

SEQ ID NO: 12576 - DNA, 25 bp, E. coli
ttacaatcctaaagtcatggcgccg

SEQ ID NO: 12577 - DNA, 25 bp, E. coli
tgctgcgaccatccgacataaccgg

SEQ ID NO: 12578 - DNA, 25 bp, E. coli
tgctgcgaccatgcgacataaccgg

SEQ ID NO: 12579 - DNA, 25 bp, E. coli
tcagtccttttgcacatgagccagt

SEQ ID NO: 12580 - DNA, 25 bp, E. coli
tctgtgacaccgcagataattggca

SEQ ID NO: 12581 - DNA, 25 bp, E. coli
tcagtccttttggacatgagccagt

SEQ ID NO: 12582 - DNA, 25 bp, E. coli
tctgtgacaccggagataattggca

SEQ ID NO: 12583 - DNA, 25 bp, E. coli
gacaggcctcacctattgctgcgac

SEQ ID NO: 12584 - DNA, 25 bp, E. coli
gaaaagaaccataacctggtggtgg

SEQ ID NO: 12585 - DNA, 25 bp, E. coli
gaaaagaaccattacctggtggtgg

SEQ ID NO: 12586 - DNA, 25 bp, E. coli
gacaggcctcacgtattgctgcgac

SEQ ID NO: 12587 - DNA, 25 bp, E. coli
gataattggcaacatgattcgtcag

SEQ ID NO: 12588 - DNA, 25 bp, E. coli
gataattggcaagatgattcgtcag

SEQ ID NO: 12589 - DNA, 25 bp, E. coli
ggcccttaatcagctgcgcagagtg

SEQ ID NO: 12590 - DNA, 25 bp, E. coli
ggctgccggtggactgtattaatcc

SEQ ID NO: 12591 - DNA, 25 bp, E. coli
ggcccttaatcacctgcgcagagtg

SEQ ID NO: 12592 - DNA, 25 bp, E. coli
ggctgccggtggtctgtattaatcc

SEQ ID NO: 12593 - DNA, 25 bp, E. coli
gaccaggatgaacttctcagattga

SEQ ID NO: 12594 - DNA, 25 bp, E. coli
gaccaggatgaagttctcagattga

SEQ ID NO: 12595 - DNA, 25 bp, E. coli
cagaaaagaagatgctacaccggaa

SEQ ID NO: 12596 - DNA, 25 bp, E. coli
cagaaaagaagaagctacaccggaa

SEQ ID NO: 12597 - DNA, 25 bp, E. coli
tatgctggtgcaatggttatggccg

SEQ ID NO: 12598 - DNA, 25 bp, E. coli
tatgctggtgcattggttatggccg

SEQ ID NO: 12599 - DNA, 25 bp, E. coli
ttagagcgtctgtaaaaaggtggca

SEQ ID NO: 12600 - DNA, 25 bp, E. coli
ttagagcgtctgaaaaaaggtggca

SEQ ID NO: 12601 - DNA, 25 bp, E. coli
tcttatcggcagtggagctctggct

SEQ ID NO: 12602 - DNA, 25 bp, E. coli
tcagacaaaactcggtcgtcgcttt

SEQ ID NO: 12603 - DNA, 25 bp, E. coli
tcttatcggcagaggagctctggct

SEQ ID NO: 12604 - DNA, 25 bp, E. coli
tcagacaaaactgggtcgtcgcttt

SEQ ID NO: 12605 - DNA, 25 bp, E. coli
gccggtaagttaatgagagccactg

SEQ ID NO: 12606 - DNA, 25 bp, E. coli
gccggtaagttattgagagccactg

SEQ ID NO: 12607 - DNA, 25 bp, E. coli
gcatcactatctcgtttggtctggg

SEQ ID NO: 12608 - DNA, 25 bp, E. coli
gcatcactatctggtttggtctggg

SEQ ID NO: 12609 - DNA, 25 bp, E. coli
ggtcgtcgtcgcttcttcatattaa

SEQ ID NO: 12610 - DNA, 25 bp, E. coli
ggtcgtcgtcgcatcttcatattaa

SEQ ID NO: 12611 - DNA, 25 bp, E. coli
tgtgccaaacgaggatttaaacgcc

SEQ ID NO: 12612 - DNA, 25 bp, E. coli
tgtgccaaacgacgatttaaacgcc

SEQ ID NO: 12613 - DNA, 25 bp, E. coli
tcaacgcatggttttatggagggct

SEQ ID NO: 12614 - DNA, 25 bp, E. coli
tcaacgcatggtattatggagggct

SEQ ID NO: 12615 - DNA, 25 bp, E. coli
gaggtcttaactggtcgtcgtcgtg

SEQ ID NO: 12616 - DNA, 25 bp, E. coli
gaggtcttaactcgtcgtcgtcgtg

SEQ ID NO: 12617 - DNA, 25 bp, E. coli
caacacggattgttccggctaaagg

SEQ ID NO: 12618 - DNA, 25 bp, E. coli
caacacggattgatccggctaaagg

SEQ ID NO: 12619 - DNA, 25 bp, E. coli
atagagcgaggaggctaacaggaac

SEQ ID NO: 12620 - DNA, 25 bp, E. coli
atagagcgaggacgctaacaggaac

SEQ ID NO: 12621 - DNA, 25 bp, E. coli
aacaggaacaatgactcaggatgag

SEQ ID NO: 12622 - DNA, 25 bp, E. coli
aacaggaacaatcactcaggatgag

SEQ ID NO: 12623 - DNA, 25 bp, E. coli
ttaaacggaaatcgaatcaacacgg

SEQ ID NO: 12624 - DNA, 25 bp, E. coli
ttaaacggaaatggaatcaacacgg

SEQ ID NO: 12625 - DNA, 25 bp, E. coli
tgttggcggcctccaaggattgtaa

SEQ ID NO: 12626 - DNA, 25 bp, E. coli
tgttggcggcctgcaaggattgtaa

SEQ ID NO: 12627 - DNA, 25 bp, E. coli
gcctgcaaggattgtaagacccgtt

SEQ ID NO: 12628 - DNA, 25 bp, E. coli
gcctgcaaggatagtaagacccgtt

SEQ ID NO: 12629 - DNA, 25 bp, E. coli
gctaaaggaaaatcagggtgtgttg

SEQ ID NO: 12630 - DNA, 25 bp, E. coli
gctaaaggaaaaacagggtgtgttg

SEQ ID NO: 12631 - DNA, 25 bp, E. coli
gaatcaacacggattgttccggcta

SEQ ID NO: 12632 - DNA, 25 bp, E. coli
gaatcaacacggtttgttccggcta

SEQ ID NO: 12633 - DNA, 25 bp, E. coli
gcaaggattgtatgacccgttaagg

SEQ ID NO: 12634 - DNA, 25 bp, E. coli
gcaaggattgtaagacccgttaagg

SEQ ID NO: 12635 - DNA, 25 bp, E. coli
gacccgttaagggttatgagtcagg

SEQ ID NO: 12636 - DNA, 25 bp, E. coli
gacccgttaaggcttatgagtcagg

SEQ ID NO: 12637 - DNA, 25 bp, E. coli
gacgctaacaggaacaatgactcag

SEQ ID NO: 12638 - DNA, 25 bp, E. coli
gacgctaacaggtacaatgactcag

SEQ ID NO: 12639 - DNA, 25 bp, E. coli
catctttcgcgttgttggcagagaa

SEQ ID NO: 12640 - DNA, 25 bp, E. coli
catctttcgcgtagttggcagagaa

SEQ ID NO: 12641 - DNA, 25 bp, E. coli
tttattctgccgatagcggagtgta

SEQ ID NO: 12642 - DNA, 25 bp, E. coli
tttattctgccgttagcggagtgta

SEQ ID NO: 12643 - DNA, 25 bp, E. coli
tgtgctgacgttttcccttccggca

SEQ ID NO: 12644 - DNA, 25 bp, E. coli
tgtgctgacgttatcccttccggca

SEQ ID NO: 12645 - DNA, 25 bp, E. coli
tgcatacgaccattcaaccaggtcg

SEQ ID NO: 12646 - DNA, 25 bp, E. coli
tgcatacgaccaatcaaccaggtcg

SEQ ID NO: 12647 - DNA, 25 bp, E. coli
tgcctgttctccatttgccgttgaa

SEQ ID NO: 12648 - DNA, 25 bp, E. coli
tgcctgttctccttttgccgttgaa

SEQ ID NO: 12649 - DNA, 25 bp, E. coli
tcggtgaagttcctcccatgccgtg

SEQ ID NO: 12650 - DNA, 25 bp, E. coli
tcggtgaagttcgtcccatgccgtg

SEQ ID NO: 12651 - DNA, 25 bp, E. coli
gccaatccattaggaggccgctttc

SEQ ID NO: 12652 - DNA, 25 bp, E. coli
gccaatccattacgaggccgctttc

SEQ ID NO: 12653 - DNA, 25 bp, E. coli
gcgggataagtctaccgccaatcca

SEQ ID NO: 12654 - DNA, 25 bp, E. coli
gcgggataagtcaaccgccaatcca

SEQ ID NO: 12655 - DNA, 25 bp, E. coli
cccgacacaggaagtattttgcatc

SEQ ID NO: 12656 - DNA, 25 bp, E. coli
cgcgacgcgacagtatcggtgaagt

SEQ ID NO: 12657 - DNA, 25 bp, E. coli
cgcgacgcgacactatcggtgaagt

SEQ ID NO: 12658 - DNA, 25 bp, E. coli
cccgacacaggatgtattttgcatc

SEQ ID NO: 12659 - DNA, 25 bp, E. coli
tggcagagaagccaacaggaaaact

SEQ ID NO: 12660 - DNA, 25 bp, E. coli
tggcagagaagcgaacaggaaaact

SEQ ID NO: 12661 - DNA, 25 bp, E. coli
caactttgagtacgatggtgttgga

SEQ ID NO: 12662 - DNA, 25 bp, E. coli
caactttgagtaggatggtgttgga

SEQ ID NO: 12663 - DNA, 25 bp, E. coli
aagcttttttcctgtcgctacgacg

SEQ ID NO: 12664 - DNA, 25 bp, E. coli
aagcttttttccagtcgctacgacg

SEQ ID NO: 12665 - DNA, 25 bp, E. coli
taccagggtgttaacgacttcgact

SEQ ID NO: 12666 - DNA, 25 bp, E. coli
taccagggtgtttacgacttcgact

SEQ ID NO: 12667 - DNA, 25 bp, E. coli
ttcaaacagtttgtgcacagcagct

SEQ ID NO: 12668 - DNA, 25 bp, E. coli
ttcaaacagtttctgcacagcagct

SEQ ID NO: 12669 - DNA, 25 bp, E. coli
tcagggtgacgttagcttttttcca

SEQ ID NO: 12670 - DNA, 25 bp, E. coli
tcagggtgacgtaagcttttttcca

SEQ ID NO: 12671 - DNA, 25 bp, E. coli
tcgctacgacgagcgatacgctgtc

SEQ ID NO: 12672 - DNA, 25 bp, E. coli
tcgctacgacgaccgatacgctgtc

SEQ ID NO: 12673 - DNA, 25 bp, E. coli
gctttttcagaaacgtgcggtgcac

SEQ ID NO: 12674 - DNA, 25 bp, E. coli
gctttttcagaatcgtgcggtgcac

SEQ ID NO: 12675 - DNA, 25 bp, E. coli
ctttgatttctggtttggtcgcgtc

SEQ ID NO: 12676 - DNA, 25 bp, E. coli
ctttgatttctgctttggtcgcgtc

SEQ ID NO: 12677 - DNA, 25 bp, E. coli
gatacgctgtccctgacgtttaact

SEQ ID NO: 12678 - DNA, 25 bp, E. coli
gatacgctgtccgtgacgtttaact

SEQ ID NO: 12679 - DNA, 25 bp, E. coli
ggatttttccatcgcagtagacgct

SEQ ID NO: 12680 - DNA, 25 bp, E. coli
ggatttttccatggcagtagacgct

SEQ ID NO: 12681 - DNA, 25 bp, E. coli
tggtcgcgtctttagcaactttgag

SEQ ID NO: 12682 - DNA, 25 bp, E. coli
tggtcgcgtcttaagcaactttgag

SEQ ID NO: 12683 - DNA, 25 bp, E. coli
cagcaaactgaatgtgcaggcgcaa

SEQ ID NO: 12684 - DNA, 25 bp, E. coli
cagcaaactgaaagtgcaggcgcaa

SEQ ID NO: 12685 - DNA, 25 bp, E. coli
tgtggaagcgaatctgaaacagggc

SEQ ID NO: 12686 - DNA, 25 bp, E. coli
tgtggaagcgaaactgaaacagggc

SEQ ID NO: 12687 - DNA, 25 bp, E. coli
tgaagcgcggcattgaaggcagttc

SEQ ID NO: 12688 - DNA, 25 bp, E. coli
tgaagggagaggtaaagatgccatc

SEQ ID NO: 12689 - DNA, 25 bp, E. coli
tgaagggagaggaaaagatgccatc

SEQ ID NO: 12690 - DNA, 25 bp, E. coli
tgaagcgcggcaatgaaggcagttc

SEQ ID NO: 12691 - DNA, 25 bp, E. coli
tcggtcagccgttccagttcaaaaa

SEQ ID NO: 12692 - DNA, 25 bp, E. coli
tcggtcagccgtaccagttcaaaaa

SEQ ID NO: 12693 - DNA, 25 bp, E. coli
tcttcaggaagctcgtaacgcggtc

SEQ ID NO: 12694 - DNA, 25 bp, E. coli
tcttcaggaagcacgtaacgcggtc

SEQ ID NO: 12695 - DNA, 25 bp, E. coli
ccatcaaagtgttgagcgagtccga

SEQ ID NO: 12696 - DNA, 25 bp, E. coli
ccatcaaagtgtagagcgagtccga

SEQ ID NO: 12697 - DNA, 25 bp, E. coli
taacgcggtcgataacgcgagccgc

SEQ ID NO: 12698 - DNA, 25 bp, E. coli
taacgttgaagcctcatttgagctg

SEQ ID NO: 12699 - DNA, 25 bp, E. coli
taacgcggtcgaaaacgcgagccgc

SEQ ID NO: 12700 - DNA, 25 bp, E. coli
taacgttgaagcgtcatttgagctg

SEQ ID NO: 12701 - DNA, 25 bp, E. coli
gacgccagcaaatccatcaaagtgt

SEQ ID NO: 12702 - DNA, 25 bp, E. coli
gacgccagcaaaaccatcaaagtgt

SEQ ID NO: 12703 - DNA, 25 bp, E. coli
gagccgcgaagtcgagtcccgtttt

SEQ ID NO: 12704 - DNA, 25 bp, E. coli
gagccgcgaagtggagtcccgtttt

SEQ ID NO: 12705 - DNA, 25 bp, E. coli
aacggtctgactctcctgccacaaa

SEQ ID NO: 12706 - DNA, 25 bp, E. coli
tacataacggtcagactgtcctgcc

SEQ ID NO: 12707 - DNA, 25 bp, E. coli
tacataacggtctgactgtcctgcc

SEQ ID NO: 12708 - DNA, 25 bp, E. coli
atttgttgccgctccaacgatcgcc

SEQ ID NO: 12709 - DNA, 25 bp, E. coli
atttgttgccgcaccaacgatcgcc

SEQ ID NO: 12710 - DNA, 25 bp, E. coli
aacggtctgactgtcctgccacaaa

SEQ ID NO: 12711 - DNA, 25 bp, E. coli
tagcggcggcccttgccgtacataa

SEQ ID NO: 12712 - DNA, 25 bp, E. coli
tagcggcggcccatgccgtacataa

SEQ ID NO: 12713 - DNA, 25 bp, E. coli
ttttacgcgtgttgcggcggcccat

SEQ ID NO: 12714 - DNA, 25 bp, E. coli
ttttacgcgtgtagcggcggcccat

SEQ ID NO: 12715 - DNA, 25 bp, E. coli
tgtcctgccacaaaccgagaagttt

SEQ ID NO: 12716 - DNA, 25 bp, E. coli
tgtcctgccacataccgagaagttt

SEQ ID NO: 12717 - DNA, 25 bp, E. coli
tcgttttacgcgagtagcggcggcc

SEQ ID NO: 12718 - DNA, 25 bp, E. coli
tcgttttacgcgtgtagcggcggcc

SEQ ID NO: 12719 - DNA, 25 bp, E. coli
gcttgccgatcagcaaaatcagcag

SEQ ID NO: 12720 - DNA, 25 bp, E. coli
gcttgccgatcaccaaaatcagcag

SEQ ID NO: 12721 - DNA, 25 bp, E. coli
gaacaggcgcttcccgatcagcaaa

SEQ ID NO: 12722 - DNA, 25 bp, E. coli
gaacaggcgcttgccgatcagcaaa

SEQ ID NO: 12723 - DNA, 25 bp, E. coli
cggcccatgccgaacataacggtct

SEQ ID NO: 12724 - DNA, 25 bp, E. coli
cggcccatgccgtacataacggtct

SEQ ID NO: 12725 - DNA, 25 bp, E. coli
ggtctgccatttgttgccgctccaa

SEQ ID NO: 12726 - DNA, 25 bp, E. coli
ggtctgccatttcttgccgctccaa

SEQ ID NO: 12727 - DNA, 25 bp, E. coli
cacctgaaccggatgaagatgatgg

SEQ ID NO: 12728 - DNA, 25 bp, E. coli
cacctgaaccggttgaagatgatgg

SEQ ID NO: 12729 - DNA, 25 bp, E. coli
agaaacctggattctgttcaatgcc

SEQ ID NO: 12730 - DNA, 25 bp, E. coli
agaaacctggatactgttcaatgcc

SEQ ID NO: 12731 - DNA, 25 bp, E. coli
tatagcacctgaaccggatgaagat

SEQ ID NO: 12732 - DNA, 25 bp, E. coli
tatagcacctgatccggatgaagat

SEQ ID NO: 12733 - DNA, 25 bp, E. coli
tttatagcacctgaaccggatgaag

SEQ ID NO: 12734 - DNA, 25 bp, E. coli
tttatagcacctcaaccggatgaag

SEQ ID NO: 12735 - DNA, 25 bp, E. coli
cctgaaccggatgaagatgatggag

SEQ ID NO: 12736 - DNA, 25 bp, E. coli
cctgaaccggatcaagatgatggag

SEQ ID NO: 12737 - DNA, 25 bp, E. coli
gaagatgatggagaaacctggatac

SEQ ID NO: 12738 - DNA, 25 bp, E. coli
gaagatgatggacaaacctggatac

SEQ ID NO: 12739 - DNA, 25 bp, E. coli
ccggatgaagatcatggagaaacct

SEQ ID NO: 12740 - DNA, 25 bp, E. coli
ccggatgaagatgatggagaaacct

SEQ ID NO: 12741 - DNA, 25 bp, E. coli
ggagaaacctggatactgttcaatg

SEQ ID NO: 12742 - DNA, 25 bp, E. coli
ggagaaacctggttactgttcaatg

SEQ ID NO: 12743 - DNA, 25 bp, E. coli
gatggagaaacctggatactgttca

SEQ ID NO: 12744 - DNA, 25 bp, E. coli
gatgatggagaaacctggatactgt

SEQ ID NO: 12745 - DNA, 25 bp, E. coli
gatgaagatgatggagaaacctgga

SEQ ID NO: 12746 - DNA, 25 bp, E. coli
gatggagaaaccaggatactgttca

SEQ ID NO: 12747 - DNA, 25 bp, E. coli
gatgatggagaatcctggatactgt

SEQ ID NO: 12748 - DNA, 25 bp, E. coli
gatgaagatgatcgagaaacctgga

SEQ ID NO: 12749 - DNA, 25 bp, E. coli
aatgcagctgtatgtgatcggtttc

SEQ ID NO: 12750 - DNA, 25 bp, E. coli
aataaatgcagcagtatgtgatcgg

SEQ ID NO: 12751 - DNA, 25 bp, E. coli
aatgcagctgtaagtgatcggtttc

SEQ ID NO: 12752 - DNA, 25 bp, E. coli
aataaatgcagctgtatgtgatcgg

SEQ ID NO: 12753 - DNA, 25 bp, E. coli
cagctgtatgtgatcggtttctaag

SEQ ID NO: 12754 - DNA, 25 bp, E. coli
cagctgtatgtgttcggtttctaag

SEQ ID NO: 12755 - DNA, 25 bp, E. coli
taaatgcagctgtatgtgatcggtt

SEQ ID NO: 12756 - DNA, 25 bp, E. coli
taaatgcagctgaatgtgatcggtt

SEQ ID NO: 12757 - DNA, 25 bp, E. coli
tcggtttctaagtattttccatccg

SEQ ID NO: 12758 - DNA, 25 bp, E. coli
tccatccgggaataataatcgaaat

SEQ ID NO: 12759 - DNA, 25 bp, E. coli
tccatccgggaaaaataatcgaaat

SEQ ID NO: 12760 - DNA, 25 bp, E. coli
tcggtttctaagaattttccatccg

SEQ ID NO: 12761 - DNA, 25 bp, E. coli
ccttaataaatgcagctgtatgtga

SEQ ID NO: 12762 - DNA, 25 bp, E. coli
ccttaataaatggagctgtatgtga

SEQ ID NO: 12763 - DNA, 25 bp, E. coli
gctgtatgtgatgggtttctaagaa

SEQ ID NO: 12764 - DNA, 25 bp, E. coli
gctgtatgtgatcggtttctaagaa

SEQ ID NO: 12765 - DNA, 25 bp, E. coli
gcagctgtatgtcatcggtttctaa

SEQ ID NO: 12766 - DNA, 25 bp, E. coli
gcagctgtatgtgatcggtttctaa

SEQ ID NO: 12767 - DNA, 25 bp, E. coli
tgtgatcggtttctaagaattttcc

SEQ ID NO: 12768 - DNA, 25 bp, E. coli
tgtgatcggtttgtaagaattttcc

SEQ ID NO: 12769 - DNA, 25 bp, E. coli
taaccttaataattgcagctgtatg

SEQ ID NO: 12770 - DNA, 25 bp, E. coli
taaccttaataaatgcagctgtatg

SEQ ID NO: 12771 - DNA, 25 bp, E. coli
aatcgcgctgtctcaattatgactg

SEQ ID NO: 12772 - DNA, 25 bp, E. coli
aatcgcgctgtcacaattatgactg

SEQ ID NO: 12773 - DNA, 25 bp, E. coli
catctgttgattctcgatgccattg

SEQ ID NO: 12774 - DNA, 25 bp, E. coli
catctgttgattgtcgatgccattg

SEQ ID NO: 12775 - DNA, 25 bp, E. coli
atatccgcggacttctgccagcaca

SEQ ID NO: 12776 - DNA, 25 bp, E. coli
atatccgcggacatctgccagcaca

SEQ ID NO: 12777 - DNA, 25 bp, E. coli
tgtatgcccattaccactggcccga

SEQ ID NO: 12778 - DNA, 25 bp, E. coli
tgtatgcccatttccactggcccga

SEQ ID NO: 12779 - DNA, 25 bp, E. coli
tgccagcacatattgccctcgtcgg

SEQ ID NO: 12780 - DNA, 25 bp, E. coli
tccggcttatctcagcgcgaagaaa

SEQ ID NO: 12781 - DNA, 25 bp, E. coli
tccggcttatctgagcgcgaagaaa

SEQ ID NO: 12782 - DNA, 25 bp, E. coli
tgccagcacataatgccctcgtcgg

SEQ ID NO: 12783 - DNA, 25 bp, E. coli
gactgtctgtcgatggaaaattacg

SEQ ID NO: 12784 - DNA, 25 bp, E. coli
gactgtctgtcgttggaaaattacg

SEQ ID NO: 12785 - DNA, 25 bp, E. coli
gcaaccggctaatgaatcgcgctgt

SEQ ID NO: 12786 - DNA, 25 bp, E. coli
gcaaccggctaaagaatcgcgctgt

SEQ ID NO: 12787 - DNA, 25 bp, E. coli
gaaaattacgaacgcgttcgcttgc

SEQ ID NO: 12788 - DNA, 25 bp, E. coli
gaaaattacgaaggcgttcgcttgc

SEQ ID NO: 12789 - DNA, 25 bp, E. coli
ggaattgtgccgcaaccggctaatg

SEQ ID NO: 12790 - DNA, 25 bp, E. coli
ggaattgtgccggaaccggctaatg

SEQ ID NO: 12791 - DNA, 25 bp, E. coli
tcagcgcgaagataatgagcctgca

SEQ ID NO: 12792 - DNA, 25 bp, E. coli
tcagcgcgaagaaaatgagcctgca

SEQ ID NO: 12793 - DNA, 25 bp, E. coli
tacctgttgaaatcacgcgtgccgg

SEQ ID NO: 12794 - DNA, 25 bp, E. coli
tacctgttgaaaacacgcgtgccgg

SEQ ID NO: 12795 - DNA, 25 bp, E. coli
tttattcagggcaatacggcgctgc

SEQ ID NO: 12796 - DNA, 25 bp, E. coli
tttattcagggctatacggcgctgc

SEQ ID NO: 12797 - DNA, 25 bp, E. coli
tctgcctggcgtgaatgacacacgg

SEQ ID NO: 12798 - DNA, 25 bp, E. coli
tctgcctggcgtcaatgacacacgg

SEQ ID NO: 12799 - DNA, 25 bp, E. coli
gccctggcaaagttctcgaccgtat

SEQ ID NO: 12800 - DNA, 25 bp, E. coli
gccctggcaaagatctcgaccgtat

SEQ ID NO: 12801 - DNA, 25 bp, E. coli
gaagaagtcaagcagagtaatcgtc

SEQ ID NO: 12802 - DNA, 25 bp, E. coli
gaagaagtcaaggagagtaatcgtc

SEQ ID NO: 12803 - DNA, 25 bp, E. coli
cgagctttctaatcgtgtgggactt

SEQ ID NO: 12804 - DNA, 25 bp, E. coli
cgagctttctaaacgtgtgggactt

SEQ ID NO: 12805 - DNA, 25 bp, E. coli
gattactctgaatcgtggcgcaccg

SEQ ID NO: 12806 - DNA, 25 bp, E. coli
gattactctgaaacgtggcgcaccg

SEQ ID NO: 12807 - DNA, 25 bp, E. coli
tggtagatagcaagaagcgccctgg

SEQ ID NO: 12808 - DNA, 25 bp, E. coli
tggtagatagcatgaagcgccctgg

SEQ ID NO: 12809 - DNA, 25 bp, E. coli
ggcgcaccggatgtgtttgaacaat

SEQ ID NO: 12810 - DNA, 25 bp, E. coli
ggcgcaccggatctgtttgaacaat

SEQ ID NO: 12811 - DNA, 25 bp, E. coli
taatgagttgcaaaaggatgggcgt

SEQ ID NO: 12812 - DNA, 25 bp, E. coli
taatgagttgcataaggatgggcgt

SEQ ID NO: 12813 - DNA, 25 bp, E. coli
gatgggcgtatttctaacgtcgagc

SEQ ID NO: 12814 - DNA, 25 bp, E. coli
gatgggcgtattactaacgtcgagc

SEQ ID NO: 12815 - DNA, 25 bp, E. coli
tacaattcattggtcagcgggcggc

SEQ ID NO: 12816 - DNA, 25 bp, E. coli
tacaattcattgctcagcgggcggc

SEQ ID NO: 12817 - DNA, 25 bp, E. coli
aaaggttacattctcaccgagcagg

SEQ ID NO: 12818 - DNA, 25 bp, E. coli
aaaggttacattgtcaccgagcagg

SEQ ID NO: 12819 - DNA, 25 bp, E. coli
taccgtttcagaattcaaagcgggc

SEQ ID NO: 12820 - DNA, 25 bp, E. coli
tatggatttaatgcgcaaaggccgg

SEQ ID NO: 12821 - DNA, 25 bp, E. coli
taccgtttcagatttcaaagcgggc

SEQ ID NO: 12822 - DNA, 25 bp, E. coli
tatggatttaatccgcaaaggccgg

SEQ ID NO: 12823 - DNA, 25 bp, E. coli
tgaaacccactttaccggagctgga

SEQ ID NO: 12824 - DNA, 25 bp, E. coli
tgaaacccacttaaccggagctgga

SEQ ID NO: 12825 - DNA, 25 bp, E. coli
gcaaaatcaaacactggctggcgca

SEQ ID NO: 12826 - DNA, 25 bp, E. coli
gcaaaatcaaactctggctggcgca

SEQ ID NO: 12827 - DNA, 25 bp, E. coli
cgaaatgctcctggaagaaacgcgc

SEQ ID NO: 12828 - DNA, 25 bp, E. coli
cgattaacgatagccatctgctgga

SEQ ID NO: 12829 - DNA, 25 bp, E. coli
cgaaatgctcctcgaagaaacgcgc

SEQ ID NO: 12830 - DNA, 25 bp, E. coli
ccgaggcgctggaatgggtctttac

SEQ ID NO: 12831 - DNA, 25 bp, E. coli
cgatttacttcgtcatgcgggcgtg

SEQ ID NO: 12832 - DNA, 25 bp, E. coli
ccgaggcgctggtatgggtctttac

SEQ ID NO: 12833 - DNA, 25 bp, E. coli
cgattaacgatacccatctgctgga

SEQ ID NO: 12834 - DNA, 25 bp, E. coli
cgatttacttcgacatgcgggcgtg

SEQ ID NO: 12835 - DNA, 25 bp, E. coli
ggctggcgcatattcacaccctgaa

SEQ ID NO: 12836 - DNA, 25 bp, E. coli
ggctggcgcataatcacaccctgaa

SEQ ID NO: 12837 - DNA, 25 bp, E. coli
caaataccggtcatccactgaaaaa

SEQ ID NO: 12838 - DNA, 25 bp, E. coli
caaataccggtcttccactgaaaaa

SEQ ID NO: 12839 - DNA, 25 bp, E. coli
cagcccaaggcctgaaaagtaaagc

SEQ ID NO: 12840 - DNA, 25 bp, E. coli
cagcccaaggccagaaaagtaaagc

SEQ ID NO: 12841 - DNA, 25 bp, E. coli
accataatgatgtacaggattggca

SEQ ID NO: 12842 - DNA, 25 bp, E. coli
accataatgatgaacaggattggca

SEQ ID NO: 12843 - DNA, 25 bp, E. coli
ttttcagtacaattaccggtcatcc

SEQ ID NO: 12844 - DNA, 25 bp, E. coli
ttttcagtacaaataccggtcatcc

SEQ ID NO: 12845 - DNA, 25 bp, E. coli
tcagtggcacacagtagcctccctg

SEQ ID NO: 12846 - DNA, 25 bp, E. coli
tcagtggcacactgtagcctccctg

SEQ ID NO: 12847 - DNA, 25 bp, E. coli
gcctccctgcacatgaccataatga

SEQ ID NO: 12848 - DNA, 25 bp, E. coli
gccggtatattcctctctcccttaa

SEQ ID NO: 12849 - DNA, 25 bp, E. coli
ccataacaggttagttatcttcgtc

SEQ ID NO: 12850 - DNA, 25 bp, E. coli
gccggtatattcgtctctcccttaa

SEQ ID NO: 12851 - DNA, 25 bp, E. coli
gcctccctgcacttgaccataatga

SEQ ID NO: 12852 - DNA, 25 bp, E. coli
ccataacaggtttgttatcttcgtc

SEQ ID NO: 12853 - DNA, 25 bp, E. coli
gaataagtggctgaggtttcaaact

SEQ ID NO: 12854 - DNA, 25 bp, E. coli
gaataagtggctcaggtttcaaact

SEQ ID NO: 12855 - DNA, 25 bp, E. coli
ggcggtaataatgagtggcacactg

SEQ ID NO: 12856 - DNA, 25 bp, E. coli
ggcggtaataatcagtggcacactg

SEQ ID NO: 12857 - DNA, 25 bp, E. coli
ggtttcaaactgtctgccggtatat

SEQ ID NO: 12858 - DNA, 25 bp, E. coli
ggtttcaaactgactgccggtatat

SEQ ID NO: 12859 - DNA, 25 bp, E. coli
catacgctgggactgaacctgacga

SEQ ID NO: 12860 - DNA, 25 bp, E. coli
catacgctgggagtgaacctgacga

SEQ ID NO: 12861 - DNA, 25 bp, E. coli
tacggcatcttttactggctggcag

SEQ ID NO: 12862 - DNA, 25 bp, E. coli
tacggcatctttaactggctggcag

SEQ ID NO: 12863 - DNA, 25 bp, E. coli
ttctgggcaggcttcgatcagcgca

SEQ ID NO: 12864 - DNA, 25 bp, E. coli
ttctgggcaggcatcgatcagcgca

SEQ ID NO: 12865 - DNA, 25 bp, E. coli
tgtttccggagcagatgcaacccgc

SEQ ID NO: 12866 - DNA, 25 bp, E. coli
tgtttccggagctgatgcaacccgc

SEQ ID NO: 12867 - DNA, 25 bp, E. coli
tgctgctggcgattcaactgaacct

SEQ ID NO: 12868 - DNA, 25 bp, E. coli
tgctgctggcgaatcaactgaacct

SEQ ID NO: 12869 - DNA, 25 bp, E. coli
tctgtcattcatcgcggcatgcggg

SEQ ID NO: 12870 - DNA, 25 bp, E. coli
tctgtcattcatggcggcatgcggg

SEQ ID NO: 12871 - DNA, 25 bp, E. coli
gctgctggccgaagatcatgcttac

SEQ ID NO: 12872 - DNA, 25 bp, E. coli
gctgctggccgatgatcatgcttac

SEQ ID NO: 12873 - DNA, 25 bp, E. coli
gaaacaaactgaacctcgcgggtat

SEQ ID NO: 12874 - DNA, 25 bp, E. coli
gaaacaaactgatcctcgcgggtat

SEQ ID NO: 12875 - DNA, 25 bp, E. coli
cgtttatcggtcagctggtgccaca

SEQ ID NO: 12876 - DNA, 25 bp, E. coli
cgtttatcggtctgctggtgccaca

SEQ ID NO: 12877 - DNA, 25 bp, E. coli
gatcagcgcaacctactgccagtga

SEQ ID NO: 12878 - DNA, 25 bp, E. coli
gatcagcgcaacgtactgccagtga

SEQ ID NO: 12879 - DNA, 25 bp, E. coli
gaggcggatttcgtcatacccatga

SEQ ID NO: 12880 - DNA, 25 bp, E. coli
gaggcggatttcctcatacccatga

SEQ ID NO: 12881 - DNA, 25 bp, E. coli
cacatttatgcgtagtgccactgct

SEQ ID NO: 12882 - DNA, 25 bp, E. coli
caacattgcattgccattgactggc

SEQ ID NO: 12883 - DNA, 25 bp, E. coli
cacatttatgcgaagtgccactgct

SEQ ID NO: 12884 - DNA, 25 bp, E. coli
caacattgcattcccattgactggc

SEQ ID NO: 12885 - DNA, 25 bp, E. coli
tacaggagagatcgaaagtgatatc

SEQ ID NO: 12886 - DNA, 25 bp, E. coli
tacaggagagatggaaagtgatatc

SEQ ID NO: 12887 - DNA, 25 bp, E. coli
aaagtgatatctcgctaaacagcgc

SEQ ID NO: 12888 - DNA, 25 bp, E. coli
aaagtgatatctggctaaacagcgc

SEQ ID NO: 12889 - DNA, 25 bp, E. coli
tttaccctgccggtggacttctctg

SEQ ID NO: 12890 - DNA, 25 bp, E. coli
tttaccctgccgctggacttctctg

SEQ ID NO: 12891 - DNA, 25 bp, E. coli
tgccattattgctccactggctgat

SEQ ID NO: 12892 - DNA, 25 bp, E. coli
tgccattattgcaccactggctgat

SEQ ID NO: 12893 - DNA, 25 bp, E. coli
gccagcaaagcgatggtgccattat

SEQ ID NO: 12894 - DNA, 25 bp, E. coli
gccagcaaagcgttggtgccattat

SEQ ID NO: 12895 - DNA, 25 bp, E. coli
gaagtgccactgctacaacattgca

SEQ ID NO: 12896 - DNA, 25 bp, E. coli
gaagtgccactggtacaacattgca

SEQ ID NO: 12897 - DNA, 25 bp, E. coli
cattcccattgactggcaagccgac

SEQ ID NO: 12898 - DNA, 25 bp, E. coli
cattcccattgagtggcaagccgac

SEQ ID NO: 12899 - DNA, 25 bp, E. coli
gtggcatacaggtgagatcgaaagt

SEQ ID NO: 12900 - DNA, 25 bp, E. coli
ggacttctctgtattcgcacattta

SEQ ID NO: 12901 - DNA, 25 bp, E. coli
gtggcatacaggagagatcgaaagt

SEQ ID NO: 12902 - DNA, 25 bp, E. coli
ggacttctctgttttcgcacattta

SEQ ID NO: 12903 - DNA, 25 bp, E. coli
caaggcgcgaaaggttatgtcatta

SEQ ID NO: 12904 - DNA, 25 bp, E. coli
caaggcgcgaaacgttatgtcatta

SEQ ID NO: 12905 - DNA, 25 bp, E. coli
tatgccgcgcaagcgatgagtaacc

SEQ ID NO: 12906 - DNA, 25 bp, E. coli
tatgccgcgcaaccgatgagtaacc

SEQ ID NO: 12907 - DNA, 25 bp, E. coli
ttatgtcattaaatccgcaggcgga

SEQ ID NO: 12908 - DNA, 25 bp, E. coli
ttatgtcattaattccgcaggcgga

SEQ ID NO: 12909 - DNA, 25 bp, E. coli
tgattgccaccgacctgagcggaat

SEQ ID NO: 12910 - DNA, 25 bp, E. coli
tgattgccaccgtcctgagcggaat

SEQ ID NO: 12911 - DNA, 25 bp, E. coli
tcattatgaaaaagtgcctcacact

SEQ ID NO: 12912 - DNA, 25 bp, E. coli
tcattatgaaaatgtgcctcacact

SEQ ID NO: 12913 - DNA, 25 bp, E. coli
gcactacccgttctatttatgagga

SEQ ID NO: 12914 - DNA, 25 bp, E. coli
gcactacccgttgtatttatgagga

SEQ ID NO: 12915 - DNA, 25 bp, E. coli
gaaatgaccagatgttcggtactgc

SEQ ID NO: 12916 - DNA, 25 bp, E. coli
gaaatgaccagaagttcggtactgc

SEQ ID NO: 12917 - DNA, 25 bp, E. coli
cgttcaaaaaattagcacatctctg

SEQ ID NO: 12918 - DNA, 25 bp, E. coli
cgttcaaaaaataagcacatctctg

SEQ ID NO: 12919 - DNA, 25 bp, E. coli
ggaatctctctcacggcttatgccg

SEQ ID NO: 12920 - DNA, 25 bp, E. coli
ggaatctctctctcggcttatgccg

SEQ ID NO: 12921 - DNA, 25 bp, E. coli
tggcgcatcaaagctaagcgatctg

SEQ ID NO: 12922 - DNA, 25 bp, E. coli
tggcgcatcaaacctaagcgatctg

SEQ ID NO: 12923 - DNA, 25 bp, E. coli
gtaccgtttcggcaactggcgcatc

SEQ ID NO: 12924 - DNA, 25 bp, E. coli
gtaccgtttcgggaactggcgcatc

SEQ ID NO: 12925 - DNA, 25 bp, E. coli
caaaaacaatttgatgacgccggaa

SEQ ID NO: 12926 - DNA, 25 bp, E. coli
cactcagacgggttggttcagcaaa

SEQ ID NO: 12927 - DNA, 25 bp, E. coli
caaaaacaatttcatgacgccggaa

SEQ ID NO: 12928 - DNA, 25 bp, E. coli
cactcagacgggatggttcagcaaa

SEQ ID NO: 12929 - DNA, 25 bp, E. coli
taaacaggcgatattcgcgacccca

SEQ ID NO: 12930 - DNA, 25 bp, E. coli
tacgccgcaaaactgaatgaccagg

SEQ ID NO: 12931 - DNA, 25 bp, E. coli
tatgaaaaccctgcgtcaacaggtg

SEQ ID NO: 12932 - DNA, 25 bp, E. coli
tatgaaaaccctccgtcaacaggtg

SEQ ID NO: 12933 - DNA, 25 bp, E. coli
tacgccgcaaaagtgaatgaccagg

SEQ ID NO: 12934 - DNA, 25 bp, E. coli
tatgctgaaaggagaaaccgacgag

SEQ ID NO: 12935 - DNA, 25 bp, E. coli
tatgctgaaaggtgaaaccgacgag

SEQ ID NO: 12936 - DNA, 25 bp, E. coli
tgggcgatcaattctccgagctggc

SEQ ID NO: 12937 - DNA, 25 bp, E. coli
tgggcgatcaatactccgagctggc

SEQ ID NO: 12938 - DNA, 25 bp, E. coli
tctgacatcatctccgtagacggcg

SEQ ID NO: 12939 - DNA, 25 bp, E. coli
tctgacatcatcaccgtagacggcg

SEQ ID NO: 12940 - DNA, 25 bp, E. coli
gaaaaagccctccatgcgtactacg

SEQ ID NO: 12941 - DNA, 25 bp, E. coli
gaaaaagccctcgatgcgtactacg

SEQ ID NO: 12942 - DNA, 25 bp, E. coli
tcagcgatgagcaggttaaacaggc

SEQ ID NO: 12943 - DNA, 25 bp, E. coli
tcagcgatgagctggttaaacaggc

SEQ ID NO: 12944 - DNA, 25 bp, E. coli
taatcgcatgcaccaacagctgggc

SEQ ID NO: 12945 - DNA, 25 bp, E. coli
taaacaggcgattttcgcgacccca

SEQ ID NO: 12946 - DNA, 25 bp, E. coli
taatcgcatgcagcaacagctgggc

SEQ ID NO: 12947 - DNA, 25 bp, E. coli
catctgctacgtaatagcatcgcta

SEQ ID NO: 12948 - DNA, 25 bp, E. coli
catctgctacgttatagcatcgcta

SEQ ID NO: 12949 - DNA, 25 bp, E. coli
ttctattttattcgtgcagagttac

SEQ ID NO: 12950 - DNA, 25 bp, E. coli
ttctattttattggtgcagagttac

SEQ ID NO: 12951 - DNA, 25 bp, E. coli
tgttccaggaagctcatctgctacg

SEQ ID NO: 12952 - DNA, 25 bp, E. coli
tgttccaggaaggtcatctgctacg

SEQ ID NO: 12953 - DNA, 25 bp, E. coli
tgtttgcccgctttgtctggcttaa

SEQ ID NO: 12954 - DNA, 25 bp, E. coli
tgtttgcccgctatgtctggcttaa

SEQ ID NO: 12955 - DNA, 25 bp, E. coli
tctggccgctgattggcgtaatggc

SEQ ID NO: 12956 - DNA, 25 bp, E. coli
tctggccgctgaatggcgtaatggc

SEQ ID NO: 12957 - DNA, 25 bp, E. coli
gaactttctcttttctggccgctga

SEQ ID NO: 12958 - DNA, 25 bp, E. coli
gaactttctcttatctggccgctga

SEQ ID NO: 12959 - DNA, 25 bp, E. coli
cttttctggccggtgaatggcgtaa

SEQ ID NO: 12960 - DNA, 25 bp, E. coli
cttttctggccgctgaatggcgtaa

SEQ ID NO: 12961 - DNA, 25 bp, E. coli
ggaaggtcatctgctacgtaatagc

SEQ ID NO: 12962 - DNA, 25 bp, E. coli
ggtgtttgcccgctatgtctggctt

SEQ ID NO: 12963 - DNA, 25 bp, E. coli
ggtgtttgcccggtatgtctggctt

SEQ ID NO: 12964 - DNA, 25 bp, E. coli
ggctggttcacgaactttctctttt

SEQ ID NO: 12965 - DNA, 25 bp, E. coli
ggctggttcacgtactttctctttt

SEQ ID NO: 12966 - DNA, 25 bp, E. coli
ggaaggtcatctcctacgtaatagc

SEQ ID NO: 12967 - DNA, 25 bp, E. coli
taaccacgctgttctattttattgg

SEQ ID NO: 12968 - DNA, 25 bp, E. coli
taaccacgctgtactattttattgg

SEQ ID NO: 12969 - DNA, 25 bp, E. coli
caggtccggtgcataaaggcgttat

SEQ ID NO: 12970 - DNA, 25 bp, E. coli
caggtccggtgcttaaaggcgttat

SEQ ID NO: 12971 - DNA, 25 bp, E. coli
tattaacgacgctggcattcctttt

SEQ ID NO: 12972 - DNA, 25 bp, E. coli
tattaacgacgcaggcattcctttt

SEQ ID NO: 12973 - DNA, 25 bp, E. coli
atttgccgcgctcatcacaggtccg

SEQ ID NO: 12974 - DNA, 25 bp, E. coli
cacaggtccggtgcataaaggcgtt

SEQ ID NO: 12975 - DNA, 25 bp, E. coli
atttgccgcgctgatcacaggtccg

SEQ ID NO: 12976 - DNA, 25 bp, E. coli
cacaggtccggtccataaaggcgtt

SEQ ID NO: 12977 - DNA, 25 bp, E. coli
ttgccgcgctgatcacaggtccggt

SEQ ID NO: 12978 - DNA, 25 bp, E. coli
ttgccgcgctgaacacaggtccggt

SEQ ID NO: 12979 - DNA, 25 bp, E. coli
ttccggtgctcattgagctgcgggc

SEQ ID NO: 12980 - DNA, 25 bp, E. coli
ttccggtgctcaatgagctgcgggc

SEQ ID NO: 12981 - DNA, 25 bp, E. coli
tggttgtctgaagggcgaatttgcc

SEQ ID NO: 12982 - DNA, 25 bp, E. coli
gcgatggttgtcagaacggcgaatt

SEQ ID NO: 12983 - DNA, 25 bp, E. coli
gcgatggttgtctgaacggcgaatt

SEQ ID NO: 12984 - DNA, 25 bp, E. coli
cgcgctgatcactggtccggtgcat

SEQ ID NO: 12985 - DNA, 25 bp, E. coli
cgttattaacgaggctggcattcct

SEQ ID NO: 12986 - DNA, 25 bp, E. coli
cgcgctgatcacaggtccggtgcat

SEQ ID NO: 12987 - DNA, 25 bp, E. coli
cgttattaacgacgctggcattcct

SEQ ID NO: 12988 - DNA, 25 bp, E. coli
ggtgctcaatgagctgcgggcgcag

SEQ ID NO: 12989 - DNA, 25 bp, E. coli
ggtgctcaatgacctgcgggcgcag

SEQ ID NO: 12990 - DNA, 25 bp, E. coli
tggttgtctgaacggcgaatttgcc

SEQ ID NO: 12991 - DNA, 25 bp, E. coli
caagagagcgtggaaacgatgcgcc

SEQ ID NO: 12992 - DNA, 25 bp, E. coli
cagcgaatgttggaatggtttacac

SEQ ID NO: 12993 - DNA, 25 bp, E. coli
caagagagcgtgcaaacgatgcgcc

SEQ ID NO: 12994 - DNA, 25 bp, E. coli
cagcgaatgttgcaatggtttacac

SEQ ID NO: 12995 - DNA, 25 bp, E. coli
cagggcatgcgttcaacgccgatta

SEQ ID NO: 12996 - DNA, 25 bp, E. coli
cagggcatgcgtacaacgccgatta

SEQ ID NO: 12997 - DNA, 25 bp, E. coli
tacccggatgcagggcatgcgttca

SEQ ID NO: 12998 - DNA, 25 bp, E. coli
tacccggatgcacggcatgcgttca

SEQ ID NO: 12999 - DNA, 25 bp, E. coli
gctgcgggcagctaacgcgaaagca

SEQ ID NO: 13000 - DNA, 25 bp, E. coli
gctgcgggcagcaaacgcgaaagca

SEQ ID NO: 13001 - DNA, 25 bp, E. coli
gctatcatgccgtatctgcgaaaga

SEQ ID NO: 13002 - DNA, 25 bp, E. coli
gctatcatgccgaatctgcgaaaga

SEQ ID NO: 13003 - DNA, 25 bp, E. coli
gaatggtttacacagtatggtgtta

SEQ ID NO: 13004 - DNA, 25 bp, E. coli
gaatggtttacagagtatggtgtta

SEQ ID NO: 13005 - DNA, 25 bp, E. coli
ccgaatctgcgaaagacggctggca

SEQ ID NO: 13006 - DNA, 25 bp, E. coli
ccgaatctgcgatagacggctggca

SEQ ID NO: 13007 - DNA, 25 bp, E. coli
cgaaagacggctcgcagcgaatgtt

SEQ ID NO: 13008 - DNA, 25 bp, E. coli
cgaaagacggctggcagcgaatgtt

SEQ ID NO: 13009 - DNA, 25 bp, E. coli
cattccgcaagacagcgtggaaacg

SEQ ID NO: 13010 - DNA, 25 bp, E. coli
cattccgcaagagagcgtggaaacg

SEQ ID NO: 13011 - DNA, 25 bp, E. coli
ggcagcaaacgcgaaagcagagatt

SEQ ID NO: 13012 - DNA, 25 bp, E. coli
ggcagcaaacgccaaagcagagatt

SEQ ID NO: 13013 - DNA, 25 bp, E. coli
catgggatgcactaatatcatacgc

SEQ ID NO: 13014 - DNA, 25 bp, E. coli
catgggatgcacaaatatcatacgc

SEQ ID NO: 13015 - DNA, 25 bp, E. coli
taaatcatcatgctatagcggcgta

SEQ ID NO: 13016 - DNA, 25 bp, E. coli
taaatcatcatggtatagcggcgta

SEQ ID NO: 13017 - DNA, 25 bp, E. coli
ccaggcagttatccgatggcggatt

SEQ ID NO: 13018 - DNA, 25 bp, E. coli
cctgatgacgttgacattgatgaaa

SEQ ID NO: 13019 - DNA, 25 bp, E. coli
ccaaatcgaaaatagccaggcagtt

SEQ ID NO: 13020 - DNA, 25 bp, E. coli
ccaaatcgaaaaaagccaggcagtt

SEQ ID NO: 13021 - DNA, 25 bp, E. coli
ccaggcagttatgcgatggcggatt

SEQ ID NO: 13022 - DNA, 25 bp, E. coli
cctgatgacgttcacattgatgaaa

SEQ ID NO: 13023 - DNA, 25 bp, E. coli
gcgtattgctccgatcttcctgatg

SEQ ID NO: 13024 - DNA, 25 bp, E. coli
gcgtattgctcccatcttcctgatg

SEQ ID NO: 13025 - DNA, 25 bp, E. coli
gaaattgagattacgcgccagatgg

SEQ ID NO: 13026 - DNA, 25 bp, E. coli
gaaattgagatttcgcgccagatgg

SEQ ID NO: 13027 - DNA, 25 bp, E. coli
cgctttgaaagaacaggcactacca

SEQ ID NO: 13028 - DNA, 25 bp, E. coli
cgctttgaaagatcaggcactacca

SEQ ID NO: 13029 - DNA, 25 bp, E. coli
cgcgccagatggaaacgtttaaagg

SEQ ID NO: 13030 - DNA, 25 bp, E. coli
cgcgccagatggtaacgtttaaagg

SEQ ID NO: 13031 - DNA, 25 bp, E. coli
cattctcgaaaacgcatgggatgca

SEQ ID NO: 13032 - DNA, 25 bp, E. coli
cattctcgaaaaggcatgggatgca

SEQ ID NO: 13033 - DNA, 25 bp, E. coli
ggcggattcctgaacgaaattgaga

SEQ ID NO: 13034 - DNA, 25 bp, E. coli
ggcggattcctgtacgaaattgaga

SEQ ID NO: 13035 - DNA, 25 bp, E. coli
tacagtgaggtatatgttgcacaag

SEQ ID NO: 13036 - DNA, 25 bp, E. coli
tacagtgaggtaaatgttgcacaag

SEQ ID NO: 13037 - DNA, 25 bp, E. coli
agcgtttacgtactcctctgaaaga

SEQ ID NO: 13038 - DNA, 25 bp, E. coli
agcgtttacgtagtcctctgaaaga

SEQ ID NO: 13039 - DNA, 25 bp, E. coli
tatgcgcctgcttttcgcggactag

SEQ ID NO: 13040 - DNA, 25 bp, E. coli
ttcctatgtgaaagggcgttatctg

SEQ ID NO: 13041 - DNA, 25 bp, E. coli
ttcctatgtgaatgggcgttatctg

SEQ ID NO: 13042 - DNA, 25 bp, E. coli
tatgcgcctgctattcgcggactag

SEQ ID NO: 13043 - DNA, 25 bp, E. coli
tattcgcggactagtgctggcatct

SEQ ID NO: 13044 - DNA, 25 bp, E. coli
tattcgcggacttgtgctggcatct

SEQ ID NO: 13045 - DNA, 25 bp, E. coli
ttatcagcgttttcgtagtcctctg

SEQ ID NO: 13046 - DNA, 25 bp, E. coli
ttatcagcgtttacgtagtcctctg

SEQ ID NO: 13047 - DNA, 25 bp, E. coli
ttcgctcgtgcaagatgccggattc

SEQ ID NO: 13048 - DNA, 25 bp, E. coli
ttcgctcgtgcatgatgccggattc

SEQ ID NO: 13049 - DNA, 25 bp, E. coli
tgaggtaaatgttgcacaagggcaa

SEQ ID NO: 13050 - DNA, 25 bp, E. coli
tgaggtaaatgtagcacaagggcaa

SEQ ID NO: 13051 - DNA, 25 bp, E. coli
gactagtgctggcatctccggcctt

SEQ ID NO: 13052 - DNA, 25 bp, E. coli
gactagtgctgggatctccggcctt

SEQ ID NO: 13053 - DNA, 25 bp, E. coli
gggcgttatctgtcccacgatcggc

SEQ ID NO: 13054 - DNA, 25 bp, E. coli
gggcgttatctgacccacgatcggc

SEQ ID NO: 13055 - DNA, 25 bp, E. coli
gagcccgccatatgcgaaattttgt

SEQ ID NO: 13056 - DNA, 25 bp, E. coli
gagcccgccataagcgaaattttgt

SEQ ID NO: 13057 - DNA, 25 bp, E. coli
caaaaatttcgtagctgtgcggcaa

SEQ ID NO: 13058 - DNA, 25 bp, E. coli
caaaaatttcgttgctgtgcggcaa

SEQ ID NO: 13059 - DNA, 25 bp, E. coli
gttgctgtgcgggaaacttttttcc

SEQ ID NO: 13060 - DNA, 25 bp, E. coli
gttgctgtgcggcaaacttttttcc

SEQ ID NO: 13061 - DNA, 25 bp, E. coli
tgttttgtgccggttttctcctgaa

SEQ ID NO: 13062 - DNA, 25 bp, E. coli
tgttttgtgccgcttttctcctgaa

SEQ ID NO: 13063 - DNA, 25 bp, E. coli
tgccgcttttctgctgaatactcgt

SEQ ID NO: 13064 - DNA, 25 bp, E. coli
tgccgcttttctcctgaatactcgt

SEQ ID NO: 13065 - DNA, 25 bp, E. coli
gaatactcgttctcagaacaactgg

SEQ ID NO: 13066 - DNA, 25 bp, E. coli
gaatactcgttcacagaacaactgg

SEQ ID NO: 13067 - DNA, 25 bp, E. coli
ccatttttcaggctcaaccctttga

SEQ ID NO: 13068 - DNA, 25 bp, E. coli
ccatttttcagggtcaaccctttga

SEQ ID NO: 13069 - DNA, 25 bp, E. coli
cgttctcagaactactggatcgttt

SEQ ID NO: 13070 - DNA, 25 bp, E. coli
cgttctcagaacaactggatcgttt

SEQ ID NO: 13071 - DNA, 25 bp, E. coli
ggatcgtttaaacatcagacaggag

SEQ ID NO: 13072 - DNA, 25 bp, E. coli
ggatcgtttaaagatcagacaggag

SEQ ID NO: 13073 - DNA, 25 bp, E. coli
ggagatttaccatgacgcaatccat

SEQ ID NO: 13074 - DNA, 25 bp, E. coli
ggagatttaccaagacgcaatccat

SEQ ID NO: 13075 - DNA, 25 bp, E. coli
tcagacaggagatttaccatgacgc

SEQ ID NO: 13076 - DNA, 25 bp, E. coli
tcagacaggagaattaccatgacgc

SEQ ID NO: 13077 - DNA, 25 bp, E. coli
gacgcaatccatttttcaggctcaa

SEQ ID NO: 13078 - DNA, 25 bp, E. coli
gacgcaatccatatttcaggctcaa

SEQ ID NO: 13079 - DNA, 25 bp, E. coli
caccgcctgccgagaggaaagatgc

SEQ ID NO: 13080 - DNA, 25 bp, E. coli
caccgcctgccgtgaggaaagatgc

SEQ ID NO: 13081 - DNA, 25 bp, E. coli
agttgcgcggccttacactacctct

SEQ ID NO: 13082 - DNA, 25 bp, E. coli
agttgcgcggccatacactacctct

SEQ ID NO: 13083 - DNA, 25 bp, E. coli
tgagcattaccacctcgcacagctt

SEQ ID NO: 13084 - DNA, 25 bp, E. coli
tgctttacgccttgtggcagctcga

SEQ ID NO: 13085 - DNA, 25 bp, E. coli
tgctttacgcctagtggcagctcga

SEQ ID NO: 13086 - DNA, 25 bp, E. coli
tgagcattaccagctcgcacagctt

SEQ ID NO: 13087 - DNA, 25 bp, E. coli
gccatggagctagcgcggagttatt

SEQ ID NO: 13088 - DNA, 25 bp, E. coli
gccatggagctaccgcggagttatt

SEQ ID NO: 13089 - DNA, 25 bp, E. coli
gcttcccatttctgcgctgcaaatg

SEQ ID NO: 13090 - DNA, 25 bp, E. coli
gcttcccatttcagcgctgcaaatg

SEQ ID NO: 13091 - DNA, 25 bp, E. coli
gcagctcatctggatgtgatggcac

SEQ ID NO: 13092 - DNA, 25 bp, E. coli
gaatgcgccgttgccatggagctac

SEQ ID NO: 13093 - DNA, 25 bp, E. coli
gaatgcgccgttcccatggagctac

SEQ ID NO: 13094 - DNA, 25 bp, E. coli
gcagctcatctgcatgtgatggcac

SEQ ID NO: 13095 - DNA, 25 bp, E. coli
ggcagctcgatgaaatcagcggtat

SEQ ID NO: 13096 - DNA, 25 bp, E. coli
ggcagctcgatgtaatcagcggtat

SEQ ID NO: 13097 - DNA, 25 bp, E. coli
tggcttacagcacgcaggtgaacaa

SEQ ID NO: 13098 - DNA, 25 bp, E. coli
ggaaagatgcatgagcgagccgtta

SEQ ID NO: 13099 - DNA, 25 bp, E. coli
tggcttacagcaggcaggtgaacaa

SEQ ID NO: 13100 - DNA, 25 bp, E. coli
ggaaagatgcatcagcgagccgtta

SEQ ID NO: 13101 - DNA, 25 bp, E. coli
aacgaacgctgttctataatgtaga

SEQ ID NO: 13102 - DNA, 25 bp, E. coli
acaagtgttcacaatgtccccggac

SEQ ID NO: 13103 - DNA, 25 bp, E. coli
acaagtgttcactatgtccccggac

SEQ ID NO: 13104 - DNA, 25 bp, E. coli
aacgaacgctgtactataatgtaga

SEQ ID NO: 13105 - DNA, 25 bp, E. coli
tatgccttagttctaagtgtctacc

SEQ ID NO: 13106 - DNA, 25 bp, E. coli
tatgccttagttgtaagtgtctacc

SEQ ID NO: 13107 - DNA, 25 bp, E. coli
tgtctaccatgtccccgaacaagtg

SEQ ID NO: 13108 - DNA, 25 bp, E. coli
tgtctaccatgtgcccgaacaagtg

SEQ ID NO: 13109 - DNA, 25 bp, E. coli
tgatcgttaaattaacgaacgctgt

SEQ ID NO: 13110 - DNA, 25 bp, E. coli
tgatccagcttatatttcccgcact

SEQ ID NO: 13111 - DNA, 25 bp, E. coli
tgatccagcttaaatttcccgcact

SEQ ID NO: 13112 - DNA, 25 bp, E. coli
tgatcgttaaataaacgaacgctgt

SEQ ID NO: 13113 - DNA, 25 bp, E. coli
ccttgttctgcgacatagtatgatc

SEQ ID NO: 13114 - DNA, 25 bp, E. coli
ccttgttctgcgtcatagtatgatc

SEQ ID NO: 13115 - DNA, 25 bp, E. coli
gatttacctctcgttgttctgcgtc

SEQ ID NO: 13116 - DNA, 25 bp, E. coli
gatttacctctccttgttctgcgtc

SEQ ID NO: 13117 - DNA, 25 bp, E. coli
tgtaagtgtctaccatgtccccgaa

SEQ ID NO: 13118 - DNA, 25 bp, E. coli
gggactgcaccgagccatcttttcc

SEQ ID NO: 13119 - DNA, 25 bp, E. coli
gggcaatatgtgttccagcttaaat

SEQ ID NO: 13120 - DNA, 25 bp, E. coli
gggactgcaccgtgccatcttttcc

SEQ ID NO: 13121 - DNA, 25 bp, E. coli
tgtaagtgtctagcatgtccccgaa

SEQ ID NO: 13122 - DNA, 25 bp, E. coli
gggcaatatgtgatccagcttaaat

SEQ ID NO: 13123 - DNA, 25 bp, E. coli
attcatttcagtcaggggcgagcgc

SEQ ID NO: 13124 - DNA, 25 bp, E. coli
agcgctctctatacttaccattctg

SEQ ID NO: 13125 - DNA, 25 bp, E. coli
attcatttcagtgaggggcgagcgc

SEQ ID NO: 13126 - DNA, 25 bp, E. coli
aggatatcctctgatgcccgtggcg

SEQ ID NO: 13127 - DNA, 25 bp, E. coli
agcgctctctattcttaccattctg

SEQ ID NO: 13128 - DNA, 25 bp, E. coli
aggatatcctctcatgcccgtggcg

SEQ ID NO: 13129 - DNA, 25 bp, E. coli
taccattctgttttattttcaggat

SEQ ID NO: 13130 - DNA, 25 bp, E. coli
taccattctgttatattttcaggat

SEQ ID NO: 13131 - DNA, 25 bp, E. coli
tattttcaggatatcctctcatgcc

SEQ ID NO: 13132 - DNA, 25 bp, E. coli
tattttcaggatttcctctcatgcc

SEQ ID NO: 13133 - DNA, 25 bp, E. coli
tgattttaattcatttcagtcaggg

SEQ ID NO: 13134 - DNA, 25 bp, E. coli
tgattttaattcttttcagtcaggg

SEQ ID NO: 13135 - DNA, 25 bp, E. coli
tgactatacctggaatgattttaat

SEQ ID NO: 13136 - DNA, 25 bp, E. coli
tgactatacctgcaatgattttaat

SEQ ID NO: 13137 - DNA, 25 bp, E. coli
tcaggatatcctctcatgcccgtgg

SEQ ID NO: 13138 - DNA, 25 bp, E. coli
tcaggatatcctgtcatgcccgtgg

SEQ ID NO: 13139 - DNA, 25 bp, E. coli
gctctctatactaaccattctgttt

SEQ ID NO: 13140 - DNA, 25 bp, E. coli
gcgagcgctctcaatacttaccatt

SEQ ID NO: 13141 - DNA, 25 bp, E. coli
gcgagcgctctctatacttaccatt

SEQ ID NO: 13142 - DNA, 25 bp, E. coli
gctctctatacttaccattctgttt

SEQ ID NO: 13143 - DNA, 25 bp, E. coli
gggcgagcgctctctatacttacca

SEQ ID NO: 13144 - DNA, 25 bp, E. coli
gggcgagcgctcactatacttacca

SEQ ID NO: 13145 - DNA, 25 bp, E. coli
aagccgcgtattgtctcgcttgcct

SEQ ID NO: 13146 - DNA, 25 bp, E. coli
aagccgcgtattctctcgcttgcct

SEQ ID NO: 13147 - DNA, 25 bp, E. coli
ctctcgcttgcctcgtgttttctaa

SEQ ID NO: 13148 - DNA, 25 bp, E. coli
ctctcgcttgccacgtgttttctaa

SEQ ID NO: 13149 - DNA, 25 bp, E. coli
tacacatggttatccacaggaatag

SEQ ID NO: 13150 - DNA, 25 bp, E. coli
tacacatggttaaccacaggaatag

SEQ ID NO: 13151 - DNA, 25 bp, E. coli
tctttgagccgtgtttaacgccaat

SEQ ID NO: 13152 - DNA, 25 bp, E. coli
tctttgagccgtctttaacgccaat

SEQ ID NO: 13153 - DNA, 25 bp, E. coli
tctaatacacatggttatccacagg

SEQ ID NO: 13154 - DNA, 25 bp, E. coli
tctaatacacatcgttatccacagg

SEQ ID NO: 13155 - DNA, 25 bp, E. coli
gcttgcctcgtgttttctaactcta

SEQ ID NO: 13156 - DNA, 25 bp, E. coli
gcttgcctcgtgatttctaactcta

SEQ ID NO: 13157 - DNA, 25 bp, E. coli
cgtattctctcgcttgcctcgtgtt

SEQ ID NO: 13158 - DNA, 25 bp, E. coli
cgtattctctcggttgcctcgtgtt

SEQ ID NO: 13159 - DNA, 25 bp, E. coli
gttttctaactctaatacacatggt

SEQ ID NO: 13160 - DNA, 25 bp, E. coli
gttttctaactcaaatacacatggt

SEQ ID NO: 13161 - DNA, 25 bp, E. coli
gtgcaagccgcgaattctctcgctt

SEQ ID NO: 13162 - DNA, 25 bp, E. coli
gtgcaagccgcgtattctctcgctt

SEQ ID NO: 13163 - DNA, 25 bp, E. coli
taaaagatatttgtttgagccgtct

SEQ ID NO: 13164 - DNA, 25 bp, E. coli
taaaagatatttctttgagccgtct

SEQ ID NO: 13165 - DNA, 25 bp, E. coli
gatatttctttgtgccgtctttaac

SEQ ID NO: 13166 - DNA, 25 bp, E. coli
gatatttctttgagccgtctttaac

SEQ ID NO: 13167 - DNA, 25 bp, E. coli
caacgaagccgttccaacttctgaa

SEQ ID NO: 13168 - DNA, 25 bp, E. coli
caacgaagccgtaccaacttctgaa

SEQ ID NO: 13169 - DNA, 25 bp, E. coli
aaatcagcggaagtgttagtgaagg

SEQ ID NO: 13170 - DNA, 25 bp, E. coli
aaatcagcggaactgttagtgaagg

SEQ ID NO: 13171 - DNA, 25 bp, E. coli
ttccaacttctgtacttccggctca

SEQ ID NO: 13172 - DNA, 25 bp, E. coli
ttccaacttctgaacttccggctca

SEQ ID NO: 13173 - DNA, 25 bp, E. coli
tgacgccgatatggcgctttatcac

SEQ ID NO: 13174 - DNA, 25 bp, E. coli
tgacgccgatatcgcgctttatcac

SEQ ID NO: 13175 - DNA, 25 bp, E. coli
tcgcgctttatcacgacaacttcca

SEQ ID NO: 13176 - DNA, 25 bp, E. coli
tcgcgctttatctcgacaacttcca

SEQ ID NO: 13177 - DNA, 25 bp, E. coli
gccgttccaacttctgaacttccgg

SEQ ID NO: 13178 - DNA, 25 bp, E. coli
gccgttccaactactgaacttccgg

SEQ ID NO: 13179 - DNA, 25 bp, E. coli
gaagtgttagtgtaggtgtattcga

SEQ ID NO: 13180 - DNA, 25 bp, E. coli
gaagtgttagtgaaggtgtattcga

SEQ ID NO: 13181 - DNA, 25 bp, E. coli
cgcagaaaaatctgcggaagtgtta

SEQ ID NO: 13182 - DNA, 25 bp, E. coli
cgcagaaaaatcagcggaagtgtta

SEQ ID NO: 13183 - DNA, 25 bp, E. coli
gatatcgcgctttatcacgacaact

SEQ ID NO: 13184 - DNA, 25 bp, E. coli
gatatcgcgcttaatcacgacaact

SEQ ID NO: 13185 - DNA, 25 bp, E. coli
tggcgcgggctagcatattctctgg

SEQ ID NO: 13186 - DNA, 25 bp, E. coli
tggcgcgggctaccatattctctgg

SEQ ID NO: 13187 - DNA, 25 bp, E. coli
gatggcgcgggctaccatattctct

SEQ ID NO: 13188 - DNA, 25 bp, E. coli
gatggcgcgggcaaccatattctct

SEQ ID NO: 13189 - DNA, 25 bp, E. coli
aatgaccgtatgtggccgatgctga

SEQ ID NO: 13190 - DNA, 25 bp, E. coli
aatgaccgtatgaggccgatgctga

SEQ ID NO: 13191 - DNA, 25 bp, E. coli
caacgtgcggtggagtgatgactcc

SEQ ID NO: 13192 - DNA, 25 bp, E. coli
caacgtgcggtgcagtgatgactcc

SEQ ID NO: 13193 - DNA, 25 bp, E. coli
catgcttggcgtccgtaccagcaaa

SEQ ID NO: 13194 - DNA, 25 bp, E. coli
catgcttggcgtgcgtaccagcaaa

SEQ ID NO: 13195 - DNA, 25 bp, E. coli
acaacgaaaaggaagggctgcatga

SEQ ID NO: 13196 - DNA, 25 bp, E. coli
acaacgaaaaggtagggctgcatga

SEQ ID NO: 13197 - DNA, 25 bp, E. coli
aaaaactggagcaacgaagtgtgcc

SEQ ID NO: 13198 - DNA, 25 bp, E. coli
aaaaactggagctacgaagtgtgcc

SEQ ID NO: 13199 - DNA, 25 bp, E. coli
taccagcaaaatccggaaggccagc

SEQ ID NO: 13200 - DNA, 25 bp, E. coli
taccagcaaaatgcggaaggccagc

SEQ ID NO: 13201 - DNA, 25 bp, E. coli
tgaacgatgtttggcgtcaggtgct

SEQ ID NO: 13202 - DNA, 25 bp, E. coli
tgaacgatgtttcgcgtcaggtgct

SEQ ID NO: 13203 - DNA, 25 bp, E. coli
gactcccggcgacagtatgaatggt

SEQ ID NO: 13204 - DNA, 25 bp, E. coli
gactcccggcgagagtatgaatggt

SEQ ID NO: 13205 - DNA, 25 bp, E. coli
gaaatcatgttcaggttcggctcag

SEQ ID NO: 13206 - DNA, 25 bp, E. coli
gaaatcatgttctggttcggctcag

SEQ ID NO: 13207 - DNA, 25 bp, E. coli
gaaagacctgttgactgccctgtgg

SEQ ID NO: 13208 - DNA, 25 bp, E. coli
gaaagacctgttcactgccctgtgg

SEQ ID NO: 13209 - DNA, 25 bp, E. coli
cgcagcaaagcggagaatgaccgta

SEQ ID NO: 13210 - DNA, 25 bp, E. coli
cgcagcaaagcgcagaatgaccgta

SEQ ID NO: 13211 - DNA, 25 bp, E. coli
caattttgtgaaagatgccggagaa

SEQ ID NO: 13212 - DNA, 25 bp, E. coli
caattttgtgaatgatgccggagaa

SEQ ID NO: 13213 - DNA, 25 bp, E. coli
caaacaggtctagggtaacgctaat

SEQ ID NO: 13214 - DNA, 25 bp, E. coli
caaacaggtctacggtaacgctaat

SEQ ID NO: 13215 - DNA, 25 bp, E. coli
tgatcaggtgaaaacggcgacacca

SEQ ID NO: 13216 - DNA, 25 bp, E. coli
tgatcaggtgaatacggcgacacca

SEQ ID NO: 13217 - DNA, 25 bp, E. coli
tgccagccagttttataccgttaag

SEQ ID NO: 13218 - DNA, 25 bp, E. coli
tgccggagaaaatctctgggacgcg

SEQ ID NO: 13219 - DNA, 25 bp, E. coli
tgccagccagttatataccgttaag

SEQ ID NO: 13220 - DNA, 25 bp, E. coli
tgccggagaaaaactctgggacgcg

SEQ ID NO: 13221 - DNA, 25 bp, E. coli
tctgtacaataaaatcttcgaagcg

SEQ ID NO: 13222 - DNA, 25 bp, E. coli
tctgggacgcggttacaggtcagca

SEQ ID NO: 13223 - DNA, 25 bp, E. coli
tctgggacgcggatacaggtcagca

SEQ ID NO: 13224 - DNA, 25 bp, E. coli
tcaggaggcgaaggagaaaatcctt

SEQ ID NO: 13225 - DNA, 25 bp, E. coli
tctgagtgccatttccaaacaggtc

SEQ ID NO: 13226 - DNA, 25 bp, E. coli
tctgagtgccatatccaaacaggtc

SEQ ID NO: 13227 - DNA, 25 bp, E. coli
tcaggaggcgaacgagaaaatcctt

SEQ ID NO: 13228 - DNA, 25 bp, E. coli
tctgtacaataatatcttcgaagcg

SEQ ID NO: 13229 - DNA, 25 bp, E. coli
gaataaaccgatcctaaaaagcccg

SEQ ID NO: 13230 - DNA, 25 bp, E. coli
gaataaaccgatgctaaaaagcccg

SEQ ID NO: 13231 - DNA, 25 bp, E. coli
taagtctggcgagactctgagtgcc

SEQ ID NO: 13232 - DNA, 25 bp, E. coli
taagtctggcgacactctgagtgcc

SEQ ID NO: 13233 - DNA, 25 bp, E. coli
cagttcgttcagattgaagaggaca

SEQ ID NO: 13234 - DNA, 25 bp, E. coli
cagttcgttcagtttgaagaggaca

SEQ ID NO: 13235 - DNA, 25 bp, E. coli
actggccgcagtacgttcagattga

SEQ ID NO: 13236 - DNA, 25 bp, E. coli
aaactggccgcacttcgttcagatt

SEQ ID NO: 13237 - DNA, 25 bp, E. coli
aaactggccgcagttcgttcagatt

SEQ ID NO: 13238 - DNA, 25 bp, E. coli
actggccgcagttcgttcagattga

SEQ ID NO: 13239 - DNA, 25 bp, E. coli
ttcgttcagattcaagaggacacgc

SEQ ID NO: 13240 - DNA, 25 bp, E. coli
ttcgttcagattgaagaggacacgc

SEQ ID NO: 13241 - DNA, 25 bp, E. coli
tcgttcagattgaagaggacacgcg

SEQ ID NO: 13242 - DNA, 25 bp, E. coli
tcgttcagattgtagaggacacgcg

SEQ ID NO: 13243 - DNA, 25 bp, E. coli
gccgcagttcgttcagattgaagag

SEQ ID NO: 13244 - DNA, 25 bp, E. coli
gccgcagttcgtacagattgaagag

SEQ ID NO: 13245 - DNA, 25 bp, E. coli
gcagttcgttcacattgaagaggac

SEQ ID NO: 13246 - DNA, 25 bp, E. coli
gcagttcgttcagattgaagaggac

SEQ ID NO: 13247 - DNA, 25 bp, E. coli
ccgcagttcgttcagattgaagagg

SEQ ID NO: 13248 - DNA, 25 bp, E. coli
ccgcagttcgttgagattgaagagg

SEQ ID NO: 13249 - DNA, 25 bp, E. coli
ctggccgcagttcgttcagattgaa

SEQ ID NO: 13250 - DNA, 25 bp, E. coli
ctggccgcagttggttcagattgaa

SEQ ID NO: 13251 - DNA, 25 bp, E. coli
ggccgcagttcgatcagattgaaga

SEQ ID NO: 13252 - DNA, 25 bp, E. coli
tggccgcagttccttcagattgaag

SEQ ID NO: 13253 - DNA, 25 bp, E. coli
tggccgcagttcgttcagattgaag

SEQ ID NO: 13254 - DNA, 25 bp, E. coli
ggccgcagttcgttcagattgaaga

SEQ ID NO: 13255 - DNA, 25 bp, E. coli
catactgtgactccaaggcggcgta

SEQ ID NO: 13256 - DNA, 25 bp, E. coli
catactgtgactgcaaggcggcgta

SEQ ID NO: 13257 - DNA, 25 bp, E. coli
aactttgaccaatcctctgagatgg

SEQ ID NO: 13258 - DNA, 25 bp, E. coli
aactttgaccaaacctctgagatgg

SEQ ID NO: 13259 - DNA, 25 bp, E. coli
tttgtgagcttgctcgcacttcgcc

SEQ ID NO: 13260 - DNA, 25 bp, E. coli
tttgtgagcttggtcgcacttcgcc

SEQ ID NO: 13261 - DNA, 25 bp, E. coli
tatattacgcatattttgcacgaga

SEQ ID NO: 13262 - DNA, 25 bp, E. coli
tatattacgcattttttgcacgaga

SEQ ID NO: 13263 - DNA, 25 bp, E. coli
ttgcacgagatgaaaggccaaactt

SEQ ID NO: 13264 - DNA, 25 bp, E. coli
ttgcacgagatgtaaggccaaactt

SEQ ID NO: 13265 - DNA, 25 bp, E. coli
tgcatttaaaatgagcgtggtgcga

SEQ ID NO: 13266 - DNA, 25 bp, E. coli
tgcatttaaaatcagcgtggtgcga

SEQ ID NO: 13267 - DNA, 25 bp, E. coli
cctctgagatggttcaaagaattgc

SEQ ID NO: 13268 - DNA, 25 bp, E. coli
cctctgagatggatcaaagaattgc

SEQ ID NO: 13269 - DNA, 25 bp, E. coli
gcgtggtgcgataattactcataaa

SEQ ID NO: 13270 - DNA, 25 bp, E. coli
gcaaatttacgtgccttttgtgagc

SEQ ID NO: 13271 - DNA, 25 bp, E. coli
gcgtggtgcgattattactcataaa

SEQ ID NO: 13272 - DNA, 25 bp, E. coli
gcaaatttacgtcccttttgtgagc

SEQ ID NO: 13273 - DNA, 25 bp, E. coli
cgcgtcaccctagggcgatgcgaag

SEQ ID NO: 13274 - DNA, 25 bp, E. coli
cgcgtcaccctacggcgatgcgaag

SEQ ID NO: 13275 - DNA, 25 bp, E. coli
taagaaatgaccatactgtgactgc

SEQ ID NO: 13276 - DNA, 25 bp, E. coli
taagaaatgaccttactgtgactgc

SEQ ID NO: 13277 - DNA, 25 bp, E. coli
catgtggtcggatattgcggcgttc

SEQ ID NO: 13278 - DNA, 25 bp, E. coli
catgtggtcggaaattgcggcgttc

SEQ ID NO: 13279 - DNA, 25 bp, E. coli
tatgcctgaccaagttgctgaccgt

SEQ ID NO: 13280 - DNA, 25 bp, E. coli
tatgcctgaccatgttgctgaccgt

SEQ ID NO: 13281 - DNA, 25 bp, E. coli
tgccgcaaaaaaggatcattgtggg

SEQ ID NO: 13282 - DNA, 25 bp, E. coli
tgccgcaaaaaacgatcattgtggg

SEQ ID NO: 13283 - DNA, 25 bp, E. coli
tcagggtaagctacatgtggtcgga

SEQ ID NO: 13284 - DNA, 25 bp, E. coli
tcagggtaagcttcatgtggtcgga

SEQ ID NO: 13285 - DNA, 25 bp, E. coli
gaaattgcggcgatcttgcagtgta

SEQ ID NO: 13286 - DNA, 25 bp, E. coli
gaaattgcggcgttcttgcagtgta

SEQ ID NO: 13287 - DNA, 25 bp, E. coli
cattgtgggcatcttatgcctgacc

SEQ ID NO: 13288 - DNA, 25 bp, E. coli
cattgtgggcatgttatgcctgacc

SEQ ID NO: 13289 - DNA, 25 bp, E. coli
gggtgttacacggatcaccgtgtga

SEQ ID NO: 13290 - DNA, 25 bp, E. coli
gggtgttacacgcatcaccgtgtga

SEQ ID NO: 13291 - DNA, 25 bp, E. coli
ggcgttcttgcactgtaaaccgtaa

SEQ ID NO: 13292 - DNA, 25 bp, E. coli
ggcgttcttgcagtgtaaaccgtaa

SEQ ID NO: 13293 - DNA, 25 bp, E. coli
tcaccgtgtgaattcagggtaagct

SEQ ID NO: 13294 - DNA, 25 bp, E. coli
tcaccgtgtgaaatcagggtaagct

SEQ ID NO: 13295 - DNA, 25 bp, E. coli
gaccgtctgggtcttacacgcatca

SEQ ID NO: 13296 - DNA, 25 bp, E. coli
gaccgtctgggtgttacacgcatca

SEQ ID NO: 13297 - DNA, 25 bp, E. coli
gaccatgttgctcaccgtctgggtg

SEQ ID NO: 13298 - DNA, 25 bp, E. coli
gaccatgttgctgaccgtctgggtg

SEQ ID NO: 13299 - DNA, 25 bp, E. coli
aaggcgcggagaatgtcgttcacat

SEQ ID NO: 13300 - DNA, 25 bp, E. coli
aaggcgcggagattgtcgttcacat

SEQ ID NO: 13301 - DNA, 25 bp, E. coli
aaaaggcgcggacattgtcgttcac

SEQ ID NO: 13302 - DNA, 25 bp, E. coli
aaaaggcgcggagattgtcgttcac

SEQ ID NO: 13303 - DNA, 25 bp, E. coli
tttctacgctggtgacggcaccgcg

SEQ ID NO: 13304 - DNA, 25 bp, E. coli
tttctacgctggagacggcaccgcg

SEQ ID NO: 13305 - DNA, 25 bp, E. coli
tgtcgttcacatcggtatcgatacc

SEQ ID NO: 13306 - DNA, 25 bp, E. coli
tgtcgttcacatgggtatcgatacc

SEQ ID NO: 13307 - DNA, 25 bp, E. coli
gcgacatcaaccctttctacgctgg

SEQ ID NO: 13308 - DNA, 25 bp, E. coli
gcgacatcaaccgtttctacgctgg

SEQ ID NO: 13309 - DNA, 25 bp, E. coli
gcggagattgtcgttcacatgggta

SEQ ID NO: 13310 - DNA, 25 bp, E. coli
gcggagattgtccttcacatgggta

SEQ ID NO: 13311 - DNA, 25 bp, E. coli
gacatcaaccgtttctacgctggtg

SEQ ID NO: 13312 - DNA, 25 bp, E. coli
gacatcaaccgtatctacgctggtg

SEQ ID NO: 13313 - DNA, 25 bp, E. coli
cgtttctacgctcgtgacggcaccg

SEQ ID NO: 13314 - DNA, 25 bp, E. coli
cgtttctacgctggtgacggcaccg

SEQ ID NO: 13315 - DNA, 25 bp, E. coli
tcacatgggtatggataccgtagcg

SEQ ID NO: 13316 - DNA, 25 bp, E. coli
tcaaccgtttcttcgctggtgacgg

SEQ ID NO: 13317 - DNA, 25 bp, E. coli
tcacatgggtatcgataccgtagcg

SEQ ID NO: 13318 - DNA, 25 bp, E. coli
tcaaccgtttctacgctggtgacgg

SEQ ID NO: 13319 - DNA, 25 bp, E. coli
gagattgtcgttcacatgggtatcg

SEQ ID NO: 13320 - DNA, 25 bp, E. coli
gagattgtcgttgacatgggtatcg

SEQ ID NO: 13321 - DNA, 25 bp, E. coli
cacaacctggtggaactggcagaac

SEQ ID NO: 13322 - DNA, 25 bp, E. coli
cacaacctggtgcaactggcagaac

SEQ ID NO: 13323 - DNA, 25 bp, E. coli
taaaaaccagtgcaggtcgtcgtga

SEQ ID NO: 13324 - DNA, 25 bp, E. coli
taaaaaccagtggaggtcgtcgtga

SEQ ID NO: 13325 - DNA, 25 bp, E. coli
tttattaaccgcaccagaaatctgg

SEQ ID NO: 13326 - DNA, 25 bp, E. coli
tttattaaccgctccagaaatctgg

SEQ ID NO: 13327 - DNA, 25 bp, E. coli
tgtaacacgactgatggcgctggcc

SEQ ID NO: 13328 - DNA, 25 bp, E. coli
tggttgcttacccatctgactgaag

SEQ ID NO: 13329 - DNA, 25 bp, E. coli
tgtaacacgactcatggcgctggcc

SEQ ID NO: 13330 - DNA, 25 bp, E. coli
tgcaggctcgtttacaggctaatcc

SEQ ID NO: 13331 - DNA, 25 bp, E. coli
tgcaggctcgttaacaggctaatcc

SEQ ID NO: 13332 - DNA, 25 bp, E. coli
tgcctgccatgcgtaccgattaatg

SEQ ID NO: 13333 - DNA, 25 bp, E. coli
tgcctgccatgcctaccgattaatg

SEQ ID NO: 13334 - DNA, 25 bp, E. coli
tcatgagtgcaaccgcagagatcgg

SEQ ID NO: 13335 - DNA, 25 bp, E. coli
tcatgagtgcaagcgcagagatcgg

SEQ ID NO: 13336 - DNA, 25 bp, E. coli
gattctgcggaacaagctgaaccca

SEQ ID NO: 13337 - DNA, 25 bp, E. coli
gattctgcggaagaagctgaaccca

SEQ ID NO: 13338 - DNA, 25 bp, E. coli
tggcgagtgcagttgataccgtgac

SEQ ID NO: 13339 - DNA, 25 bp, E. coli
tggcgagtgcagatgataccgtgac

SEQ ID NO: 13340 - DNA, 25 bp, E. coli
ggctaatcctgccatggcgagtgca

SEQ ID NO: 13341 - DNA, 25 bp, E. coli
ggctaatcctgcgatggcgagtgca

SEQ ID NO: 13342 - DNA, 25 bp, E. coli
tggttgcttaccgatctgactgaag

SEQ ID NO: 13343 - DNA, 25 bp, E. coli
taaatcgccggaagttttcaacctg

SEQ ID NO: 13344 - DNA, 25 bp, E. coli
taaatcgccggatgttttcaacctg

SEQ ID NO: 13345 - DNA, 25 bp, E. coli
tttttgcgccgatcatggcatcgtg

SEQ ID NO: 13346 - DNA, 25 bp, E. coli
tttttgcgccgaacatggcatcgtg

SEQ ID NO: 13347 - DNA, 25 bp, E. coli
tgggcggctactgacaacagatcgt

SEQ ID NO: 13348 - DNA, 25 bp, E. coli
tgggcggctactcacaacagatcgt

SEQ ID NO: 13349 - DNA, 25 bp, E. coli
tcaggagatgctcgatttttgcgcc

SEQ ID NO: 13350 - DNA, 25 bp, E. coli
tcggcatcggcggtctgggacatat

SEQ ID NO: 13351 - DNA, 25 bp, E. coli
tcggcatcggcgctctgggacatat

SEQ ID NO: 13352 - DNA, 25 bp, E. coli
tcaggagatgctggatttttgcgcc

SEQ ID NO: 13353 - DNA, 25 bp, E. coli
cgataatcgcactctaacagactga

SEQ ID NO: 13354 - DNA, 25 bp, E. coli
cgataatcgcacactaacagactga

SEQ ID NO: 13355 - DNA, 25 bp, E. coli
cgacgattttacgaccttgctgaag

SEQ ID NO: 13356 - DNA, 25 bp, E. coli
cgacgattttaccaccttgctgaag

SEQ ID NO: 13357 - DNA, 25 bp, E. coli
ctgatatagagaagattcgggccga

SEQ ID NO: 13358 - DNA, 25 bp, E. coli
cattttgaatactgtagctgcgcca

SEQ ID NO: 13359 - DNA, 25 bp, E. coli
cattttgaatacagtagctgcgcca

SEQ ID NO: 13360 - DNA, 25 bp, E. coli
ctgatatagagatgattcgggccga

SEQ ID NO: 13361 - DNA, 25 bp, E. coli
gattggcggcataccagaaactcag

SEQ ID NO: 13362 - DNA, 25 bp, E. coli
gattggcggcattccagaaactcag

SEQ ID NO: 13363 - DNA, 25 bp, E. coli
taatgaagcctatgagcgaatgctg

SEQ ID NO: 13364 - DNA, 25 bp, E. coli
taatgaagcctaagagcgaatgctg

SEQ ID NO: 13365 - DNA, 25 bp, E. coli
catcagcctgatatctcaggctgca

SEQ ID NO: 13366 - DNA, 25 bp, E. coli
cagcagtagtcaaacagtgtgaaac

SEQ ID NO: 13367 - DNA, 25 bp, E. coli
cagcagtagtcatacagtgtgaaac

SEQ ID NO: 13368 - DNA, 25 bp, E. coli
catcagcctgatttctcaggctgca

SEQ ID NO: 13369 - DNA, 25 bp, E. coli
tactggcgcctttcagcgcaaaaag

SEQ ID NO: 13370 - DNA, 25 bp, E. coli
tactggcgccttacagcgcaaaaag

SEQ ID NO: 13371 - DNA, 25 bp, E. coli
taaaaagtcaccagccatcagcctg

SEQ ID NO: 13372 - DNA, 25 bp, E. coli
taaaaagtcacctgccatcagcctg

SEQ ID NO: 13373 - DNA, 25 bp, E. coli
aacagtgtgaaaggctactggcgcc

SEQ ID NO: 13374 - DNA, 25 bp, E. coli
aacagtgtgaaacgctactggcgcc

SEQ ID NO: 13375 - DNA, 25 bp, E. coli
tgatagacatttaaattgttcctga

SEQ ID NO: 13376 - DNA, 25 bp, E. coli
tgatagacattttaattgttcctga

SEQ ID NO: 13377 - DNA, 25 bp, E. coli
tgaaacgctactggcgccttacagc

SEQ ID NO: 13378 - DNA, 25 bp, E. coli
tgaaacgctactcgcgccttacagc

SEQ ID NO: 13379 - DNA, 25 bp, E. coli
ccttacagcgcataaaggctggtga

SEQ ID NO: 13380 - DNA, 25 bp, E. coli
ccttacagcgcaaaaaggctggtga

SEQ ID NO: 13381 - DNA, 25 bp, E. coli
gctgcaaccggaagggttggcttat

SEQ ID NO: 13382 - DNA, 25 bp, E. coli
gctgcaaccggatgggttggcttat

SEQ ID NO: 13383 - DNA, 25 bp, E. coli
gcaaaaaggctgctgactaaaaagt

SEQ ID NO: 13384 - DNA, 25 bp, E. coli
gcaaaaaggctggtgactaaaaagt

SEQ ID NO: 13385 - DNA, 25 bp, E. coli
gaaaggcacagcagtagtcaaacag

SEQ ID NO: 13386 - DNA, 25 bp, E. coli
gaaaggcacagctgtagtcaaacag

SEQ ID NO: 13387 - DNA, 25 bp, E. coli
caatcgtgttgaagttcgtcgcccg

SEQ ID NO: 13388 - DNA, 25 bp, E. coli
caatcgtgttgatgttcgtcgcccg

SEQ ID NO: 13389 - DNA, 25 bp, E. coli
cagaacgtcagggaactggctgcgt

SEQ ID NO: 13390 - DNA, 25 bp, E. coli
cagaacgtcaggcaactggctgcgt

SEQ ID NO: 13391 - DNA, 25 bp, E. coli
acgctagcgagttcatttatggttc

SEQ ID NO: 13392 - DNA, 25 bp, E. coli
aactggctgcgtcacgggaaaacgt

SEQ ID NO: 13393 - DNA, 25 bp, E. coli
aactggctgcgtgacgggaaaacgt

SEQ ID NO: 13394 - DNA, 25 bp, E. coli
acgctagcgagtacatttatggttc

SEQ ID NO: 13395 - DNA, 25 bp, E. coli
tgacgggaaaacgttgatccttgat

SEQ ID NO: 13396 - DNA, 25 bp, E. coli
tgacgggaaaaccttgatccttgat

SEQ ID NO: 13397 - DNA, 25 bp, E. coli
tcatttatggttcgctgcatttatt

SEQ ID NO: 13398 - DNA, 25 bp, E. coli
tcatttatggttggctgcatttatt

SEQ ID NO: 13399 - DNA, 25 bp, E. coli
tgcgtgacgggaaaacgttgatcct

SEQ ID NO: 13400 - DNA, 25 bp, E. coli
tcgatgaacgcttgcgagttcattt

SEQ ID NO: 13401 - DNA, 25 bp, E. coli
tcgatgaacgctagcgagttcattt

SEQ ID NO: 13402 - DNA, 25 bp, E. coli
tgcgtgacgggataacgttgatcct

SEQ ID NO: 13403 - DNA, 25 bp, E. coli
cgccgccgcgactttcaatcgtgtt

SEQ ID NO: 13404 - DNA, 25 bp, E. coli
cgagttcatttaaggttcgctgcat

SEQ ID NO: 13405 - DNA, 25 bp, E. coli
cgccgccgcgacattcaatcgtgtt

SEQ ID NO: 13406 - DNA, 25 bp, E. coli
cgagttcatttatggttcgctgcat

SEQ ID NO: 13407 - DNA, 25 bp, E. coli
gttcgtcgcccgacgctggcgctga

SEQ ID NO: 13408 - DNA, 25 bp, E. coli
gttcgtcgcccgtcgctggcgctga

SEQ ID NO: 13409 - DNA, 25 bp, E. coli
caaagtaaaccggaataatcccgtg

SEQ ID NO: 13410 - DNA, 25 bp, E. coli
caaagtaaaccgcaataatcccgtg

SEQ ID NO: 13411 - DNA, 25 bp, E. coli
cagctacgacgatattttgcgggtt

SEQ ID NO: 13412 - DNA, 25 bp, E. coli
cagctacgacgaaattttgcgggtt

SEQ ID NO: 13413 - DNA, 25 bp, E. coli
catgcagaaaggtattggaagtggc

SEQ ID NO: 13414 - DNA, 25 bp, E. coli
cataaaattattaggcgctcgcggt

SEQ ID NO: 13415 - DNA, 25 bp, E. coli
cataaaattatttggcgctcgcggt

SEQ ID NO: 13416 - DNA, 25 bp, E. coli
catgcagaaaggaattggaagtggc

SEQ ID NO: 13417 - DNA, 25 bp, E. coli
taaaggatttaactccctccagccg

SEQ ID NO: 13418 - DNA, 25 bp, E. coli
taaaaatatcgactgcagctacgac

SEQ ID NO: 13419 - DNA, 25 bp, E. coli
taaaaatatcgagtgcagctacgac

SEQ ID NO: 13420 - DNA, 25 bp, E. coli
taaaggatttaagtccctccagccg

SEQ ID NO: 13421 - DNA, 25 bp, E. coli
tacccttgcttgaaaatcaccggcg

SEQ ID NO: 13422 - DNA, 25 bp, E. coli
tacccttgcttgtaaatcaccggcg

SEQ ID NO: 13423 - DNA, 25 bp, E. coli
tttatgaccacattacgacaggttg

SEQ ID NO: 13424 - DNA, 25 bp, E. coli
tttatgaccacaatacgacaggttg

SEQ ID NO: 13425 - DNA, 25 bp, E. coli
cgctcgcggtgctataaactcgcat

SEQ ID NO: 13426 - DNA, 25 bp, E. coli
cgctcgcggtgcaataaactcgcat

SEQ ID NO: 13427 - DNA, 25 bp, E. coli
cgcgactctctctgattaccacgaa

SEQ ID NO: 13428 - DNA, 25 bp, E. coli
cgcgactctctcagattaccacgaa

SEQ ID NO: 13429 - DNA, 25 bp, E. coli
tcaccggcgcttcttacagttgtaa

SEQ ID NO: 13430 - DNA, 25 bp, E. coli
tcaccggcgcttgttacagttgtaa

SEQ ID NO: 13431 - DNA, 25 bp, E. coli
cactatctcatcaataatattcgcg

SEQ ID NO: 13432 - DNA, 25 bp, E. coli
cactatctcatctataatattcgcg

SEQ ID NO: 13433 - DNA, 25 bp, E. coli
atctcatcaatattattcgcgagca

SEQ ID NO: 13434 - DNA, 25 bp, E. coli
atgcgtcggctgatgcactatctca

SEQ ID NO: 13435 - DNA, 25 bp, E. coli
atgcgtcggctgttgcactatctca

SEQ ID NO: 13436 - DNA, 25 bp, E. coli
atctcatcaataatattcgcgagca

SEQ ID NO: 13437 - DNA, 25 bp, E. coli
tatggatctgatctatgtgttttat

SEQ ID NO: 13438 - DNA, 25 bp, E. coli
tatggatctgatgtatgtgttttat

SEQ ID NO: 13439 - DNA, 25 bp, E. coli
tatttaatgcgtcggctgttgcact

SEQ ID NO: 13440 - DNA, 25 bp, E. coli
tatttaatgcgtgggctgttgcact

SEQ ID NO: 13441 - DNA, 25 bp, E. coli
tgttggcaattatggatctgatcta

SEQ ID NO: 13442 - DNA, 25 bp, E. coli
tgttggcaattaaggatctgatcta

SEQ ID NO: 13443 - DNA, 25 bp, E. coli
cgtcggctgttggactatctcatca

SEQ ID NO: 13444 - DNA, 25 bp, E. coli
cgtcggctgttgcactatctcatca

SEQ ID NO: 13445 - DNA, 25 bp, E. coli
ggattgttggcaattatggatctga

SEQ ID NO: 13446 - DNA, 25 bp, E. coli
ggattgttggcatttatggatctga

SEQ ID NO: 13447 - DNA, 25 bp, E. coli
ggctgttgcactttctcatcaataa

SEQ ID NO: 13448 - DNA, 25 bp, E. coli
ggcaattatggatctgatctatgtg

SEQ ID NO: 13449 - DNA, 25 bp, E. coli
ggcaattatggaactgatctatgtg

SEQ ID NO: 13450 - DNA, 25 bp, E. coli
ggctgttgcactatctcatcaataa

SEQ ID NO: 13451 - DNA, 25 bp, E. coli
taatgcgtcggcagttgcactatct

SEQ ID NO: 13452 - DNA, 25 bp, E. coli
taatgcgtcggctgttgcactatct

SEQ ID NO: 13453 - DNA, 25 bp, E. coli
tacttttttaagtgcaatggatgga

SEQ ID NO: 13454 - DNA, 25 bp, E. coli
tacttttttaagagcaatggatgga

SEQ ID NO: 13455 - DNA, 25 bp, E. coli
caactaattgcctggagaagttatg

SEQ ID NO: 13456 - DNA, 25 bp, E. coli
caactaattgccaggagaagttatg

SEQ ID NO: 13457 - DNA, 25 bp, E. coli
aaatgatgaatgatttagactatcc

SEQ ID NO: 13458 - DNA, 25 bp, E. coli
aaatgatgaatgttttagactatcc

SEQ ID NO: 13459 - DNA, 25 bp, E. coli
tagactatccatatgaagcaccgct

SEQ ID NO: 13460 - DNA, 25 bp, E. coli
tagactatccatttgaagcaccgct

SEQ ID NO: 13461 - DNA, 25 bp, E. coli
tatttagcctctggattccagaacc

SEQ ID NO: 13462 - DNA, 25 bp, E. coli
tatttagcctctcgattccagaacc

SEQ ID NO: 13463 - DNA, 25 bp, E. coli
tcgattccagaaccttcagttaaaa

SEQ ID NO: 13464 - DNA, 25 bp, E. coli
tcgattccagaagcttcagttaaaa

SEQ ID NO: 13465 - DNA, 25 bp, E. coli
gaagcaccgctctaggaatcattta

SEQ ID NO: 13466 - DNA, 25 bp, E. coli
gaagcaccgctcaaggaatcattta

SEQ ID NO: 13467 - DNA, 25 bp, E. coli
cctggagaagttatgtaatgaagtt

SEQ ID NO: 13468 - DNA, 25 bp, E. coli
cctggagaagttttgtaatgaagtt

SEQ ID NO: 13469 - DNA, 25 bp, E. coli
ggattacgattatttagcctctcga

SEQ ID NO: 13470 - DNA, 25 bp, E. coli
ggattacgattaattagcctctcga

SEQ ID NO: 13471 - DNA, 25 bp, E. coli
tggattcgaagttaatggattacga

SEQ ID NO: 13472 - DNA, 25 bp, E. coli
tggattcgaagtaaatggattacga

SEQ ID NO: 13473 - DNA, 25 bp, E. coli
taagagcaatggatggattcgaagt

SEQ ID NO: 13474 - DNA, 25 bp, E. coli
taagagcaatggttggattcgaagt

SEQ ID NO: 13475 - DNA, 25 bp, E. coli
taaatttggcaacgtgcgtccggcg

SEQ ID NO: 13476 - DNA, 25 bp, E. coli
taaatttggcaaggtgcgtccggcg

SEQ ID NO: 13477 - DNA, 25 bp, E. coli
agtatgtgaagttcgcgcagacgca

SEQ ID NO: 13478 - DNA, 25 bp, E. coli
agtatgtgaagtacgcgcagacgca

SEQ ID NO: 13479 - DNA, 25 bp, E. coli
tgtcgatggcgcaaaagcatgtgct

SEQ ID NO: 13480 - DNA, 25 bp, E. coli
tgtcgatggcgctaaagcatgtgct

SEQ ID NO: 13481 - DNA, 25 bp, E. coli
gctcggcggctatattgttctggaa

SEQ ID NO: 13482 - DNA, 25 bp, E. coli
gctcggcggctaaattgttctggaa

SEQ ID NO: 13483 - DNA, 25 bp, E. coli
gcgatcaaaaatcccgcctggtgga

SEQ ID NO: 13484 - DNA, 25 bp, E. coli
gcatgggtgacctgaaacgctttga

SEQ ID NO: 13485 - DNA, 25 bp, E. coli
gcgatcaaaaatgccgcctggtgga

SEQ ID NO: 13486 - DNA, 25 bp, E. coli
gcatgggtgaccagaaacgctttga

SEQ ID NO: 13487 - DNA, 25 bp, E. coli
gaaacacgtcgcgaagagcgtatcg

SEQ ID NO: 13488 - DNA, 25 bp, E. coli
gaaacacgtcgccaagagcgtatcg

SEQ ID NO: 13489 - DNA, 25 bp, E. coli
cgtgcatgtcagaaaaggcgctacc

SEQ ID NO: 13490 - DNA, 25 bp, E. coli
cgtgcatgtcagtaaaggcgctacc

SEQ ID NO: 13491 - DNA, 25 bp, E. coli
tggtagaacccgatcagaccctctt

SEQ ID NO: 13492 - DNA, 25 bp, E. coli
tggtagaacccgttcagaccctctt

SEQ ID NO: 13493 - DNA, 25 bp, E. coli
taagttacatcttaaagacgccgcc

SEQ ID NO: 13494 - DNA, 25 bp, E. coli
taagttacatctaaaagacgccgcc

SEQ ID NO: 13495 - DNA, 25 bp, E. coli
gagttgccggtaaaacactgggcca

SEQ ID NO: 13496 - DNA, 25 bp, E. coli
gagttgccggtataacactgggcca

SEQ ID NO: 13497 - DNA, 25 bp, E. coli
catctggttgtgaatcctgaagtgc

SEQ ID NO: 13498 - DNA, 25 bp, E. coli
catctggttgtgtatcctgaagtgc

SEQ ID NO: 13499 - DNA, 25 bp, E. coli
tagggaagctgtcgctaacgatacc

SEQ ID NO: 13500 - DNA, 25 bp, E. coli
tagggaagctgtggctaacgatacc

SEQ ID NO: 13501 - DNA, 25 bp, E. coli
tgtaagcgacgtaaagatcaatctg

SEQ ID NO: 13502 - DNA, 25 bp, E. coli
tgtaagcgacgttaagatcaatctg

SEQ ID NO: 13503 - DNA, 25 bp, E. coli
tcagaaatctgattgagcaggcgtg

SEQ ID NO: 13504 - DNA, 25 bp, E. coli
cctggtgtactgcaacagacggccc

SEQ ID NO: 13505 - DNA, 25 bp, E. coli
ccagggcagggttttaataaggcca

SEQ ID NO: 13506 - DNA, 25 bp, E. coli
ccagggcagggtattaataaggcca

SEQ ID NO: 13507 - DNA, 25 bp, E. coli
gccctctggcaatagtgtgtccttg

SEQ ID NO: 13508 - DNA, 25 bp, E. coli
cctggtgtactggaacagacggccc

SEQ ID NO: 13509 - DNA, 25 bp, E. coli
gccctctggcaaaagtgtgtccttg

SEQ ID NO: 13510 - DNA, 25 bp, E. coli
gggctgcagccacacatcctgaaat

SEQ ID NO: 13511 - DNA, 25 bp, E. coli
gggctgcagccagacatcctgaaat

SEQ ID NO: 13512 - DNA, 25 bp, E. coli
tgtgtccttgcatctctgtatcggg

SEQ ID NO: 13513 - DNA, 25 bp, E. coli
tgtgtccttgcaactctgtatcggg

SEQ ID NO: 13514 - DNA, 25 bp, E. coli
taagctttcctgaaacgccctctgg

SEQ ID NO: 13515 - DNA, 25 bp, E. coli
tcagaaatctgaatgagcaggcgtg

SEQ ID NO: 13516 - DNA, 25 bp, E. coli
taagctttcctgtaacgccctctgg

SEQ ID NO: 13517 - DNA, 25 bp, E. coli
gacggcccgggcatacattgaatca

SEQ ID NO: 13518 - DNA, 25 bp, E. coli
gacggcccgggcttacattgaatca

SEQ ID NO: 13519 - DNA, 25 bp, E. coli
caatcgccaacgagctgaaggaaga

SEQ ID NO: 13520 - DNA, 25 bp, E. coli
caatcgccaacgtgctgaaggaaga

SEQ ID NO: 13521 - DNA, 25 bp, E. coli
caggctggtcttggtggcgaaatta

SEQ ID NO: 13522 - DNA, 25 bp, E. coli
caggctggtcttcgtggcgaaatta

SEQ ID NO: 13523 - DNA, 25 bp, E. coli
atgagcatgcaacatccgatcgcgg

SEQ ID NO: 13524 - DNA, 25 bp, E. coli
atgagcatgcaagatccgatcgcgg

SEQ ID NO: 13525 - DNA, 25 bp, E. coli
tatgctgacccgaatccgtaacggt

SEQ ID NO: 13526 - DNA, 25 bp, E. coli
tagaaagcattctgcgtgtcagccg

SEQ ID NO: 13527 - DNA, 25 bp, E. coli
tagaaagcattcagcgtgtcagccg

SEQ ID NO: 13528 - DNA, 25 bp, E. coli
tatgctgacccgtatccgtaacggt

SEQ ID NO: 13529 - DNA, 25 bp, E. coli
tataaacgtaaacatgagctgccga

SEQ ID NO: 13530 - DNA, 25 bp, E. coli
tttaaagttgaaggcgacaccaagc

SEQ ID NO: 13531 - DNA, 25 bp, E. coli
ttatgactgatcctgcagcgcgcca

SEQ ID NO: 13532 - DNA, 25 bp, E. coli
tataaacgtaaagatgagctgccga

SEQ ID NO: 13533 - DNA, 25 bp, E. coli
ttatgactgatcgtgcagcgcgcca

SEQ ID NO: 13534 - DNA, 25 bp, E. coli
tttaaagttgaacgcgacaccaagc

SEQ ID NO: 13535 - DNA, 25 bp, E. coli
tccaagctgaaagtggcaatcgcca

SEQ ID NO: 13536 - DNA, 25 bp, E. coli
tccaagctgaaactggcaatcgcca

SEQ ID NO: 13537 - DNA, 25 bp, E. coli
gcctgaactggatcttactctgaag

SEQ ID NO: 13538 - DNA, 25 bp, E. coli
gcctgaactggaacttactctgaag

SEQ ID NO: 13539 - DNA, 25 bp, E. coli
ccaggtctgcgcttctataaacgta

SEQ ID NO: 13540 - DNA, 25 bp, E. coli
ccaggtctgcgcatctataaacgta

SEQ ID NO: 13541 - DNA, 25 bp, E. coli
caaatcacgtttcccaccagcgatt

SEQ ID NO: 13542 - DNA, 25 bp, E. coli
caaatcacgtttgccaccagcgatt

SEQ ID NO: 13543 - DNA, 25 bp, E. coli
tacaattccgtgtactgtttagctg

SEQ ID NO: 13544 - DNA, 25 bp, E. coli
tacaattccgtgaactgtttagctg

SEQ ID NO: 13545 - DNA, 25 bp, E. coli
ttcggcccggtgcatgtggaacaac

SEQ ID NO: 13546 - DNA, 25 bp, E. coli
ttcggcccggtggatgtggaacaac

SEQ ID NO: 13547 - DNA, 25 bp, E. coli
ttaatgaacttatcgccggattggt

SEQ ID NO: 13548 - DNA, 25 bp, E. coli
ttaatgaacttaacgccggattggt

SEQ ID NO: 13549 - DNA, 25 bp, E. coli
tgtttagctggtaatccagttcgct

SEQ ID NO: 13550 - DNA, 25 bp, E. coli
tgtttagctggttatccagttcgct

SEQ ID NO: 13551 - DNA, 25 bp, E. coli
tccacgccgggatcggaagttgtgc

SEQ ID NO: 13552 - DNA, 25 bp, E. coli
tccacgccgggaacggaagttgtgc

SEQ ID NO: 13553 - DNA, 25 bp, E. coli
gccattaccaaacccctggatatgg

SEQ ID NO: 13554 - DNA, 25 bp, E. coli
gccattaccaaagccctggatatgg

SEQ ID NO: 13555 - DNA, 25 bp, E. coli
cgttgcccctgcattttgctgctgg

SEQ ID NO: 13556 - DNA, 25 bp, E. coli
cgttgcccctgctttttgctgctgg

SEQ ID NO: 13557 - DNA, 25 bp, E. coli
ctggaagcgccaaaaggctggacgt

SEQ ID NO: 13558 - DNA, 25 bp, E. coli
ctggaagcgccataaggctggacgt

SEQ ID NO: 13559 - DNA, 25 bp, E. coli
gtggaacaaccctttaccagcgccg

SEQ ID NO: 13560 - DNA, 25 bp, E. coli
gtggaacaacccattaccagcgccg

SEQ ID NO: 13561 - DNA, 25 bp, E. coli
gatggtgcaccatccgatgagtggc

SEQ ID NO: 13562 - DNA, 25 bp, E. coli
gatggtgcaccaaccgatgagtggc

SEQ ID NO: 13563 - DNA, 25 bp, E. coli
caaagcgcactatgtcacaatctga

SEQ ID NO: 13564 - DNA, 25 bp, E. coli
caaagcgcactaagtcacaatctga

SEQ ID NO: 13565 - DNA, 25 bp, E. coli
taaactgacccgctcgagactgatt

SEQ ID NO: 13566 - DNA, 25 bp, E. coli
taaactgacccggtcgagactgatt

SEQ ID NO: 13567 - DNA, 25 bp, E. coli
tatgtcacaatctgaagcgggccag

SEQ ID NO: 13568 - DNA, 25 bp, E. coli
tatgtcacaatcagaagcgggccag

SEQ ID NO: 13569 - DNA, 25 bp, E. coli
tctgaagcgggcgagctgacccgct

SEQ ID NO: 13570 - DNA, 25 bp, E. coli
tctgaagcgggccagctgacccgct

SEQ ID NO: 13571 - DNA, 25 bp, E. coli
ccagctgacccggtcgttttggtgc

SEQ ID NO: 13572 - DNA, 25 bp, E. coli
ccagctgacccgctcgttttggtgc

SEQ ID NO: 13573 - DNA, 25 bp, E. coli
gctcgagactgaatacaaacgcaaa

SEQ ID NO: 13574 - DNA, 25 bp, E. coli
gctcgagactgattacaaacgcaaa

SEQ ID NO: 13575 - DNA, 25 bp, E. coli
gcacttcagcaaaaataacgcataa

SEQ ID NO: 13576 - DNA, 25 bp, E. coli
gcacttcagcaataataacgcataa

SEQ ID NO: 13577 - DNA, 25 bp, E. coli
gggccagtaaacagacccgctcgag

SEQ ID NO: 13578 - DNA, 25 bp, E. coli
gggccagtaaactgacccgctcgag

SEQ ID NO: 13579 - DNA, 25 bp, E. coli
tcacaatctgaaccgggccagctga

SEQ ID NO: 13580 - DNA, 25 bp, E. coli
tcacaatctgaagcgggccagctga

SEQ ID NO: 13581 - DNA, 25 bp, E. coli
gacccgctcgagtctgattacaaac

SEQ ID NO: 13582 - DNA, 25 bp, E. coli
gacccgctcgttttggtgcgtacga

SEQ ID NO: 13583 - DNA, 25 bp, E. coli
gacccgctcgagactgattacaaac

SEQ ID NO: 13584 - DNA, 25 bp, E. coli
gacccgctcgttatggtgcgtacga

SEQ ID NO: 13585 - DNA, 25 bp, E. coli
cagaagaactacgttctactactga

SEQ ID NO: 13586 - DNA, 25 bp, E. coli
cagaagaactaccttctactactga

SEQ ID NO: 13587 - DNA, 25 bp, E. coli
taaatgcagcagaagaactacgttc

SEQ ID NO: 13588 - DNA, 25 bp, E. coli
taaatgcagcagtagaactacgttc

SEQ ID NO: 13589 - DNA, 25 bp, E. coli
aaaaaagctggaaattcaaaatggt

SEQ ID NO: 13590 - DNA, 25 bp, E. coli
aaaaaagctggatattcaaaatggt

SEQ ID NO: 13591 - DNA, 25 bp, E. coli
tatcattggtatatctattggtagg

SEQ ID NO: 13592 - DNA, 25 bp, E. coli
tatcattggtatttctattggtagg

SEQ ID NO: 13593 - DNA, 25 bp, E. coli
tgatgaaaatctagaggtagaactc

SEQ ID NO: 13594 - DNA, 25 bp, E. coli
tgatgaaaatcttgaggtagaactc

SEQ ID NO: 13595 - DNA, 25 bp, E. coli
tgagcttgctaaatggattgatgaa

SEQ ID NO: 13596 - DNA, 25 bp, E. coli
tgagcttgctaattggattgatgaa

SEQ ID NO: 13597 - DNA, 25 bp, E. coli
gctactataaaatacagcgctgata

SEQ ID NO: 13598 - DNA, 25 bp, E. coli
gctactataaaaaacagcgctgata

SEQ ID NO: 13599 - DNA, 25 bp, E. coli
gcgctgatatcattgagcttgctaa

SEQ ID NO: 13600 - DNA, 25 bp, E. coli
gcgctgatatcaatgagcttgctaa

SEQ ID NO: 13601 - DNA, 25 bp, E. coli
tggtaggtatataaataaatgcagc

SEQ ID NO: 13602 - DNA, 25 bp, E. coli
tggtaggtatattaataaatgcagc

SEQ ID NO: 13603 - DNA, 25 bp, E. coli
tcaaaatggtatatacagagattgt

SEQ ID NO: 13604 - DNA, 25 bp, E. coli
tcaaaatggtatttacagagattgt

SEQ ID NO: 13605 - DNA, 25 bp, E. coli
gaggtagaactcacaataaatattg

SEQ ID NO: 13606 - DNA, 25 bp, E. coli
gaggtagaactctcaataaatattg

SEQ ID NO: 13607 - DNA, 25 bp, E. coli
catatgaaaaactgacggagtcgca

SEQ ID NO: 13608 - DNA, 25 bp, E. coli
caggatgggatggtgattacgccta

SEQ ID NO: 13609 - DNA, 25 bp, E. coli
catatgaaaaacagacggagtcgca

SEQ ID NO: 13610 - DNA, 25 bp, E. coli
caggatgggatgctgattacgccta

SEQ ID NO: 13611 - DNA, 25 bp, E. coli
aactttacctgaggaccctggcgat

SEQ ID NO: 13612 - DNA, 25 bp, E. coli
aactttacctgacgaccctggcgat

SEQ ID NO: 13613 - DNA, 25 bp, E. coli
aactttctgaacttgttgcgctggc

SEQ ID NO: 13614 - DNA, 25 bp, E. coli
aactttctgaacatgttgcgctggc

SEQ ID NO: 13615 - DNA, 25 bp, E. coli
tatgcgacctttggaacacgcgaac

SEQ ID NO: 13616 - DNA, 25 bp, E. coli
tatgcgacctttcgaacacgcgaac

SEQ ID NO: 13617 - DNA, 25 bp, E. coli
tatcaaagcagagcggatgccaacg

SEQ ID NO: 13618 - DNA, 25 bp, E. coli
tatcaaagcagaccggatgccaacg

SEQ ID NO: 13619 - DNA, 25 bp, E. coli
gccgtagtgctggagaaattcaaaa

SEQ ID NO: 13620 - DNA, 25 bp, E. coli
gccgtagtgctgcagaaattcaaaa

SEQ ID NO: 13621 - DNA, 25 bp, E. coli
gctggctctcaataatcgtaaggca

SEQ ID NO: 13622 - DNA, 25 bp, E. coli
gctggctctcaaaaatcgtaaggca

SEQ ID NO: 13623 - DNA, 25 bp, E. coli
cccggtgccagtcctgagcgatgaa

SEQ ID NO: 13624 - DNA, 25 bp, E. coli
cccggtgccagtgctgagcgatgaa

SEQ ID NO: 13625 - DNA, 25 bp, E. coli
ggtaattctattccttgcgcgcctt

SEQ ID NO: 13626 - DNA, 25 bp, E. coli
ggtaattctattgcttgcgcgcctt

SEQ ID NO: 13627 - DNA, 25 bp, E. coli
tcactacatgatagcggcggctggc

SEQ ID NO: 13628 - DNA, 25 bp, E. coli
tcactacatgattgcggcggctggc

SEQ ID NO: 13629 - DNA, 25 bp, E. coli
aagagatctctcacaaccagatggg

SEQ ID NO: 13630 - DNA, 25 bp, E. coli
aagagatctctctcaaccagatggg

SEQ ID NO: 13631 - DNA, 25 bp, E. coli
cagagtctgtaacagatctctcaca

SEQ ID NO: 13632 - DNA, 25 bp, E. coli
cagagtctgtaagagatctctcaca

SEQ ID NO: 13633 - DNA, 25 bp, E. coli
tatttcctggcgttctcctacagag

SEQ ID NO: 13634 - DNA, 25 bp, E. coli
tatttcctggcgatctcctacagag

SEQ ID NO: 13635 - DNA, 25 bp, E. coli
ttaagtattcgcttatttcctggcg

SEQ ID NO: 13636 - DNA, 25 bp, E. coli
ttaagtattcgcatatttcctggcg

SEQ ID NO: 13637 - DNA, 25 bp, E. coli
ttacaaggcgctaacagacaatgcc

SEQ ID NO: 13638 - DNA, 25 bp, E. coli
ttacaaggcgcttacagacaatgcc

SEQ ID NO: 13639 - DNA, 25 bp, E. coli
tcgcgaagtcttacaaggcgcttac

SEQ ID NO: 13640 - DNA, 25 bp, E. coli
tcgcgaagtctttcaaggcgcttac

SEQ ID NO: 13641 - DNA, 25 bp, E. coli
cctgtcgacgaagatagaatcgtct

SEQ ID NO: 13642 - DNA, 25 bp, E. coli
cctgtcgacgaacatagaatcgtct

SEQ ID NO: 13643 - DNA, 25 bp, E. coli
gacaatgccttaaggaaaatttcat

SEQ ID NO: 13644 - DNA, 25 bp, E. coli
gacaatgccttatggaaaatttcat

SEQ ID NO: 13645 - DNA, 25 bp, E. coli
gatagaatcgtcattttcgcgaagt

SEQ ID NO: 13646 - DNA, 25 bp, E. coli
gatagaatcgtctttttcgcgaagt

SEQ ID NO: 13647 - DNA, 25 bp, E. coli
tggcgatctcctacagagtctgtaa

SEQ ID NO: 13648 - DNA, 25 bp, E. coli
ggcgcttacagacaatgccttaagg

SEQ ID NO: 13649 - DNA, 25 bp, E. coli
ggcgcttacagagaatgccttaagg

SEQ ID NO: 13650 - DNA, 25 bp, E. coli
tggcgatctccttcagagtctgtaa

SEQ ID NO: 13651 - DNA, 25 bp, E. coli
aatctatatgcccacctggaaccgc

SEQ ID NO: 13652 - DNA, 25 bp, E. coli
aatgcagatcacctcgtcaccgaaa

SEQ ID NO: 13653 - DNA, 25 bp, E. coli
aatctatatgccgacctggaaccgc

SEQ ID NO: 13654 - DNA, 25 bp, E. coli
aatgcagatcacgtcgtcaccgaaa

SEQ ID NO: 13655 - DNA, 25 bp, E. coli
cggtacgtaacctggcgattatgct

SEQ ID NO: 13656 - DNA, 25 bp, E. coli
cggtacgtaaccaggcgattatgct

SEQ ID NO: 13657 - DNA, 25 bp, E. coli
aacggcaaacgtctggctgatggta

SEQ ID NO: 13658 - DNA, 25 bp, E. coli
aacggcaaacgtgtggctgatggta

SEQ ID NO: 13659 - DNA, 25 bp, E. coli
taccgcaagcacaaagacaaattcg

SEQ ID NO: 13660 - DNA, 25 bp, E. coli
taccgaactgaaagcggcacaggat

SEQ ID NO: 13661 - DNA, 25 bp, E. coli
taccgcaagcactaagacaaattcg

SEQ ID NO: 13662 - DNA, 25 bp, E. coli
taccgaactgaatgcggcacaggat

SEQ ID NO: 13663 - DNA, 25 bp, E. coli
gaagaggcgacgcagatcctgcata

SEQ ID NO: 13664 - DNA, 25 bp, E. coli
gaagaggcgacggagatcctgcata

SEQ ID NO: 13665 - DNA, 25 bp, E. coli
cgctgctgtcggagcgtaacggcaa

SEQ ID NO: 13666 - DNA, 25 bp, E. coli
cgctgctgtcggtgcgtaacggcaa

SEQ ID NO: 13667 - DNA, 25 bp, E. coli
cattcacaacgagattaacagcggg

SEQ ID NO: 13668 - DNA, 25 bp, E. coli
cattcacaacgacattaacagcggg

SEQ ID NO: 13669 - DNA, 25 bp, E. coli
gattacgacatcatcctgcggatgg

SEQ ID NO: 13670 - DNA, 25 bp, E. coli
gattacgacatcttcctgcggatgg

SEQ ID NO: 13671 - DNA, 25 bp, E. coli
ggatgattgctcgacctcctgggaa

SEQ ID NO: 13672 - DNA, 25 bp, E. coli
ggatgattgctccacctcctgggaa

SEQ ID NO: 13673 - DNA, 25 bp, E. coli
taaaaatgtgattgttgccgatcgc

SEQ ID NO: 13674 - DNA, 25 bp, E. coli
taaaaatgtgatagttgccgatcgc

SEQ ID NO: 13675 - DNA, 25 bp, E. coli
gaaccttttaccattgcggctaacg

SEQ ID NO: 13676 - DNA, 25 bp, E. coli
gaaccttttacctttgcggctaacg

SEQ ID NO: 13677 - DNA, 25 bp, E. coli
aaatatccgcgcgtcattggtcatg

SEQ ID NO: 13678 - DNA, 25 bp, E. coli
aaatatccgcgcctcattggtcatg

SEQ ID NO: 13679 - DNA, 25 bp, E. coli
ttaataacagccagacaccgcttgg

SEQ ID NO: 13680 - DNA, 25 bp, E. coli
ttaataacagcctgacaccgcttgg

SEQ ID NO: 13681 - DNA, 25 bp, E. coli
tccagtgaaccgactgaagtgattc

SEQ ID NO: 13682 - DNA, 25 bp, E. coli
tccagtgaaccgtctgaagtgattc

SEQ ID NO: 13683 - DNA, 25 bp, E. coli
tctccagcggcaggtattgtattga

SEQ ID NO: 13684 - DNA, 25 bp, E. coli
tctccagcggcacgtattgtattga

SEQ ID NO: 13685 - DNA, 25 bp, E. coli
gccggaatttgtggttcagatagcc

SEQ ID NO: 13686 - DNA, 25 bp, E. coli
gaggccgtaacgctggcttctccag

SEQ ID NO: 13687 - DNA, 25 bp, E. coli
gccggaatttgtcgttcagatagcc

SEQ ID NO: 13688 - DNA, 25 bp, E. coli
gaggccgtaacggtggcttctccag

SEQ ID NO: 13689 - DNA, 25 bp, E. coli
gacgatcgttcacgtattaaaaggc

SEQ ID NO: 13690 - DNA, 25 bp, E. coli
gacgatcgttcaggtattaaaaggc

SEQ ID NO: 13691 - DNA, 25 bp, E. coli
cccgtcagcgggagaagtacgagta

SEQ ID NO: 13692 - DNA, 25 bp, E. coli
cccgtcagcgggtgaagtacgagta

SEQ ID NO: 13693 - DNA, 25 bp, E. coli
ggtcaaccgactcaaaatgataccg

SEQ ID NO: 13694 - DNA, 25 bp, E. coli
ggtcaaccgactgaaaatgataccg

SEQ ID NO: 13695 - DNA, 25 bp, E. coli
ttccgttgcgcgttttggttagtac

SEQ ID NO: 13696 - DNA, 25 bp, E. coli
tagtacgcgtacactgtcaggaaaa

SEQ ID NO: 13697 - DNA, 25 bp, E. coli
tagtacgcgtactctgtcaggaaaa

SEQ ID NO: 13698 - DNA, 25 bp, E. coli
ttccgttgcgcgatttggttagtac

SEQ ID NO: 13699 - DNA, 25 bp, E. coli
ttctccagagccagataacgccgct

SEQ ID NO: 13700 - DNA, 25 bp, E. coli
ttctccagagcctgataacgccgct

SEQ ID NO: 13701 - DNA, 25 bp, E. coli
ttcgctttgtgtctcctggtgtctc

SEQ ID NO: 13702 - DNA, 25 bp, E. coli
ttcgctttgtgtgtcctggtgtctc

SEQ ID NO: 13703 - DNA, 25 bp, E. coli
tgtactgcacggaaatgtgacgtcc

SEQ ID NO: 13704 - DNA, 25 bp, E. coli
tgtattactgtaccatcctgactgt

SEQ ID NO: 13705 - DNA, 25 bp, E. coli
tgtattactgtagcatcctgactgt

SEQ ID NO: 13706 - DNA, 25 bp, E. coli
tgtactgcacggtaatgtgacgtcc

SEQ ID NO: 13707 - DNA, 25 bp, E. coli
tcaggaaaattgacgcagtggagta

SEQ ID NO: 13708 - DNA, 25 bp, E. coli
tcaggaaaattgtcgcagtggagta

SEQ ID NO: 13709 - DNA, 25 bp, E. coli
cgaaatatgcttcccgctacctggg

SEQ ID NO: 13710 - DNA, 25 bp, E. coli
cgaaatatgcttgccgctacctggg

SEQ ID NO: 13711 - DNA, 25 bp, E. coli
gtgtctcgcttcagcatgacccagg

SEQ ID NO: 13712 - DNA, 25 bp, E. coli
gtgtctcgcttctgcatgacccagg

SEQ ID NO: 13713 - DNA, 25 bp, E. coli
tgtgacgtcctttgcatacatgcag

SEQ ID NO: 13714 - DNA, 25 bp, E. coli
tgtgacgtccttagcatacatgcag

SEQ ID NO: 13715 - DNA, 25 bp, E. coli
taacgccgctgtgtctggattgccg

SEQ ID NO: 13716 - DNA, 25 bp, E. coli
taacgccgctgtctctggattgccg

SEQ ID NO: 13717 - DNA, 25 bp, E. coli
aattatacgcttagtgaaatgacca

SEQ ID NO: 13718 - DNA, 25 bp, E. coli
aagaaaatcggccttccggatgcgg

SEQ ID NO: 13719 - DNA, 25 bp, E. coli
aattatacgctttgtgaaatgacca

SEQ ID NO: 13720 - DNA, 25 bp, E. coli
aagaaaatcggcgttccggatgcgg

SEQ ID NO: 13721 - DNA, 25 bp, E. coli
aagaagcgttatgacaaaccgtcag

SEQ ID NO: 13722 - DNA, 25 bp, E. coli
aaacaggtcacactggcgcatctca

SEQ ID NO: 13723 - DNA, 25 bp, E. coli
aagaagcgttatcacaaaccgtcag

SEQ ID NO: 13724 - DNA, 25 bp, E. coli
aaacaggtcacagtggcgcatctca

SEQ ID NO: 13725 - DNA, 25 bp, E. coli
tgatttatggctcggtgggcgcagt

SEQ ID NO: 13726 - DNA, 25 bp, E. coli
tgatttatggctgggtgggcgcagt

SEQ ID NO: 13727 - DNA, 25 bp, E. coli
gcagtagaagaagcgttatcacaaa

SEQ ID NO: 13728 - DNA, 25 bp, E. coli
gcagtagaagaaccgttatcacaaa

SEQ ID NO: 13729 - DNA, 25 bp, E. coli
gcatcattcaggtatttgtgcccgg

SEQ ID NO: 13730 - DNA, 25 bp, E. coli
gcatcattcaggaatttgtgcccgg

SEQ ID NO: 13731 - DNA, 25 bp, E. coli
gaaacggcgatgatcgccggtgatt

SEQ ID NO: 13732 - DNA, 25 bp, E. coli
gaaacggcgatgttcgccggtgatt

SEQ ID NO: 13733 - DNA, 25 bp, E. coli
cgctttgtgaaaagaccaaaagtta

SEQ ID NO: 13734 - DNA, 25 bp, E. coli
cgcttattaaattatacgctttgtg

SEQ ID NO: 13735 - DNA, 25 bp, E. coli
cgcttattaaataatacgctttgtg

SEQ ID NO: 13736 - DNA, 25 bp, E. coli
cgctttgtgaaatgaccaaaagtta

SEQ ID NO: 13737 - DNA, 25 bp, E. coli
ggataaagaacgcatcattcaggaa

SEQ ID NO: 13738 - DNA, 25 bp, E. coli
ggataaagaacggatcattcaggaa

SEQ ID NO: 13739 - DNA, 25 bp, E. coli
cagggtaattttgagaaggtgctgt

SEQ ID NO: 13740 - DNA, 25 bp, E. coli
cagggtaattttcagaaggtgctgt

SEQ ID NO: 13741 - DNA, 25 bp, E. coli
tacaattcaggctacggattattcc

SEQ ID NO: 13742 - DNA, 25 bp, E. coli
tacaattcaggcaacggattattcc

SEQ ID NO: 13743 - DNA, 25 bp, E. coli
aacttgtacgtcagagcggtcgcga

SEQ ID NO: 13744 - DNA, 25 bp, E. coli
aacttgtacgtctgagcggtcgcga

SEQ ID NO: 13745 - DNA, 25 bp, E. coli
tattacataagctctctcgccagag

SEQ ID NO: 13746 - DNA, 25 bp, E. coli
tattacataagcactctcgccagag

SEQ ID NO: 13747 - DNA, 25 bp, E. coli
tcgccagtggtgttgtttacaattc

SEQ ID NO: 13748 - DNA, 25 bp, E. coli
tcgccagtggtgatgtttacaattc

SEQ ID NO: 13749 - DNA, 25 bp, E. coli
tctggaggctaataccggtgcatca

SEQ ID NO: 13750 - DNA, 25 bp, E. coli
tctcgccagagaactggtcgccagt

SEQ ID NO: 13751 - DNA, 25 bp, E. coli
tctggaggctaaaaccggtgcatca

SEQ ID NO: 13752 - DNA, 25 bp, E. coli
tctcgccagagatctggtcgccagt

SEQ ID NO: 13753 - DNA, 25 bp, E. coli
gccgctacgacacgcgtctgaacat

SEQ ID NO: 13754 - DNA, 25 bp, E. coli
gccgctacgacaggcgtctgaacat

SEQ ID NO: 13755 - DNA, 25 bp, E. coli
ccggtgcatcaacgtattacataag

SEQ ID NO: 13756 - DNA, 25 bp, E. coli
ccggtgcatcaaggtattacataag

SEQ ID NO: 13757 - DNA, 25 bp, E. coli
gattattcccgtctgagcaggcgcg

SEQ ID NO: 13758 - DNA, 25 bp, E. coli
gattattcccgtgtgagcaggcgcg

SEQ ID NO: 13759 - DNA, 25 bp, E. coli
gacgttacgggctctggaggctaaa

SEQ ID NO: 13760 - DNA, 25 bp, E. coli
gacgttacgggcactggaggctaaa

SEQ ID NO: 13761 - DNA, 25 bp, E. coli
aagagctggcattacgtgacgggaa

SEQ ID NO: 13762 - DNA, 25 bp, E. coli
aagagctggcataacgtgacgggaa

SEQ ID NO: 13763 - DNA, 25 bp, E. coli
catgaccggaacacctgcagaaatg

SEQ ID NO: 13764 - DNA, 25 bp, E. coli
catgaccggaactcctgcagaaatg

SEQ ID NO: 13765 - DNA, 25 bp, E. coli
atctggatacttacgccccgctgag

SEQ ID NO: 13766 - DNA, 25 bp, E. coli
atctggatactttcgccccgctgag

SEQ ID NO: 13767 - DNA, 25 bp, E. coli
tatcgcagtgattttcggacattta

SEQ ID NO: 13768 - DNA, 25 bp, E. coli
tatcgcagtgatattcggacattta

SEQ ID NO: 13769 - DNA, 25 bp, E. coli
tgctgacgccgatgccaatctcggc

SEQ ID NO: 13770 - DNA, 25 bp, E. coli
tgctgacgccgaagccaatctcggc

SEQ ID NO: 13771 - DNA, 25 bp, E. coli
ccgggacgcatgaccggaactcctg

SEQ ID NO: 13772 - DNA, 25 bp, E. coli
ccgggacgcatgtccggaactcctg

SEQ ID NO: 13773 - DNA, 25 bp, E. coli
cttacgccccgcagagcgatgctga

SEQ ID NO: 13774 - DNA, 25 bp, E. coli
cggacatttaatagtcggtatattt

SEQ ID NO: 13775 - DNA, 25 bp, E. coli
cttacgccccgctgagcgatgctga

SEQ ID NO: 13776 - DNA, 25 bp, E. coli
cggacatttaattgtcggtatattt

SEQ ID NO: 13777 - DNA, 25 bp, E. coli
gatattcggacatttaatagtcggt

SEQ ID NO: 13778 - DNA, 25 bp, E. coli
gatattcggacaattaatagtcggt

SEQ ID NO: 13779 - DNA, 25 bp, E. coli
gggttatcgcagagatattcggaca

SEQ ID NO: 13780 - DNA, 25 bp, E. coli
gggttatcgcagtgatattcggaca

SEQ ID NO: 13781 - DNA, 25 bp, E. coli
gagcgatgctgaggccgatgccaat

SEQ ID NO: 13782 - DNA, 25 bp, E. coli
gagcgatgctgacgccgatgccaat

SEQ ID NO: 13783 - DNA, 25 bp, E. coli
caatacgctgttaggctcgcgccct

SEQ ID NO: 13784 - DNA, 25 bp, E. coli
aattacgatggaagcgaatcctggt

SEQ ID NO: 13785 - DNA, 25 bp, E. coli
aattacgatggatgcgaatcctggt

SEQ ID NO: 13786 - DNA, 25 bp, E. coli
caatacgctgtttggctcgcgccct

SEQ ID NO: 13787 - DNA, 25 bp, E. coli
cagtatactggcgtttcagaagagg

SEQ ID NO: 13788 - DNA, 25 bp, E. coli
cagtatactggcctttcagaagagg

SEQ ID NO: 13789 - DNA, 25 bp, E. coli
aggttattcgccctcagttagacga

SEQ ID NO: 13790 - DNA, 25 bp, E. coli
aggttattcgccgtcagttagacga

SEQ ID NO: 13791 - DNA, 25 bp, E. coli
tattgctcagggttatctcacagaa

SEQ ID NO: 13792 - DNA, 25 bp, E. coli
tattgctcagggatatctcacagaa

SEQ ID NO: 13793 - DNA, 25 bp, E. coli
tgtgaaccgcatctccattggcgta

SEQ ID NO: 13794 - DNA, 25 bp, E. coli
tgtgaaccgcatgtccattggcgta

SEQ ID NO: 13795 - DNA, 25 bp, E. coli
tcagttagacgacgctattgctcag

SEQ ID NO: 13796 - DNA, 25 bp, E. coli
tcagttagacgaggctattgctcag

SEQ ID NO: 13797 - DNA, 25 bp, E. coli
gcgcgtggagttaagccagtatact

SEQ ID NO: 13798 - DNA, 25 bp, E. coli
gccctcctgtacagccggacgatga

SEQ ID NO: 13799 - DNA, 25 bp, E. coli
gcgcgtggagtttagccagtatact

SEQ ID NO: 13800 - DNA, 25 bp, E. coli
gccctcctgtactgccggacgatga

SEQ ID NO: 13801 - DNA, 25 bp, E. coli
gcctttcagaagtggttattcgccc

SEQ ID NO: 13802 - DNA, 25 bp, E. coli
gcctttcagaagaggttattcgccc

SEQ ID NO: 13803 - DNA, 25 bp, E. coli
cgaatcctggtagggttgaagccga

SEQ ID NO: 13804 - DNA, 25 bp, E. coli
cgaatcctggtacggttgaagccga

SEQ ID NO: 13805 - DNA, 25 bp, E. coli
catacgaagattcttgctgcctgga

SEQ ID NO: 13806 - DNA, 25 bp, E. coli
catattcctttcgagcttgagcagc

SEQ ID NO: 13807 - DNA, 25 bp, E. coli
catattcctttccagcttgagcagc

SEQ ID NO: 13808 - DNA, 25 bp, E. coli
catacgaagattgttgctgcctgga

SEQ ID NO: 13809 - DNA, 25 bp, E. coli
tactccttgcgaaagataatctcgg

SEQ ID NO: 13810 - DNA, 25 bp, E. coli
tactccttgcgatagataatctcgg

SEQ ID NO: 13811 - DNA, 25 bp, E. coli
tatggccgtccggttgaggatcaaa

SEQ ID NO: 13812 - DNA, 25 bp, E. coli
tatggccgtccgcttgaggatcaaa

SEQ ID NO: 13813 - DNA, 25 bp, E. coli
tataattttagccaagaggacctgg

SEQ ID NO: 13814 - DNA, 25 bp, E. coli
tataattttagcgaagaggacctgg

SEQ ID NO: 13815 - DNA, 25 bp, E. coli
tgctccgagtgtctaggaataaccc

SEQ ID NO: 13816 - DNA, 25 bp, E. coli
tgctccgagtgtgtaggaataaccc

SEQ ID NO: 13817 - DNA, 25 bp, E. coli
cctggcgttgcaacacgggttcact

SEQ ID NO: 13818 - DNA, 25 bp, E. coli
cctggcgttgcatcacgggttcact

SEQ ID NO: 13819 - DNA, 25 bp, E. coli
gacaaatggacgaaggcatcaggct

SEQ ID NO: 13820 - DNA, 25 bp, E. coli
gacaaatggacgtaggcatcaggct

SEQ ID NO: 13821 - DNA, 25 bp, E. coli
gattttggagcagtttacccgtgac

SEQ ID NO: 13822 - DNA, 25 bp, E. coli
gattttggagcactttacccgtgac

SEQ ID NO: 13823 - DNA, 25 bp, E. coli
taaccgtaagcgatgcagacgcaat

SEQ ID NO: 13824 - DNA, 25 bp, E. coli
taaccgtaagcgttgcagacgcaat

SEQ ID NO: 13825 - DNA, 25 bp, E. coli
gagagaactcctctcgctgagcaga

SEQ ID NO: 13826 - DNA, 25 bp, E. coli
gagagaactcctgtcgctgagcaga

SEQ ID NO: 13827 - DNA, 25 bp, E. coli
caggctctgctaaaaatgccagata

SEQ ID NO: 13828 - DNA, 25 bp, E. coli
caggctctgctataaatgccagata

SEQ ID NO: 13829 - DNA, 25 bp, E. coli
cattcaggctctgctaaaaatgcca

SEQ ID NO: 13830 - DNA, 25 bp, E. coli
cattcaggctctcctaaaaatgcca

SEQ ID NO: 13831 - DNA, 25 bp, E. coli
taaaaatgccagataacattccggc

SEQ ID NO: 13832 - DNA, 25 bp, E. coli
taaaaatgccagttaacattccggc

SEQ ID NO: 13833 - DNA, 25 bp, E. coli
aaaaatgccagaaaacattccggcc

SEQ ID NO: 13834 - DNA, 25 bp, E. coli
aaaagccgccagtgtcacccactga

SEQ ID NO: 13835 - DNA, 25 bp, E. coli
aaaagccgccagagtcacccactga

SEQ ID NO: 13836 - DNA, 25 bp, E. coli
aaaaaagccgccagtgtcacccact

SEQ ID NO: 13837 - DNA, 25 bp, E. coli
aaaaaagccgcctgtgtcacccact

SEQ ID NO: 13838 - DNA, 25 bp, E. coli
aaaaatgccagataacattccggcc

SEQ ID NO: 13839 - DNA, 25 bp, E. coli
ttcaggctctgctaaaaatgccaga

SEQ ID NO: 13840 - DNA, 25 bp, E. coli
ttcaggctctgcaaaaaatgccaga

SEQ ID NO: 13841 - DNA, 25 bp, E. coli
gccagtgtcaccgactgacggccaa

SEQ ID NO: 13842 - DNA, 25 bp, E. coli
gccagtgtcacccactgacggccaa

SEQ ID NO: 13843 - DNA, 25 bp, E. coli
gctaaaaatgccagataacattccg

SEQ ID NO: 13844 - DNA, 25 bp, E. coli
gctaaaaatgcctgataacattccg

SEQ ID NO: 13845 - DNA, 25 bp, E. coli
ggcattcaggctctgctaaaaatgc

SEQ ID NO: 13846 - DNA, 25 bp, E. coli
ggcattcaggctgtgctaaaaatgc

SEQ ID NO: 13847 - DNA, 25 bp, E. coli
ggctctgctaaatatgccagataac

SEQ ID NO: 13848 - DNA, 25 bp, E. coli
ggctctgctaaaaatgccagataac

SEQ ID NO: 13849 - DNA, 25 bp, E. coli
agttacgaacaagaaagcgtcgagc

SEQ ID NO: 13850 - DNA, 25 bp, E. coli
agttacgaacaacaaagcgtcgagc

SEQ ID NO: 13851 - DNA, 25 bp, E. coli
tgagcgattcgaatagctcgatgca

SEQ ID NO: 13852 - DNA, 25 bp, E. coli
tgagcgattcgattagctcgatgca

SEQ ID NO: 13853 - DNA, 25 bp, E. coli
tcgaagttacgaacaagaaagcgtc

SEQ ID NO: 13854 - DNA, 25 bp, E. coli
tcgatgcacgagcaaaaagatgatg

SEQ ID NO: 13855 - DNA, 25 bp, E. coli
tcgatgcacgaggaaaaagatgatg

SEQ ID NO: 13856 - DNA, 25 bp, E. coli
tcgaagttacgatcaagaaagcgtc

SEQ ID NO: 13857 - DNA, 25 bp, E. coli
gctgcgcagagcagatgagcgattc

SEQ ID NO: 13858 - DNA, 25 bp, E. coli
gctgcgcagagctgatgagcgattc

SEQ ID NO: 13859 - DNA, 25 bp, E. coli
gcacgaggaaaaagatgatggctaa

SEQ ID NO: 13860 - DNA, 25 bp, E. coli
gcacgaggaaaatgatgatggctaa

SEQ ID NO: 13861 - DNA, 25 bp, E. coli
gaccaaaatcgaagttacgaacaag

SEQ ID NO: 13862 - DNA, 25 bp, E. coli
gaccaaaatcgatgttacgaacaag

SEQ ID NO: 13863 - DNA, 25 bp, E. coli
cgaatagctcgaagcacgaggaaaa

SEQ ID NO: 13864 - DNA, 25 bp, E. coli
cgaatagctcgatgcacgaggaaaa

SEQ ID NO: 13865 - DNA, 25 bp, E. coli
cgcagagctgatcagcgattcgaat

SEQ ID NO: 13866 - DNA, 25 bp, E. coli
cgcagagctgatgagcgattcgaat

SEQ ID NO: 13867 - DNA, 25 bp, E. coli
gtgattgaccaaaatcgaagttacg

SEQ ID NO: 13868 - DNA, 25 bp, E. coli
gattcgaatagcacgatgcacgagg

SEQ ID NO: 13869 - DNA, 25 bp, E. coli
gattcgaatagctcgatgcacgagg

SEQ ID NO: 13870 - DNA, 25 bp, E. coli
gtgattgaccaatatcgaagttacg

SEQ ID NO: 13871 - DNA, 25 bp, E. coli
catttccatcagatgtccttcctgc

SEQ ID NO: 13872 - DNA, 25 bp, E. coli
atcagatgtccttcctgctccgcta

SEQ ID NO: 13873 - DNA, 25 bp, E. coli
agatgtccttccagctccgctactg

SEQ ID NO: 13874 - DNA, 25 bp, E. coli
agatgtccttcctgctccgctactg

SEQ ID NO: 13875 - DNA, 25 bp, E. coli
atcagatgtcctacctgctccgcta

SEQ ID NO: 13876 - DNA, 25 bp, E. coli
ttcctgctccgctactgaaggcgtg

SEQ ID NO: 13877 - DNA, 25 bp, E. coli
ttcctgctccgcaactgaaggcgtg

SEQ ID NO: 13878 - DNA, 25 bp, E. coli
tgctccgctactcaaggcgtggtgc

SEQ ID NO: 13879 - DNA, 25 bp, E. coli
tgctccgctactgaaggcgtggtgc

SEQ ID NO: 13880 - DNA, 25 bp, E. coli
cctgctccgctagtgaaggcgtggt

SEQ ID NO: 13881 - DNA, 25 bp, E. coli
cctgctccgctactgaaggcgtggt

SEQ ID NO: 13882 - DNA, 25 bp, E. coli
ctccgctactgatggcgtggtgcgt

SEQ ID NO: 13883 - DNA, 25 bp, E. coli
ctctcagcccggtaagcaccagaaa

SEQ ID NO: 13884 - DNA, 25 bp, E. coli
ctctcagcccggaaagcaccagaaa

SEQ ID NO: 13885 - DNA, 25 bp, E. coli
catttccatcagttgtccttcctgc

SEQ ID NO: 13886 - DNA, 25 bp, E. coli
ctccgctactgaaggcgtggtgcgt

SEQ ID NO: 13887 - DNA, 25 bp, E. coli
gtggcttccattaccatcagatgtc

SEQ ID NO: 13888 - DNA, 25 bp, E. coli
tgtccttcctgcaccgctactgaag

SEQ ID NO: 13889 - DNA, 25 bp, E. coli
gtggcttccatttccatcagatgtc

SEQ ID NO: 13890 - DNA, 25 bp, E. coli
tgtccttcctgctccgctactgaag

SEQ ID NO: 13891 - DNA, 25 bp, E. coli
ggcttccatttccatcagatgtcct

SEQ ID NO: 13892 - DNA, 25 bp, E. coli
ggcttccatttcgatcagatgtcct

SEQ ID NO: 13893 - DNA, 25 bp, E. coli
aattttaccgtggtgacctcgatcg

SEQ ID NO: 13894 - DNA, 25 bp, E. coli
aattttaccgtgctgacctcgatcg

SEQ ID NO: 13895 - DNA, 25 bp, E. coli
taccgatgagtgacagcgaatacgc

SEQ ID NO: 13896 - DNA, 25 bp, E. coli
taccgatgagtgtcagcgaatacgc

SEQ ID NO: 13897 - DNA, 25 bp, E. coli
tatcaggtaaaagaggccaaatggc

SEQ ID NO: 13898 - DNA, 25 bp, E. coli
tatcaggtaaaacaggccaaatggc

SEQ ID NO: 13899 - DNA, 25 bp, E. coli
ttttacaccgcatacgaaactggcg

SEQ ID NO: 13900 - DNA, 25 bp, E. coli
tttaatcagcaaggtcgcccgtgtg

SEQ ID NO: 13901 - DNA, 25 bp, E. coli
ttttacaccgcaaacgaaactggcg

SEQ ID NO: 13902 - DNA, 25 bp, E. coli
ttaaccctgcctaatgatgccgagc

SEQ ID NO: 13903 - DNA, 25 bp, E. coli
ttaaccctgccttatgatgccgagc

SEQ ID NO: 13904 - DNA, 25 bp, E. coli
tttaatcagcaacgtcgcccgtgtg

SEQ ID NO: 13905 - DNA, 25 bp, E. coli
gatttacaaggctatggtcacacgc

SEQ ID NO: 13906 - DNA, 25 bp, E. coli
gattaaccgctaaggaccgtgccgg

SEQ ID NO: 13907 - DNA, 25 bp, E. coli
gatttacaaggcaatggtcacacgc

SEQ ID NO: 13908 - DNA, 25 bp, E. coli
gtttggcaagtttagctaccccgca

SEQ ID NO: 13909 - DNA, 25 bp, E. coli
gattaaccgctatggaccgtgccgg

SEQ ID NO: 13910 - DNA, 25 bp, E. coli
gtcattaaacctgtcgccggacgta

SEQ ID NO: 13911 - DNA, 25 bp, E. coli
gtcattaaacctctcgccggacgta

SEQ ID NO: 13912 - DNA, 25 bp, E. coli
gtttggcaagttaagctaccccgca

SEQ ID NO: 13913 - DNA, 25 bp, E. coli
taacccgcaaacgaaagatctggcg

SEQ ID NO: 13914 - DNA, 25 bp, E. coli
taacccgcaaaccaaagatctggcg

SEQ ID NO: 13915 - DNA, 25 bp, E. coli
attatcagtgacattcgcggcgcgg

SEQ ID NO: 13916 - DNA, 25 bp, E. coli
aggacgttacgcgattttgaggaca

SEQ ID NO: 13917 - DNA, 25 bp, E. coli
attatcagtgactttcgcggcgcgg

SEQ ID NO: 13918 - DNA, 25 bp, E. coli
aggacgttacgccattttgaggaca

SEQ ID NO: 13919 - DNA, 25 bp, E. coli
atgaacgcggcgcattatcagtgac

SEQ ID NO: 13920 - DNA, 25 bp, E. coli
atgaacgcggcggattatcagtgac

SEQ ID NO: 13921 - DNA, 25 bp, E. coli
tagtaatattgaagctggtgcgacc

SEQ ID NO: 13922 - DNA, 25 bp, E. coli
tagtaatattgatgctggtgcgacc

SEQ ID NO: 13923 - DNA, 25 bp, E. coli
ttatataattcaggcaaatacttcc

SEQ ID NO: 13924 - DNA, 25 bp, E. coli
ttatataattcacgcaaatacttcc

SEQ ID NO: 13925 - DNA, 25 bp, E. coli
tggtgcgaccacagaggaatcttta

SEQ ID NO: 13926 - DNA, 25 bp, E. coli
tcacgcccgttttttctaagaggag

SEQ ID NO: 13927 - DNA, 25 bp, E. coli
tcacgcccgtttattctaagaggag

SEQ ID NO: 13928 - DNA, 25 bp, E. coli
gcccgttttttctaagaggagcgca

SEQ ID NO: 13929 - DNA, 25 bp, E. coli
gcccgttttttcaaagaggagcgca

SEQ ID NO: 13930 - DNA, 25 bp, E. coli
cccctgtatggatttcactcaaaaa

SEQ ID NO: 13931 - DNA, 25 bp, E. coli
cccctgtatggaattcactcaaaaa

SEQ ID NO: 13932 - DNA, 25 bp, E. coli
cattttgaggacttgaacgcggcgc

SEQ ID NO: 13933 - DNA, 25 bp, E. coli
cattttgaggacatgaacgcggcgc

SEQ ID NO: 13934 - DNA, 25 bp, E. coli
tggtgcgaccactgaggaatcttta

SEQ ID NO: 13935 - DNA, 25 bp, E. coli
gaggaatctttagaattcacgcccg

SEQ ID NO: 13936 - DNA, 25 bp, E. coli
gaggaatctttacaattcacgcccg

SEQ ID NO: 13937 - DNA, 25 bp, E. coli
caccgtcagtgccaatgcgatggca

SEQ ID NO: 13938 - DNA, 25 bp, E. coli
caccgtcagtgcgaatgcgatggca

SEQ ID NO: 13939 - DNA, 25 bp, E. coli
agtttaatgttcttgccagccagcc

SEQ ID NO: 13940 - DNA, 25 bp, E. coli
agtttaatgttcatgccagccagcc

SEQ ID NO: 13941 - DNA, 25 bp, E. coli
aaaattctgctgattaacccgaccg

SEQ ID NO: 13942 - DNA, 25 bp, E. coli
aaaattctgctgtttaacccgaccg

SEQ ID NO: 13943 - DNA, 25 bp, E. coli
tatcgctgaaagatggcgcgcagaa

SEQ ID NO: 13944 - DNA, 25 bp, E. coli
tataacctggtggtgctggactccc

SEQ ID NO: 13945 - DNA, 25 bp, E. coli
tataacctggtgctgctggactccc

SEQ ID NO: 13946 - DNA, 25 bp, E. coli
tatcgctgaaagttggcgcgcagaa

SEQ ID NO: 13947 - DNA, 25 bp, E. coli
ccaaagttatcgagctgcaaggcat

SEQ ID NO: 13948 - DNA, 25 bp, E. coli
ccaaagttatcgtgctgcaaggcat

SEQ ID NO: 13949 - DNA, 25 bp, E. coli
gaatgatggcaaactagcagcgact

SEQ ID NO: 13950 - DNA, 25 bp, E. coli
gaatgatggcaatctagcagcgact

SEQ ID NO: 13951 - DNA, 25 bp, E. coli
gaacatgaaaaatctggctaccctg

SEQ ID NO: 13952 - DNA, 25 bp, E. coli
gaacatgaaaaaactggctaccctg

SEQ ID NO: 13953 - DNA, 25 bp, E. coli
gacggtacaccggatggcgaaaaag

SEQ ID NO: 13954 - DNA, 25 bp, E. coli
cgtgcaggactttaccgttcgcggc

SEQ ID NO: 13955 - DNA, 25 bp, E. coli
cgtgcaggacttaaccgttcgcggc

SEQ ID NO: 13956 - DNA, 25 bp, E. coli
ggttatcactctagaccgccaggca

SEQ ID NO: 13957 - DNA, 25 bp, E. coli
ggttatcactcttgaccgccaggca

SEQ ID NO: 13958 - DNA, 25 bp, E. coli
gacggtacaccgcatggcgaaaaag

SEQ ID NO: 13959 - DNA, 25 bp, E. coli
cacagcgtgacgatgatcgcgcaga

SEQ ID NO: 13960 - DNA, 25 bp, E. coli
cacagcgtgacgttgatcgcgcaga

SEQ ID NO: 13961 - DNA, 25 bp, E. coli
caaactatcacagcgtgacgttgat

SEQ ID NO: 13962 - DNA, 25 bp, E. coli
cagcgtgacgttgatcgcgcagaaa

SEQ ID NO: 13963 - DNA, 25 bp, E. coli
caaactatcacaccgtgacgttgat

SEQ ID NO: 13964 - DNA, 25 bp, E. coli
cagcgtgacgttcatcgcgcagaaa

SEQ ID NO: 13965 - DNA, 25 bp, E. coli
agtatgcgcttgatggactcaccaa

SEQ ID NO: 13966 - DNA, 25 bp, E. coli
agtatgcgcttgttggactcaccaa

SEQ ID NO: 13967 - DNA, 25 bp, E. coli
tatcacagcgtgtcgttgatcgcgc

SEQ ID NO: 13968 - DNA, 25 bp, E. coli
tatcacagcgtgacgttgatcgcgc

SEQ ID NO: 13969 - DNA, 25 bp, E. coli
tgcgcttgatggactcaccaataaa

SEQ ID NO: 13970 - DNA, 25 bp, E. coli
tgcgcttgatggtctcaccaataaa

SEQ ID NO: 13971 - DNA, 25 bp, E. coli
gcttgatggactcaccaataaaaaa

SEQ ID NO: 13972 - DNA, 25 bp, E. coli
gcttgatggactgaccaataaaaaa

SEQ ID NO: 13973 - DNA, 25 bp, E. coli
cgcgcagaaacacatttacttatca

SEQ ID NO: 13974 - DNA, 25 bp, E. coli
cgcgcagaaacagatttacttatca

SEQ ID NO: 13975 - DNA, 25 bp, E. coli
gatttacttatcaatctgtcagcta

SEQ ID NO: 13976 - DNA, 25 bp, E. coli
gatttacttatctatctgtcagcta

SEQ ID NO: 13977 - DNA, 25 bp, E. coli
gatcgcgcagaatcagatttactta

SEQ ID NO: 13978 - DNA, 25 bp, E. coli
ttatcaatctgtgagctattaccca

SEQ ID NO: 13979 - DNA, 25 bp, E. coli
ttatcaatctgtcagctattaccca

SEQ ID NO: 13980 - DNA, 25 bp, E. coli
gatcgcgcagaaacagatttactta

SEQ ID NO: 13981 - DNA, 25 bp, E. coli
aataccgctattatcttgccatcag

SEQ ID NO: 13982 - DNA, 25 bp, E. coli
aataccgctattttcttgccatcag

SEQ ID NO: 13983 - DNA, 25 bp, E. coli
aaccgttcctttccaataccgctat

SEQ ID NO: 13984 - DNA, 25 bp, E. coli
cagcggcagtttcatactatggcgg

SEQ ID NO: 13985 - DNA, 25 bp, E. coli
cagcggcagtttgatactatggcgg

SEQ ID NO: 13986 - DNA, 25 bp, E. coli
aaccgttcctttgcaataccgctat

SEQ ID NO: 13987 - DNA, 25 bp, E. coli
tatcaaaaagtgcttaaggcaccgg

SEQ ID NO: 13988 - DNA, 25 bp, E. coli
tatcaaaaagtggttaaggcaccgg

SEQ ID NO: 13989 - DNA, 25 bp, E. coli
tagaatgagtagatccttaacggaa

SEQ ID NO: 13990 - DNA, 25 bp, E. coli
tagaatgagtagttccttaacggaa

SEQ ID NO: 13991 - DNA, 25 bp, E. coli
tatagggagcgttagagaacgaatg

SEQ ID NO: 13992 - DNA, 25 bp, E. coli
tttgcatggtatataaggactcact

SEQ ID NO: 13993 - DNA, 25 bp, E. coli
tatagggagcgtaagagaacgaatg

SEQ ID NO: 13994 - DNA, 25 bp, E. coli
tttgcatggtatttaaggactcact

SEQ ID NO: 13995 - DNA, 25 bp, E. coli
tgaaattgttttagcgcagcggcag

SEQ ID NO: 13996 - DNA, 25 bp, E. coli
tgaaattgtttttgcgcagcggcag

SEQ ID NO: 13997 - DNA, 25 bp, E. coli
tcgggcgtttagcaagatttgaaat

SEQ ID NO: 13998 - DNA, 25 bp, E. coli
tcgggcgtttaggaagatttgaaat

SEQ ID NO: 13999 - DNA, 25 bp, E. coli
tcagatgtttcgtctatagggagcg

SEQ ID NO: 14000 - DNA, 25 bp, E. coli
tcagatgtttcgactatagggagcg

SEQ ID NO: 14001 - DNA, 25 bp, E. coli
taacggaataaccatttggcaaagc

SEQ ID NO: 14002 - DNA, 25 bp, E. coli
taacggaataacgatttggcaaagc

SEQ ID NO: 14003 - DNA, 25 bp, E. coli
caacgcgtatggacgctgcgcagct

SEQ ID NO: 14004 - DNA, 25 bp, E. coli
caacgcgtatggtcgctgcgcagct

SEQ ID NO: 14005 - DNA, 25 bp, E. coli
caggcgcgtgtagcagacggtgcga

SEQ ID NO: 14006 - DNA, 25 bp, E. coli
caggcgcgtgtaccagacggtgcga

SEQ ID NO: 14007 - DNA, 25 bp, E. coli
accgccaacgcgtatggacgctgcg

SEQ ID NO: 14008 - DNA, 25 bp, E. coli
acgctgcgcagctgaccgaagaagg

SEQ ID NO: 14009 - DNA, 25 bp, E. coli
acgctgcgcagcagaccgaagaagg

SEQ ID NO: 14010 - DNA, 25 bp, E. coli
accgccaacgcgaatggacgctgcg

SEQ ID NO: 14011 - DNA, 25 bp, E. coli
tgtagcagacggagcgacggtggtt

SEQ ID NO: 14012 - DNA, 25 bp, E. coli
tgtagcagacggtgcgacggtggtt

SEQ ID NO: 14013 - DNA, 25 bp, E. coli
tcagtacaccgataaagcggacggg

SEQ ID NO: 14014 - DNA, 25 bp, E. coli
tctcagtacaccgaaaaagcggacg

SEQ ID NO: 14015 - DNA, 25 bp, E. coli
tctcagtacacccaaaaagcggacg

SEQ ID NO: 14016 - DNA, 25 bp, E. coli
tcagtacaccgaaaaagcggacggg

SEQ ID NO: 14017 - DNA, 25 bp, E. coli
gcgtatggacgctgcgcagctgacc

SEQ ID NO: 14018 - DNA, 25 bp, E. coli
gcgtatggacgcagcgcagctgacc

SEQ ID NO: 14019 - DNA, 25 bp, E. coli
cgaggagaaccgtcgtgctagaaga

SEQ ID NO: 14020 - DNA, 25 bp, E. coli
cgaggagaaccgacgtgctagaaga

SEQ ID NO: 14021 - DNA, 25 bp, E. coli
ggcatttgagctgacagatgcgtct

SEQ ID NO: 14022 - DNA, 25 bp, E. coli
ggcatttgagctcacagatgcgtct

SEQ ID NO: 14023 - DNA, 25 bp, E. coli
gagaaccgtcgtgctagaagaatac

SEQ ID NO: 14024 - DNA, 25 bp, E. coli
gagaaccgtcgtcctagaagaatac

SEQ ID NO: 14025 - DNA, 25 bp, E. coli
caagtaccgttatccggaagatcag

SEQ ID NO: 14026 - DNA, 25 bp, E. coli
caagtaccgttaaccggaagatcag

SEQ ID NO: 14027 - DNA, 25 bp, E. coli
taaagactttaaagcgaccgatccg

SEQ ID NO: 14028 - DNA, 25 bp, E. coli
tacgcatatcaagtacaagtaccgt

SEQ ID NO: 14029 - DNA, 25 bp, E. coli
taaagactttaatgcgaccgatccg

SEQ ID NO: 14030 - DNA, 25 bp, E. coli
agcgaccgatccgaacggtttcctg

SEQ ID NO: 14031 - DNA, 25 bp, E. coli
agcgaccgatcccaacggtttcctg

SEQ ID NO: 14032 - DNA, 25 bp, E. coli
tatccggaagatcagggcaaatttg

SEQ ID NO: 14033 - DNA, 25 bp, E. coli
tatccggaagatgagggcaaatttg

SEQ ID NO: 14034 - DNA, 25 bp, E. coli
tacgcatatcaactacaagtaccgt

SEQ ID NO: 14035 - DNA, 25 bp, E. coli
tgattatgacaaagctaacctgtac

SEQ ID NO: 14036 - DNA, 25 bp, E. coli
tgattatgacaatgctaacctgtac

SEQ ID NO: 14037 - DNA, 25 bp, E. coli
tgctaacctgtacaacgatcacgtg

SEQ ID NO: 14038 - DNA, 25 bp, E. coli
tgctaacctgtagaacgatcacgtg

SEQ ID NO: 14039 - DNA, 25 bp, E. coli
gggcaaatttgagggtaatacagag

SEQ ID NO: 14040 - DNA, 25 bp, E. coli
gggcaaatttgacggtaatacagag

SEQ ID NO: 14041 - DNA, 25 bp, E. coli
gacaggttcttagtatgcattccac

SEQ ID NO: 14042 - DNA, 25 bp, E. coli
gacaggttcttactatgcattccac

SEQ ID NO: 14043 - DNA, 25 bp, E. coli
taatacagagcaagttccaccggga

SEQ ID NO: 14044 - DNA, 25 bp, E. coli
taattggcgaatggacccagcgtgg

SEQ ID NO: 14045 - DNA, 25 bp, E. coli
taatacagagcatgttccaccggga

SEQ ID NO: 14046 - DNA, 25 bp, E. coli
taattggcgaatcgacccagcgtgg

SEQ ID NO: 14047 - DNA, 25 bp, E. coli
caactacgagcggagaaagtcaacg

SEQ ID NO: 14048 - DNA, 25 bp, E. coli
caactacgagcgcagaaagtcaacg

SEQ ID NO: 14049 - DNA, 25 bp, E. coli
cagaatcactgaatgcggctaatcc

SEQ ID NO: 14050 - DNA, 25 bp, E. coli
cagaatcactgattgcggctaatcc

SEQ ID NO: 14051 - DNA, 25 bp, E. coli
tacaaaagctactgtgcagaatcac

SEQ ID NO: 14052 - DNA, 25 bp, E. coli
tacgagcgcagaaagtcaacgtcgt

SEQ ID NO: 14053 - DNA, 25 bp, E. coli
tacaaaagctacagtgcagaatcac

SEQ ID NO: 14054 - DNA, 25 bp, E. coli
tacgagcgcagatagtcaacgtcgt

SEQ ID NO: 14055 - DNA, 25 bp, E. coli
actgattgcggctaatccagaagtg

SEQ ID NO: 14056 - DNA, 25 bp, E. coli
actgattgcggcaaatccagaagtg

SEQ ID NO: 14057 - DNA, 25 bp, E. coli
tacctggcaggatgccgggccacaa

SEQ ID NO: 14058 - DNA, 25 bp, E. coli
tacctggcaggaagccgggccacaa

SEQ ID NO: 14059 - DNA, 25 bp, E. coli
tgtgctcgaccatctacgagcgcag

SEQ ID NO: 14060 - DNA, 25 bp, E. coli
tgtgctcgaccaactacgagcgcag

SEQ ID NO: 14061 - DNA, 25 bp, E. coli
tccagaagtgattgtcgtaacctca

SEQ ID NO: 14062 - DNA, 25 bp, E. coli
tccagaagtgatagtcgtaacctca

SEQ ID NO: 14063 - DNA, 25 bp, E. coli
tctgccgcgaagtccgcagtaaaac

SEQ ID NO: 14064 - DNA, 25 bp, E. coli
tctgccgcgaagaccgcagtaaaac

SEQ ID NO: 14065 - DNA, 25 bp, E. coli
gtgcctgccacccttcagcagatgt

SEQ ID NO: 14066 - DNA, 25 bp, E. coli
gtgcctgccaccgttcagcagatgt

SEQ ID NO: 14067 - DNA, 25 bp, E. coli
gatgccgggccacaaattgtgctcg

SEQ ID NO: 14068 - DNA, 25 bp, E. coli
gatgccgggccagaaattgtgctcg

SEQ ID NO: 14069 - DNA, 25 bp, E. coli
catcgagatggttcaccggaagacc

SEQ ID NO: 14070 - DNA, 25 bp, E. coli
catcgagatggtacaccggaagacc

SEQ ID NO: 14071 - DNA, 25 bp, E. coli
atcgagatggtacaccggaagacct

SEQ ID NO: 14072 - DNA, 25 bp, E. coli
atgctgcatcgagatggtacaccgg

SEQ ID NO: 14073 - DNA, 25 bp, E. coli
atcgagatggtagaccggaagacct

SEQ ID NO: 14074 - DNA, 25 bp, E. coli
atgctgcatcgacatggtacaccgg

SEQ ID NO: 14075 - DNA, 25 bp, E. coli
tatgctgcatcgagatggtacaccg

SEQ ID NO: 14076 - DNA, 25 bp, E. coli
tatgctgcatcgtgatggtacaccg

SEQ ID NO: 14077 - DNA, 25 bp, E. coli
tgcatcgagatgctacaccggaaga

SEQ ID NO: 14078 - DNA, 25 bp, E. coli
tgcatcgagatggtacaccggaaga

SEQ ID NO: 14079 - DNA, 25 bp, E. coli
tcgagatggtacaccggaagacctt

SEQ ID NO: 14080 - DNA, 25 bp, E. coli
tcgagatggtactccggaagacctt

SEQ ID NO: 14081 - DNA, 25 bp, E. coli
tgctgcatcgagatggtacaccgga

SEQ ID NO: 14082 - DNA, 25 bp, E. coli
tgctgcatcgagttggtacaccgga

SEQ ID NO: 14083 - DNA, 25 bp, E. coli
gctgcatcgagaaggtacaccggaa

SEQ ID NO: 14084 - DNA, 25 bp, E. coli
gctgcatcgagatggtacaccggaa

SEQ ID NO: 14085 - DNA, 25 bp, E. coli
gcatcgagatggtacaccggaagac

SEQ ID NO: 14086 - DNA, 25 bp, E. coli
gcatcgagatggaacaccggaagac

SEQ ID NO: 14087 - DNA, 25 bp, E. coli
ctgcatcgagatcgtacaccggaag

SEQ ID NO: 14088 - DNA, 25 bp, E. coli
ctgcatcgagatggtacaccggaag

SEQ ID NO: 14089 - DNA, 25 bp, E. coli
caaaaaaggttgtatggcgaggcgc

SEQ ID NO: 14090 - DNA, 25 bp, E. coli
caaaaaaggttgaatggcgaggcgc

SEQ ID NO: 14091 - DNA, 25 bp, E. coli
catgatgttcccgattacgctagcg

SEQ ID NO: 14092 - DNA, 25 bp, E. coli
catgatgttccccattacgctagcg

SEQ ID NO: 14093 - DNA, 25 bp, E. coli
tatgtcaaacctttcggtggcggct

SEQ ID NO: 14094 - DNA, 25 bp, E. coli
tatgtcaaacctatcggtggcggct

SEQ ID NO: 14095 - DNA, 25 bp, E. coli
tattcgttgggcgtcaccaattccg

SEQ ID NO: 14096 - DNA, 25 bp, E. coli
tattcgttgggcctcaccaattccg

SEQ ID NO: 14097 - DNA, 25 bp, E. coli
tgggctttaaagtcggcaccgccaa

SEQ ID NO: 14098 - DNA, 25 bp, E. coli
tgctgcatgagcttgatgttcccga

SEQ ID NO: 14099 - DNA, 25 bp, E. coli
tgctgcatgagcatgatgttcccga

SEQ ID NO: 14100 - DNA, 25 bp, E. coli
gaaagagcagcacacgatatttggt

SEQ ID NO: 14101 - DNA, 25 bp, E. coli
gaaagagcagcagacgatatttggt

SEQ ID NO: 14102 - DNA, 25 bp, E. coli
ccgattacgctagcgatccggaagg

SEQ ID NO: 14103 - DNA, 25 bp, E. coli
ccgattacgctaccgatccggaagg

SEQ ID NO: 14104 - DNA, 25 bp, E. coli
cgccgataaatttgctgggctttaa

SEQ ID NO: 14105 - DNA, 25 bp, E. coli
cgccgataaattagctgggctttaa

SEQ ID NO: 14106 - DNA, 25 bp, E. coli
ggctatttctttgcgctgccgggtg

SEQ ID NO: 14107 - DNA, 25 bp, E. coli
ggctatttctttccgctgccgggtg

SEQ ID NO: 14108 - DNA, 25 bp, E. coli
tgggctttaaagacggcaccgccaa

SEQ ID NO: 14109 - DNA, 25 bp, E. coli
gaggcgctggagcaatatgtcaaac

SEQ ID NO: 14110 - DNA, 25 bp, E. coli
gaggcgctggaggaatatgtcaaac

SEQ ID NO: 14111 - DNA, 25 bp, E. coli
aaagccgcctgtgggtaccggtgat

SEQ ID NO: 14112 - DNA, 25 bp, E. coli
aaagccgcctgtcggtaccggtgat

SEQ ID NO: 14113 - DNA, 25 bp, E. coli
agtcggcgaagagtcccattccagg

SEQ ID NO: 14114 - DNA, 25 bp, E. coli
agtcggcgaagactcccattccagg

SEQ ID NO: 14115 - DNA, 25 bp, E. coli
aaaaaactggccagcgaacgctgcg

SEQ ID NO: 14116 - DNA, 25 bp, E. coli
aaaaaactggcctgcgaacgctgcg

SEQ ID NO: 14117 - DNA, 25 bp, E. coli
tattattgctctacgactggccggg

SEQ ID NO: 14118 - DNA, 25 bp, E. coli
tattattgctcttcgactggccggg

SEQ ID NO: 14119 - DNA, 25 bp, E. coli
ccattccaggctagctgacagcaca

SEQ ID NO: 14120 - DNA, 25 bp, E. coli
gccgcattacgtgagggattagaga

SEQ ID NO: 14121 - DNA, 25 bp, E. coli
ccattccaggcttgctgacagcaca

SEQ ID NO: 14122 - DNA, 25 bp, E. coli
gccgcattacgtcagggattagaga

SEQ ID NO: 14123 - DNA, 25 bp, E. coli
gaaaatgtctctggcggcactctct

SEQ ID NO: 14124 - DNA, 25 bp, E. coli
gaaaatgtctctcgcggcactctct

SEQ ID NO: 14125 - DNA, 25 bp, E. coli
gattctgataaaaccgagtggctac

SEQ ID NO: 14126 - DNA, 25 bp, E. coli
gtattttacgccagcaactgccgcc

SEQ ID NO: 14127 - DNA, 25 bp, E. coli
gtattttacgcctgcaactgccgcc

SEQ ID NO: 14128 - DNA, 25 bp, E. coli
gattctgataaatccgagtggctac

SEQ ID NO: 14129 - DNA, 25 bp, E. coli
ggtggcctacatccgcaaaaaactg

SEQ ID NO: 14130 - DNA, 25 bp, E. coli
ggtggcctacatgcgcaaaaaactg

SEQ ID NO: 14131 - DNA, 25 bp, E. coli
gagacctgtcagattgtattattgc

SEQ ID NO: 14132 - DNA, 25 bp, E. coli
gagacctgtcagtttgtattattgc

SEQ ID NO: 14133 - DNA, 25 bp, E. coli
tacttcgggtgccatatctttggga

SEQ ID NO: 14134 - DNA, 25 bp, E. coli
tacttcgggtgcgatatctttggga

SEQ ID NO: 14135 - DNA, 25 bp, E. coli
taacaatgcagcgaaactacttcgg

SEQ ID NO: 14136 - DNA, 25 bp, E. coli
taacaatgcagccaaactacttcgg

SEQ ID NO: 14137 - DNA, 25 bp, E. coli
taccctgaagtaagaaaaattgaag

SEQ ID NO: 14138 - DNA, 25 bp, E. coli
ttaattagcggtgcgttagacctac

SEQ ID NO: 14139 - DNA, 25 bp, E. coli
ttaattagcggtccgttagacctac

SEQ ID NO: 14140 - DNA, 25 bp, E. coli
taccctgaagtatgaaaaattgaag

SEQ ID NO: 14141 - DNA, 25 bp, E. coli
tgtcccacctataaaagatcatgag

SEQ ID NO: 14142 - DNA, 25 bp, E. coli
tgtcccacctattaaagatcatgag

SEQ ID NO: 14143 - DNA, 25 bp, E. coli
tgctttgacagtaaagcccagaact

SEQ ID NO: 14144 - DNA, 25 bp, E. coli
tgagcaatctattttaccctgaagt

SEQ ID NO: 14145 - DNA, 25 bp, E. coli
tgagcaatctatattaccctgaagt

SEQ ID NO: 14146 - DNA, 25 bp, E. coli
tgctttgacagttaagcccagaact

SEQ ID NO: 14147 - DNA, 25 bp, E. coli
tcaagtcggaaaaatcccggacgat

SEQ ID NO: 14148 - DNA, 25 bp, E. coli
tcaagtcggaaatatcccggacgat

SEQ ID NO: 14149 - DNA, 25 bp, E. coli
gcccagaactgatagtcaagtcgga

SEQ ID NO: 14150 - DNA, 25 bp, E. coli
gcccagaactgaaagtcaagtcgga

SEQ ID NO: 14151 - DNA, 25 bp, E. coli
ccgttatcacggtgagctggagtca

SEQ ID NO: 14152 - DNA, 25 bp, E. coli
ccgttatcacggagagctggagtca

SEQ ID NO: 14153 - DNA, 25 bp, E. coli
ggtatattacctagtgcttttgcga

SEQ ID NO: 14154 - DNA, 25 bp, E. coli
ggtatattaccttgtgcttttgcga

SEQ ID NO: 14155 - DNA, 25 bp, E. coli
tagtccacagatatggccttaagga

SEQ ID NO: 14156 - DNA, 25 bp, E. coli
taaaaaatcatgtaaaaccgctcgc

SEQ ID NO: 14157 - DNA, 25 bp, E. coli
tagtccacagatttggccttaagga

SEQ ID NO: 14158 - DNA, 25 bp, E. coli
taaaaaatcatgaaaaaccgctcgc

SEQ ID NO: 14159 - DNA, 25 bp, E. coli
tgtactttaattcaccaaccccgct

SEQ ID NO: 14160 - DNA, 25 bp, E. coli
tgtactttaattgaccaaccccgct

SEQ ID NO: 14161 - DNA, 25 bp, E. coli
tatttgtcgttatggacttcaaggg

SEQ ID NO: 14162 - DNA, 25 bp, E. coli
tatttgtcgttaaggacttcaaggg

SEQ ID NO: 14163 - DNA, 25 bp, E. coli
ttgcctcggcggtagattatcctca

SEQ ID NO: 14164 - DNA, 25 bp, E. coli
ttgcctcggcggaagattatcctca

SEQ ID NO: 14165 - DNA, 25 bp, E. coli
gccaagaccgcagcaatcgggtaat

SEQ ID NO: 14166 - DNA, 25 bp, E. coli
gccaagaccgcaccaatcgggtaat

SEQ ID NO: 14167 - DNA, 25 bp, E. coli
gaatggattgcatgcgtttcactca

SEQ ID NO: 14168 - DNA, 25 bp, E. coli
gaatggattgcaagcgtttcactca

SEQ ID NO: 14169 - DNA, 25 bp, E. coli
gaattgtttcaagatgcccaggtaa

SEQ ID NO: 14170 - DNA, 25 bp, E. coli
gaattgtttcaacatgcccaggtaa

SEQ ID NO: 14171 - DNA, 25 bp, E. coli
gataatcctgatcatgcgcaccgtg

SEQ ID NO: 14172 - DNA, 25 bp, E. coli
gataatcctgatgatgcgcaccgtg

SEQ ID NO: 14173 - DNA, 25 bp, E. coli
gtaattagtctcgtgtcgcttggca

SEQ ID NO: 14174 - DNA, 25 bp, E. coli
gtaattagtctcctgtcgcttggca

SEQ ID NO: 14175 - DNA, 25 bp, E. coli
taatctcgaactcgttttgcctcgg

SEQ ID NO: 14176 - DNA, 25 bp, E. coli
taatctcgaactggttttgcctcgg

SEQ ID NO: 14177 - DNA, 25 bp, E. coli
taaaattccactccggatgatggtg

SEQ ID NO: 14178 - DNA, 25 bp, E. coli
taaaattccactgcggatgatggtg

SEQ ID NO: 14179 - DNA, 25 bp, E. coli
aaaatgagctgtatgccgttgccga

SEQ ID NO: 14180 - DNA, 25 bp, E. coli
aaaatgagctgtttgccgttgccga

SEQ ID NO: 14181 - DNA, 25 bp, E. coli
tagcgtcagccatcatgcgggtgtt

SEQ ID NO: 14182 - DNA, 25 bp, E. coli
tagcgtcagccaacatgcgggtgtt

SEQ ID NO: 14183 - DNA, 25 bp, E. coli
tcaggtacagctggacaatttgcgt

SEQ ID NO: 14184 - DNA, 25 bp, E. coli
tcaggtacagctcgacaatttgcgt

SEQ ID NO: 14185 - DNA, 25 bp, E. coli
gccagatcgattacattacgcaggt

SEQ ID NO: 14186 - DNA, 25 bp, E. coli
gccagatcgatttcattacgcaggt

SEQ ID NO: 14187 - DNA, 25 bp, E. coli
gctgtacagtagttcggcgtatcgg

SEQ ID NO: 14188 - DNA, 25 bp, E. coli
gcaggttctgcacaaattcgcggct

SEQ ID NO: 14189 - DNA, 25 bp, E. coli
gctgaatttatgctcgacggtgtcg

SEQ ID NO: 14190 - DNA, 25 bp, E. coli
gctgaatttatggtcgacggtgtcg

SEQ ID NO: 14191 - DNA, 25 bp, E. coli
gctgtacagtagatcggcgtatcgg

SEQ ID NO: 14192 - DNA, 25 bp, E. coli
gcatcgttactgaacagcaccgcgt

SEQ ID NO: 14193 - DNA, 25 bp, E. coli
gcaggttctgcagaaattcgcggct

SEQ ID NO: 14194 - DNA, 25 bp, E. coli
gcatcgttactgtacagcaccgcgt

SEQ ID NO: 14195 - DNA, 25 bp, E. coli
cgttgaacagatcctcgtcgcagta

SEQ ID NO: 14196 - DNA, 25 bp, E. coli
cgttgaacagatgctcgtcgcagta

SEQ ID NO: 14197 - DNA, 25 bp, E. coli
gtaagtcatcatgctgtccggccag

SEQ ID NO: 14198 - DNA, 25 bp, E. coli
gtaagtcatcatcctgtccggccag

SEQ ID NO: 14199 - DNA, 25 bp, E. coli
catgggcctgcgtaaagaagataac

SEQ ID NO: 14200 - DNA, 25 bp, E. coli
catgggcctgcgaaaagaagataac

SEQ ID NO: 14201 - DNA, 25 bp, E. coli
taaagattacaaattcggtggcccg

SEQ ID NO: 14202 - DNA, 25 bp, E. coli
taaagattacaatttcggtggcccg

SEQ ID NO: 14203 - DNA, 25 bp, E. coli
aacaaagcctttgccgaaatgcgcg

SEQ ID NO: 14204 - DNA, 25 bp, E. coli
aaactggtgctatcgctctctctgg

SEQ ID NO: 14205 - DNA, 25 bp, E. coli
aacaaagcctttcccgaaatgcgcg

SEQ ID NO: 14206 - DNA, 25 bp, E. coli
aaatgcgcgctgacggtacttacga

SEQ ID NO: 14207 - DNA, 25 bp, E. coli
aaactggtgctaacgctctctctgg

SEQ ID NO: 14208 - DNA, 25 bp, E. coli
aactgtttggcgaagggaccggcat

SEQ ID NO: 14209 - DNA, 25 bp, E. coli
aaatgcgcgctgtcggtacttacga

SEQ ID NO: 14210 - DNA, 25 bp, E. coli
aactgtttggcgtagggaccggcat

SEQ ID NO: 14211 - DNA, 25 bp, E. coli
tattgatgccgcgttccaggatgag

SEQ ID NO: 14212 - DNA, 25 bp, E. coli
tattgatgccgccttccaggatgag

SEQ ID NO: 14213 - DNA, 25 bp, E. coli
gaaatagccttcaccgacaaactgt

SEQ ID NO: 14214 - DNA, 25 bp, E. coli
gaaatagccttctccgacaaactgt

SEQ ID NO: 14215 - DNA, 25 bp, E. coli
cggtggcccgtctgttaaagatgaa

SEQ ID NO: 14216 - DNA, 25 bp, E. coli
cggtggcccgtcagttaaagatgaa

SEQ ID NO: 14217 - DNA, 25 bp, E. coli
tccattacggaaaaacgtcagcaag

SEQ ID NO: 14218 - DNA, 25 bp, E. coli
tccattacggaataacgtcagcaag

SEQ ID NO: 14219 - DNA, 25 bp, E. coli
gattccgcaaaacatccgcatcggt

SEQ ID NO: 14220 - DNA, 25 bp, E. coli
gattccgcaaaagatccgcatcggt

SEQ ID NO: 14221 - DNA, 25 bp, E. coli
caccgaaaatctcgcaaacgctggg

SEQ ID NO: 14222 - DNA, 25 bp, E. coli
caaatcgtcaccgttgcgatgggat

SEQ ID NO: 14223 - DNA, 25 bp, E. coli
caccgaaaatctggcaaacgctggg

SEQ ID NO: 14224 - DNA, 25 bp, E. coli
caaatcgtcacccttgcgatgggat

SEQ ID NO: 14225 - DNA, 25 bp, E. coli
catccagatgcggtgtatatgggcg

SEQ ID NO: 14226 - DNA, 25 bp, E. coli
catccagatgcgctgtatatgggcg

SEQ ID NO: 14227 - DNA, 25 bp, E. coli
tttcgcagccgagccgcattaagcg

SEQ ID NO: 14228 - DNA, 25 bp, E. coli
tattttaaacccgagcagcgtcagg

SEQ ID NO: 14229 - DNA, 25 bp, E. coli
tattttaaaccccagcagcgtcagg

SEQ ID NO: 14230 - DNA, 25 bp, E. coli
tttcgcagccgacccgcattaagcg

SEQ ID NO: 14231 - DNA, 25 bp, E. coli
tatacgctgcgtcgcttacagttga

SEQ ID NO: 14232 - DNA, 25 bp, E. coli
tatacgctgcgtggcttacagttga

SEQ ID NO: 14233 - DNA, 25 bp, E. coli
tttcaccggtcaggtaaaacgcgca

SEQ ID NO: 14234 - DNA, 25 bp, E. coli
tttcaccggtcacgtaaaacgcgca

SEQ ID NO: 14235 - DNA, 25 bp, E. coli
tgtttgaacgcattcatgccagcgg

SEQ ID NO: 14236 - DNA, 25 bp, E. coli
tgtttgaacgcaatcatgccagcgg

SEQ ID NO: 14237 - DNA, 25 bp, E. coli
tgaagctaaactccgcaaccagtgg

SEQ ID NO: 14238 - DNA, 25 bp, E. coli
tgaagctaaactgcgcaaccagtgg

SEQ ID NO: 14239 - DNA, 25 bp, E. coli
gaagtgctggcggaaactgaagcta

SEQ ID NO: 14240 - DNA, 25 bp, E. coli
gaagtgctggcgcaaactgaagcta

SEQ ID NO: 14241 - DNA, 25 bp, E. coli
cttaagcagggatcgctggttgcca

SEQ ID NO: 14242 - DNA, 25 bp, E. coli
cttaagcagggaacgctggttgcca

SEQ ID NO: 14243 - DNA, 25 bp, E. coli
caatgctgatgtgtgaaaccgggaa

SEQ ID NO: 14244 - DNA, 25 bp, E. coli
caatgctgatgtctgaaaccgggaa

SEQ ID NO: 14245 - DNA, 25 bp, E. coli
tacagaaggtctttcgtccggaagc

SEQ ID NO: 14246 - DNA, 25 bp, E. coli
tacagaaggtctatcgtccggaagc

SEQ ID NO: 14247 - DNA, 25 bp, E. coli
tacagggaaccgctgataaagcgct

SEQ ID NO: 14248 - DNA, 25 bp, E. coli
tacagggaaccggtgataaagcgct

SEQ ID NO: 14249 - DNA, 25 bp, E. coli
tattgtcaccagactggcgtccggg

SEQ ID NO: 14250 - DNA, 25 bp, E. coli
tatattgcgaacttagctggcagcc

SEQ ID NO: 14251 - DNA, 25 bp, E. coli
tattgtcaccagtctggcgtccggg

SEQ ID NO: 14252 - DNA, 25 bp, E. coli
tatattgcgaacatagctggcagcc

SEQ ID NO: 14253 - DNA, 25 bp, E. coli
tgttaatggtctcaacagcaccggg

SEQ ID NO: 14254 - DNA, 25 bp, E. coli
tgttaatggtctgaacagcaccggg

SEQ ID NO: 14255 - DNA, 25 bp, E. coli
gaatgatattacaggctccggcgct

SEQ ID NO: 14256 - DNA, 25 bp, E. coli
gaatgatattactggctccggcgct

SEQ ID NO: 14257 - DNA, 25 bp, E. coli
gaaaaatcagtcatgccggtacggg

SEQ ID NO: 14258 - DNA, 25 bp, E. coli
gactctttctcacaacgcgatgcgg

SEQ ID NO: 14259 - DNA, 25 bp, E. coli
gactctttctcagaacgcgatgcgg

SEQ ID NO: 14260 - DNA, 25 bp, E. coli
gaaaaatcagtcttgccggtacggg

SEQ ID NO: 14261 - DNA, 25 bp, E. coli
gataatgccagtccgatagccggta

SEQ ID NO: 14262 - DNA, 25 bp, E. coli
gataatgccagtgcgatagccggta

SEQ ID NO: 14263 - DNA, 25 bp, E. coli
tcaatgttatactggccgatggcgg

SEQ ID NO: 14264 - DNA, 25 bp, E. coli
tcaatgttatacaggccgatggcgg

SEQ ID NO: 14265 - DNA, 25 bp, E. coli
taaaagcaggcaatgcggcaggact

SEQ ID NO: 14266 - DNA, 25 bp, E. coli
taaaagcaggcattgcggcaggact

SEQ ID NO: 14267 - DNA, 25 bp, E. coli
tacgcgcctatttacgcgcggcgca

SEQ ID NO: 14268 - DNA, 25 bp, E. coli
aacaggctggcacgtacgcgcctat

SEQ ID NO: 14269 - DNA, 25 bp, E. coli
aacaggctggcaggtacgcgcctat

SEQ ID NO: 14270 - DNA, 25 bp, E. coli
tacgcgcctattaacgcgcggcgca

SEQ ID NO: 14271 - DNA, 25 bp, E. coli
tcgtgaaggcgcacaaggaacgcca

SEQ ID NO: 14272 - DNA, 25 bp, E. coli
tcgtgaaggcgctcaaggaacgcca

SEQ ID NO: 14273 - DNA, 25 bp, E. coli
gccaccagcagatcgtaaaagcagg

SEQ ID NO: 14274 - DNA, 25 bp, E. coli
gccaccagcagaacgtaaaagcagg

SEQ ID NO: 14275 - DNA, 25 bp, E. coli
gctgaagagaaaaaaggcggtgttt

SEQ ID NO: 14276 - DNA, 25 bp, E. coli
gctgaagagaaataaggcggtgttt

SEQ ID NO: 14277 - DNA, 25 bp, E. coli
ccgctggcgatgcttgagccgtcaa

SEQ ID NO: 14278 - DNA, 25 bp, E. coli
ccgctggcgatggttgagccgtcaa

SEQ ID NO: 14279 - DNA, 25 bp, E. coli
cggcgcagggtaagaatcaggttca

SEQ ID NO: 14280 - DNA, 25 bp, E. coli
cggcaggacttgatccgctggcgat

SEQ ID NO: 14281 - DNA, 25 bp, E. coli
cggcgcagggtatgaatcaggttca

SEQ ID NO: 14282 - DNA, 25 bp, E. coli
cggcaggacttgttccgctggcgat

SEQ ID NO: 14283 - DNA, 25 bp, E. coli
ggtgtttcggtgaacataagccccg

SEQ ID NO: 14284 - DNA, 25 bp, E. coli
ggtgtttcggtgtacataagccccg

SEQ ID NO: 14285 - DNA, 25 bp, E. coli
taagccccgacaacgtgaaggcgct

SEQ ID NO: 14286 - DNA, 25 bp, E. coli
taagccccgacatcgtgaaggcgct

SEQ ID NO: 14287 - DNA, 25 bp, E. coli
caacgatttggccatgggcatctca

SEQ ID NO: 14288 - DNA, 25 bp, E. coli
caacgatttggcgatgggcatctca

SEQ ID NO: 14289 - DNA, 25 bp, E. coli
cactctatagcactggcaatgggcg

SEQ ID NO: 14290 - DNA, 25 bp, E. coli
cactctatagcagtggcaatgggcg

SEQ ID NO: 14291 - DNA, 25 bp, E. coli
cagatattcagggagtaacgcccga

SEQ ID NO: 14292 - DNA, 25 bp, E. coli
cagatattcaggcagtaacgcccga

SEQ ID NO: 14293 - DNA, 25 bp, E. coli
tattgacggtatcgctcacgaactg

SEQ ID NO: 14294 - DNA, 25 bp, E. coli
tattgacggtatggctcacgaactg

SEQ ID NO: 14295 - DNA, 25 bp, E. coli
ttaattgtgacagcagcgaactggg

SEQ ID NO: 14296 - DNA, 25 bp, E. coli
ttaattgtgacaccagcgaactggg

SEQ ID NO: 14297 - DNA, 25 bp, E. coli
tgttaaaactggtagcagcggcgca

SEQ ID NO: 14298 - DNA, 25 bp, E. coli
tgttaaaactggaagcagcggcgca

SEQ ID NO: 14299 - DNA, 25 bp, E. coli
tgtggctgtcaacgcatctggcaga

SEQ ID NO: 14300 - DNA, 25 bp, E. coli
tgtggctgtcaaggcatctggcaga

SEQ ID NO: 14301 - DNA, 25 bp, E. coli
gaagagctgctgacttatgcccgac

SEQ ID NO: 14302 - DNA, 25 bp, E. coli
gaagagctgctgtcttatgcccgac

SEQ ID NO: 14303 - DNA, 25 bp, E. coli
gaacaccgttagtgcgcctgcgtta

SEQ ID NO: 14304 - DNA, 25 bp, E. coli
gaacaccgttagagcgcctgcgtta

SEQ ID NO: 14305 - DNA, 25 bp, E. coli
gattgctggataacgccctgatcgc

SEQ ID NO: 14306 - DNA, 25 bp, E. coli
gattgctggatatcgccctgatcgc

SEQ ID NO: 14307 - DNA, 25 bp, E. coli
gtgtacaaattttccgccgaacgcg

SEQ ID NO: 14308 - DNA, 25 bp, E. coli
gtgtacaaatttaccgccgaacgcg

SEQ ID NO: 14309 - DNA, 25 bp, E. coli
aaggtctggtcaattacggcgcggt

SEQ ID NO: 14310 - DNA, 25 bp, E. coli
aaggtctggtcatttacggcgcggt

SEQ ID NO: 14311 - DNA, 25 bp, E. coli
aattccggttggagccgctggcgaa

SEQ ID NO: 14312 - DNA, 25 bp, E. coli
aattccggttggtgccgctggcgaa

SEQ ID NO: 14313 - DNA, 25 bp, E. coli
ttctccaactttcgcggacgggcgt

SEQ ID NO: 14314 - DNA, 25 bp, E. coli
ttctccaactttggcggacgggcgt

SEQ ID NO: 14315 - DNA, 25 bp, E. coli
tctgctcgaacacaatggccgtggt

SEQ ID NO: 14316 - DNA, 25 bp, E. coli
tctgctcgaacagaatggccgtggt

SEQ ID NO: 14317 - DNA, 25 bp, E. coli
cctggaagagttggatatcggcatc

SEQ ID NO: 14318 - DNA, 25 bp, E. coli
cctggaagagttcgatatcggcatc

SEQ ID NO: 14319 - DNA, 25 bp, E. coli
gcattggcgaaagcgatgtccgcgt

SEQ ID NO: 14320 - DNA, 25 bp, E. coli
gcattggcgaaaccgatgtccgcgt

SEQ ID NO: 14321 - DNA, 25 bp, E. coli
gcatccaggcgaaggcggcaattcc

SEQ ID NO: 14322 - DNA, 25 bp, E. coli
gcatccaggcgatggcggcaattcc

SEQ ID NO: 14323 - DNA, 25 bp, E. coli
gacaacgggttggtgtacgatctgc

SEQ ID NO: 14324 - DNA, 25 bp, E. coli
gacaacgggttgctgtacgatctgc

SEQ ID NO: 14325 - DNA, 25 bp, E. coli
cgcgtctggcagaacaaaatgaatg

SEQ ID NO: 14326 - DNA, 25 bp, E. coli
cgtttggcggactaataatcacggt

SEQ ID NO: 14327 - DNA, 25 bp, E. coli
cgtttggcggacaaataatcacggt

SEQ ID NO: 14328 - DNA, 25 bp, E. coli
cgcgtctggcagtacaaaatgaatg

SEQ ID NO: 14329 - DNA, 25 bp, E. coli
gatgttaacgtcgtggaaccgctgt

SEQ ID NO: 14330 - DNA, 25 bp, E. coli
gatgttaacgtcctggaaccgctgt

SEQ ID NO: 14331 - DNA, 25 bp, E. coli
cagttctggcgaagcgttaagtgca

SEQ ID NO: 14332 - DNA, 25 bp, E. coli
cagttctggcgatgcgttaagtgca

SEQ ID NO: 14333 - DNA, 25 bp, E. coli
tacacgtacatgaggaagcaagcgg

SEQ ID NO: 14334 - DNA, 25 bp, E. coli
tactgtagaagccaaagactggacc

SEQ ID NO: 14335 - DNA, 25 bp, E. coli
tactgtagaagcgaaagactggacc

SEQ ID NO: 14336 - DNA, 25 bp, E. coli
tacacgtacatgtggaagcaagcgg

SEQ ID NO: 14337 - DNA, 25 bp, E. coli
aaaatgtccccgtcgctactgtaga

SEQ ID NO: 14338 - DNA, 25 bp, E. coli
aaaatgtccccgacgctactgtaga

SEQ ID NO: 14339 - DNA, 25 bp, E. coli
tatctatacgttgacacttgcgccc

SEQ ID NO: 14340 - DNA, 25 bp, E. coli
tatctatacgttcacacttgcgccc

SEQ ID NO: 14341 - DNA, 25 bp, E. coli
tcctggtcataaccggaagcctgcc

SEQ ID NO: 14342 - DNA, 25 bp, E. coli
tcctggtcataagcggaagcctgcc

SEQ ID NO: 14343 - DNA, 25 bp, E. coli
ccaccaccggtgaaaagccagagta

SEQ ID NO: 14344 - DNA, 25 bp, E. coli
ccaccaccggtgtaaagccagagta

SEQ ID NO: 14345 - DNA, 25 bp, E. coli
gactggacccggcagaatttacacg

SEQ ID NO: 14346 - DNA, 25 bp, E. coli
gactggacccgggagaatttacacg

SEQ ID NO: 14347 - DNA, 25 bp, E. coli
gaaatcgttaatagcggcaaggcca

SEQ ID NO: 14348 - DNA, 25 bp, E. coli
gaaatcgttaattgcggcaaggcca

SEQ ID NO: 14349 - DNA, 25 bp, E. coli
cgcaaagccgcgcaggaaatcgtta

SEQ ID NO: 14350 - DNA, 25 bp, E. coli
cgcaaagccgcggaggaaatcgtta

SEQ ID NO: 14351 - DNA, 25 bp, E. coli
taaccaaaaagaactcagtgcgctg

SEQ ID NO: 14352 - DNA, 25 bp, E. coli
taaccaaaaagatctcagtgcgctg

SEQ ID NO: 14353 - DNA, 25 bp, E. coli
cagggaacccctccattatacatcg

SEQ ID NO: 14354 - DNA, 25 bp, E. coli
cagtaaggctacgaataaagcagtc

SEQ ID NO: 14355 - DNA, 25 bp, E. coli
cagggaacccctgcattatacatcg

SEQ ID NO: 14356 - DNA, 25 bp, E. coli
cagtaaggctaccaataaagcagtc

SEQ ID NO: 14357 - DNA, 25 bp, E. coli
taaaagtgctaaggaaacacctgga

SEQ ID NO: 14358 - DNA, 25 bp, E. coli
taaaagtgctaacgaaacacctgga

SEQ ID NO: 14359 - DNA, 25 bp, E. coli
tatcttatatatcgacgctgggtgc

SEQ ID NO: 14360 - DNA, 25 bp, E. coli
tatcttatatatggacgctgggtgc

SEQ ID NO: 14361 - DNA, 25 bp, E. coli
tgagcaagggtaatgaagacgtcgt

SEQ ID NO: 14362 - DNA, 25 bp, E. coli
tatgttgtgtccctttacgacccga

SEQ ID NO: 14363 - DNA, 25 bp, E. coli
tgagcaagggtattgaagacgtcgt

SEQ ID NO: 14364 - DNA, 25 bp, E. coli
tatgttgtgtccgtttacgacccga

SEQ ID NO: 14365 - DNA, 25 bp, E. coli
gccaggattatacgccgcaatggaa

SEQ ID NO: 14366 - DNA, 25 bp, E. coli
gccaggattataggccgcaatggaa

SEQ ID NO: 14367 - DNA, 25 bp, E. coli
cccgatgctcagtcctgggctgata

SEQ ID NO: 14368 - DNA, 25 bp, E. coli
cccgatgctcagacctgggctgata

SEQ ID NO: 14369 - DNA, 25 bp, E. coli
gataagttcatctgttcaggtcccg

SEQ ID NO: 14370 - DNA, 25 bp, E. coli
gataagttcatcagttcaggtcccg

SEQ ID NO: 14371 - DNA, 25 bp, E. coli
taatcaccctttgtgtgtcacacgg

SEQ ID NO: 14372 - DNA, 25 bp, E. coli
taatcaccctttctgtgtcacacgg

SEQ ID NO: 14373 - DNA, 25 bp, E. coli
gatgaacggacatactgacaacgtg

SEQ ID NO: 14374 - DNA, 25 bp, E. coli
gatgaacggacaaactgacaacgtg

SEQ ID NO: 14375 - DNA, 25 bp, E. coli
caataaaactgaaaatccgccgctg

SEQ ID NO: 14376 - DNA, 25 bp, E. coli
aatgacctgtcataagcctgcggcg

SEQ ID NO: 14377 - DNA, 25 bp, E. coli
caataaaactgataatccgccgctg

SEQ ID NO: 14378 - DNA, 25 bp, E. coli
aatgacctgtcaaaagcctgcggcg

SEQ ID NO: 14379 - DNA, 25 bp, E. coli
caaatttggcggtaccagcgtagct

SEQ ID NO: 14380 - DNA, 25 bp, E. coli
caaatttggcggaaccagcgtagct

SEQ ID NO: 14381 - DNA, 25 bp, E. coli
cataacctgtgcatcctggtgcccg

SEQ ID NO: 14382 - DNA, 25 bp, E. coli
cataacctgtgcttcctggtgcccg

SEQ ID NO: 14383 - DNA, 25 bp, E. coli
ttgatatctggaccgacgtcccggg

SEQ ID NO: 14384 - DNA, 25 bp, E. coli
ttgatatctggagcgacgtcccggg

SEQ ID NO: 14385 - DNA, 25 bp, E. coli
tgattttgacgcgatgaaccgcagc

SEQ ID NO: 14386 - DNA, 25 bp, E. coli
tgattttgacgccatgaaccgcagc

SEQ ID NO: 14387 - DNA, 25 bp, E. coli
tgtgctttctgatgccaacgtgcgt

SEQ ID NO: 14388 - DNA, 25 bp, E. coli
tgtgctttctgaagccaacgtgcgt

SEQ ID NO: 14389 - DNA, 25 bp, E. coli
tcctcgcgcggcataatatttcggt

SEQ ID NO: 14390 - DNA, 25 bp, E. coli
tcctcgcgcggcttaatatttcggt

SEQ ID NO: 14391 - DNA, 25 bp, E. coli
tattcggcgtacaggaaccgttcaa

SEQ ID NO: 14392 - DNA, 25 bp, E. coli
tattcggcgtactggaaccgttcaa

SEQ ID NO: 14393 - DNA, 25 bp, E. coli
gcaaaagtactgcatccggcaacgt

SEQ ID NO: 14394 - DNA, 25 bp, E. coli
gaaggcttagtgttcacccagggat

SEQ ID NO: 14395 - DNA, 25 bp, E. coli
gaaggcttagtgatcacccagggat

SEQ ID NO: 14396 - DNA, 25 bp, E. coli
gcaaaagtactggatccggcaacgt

SEQ ID NO: 14397 - DNA, 25 bp, E. coli
aatcgtgagcaaccttgagtgagcc

SEQ ID NO: 14398 - DNA, 25 bp, E. coli
aatcgtgagcaagcttgagtgagcc

SEQ ID NO: 14399 - DNA, 25 bp, E. coli
cacgtaatactagtttcgagtgaaa

SEQ ID NO: 14400 - DNA, 25 bp, E. coli
cacaatacggtttgttactggaatc

SEQ ID NO: 14401 - DNA, 25 bp, E. coli
cacaatacggttagttactggaatc

SEQ ID NO: 14402 - DNA, 25 bp, E. coli
cacgtaatactactttcgagtgaaa

SEQ ID NO: 14403 - DNA, 25 bp, E. coli
tactggaatcaatcgtgagcaagct

SEQ ID NO: 14404 - DNA, 25 bp, E. coli
tactggaatcaaacgtgagcaagct

SEQ ID NO: 14405 - DNA, 25 bp, E. coli
tatacaagcctaaatagcgaactgc

SEQ ID NO: 14406 - DNA, 25 bp, E. coli
tatacaagcctatatagcgaactgc

SEQ ID NO: 14407 - DNA, 25 bp, E. coli
tgtctccctttgttaccgaacaata

SEQ ID NO: 14408 - DNA, 25 bp, E. coli
tgtctccctttgataccgaacaata

SEQ ID NO: 14409 - DNA, 25 bp, E. coli
tgagtgagccataatgaaaacgaaa

SEQ ID NO: 14410 - DNA, 25 bp, E. coli
tgagtgagccattatgaaaacgaaa

SEQ ID NO: 14411 - DNA, 25 bp, E. coli
tctgaatctaaaaagcgcctgcggg

SEQ ID NO: 14412 - DNA, 25 bp, E. coli
tctgaatctaaatagcgcctgcggg

SEQ ID NO: 14413 - DNA, 25 bp, E. coli
gcgaactgctattgaaataattaca

SEQ ID NO: 14414 - DNA, 25 bp, E. coli
gcgaactgctatagaaataattaca

SEQ ID NO: 14415 - DNA, 25 bp, E. coli
tcaaattattcgttgtatacaagcc

SEQ ID NO: 14416 - DNA, 25 bp, E. coli
tcaaattattcgatgtatacaagcc

SEQ ID NO: 14417 - DNA, 25 bp, E. coli
gagtgaaaatctacctatctctttg

SEQ ID NO: 14418 - DNA, 25 bp, E. coli
gagtgaaaatcttcctatctctttg

SEQ ID NO: 14419 - DNA, 25 bp, E. coli
atgggaataaaaggcattaccgcta

SEQ ID NO: 14420 - DNA, 25 bp, E. coli
atgggaataaaacgcattaccgcta

SEQ ID NO: 14421 - DNA, 25 bp, E. coli
aaatacgaatggcaataaaacgcat

SEQ ID NO: 14422 - DNA, 25 bp, E. coli
aaatacgaatgggaataaaacgcat

SEQ ID NO: 14423 - DNA, 25 bp, E. coli
tgttattttattatttgcaaaaggt

SEQ ID NO: 14424 - DNA, 25 bp, E. coli
tgtggcgtcactttaatttgttatt

SEQ ID NO: 14425 - DNA, 25 bp, E. coli
tgtggcgtcactataatttgttatt

SEQ ID NO: 14426 - DNA, 25 bp, E. coli
tgttattttattttttgcaaaaggt

SEQ ID NO: 14427 - DNA, 25 bp, E. coli
gctgtggcgtcactataatttgtta

SEQ ID NO: 14428 - DNA, 25 bp, E. coli
gctgtggcgtcagtataatttgtta

SEQ ID NO: 14429 - DNA, 25 bp, E. coli
gaatgggaataaaacgcattaccgc

SEQ ID NO: 14430 - DNA, 25 bp, E. coli
gaatgggaataatacgcattaccgc

SEQ ID NO: 14431 - DNA, 25 bp, E. coli
cgaatgggaataaaacgcattaccg

SEQ ID NO: 14432 - DNA, 25 bp, E. coli
cgaatgggaatataacgcattaccg

SEQ ID NO: 14433 - DNA, 25 bp, E. coli
gggaataaaacggattaccgctatt

SEQ ID NO: 14434 - DNA, 25 bp, E. coli
gggaataaaacgcattaccgctatt

SEQ ID NO: 14435 - DNA, 25 bp, E. coli
ggcgtcactataatttgttatttta

SEQ ID NO: 14436 - DNA, 25 bp, E. coli
ggaataaaacgctttaccgctattt

SEQ ID NO: 14437 - DNA, 25 bp, E. coli
ggcgtcactatattttgttatttta

SEQ ID NO: 14438 - DNA, 25 bp, E. coli
ggaataaaacgcattaccgctattt

SEQ ID NO: 14439 - DNA, 25 bp, E. coli
gttgctgtggcgacactataatttg

SEQ ID NO: 14440 - DNA, 25 bp, E. coli
gttgctgtggcgtcactataatttg

SEQ ID NO: 14441 - DNA, 25 bp, E. coli
aagtttttcagatgctgcggcagcg

SEQ ID NO: 14442 - DNA, 25 bp, E. coli
aagtttttcagaagctgcggcagcg

SEQ ID NO: 14443 - DNA, 25 bp, E. coli
caacagattgatattgaatgggatt

SEQ ID NO: 14444 - DNA, 25 bp, E. coli
caacagattgattttgaatgggatt

SEQ ID NO: 14445 - DNA, 25 bp, E. coli
tagctacttggaccaatattccaga

SEQ ID NO: 14446 - DNA, 25 bp, E. coli
taaaaagtttttcagatgctgcggc

SEQ ID NO: 14447 - DNA, 25 bp, E. coli
tagctacttggagcaatattccaga

SEQ ID NO: 14448 - DNA, 25 bp, E. coli
taaaaagtttttgagatgctgcggc

SEQ ID NO: 14449 - DNA, 25 bp, E. coli
tattattctgccgtctggcattgca

SEQ ID NO: 14450 - DNA, 25 bp, E. coli
tattattctgccctctggcattgca

SEQ ID NO: 14451 - DNA, 25 bp, E. coli
ttttcagatgctgcggcagcggcaa

SEQ ID NO: 14452 - DNA, 25 bp, E. coli
ttttcagatgctccggcagcggcaa

SEQ ID NO: 14453 - DNA, 25 bp, E. coli
gaatgggattatccgaataatgtca

SEQ ID NO: 14454 - DNA, 25 bp, E. coli
gaatgggattatgcgaataatgtca

SEQ ID NO: 14455 - DNA, 25 bp, E. coli
gttggcaccaaagggcaaagccaga

SEQ ID NO: 14456 - DNA, 25 bp, E. coli
gttggcaccaaacggcaaagccaga

SEQ ID NO: 14457 - DNA, 25 bp, E. coli
gtaataatacaccttcaacagattg

SEQ ID NO: 14458 - DNA, 25 bp, E. coli
gtaataatacacgttcaacagattg

SEQ ID NO: 14459 - DNA, 25 bp, E. coli
ggagcaatattccagatttgaatga

SEQ ID NO: 14460 - DNA, 25 bp, E. coli
tggcattgcaccaagctacttggag

SEQ ID NO: 14461 - DNA, 25 bp, E. coli
tggcattgcacctagctacttggag

SEQ ID NO: 14462 - DNA, 25 bp, E. coli
ggagcaatattcgagatttgaatga

SEQ ID NO: 14463 - DNA, 25 bp, E. coli
catgctggataacagtgcgcgtagc

SEQ ID NO: 14464 - DNA, 25 bp, E. coli
catgctggcacctgaaaaaatgggc

SEQ ID NO: 14465 - DNA, 25 bp, E. coli
catgctggataagagtgcgcgtagc

SEQ ID NO: 14466 - DNA, 25 bp, E. coli
catgctggcaccagaaaaaatgggc

SEQ ID NO: 14467 - DNA, 25 bp, E. coli
tacatcgtgggctattagttgggcg

SEQ ID NO: 14468 - DNA, 25 bp, E. coli
tactgatttcgctaactggcagcag

SEQ ID NO: 14469 - DNA, 25 bp, E. coli
tactgatttcgcaaactggcagcag

SEQ ID NO: 14470 - DNA, 25 bp, E. coli
tacatcgtgggcaattagttgggcg

SEQ ID NO: 14471 - DNA, 25 bp, E. coli
tgattttagctagcggctggagtgc

SEQ ID NO: 14472 - DNA, 25 bp, E. coli
tgattttagctaccggctggagtgc

SEQ ID NO: 14473 - DNA, 25 bp, E. coli
gctgggaaatagtccccgtcgcata

SEQ ID NO: 14474 - DNA, 25 bp, E. coli
gctgggaaatagaccccgtcgcata

SEQ ID NO: 14475 - DNA, 25 bp, E. coli
gcatcgccagacaggcatccttgaa

SEQ ID NO: 14476 - DNA, 25 bp, E. coli
gaatactgggcggatgaagcctgct

SEQ ID NO: 14477 - DNA, 25 bp, E. coli
gaatactgggcgcatgaagcctgct

SEQ ID NO: 14478 - DNA, 25 bp, E. coli
gcatcgccagactggcatccttgaa

SEQ ID NO: 14479 - DNA, 25 bp, E. coli
ctgttgtctgggatcgcaaacgcgc

SEQ ID NO: 14480 - DNA, 25 bp, E. coli
ctgttgtctgggttcgcaaacgcgc

SEQ ID NO: 14481 - DNA, 25 bp, E. coli
gattgaacggcggaacttccagcgc

SEQ ID NO: 14482 - DNA, 25 bp, E. coli
gattgaacggcgcaacttccagcgc

SEQ ID NO: 14483 - DNA, 25 bp, E. coli
gatgcgcgtaatgttcaccttgccg

SEQ ID NO: 14484 - DNA, 25 bp, E. coli
gatgcgcgtaatcttcaccttgccg

SEQ ID NO: 14485 - DNA, 25 bp, E. coli
catatgcgctgggagtttcgcgacc

SEQ ID NO: 14486 - DNA, 25 bp, E. coli
catatgcgctggcagtttcgcgacc

SEQ ID NO: 14487 - DNA, 25 bp, E. coli
atgacatcgacctgaagccgtggct

SEQ ID NO: 14488 - DNA, 25 bp, E. coli
atgacatcgaccagaagccgtggct

SEQ ID NO: 14489 - DNA, 25 bp, E. coli
tagaatccgcgactggcatgccggt

SEQ ID NO: 14490 - DNA, 25 bp, E. coli
tagaatccgcgagtggcatgccggt

SEQ ID NO: 14491 - DNA, 25 bp, E. coli
ttgttaagcaatggtcgcgtctggc

SEQ ID NO: 14492 - DNA, 25 bp, E. coli
ttgttaagcaatcgtcgcgtctggc

SEQ ID NO: 14493 - DNA, 25 bp, E. coli
ttactctggcgctggatgtctggca

SEQ ID NO: 14494 - DNA, 25 bp, E. coli
ttactctggcgcaggatgtctggca

SEQ ID NO: 14495 - DNA, 25 bp, E. coli
tgctttaccgcatcttgacgcctgg

SEQ ID NO: 14496 - DNA, 25 bp, E. coli
tgctttaccgcaacttgacgcctgg

SEQ ID NO: 14497 - DNA, 25 bp, E. coli
tcgacaaaggcgatgtaaccggcgg

SEQ ID NO: 14498 - DNA, 25 bp, E. coli
tcgacaaaggcgttgtaaccggcgg

SEQ ID NO: 14499 - DNA, 25 bp, E. coli
cccttgaaggctggatgacgatcga

SEQ ID NO: 14500 - DNA, 25 bp, E. coli
cccttgaaggctcgatgacgatcga

SEQ ID NO: 14501 - DNA, 25 bp, E. coli
gattttactgcttactggagccgcg

SEQ ID NO: 14502 - DNA, 25 bp, E. coli
gattttactgctaactggagccgcg

SEQ ID NO: 14503 - DNA, 25 bp, E. coli
ggctcggtaaatggatgcaggacaa

SEQ ID NO: 14504 - DNA, 25 bp, E. coli
tggaagccagtcacatcagcgatct

SEQ ID NO: 14505 - DNA, 25 bp, E. coli
ggctcggtaaatcgatgcaggacaa

SEQ ID NO: 14506 - DNA, 25 bp, E. coli
tggaagccagtctcatcagcgatct

SEQ ID NO: 14507 - DNA, 25 bp, E. coli
caatcactgaaaccctgagcggcag

SEQ ID NO: 14508 - DNA, 25 bp, E. coli
caatcactgaaagcctgagcggcag

SEQ ID NO: 14509 - DNA, 25 bp, E. coli
agaaagcagtctgtatggctcgccc

SEQ ID NO: 14510 - DNA, 25 bp, E. coli
agaaagcagtctctatggctcgccc

SEQ ID NO: 14511 - DNA, 25 bp, E. coli
aacaccgttcaccttgatatgctga

SEQ ID NO: 14512 - DNA, 25 bp, E. coli
aacaccgttcacgttgatatgctga

SEQ ID NO: 14513 - DNA, 25 bp, E. coli
tataaacacattctcatcgcggtcg

SEQ ID NO: 14514 - DNA, 25 bp, E. coli
tataaacacattgtcatcgcggtcg

SEQ ID NO: 14515 - DNA, 25 bp, E. coli
ttgtggtcaccaccaggacttctgg

SEQ ID NO: 14516 - DNA, 25 bp, E. coli
ttgtggtcaccagcaggacttctgg

SEQ ID NO: 14517 - DNA, 25 bp, E. coli
tgatgtcttccgcacgtcagctgat

SEQ ID NO: 14518 - DNA, 25 bp, E. coli
tgcagaaacgcaactctgaagagac

SEQ ID NO: 14519 - DNA, 25 bp, E. coli
tgatgtcttccggacgtcagctgat

SEQ ID NO: 14520 - DNA, 25 bp, E. coli
tgcagaaacgcatctctgaagagac

SEQ ID NO: 14521 - DNA, 25 bp, E. coli
tccgctgcgcgacgaagaagaataa

SEQ ID NO: 14522 - DNA, 25 bp, E. coli
tccgctgcgcgaggaagaagaataa

SEQ ID NO: 14523 - DNA, 25 bp, E. coli
tctccccggaaagcaaagttctggt

SEQ ID NO: 14524 - DNA, 25 bp, E. coli
tctccccggaaaccaaagttctggt

SEQ ID NO: 14525 - DNA, 25 bp, E. coli
gcgaaagtttctctgatccacgtag

SEQ ID NO: 14526 - DNA, 25 bp, E. coli
gcgaaagtttctgtgatccacgtag

SEQ ID NO: 14527 - DNA, 25 bp, E. coli
gatatgctgattcttccgctgcgcg

SEQ ID NO: 14528 - DNA, 25 bp, E. coli
gatatgctgattgttccgctgcgcg

SEQ ID NO: 14529 - DNA, 25 bp, E. coli
catgccgggttatcgtaaagcgttt

SEQ ID NO: 14530 - DNA, 25 bp, E. coli
catgccgggttaacgtaaagcgttt

SEQ ID NO: 14531 - DNA, 25 bp, E. coli
tactgaatttgtacgtacgcgcact

SEQ ID NO: 14532 - DNA, 25 bp, E. coli
tactgaatttgttcgtacgcgcact

SEQ ID NO: 14533 - DNA, 25 bp, E. coli
tgaactggcactggaaactgaaacc

SEQ ID NO: 14534 - DNA, 25 bp, E. coli
tgcaaatgcgtcctcaggaagtcgt

SEQ ID NO: 14535 - DNA, 25 bp, E. coli
tgcaaatgcgtcgtcaggaagtcgt

SEQ ID NO: 14536 - DNA, 25 bp, E. coli
tgcttaacctgatggacatgccggg

SEQ ID NO: 14537 - DNA, 25 bp, E. coli
tgaactggcactcgaaactgaaacc

SEQ ID NO: 14538 - DNA, 25 bp, E. coli
tgcttaacctgaaggacatgccggg

SEQ ID NO: 14539 - DNA, 25 bp, E. coli
tctgcaactgtttgccgactggcga

SEQ ID NO: 14540 - DNA, 25 bp, E. coli
tctgcaactgttagccgactggcga

SEQ ID NO: 14541 - DNA, 25 bp, E. coli
tctttgtgtgaagccgtccgtgcct

SEQ ID NO: 14542 - DNA, 25 bp, E. coli
tctttgtgtgaacccgtccgtgcct

SEQ ID NO: 14543 - DNA, 25 bp, E. coli
ccggcgatagccgtggatactgaat

SEQ ID NO: 14544 - DNA, 25 bp, E. coli
ccggcgatagccctggatactgaat

SEQ ID NO: 14545 - DNA, 25 bp, E. coli
gcttatggtagaaacggaggcctcc

SEQ ID NO: 14546 - DNA, 25 bp, E. coli
gcttatggtagatacggaggcctcc

SEQ ID NO: 14547 - DNA, 25 bp, E. coli
gaattgctggcaacgcgtcggcaaa

SEQ ID NO: 14548 - DNA, 25 bp, E. coli
gaattgctggcatcgcgtcggcaaa

SEQ ID NO: 14549 - DNA, 25 bp, E. coli
tggacaagagtgtatcgcgcaccga

SEQ ID NO: 14550 - DNA, 25 bp, E. coli
tggacaagagtgaatcgcgcaccga

SEQ ID NO: 14551 - DNA, 25 bp, E. coli
taccaggaacgtgtgcaagcggagc

SEQ ID NO: 14552 - DNA, 25 bp, E. coli
taccaggaacgtctgcaagcggagc

SEQ ID NO: 14553 - DNA, 25 bp, E. coli
tatcaccaaagtgttccaccagggc

SEQ ID NO: 14554 - DNA, 25 bp, E. coli
tattagcgcgcagatggattacgcc

SEQ ID NO: 14555 - DNA, 25 bp, E. coli
tattagcgcgcacatggattacgcc

SEQ ID NO: 14556 - DNA, 25 bp, E. coli
tattgctgtgtgatgaagccaccag

SEQ ID NO: 14557 - DNA, 25 bp, E. coli
tatcaccaaagtcttccaccagggc

SEQ ID NO: 14558 - DNA, 25 bp, E. coli
tattgctgtgtgttgaagccaccag

SEQ ID NO: 14559 - DNA, 25 bp, E. coli
tcatgctgactgaaatgcacggcac

SEQ ID NO: 14560 - DNA, 25 bp, E. coli
tcatgctgactgtaatgcacggcac

SEQ ID NO: 14561 - DNA, 25 bp, E. coli
gcgttgaacaacgtcagcctgcatg

SEQ ID NO: 14562 - DNA, 25 bp, E. coli
gcgttgaacaacctcagcctgcatg

SEQ ID NO: 14563 - DNA, 25 bp, E. coli
gctgcgtctggactttaccggtcaa

SEQ ID NO: 14564 - DNA, 25 bp, E. coli
gctgcgtctggagtttaccggtcaa

SEQ ID NO: 14565 - DNA, 25 bp, E. coli
cgtcgaatctttccggtgggcagaa

SEQ ID NO: 14566 - DNA, 25 bp, E. coli
cgtcgaatctttgcggtgggcagaa

SEQ ID NO: 14567 - DNA, 25 bp, E. coli
taagcatgataggtacccgtcgaat

SEQ ID NO: 14568 - DNA, 25 bp, E. coli
taagcatgatagctacccgtcgaat

SEQ ID NO: 14569 - DNA, 25 bp, E. coli
gagccatttactcactgcgtgccga

SEQ ID NO: 14570 - DNA, 25 bp, E. coli
gatgccccactgctttctgaaaccg

SEQ ID NO: 14571 - DNA, 25 bp, E. coli
gagccatttactgactgcgtgccga

SEQ ID NO: 14572 - DNA, 25 bp, E. coli
gatgccccactggtttctgaaaccg

SEQ ID NO: 14573 - DNA, 25 bp, E. coli
aattgataacagagggcgttgcagc

SEQ ID NO: 14574 - DNA, 25 bp, E. coli
aattgataacagtgggcgttgcagc

SEQ ID NO: 14575 - DNA, 25 bp, E. coli
aacgtcaccagataattgataacag

SEQ ID NO: 14576 - DNA, 25 bp, E. coli
aaacgtcaccagaaaattgataaca

SEQ ID NO: 14577 - DNA, 25 bp, E. coli
aacgtcaccagaaaattgataacag

SEQ ID NO: 14578 - DNA, 25 bp, E. coli
aaacgtcaccagtaaattgataaca

SEQ ID NO: 14579 - DNA, 25 bp, E. coli
ttaaaaagggcggcagagcagtcac

SEQ ID NO: 14580 - DNA, 25 bp, E. coli
ttaaaaagggcgccagagcagtcac

SEQ ID NO: 14581 - DNA, 25 bp, E. coli
tcacggagtaaaactgataccgcca

SEQ ID NO: 14582 - DNA, 25 bp, E. coli
cggcagagcagtgacggagtaaaac

SEQ ID NO: 14583 - DNA, 25 bp, E. coli
cgtcaccagaaatttgataacagag

SEQ ID NO: 14584 - DNA, 25 bp, E. coli
cgtcaccagaaaattgataacagag

SEQ ID NO: 14585 - DNA, 25 bp, E. coli
cggcagagcagtcacggagtaaaac

SEQ ID NO: 14586 - DNA, 25 bp, E. coli
gataccgccaaaggtcaccagaaaa

SEQ ID NO: 14587 - DNA, 25 bp, E. coli
gataccgccaaacgtcaccagaaaa

SEQ ID NO: 14588 - DNA, 25 bp, E. coli
gtcaccagaaaattgataacagagg

SEQ ID NO: 14589 - DNA, 25 bp, E. coli
gtcaccagaaaaatgataacagagg

SEQ ID NO: 14590 - DNA, 25 bp, E. coli
tcaccagaaaattgataacagaggg

SEQ ID NO: 14591 - DNA, 25 bp, E. coli
tcactttaaaaacggcggcagagca

SEQ ID NO: 14592 - DNA, 25 bp, E. coli
tcaccagaaaatagataacagaggg

SEQ ID NO: 14593 - DNA, 25 bp, E. coli
tcactttaaaaagggcggcagagca

SEQ ID NO: 14594 - DNA, 25 bp, E. coli
tcacggagtaaatctgataccgcca

SEQ ID NO: 14595 - DNA, 25 bp, E. coli
aacccctggctgcagaatattgcac

SEQ ID NO: 14596 - DNA, 25 bp, E. coli
tatttttaaatgtgaccaggtcctc

SEQ ID NO: 14597 - DNA, 25 bp, E. coli
tatttttaaatgagaccaggtcctc

SEQ ID NO: 14598 - DNA, 25 bp, E. coli
actcgggaattagtataagcagcgc

SEQ ID NO: 14599 - DNA, 25 bp, E. coli
actcgggaattactataagcagcgc

SEQ ID NO: 14600 - DNA, 25 bp, E. coli
aacccctggctggagaatattgcac

SEQ ID NO: 14601 - DNA, 25 bp, E. coli
tatgccgtaacgacaatgaactcgg

SEQ ID NO: 14602 - DNA, 25 bp, E. coli
tatgccgtaacgtcaatgaactcgg

SEQ ID NO: 14603 - DNA, 25 bp, E. coli
tcattttaataacccctggctggag

SEQ ID NO: 14604 - DNA, 25 bp, E. coli
tcattttaataagccctggctggag

SEQ ID NO: 14605 - DNA, 25 bp, E. coli
gcatatgcacattaggttgcgcgct

SEQ ID NO: 14606 - DNA, 25 bp, E. coli
gcatatgcacataaggttgcgcgct

SEQ ID NO: 14607 - DNA, 25 bp, E. coli
gatttgcgcttttccttaccgggcg

SEQ ID NO: 14608 - DNA, 25 bp, E. coli
gatttgcgctttaccttaccgggcg

SEQ ID NO: 14609 - DNA, 25 bp, E. coli
gttgcgcgctaaagcacagatttgc

SEQ ID NO: 14610 - DNA, 25 bp, E. coli
gattgacattgatcacatttctgcg

SEQ ID NO: 14611 - DNA, 25 bp, E. coli
gttgcgcgctaatgcacagatttgc

SEQ ID NO: 14612 - DNA, 25 bp, E. coli
gattgacattgaacacatttctgcg

SEQ ID NO: 14613 - DNA, 25 bp, E. coli
ggcggcactgcattccctgaaatga

SEQ ID NO: 14614 - DNA, 25 bp, E. coli
ggcggcactgcaatccctgaaatga

SEQ ID NO: 14615 - DNA, 25 bp, E. coli
taagcagcgcgagaataataatcat

SEQ ID NO: 14616 - DNA, 25 bp, E. coli
taagcagcgcgacaataataatcat

SEQ ID NO: 14617 - DNA, 25 bp, E. coli
aatatggaatctacccgctgggcgc

SEQ ID NO: 14618 - DNA, 25 bp, E. coli
aatatggaatcttcccgctgggcgc

SEQ ID NO: 14619 - DNA, 25 bp, E. coli
caaatcgtcggcagtgtgctcgcgt

SEQ ID NO: 14620 - DNA, 25 bp, E. coli
caaatcgtcggctgtgtgctcgcgt

SEQ ID NO: 14621 - DNA, 25 bp, E. coli
cagtttctcgacagcgcattagggc

SEQ ID NO: 14622 - DNA, 25 bp, E. coli
cagtttctcgactgcgcattagggc

SEQ ID NO: 14623 - DNA, 25 bp, E. coli
tacgcgcccggatttgatcactgat

SEQ ID NO: 14624 - DNA, 25 bp, E. coli
tacgcgcccggaattgatcactgat

SEQ ID NO: 14625 - DNA, 25 bp, E. coli
tgtttccgcgatgactaccaatgtg

SEQ ID NO: 14626 - DNA, 25 bp, E. coli
tgtttccgcgatcactaccaatgtg

SEQ ID NO: 14627 - DNA, 25 bp, E. coli
tcgactttatctacgggacgctggc

SEQ ID NO: 14628 - DNA, 25 bp, E. coli
tcgactttatcttcgggacgctggc

SEQ ID NO: 14629 - DNA, 25 bp, E. coli
tcattgtgatcagcattcagccgga

SEQ ID NO: 14630 - DNA, 25 bp, E. coli
tcattgtgatcaccattcagccgga

SEQ ID NO: 14631 - DNA, 25 bp, E. coli
ccatttatagctcggtcgcggcggc

SEQ ID NO: 14632 - DNA, 25 bp, E. coli
ccatttatagctgggtcgcggcggc

SEQ ID NO: 14633 - DNA, 25 bp, E. coli
cgtttgccgaatgcacgcatggtgg

SEQ ID NO: 14634 - DNA, 25 bp, E. coli
cgtttgccgaatccacgcatggtgg

SEQ ID NO: 14635 - DNA, 25 bp, E. coli
gatcaatacgctatcgctgacgctg

SEQ ID NO: 14636 - DNA, 25 bp, E. coli
gatcaatacgctttcgctgacgctg

SEQ ID NO: 14637 - DNA, 25 bp, E. coli
gaccatgtgataactgcccgtagcg

SEQ ID NO: 14638 - DNA, 25 bp, E. coli
gaccatgtgatatctgcccgtagcg

SEQ ID NO: 14639 - DNA, 25 bp, E. coli
aatccggatgtagcacacgcagggc

SEQ ID NO: 14640 - DNA, 25 bp, E. coli
aatccggatgtaccacacgcagggc

SEQ ID NO: 14641 - DNA, 25 bp, E. coli
tacgctgttcgaaggtcagtggacg

SEQ ID NO: 14642 - DNA, 25 bp, E. coli
tacgctgttcgatggtcagtggacg

SEQ ID NO: 14643 - DNA, 25 bp, E. coli
tttgaagaaattgcccggcgttcga

SEQ ID NO: 14644 - DNA, 25 bp, E. coli
tttgaagaaattccccggcgttcga

SEQ ID NO: 14645 - DNA, 25 bp, E. coli
tgatcaccccgtggatgctgagtgc

SEQ ID NO: 14646 - DNA, 25 bp, E. coli
tgatcaccccgtcgatgctgagtgc

SEQ ID NO: 14647 - DNA, 25 bp, E. coli
tgaagagatagcaggtttccagacc

SEQ ID NO: 14648 - DNA, 25 bp, E. coli
tgctgagtgcagatatcttccccgg

SEQ ID NO: 14649 - DNA, 25 bp, E. coli
tgctgagtgcagttatcttccccgg

SEQ ID NO: 14650 - DNA, 25 bp, E. coli
tgaagagatagctggtttccagacc

SEQ ID NO: 14651 - DNA, 25 bp, E. coli
tccccgaaggcggaagtacaggcag

SEQ ID NO: 14652 - DNA, 25 bp, E. coli
tccccgaaggcgcaagtacaggcag

SEQ ID NO: 14653 - DNA, 25 bp, E. coli
ccttcaatgccgctgtatgtttctg

SEQ ID NO: 14654 - DNA, 25 bp, E. coli
ccttcaatgccggtgtatgtttctg

SEQ ID NO: 14655 - DNA, 25 bp, E. coli
gaatgatcctttggctgccagtcac

SEQ ID NO: 14656 - DNA, 25 bp, E. coli
gaatgatcctttcgctgccagtcac

SEQ ID NO: 14657 - DNA, 25 bp, E. coli
gaaaaaattggtctgcaactgccgt

SEQ ID NO: 14658 - DNA, 25 bp, E. coli
gaaaaaattggtgtgcaactgccgt

SEQ ID NO: 14659 - DNA, 25 bp, E. coli
tggccgctgcgcaaagtgagtgaaa

SEQ ID NO: 14660 - DNA, 25 bp, E. coli
tggccgctgcgctaagtgagtgaaa

SEQ ID NO: 14661 - DNA, 25 bp, E. coli
cacgggctttgagcatgacggcaat

SEQ ID NO: 14662 - DNA, 25 bp, E. coli
cacgggctttgaccatgacggcaat

SEQ ID NO: 14663 - DNA, 25 bp, E. coli
actatcagacatgaggcccagtgca

SEQ ID NO: 14664 - DNA, 25 bp, E. coli
actatcagacatcaggcccagtgca

SEQ ID NO: 14665 - DNA, 25 bp, E. coli
tattcaaaatacctagtgccgggcc

SEQ ID NO: 14666 - DNA, 25 bp, E. coli
tattcaaaatacgtagtgccgggcc

SEQ ID NO: 14667 - DNA, 25 bp, E. coli
tgactttggctaaacgggcgctgac

SEQ ID NO: 14668 - DNA, 25 bp, E. coli
tgactttggctatacgggcgctgac

SEQ ID NO: 14669 - DNA, 25 bp, E. coli
tgccagcacggaatgtgacatgccg

SEQ ID NO: 14670 - DNA, 25 bp, E. coli
tgccgggccgctcggttttatttca

SEQ ID NO: 14671 - DNA, 25 bp, E. coli
tgccagcacggattgtgacatgccg

SEQ ID NO: 14672 - DNA, 25 bp, E. coli
tgccgggccgctgggttttatttca

SEQ ID NO: 14673 - DNA, 25 bp, E. coli
tcattacgttccgatttcgagacac

SEQ ID NO: 14674 - DNA, 25 bp, E. coli
tcattacgttcccatttcgagacac

SEQ ID NO: 14675 - DNA, 25 bp, E. coli
gagacactttctattgacattccca

SEQ ID NO: 14676 - DNA, 25 bp, E. coli
gacggcaatggcatcaacctcacta

SEQ ID NO: 14677 - DNA, 25 bp, E. coli
gagacactttcttttgacattccca

SEQ ID NO: 14678 - DNA, 25 bp, E. coli
cattcccattgtttgtgccagcacg

SEQ ID NO: 14679 - DNA, 25 bp, E. coli
cattcccattgtatgtgccagcacg

SEQ ID NO: 14680 - DNA, 25 bp, E. coli
ggatggctttgatctcttcacccgt

SEQ ID NO: 14681 - DNA, 25 bp, E. coli
ggatggctttgaactcttcacccgt

SEQ ID NO: 14682 - DNA, 25 bp, E. coli
gacggcaatggcttcaacctcacta

SEQ ID NO: 14683 - DNA, 25 bp, E. coli
caacaccaagttggatgaatgaaag

SEQ ID NO: 14684 - DNA, 25 bp, E. coli
cacggaaaaaatcgttggatgggca

SEQ ID NO: 14685 - DNA, 25 bp, E. coli
cacggaaaaaatggttggatgggca

SEQ ID NO: 14686 - DNA, 25 bp, E. coli
caacaccaagttcgatgaatgaaag

SEQ ID NO: 14687 - DNA, 25 bp, E. coli
caggaagaactataagcactggtct

SEQ ID NO: 14688 - DNA, 25 bp, E. coli
caggaagaactaaaagcactggtct

SEQ ID NO: 14689 - DNA, 25 bp, E. coli
taaagccctggatttcattggtgcc

SEQ ID NO: 14690 - DNA, 25 bp, E. coli
taaaagaactgggagtacccgcgag

SEQ ID NO: 14691 - DNA, 25 bp, E. coli
taaaagaactggcagtacccgcgag

SEQ ID NO: 14692 - DNA, 25 bp, E. coli
taaagccctggaattcattggtgcc

SEQ ID NO: 14693 - DNA, 25 bp, E. coli
tatatagccttatcgataacatggt

SEQ ID NO: 14694 - DNA, 25 bp, E. coli
tatatagccttaacgataacatggt

SEQ ID NO: 14695 - DNA, 25 bp, E. coli
tcattggtgccatggatgtatcagc

SEQ ID NO: 14696 - DNA, 25 bp, E. coli
tcattggtgccaaggatgtatcagc

SEQ ID NO: 14697 - DNA, 25 bp, E. coli
gcctgctgtaatagataaagccctg

SEQ ID NO: 14698 - DNA, 25 bp, E. coli
gcctgctgtaattgataaagccctg

SEQ ID NO: 14699 - DNA, 25 bp, E. coli
gtacccgcgagtgccgctgatatta

SEQ ID NO: 14700 - DNA, 25 bp, E. coli
gtacccgcgagtcccgctgatatta

SEQ ID NO: 14701 - DNA, 25 bp, E. coli
taaggataagaatatgcctgctgta

SEQ ID NO: 14702 - DNA, 25 bp, E. coli
tcaacatatatgcaggaagaactaa

SEQ ID NO: 14703 - DNA, 25 bp, E. coli
tcaacatatatggaggaagaactaa

SEQ ID NO: 14704 - DNA, 25 bp, E. coli
taaggataagaaaatgcctgctgta

SEQ ID NO: 14705 - DNA, 25 bp, E. coli
tacaaaaagaagcataccactcagg

SEQ ID NO: 14706 - DNA, 25 bp, E. coli
tacaaaaagaaggataccactcagg

SEQ ID NO: 14707 - DNA, 25 bp, E. coli
tttacatgtggcctaagcgtcctgg

SEQ ID NO: 14708 - DNA, 25 bp, E. coli
tttacatgtggcgtaagcgtcctgg

SEQ ID NO: 14709 - DNA, 25 bp, E. coli
tgcgagttgatgaacttgtccagtt

SEQ ID NO: 14710 - DNA, 25 bp, E. coli
tgcgagttgatgtacttgtccagtt

SEQ ID NO: 14711 - DNA, 25 bp, E. coli
tccagttttttgcttctgttcagag

SEQ ID NO: 14712 - DNA, 25 bp, E. coli
taagcgtcctggagaaatagttccg

SEQ ID NO: 14713 - DNA, 25 bp, E. coli
taagcgtcctggtgaaatagttccg

SEQ ID NO: 14714 - DNA, 25 bp, E. coli
tccagttttttggttctgttcagag

SEQ ID NO: 14715 - DNA, 25 bp, E. coli
tgcggaagctgctgcatactccaag

SEQ ID NO: 14716 - DNA, 25 bp, E. coli
tgcggaagctgcagcatactccaag

SEQ ID NO: 14717 - DNA, 25 bp, E. coli
gccgatttttatcggataacccgcg

SEQ ID NO: 14718 - DNA, 25 bp, E. coli
gccgatttttatgggataacccgcg

SEQ ID NO: 14719 - DNA, 25 bp, E. coli
ctgttcagagggttgccgattttta

SEQ ID NO: 14720 - DNA, 25 bp, E. coli
ctgttcagagggatgccgattttta

SEQ ID NO: 14721 - DNA, 25 bp, E. coli
ggataccactcacggcgaaggaaag

SEQ ID NO: 14722 - DNA, 25 bp, E. coli
ggataccactcagggcgaaggaaag

SEQ ID NO: 14723 - DNA, 25 bp, E. coli
ggaaattatcttagaacccagaact

SEQ ID NO: 14724 - DNA, 25 bp, E. coli
ggaaattatctttgaacccagaact

SEQ ID NO: 14725 - DNA, 25 bp, E. coli
taacccgcgaagctatttacatgtg

SEQ ID NO: 14726 - DNA, 25 bp, E. coli
taacccgcgaaggtatttacatgtg

SEQ ID NO: 14727 - DNA, 25 bp, E. coli
aatcacaagttgcagattctggcgg

SEQ ID NO: 14728 - DNA, 25 bp, E. coli
aatcacaagttggagattctggcgg

SEQ ID NO: 14729 - DNA, 25 bp, E. coli
cagcgcaaagtgaaaggttacgatc

SEQ ID NO: 14730 - DNA, 25 bp, E. coli
cagcgcaaagtgtaaggttacgatc

SEQ ID NO: 14731 - DNA, 25 bp, E. coli
cagttgataaacgttgcccggtgaa

SEQ ID NO: 14732 - DNA, 25 bp, E. coli
cagttgataaaccttgcccggtgaa

SEQ ID NO: 14733 - DNA, 25 bp, E. coli
aaaattgcagctcaaggtctacacc

SEQ ID NO: 14734 - DNA, 25 bp, E. coli
aaaattgcagctgaaggtctacacc

SEQ ID NO: 14735 - DNA, 25 bp, E. coli
aacaacgcagggttggtagtcacgc

SEQ ID NO: 14736 - DNA, 25 bp, E. coli
aacaacgcagggatggtagtcacgc

SEQ ID NO: 14737 - DNA, 25 bp, E. coli
gacggcctgaaatctgtcgccggaa

SEQ ID NO: 14738 - DNA, 25 bp, E. coli
gacggcctgaaaactgtcgccggaa

SEQ ID NO: 14739 - DNA, 25 bp, E. coli
cccggaatgctatcaggatcaggcc

SEQ ID NO: 14740 - DNA, 25 bp, E. coli
cccggaatgctaacaggatcaggcc

SEQ ID NO: 14741 - DNA, 25 bp, E. coli
cttgttacaggccaaaggcgatggc

SEQ ID NO: 14742 - DNA, 25 bp, E. coli
cttgttacaggcgaaaggcgatggc

SEQ ID NO: 14743 - DNA, 25 bp, E. coli
gattgtgaaccacaacgatcgtcag

SEQ ID NO: 14744 - DNA, 25 bp, E. coli
gattgtgaaccagaacgatcgtcag

SEQ ID NO: 14745 - DNA, 25 bp, E. coli
gagtttcttgccgacgacgatcagc

SEQ ID NO: 14746 - DNA, 25 bp, E. coli
gatggtcagccgtaccgactgttaa

SEQ ID NO: 14747 - DNA, 25 bp, E. coli
gagtttcttgcccacgacgatcagc

SEQ ID NO: 14748 - DNA, 25 bp, E. coli
gatggtcagccgaaccgactgttaa

SEQ ID NO: 14749 - DNA, 25 bp, E. coli
tagaaagatcaaaaaccccaccgct

SEQ ID NO: 14750 - DNA, 25 bp, E. coli
tagaaagatcaataaccccaccgct

SEQ ID NO: 14751 - DNA, 25 bp, E. coli
actgggatggccaagtattaaaatc

SEQ ID NO: 14752 - DNA, 25 bp, E. coli
actgggatggcctagtattaaaatc

SEQ ID NO: 14753 - DNA, 25 bp, E. coli
aacaagatgaactattagcaatggc

SEQ ID NO: 14754 - DNA, 25 bp, E. coli
aacaagatgaacaattagcaatggc

SEQ ID NO: 14755 - DNA, 25 bp, E. coli
aaaaagccgttatgaattacatgga

SEQ ID NO: 14756 - DNA, 25 bp, E. coli
aaaaagccgttaagaattacatgga

SEQ ID NO: 14757 - DNA, 25 bp, E. coli
ttaaccacgattatcctaacaatgg

SEQ ID NO: 14758 - DNA, 25 bp, E. coli
ttaaccacgattttcctaacaatgg

SEQ ID NO: 14759 - DNA, 25 bp, E. coli
tgttgcaaaatctatacgttcgtga

SEQ ID NO: 14760 - DNA, 25 bp, E. coli
tgttgcaaaatcaatacgttcgtga

SEQ ID NO: 14761 - DNA, 25 bp, E. coli
tcagcaggccttaagtttactggga

SEQ ID NO: 14762 - DNA, 25 bp, E. coli
tcagcaggcctttagtttactggga

SEQ ID NO: 14763 - DNA, 25 bp, E. coli
gaaaatatggcgtacgaggtttacg

SEQ ID NO: 14764 - DNA, 25 bp, E. coli
gacggatattgattaacattaacca

SEQ ID NO: 14765 - DNA, 25 bp, E. coli
gaaaatatggcgaacgaggtttacg

SEQ ID NO: 14766 - DNA, 25 bp, E. coli
gaaagagatgatataagcgccattg

SEQ ID NO: 14767 - DNA, 25 bp, E. coli
gaaagagatgatttaagcgccattg

SEQ ID NO: 14768 - DNA, 25 bp, E. coli
cgttcgtgaaatccgaaaatatggc

SEQ ID NO: 14769 - DNA, 25 bp, E. coli
cgttcgtgaaatgcgaaaatatggc

SEQ ID NO: 14770 - DNA, 25 bp, E. coli
gacggatattgaataacattaacca

SEQ ID NO: 14771 - DNA, 25 bp, E. coli
cagtcgagtattgtgaagtttgccc

SEQ ID NO: 14772 - DNA, 25 bp, E. coli
cagtcgagtattctgaagtttgccc

SEQ ID NO: 14773 - DNA, 25 bp, E. coli
tacgcaatgcggaaagtgaatttac

SEQ ID NO: 14774 - DNA, 25 bp, E. coli
taccgagaacgagcaaaaaattgct

SEQ ID NO: 14775 - DNA, 25 bp, E. coli
tacgcaatgcggtaagtgaatttac

SEQ ID NO: 14776 - DNA, 25 bp, E. coli
taccgagaacgaccaaaaaattgct

SEQ ID NO: 14777 - DNA, 25 bp, E. coli
tgtgcgttgttcgactacgcgcggc

SEQ ID NO: 14778 - DNA, 25 bp, E. coli
tgtgcgttgttccactacgcgcggc

SEQ ID NO: 14779 - DNA, 25 bp, E. coli
tcgctggaagtgattgcccgcaaat

SEQ ID NO: 14780 - DNA, 25 bp, E. coli
tcgctggaagtgtttgcccgcaaat

SEQ ID NO: 14781 - DNA, 25 bp, E. coli
tcggcatcagcctgtcgagtattgt

SEQ ID NO: 14782 - DNA, 25 bp, E. coli
tcggcatcagccagtcgagtattgt

SEQ ID NO: 14783 - DNA, 25 bp, E. coli
tcttcgcgcaagatggcgaaacagc

SEQ ID NO: 14784 - DNA, 25 bp, E. coli
tcttcgcgcaagttggcgaaacagc

SEQ ID NO: 14785 - DNA, 25 bp, E. coli
gctcggcgcacaagggtttactgaa

SEQ ID NO: 14786 - DNA, 25 bp, E. coli
gctgaaatccgtgtcttcgcgcaag

SEQ ID NO: 14787 - DNA, 25 bp, E. coli
gctgaaatccgtctcttcgcgcaag

SEQ ID NO: 14788 - DNA, 25 bp, E. coli
gctcggcgcacatgggtttactgaa

SEQ ID NO: 14789 - DNA, 25 bp, E. coli
gaagtttgcccagaagctcggcgca

SEQ ID NO: 14790 - DNA, 25 bp, E. coli
gaagtttgcccacaagctcggcgca

SEQ ID NO: 14791 - DNA, 25 bp, E. coli
gaaagtgaattttccgagaacgagc

SEQ ID NO: 14792 - DNA, 25 bp, E. coli
gaaagtgaatttaccgagaacgagc

SEQ ID NO: 14793 - DNA, 25 bp, E. coli
caaaacaatatctccggttgggaag

SEQ ID NO: 14794 - DNA, 25 bp, E. coli
caaaacaatatcaccggttgggaag

SEQ ID NO: 14795 - DNA, 25 bp, E. coli
cagtttctggaccttgggtatcacc

SEQ ID NO: 14796 - DNA, 25 bp, E. coli
cagtttctggacgttgggtatcacc

SEQ ID NO: 14797 - DNA, 25 bp, E. coli
taaaacaaaacacagacgcgaccag

SEQ ID NO: 14798 - DNA, 25 bp, E. coli
tactacgtaaaataggctgggcaca

SEQ ID NO: 14799 - DNA, 25 bp, E. coli
tactacgtaaaaaaggctgggcaca

SEQ ID NO: 14800 - DNA, 25 bp, E. coli
tatgcgcaaaaaacctgagcgcccg

SEQ ID NO: 14801 - DNA, 25 bp, E. coli
tatgcgcaaaaatcctgagcgcccg

SEQ ID NO: 14802 - DNA, 25 bp, E. coli
tggtggcgtgaagaagcactttcct

SEQ ID NO: 14803 - DNA, 25 bp, E. coli
tggtggcgtgaacaagcactttcct

SEQ ID NO: 14804 - DNA, 25 bp, E. coli
tgggcacaagattgctatatcgcgc

SEQ ID NO: 14805 - DNA, 25 bp, E. coli
tgatcgcagacttagaaaaaagcgc

SEQ ID NO: 14806 - DNA, 25 bp, E. coli
tgatcgcagactaagaaaaaagcgc

SEQ ID NO: 14807 - DNA, 25 bp, E. coli
tgggcacaagatagctatatcgcgc

SEQ ID NO: 14808 - DNA, 25 bp, E. coli
gcactttcctgtgatatgcgcaaaa

SEQ ID NO: 14809 - DNA, 25 bp, E. coli
gcactttcctgtcatatgcgcaaaa

SEQ ID NO: 14810 - DNA, 25 bp, E. coli
gggtatcacccctatgatagacagg

SEQ ID NO: 14811 - DNA, 25 bp, E. coli
gggaaaggctggtctctctcatcga

SEQ ID NO: 14812 - DNA, 25 bp, E. coli
gggtatcaccccaatgatagacagg

SEQ ID NO: 14813 - DNA, 25 bp, E. coli
gggaaaggctggactctctcatcga

SEQ ID NO: 14814 - DNA, 25 bp, E. coli
taaaacaaaacagagacgcgaccag

SEQ ID NO: 14815 - DNA, 25 bp, E. coli
cagtagcgctgaagtcctatcagga

SEQ ID NO: 14816 - DNA, 25 bp, E. coli
cagtagcgctgatgtcctatcagga

SEQ ID NO: 14817 - DNA, 25 bp, E. coli
tcctatcaggatgaacttgcgaaag

SEQ ID NO: 14818 - DNA, 25 bp, E. coli
tcctatcaggatcaacttgcgaaag

SEQ ID NO: 14819 - DNA, 25 bp, E. coli
tgctgcgctgaatgatgcacagact

SEQ ID NO: 14820 - DNA, 25 bp, E. coli
tgctgcgctgaaagatgcacagact

SEQ ID NO: 14821 - DNA, 25 bp, E. coli
tcgtcagactgtcgatgctgcgctg

SEQ ID NO: 14822 - DNA, 25 bp, E. coli
tcagactgtggatgctgcgctgaaa

SEQ ID NO: 14823 - DNA, 25 bp, E. coli
tcgtcagactgtggatgctgcgctg

SEQ ID NO: 14824 - DNA, 25 bp, E. coli
cgctgaagtcctttcaggatgaact

SEQ ID NO: 14825 - DNA, 25 bp, E. coli
cgctgaaagatgcacagactcgtat

SEQ ID NO: 14826 - DNA, 25 bp, E. coli
cgctgaaagatggacagactcgtat

SEQ ID NO: 14827 - DNA, 25 bp, E. coli
cgctgaagtcctatcaggatgaact

SEQ ID NO: 14828 - DNA, 25 bp, E. coli
ggataacgctcagaaaggtgaaatt

SEQ ID NO: 14829 - DNA, 25 bp, E. coli
ggtgcagtagcggtgaagtcctatc

SEQ ID NO: 14830 - DNA, 25 bp, E. coli
ggtgcagtagcgctgaagtcctatc

SEQ ID NO: 14831 - DNA, 25 bp, E. coli
ggataacgctcacaaaggtgaaatt

SEQ ID NO: 14832 - DNA, 25 bp, E. coli
ggatgaacttgcgaaagatccacgt

SEQ ID NO: 14833 - DNA, 25 bp, E. coli
ggatgaacttgccaaagatccacgt

SEQ ID NO: 14834 - DNA, 25 bp, E. coli
tcagactgtggaagctgcgctgaaa

SEQ ID NO: 14835 - DNA, 25 bp, E. coli
taacgctcagaatggtgaaattatg

SEQ ID NO: 14836 - DNA, 25 bp, E. coli
taacgctcagaaaggtgaaattatg

SEQ ID NO: 14837 - DNA, 25 bp, E. coli
aagtggtaaacggttcgctggagat

SEQ ID NO: 14838 - DNA, 25 bp, E. coli
aagtggtaaacgcttcgctggagat

SEQ ID NO: 14839 - DNA, 25 bp, E. coli
cagacaacctcgttaaattcttcac

SEQ ID NO: 14840 - DNA, 25 bp, E. coli
cagtatgaagagcaacagctggcgc

SEQ ID NO: 14841 - DNA, 25 bp, E. coli
cagatgcagcagaatgaagaggaac

SEQ ID NO: 14842 - DNA, 25 bp, E. coli
cagatgcagcagtatgaagaggaac

SEQ ID NO: 14843 - DNA, 25 bp, E. coli
cagtatgaagaggaacagctggcgc

SEQ ID NO: 14844 - DNA, 25 bp, E. coli
cagacaacctcgataaattcttcac

SEQ ID NO: 14845 - DNA, 25 bp, E. coli
acctgcgctgcgagctgccgcataa

SEQ ID NO: 14846 - DNA, 25 bp, E. coli
acctgcgctgcgtgctgccgcataa

SEQ ID NO: 14847 - DNA, 25 bp, E. coli
aacagctggcgcttgccgcacgctg

SEQ ID NO: 14848 - DNA, 25 bp, E. coli
aacagctggcgcatgccgcacgctg

SEQ ID NO: 14849 - DNA, 25 bp, E. coli
tgaagaggaacacctggcgcttgcc

SEQ ID NO: 14850 - DNA, 25 bp, E. coli
tgaagaggaacagctggcgcttgcc

SEQ ID NO: 14851 - DNA, 25 bp, E. coli
ccagcctgctggatgcggcgttccg

SEQ ID NO: 14852 - DNA, 25 bp, E. coli
ccagcctgctggttgcggcgttccg

SEQ ID NO: 14853 - DNA, 25 bp, E. coli
gctgcatacagacaacctcgataaa

SEQ ID NO: 14854 - DNA, 25 bp, E. coli
gctgcatacagagaacctcgataaa

SEQ ID NO: 14855 - DNA, 25 bp, E. coli
gattgagctgcaaacagacaacctc

SEQ ID NO: 14856 - DNA, 25 bp, E. coli
gattgagctgcatacagacaacctc

SEQ ID NO: 14857 - DNA, 25 bp, E. coli
tggatgcggcgttccgcgtcgccga

SEQ ID NO: 14858 - DNA, 25 bp, E. coli
tggatgcggcgtaccgcgtcgccga

SEQ ID NO: 14859 - DNA, 25 bp, E. coli
catggcggtttaacacgaaggcacc

SEQ ID NO: 14860 - DNA, 25 bp, E. coli
catggcggtttatcacgaaggcacc

SEQ ID NO: 14861 - DNA, 25 bp, E. coli
aaatatcggtttagcggctgcctgg

SEQ ID NO: 14862 - DNA, 25 bp, E. coli
aaatatcggttttgcggctgcctgg

SEQ ID NO: 14863 - DNA, 25 bp, E. coli
tattaacgttgaagggcattccccg

SEQ ID NO: 14864 - DNA, 25 bp, E. coli
tattaacgttgatgggcattccccg

SEQ ID NO: 14865 - DNA, 25 bp, E. coli
tgaataaactcgacggcatggcggt

SEQ ID NO: 14866 - DNA, 25 bp, E. coli
tgaataaactcgtcggcatggcggt

SEQ ID NO: 14867 - DNA, 25 bp, E. coli
tccacatcactaaagaggccggcgt

SEQ ID NO: 14868 - DNA, 25 bp, E. coli
tccacatcactatagaggccggcgt

SEQ ID NO: 14869 - DNA, 25 bp, E. coli
tcagcgtgatcaacatgggcgacct

SEQ ID NO: 14870 - DNA, 25 bp, E. coli
tcagcgtgatcatcatgggcgacct

SEQ ID NO: 14871 - DNA, 25 bp, E. coli
gaaggcaccgcctttaatgaccaga

SEQ ID NO: 14872 - DNA, 25 bp, E. coli
gaaggcaccgccattaatgaccaga

SEQ ID NO: 14873 - DNA, 25 bp, E. coli
cgaaaattgtcgctgacggtgccac

SEQ ID NO: 14874 - DNA, 25 bp, E. coli
cgaaaattgtcggtgacggtgccac

SEQ ID NO: 14875 - DNA, 25 bp, E. coli
gattactgtctagaacgccggtgcg

SEQ ID NO: 14876 - DNA, 25 bp, E. coli
gattactgtctacaacgccggtgcg

SEQ ID NO: 14877 - DNA, 25 bp, E. coli
taataccaagctaaacactgcgggc

SEQ ID NO: 14878 - DNA, 25 bp, E. coli
taataccaagcttaacactgcgggc

SEQ ID NO: 14879 - DNA, 25 bp, E. coli
gatgggagctactccttaacggcgc

SEQ ID NO: 14880 - DNA, 25 bp, E. coli
gatgggagctacaccttaacggcgc

SEQ ID NO: 14881 - DNA, 25 bp, E. coli
caacatttcgcagggcaagcaggcg

SEQ ID NO: 14882 - DNA, 25 bp, E. coli
caacatttcgcacggcaagcaggcg

SEQ ID NO: 14883 - DNA, 25 bp, E. coli
tacgatccttttccgatggcggcac

SEQ ID NO: 14884 - DNA, 25 bp, E. coli
tacgatccttttgcgatggcggcac

SEQ ID NO: 14885 - DNA, 25 bp, E. coli
gaagaaatacgccaggtgtccgatc

SEQ ID NO: 14886 - DNA, 25 bp, E. coli
gaagaaatacgcgaggtgtccgatc

SEQ ID NO: 14887 - DNA, 25 bp, E. coli
cgtggaggaaaaccgctatcagctt

SEQ ID NO: 14888 - DNA, 25 bp, E. coli
cgtggaggaaaagcgctatcagctt

SEQ ID NO: 14889 - DNA, 25 bp, E. coli
gattatctgcaacgcaacgcccggt

SEQ ID NO: 14890 - DNA, 25 bp, E. coli
gattcaggcgtactgcaaaccgggt

SEQ ID NO: 14891 - DNA, 25 bp, E. coli
gattatctgcaaggcaacgcccggt

SEQ ID NO: 14892 - DNA, 25 bp, E. coli
gattcaggcgtagtgcaaaccgggt

SEQ ID NO: 14893 - DNA, 25 bp, E. coli
tggaagatgatgtccccggaatcgt

SEQ ID NO: 14894 - DNA, 25 bp, E. coli
tggatcacgttgtcctacggcacgg

SEQ ID NO: 14895 - DNA, 25 bp, E. coli
tggtcatagaagacggcagccacta

SEQ ID NO: 14896 - DNA, 25 bp, E. coli
tggtcatagaagtcggcagccacta

SEQ ID NO: 14897 - DNA, 25 bp, E. coli
tggatcacgttgacctacggcacgg

SEQ ID NO: 14898 - DNA, 25 bp, E. coli
tggaagatgatgaccccggaatcgt

SEQ ID NO: 14899 - DNA, 25 bp, E. coli
tcaacgctacggcacgattctggtg

SEQ ID NO: 14900 - DNA, 25 bp, E. coli
taagtgccgtaattgggaccatgcc

SEQ ID NO: 14901 - DNA, 25 bp, E. coli
tcaacgctacgggacgattctggtg

SEQ ID NO: 14902 - DNA, 25 bp, E. coli
taagtgccgtaaatgggaccatgcc

SEQ ID NO: 14903 - DNA, 25 bp, E. coli
catttatcagatcgttaggtggcta

SEQ ID NO: 14904 - DNA, 25 bp, E. coli
catttatcagatggttaggtggcta

SEQ ID NO: 14905 - DNA, 25 bp, E. coli
tatcggcatttatcagatcgttagg

SEQ ID NO: 14906 - DNA, 25 bp, E. coli
tatcggcatttaacagatcgttagg

SEQ ID NO: 14907 - DNA, 25 bp, E. coli
ttttttgtagcctgagatttacgcc

SEQ ID NO: 14908 - DNA, 25 bp, E. coli
ttttttgtagccagagatttacgcc

SEQ ID NO: 14909 - DNA, 25 bp, E. coli
tgtagccagagatttacgccttcgc

SEQ ID NO: 14910 - DNA, 25 bp, E. coli
tgtagccagagaattacgccttcgc

SEQ ID NO: 14911 - DNA, 25 bp, E. coli
tgccgttgccttatttgtagccaga

SEQ ID NO: 14912 - DNA, 25 bp, E. coli
tcgttaggtggctataagtcacgct

SEQ ID NO: 14913 - DNA, 25 bp, E. coli
tgccgttgccttttttgtagccaga

SEQ ID NO: 14914 - DNA, 25 bp, E. coli
tcgttaggtggcaataagtcacgct

SEQ ID NO: 14915 - DNA, 25 bp, E. coli
tcagatcgttaggtggctataagtc

SEQ ID NO: 14916 - DNA, 25 bp, E. coli
gccagagatttacgccttcgcagaa

SEQ ID NO: 14917 - DNA, 25 bp, E. coli
gccagagatttaggccttcgcagaa

SEQ ID NO: 14918 - DNA, 25 bp, E. coli
cgttgccttttttgtagccagagat

SEQ ID NO: 14919 - DNA, 25 bp, E. coli
cgttgcctttttagtagccagagat

SEQ ID NO: 14920 - DNA, 25 bp, E. coli
gttaggtggctataagtcacgctaa

SEQ ID NO: 14921 - DNA, 25 bp, E. coli
gttaggtggctaaaagtcacgctaa

SEQ ID NO: 14922 - DNA, 25 bp, E. coli
tcagatcgttagctggctataagtc

SEQ ID NO: 14923 - DNA, 25 bp, E. coli
gagtggtaagagttatatcggcatt

SEQ ID NO: 14924 - DNA, 25 bp, E. coli
gagtggtaagagatatatcggcatt

SEQ ID NO: 14925 - DNA, 25 bp, E. coli
caaaagtgtctaaaatcacggcaga

SEQ ID NO: 14926 - DNA, 25 bp, E. coli
caaaagtgtctataatcacggcaga

SEQ ID NO: 14927 - DNA, 25 bp, E. coli
cacggcagaaaactccacattgatt

SEQ ID NO: 14928 - DNA, 25 bp, E. coli
cacggcagaaaagtccacattgatt

SEQ ID NO: 14929 - DNA, 25 bp, E. coli
tgcatcagacatagccgtcactgcg

SEQ ID NO: 14930 - DNA, 25 bp, E. coli
tgcatcagacattgccgtcactgcg

SEQ ID NO: 14931 - DNA, 25 bp, E. coli
gacgctttttatggcaactctctac

SEQ ID NO: 14932 - DNA, 25 bp, E. coli
gacgctttttatcgcaactctctac

SEQ ID NO: 14933 - DNA, 25 bp, E. coli
cattcagagaagtaaccaattgtcc

SEQ ID NO: 14934 - DNA, 25 bp, E. coli
cgtcactgcgtcatttactggctct

SEQ ID NO: 14935 - DNA, 25 bp, E. coli
cattcagagaagaaaccaattgtcc

SEQ ID NO: 14936 - DNA, 25 bp, E. coli
cattgattatttccacggcgtcaca

SEQ ID NO: 14937 - DNA, 25 bp, E. coli
cattctgtaacaaagcgggaccaaa

SEQ ID NO: 14938 - DNA, 25 bp, E. coli
cattctgtaacatagcgggaccaaa

SEQ ID NO: 14939 - DNA, 25 bp, E. coli
cgtcactgcgtcttttactggctct

SEQ ID NO: 14940 - DNA, 25 bp, E. coli
cattgattatttgcacggcgtcaca

SEQ ID NO: 14941 - DNA, 25 bp, E. coli
ggaccaaagccaagacaaaaacgcg

SEQ ID NO: 14942 - DNA, 25 bp, E. coli
ggaccaaagccatgacaaaaacgcg

SEQ ID NO: 14943 - DNA, 25 bp, E. coli
ggcgtcacacttagctatgccatag

SEQ ID NO: 14944 - DNA, 25 bp, E. coli
ggcgtcacactttgctatgccatag

SEQ ID NO: 14945 - DNA, 25 bp, E. coli
taagattagcggatcctacctgacg

SEQ ID NO: 14946 - DNA, 25 bp, E. coli
taagattagcggttcctacctgacg

SEQ ID NO: 14947 - DNA, 25 bp, E. coli
gaagttactcgcaggaattttgtga

SEQ ID NO: 14948 - DNA, 25 bp, E. coli
gaagttactcgctggaattttgtga

SEQ ID NO: 14949 - DNA, 25 bp, E. coli
actggttctctgtagacgccaccga

SEQ ID NO: 14950 - DNA, 25 bp, E. coli
actggttctctgaagacgccaccga

SEQ ID NO: 14951 - DNA, 25 bp, E. coli
tgtcggtgctgatcccttctgaaga

SEQ ID NO: 14952 - DNA, 25 bp, E. coli
tgtcggtgctgaacccttctgaaga

SEQ ID NO: 14953 - DNA, 25 bp, E. coli
tccaatgacacaagactatgaactg

SEQ ID NO: 14954 - DNA, 25 bp, E. coli
tccaatgacacatgactatgaactg

SEQ ID NO: 14955 - DNA, 25 bp, E. coli
gccagaatgagattcagacaggtat

SEQ ID NO: 14956 - DNA, 25 bp, E. coli
gccagaatgagaatcagacaggtat

SEQ ID NO: 14957 - DNA, 25 bp, E. coli
gccaccgacggctttgcggtcagaa

SEQ ID NO: 14958 - DNA, 25 bp, E. coli
gccaccgacggcattgcggtcagaa

SEQ ID NO: 14959 - DNA, 25 bp, E. coli
gcgagaagagagaaatccaatgaca

SEQ ID NO: 14960 - DNA, 25 bp, E. coli
gcgagaagagagtaatccaatgaca

SEQ ID NO: 14961 - DNA, 25 bp, E. coli
gaaaaagatgattttgaatcgccca

SEQ ID NO: 14962 - DNA, 25 bp, E. coli
gaaaaagatgatattgaatcgccca

SEQ ID NO: 14963 - DNA, 25 bp, E. coli
cgatgagcagttagcggcgttttac

SEQ ID NO: 14964 - DNA, 25 bp, E. coli
cgatgagcagtttgcggcgttttac

SEQ ID NO: 14965 - DNA, 25 bp, E. coli
cattgaaaaactggagggcagcgtc

SEQ ID NO: 14966 - DNA, 25 bp, E. coli
cattgaaaaactcgagggcagcgtc

SEQ ID NO: 14967 - DNA, 25 bp, E. coli
ggcagcgtcgctcatctgaataaaa

SEQ ID NO: 14968 - DNA, 25 bp, E. coli
ggcagcgtcgctgatctgaataaaa

SEQ ID NO: 14969 - DNA, 25 bp, E. coli
aagcatgggcgccattatacccaaa

SEQ ID NO: 14970 - DNA, 25 bp, E. coli
aagcatgggcgcgattatacccaaa

SEQ ID NO: 14971 - DNA, 25 bp, E. coli
cggttccctggcgaaaaagcatggg

SEQ ID NO: 14972 - DNA, 25 bp, E. coli
cggttccctggccaaaaagcatggg

SEQ ID NO: 14973 - DNA, 25 bp, E. coli
cagatgtgccatatgcttttttctg

SEQ ID NO: 14974 - DNA, 25 bp, E. coli
cagatgtgccatttgcttttttctg

SEQ ID NO: 14975 - DNA, 25 bp, E. coli
tacccaaacagatgtgccatttgct

SEQ ID NO: 14976 - DNA, 25 bp, E. coli
tacccaaacagaagtgccatttgct

SEQ ID NO: 14977 - DNA, 25 bp, E. coli
gccacggaaatctataacctgaaga

SEQ ID NO: 14978 - DNA, 25 bp, E. coli
cctgaagatatgtgcgacgagcttt

SEQ ID NO: 14979 - DNA, 25 bp, E. coli
cctggcgaaaaagcatgggcgcgat

SEQ ID NO: 14980 - DNA, 25 bp, E. coli
gccacggaaatcaataacctgaaga

SEQ ID NO: 14981 - DNA, 25 bp, E. coli
cctgaagatatgagcgacgagcttt

SEQ ID NO: 14982 - DNA, 25 bp, E. coli
cctggcgaaaaaccatgggcgcgat

SEQ ID NO: 14983 - DNA, 25 bp, E. coli
cgattatacccaaacagatgtgcca

SEQ ID NO: 14984 - DNA, 25 bp, E. coli
cgattatacccatacagatgtgcca

SEQ ID NO: 14985 - DNA, 25 bp, E. coli
gatatgtgcgaccagcttttcataa

SEQ ID NO: 14986 - DNA, 25 bp, E. coli
gatatgtgcgacgagcttttcataa

SEQ ID NO: 14987 - DNA, 25 bp, E. coli
ggcgcgattatagccaaacagatgt

SEQ ID NO: 14988 - DNA, 25 bp, E. coli
ggcgcgattatacccaaacagatgt

SEQ ID NO: 14989 - DNA, 25 bp, E. coli
taacctgaagatttgtgcgacgagc

SEQ ID NO: 14990 - DNA, 25 bp, E. coli
taacctgaagatatgtgcgacgagc

SEQ ID NO: 14991 - DNA, 25 bp, E. coli
tacatcgcggttacgcattcattgc

SEQ ID NO: 14992 - DNA, 25 bp, E. coli
tacatcgcggtttcgcattcattgc

SEQ ID NO: 14993 - DNA, 25 bp, E. coli
acatcgcggtttcgcattcattgcc

SEQ ID NO: 14994 - DNA, 25 bp, E. coli
acatcgcggtttggcattcattgcc

SEQ ID NO: 14995 - DNA, 25 bp, E. coli
ttggccctgaccgaaacggccaatt

SEQ ID NO: 14996 - DNA, 25 bp, E. coli
ttggccctgacccaaacggccaatt

SEQ ID NO: 14997 - DNA, 25 bp, E. coli
tgtcgttatttacatcgcggtttcg

SEQ ID NO: 14998 - DNA, 25 bp, E. coli
tgtcgttatttagatcgcggtttcg

SEQ ID NO: 14999 - DNA, 25 bp, E. coli
tcgcggtttcgcattcattgcctga

SEQ ID NO: 15000 - DNA, 25 bp, E. coli
tcgcggtttcgctttcattgcctga

SEQ ID NO: 15001 - DNA, 25 bp, E. coli
gccctgaccgaaacggccaattttg

SEQ ID NO: 15002 - DNA, 25 bp, E. coli
gccctgaccgaatcggccaattttg

SEQ ID NO: 15003 - DNA, 25 bp, E. coli
cgttatttacatcgcggtttcgcat

SEQ ID NO: 15004 - DNA, 25 bp, E. coli
cgttatttacatggcggtttcgcat

SEQ ID NO: 15005 - DNA, 25 bp, E. coli
gtcgttatttacatcgcggtttcgc

SEQ ID NO: 15006 - DNA, 25 bp, E. coli
gtttttgtcgttttttacatcgcgg

SEQ ID NO: 15007 - DNA, 25 bp, E. coli
gtttttgtcgttatttacatcgcgg

SEQ ID NO: 15008 - DNA, 25 bp, E. coli
gtcgttatttacttcgcggtttcgc

SEQ ID NO: 15009 - DNA, 25 bp, E. coli
ggtttcgcattcattgcctgatgcg

SEQ ID NO: 15010 - DNA, 25 bp, E. coli
ggtttcgcattctttgcctgatgcg

SEQ ID NO: 15011 - DNA, 25 bp, E. coli
tcgttatttacatcgcggtttcgca

SEQ ID NO: 15012 - DNA, 25 bp, E. coli
tcgttatttacaacgcggtttcgca

SEQ ID NO: 15013 - DNA, 25 bp, E. coli
aataaattggtatctgaagcatcag

SEQ ID NO: 15014 - DNA, 25 bp, E. coli
aataaattggtaactgaagcatcag

SEQ ID NO: 15015 - DNA, 25 bp, E. coli
tataaaaaatatatcgaagggccgt

SEQ ID NO: 15016 - DNA, 25 bp, E. coli
tataaaaaatatttcgaagggccgt

SEQ ID NO: 15017 - DNA, 25 bp, E. coli
tatgctgcatctttaatttatggac

SEQ ID NO: 15018 - DNA, 25 bp, E. coli
tatgctgcatctataatttatggac

SEQ ID NO: 15019 - DNA, 25 bp, E. coli
taccagaaggtacttggcatacctg

SEQ ID NO: 15020 - DNA, 25 bp, E. coli
taccagaaggtagttggcatacctg

SEQ ID NO: 15021 - DNA, 25 bp, E. coli
tatgaagatctcaactgtttcccga

SEQ ID NO: 15022 - DNA, 25 bp, E. coli
tatgaagatctctactgtttcccga

SEQ ID NO: 15023 - DNA, 25 bp, E. coli
tcgaagggccgtatgaagatctcta

SEQ ID NO: 15024 - DNA, 25 bp, E. coli
tcgaagggccgtttgaagatctcta

SEQ ID NO: 15025 - DNA, 25 bp, E. coli
tctttctggtcgttgatcatctgcc

SEQ ID NO: 15026 - DNA, 25 bp, E. coli
tctataatttatcgacattgcgtcc

SEQ ID NO: 15027 - DNA, 25 bp, E. coli
tctataatttatggacattgcgtcc

SEQ ID NO: 15028 - DNA, 25 bp, E. coli
tctttctggtcgatgatcatctgcc

SEQ ID NO: 15029 - DNA, 25 bp, E. coli
gacattgcgtcctgtacagattttg

SEQ ID NO: 15030 - DNA, 25 bp, E. coli
gacattgcgtccagtacagattttg

SEQ ID NO: 15031 - DNA, 25 bp, E. coli
gatatcggtaatcgcttcactgact

SEQ ID NO: 15032 - DNA, 25 bp, E. coli
gatatcggtaatggcttcactgact

SEQ ID NO: 15033 - DNA, 25 bp, E. coli
gatgctggcaatacagtctttctgg

SEQ ID NO: 15034 - DNA, 25 bp, E. coli
gatgctggcaattcagtctttctgg

SEQ ID NO: 15035 - DNA, 25 bp, E. coli
actcccgttgcgaagtgatttctgg

SEQ ID NO: 15036 - DNA, 25 bp, E. coli
actcccgttgcgtagtgatttctgg

SEQ ID NO: 15037 - DNA, 25 bp, E. coli
tatgctcagccgcatgatgtgcgat

SEQ ID NO: 15038 - DNA, 25 bp, E. coli
tatgctcagccggatgatgtgcgat

SEQ ID NO: 15039 - DNA, 25 bp, E. coli
tattaagccacaaacactcccgttg

SEQ ID NO: 15040 - DNA, 25 bp, E. coli
tattaagccacatacactcccgttg

SEQ ID NO: 15041 - DNA, 25 bp, E. coli
ttaaccgatatagccggagcgccac

SEQ ID NO: 15042 - DNA, 25 bp, E. coli
ttaaccgatatacccggagcgccac

SEQ ID NO: 15043 - DNA, 25 bp, E. coli
tgaccgggcgcatgagatactggat

SEQ ID NO: 15044 - DNA, 25 bp, E. coli
tgaccgggcgcaagagatactggat

SEQ ID NO: 15045 - DNA, 25 bp, E. coli
tccgcctttcgtcctcaaacataat

SEQ ID NO: 15046 - DNA, 25 bp, E. coli
tccgcctttcgtgctcaaacataat

SEQ ID NO: 15047 - DNA, 25 bp, E. coli
gatttctggtgtgacgttaccgtta

SEQ ID NO: 15048 - DNA, 25 bp, E. coli
gccgtgaatttctggcgcggattaa

SEQ ID NO: 15049 - DNA, 25 bp, E. coli
gatttctggtgtcacgttaccgtta

SEQ ID NO: 15050 - DNA, 25 bp, E. coli
gccgtgaatttcaggcgcggattaa

SEQ ID NO: 15051 - DNA, 25 bp, E. coli
ggcttgccgtgataccatgaccagt

SEQ ID NO: 15052 - DNA, 25 bp, E. coli
ggcttgccgtgaaaccatgaccagt

SEQ ID NO: 15053 - DNA, 25 bp, E. coli
taattacctgtctcgatgaccgggc

SEQ ID NO: 15054 - DNA, 25 bp, E. coli
taattacctgtcacgatgaccgggc

SEQ ID NO: 15055 - DNA, 25 bp, E. coli
taattgaacagaagatggcttgccg

SEQ ID NO: 15056 - DNA, 25 bp, E. coli
taattgaacagatgatggcttgccg

SEQ ID NO: 15057 - DNA, 25 bp, E. coli
tacgggaaaggttcactggacggca

SEQ ID NO: 15058 - DNA, 25 bp, E. coli
aaaaactgggagtggagccgctact

SEQ ID NO: 15059 - DNA, 25 bp, E. coli
aaaaactgggagaggagccgctact

SEQ ID NO: 15060 - DNA, 25 bp, E. coli
tacgggaaaggtacactggacggca

SEQ ID NO: 15061 - DNA, 25 bp, E. coli
tataacggcaactacggcagcggtt

SEQ ID NO: 15062 - DNA, 25 bp, E. coli
tataacggcaacaacggcagcggtt

SEQ ID NO: 15063 - DNA, 25 bp, E. coli
tatatcgacctatacaacctgccgg

SEQ ID NO: 15064 - DNA, 25 bp, E. coli
tatatcgacctaaacaacctgccgg

SEQ ID NO: 15065 - DNA, 25 bp, E. coli
tctggataaagagaccgcctacggg

SEQ ID NO: 15066 - DNA, 25 bp, E. coli
tctggataaagacaccgcctacggg

SEQ ID NO: 15067 - DNA, 25 bp, E. coli
gctataaactgatgatgggccgccc

SEQ ID NO: 15068 - DNA, 25 bp, E. coli
gctataaactgaagatgggccgccc

SEQ ID NO: 15069 - DNA, 25 bp, E. coli
gacggttattacagccacgacggat

SEQ ID NO: 15070 - DNA, 25 bp, E. coli
gacttcgatgaagtgaacagccgcg

SEQ ID NO: 15071 - DNA, 25 bp, E. coli
gacttcgatgaactgaacagccgcg

SEQ ID NO: 15072 - DNA, 25 bp, E. coli
gacggttattactgccacgacggat

SEQ ID NO: 15073 - DNA, 25 bp, E. coli
gtatttccttactgggcggcgcgac

SEQ ID NO: 15074 - DNA, 25 bp, E. coli
gatatttactggaacgcctctgaga

SEQ ID NO: 15075 - DNA, 25 bp, E. coli
gtatttccttacagggcggcgcgac

SEQ ID NO: 15076 - DNA, 25 bp, E. coli
gatatttactggtacgcctctgaga

SEQ ID NO: 15077 - DNA, 25 bp, E. coli
taagttctcggtcatcagcgggcaa

SEQ ID NO: 15078 - DNA, 25 bp, E. coli
taagttctcggtgatcagcgggcaa

SEQ ID NO: 15079 - DNA, 25 bp, E. coli
aagattttccccattcgccagtgcg

SEQ ID NO: 15080 - DNA, 25 bp, E. coli
aagattttcccctttcgccagtgcg

SEQ ID NO: 15081 - DNA, 25 bp, E. coli
tacggttatctatgtcggcaaagcg

SEQ ID NO: 15082 - DNA, 25 bp, E. coli
tacggttatctaagtcggcaaagcg

SEQ ID NO: 15083 - DNA, 25 bp, E. coli
tacgtgaaacactggcgctactgca

SEQ ID NO: 15084 - DNA, 25 bp, E. coli
tacgtgaaacacaggcgctactgca

SEQ ID NO: 15085 - DNA, 25 bp, E. coli
tatttacaaggctgccagatgcgca

SEQ ID NO: 15086 - DNA, 25 bp, E. coli
tatttcccgaaagtgcctggcggta

SEQ ID NO: 15087 - DNA, 25 bp, E. coli
tatttcccgaaactgcctggcggta

SEQ ID NO: 15088 - DNA, 25 bp, E. coli
tatttacaaggcagccagatgcgca

SEQ ID NO: 15089 - DNA, 25 bp, E. coli
tggtgtttgatgctaacggcccgct

SEQ ID NO: 15090 - DNA, 25 bp, E. coli
tggtgtttgatggtaacggcccgct

SEQ ID NO: 15091 - DNA, 25 bp, E. coli
tgaagaagaatacgctcagcaggtc

SEQ ID NO: 15092 - DNA, 25 bp, E. coli
tgaagaagaataggctcagcaggtc

SEQ ID NO: 15093 - DNA, 25 bp, E. coli
gaaacgctgttcattgagccggaag

SEQ ID NO: 15094 - DNA, 25 bp, E. coli
gaaacgctgttctttgagccggaag

SEQ ID NO: 15095 - DNA, 25 bp, E. coli
ccctttcagaacaggcgggacgcaa

SEQ ID NO: 15096 - DNA, 25 bp, E. coli
ccctttcagaactggcgggacgcaa

SEQ ID NO: 15097 - DNA, 25 bp, E. coli
tggaaaccattgaaggcgtcgggcc

SEQ ID NO: 15098 - DNA, 25 bp, E. coli
tggaaaccattgtaggcgtcgggcc

SEQ ID NO: 15099 - DNA, 25 bp, E. coli
taacgccagcgtcgaggaaattgca

SEQ ID NO: 15100 - DNA, 25 bp, E. coli
taacgccagcgtggaggaaattgca

SEQ ID NO: 15101 - DNA, 25 bp, E. coli
aatgccagcaaggtttacgcacacg

SEQ ID NO: 15102 - DNA, 25 bp, E. coli
aatgccagcaagctttacgcacacg

SEQ ID NO: 15103 - DNA, 25 bp, E. coli
cattctgttactccggatggtgacc

SEQ ID NO: 15104 - DNA, 25 bp, E. coli
cattctgttactgcggatggtgacc

SEQ ID NO: 15105 - DNA, 25 bp, E. coli
ttcggcgcagcgctaattttgacta

SEQ ID NO: 15106 - DNA, 25 bp, E. coli
ttcggcgcagcggtaattttgacta

SEQ ID NO: 15107 - DNA, 25 bp, E. coli
tggtgattaccatcgttgcccgcaa

SEQ ID NO: 15108 - DNA, 25 bp, E. coli
tcgcttttactaagggaccggctgc

SEQ ID NO: 15109 - DNA, 25 bp, E. coli
tccggaattatgtcgctggcaagta

SEQ ID NO: 15110 - DNA, 25 bp, E. coli
tccggaattatgacgctggcaagta

SEQ ID NO: 15111 - DNA, 25 bp, E. coli
tcgcttttactatgggaccggctgc

SEQ ID NO: 15112 - DNA, 25 bp, E. coli
tctggcaaatgaccaaacagggcga

SEQ ID NO: 15113 - DNA, 25 bp, E. coli
tcaggcaaaaatacgtgacgggcgc

SEQ ID NO: 15114 - DNA, 25 bp, E. coli
tcaggcaaaaattcgtgacgggcgc

SEQ ID NO: 15115 - DNA, 25 bp, E. coli
tctggcaaatgagcaaacagggcga

SEQ ID NO: 15116 - DNA, 25 bp, E. coli
gcgtcgccgtcatagtctgcaaaaa

SEQ ID NO: 15117 - DNA, 25 bp, E. coli
gcgtcgccgtcaaagtctgcaaaaa

SEQ ID NO: 15118 - DNA, 25 bp, E. coli
ccgctacgcgtagggacgagaaact

SEQ ID NO: 15119 - DNA, 25 bp, E. coli
ccgctacgcgtacggacgagaaact

SEQ ID NO: 15120 - DNA, 25 bp, E. coli
ctgcaaaaatgcagggcggcgctgt

SEQ ID NO: 15121 - DNA, 25 bp, E. coli
ctgcaaaaatgctgggcggcgctgt

SEQ ID NO: 15122 - DNA, 25 bp, E. coli
tggtgattaccaacgttgcccgcaa

SEQ ID NO: 15123 - DNA, 25 bp, E. coli
aataaagcgaaaccgtccagcgaga

SEQ ID NO: 15124 - DNA, 25 bp, E. coli
aatgccgttgaacaaagtggtgcag

SEQ ID NO: 15125 - DNA, 25 bp, E. coli
aatgccgttgaagaaagtggtgcag

SEQ ID NO: 15126 - DNA, 25 bp, E. coli
aataaagcgaaagcgtccagcgaga

SEQ ID NO: 15127 - DNA, 25 bp, E. coli
tagccctggcggcagcctgatcatc

SEQ ID NO: 15128 - DNA, 25 bp, E. coli
tagccctggcgggagcctgatcatc

SEQ ID NO: 15129 - DNA, 25 bp, E. coli
ttgaacaaagtggtgcagccagcgt

SEQ ID NO: 15130 - DNA, 25 bp, E. coli
ttgaacaaagtgctgcagccagcgt

SEQ ID NO: 15131 - DNA, 25 bp, E. coli
tcctgtttcttacggcgtggaggaa

SEQ ID NO: 15132 - DNA, 25 bp, E. coli
tcctgtttcttagggcgtggaggaa

SEQ ID NO: 15133 - DNA, 25 bp, E. coli
ccattattcggtggtggataaagac

SEQ ID NO: 15134 - DNA, 25 bp, E. coli
ccattattcggtcgtggataaagac

SEQ ID NO: 15135 - DNA, 25 bp, E. coli
gcgaaaccgtccagcgagattcgcc

SEQ ID NO: 15136 - DNA, 25 bp, E. coli
gcgaaaccgtcctgcgagattcgcc

SEQ ID NO: 15137 - DNA, 25 bp, E. coli
ccggtacggtcggtggtttctcgct

SEQ ID NO: 15138 - DNA, 25 bp, E. coli
ccggtacggtcgctggtttctcgct

SEQ ID NO: 15139 - DNA, 25 bp, E. coli
ctgcgccgtctcctgtttcttacgg

SEQ ID NO: 15140 - DNA, 25 bp, E. coli
ctgcgccgtctcgtgtttcttacgg

SEQ ID NO: 15141 - DNA, 25 bp, E. coli
cggtcgctggttactcgctggcgtt

SEQ ID NO: 15142 - DNA, 25 bp, E. coli
cggtcgctggtttctcgctggcgtt

SEQ ID NO: 15143 - DNA, 25 bp, E. coli
tggcgggagcctgatcatcactaca

SEQ ID NO: 15144 - DNA, 25 bp, E. coli
tggcgggagcctcatcatcactaca

SEQ ID NO: 15145 - DNA, 25 bp, E. coli
cacaaaagccttacaaatatgggat

SEQ ID NO: 15146 - DNA, 25 bp, E. coli
cacaaaagcctttcaaatatgggat

SEQ ID NO: 15147 - DNA, 25 bp, E. coli
acaggccccgatccacttttattgg

SEQ ID NO: 15148 - DNA, 25 bp, E. coli
acaggccccgatgcacttttattgg

SEQ ID NO: 15149 - DNA, 25 bp, E. coli
actgcgaagaggtttgaagcatggc

SEQ ID NO: 15150 - DNA, 25 bp, E. coli
aaaccctcattatccgcacaggtcg

SEQ ID NO: 15151 - DNA, 25 bp, E. coli
actgcgaagaggattgaagcatggc

SEQ ID NO: 15152 - DNA, 25 bp, E. coli
aaaccctcattaaccgcacaggtcg

SEQ ID NO: 15153 - DNA, 25 bp, E. coli
tagttcattatctagttcgggagct

SEQ ID NO: 15154 - DNA, 25 bp, E. coli
tatcgtgtatttcgaacaggccccg

SEQ ID NO: 15155 - DNA, 25 bp, E. coli
tatgggatacatatggagcgccagg

SEQ ID NO: 15156 - DNA, 25 bp, E. coli
tagtgcagaagatttagtctcagac

SEQ ID NO: 15157 - DNA, 25 bp, E. coli
tagttcattatcaagttcgggagct

SEQ ID NO: 15158 - DNA, 25 bp, E. coli
tagtgcagaagaattagtctcagac

SEQ ID NO: 15159 - DNA, 25 bp, E. coli
tatcgtgtatttggaacaggccccg

SEQ ID NO: 15160 - DNA, 25 bp, E. coli
tatgggatacatttggagcgccagg

SEQ ID NO: 15161 - DNA, 25 bp, E. coli
ttttaactggtatactgatagcgga

SEQ ID NO: 15162 - DNA, 25 bp, E. coli
ttttaactggtaaactgatagcgga

SEQ ID NO: 15163 - DNA, 25 bp, E. coli
tcagaatctccctttgaaagaccgc

SEQ ID NO: 15164 - DNA, 25 bp, E. coli
tcagaatctcccattgaaagaccgc

SEQ ID NO: 15165 - DNA, 25 bp, E. coli
taacgttaatgtttggaactgcgaa

SEQ ID NO: 15166 - DNA, 25 bp, E. coli
taacgttaatgtatggaactgcgaa

SEQ ID NO: 15167 - DNA, 25 bp, E. coli
taaaacaggtacatcaacacggcga

SEQ ID NO: 15168 - DNA, 25 bp, E. coli
taaaacaggtacttcaacacggcga

SEQ ID NO: 15169 - DNA, 25 bp, E. coli
aaagatgttccggtgcgtgaagccc

SEQ ID NO: 15170 - DNA, 25 bp, E. coli
aaacgggcgtcaacggcaatatggc

SEQ ID NO: 15171 - DNA, 25 bp, E. coli
aaacgggcgtcatcggcaatatggc

SEQ ID NO: 15172 - DNA, 25 bp, E. coli
aaagatgttccgctgcgtgaagccc

SEQ ID NO: 15173 - DNA, 25 bp, E. coli
tttggtcaccgatggcgttatcagc

SEQ ID NO: 15174 - DNA, 25 bp, E. coli
tttggtcaccgaaggcgttatcagc

SEQ ID NO: 15175 - DNA, 25 bp, E. coli
tgttcgccgaaaaactgaccacgct

SEQ ID NO: 15176 - DNA, 25 bp, E. coli
tgtctgaacaacgtgctggacgcca

SEQ ID NO: 15177 - DNA, 25 bp, E. coli
tgttcgccgaaatactgaccacgct

SEQ ID NO: 15178 - DNA, 25 bp, E. coli
tgtctgaacaacctgctggacgcca

SEQ ID NO: 15179 - DNA, 25 bp, E. coli
tgcataaggtagtctgcgcgcgtcc

SEQ ID NO: 15180 - DNA, 25 bp, E. coli
tgcataaggtagactgcgcgcgtcc

SEQ ID NO: 15181 - DNA, 25 bp, E. coli
gaatggacgcacatcaccagcatga

SEQ ID NO: 15182 - DNA, 25 bp, E. coli
gaatggacgcacttcaccagcatga

SEQ ID NO: 15183 - DNA, 25 bp, E. coli
gaaacgttggatggcgtcctgacaa

SEQ ID NO: 15184 - DNA, 25 bp, E. coli
gaaacgttggatcgcgtcctgacaa

SEQ ID NO: 15185 - DNA, 25 bp, E. coli
tcaaacatgatcagcgtgcgcgaat

SEQ ID NO: 15186 - DNA, 25 bp, E. coli
tatgaaagtttgtggcccgatgcct

SEQ ID NO: 15187 - DNA, 25 bp, E. coli
tatgaaagtttgaggcccgatgcct

SEQ ID NO: 15188 - DNA, 25 bp, E. coli
tcaaacatgatctgcgtgcgcgaat

SEQ ID NO: 15189 - DNA, 25 bp, E. coli
caatggttctgggtctgatctgggc

SEQ ID NO: 15190 - DNA, 25 bp, E. coli
caatggttctggctctgatctgggc

SEQ ID NO: 15191 - DNA, 25 bp, E. coli
agaaatccattaccccgactgtcgg

SEQ ID NO: 15192 - DNA, 25 bp, E. coli
agaaatccattagcccgactgtcgg

SEQ ID NO: 15193 - DNA, 25 bp, E. coli
tttggtatcgttacaggcctcacgg

SEQ ID NO: 15194 - DNA, 25 bp, E. coli
tatttgaaggtgaaggcgctggtac

SEQ ID NO: 15195 - DNA, 25 bp, E. coli
tttggtatcgtttcaggcctcacgg

SEQ ID NO: 15196 - DNA, 25 bp, E. coli
tatttgaaggtgtaggcgctggtac

SEQ ID NO: 15197 - DNA, 25 bp, E. coli
tgctggcaatcaacttcgacctggt

SEQ ID NO: 15198 - DNA, 25 bp, E. coli
tgctggcaatcatcttcgacctggt

SEQ ID NO: 15199 - DNA, 25 bp, E. coli
tcacggatggtcatgtgccgacagc

SEQ ID NO: 15200 - DNA, 25 bp, E. coli
gaagaaaccaaagatgcagagcgcg

SEQ ID NO: 15201 - DNA, 25 bp, E. coli
gaagaaaccaaacatgcagagcgcg

SEQ ID NO: 15202 - DNA, 25 bp, E. coli
gaaatcatgctgaacgttgcgggta

SEQ ID NO: 15203 - DNA, 25 bp, E. coli
gaaatcatgctgtacgttgcgggta

SEQ ID NO: 15204 - DNA, 25 bp, E. coli
cctgcgtagtctcaaatccgtagcg

SEQ ID NO: 15205 - DNA, 25 bp, E. coli
cgaaatggcgtactccggcgatgaa

SEQ ID NO: 15206 - DNA, 25 bp, E. coli
cctgcgtagtctgaaatccgtagcg

SEQ ID NO: 15207 - DNA, 25 bp, E. coli
cgaaatggcgtagtccggcgatgaa

SEQ ID NO: 15208 - DNA, 25 bp, E. coli
cattgattgcgatcctgtttacggc

SEQ ID NO: 15209 - DNA, 25 bp, E. coli
cattgattgcgaacctgtttacggc

SEQ ID NO: 15210 - DNA, 25 bp, E. coli
tcacggatggtcttgtgccgacagc

SEQ ID NO: 15211 - DNA, 25 bp, E. coli
tatatcgtcgcggaaatgggcatcg

SEQ ID NO: 15212 - DNA, 25 bp, E. coli
tatcacctgattgaagccaacgacg

SEQ ID NO: 15213 - DNA, 25 bp, E. coli
tatatcgtcgcgcaaatgggcatcg

SEQ ID NO: 15214 - DNA, 25 bp, E. coli
tatcacctgattcaagccaacgacg

SEQ ID NO: 15215 - DNA, 25 bp, E. coli
tttaccgaaacgtcagcagctgcac

SEQ ID NO: 15216 - DNA, 25 bp, E. coli
tttaccgaaacgacagcagctgcac

SEQ ID NO: 15217 - DNA, 25 bp, E. coli
tgggaaaatcctagaatgcgcggca

SEQ ID NO: 15218 - DNA, 25 bp, E. coli
tgatcccggcagacgttgacaaagc

SEQ ID NO: 15219 - DNA, 25 bp, E. coli
tgatcccggcagtcgttgacaaagc

SEQ ID NO: 15220 - DNA, 25 bp, E. coli
tgggaaaatccttgaatgcgcggca

SEQ ID NO: 15221 - DNA, 25 bp, E. coli
tccatattgaactggtgacgccaga

SEQ ID NO: 15222 - DNA, 25 bp, E. coli
tccttgatgtagatgcaccgaccca

SEQ ID NO: 15223 - DNA, 25 bp, E. coli
tccttgatgtagttgcaccgaccca

SEQ ID NO: 15224 - DNA, 25 bp, E. coli
tccatattgaacaggtgacgccaga

SEQ ID NO: 15225 - DNA, 25 bp, E. coli
gctatatgatcagcgcaggcgtgca

SEQ ID NO: 15226 - DNA, 25 bp, E. coli
gctatatgatcaccgcaggcgtgca

SEQ ID NO: 15227 - DNA, 25 bp, E. coli
gctttgatgaaggtctggcgctgca

SEQ ID NO: 15228 - DNA, 25 bp, E. coli
gctttgatgaagctctggcgctgca

SEQ ID NO: 15229 - DNA, 25 bp, E. coli
gaaacgccgtatcccctgaaactgg

SEQ ID NO: 15230 - DNA, 25 bp, E. coli
gaaacgccgtatgccctgaaactgg

SEQ ID NO: 15231 - DNA, 25 bp, E. coli
gataacggcaaaatcacggcgctgg

SEQ ID NO: 15232 - DNA, 25 bp, E. coli
gataacggcaaattcacggcgctgg

SEQ ID NO: 15233 - DNA, 25 bp, E. coli
cagaatatgtcgttgaagcaaccaa

SEQ ID NO: 15234 - DNA, 25 bp, E. coli
cagaatatgtcgatgaagcaaccaa

SEQ ID NO: 15235 - DNA, 25 bp, E. coli
tacccgaagcatcaagaggcaaatg

SEQ ID NO: 15236 - DNA, 25 bp, E. coli
tacccgaagcatgaagaggcaaatg

SEQ ID NO: 15237 - DNA, 25 bp, E. coli
tgattggacatagttacgacgctcg

SEQ ID NO: 15238 - DNA, 25 bp, E. coli
tgattggacatacttacgacgctcg

SEQ ID NO: 15239 - DNA, 25 bp, E. coli
tgacgaaaacgatcatacccgaagc

SEQ ID NO: 15240 - DNA, 25 bp, E. coli
tgacgaaaacgaacatacccgaagc

SEQ ID NO: 15241 - DNA, 25 bp, E. coli
tcagttgcctgcagagagatgtcct

SEQ ID NO: 15242 - DNA, 25 bp, E. coli
tcagttgcctgctgagagatgtcct

SEQ ID NO: 15243 - DNA, 25 bp, E. coli
gaacttcgtcctcatgttgattgga

SEQ ID NO: 15244 - DNA, 25 bp, E. coli
gaacttcgtcctgatgttgattgga

SEQ ID NO: 15245 - DNA, 25 bp, E. coli
gaacgagcaacaaaaggtggtgtcc

SEQ ID NO: 15246 - DNA, 25 bp, E. coli
gaacgagcaacataaggtggtgtcc

SEQ ID NO: 15247 - DNA, 25 bp, E. coli
gataactattcaatcaaacgagctt

SEQ ID NO: 15248 - DNA, 25 bp, E. coli
gataactattcattcaaacgagctt

SEQ ID NO: 15249 - DNA, 25 bp, E. coli
ggtgtcctgtgtcaagaacttcgtc

SEQ ID NO: 15250 - DNA, 25 bp, E. coli
ggtgtcctgtgtgaagaacttcgtc

SEQ ID NO: 15251 - DNA, 25 bp, E. coli
gagatgtcctgccattgaacgagca

SEQ ID NO: 15252 - DNA, 25 bp, E. coli
gagatgtcctgcgattgaacgagca

SEQ ID NO: 15253 - DNA, 25 bp, E. coli
gacgctcgtcatgttattcgcagaa

SEQ ID NO: 15254 - DNA, 25 bp, E. coli
gacgctcgtcatcttattcgcagaa

SEQ ID NO: 15255 - DNA, 25 bp, E. coli
tacatgcggaaattgctctcagcgg

SEQ ID NO: 15256 - DNA, 25 bp, E. coli
tactcgacgccacacagcaaggagt

SEQ ID NO: 15257 - DNA, 25 bp, E. coli
tactcgacgccagacagcaaggagt

SEQ ID NO: 15258 - DNA, 25 bp, E. coli
tacatgcggaaaatgctctcagcgg

SEQ ID NO: 15259 - DNA, 25 bp, E. coli
acagcaaggagttaaccgtggctaa

SEQ ID NO: 15260 - DNA, 25 bp, E. coli
acagcaaggagtaaaccgtggctaa

SEQ ID NO: 15261 - DNA, 25 bp, E. coli
tctcagcggttgtgggatttattac

SEQ ID NO: 15262 - DNA, 25 bp, E. coli
tcgacgccacactgcaaggagttaa

SEQ ID NO: 15263 - DNA, 25 bp, E. coli
tctcagcggttgagggatttattac

SEQ ID NO: 15264 - DNA, 25 bp, E. coli
tcgacgccacacagcaaggagttaa

SEQ ID NO: 15265 - DNA, 25 bp, E. coli
gccacacagcaacgagttaaccgtg

SEQ ID NO: 15266 - DNA, 25 bp, E. coli
gccacacagcaaggagttaaccgtg

SEQ ID NO: 15267 - DNA, 25 bp, E. coli
gaaattgctctcagcggttgtggga

SEQ ID NO: 15268 - DNA, 25 bp, E. coli
gaaattgctctctgcggttgtggga

SEQ ID NO: 15269 - DNA, 25 bp, E. coli
gttgtgggattttttactcgacgcc

SEQ ID NO: 15270 - DNA, 25 bp, E. coli
gttgtgggatttattactcgacgcc

SEQ ID NO: 15271 - DNA, 25 bp, E. coli
gtgggtcaacgcagtacatgcggaa

SEQ ID NO: 15272 - DNA, 25 bp, E. coli
ggatttattactcgacgccacacag

SEQ ID NO: 15273 - DNA, 25 bp, E. coli
gtgggtcaacgctgtacatgcggaa

SEQ ID NO: 15274 - DNA, 25 bp, E. coli
ggatttattactggacgccacacag

SEQ ID NO: 15275 - DNA, 25 bp, E. coli
tcaacgctgtacatgcggaaattgc

SEQ ID NO: 15276 - DNA, 25 bp, E. coli
tcaacgctgtacttgcggaaattgc

SEQ ID NO: 15277 - DNA, 25 bp, E. coli
cactttgtgccgaatctgacgctct

SEQ ID NO: 15278 - DNA, 25 bp, E. coli
cactttgtgccgtatctgacgctct

SEQ ID NO: 15279 - DNA, 25 bp, E. coli
actggcgagtaatccgctcgactgc

SEQ ID NO: 15280 - DNA, 25 bp, E. coli
actggcgagtaaaccgctcgactgc

SEQ ID NO: 15281 - DNA, 25 bp, E. coli
tatcaacggtcaggcattccgcctg

SEQ ID NO: 15282 - DNA, 25 bp, E. coli
tatcaacggtcacgcattccgcctg

SEQ ID NO: 15283 - DNA, 25 bp, E. coli
tgccatctgatggtaacgcgtccgc

SEQ ID NO: 15284 - DNA, 25 bp, E. coli
tgccgaatctgaggctctcaccgtt

SEQ ID NO: 15285 - DNA, 25 bp, E. coli
tcatggacggcctctttgtgccgaa

SEQ ID NO: 15286 - DNA, 25 bp, E. coli
tgccgaatctgacgctctcaccgtt

SEQ ID NO: 15287 - DNA, 25 bp, E. coli
tgccatctgatgctaacgcgtccgc

SEQ ID NO: 15288 - DNA, 25 bp, E. coli
tcatggacggccactttgtgccgaa

SEQ ID NO: 15289 - DNA, 25 bp, E. coli
tcttaatccggaaacgccggttgag

SEQ ID NO: 15290 - DNA, 25 bp, E. coli
tcttaatccggatacgccggttgag

SEQ ID NO: 15291 - DNA, 25 bp, E. coli
ccatctgatggttacgcgtccgcag

SEQ ID NO: 15292 - DNA, 25 bp, E. coli
ccatctgatggtaacgcgtccgcag

SEQ ID NO: 15293 - DNA, 25 bp, E. coli
cggaaactatcatcggtcaggcatt

SEQ ID NO: 15294 - DNA, 25 bp, E. coli
cggaaactatcaacggtcaggcatt

SEQ ID NO: 15295 - DNA, 25 bp, E. coli
gggctgattcttaatccggaaacgc

SEQ ID NO: 15296 - DNA, 25 bp, E. coli
gggctgattctttatccggaaacgc

SEQ ID NO: 15297 - DNA, 25 bp, E. coli
gagtaaaccgctcgactgccatctg

SEQ ID NO: 15298 - DNA, 25 bp, E. coli
gagtaaaccgctggactgccatctg

SEQ ID NO: 15299 - DNA, 25 bp, E. coli
aagtattcaatgatgagctcggcaa

SEQ ID NO: 15300 - DNA, 25 bp, E. coli
aagtattcaatgttgagctcggcaa

SEQ ID NO: 15301 - DNA, 25 bp, E. coli
atgagctcggcaaaccacggctacg

SEQ ID NO: 15302 - DNA, 25 bp, E. coli
atgagctcggcataccacggctacg

SEQ ID NO: 15303 - DNA, 25 bp, E. coli
tattcaatgatgagctcggcaaacc

SEQ ID NO: 15304 - DNA, 25 bp, E. coli
tattcaatgatgtgctcggcaaacc

SEQ ID NO: 15305 - DNA, 25 bp, E. coli
ttctggcgaagccttttgctgtgaa

SEQ ID NO: 15306 - DNA, 25 bp, E. coli
ttctggcgaagcgttttgctgtgaa

SEQ ID NO: 15307 - DNA, 25 bp, E. coli
tgaagtattcaatgatgagctcggc

SEQ ID NO: 15308 - DNA, 25 bp, E. coli
tgatgagctcggcaaaccacggcta

SEQ ID NO: 15309 - DNA, 25 bp, E. coli
tgaagtattcaaagatgagctcggc

SEQ ID NO: 15310 - DNA, 25 bp, E. coli
tgatgagctcgggaaaccacggcta

SEQ ID NO: 15311 - DNA, 25 bp, E. coli
ctcggcaaaccagggctacggctat

SEQ ID NO: 15312 - DNA, 25 bp, E. coli
ctcggcaaaccacggctacggctat

SEQ ID NO: 15313 - DNA, 25 bp, E. coli
cgaagcgttttggtgtgaaagaagc

SEQ ID NO: 15314 - DNA, 25 bp, E. coli
cgaagcgttttgctgtgaaagaagc

SEQ ID NO: 15315 - DNA, 25 bp, E. coli
ggcgaagcgttttgctgtgaaagaa

SEQ ID NO: 15316 - DNA, 25 bp, E. coli
ggcaaaccacgggtacggctatggg

SEQ ID NO: 15317 - DNA, 25 bp, E. coli
ggcgaagcgtttagctgtgaaagaa

SEQ ID NO: 15318 - DNA, 25 bp, E. coli
ggcaaaccacggctacggctatggg

SEQ ID NO: 15319 - DNA, 25 bp, E. coli
tcaatgatgagctcggcaaaccacg

SEQ ID NO: 15320 - DNA, 25 bp, E. coli
tcaatgatgagcacggcaaaccacg

SEQ ID NO: 15321 - DNA, 25 bp, E. coli
taaactggtagaagatcgttgtgcc

SEQ ID NO: 15322 - DNA, 25 bp, E. coli
taaactggtagatgatcgttgtgcc

SEQ ID NO: 15323 - DNA, 25 bp, E. coli
aaagcaggtgcgtcgcttgcgacct

SEQ ID NO: 15324 - DNA, 25 bp, E. coli
aaagcaggtgcgacgcttgcgacct

SEQ ID NO: 15325 - DNA, 25 bp, E. coli
tatggcattcgtagtgcgctcacct

SEQ ID NO: 15326 - DNA, 25 bp, E. coli
tatggcattcgttgtgcgctcacct

SEQ ID NO: 15327 - DNA, 25 bp, E. coli
tattgaagtcgctatcattaccggg

SEQ ID NO: 15328 - DNA, 25 bp, E. coli
tattgaagtcgcaatcattaccggg

SEQ ID NO: 15329 - DNA, 25 bp, E. coli
ttgcgacctgtttcggccctgtcag

SEQ ID NO: 15330 - DNA, 25 bp, E. coli
ttgcgacctgttacggccctgtcag

SEQ ID NO: 15331 - DNA, 25 bp, E. coli
tgaaagcgttcaatgttcgtgacgg

SEQ ID NO: 15332 - DNA, 25 bp, E. coli
tgaaagcgttcattgttcgtgacgg

SEQ ID NO: 15333 - DNA, 25 bp, E. coli
tcattaccgggccaaaggctaaact

SEQ ID NO: 15334 - DNA, 25 bp, E. coli
tcattaccgggcgaaaggctaaact

SEQ ID NO: 15335 - DNA, 25 bp, E. coli
gacttattactcctggcgcagggca

SEQ ID NO: 15336 - DNA, 25 bp, E. coli
gacttattactcgtggcgcagggca

SEQ ID NO: 15337 - DNA, 25 bp, E. coli
cgattgccccggtaaatgtggctta

SEQ ID NO: 15338 - DNA, 25 bp, E. coli
cgattgccccggaaaatgtggctta

SEQ ID NO: 15339 - DNA, 25 bp, E. coli
tggccgatgcgcatccactgttgat

SEQ ID NO: 15340 - DNA, 25 bp, E. coli
tggccgatgcgcttccactgttgat

SEQ ID NO: 15341 - DNA, 25 bp, E. coli
gatggcgtactgacagatggcctga

SEQ ID NO: 15342 - DNA, 25 bp, E. coli
gatggcgtactgtcagatggcctga

SEQ ID NO: 15343 - DNA, 25 bp, E. coli
gaacgaactggagtcgctggattca

SEQ ID NO: 15344 - DNA, 25 bp, E. coli
gaacgaactggactcgctggattca

SEQ ID NO: 15345 - DNA, 25 bp, E. coli
cagggattgtcggtcttccagctca

SEQ ID NO: 15346 - DNA, 25 bp, E. coli
cagggattgtcgctcttccagctca

SEQ ID NO: 15347 - DNA, 25 bp, E. coli
cagacggtagcgcttctgaaaccaa

SEQ ID NO: 15348 - DNA, 25 bp, E. coli
cagacggtagcggttctgaaaccaa

SEQ ID NO: 15349 - DNA, 25 bp, E. coli
tggattcattagctagcgatcgcgc

SEQ ID NO: 15350 - DNA, 25 bp, E. coli
tcatgcagcaaacggcattgcaggc

SEQ ID NO: 15351 - DNA, 25 bp, E. coli
tcaggaaaaaattgtctacgccagc

SEQ ID NO: 15352 - DNA, 25 bp, E. coli
tcaggcagaatggatgaagtacggc

SEQ ID NO: 15353 - DNA, 25 bp, E. coli
tcatgcagcaaagggcattgcaggc

SEQ ID NO: 15354 - DNA, 25 bp, E. coli
tcaggcagaatgcatgaagtacggc

SEQ ID NO: 15355 - DNA, 25 bp, E. coli
tcaggaaaaaatagtctacgccagc

SEQ ID NO: 15356 - DNA, 25 bp, E. coli
ggtaacgggcgctacatttttgccg

SEQ ID NO: 15357 - DNA, 25 bp, E. coli
ggtaacgggcgcaacatttttgccg

SEQ ID NO: 15358 - DNA, 25 bp, E. coli
ggactgaaaaactcgctgaacaatg

SEQ ID NO: 15359 - DNA, 25 bp, E. coli
ggttataaaacacagactgcgccgt

SEQ ID NO: 15360 - DNA, 25 bp, E. coli
ggttataaaacagagactgcgccgt

SEQ ID NO: 15361 - DNA, 25 bp, E. coli
ggactgaaaaacacgctgaacaatg

SEQ ID NO: 15362 - DNA, 25 bp, E. coli
ggcctcgctggctacggatattcag

SEQ ID NO: 15363 - DNA, 25 bp, E. coli
tggattcattaggtagcgatcgcgc

SEQ ID NO: 15364 - DNA, 25 bp, E. coli
ggcctcgctggcaacggatattcag

SEQ ID NO: 15365 - DNA, 25 bp, E. coli
caaccggttattcgaaagatgagca

SEQ ID NO: 15366 - DNA, 25 bp, E. coli
caaccggttattggaaagatgagca

SEQ ID NO: 15367 - DNA, 25 bp, E. coli
cagaaactgaatggccgcgtgaaac

SEQ ID NO: 15368 - DNA, 25 bp, E. coli
cagaaactgaatcgccgcgtgaaac

SEQ ID NO: 15369 - DNA, 25 bp, E. coli
taaagccggagcaatcagcagtcct

SEQ ID NO: 15370 - DNA, 25 bp, E. coli
taaagccggagctatcagcagtcct

SEQ ID NO: 15371 - DNA, 25 bp, E. coli
tgtggagcgtgacaatacccttcga

SEQ ID NO: 15372 - DNA, 25 bp, E. coli
tgtattgccggaaaagcctgccgag

SEQ ID NO: 15373 - DNA, 25 bp, E. coli
tgtggagcgtgagaatacccttcga

SEQ ID NO: 15374 - DNA, 25 bp, E. coli
tgtattgccggataagcctgccgag

SEQ ID NO: 15375 - DNA, 25 bp, E. coli
tgaagaacatgaaaaacggctcgcc

SEQ ID NO: 15376 - DNA, 25 bp, E. coli
tgaactcatgtcagcggtaaccgca

SEQ ID NO: 15377 - DNA, 25 bp, E. coli
tgaagaacatgataaacggctcgcc

SEQ ID NO: 15378 - DNA, 25 bp, E. coli
tgaactcatgtctgcggtaaccgca

SEQ ID NO: 15379 - DNA, 25 bp, E. coli
cgtttttcgaatcatacctggcggg

SEQ ID NO: 15380 - DNA, 25 bp, E. coli
cgtttttcgaatgatacctggcggg

SEQ ID NO: 15381 - DNA, 25 bp, E. coli
gtaatattcacgagctgacgccgga

SEQ ID NO: 15382 - DNA, 25 bp, E. coli
gtaatattcacgtgctgacgccgga

SEQ ID NO: 15383 - DNA, 25 bp, E. coli
tgtgtcaggcttaacgcaacgggtc

SEQ ID NO: 15384 - DNA, 25 bp, E. coli
tgtgtcaggctttacgcaacgggtc

SEQ ID NO: 15385 - DNA, 25 bp, E. coli
tcaacctgagtatcggtgcaccgag

SEQ ID NO: 15386 - DNA, 25 bp, E. coli
tcaacctgagtaacggtgcaccgag

SEQ ID NO: 15387 - DNA, 25 bp, E. coli
caagcgcccacagtgttaagctacg

SEQ ID NO: 15388 - DNA, 25 bp, E. coli
caagcgcccacactgttaagctacg

SEQ ID NO: 15389 - DNA, 25 bp, E. coli
catcgccgcgcagaatttcagataa

SEQ ID NO: 15390 - DNA, 25 bp, E. coli
catcgccgcgcacaatttcagataa

SEQ ID NO: 15391 - DNA, 25 bp, E. coli
tacatcaactcgtcaataacgccag

SEQ ID NO: 15392 - DNA, 25 bp, E. coli
tacatcaactcgacaataacgccag

SEQ ID NO: 15393 - DNA, 25 bp, E. coli
gcccgctggagcgtgaagatttacg

SEQ ID NO: 15394 - DNA, 25 bp, E. coli
gcccgctggagcctgaagatttacg

SEQ ID NO: 15395 - DNA, 25 bp, E. coli
gaatgtgacggcgaaaaagccggtc

SEQ ID NO: 15396 - DNA, 25 bp, E. coli
gaatgtgacggccaaaaagccggtc

SEQ ID NO: 15397 - DNA, 25 bp, E. coli
cccgtgccgccatattagcaatgga

SEQ ID NO: 15398 - DNA, 25 bp, E. coli
cccgtgccgccaaattagcaatgga

SEQ ID NO: 15399 - DNA, 25 bp, E. coli
gattcacatttaccgcaagcttggc

SEQ ID NO: 15400 - DNA, 25 bp, E. coli
gataagcatattcacgatcagagcg

SEQ ID NO: 15401 - DNA, 25 bp, E. coli
gataagcatattgacgatcagagcg

SEQ ID NO: 15402 - DNA, 25 bp, E. coli
gattcacatttagcgcaagcttggc

SEQ ID NO: 15403 - DNA, 25 bp, E. coli
ggtcaatatcgttatgccattcgca

SEQ ID NO: 15404 - DNA, 25 bp, E. coli
tgaggaaccctacgaagcctttgtt

SEQ ID NO: 15405 - DNA, 25 bp, E. coli
ggtcaatatcgtaatgccattcgca

SEQ ID NO: 15406 - DNA, 25 bp, E. coli
tgaggaaccctaggaagcctttgtt

SEQ ID NO: 15407 - DNA, 25 bp, E. coli
gatgcgttactgctttgaggaaccc

SEQ ID NO: 15408 - DNA, 25 bp, E. coli
gatgcgttactggtttgaggaaccc

SEQ ID NO: 15409 - DNA, 25 bp, E. coli
cacgagcacaggcattgcgcattga

SEQ ID NO: 15410 - DNA, 25 bp, E. coli
cacgagcacagggattgcgcattga

SEQ ID NO: 15411 - DNA, 25 bp, E. coli
caggaccacgcgcattaagccgtaa

SEQ ID NO: 15412 - DNA, 25 bp, E. coli
caggaccacgcggattaagccgtaa

SEQ ID NO: 15413 - DNA, 25 bp, E. coli
tactttcggtctgcattcatggtgc

SEQ ID NO: 15414 - DNA, 25 bp, E. coli
tactttcggtctccattcatggtgc

SEQ ID NO: 15415 - DNA, 25 bp, E. coli
ttaccagtgtgggttcaggaccacg

SEQ ID NO: 15416 - DNA, 25 bp, E. coli
ttaccagtgtggcttcaggaccacg

SEQ ID NO: 15417 - DNA, 25 bp, E. coli
tgcaaccagcaacccggttaccagt

SEQ ID NO: 15418 - DNA, 25 bp, E. coli
tgcaaccagcaagccggttaccagt

SEQ ID NO: 15419 - DNA, 25 bp, E. coli
tgcgcagccgatatctgtcacgatg

SEQ ID NO: 15420 - DNA, 25 bp, E. coli
tgcgcagccgatttctgtcacgatg

SEQ ID NO: 15421 - DNA, 25 bp, E. coli
cgatgcgcagatcgcgttatgagcc

SEQ ID NO: 15422 - DNA, 25 bp, E. coli
cgatgcgcagatggcgttatgagcc

SEQ ID NO: 15423 - DNA, 25 bp, E. coli
cgtgaggtgaaatatgcgatgcgca

SEQ ID NO: 15424 - DNA, 25 bp, E. coli
cgtgaggtgaaaaatgcgatgcgca

SEQ ID NO: 15425 - DNA, 25 bp, E. coli
ggttattgaactacctgcgcctgcg

SEQ ID NO: 15426 - DNA, 25 bp, E. coli
ggttattgaacttcctgcgcctgcg

SEQ ID NO: 15427 - DNA, 25 bp, E. coli
taagccgtaatctgccgcagtatcc

SEQ ID NO: 15428 - DNA, 25 bp, E. coli
taagccgtaatcagccgcagtatcc

SEQ ID NO: 15429 - DNA, 25 bp, E. coli
gatggtcgcgtggataacgtacaaa

SEQ ID NO: 15430 - DNA, 25 bp, E. coli
gatggtcgcgtgcataacgtacaaa

SEQ ID NO: 15431 - DNA, 25 bp, E. coli
caggtgaccggtatcacaaatataa

SEQ ID NO: 15432 - DNA, 25 bp, E. coli
caggtgaccggtttcacaaatataa

SEQ ID NO: 15433 - DNA, 25 bp, E. coli
tccctttacacggaatcaacgcagt

SEQ ID NO: 15434 - DNA, 25 bp, E. coli
tccgtcacgtcgtctgataacaact

SEQ ID NO: 15435 - DNA, 25 bp, E. coli
tccctttacacgcaatcaacgcagt

SEQ ID NO: 15436 - DNA, 25 bp, E. coli
tccgtcacgtcgactgataacaact

SEQ ID NO: 15437 - DNA, 25 bp, E. coli
tcttaattccgtatcagcatcggca

SEQ ID NO: 15438 - DNA, 25 bp, E. coli
tcggcgggaaaaatattcaggtgac

SEQ ID NO: 15439 - DNA, 25 bp, E. coli
tcttaattccgtttcagcatcggca

SEQ ID NO: 15440 - DNA, 25 bp, E. coli
tcggcgggaaaattattcaggtgac

SEQ ID NO: 15441 - DNA, 25 bp, E. coli
tcatgattttgtgaaaccggtttct

SEQ ID NO: 15442 - DNA, 25 bp, E. coli
tcagcatcggcatttttccgtcacg

SEQ ID NO: 15443 - DNA, 25 bp, E. coli
tcatgattttgtcaaaccggtttct

SEQ ID NO: 15444 - DNA, 25 bp, E. coli
cctactgataacaggataaaatccg

SEQ ID NO: 15445 - DNA, 25 bp, E. coli
cctactgataactggataaaatccg

SEQ ID NO: 15446 - DNA, 25 bp, E. coli
gcagtgtactgctccgtttgccgat

SEQ ID NO: 15447 - DNA, 25 bp, E. coli
gcagtgtactgcaccgtttgccgat

SEQ ID NO: 15448 - DNA, 25 bp, E. coli
gataacaactacttctaccctactg

SEQ ID NO: 15449 - DNA, 25 bp, E. coli
gattgtccttgctcaatcggcggga

SEQ ID NO: 15450 - DNA, 25 bp, E. coli
gataacaactacatctaccctactg

SEQ ID NO: 15451 - DNA, 25 bp, E. coli
gattgtccttgcacaatcggcggga

SEQ ID NO: 15452 - DNA, 25 bp, E. coli
tcagcatcggcaattttccgtcacg

SEQ ID NO: 15453 - DNA, 25 bp, E. coli
aatttttgacctcgatgtcgccatg

SEQ ID NO: 15454 - DNA, 25 bp, E. coli
aatttttgacctggatgtcgccatg

SEQ ID NO: 15455 - DNA, 25 bp, E. coli
cagccagaaggagcgtccggcaagt

SEQ ID NO: 15456 - DNA, 25 bp, E. coli
cagccagaaggaccgtccggcaagt

SEQ ID NO: 15457 - DNA, 25 bp, E. coli
aaaatcctgccaataagcacgagcg

SEQ ID NO: 15458 - DNA, 25 bp, E. coli
aaaatcctgccattaagcacgagcg

SEQ ID NO: 15459 - DNA, 25 bp, E. coli
tcctggaagtaggagaaaaattgtc

SEQ ID NO: 15460 - DNA, 25 bp, E. coli
tcctttaagattgaaaatcctgcca

SEQ ID NO: 15461 - DNA, 25 bp, E. coli
tcctttaagattcaaaatcctgcca

SEQ ID NO: 15462 - DNA, 25 bp, E. coli
tcctggaagtagcagaaaaattgtc

SEQ ID NO: 15463 - DNA, 25 bp, E. coli
tctgcagcatcactactcctttaag

SEQ ID NO: 15464 - DNA, 25 bp, E. coli
tctgcagcatcagtactcctttaag

SEQ ID NO: 15465 - DNA, 25 bp, E. coli
gcacgagcgtccacatcataaatat

SEQ ID NO: 15466 - DNA, 25 bp, E. coli
gcagaaaaattgtcagaaaaagttg

SEQ ID NO: 15467 - DNA, 25 bp, E. coli
gcacgagcgtcctcatcataaatat

SEQ ID NO: 15468 - DNA, 25 bp, E. coli
gcagaaaaattgacagaaaaagttg

SEQ ID NO: 15469 - DNA, 25 bp, E. coli
gaaaaagttgagacttatctgcagc

SEQ ID NO: 15470 - DNA, 25 bp, E. coli
gaaaaagttgagtcttatctgcagc

SEQ ID NO: 15471 - DNA, 25 bp, E. coli
gatgtcgccatgcaccgtgttgaag

SEQ ID NO: 15472 - DNA, 25 bp, E. coli
gagcgtccggcaagtcttcctggaa

SEQ ID NO: 15473 - DNA, 25 bp, E. coli
gatgtcgccatggaccgtgttgaag

SEQ ID NO: 15474 - DNA, 25 bp, E. coli
gagcgtccggcatgtcttcctggaa

SEQ ID NO: 15475 - DNA, 25 bp, E. coli
cagattggctatcagtatggctaca

SEQ ID NO: 15476 - DNA, 25 bp, E. coli
cagattggctatgagtatggctaca

SEQ ID NO: 15477 - DNA, 25 bp, E. coli
aacgcgacggtgttgaatacggtac

SEQ ID NO: 15478 - DNA, 25 bp, E. coli
aacgcgacggtgatgaatacggtac

SEQ ID NO: 15479 - DNA, 25 bp, E. coli
tatttaattcagttcgcaggcgacc

SEQ ID NO: 15480 - DNA, 25 bp, E. coli
tattgcccgtatcgtcgagaacgct

SEQ ID NO: 15481 - DNA, 25 bp, E. coli
tatttaattcagatcgcaggcgacc

SEQ ID NO: 15482 - DNA, 25 bp, E. coli
tattgcccgtatggtcgagaacgct

SEQ ID NO: 15483 - DNA, 25 bp, E. coli
ttattccgcgatgggtggtgcagtc

SEQ ID NO: 15484 - DNA, 25 bp, E. coli
ttattccgcgatcggtggtgcagtc

SEQ ID NO: 15485 - DNA, 25 bp, E. coli
tgaatgcggcaactatcaccctgat

SEQ ID NO: 15486 - DNA, 25 bp, E. coli
tgaatgcggcaagtatcaccctgat

SEQ ID NO: 15487 - DNA, 25 bp, E. coli
tccgttaaccgtaggtgcagcaccg

SEQ ID NO: 15488 - DNA, 25 bp, E. coli
tccgttaaccgttggtgcagcaccg

SEQ ID NO: 15489 - DNA, 25 bp, E. coli
cgctggcaatgagcttcgtatccgg

SEQ ID NO: 15490 - DNA, 25 bp, E. coli
cgctggcaatgaccttcgtatccgg

SEQ ID NO: 15491 - DNA, 25 bp, E. coli
gtatggatgattccgtttacccgcg

SEQ ID NO: 15492 - DNA, 25 bp, E. coli
gtatggatgattgcgtttacccgcg

SEQ ID NO: 15493 - DNA, 25 bp, E. coli
taattgaagcttgccgcgcaatggg

SEQ ID NO: 15494 - DNA, 25 bp, E. coli
taattgaagcttcccgcgcaatggg

SEQ ID NO: 15495 - DNA, 25 bp, E. coli
gagaacgctctggtggagatcccaa

SEQ ID NO: 15496 - DNA, 25 bp, E. coli
gagaacgctctgctggagatcccaa

SEQ ID NO: 15497 - DNA, 25 bp, E. coli
catgaaattgcagcgcgcgttacgg

SEQ ID NO: 15498 - DNA, 25 bp, E. coli
catgaaattgcaccgcgcgttacgg

SEQ ID NO: 15499 - DNA, 25 bp, E. coli
taaaggtcatgctgcaatttgcgcc

SEQ ID NO: 15500 - DNA, 25 bp, E. coli
taaaggtcatgcagcaatttgcgcc

SEQ ID NO: 15501 - DNA, 25 bp, E. coli
tacccgtgtataagccggaggcacc

SEQ ID NO: 15502 - DNA, 25 bp, E. coli
tacccgtgtatatgccggaggcacc

SEQ ID NO: 15503 - DNA, 25 bp, E. coli
tatttgccattgtggatgcagcggc

SEQ ID NO: 15504 - DNA, 25 bp, E. coli
tatttgccattgaggatgcagcggc

SEQ ID NO: 15505 - DNA, 25 bp, E. coli
tttaatctttgtgaaccaccgcagg

SEQ ID NO: 15506 - DNA, 25 bp, E. coli
tttaatctttgtcaaccaccgcagg

SEQ ID NO: 15507 - DNA, 25 bp, E. coli
ccgtgattgaacgtgacgctgccaa

SEQ ID NO: 15508 - DNA, 25 bp, E. coli
gaacgcgcgcagcaaaatgattcca

SEQ ID NO: 15509 - DNA, 25 bp, E. coli
gaacgcgcgcaggaaaatgattcca

SEQ ID NO: 15510 - DNA, 25 bp, E. coli
cgttaaaaatgttcagccgggcgat

SEQ ID NO: 15511 - DNA, 25 bp, E. coli
cgattgatgtcgatgcagcgcaggc

SEQ ID NO: 15512 - DNA, 25 bp, E. coli
cgattgatgtcgttgcagcgcaggc

SEQ ID NO: 15513 - DNA, 25 bp, E. coli
ccgtgattgaacctgacgctgccaa

SEQ ID NO: 15514 - DNA, 25 bp, E. coli
cgttaaaaatgtacagccgggcgat

SEQ ID NO: 15515 - DNA, 25 bp, E. coli
gataggcttatccatcgtgcaggca

SEQ ID NO: 15516 - DNA, 25 bp, E. coli
gataggcttatcgatcgtgcaggca

SEQ ID NO: 15517 - DNA, 25 bp, E. coli
gtcactgcgttaaccgaatgccgaa

SEQ ID NO: 15518 - DNA, 25 bp, E. coli
gtcactgcgttatccgaatgccgaa

SEQ ID NO: 15519 - DNA, 25 bp, E. coli
caattttgacagtggctaccgtggg

SEQ ID NO: 15520 - DNA, 25 bp, E. coli
caattttgacagaggctaccgtggg

SEQ ID NO: 15521 - DNA, 25 bp, E. coli
cagaaattacatagatgattgtgga

SEQ ID NO: 15522 - DNA, 25 bp, E. coli
cagaaattacattgatgattgtgga

SEQ ID NO: 15523 - DNA, 25 bp, E. coli
ttgcgcaacgctggcgaatttttct

SEQ ID NO: 15524 - DNA, 25 bp, E. coli
ttgcgcaacgctcgcgaatttttct

SEQ ID NO: 15525 - DNA, 25 bp, E. coli
tgatgattgtggataactctgtgcg

SEQ ID NO: 15526 - DNA, 25 bp, E. coli
tgacagtggctagcgtgggaaaaat

SEQ ID NO: 15527 - DNA, 25 bp, E. coli
tgacagtggctaccgtgggaaaaat

SEQ ID NO: 15528 - DNA, 25 bp, E. coli
tgatgattgtggttaactctgtgcg

SEQ ID NO: 15529 - DNA, 25 bp, E. coli
tcaatggtgatcacaattttgacag

SEQ ID NO: 15530 - DNA, 25 bp, E. coli
tcaatggtgatctcaattttgacag

SEQ ID NO: 15531 - DNA, 25 bp, E. coli
gctaccgtgggaaaaatacagaaat

SEQ ID NO: 15532 - DNA, 25 bp, E. coli
gctaccgtgggataaatacagaaat

SEQ ID NO: 15533 - DNA, 25 bp, E. coli
cgcgaatttttctctttcaatggtg

SEQ ID NO: 15534 - DNA, 25 bp, E. coli
cgcgaatttttcactttcaatggtg

SEQ ID NO: 15535 - DNA, 25 bp, E. coli
cgtgggaaaaatacagaaattacat

SEQ ID NO: 15536 - DNA, 25 bp, E. coli
cgtgggaaaaattcagaaattacat

SEQ ID NO: 15537 - DNA, 25 bp, E. coli
tggataactctgtgcgtaaaaaggt

SEQ ID NO: 15538 - DNA, 25 bp, E. coli
tggataactctgagcgtaaaaaggt

SEQ ID NO: 15539 - DNA, 25 bp, E. coli
taactctgtgcgaaaaaaggtataa

SEQ ID NO: 15540 - DNA, 25 bp, E. coli
taactctgtgcgtaaaaaggtataa

SEQ ID NO: 15541 - DNA, 25 bp, E. coli
taccagtcgtaagaagcgggtctgc

SEQ ID NO: 15542 - DNA, 25 bp, E. coli
taccagtcgtaacaagcgggtctgc

SEQ ID NO: 15543 - DNA, 25 bp, E. coli
aacggtggttcacacagtaaactca

SEQ ID NO: 15544 - DNA, 25 bp, E. coli
aacggtggttcagacagtaaactca

SEQ ID NO: 15545 - DNA, 25 bp, E. coli
tatcgcctttgtactccacacatgg

SEQ ID NO: 15546 - DNA, 25 bp, E. coli
tatcgcctttgttctccacacatgg

SEQ ID NO: 15547 - DNA, 25 bp, E. coli
tccgatctacaaaaagcagagctgg

SEQ ID NO: 15548 - DNA, 25 bp, E. coli
tccgatctacaataagcagagctgg

SEQ ID NO: 15549 - DNA, 25 bp, E. coli
tcagcgttgccggtatgaacaaatg

SEQ ID NO: 15550 - DNA, 25 bp, E. coli
tcagcgttgccgctatgaacaaatg

SEQ ID NO: 15551 - DNA, 25 bp, E. coli
gcttctcttacaaaaaaccggctgg

SEQ ID NO: 15552 - DNA, 25 bp, E. coli
gcgggtctgcgaacgtattaaagcc

SEQ ID NO: 15553 - DNA, 25 bp, E. coli
gcgggtctgcgatcgtattaaagcc

SEQ ID NO: 15554 - DNA, 25 bp, E. coli
gcttctcttacataaaaccggctgg

SEQ ID NO: 15555 - DNA, 25 bp, E. coli
gcagagctggaaggccttcacgata

SEQ ID NO: 15556 - DNA, 25 bp, E. coli
gcagagctggaacgccttcacgata

SEQ ID NO: 15557 - DNA, 25 bp, E. coli
gaacaaatggttgcatcgtaacggc

SEQ ID NO: 15558 - DNA, 25 bp, E. coli
gaacaaatggttccatcgtaacggc

SEQ ID NO: 15559 - DNA, 25 bp, E. coli
cggctggaacgcctcataaattcag

SEQ ID NO: 15560 - DNA, 25 bp, E. coli
cggctggaacgcgtcataaattcag

SEQ ID NO: 15561 - DNA, 25 bp, E. coli
gagaggcaggcgcaattcattgaat

SEQ ID NO: 15562 - DNA, 25 bp, E. coli
gagaggcaggcggaattcattgaat

SEQ ID NO: 15563 - DNA, 25 bp, E. coli
catatctggctcagggatgccgggc

SEQ ID NO: 15564 - DNA, 25 bp, E. coli
catatctggctctgggatgccgggc

SEQ ID NO: 15565 - DNA, 25 bp, E. coli
taccgaatgccaacgacaaaagtct

SEQ ID NO: 15566 - DNA, 25 bp, E. coli
tacccgacgggtgaatattctgaag

SEQ ID NO: 15567 - DNA, 25 bp, E. coli
taccgaatgccatcgacaaaagtct

SEQ ID NO: 15568 - DNA, 25 bp, E. coli
acaaaagtctgctcgtgaagcggcg

SEQ ID NO: 15569 - DNA, 25 bp, E. coli
acaaaagtctgcacgtgaagcggcg

SEQ ID NO: 15570 - DNA, 25 bp, E. coli
tacccgacgggtcaatattctgaag

SEQ ID NO: 15571 - DNA, 25 bp, E. coli
tattctgaagggtgaacagcgtcgt

SEQ ID NO: 15572 - DNA, 25 bp, E. coli
tattctgaagggagaacagcgtcgt

SEQ ID NO: 15573 - DNA, 25 bp, E. coli
tgtttccctcaagcgtcatatctgg

SEQ ID NO: 15574 - DNA, 25 bp, E. coli
tgtttccctcaaccgtcatatctgg

SEQ ID NO: 15575 - DNA, 25 bp, E. coli
tgagcttcgtacactccagagcaga

SEQ ID NO: 15576 - DNA, 25 bp, E. coli
tgagcttcgtactctccagagcaga

SEQ ID NO: 15577 - DNA, 25 bp, E. coli
tcgtgtggttgagctctgtgacagt

SEQ ID NO: 15578 - DNA, 25 bp, E. coli
tcgtgtggttgacctctgtgacagt

SEQ ID NO: 15579 - DNA, 25 bp, E. coli
cgaatctctggaggctctgtaccga

SEQ ID NO: 15580 - DNA, 25 bp, E. coli
cgaatctctggacgctctgtaccga

SEQ ID NO: 15581 - DNA, 25 bp, E. coli
tggcagtgcacgagtttccctcaag

SEQ ID NO: 15582 - DNA, 25 bp, E. coli
tggcagtgcacgtgtttccctcaag

SEQ ID NO: 15583 - DNA, 25 bp, E. coli
gagcggacgacatcatcggactgta

SEQ ID NO: 15584 - DNA, 25 bp, E. coli
gagcggacgacaacatcggactgta

SEQ ID NO: 15585 - DNA, 25 bp, E. coli
aaccagttcaattacggctatcggc

SEQ ID NO: 15586 - DNA, 25 bp, E. coli
aaccagttcaataacggctatcggc

SEQ ID NO: 15587 - DNA, 25 bp, E. coli
cagattttcgatcccgaaacgggca

SEQ ID NO: 15588 - DNA, 25 bp, E. coli
cagattttcgatgccgaaacgggca

SEQ ID NO: 15589 - DNA, 25 bp, E. coli
tatttgtggccactggtcgatgcgc

SEQ ID NO: 15590 - DNA, 25 bp, E. coli
tattctgtttgatcgcatgggagtc

SEQ ID NO: 15591 - DNA, 25 bp, E. coli
tatttgtggccagtggtcgatgcgc

SEQ ID NO: 15592 - DNA, 25 bp, E. coli
tattctgtttgaacgcatgggagtc

SEQ ID NO: 15593 - DNA, 25 bp, E. coli
tttcacgacgtcgatatgatgggcg

SEQ ID NO: 15594 - DNA, 25 bp, E. coli
tttcacgacgtccatatgatgggcg

SEQ ID NO: 15595 - DNA, 25 bp, E. coli
tcgatgcgcgggagaaatatcgcca

SEQ ID NO: 15596 - DNA, 25 bp, E. coli
tcgatgcgcgggtgaaatatcgcca

SEQ ID NO: 15597 - DNA, 25 bp, E. coli
gaagagttcgaataccgtctgcgga

SEQ ID NO: 15598 - DNA, 25 bp, E. coli
gaagagttcgaaaaccgtctgcgga

SEQ ID NO: 15599 - DNA, 25 bp, E. coli
gaactgtgctttgtcagccccgata

SEQ ID NO: 15600 - DNA, 25 bp, E. coli
gaactgtgctttctcagccccgata

SEQ ID NO: 15601 - DNA, 25 bp, E. coli
gagctgaccattccctttcacgacg

SEQ ID NO: 15602 - DNA, 25 bp, E. coli
gagctgaccattgcctttcacgacg

SEQ ID NO: 15603 - DNA, 25 bp, E. coli
cgtgcgtgcgcaaatcgaagagttc

SEQ ID NO: 15604 - DNA, 25 bp, E. coli
cgtgcgtgcgcatatcgaagagttc

SEQ ID NO: 15605 - DNA, 25 bp, E. coli
gatacaccattctggtcgcggtcga

SEQ ID NO: 15606 - DNA, 25 bp, E. coli
gatacaccattcaggtcgcggtcga

SEQ ID NO: 15607 - DNA, 25 bp, E. coli
acgctgcaaccctatccgtggaatg

SEQ ID NO: 15608 - DNA, 25 bp, E. coli
acgctgcaacccaatccgtggaatg

SEQ ID NO: 15609 - DNA, 25 bp, E. coli
tatccgtggaatgcggttattcttg

SEQ ID NO: 15610 - DNA, 25 bp, E. coli
tatccgtggaatccggttattcttg

SEQ ID NO: 15611 - DNA, 25 bp, E. coli
tgccggactcatacgcagtggacaa

SEQ ID NO: 15612 - DNA, 25 bp, E. coli
tctattagcaattcccttggtgaca

SEQ ID NO: 15613 - DNA, 25 bp, E. coli
tgccggactcattcgcagtggacaa

SEQ ID NO: 15614 - DNA, 25 bp, E. coli
tctattagcaatacccttggtgaca

SEQ ID NO: 15615 - DNA, 25 bp, E. coli
tctaacaaagtttagcatcgctatc

SEQ ID NO: 15616 - DNA, 25 bp, E. coli
tctaacaaagttaagcatcgctatc

SEQ ID NO: 15617 - DNA, 25 bp, E. coli
gcaaatctattagcaattcccttgg

SEQ ID NO: 15618 - DNA, 25 bp, E. coli
gcaaatctattaccaattcccttgg

SEQ ID NO: 15619 - DNA, 25 bp, E. coli
gcaatggtgatagccagaaacggca

SEQ ID NO: 15620 - DNA, 25 bp, E. coli
gcaatggtgatacccagaaacggca

SEQ ID NO: 15621 - DNA, 25 bp, E. coli
gactcattcgcagtggacaaatttt

SEQ ID NO: 15622 - DNA, 25 bp, E. coli
gactcattcgcactggacaaatttt

SEQ ID NO: 15623 - DNA, 25 bp, E. coli
gacaaatttttcagcctgggcgctg

SEQ ID NO: 15624 - DNA, 25 bp, E. coli
gacaaatttttctgcctgggcgctg

SEQ ID NO: 15625 - DNA, 25 bp, E. coli
cgactgccctctaacaaagttaagc

SEQ ID NO: 15626 - DNA, 25 bp, E. coli
cgactgccctcttacaaagttaagc

SEQ ID NO: 15627 - DNA, 25 bp, E. coli
gtgatagccagaaacggcaaagcga

SEQ ID NO: 15628 - DNA, 25 bp, E. coli
gtgatagccagatacggcaaagcga

SEQ ID NO: 15629 - DNA, 25 bp, E. coli
caaggtttcgcgctgctgtcgtatg

SEQ ID NO: 15630 - DNA, 25 bp, E. coli
caaggtttcgcggtgctgtcgtatg

SEQ ID NO: 15631 - DNA, 25 bp, E. coli
cacgcttgatgaggatttactggag

SEQ ID NO: 15632 - DNA, 25 bp, E. coli
cagcgtcgtggtaataacaaccgtt

SEQ ID NO: 15633 - DNA, 25 bp, E. coli
cagcgtcgtggttataacaaccgtt

SEQ ID NO: 15634 - DNA, 25 bp, E. coli
cacgcttgatgacgatttactggag

SEQ ID NO: 15635 - DNA, 25 bp, E. coli
acgaaaaacgcgtcttagccagccg

SEQ ID NO: 15636 - DNA, 25 bp, E. coli
acgaaaaacgcgacttagccagccg

SEQ ID NO: 15637 - DNA, 25 bp, E. coli
tgtgtatgaacacgaaaaacgcgac

SEQ ID NO: 15638 - DNA, 25 bp, E. coli
tgtgtatgaacaggaaaaacgcgac

SEQ ID NO: 15639 - DNA, 25 bp, E. coli
tgaacacgaaaaacgcgacttagcc

SEQ ID NO: 15640 - DNA, 25 bp, E. coli
tgcaacgagtcagcatcacgcttga

SEQ ID NO: 15641 - DNA, 25 bp, E. coli
tgcaacgagtcaccatcacgcttga

SEQ ID NO: 15642 - DNA, 25 bp, E. coli
tgaacacgaaaatcgcgacttagcc

SEQ ID NO: 15643 - DNA, 25 bp, E. coli
gcttgatgacgatttactggagacg

SEQ ID NO: 15644 - DNA, 25 bp, E. coli
gcttgatgacgaattactggagacg

SEQ ID NO: 15645 - DNA, 25 bp, E. coli
cgcggtgctgtcctatgtgtatgaa

SEQ ID NO: 15646 - DNA, 25 bp, E. coli
cgcggtgctgtcgtatgtgtatgaa

SEQ ID NO: 15647 - DNA, 25 bp, E. coli
ctgagccagcgtcgtggttataaca

SEQ ID NO: 15648 - DNA, 25 bp, E. coli
ctgagccagcgtggtggttataaca

SEQ ID NO: 15649 - DNA, 25 bp, E. coli
gagtcaccatcacgcttgatgacga

SEQ ID NO: 15650 - DNA, 25 bp, E. coli
gagtcaccatcaggcttgatgacga

SEQ ID NO: 15651 - DNA, 25 bp, E. coli
caattgaaggtattgccaggctgta

SEQ ID NO: 15652 - DNA, 25 bp, E. coli
caattgaaggtaatgccaggctgta

SEQ ID NO: 15653 - DNA, 25 bp, E. coli
tactggcgatgacaacgctgagcct

SEQ ID NO: 15654 - DNA, 25 bp, E. coli
tactggcgatgagaacgctgagcct

SEQ ID NO: 15655 - DNA, 25 bp, E. coli
tgcctaaagacagagagagcgtgtt

SEQ ID NO: 15656 - DNA, 25 bp, E. coli
tgcctaaagacacagagagcgtgtt

SEQ ID NO: 15657 - DNA, 25 bp, E. coli
tcgcgtattgatcccaaacgtgggc

SEQ ID NO: 15658 - DNA, 25 bp, E. coli
tcgcgtattgatgccaaacgtgggc

SEQ ID NO: 15659 - DNA, 25 bp, E. coli
tcaggttcagaacgtaaggcgtcat

SEQ ID NO: 15660 - DNA, 25 bp, E. coli
tcaggttcagaaggtaaggcgtcat

SEQ ID NO: 15661 - DNA, 25 bp, E. coli
ccttaatggcaaagcgaattctgca

SEQ ID NO: 15662 - DNA, 25 bp, E. coli
ccttaatggcaatgcgaattctgca

SEQ ID NO: 15663 - DNA, 25 bp, E. coli
gaataacccgttccttgtccagagt

SEQ ID NO: 15664 - DNA, 25 bp, E. coli
gaataacccgttgcttgtccagagt

SEQ ID NO: 15665 - DNA, 25 bp, E. coli
gaagggaaatccctctgaagccccg

SEQ ID NO: 15666 - DNA, 25 bp, E. coli
gaagccccgttagccctgaagtggt

SEQ ID NO: 15667 - DNA, 25 bp, E. coli
gaagggaaatccgtctgaagccccg

SEQ ID NO: 15668 - DNA, 25 bp, E. coli
gaagccccgttacccctgaagtggt

SEQ ID NO: 15669 - DNA, 25 bp, E. coli
gaaaaggtcgcgaatcaaagcctgc

SEQ ID NO: 15670 - DNA, 25 bp, E. coli
gacattgtcattacgggtactcgcg

SEQ ID NO: 15671 - DNA, 25 bp, E. coli
gacattgtcatttcgggtactcgcg

SEQ ID NO: 15672 - DNA, 25 bp, E. coli
gaaaaggtcgcgtatcaaagcctgc

SEQ ID NO: 15673 - DNA, 25 bp, E. coli
caatgttcggcatattaatggcgac

SEQ ID NO: 15674 - DNA, 25 bp, E. coli
caatgttcggcaaattaatggcgac

SEQ ID NO: 15675 - DNA, 25 bp, E. coli
aaagtcagcccgaatgttggccgta

SEQ ID NO: 15676 - DNA, 25 bp, E. coli
aaagtcagcccgtatgttggccgta

SEQ ID NO: 15677 - DNA, 25 bp, E. coli
ttggcgcgcgtaacacgaaaaccat

SEQ ID NO: 15678 - DNA, 25 bp, E. coli
ttggcgcgcgtatcacgaaaaccat

SEQ ID NO: 15679 - DNA, 25 bp, E. coli
tcgatgaagcggaacagaaacgcgg

SEQ ID NO: 15680 - DNA, 25 bp, E. coli
tcgatgaagcggtacagaaacgcgg

SEQ ID NO: 15681 - DNA, 25 bp, E. coli
tcattcagccgattagcagctatgt

SEQ ID NO: 15682 - DNA, 25 bp, E. coli
tcattcagccgaatagcagctatgt

SEQ ID NO: 15683 - DNA, 25 bp, E. coli
ccaatgacgatctggaatatcgcca

SEQ ID NO: 15684 - DNA, 25 bp, E. coli
ccaggaaaagatcccgacttcgtct

SEQ ID NO: 15685 - DNA, 25 bp, E. coli
ccaatgacgatcaggaatatcgcca

SEQ ID NO: 15686 - DNA, 25 bp, E. coli
gcagctatgttcttaccaatgacga

SEQ ID NO: 15687 - DNA, 25 bp, E. coli
gcagctatgttcataccaatgacga

SEQ ID NO: 15688 - DNA, 25 bp, E. coli
gaatatcgccacaaagtcagcccgt

SEQ ID NO: 15689 - DNA, 25 bp, E. coli
gaatatcgccactaagtcagcccgt

SEQ ID NO: 15690 - DNA, 25 bp, E. coli
ccaggaaaagatgccgacttcgtct

SEQ ID NO: 15691 - DNA, 25 bp, E. coli
ggtctgcagcaataaggccgtatcg

SEQ ID NO: 15692 - DNA, 25 bp, E. coli
ggtctgcagcaaaaaggccgtatcg

SEQ ID NO: 15693 - DNA, 25 bp, E. coli
taatggcgactatcgcagcagatat

SEQ ID NO: 15694 - DNA, 25 bp, E. coli
taatggcgactaacgcagcagatat

SEQ ID NO: 15695 - DNA, 25 bp, E. coli
tacagtctcaatctcaacggtccgg

SEQ ID NO: 15696 - DNA, 25 bp, E. coli
tacagtctcaatgtcaacggtccgg

SEQ ID NO: 15697 - DNA, 25 bp, E. coli
aaagcatcggctacgttgaaaccca

SEQ ID NO: 15698 - DNA, 25 bp, E. coli
aaatcggttttgtcgcgcctggtca

SEQ ID NO: 15699 - DNA, 25 bp, E. coli
aaagcatcggcttcgttgaaaccca

SEQ ID NO: 15700 - DNA, 25 bp, E. coli
aaatcggttttgacgcgcctggtca

SEQ ID NO: 15701 - DNA, 25 bp, E. coli
tatggtcataaggatctgctcgcac

SEQ ID NO: 15702 - DNA, 25 bp, E. coli
tatggtcataagcatctgctcgcac

SEQ ID NO: 15703 - DNA, 25 bp, E. coli
tatcaaatgccttactcgaagctgg

SEQ ID NO: 15704 - DNA, 25 bp, E. coli
tatcaaatgcctaactcgaagctgg

SEQ ID NO: 15705 - DNA, 25 bp, E. coli
ttatatcccgatacagccgcaggag

SEQ ID NO: 15706 - DNA, 25 bp, E. coli
ttcggttacagtcacaaagaggcgc

SEQ ID NO: 15707 - DNA, 25 bp, E. coli
ttatatcccgattcagccgcaggag

SEQ ID NO: 15708 - DNA, 25 bp, E. coli
ttcggttacagtgacaaagaggcgc

SEQ ID NO: 15709 - DNA, 25 bp, E. coli
tgaagttgcctaccatgcgctggaa

SEQ ID NO: 15710 - DNA, 25 bp, E. coli
tgaagttgcctagcatgcgctggaa

SEQ ID NO: 15711 - DNA, 25 bp, E. coli
gaactgttgctgcaaatatcgccgg

SEQ ID NO: 15712 - DNA, 25 bp, E. coli
gaactgttgctggaaatatcgccgg

SEQ ID NO: 15713 - DNA, 25 bp, E. coli
cgatgaccatgagcaagtgcgagca

SEQ ID NO: 15714 - DNA, 25 bp, E. coli
cgatgaccatgaccaagtgcgagca

SEQ ID NO: 15715 - DNA, 25 bp, E. coli
gtatcaactgggttaggctgccgcc

SEQ ID NO: 15716 - DNA, 25 bp, E. coli
gtatcaactgggataggctgccgcc

SEQ ID NO: 15717 - DNA, 25 bp, E. coli
aagaggtgaggttttcagagcagac

SEQ ID NO: 15718 - DNA, 25 bp, E. coli
aatttgtctgcagaaggattacatc

SEQ ID NO: 15719 - DNA, 25 bp, E. coli
aagaggtgaggtattcagagcagac

SEQ ID NO: 15720 - DNA, 25 bp, E. coli
aatttgtctgcacaaggattacatc

SEQ ID NO: 15721 - DNA, 25 bp, E. coli
taggtaacaagaaatttgtctgcac

SEQ ID NO: 15722 - DNA, 25 bp, E. coli
taggtaacaagatatttgtctgcac

SEQ ID NO: 15723 - DNA, 25 bp, E. coli
ttcagagcagactacggtgaaatgt

SEQ ID NO: 15724 - DNA, 25 bp, E. coli
ttcagagcagacaacggtgaaatgt

SEQ ID NO: 15725 - DNA, 25 bp, E. coli
tgaggttttcagtgcagacaacggt

SEQ ID NO: 15726 - DNA, 25 bp, E. coli
tgaggttttcagagcagacaacggt

SEQ ID NO: 15727 - DNA, 25 bp, E. coli
tccagctaagaggtgaggttttcag

SEQ ID NO: 15728 - DNA, 25 bp, E. coli
tccagctaagagctgaggttttcag

SEQ ID NO: 15729 - DNA, 25 bp, E. coli
tcatggtattgtaacgtttaggtaa

SEQ ID NO: 15730 - DNA, 25 bp, E. coli
tcatggtattgttacgtttaggtaa

SEQ ID NO: 15731 - DNA, 25 bp, E. coli
ccttccctaactaatcaatgcgttg

SEQ ID NO: 15732 - DNA, 25 bp, E. coli
ccttccctaacttatcaatgcgttg

SEQ ID NO: 15733 - DNA, 25 bp, E. coli
cggtgaaatgtcttggtattgttac

SEQ ID NO: 15734 - DNA, 25 bp, E. coli
cggtgaaatgtcatggtattgttac

SEQ ID NO: 15735 - DNA, 25 bp, E. coli
gattgtaaatccagctaagaggtga

SEQ ID NO: 15736 - DNA, 25 bp, E. coli
gattgtaaatcctgctaagaggtga

SEQ ID NO: 15737 - DNA, 25 bp, E. coli
tcaatgcgttgattgtaaatccagc

SEQ ID NO: 15738 - DNA, 25 bp, E. coli
tcaatgcgttgaatgtaaatccagc

SEQ ID NO: 15739 - DNA, 25 bp, E. coli
aattattaaaacacgaagagatggc

SEQ ID NO: 15740 - DNA, 25 bp, E. coli
aattattaaaactcgaagagatggc

SEQ ID NO: 15741 - DNA, 25 bp, E. coli
tagtcaccagatggagaaagtatgg

SEQ ID NO: 15742 - DNA, 25 bp, E. coli
taccgttactgtagagtgtaagggc

SEQ ID NO: 15743 - DNA, 25 bp, E. coli
tagtcaccagatcgagaaagtatgg

SEQ ID NO: 15744 - DNA, 25 bp, E. coli
taccgttactgttgagtgtaagggc

SEQ ID NO: 15745 - DNA, 25 bp, E. coli
tttaaaggacgaagcgataacccct

SEQ ID NO: 15746 - DNA, 25 bp, E. coli
tttaaaggacgatgcgataacccct

SEQ ID NO: 15747 - DNA, 25 bp, E. coli
tgataaactggataatgattcgcaa

SEQ ID NO: 15748 - DNA, 25 bp, E. coli
tgataaactggaaaatgattcgcaa

SEQ ID NO: 15749 - DNA, 25 bp, E. coli
tgcaacatggtcactggaaggtaaa

SEQ ID NO: 15750 - DNA, 25 bp, E. coli
tgcaacatggtctctggaaggtaaa

SEQ ID NO: 15751 - DNA, 25 bp, E. coli
gaaggtaaatgatcgtagtcaccag

SEQ ID NO: 15752 - DNA, 25 bp, E. coli
gaaggtaaatgaacgtagtcaccag

SEQ ID NO: 15753 - DNA, 25 bp, E. coli
gattagaaacatgtcttcaagccat

SEQ ID NO: 15754 - DNA, 25 bp, E. coli
gattagaaacatctcttcaagccat

SEQ ID NO: 15755 - DNA, 25 bp, E. coli
ggttgataaaactcatcgtgcaaag

SEQ ID NO: 15756 - DNA, 25 bp, E. coli
ggttgataaaacacatcgtgcaaag

SEQ ID NO: 15757 - DNA, 25 bp, E. coli
gatgggctttctatcatagcgagaa

SEQ ID NO: 15758 - DNA, 25 bp, E. coli
gatgggctttctttcatagcgagaa

SEQ ID NO: 15759 - DNA, 25 bp, E. coli
gatggcttcatctgcatacaaacat

SEQ ID NO: 15760 - DNA, 25 bp, E. coli
gatggcttcatcagcatacaaacat

SEQ ID NO: 15761 - DNA, 25 bp, E. coli
tacaaagtggtccatgcgctggtga

SEQ ID NO: 15762 - DNA, 25 bp, E. coli
tacaaagtggtcgatgcgctggtga

SEQ ID NO: 15763 - DNA, 25 bp, E. coli
agaactgctgctgggcgatgacgaa

SEQ ID NO: 15764 - DNA, 25 bp, E. coli
agaactgctgctcggcgatgacgaa

SEQ ID NO: 15765 - DNA, 25 bp, E. coli
tatccgggcttcgagtacaaagtgg

SEQ ID NO: 15766 - DNA, 25 bp, E. coli
tatccgggcttccagtacaaagtgg

SEQ ID NO: 15767 - DNA, 25 bp, E. coli
tattaacgcaactatgaccgcgcgc

SEQ ID NO: 15768 - DNA, 25 bp, E. coli
tattaacgcaacaatgaccgcgcgc

SEQ ID NO: 15769 - DNA, 25 bp, E. coli
tttactgtcgctggacgggccgacg

SEQ ID NO: 15770 - DNA, 25 bp, E. coli
tttactgtcgctcgacgggccgacg

SEQ ID NO: 15771 - DNA, 25 bp, E. coli
ccagcggcggcatgattgaagtgct

SEQ ID NO: 15772 - DNA, 25 bp, E. coli
ccagcggcggcaagattgaagtgct

SEQ ID NO: 15773 - DNA, 25 bp, E. coli
gccacggcgcactgtttgaagtcga

SEQ ID NO: 15774 - DNA, 25 bp, E. coli
gccacggcgcacagtttgaagtcga

SEQ ID NO: 15775 - DNA, 25 bp, E. coli
gctcgacgacaaacgcattcttgcg

SEQ ID NO: 15776 - DNA, 25 bp, E. coli
gctcgacgacaatcgcattcttgcg

SEQ ID NO: 15777 - DNA, 25 bp, E. coli
gatattctcaacagcatcggccata

SEQ ID NO: 15778 - DNA, 25 bp, E. coli
gtttatcacgtacaatccgcaggca

SEQ ID NO: 15779 - DNA, 25 bp, E. coli
gatattctcaactgcatcggccata

SEQ ID NO: 15780 - DNA, 25 bp, E. coli
gatcacatcatgcactcggaatacg

SEQ ID NO: 15781 - DNA, 25 bp, E. coli
gtttatcacgtagaatccgcaggca

SEQ ID NO: 15782 - DNA, 25 bp, E. coli
gatcacatcatggactcggaatacg

SEQ ID NO: 15783 - DNA, 25 bp, E. coli
caacatcgattgataccaccgccga

SEQ ID NO: 15784 - DNA, 25 bp, E. coli
caatggcgctttgattaatgctggg

SEQ ID NO: 15785 - DNA, 25 bp, E. coli
caatggcgctttcattaatgctggg

SEQ ID NO: 15786 - DNA, 25 bp, E. coli
caacatcgattgttaccaccgccga

SEQ ID NO: 15787 - DNA, 25 bp, E. coli
tccagaaagcaaaagcaggatgccc

SEQ ID NO: 15788 - DNA, 25 bp, E. coli
tccataagaaaggtcaggcacactg

SEQ ID NO: 15789 - DNA, 25 bp, E. coli
tcgctggataaagtggatgccggtt

SEQ ID NO: 15790 - DNA, 25 bp, E. coli
tcgctggataaactggatgccggtt

SEQ ID NO: 15791 - DNA, 25 bp, E. coli
tccataagaaagctcaggcacactg

SEQ ID NO: 15792 - DNA, 25 bp, E. coli
tccagaaagcaatagcaggatgccc

SEQ ID NO: 15793 - DNA, 25 bp, E. coli
tcaggtactgaatgcggaaattacg

SEQ ID NO: 15794 - DNA, 25 bp, E. coli
tcaggtactgaaagcggaaattacg

SEQ ID NO: 15795 - DNA, 25 bp, E. coli
gaagcgggattctcgccaacatcga

SEQ ID NO: 15796 - DNA, 25 bp, E. coli
gcatgccgcatgtttctcaatggcg

SEQ ID NO: 15797 - DNA, 25 bp, E. coli
gcatgccgcatgattctcaatggcg

SEQ ID NO: 15798 - DNA, 25 bp, E. coli
gaagcgggattcacgccaacatcga

SEQ ID NO: 15799 - DNA, 25 bp, E. coli
cgtgctgaaccatcagccgtatgga

SEQ ID NO: 15800 - DNA, 25 bp, E. coli
cgtgctgaaccaacagccgtatgga

SEQ ID NO: 15801 - DNA, 25 bp, E. coli
ggaaccaaccctcaagaactgattg

SEQ ID NO: 15802 - DNA, 25 bp, E. coli
ggaaccaaccctgaagaactgattg

SEQ ID NO: 15803 - DNA, 25 bp, E. coli
tcaaacgcgggatgggaacagtatc

SEQ ID NO: 15804 - DNA, 25 bp, E. coli
tcaaacgcgggaagggaacagtatc

SEQ ID NO: 15805 - DNA, 25 bp, E. coli
catggctttggctaagtcaccgata

SEQ ID NO: 15806 - DNA, 25 bp, E. coli
catggctttggcaaagtcaccgata

SEQ ID NO: 15807 - DNA, 25 bp, E. coli
ttctgggcgcatcgctttggcaaag

SEQ ID NO: 15808 - DNA, 25 bp, E. coli
ttctgggcgcatggctttggcaaag

SEQ ID NO: 15809 - DNA, 25 bp, E. coli
tccgacgcgattgcctattatcaac

SEQ ID NO: 15810 - DNA, 25 bp, E. coli
tccgacgcgattccctattatcaac

SEQ ID NO: 15811 - DNA, 25 bp, E. coli
tgcccttccggattgcaatttcccg

SEQ ID NO: 15812 - DNA, 25 bp, E. coli
tgcccttccggaatgcaatttcccg

SEQ ID NO: 15813 - DNA, 25 bp, E. coli
cctattatcaacctacgttgggcgc

SEQ ID NO: 15814 - DNA, 25 bp, E. coli
cctattatcaacgtacgttgggcgc

SEQ ID NO: 15815 - DNA, 25 bp, E. coli
gctctataaaatgagcttcggcgaa

SEQ ID NO: 15816 - DNA, 25 bp, E. coli
gctctataaaatcagcttcggcgaa

SEQ ID NO: 15817 - DNA, 25 bp, E. coli
gtcaccgataaaattggcgtaccgt

SEQ ID NO: 15818 - DNA, 25 bp, E. coli
gtcaccgataaatttggcgtaccgt

SEQ ID NO: 15819 - DNA, 25 bp, E. coli
gaaaaatcgaaatggcctggcagga

SEQ ID NO: 15820 - DNA, 25 bp, E. coli
taagtccctaccactcttttgccgg

SEQ ID NO: 15821 - DNA, 25 bp, E. coli
gaaaaatcgaaaaggcctggcagga

SEQ ID NO: 15822 - DNA, 25 bp, E. coli
taagtccctacctctcttttgccgg

SEQ ID NO: 15823 - DNA, 25 bp, E. coli
ggaatgcaatttgccgataccgcca

SEQ ID NO: 15824 - DNA, 25 bp, E. coli
tggcgtaccgtgcatgattaatgtc

SEQ ID NO: 15825 - DNA, 25 bp, E. coli
ggaatgcaatttcccgataccgcca

SEQ ID NO: 15826 - DNA, 25 bp, E. coli
tggcgtaccgtggatgattaatgtc

SEQ ID NO: 15827 - DNA, 25 bp, E. coli
aagagttcgaccagagcagcccaca

SEQ ID NO: 15828 - DNA, 25 bp, E. coli
aagagttcgacctgagcagcccaca

SEQ ID NO: 15829 - DNA, 25 bp, E. coli
aagttcaggcaaagctcaaagaacg

SEQ ID NO: 15830 - DNA, 25 bp, E. coli
aagttcaggcaatgctcaaagaacg

SEQ ID NO: 15831 - DNA, 25 bp, E. coli
cacaagttcaggcaaagctcaaaga

SEQ ID NO: 15832 - DNA, 25 bp, E. coli
cacaagttcagggaaagctcaaaga

SEQ ID NO: 15833 - DNA, 25 bp, E. coli
ttcgacctgagctgcccacaagttc

SEQ ID NO: 15834 - DNA, 25 bp, E. coli
ttcgacctgagcagcccacaagttc

SEQ ID NO: 15835 - DNA, 25 bp, E. coli
ttgaaagagttccacctgagcagcc

SEQ ID NO: 15836 - DNA, 25 bp, E. coli
ttgaaagagttcgacctgagcagcc

SEQ ID NO: 15837 - DNA, 25 bp, E. coli
tgagcagcccactagttcaggcaaa

SEQ ID NO: 15838 - DNA, 25 bp, E. coli
tgagcagcccacaagttcaggcaaa

SEQ ID NO: 15839 - DNA, 25 bp, E. coli
gcagcccacaagatcaggcaaagct

SEQ ID NO: 15840 - DNA, 25 bp, E. coli
gcagcccacaagttcaggcaaagct

SEQ ID NO: 15841 - DNA, 25 bp, E. coli
gaaagagttcgagctgagcagccca

SEQ ID NO: 15842 - DNA, 25 bp, E. coli
gaaagagttcgacctgagcagccca

SEQ ID NO: 15843 - DNA, 25 bp, E. coli
cccacaagttcacgcaaagctcaaa

SEQ ID NO: 15844 - DNA, 25 bp, E. coli
cccacaagttcaggcaaagctcaaa

SEQ ID NO: 15845 - DNA, 25 bp, E. coli
gttcgacctgagcagcccacaagtt

SEQ ID NO: 15846 - DNA, 25 bp, E. coli
gttcgacctgaggagcccacaagtt

SEQ ID NO: 15847 - DNA, 25 bp, E. coli
gagcagcccacaagttcaggcaaag

SEQ ID NO: 15848 - DNA, 25 bp, E. coli
gagcagcccacatgttcaggcaaag

SEQ ID NO: 15849 - DNA, 25 bp, E. coli
catttaatcgcattttgtgagcctg

SEQ ID NO: 15850 - DNA, 25 bp, E. coli
tacgtaaaacatgcatactatgagc

SEQ ID NO: 15851 - DNA, 25 bp, E. coli
taaaaggtgtgtaacagggcagaaa

SEQ ID NO: 15852 - DNA, 25 bp, E. coli
taaaaggtgtgttacagggcagaaa

SEQ ID NO: 15853 - DNA, 25 bp, E. coli
tacgtaaaacatccatactatgagc

SEQ ID NO: 15854 - DNA, 25 bp, E. coli
tattgttctgttctgtgcatcccgt

SEQ ID NO: 15855 - DNA, 25 bp, E. coli
tattgttctgttgtgtgcatcccgt

SEQ ID NO: 15856 - DNA, 25 bp, E. coli
tgtcctgtaacaattgatgagcgca

SEQ ID NO: 15857 - DNA, 25 bp, E. coli
tgtcctgtaacatttgatgagcgca

SEQ ID NO: 15858 - DNA, 25 bp, E. coli
tgtgagcctgctcaaatctgcccat

SEQ ID NO: 15859 - DNA, 25 bp, E. coli
tgtgagcctgctgaaatctgcccat

SEQ ID NO: 15860 - DNA, 25 bp, E. coli
tcaggttatttcgtcaagggcagat

SEQ ID NO: 15861 - DNA, 25 bp, E. coli
tcaggttatttcctcaagggcagat

SEQ ID NO: 15862 - DNA, 25 bp, E. coli
gcctctctggcgctaatttacttta

SEQ ID NO: 15863 - DNA, 25 bp, E. coli
gcctctctggcggtaatttacttta

SEQ ID NO: 15864 - DNA, 25 bp, E. coli
catttaatcgcaatttgtgagcctg

SEQ ID NO: 15865 - DNA, 25 bp, E. coli
gtaattttttaccagaggacgtgct

SEQ ID NO: 15866 - DNA, 25 bp, E. coli
gtaattttttacgagaggacgtgct

SEQ ID NO: 15867 - DNA, 25 bp, E. coli
tcaaacgttcatcaaacactcaggt

SEQ ID NO: 15868 - DNA, 25 bp, E. coli
tcaaacgttcatgaaacactcaggt

SEQ ID NO: 15869 - DNA, 25 bp, E. coli
gatgagcgcaaacagaatgaccggt

SEQ ID NO: 15870 - DNA, 25 bp, E. coli
gatgagcgcaaagagaatgaccggt

SEQ ID NO: 15871 - DNA, 25 bp, E. coli
cacagttggtcgtgttagtggttga

SEQ ID NO: 15872 - DNA, 25 bp, E. coli
cacagttggtcgagttagtggttga

SEQ ID NO: 15873 - DNA, 25 bp, E. coli
caacaggcgatgaaaccatcgagca

SEQ ID NO: 15874 - DNA, 25 bp, E. coli
caacaggcgatgtaaccatcgagca

SEQ ID NO: 15875 - DNA, 25 bp, E. coli
cagtccgggaaaattattcgcaaca

SEQ ID NO: 15876 - DNA, 25 bp, E. coli
cagtccgggaaatttattcgcaaca

SEQ ID NO: 15877 - DNA, 25 bp, E. coli
tattcgatagctcgaaaccgggtga

SEQ ID NO: 15878 - DNA, 25 bp, E. coli
tattcgatagctggaaaccgggtga

SEQ ID NO: 15879 - DNA, 25 bp, E. coli
ttaaaaaaggcgtcctggctggtgg

SEQ ID NO: 15880 - DNA, 25 bp, E. coli
ttaaaaaaggcgacctggctggtgg

SEQ ID NO: 15881 - DNA, 25 bp, E. coli
gcctggcaggatgataccgtgcgta

SEQ ID NO: 15882 - DNA, 25 bp, E. coli
gcctggcaggatcataccgtgcgta

SEQ ID NO: 15883 - DNA, 25 bp, E. coli
ccggcacattaagaaacagcgaagt

SEQ ID NO: 15884 - DNA, 25 bp, E. coli
gaagtaaacaccctgaccaaccaga

SEQ ID NO: 15885 - DNA, 25 bp, E. coli
gaagtaaacaccgtgaccaaccaga

SEQ ID NO: 15886 - DNA, 25 bp, E. coli
ccggcacattaacaaacagcgaagt

SEQ ID NO: 15887 - DNA, 25 bp, E. coli
gtatgtgaatgacttaaccggcaca

SEQ ID NO: 15888 - DNA, 25 bp, E. coli
gttctactgttagtcgcctggcagg

SEQ ID NO: 15889 - DNA, 25 bp, E. coli
gttctactgttactcgcctggcagg

SEQ ID NO: 15890 - DNA, 25 bp, E. coli
gtatgtgaatgagttaaccggcaca

SEQ ID NO: 15891 - DNA, 25 bp, E. coli
gaccaaccagattaaagccctgacg

SEQ ID NO: 15892 - DNA, 25 bp, E. coli
gaccaaccagataaaagccctgacg

SEQ ID NO: 15893 - DNA, 25 bp, E. coli
tacaacaacccgaaatatgctggcg

SEQ ID NO: 15894 - DNA, 25 bp, E. coli
tacaacaacccgtaatatgctggcg

SEQ ID NO: 15895 - DNA, 25 bp, E. coli
tataggcacacatggttgggctgca

SEQ ID NO: 15896 - DNA, 25 bp, E. coli
tataggcacacaaggttgggctgca

SEQ ID NO: 15897 - DNA, 25 bp, E. coli
ttaggcgagcaggaaaacgtcggct

SEQ ID NO: 15898 - DNA, 25 bp, E. coli
ttccaggtgaaattgccgaaacgct

SEQ ID NO: 15899 - DNA, 25 bp, E. coli
ttaggcgagcagcaaaacgtcggct

SEQ ID NO: 15900 - DNA, 25 bp, E. coli
ttaccaacccaacagatgtagagcg

SEQ ID NO: 15901 - DNA, 25 bp, E. coli
ttaccaacccaagagatgtagagcg

SEQ ID NO: 15902 - DNA, 25 bp, E. coli
ttccaggtgaaaatgccgaaacgct

SEQ ID NO: 15903 - DNA, 25 bp, E. coli
tgaaaatcacctgtgttaacgtcgg

SEQ ID NO: 15904 - DNA, 25 bp, E. coli
tgaaaatcacctctgttaacgtcgg

SEQ ID NO: 15905 - DNA, 25 bp, E. coli
tgaaagcactgaaagccaaaccggt

SEQ ID NO: 15906 - DNA, 25 bp, E. coli
tgaaagcactgatagccaaaccggt

SEQ ID NO: 15907 - DNA, 25 bp, E. coli
tatggcattccgacagggtaaaacc

SEQ ID NO: 15908 - DNA, 25 bp, E. coli
tatggcattccgtcagggtaaaacc

SEQ ID NO: 15909 - DNA, 25 bp, E. coli
gccaaaatgattcgcgtctacaaca

SEQ ID NO: 15910 - DNA, 25 bp, E. coli
gccaaaatgattggcgtctacaaca

SEQ ID NO: 15911 - DNA, 25 bp, E. coli
gcaaaactcgacaccactaaaggcg

SEQ ID NO: 15912 - DNA, 25 bp, E. coli
gcaaaactcgactccactaaaggcg

SEQ ID NO: 15913 - DNA, 25 bp, E. coli
cgtctcgttgaacgcggcgtgaaaa

SEQ ID NO: 15914 - DNA, 25 bp, E. coli
cgtctcgttgaaggcggcgtgaaaa

SEQ ID NO: 15915 - DNA, 25 bp, E. coli
tttttggagaagatggtgcatccgg

SEQ ID NO: 15916 - DNA, 25 bp, E. coli
tttttggagaagttggtgcatccgg

SEQ ID NO: 15917 - DNA, 25 bp, E. coli
tggtgcctgcggataataccgctat

SEQ ID NO: 15918 - DNA, 25 bp, E. coli
tggtgcctgcggttaataccgctat

SEQ ID NO: 15919 - DNA, 25 bp, E. coli
tgcatccgggagcatgactcactga

SEQ ID NO: 15920 - DNA, 25 bp, E. coli
tgcatccgggaggatgactcactga

SEQ ID NO: 15921 - DNA, 25 bp, E. coli
tccgggaggatgtctcactgacgtt

SEQ ID NO: 15922 - DNA, 25 bp, E. coli
tccgggaggatgactcactgacgtt

SEQ ID NO: 15923 - DNA, 25 bp, E. coli
tctcgcaagtcgtaaaatatgacgc

SEQ ID NO: 15924 - DNA, 25 bp, E. coli
tctcgcaagtcgaaaaatatgacgc

SEQ ID NO: 15925 - DNA, 25 bp, E. coli
gcaagtcgaaaattatgacgctact

SEQ ID NO: 15926 - DNA, 25 bp, E. coli
gcaagtcgaaaaatatgacgctact

SEQ ID NO: 15927 - DNA, 25 bp, E. coli
gactcactgacgttcgcccttcggg

SEQ ID NO: 15928 - DNA, 25 bp, E. coli
gactcactgacgatcgcccttcggg

SEQ ID NO: 15929 - DNA, 25 bp, E. coli
cgaaaaatatgaggctactttagcg

SEQ ID NO: 15930 - DNA, 25 bp, E. coli
cgaaaaatatgacgctactttagcg

SEQ ID NO: 15931 - DNA, 25 bp, E. coli
ggaggatgactcactgacgttcgcc

SEQ ID NO: 15932 - DNA, 25 bp, E. coli
ggtcttctcgcaagtcgaaaaatat

SEQ ID NO: 15933 - DNA, 25 bp, E. coli
ggtcttctcgcatgtcgaaaaatat

SEQ ID NO: 15934 - DNA, 25 bp, E. coli
ggatgactcactgacgttcgccctt

SEQ ID NO: 15935 - DNA, 25 bp, E. coli
ggatgactcactcacgttcgccctt

SEQ ID NO: 15936 - DNA, 25 bp, E. coli
ggaggatgactctctgacgttcgcc

SEQ ID NO: 15937 - DNA, 25 bp, E. coli
caaattgagtggcataacctgcgca

SEQ ID NO: 15938 - DNA, 25 bp, E. coli
caaattgagtgggataacctgcgca

SEQ ID NO: 15939 - DNA, 25 bp, E. coli
ataacctgcgcagtgaccgcaaggg

SEQ ID NO: 15940 - DNA, 25 bp, E. coli
ataacctgcgcactgaccgcaaggg

SEQ ID NO: 15941 - DNA, 25 bp, E. coli
aaatctgacgaactggaaccactgc

SEQ ID NO: 15942 - DNA, 25 bp, E. coli
aaaagcgcccttccgctgattggca

SEQ ID NO: 15943 - DNA, 25 bp, E. coli
aaatctgacgaagtggaaccactgc

SEQ ID NO: 15944 - DNA, 25 bp, E. coli
aaaagcgcccttgcgctgattggca

SEQ ID NO: 15945 - DNA, 25 bp, E. coli
tttatttgtgagctacctaacggcg

SEQ ID NO: 15946 - DNA, 25 bp, E. coli
tttatttgtgaggtacctaacggcg

SEQ ID NO: 15947 - DNA, 25 bp, E. coli
tccggcaagccaggttgaaacgctg

SEQ ID NO: 15948 - DNA, 25 bp, E. coli
tccggcaagccacgttgaaacgctg

SEQ ID NO: 15949 - DNA, 25 bp, E. coli
gaactggaaccagtgccggtttcac

SEQ ID NO: 15950 - DNA, 25 bp, E. coli
gaactggaaccactgccggtttcac

SEQ ID NO: 15951 - DNA, 25 bp, E. coli
ggtttcactgaccaatctgaatccg

SEQ ID NO: 15952 - DNA, 25 bp, E. coli
ggtttcactgacgaatctgaatccg

SEQ ID NO: 15953 - DNA, 25 bp, E. coli
taagccaatggctgcgcgatgaatt

SEQ ID NO: 15954 - DNA, 25 bp, E. coli
taactgccagttactgatttccggg

SEQ ID NO: 15955 - DNA, 25 bp, E. coli
taagccaatggcagcgcgatgaatt

SEQ ID NO: 15956 - DNA, 25 bp, E. coli
taactgccagtttctgatttccggg

SEQ ID NO: 15957 - DNA, 25 bp, E. coli
gaccgcaagggcaacgccaaaagcg

SEQ ID NO: 15958 - DNA, 25 bp, E. coli
gaccgcaagggctacgccaaaagcg

SEQ ID NO: 15959 - DNA, 25 bp, E. coli
cagcctgaacggtggtgattttctc

SEQ ID NO: 15960 - DNA, 25 bp, E. coli
cagcctgaacggaggtgattttctc

SEQ ID NO: 15961 - DNA, 25 bp, E. coli
cagagccattaccagctcaacggtg

SEQ ID NO: 15962 - DNA, 25 bp, E. coli
cagagccattacgagctcaacggtg

SEQ ID NO: 15963 - DNA, 25 bp, E. coli
tcgtccggaatctcagtatcaaact

SEQ ID NO: 15964 - DNA, 25 bp, E. coli
tgatgtaatcaatggcagcctgaac

SEQ ID NO: 15965 - DNA, 25 bp, E. coli
tcgtccggaatcacagtatcaaact

SEQ ID NO: 15966 - DNA, 25 bp, E. coli
tgatgtaatcaaaggcagcctgaac

SEQ ID NO: 15967 - DNA, 25 bp, E. coli
cgcctggtggcccttgatgtaatca

SEQ ID NO: 15968 - DNA, 25 bp, E. coli
cgcctggtggccgttgatgtaatca

SEQ ID NO: 15969 - DNA, 25 bp, E. coli
gattttctcagcttcttcgtccgga

SEQ ID NO: 15970 - DNA, 25 bp, E. coli
gtatcaaactctacttccagagcca

SEQ ID NO: 15971 - DNA, 25 bp, E. coli
gattttctcagcatcttcgtccgga

SEQ ID NO: 15972 - DNA, 25 bp, E. coli
gtatcaaactcttcttccagagcca

SEQ ID NO: 15973 - DNA, 25 bp, E. coli
ggtcttcaacgaaagaagcattgtt

SEQ ID NO: 15974 - DNA, 25 bp, E. coli
ggtcttcaacgatagaagcattgtt

SEQ ID NO: 15975 - DNA, 25 bp, E. coli
tcaacggtgtcaagagaatccgcgc

SEQ ID NO: 15976 - DNA, 25 bp, E. coli
taacgcgttcttcgatagtgctcat

SEQ ID NO: 15977 - DNA, 25 bp, E. coli
taacgcccagctgttcgccgataat

SEQ ID NO: 15978 - DNA, 25 bp, E. coli
tcaacggtgtcatgagaatccgcgc

SEQ ID NO: 15979 - DNA, 25 bp, E. coli
taacgcgttcttggatagtgctcat

SEQ ID NO: 15980 - DNA, 25 bp, E. coli
taacgcccagctcttcgccgataat

SEQ ID NO: 15981 - DNA, 25 bp, E. coli
caaattaggcgtcaataaattccat

SEQ ID NO: 15982 - DNA, 25 bp, E. coli
caaattaggcgtgaataaattccat

SEQ ID NO: 15983 - DNA, 25 bp, E. coli
caggatgacgcaggaaacattcatt

SEQ ID NO: 15984 - DNA, 25 bp, E. coli
caggatgacgcacgaaacattcatt

SEQ ID NO: 15985 - DNA, 25 bp, E. coli
taaattccatgttgatgagggccac

SEQ ID NO: 15986 - DNA, 25 bp, E. coli
taaattccatgtagatgagggccac

SEQ ID NO: 15987 - DNA, 25 bp, E. coli
aacactattctccaacagtggcaat

SEQ ID NO: 15988 - DNA, 25 bp, E. coli
aacactattctcgaacagtggcaat

SEQ ID NO: 15989 - DNA, 25 bp, E. coli
tatcccgcaggctccttcggtattg

SEQ ID NO: 15990 - DNA, 25 bp, E. coli
tatcccgcaggcaccttcggtattg

SEQ ID NO: 15991 - DNA, 25 bp, E. coli
tgagccagaacgctacggttaacgt

SEQ ID NO: 15992 - DNA, 25 bp, E. coli
tgagccagaacggtacggttaacgt

SEQ ID NO: 15993 - DNA, 25 bp, E. coli
tgatgagggccacccgcatatcatt

SEQ ID NO: 15994 - DNA, 25 bp, E. coli
tgatgagggccagccgcatatcatt

SEQ ID NO: 15995 - DNA, 25 bp, E. coli
tgccctgccggactttataagcagg

SEQ ID NO: 15996 - DNA, 25 bp, E. coli
tcgaacagtggcaatatcccgcagg

SEQ ID NO: 15997 - DNA, 25 bp, E. coli
tgccctgccggagtttataagcagg

SEQ ID NO: 15998 - DNA, 25 bp, E. coli
tcgaacagtggctatatcccgcagg

SEQ ID NO: 15999 - DNA, 25 bp, E. coli
gactttataagctggatgacgcagg

SEQ ID NO: 16000 - DNA, 25 bp, E. coli
gactttataagcaggatgacgcagg

SEQ ID NO: 16001 - DNA, 25 bp, E. coli
ggttaacgtcgagatcaaattaggc

SEQ ID NO: 16002 - DNA, 25 bp, E. coli
ggttaacgtcgacatcaaattaggc

SEQ ID NO: 16003 - DNA, 25 bp, E. coli
cggaacgttacctgaaggatgactg

SEQ ID NO: 16004 - DNA, 25 bp, E. coli
caactttttgccattgatggcgcac

SEQ ID NO: 16005 - DNA, 25 bp, E. coli
aacccgagctgcctgaatattatgg

SEQ ID NO: 16006 - DNA, 25 bp, E. coli
cggaacgttaccagaaggatgactg

SEQ ID NO: 16007 - DNA, 25 bp, E. coli
caactttttgcctttgatggcgcac

SEQ ID NO: 16008 - DNA, 25 bp, E. coli
aggatgactggcacggcctgcaact

SEQ ID NO: 16009 - DNA, 25 bp, E. coli
aggatgactggctcggcctgcaact

SEQ ID NO: 16010 - DNA, 25 bp, E. coli
aacccgagctgcgtgaatattatgg

SEQ ID NO: 16011 - DNA, 25 bp, E. coli
ttacctgaaggatgactggcacggc

SEQ ID NO: 16012 - DNA, 25 bp, E. coli
ttacctgaaggaagactggcacggc

SEQ ID NO: 16013 - DNA, 25 bp, E. coli
tgatggcgcacagttcaggacacct

SEQ ID NO: 16014 - DNA, 25 bp, E. coli
tgatggcgcacacttcaggacacct

SEQ ID NO: 16015 - DNA, 25 bp, E. coli
gcacggcctgcatctttttgccatt

SEQ ID NO: 16016 - DNA, 25 bp, E. coli
gcacggcctgcaactttttgccatt

SEQ ID NO: 16017 - DNA, 25 bp, E. coli
gactggcacggcctgcaactttttg

SEQ ID NO: 16018 - DNA, 25 bp, E. coli
gactggcacggcgtgcaactttttg

SEQ ID NO: 16019 - DNA, 25 bp, E. coli
cattgatggcgcacagttcaggaca

SEQ ID NO: 16020 - DNA, 25 bp, E. coli
ctgaaggatgacaggcacggcctgc

SEQ ID NO: 16021 - DNA, 25 bp, E. coli
cattgatggcgctcagttcaggaca

SEQ ID NO: 16022 - DNA, 25 bp, E. coli
ctgaaggatgactggcacggcctgc

SEQ ID NO: 16023 - DNA, 25 bp, E. coli
tggcgcacagttcaggacacctgat

SEQ ID NO: 16024 - DNA, 25 bp, E. coli
tggcgcacagttgaggacacctgat

SEQ ID NO: 16025 - DNA, 25 bp, E. coli
caatcgcggttttctggcgcaggct

SEQ ID NO: 16026 - DNA, 25 bp, E. coli
caatcgcggtttactggcgcaggct

SEQ ID NO: 16027 - DNA, 25 bp, E. coli
caggtagaaaatgtcggcggcagca

SEQ ID NO: 16028 - DNA, 25 bp, E. coli
caggtagaaaatctcggcggcagca

SEQ ID NO: 16029 - DNA, 25 bp, E. coli
taaactgatgcaccgactcgacggt

SEQ ID NO: 16030 - DNA, 25 bp, E. coli
taaactgatgcagcgactcgacggt

SEQ ID NO: 16031 - DNA, 25 bp, E. coli
aaacaaattggcctggtggcgatcg

SEQ ID NO: 16032 - DNA, 25 bp, E. coli
aaacaaattggcgtggtggcgatcg

SEQ ID NO: 16033 - DNA, 25 bp, E. coli
ttaaacagtgaatgccagctgccag

SEQ ID NO: 16034 - DNA, 25 bp, E. coli
ttaaacagtgaaagccagctgccag

SEQ ID NO: 16035 - DNA, 25 bp, E. coli
tgaattaccgtaagtcgcaggacga

SEQ ID NO: 16036 - DNA, 25 bp, E. coli
tgaattaccgtatgtcgcaggacga

SEQ ID NO: 16037 - DNA, 25 bp, E. coli
gaagcccagcgttttggtcagccat

SEQ ID NO: 16038 - DNA, 25 bp, E. coli
gaagcccagcgtattggtcagccat

SEQ ID NO: 16039 - DNA, 25 bp, E. coli
gaaatctgatagaaaacgcgctgga

SEQ ID NO: 16040 - DNA, 25 bp, E. coli
gaaatctgatagtaaacgcgctgga

SEQ ID NO: 16041 - DNA, 25 bp, E. coli
ggaaatccgtcacggcttgcagaaa

SEQ ID NO: 16042 - DNA, 25 bp, E. coli
ggaaatccgtcagggcttgcagaaa

SEQ ID NO: 16043 - DNA, 25 bp, E. coli
gaggtcacgctgatcaacgatgccg

SEQ ID NO: 16044 - DNA, 25 bp, E. coli
gattaaccgcgcgaccgatttaggc

SEQ ID NO: 16045 - DNA, 25 bp, E. coli
gaggtcacgctgttcaacgatgccg

SEQ ID NO: 16046 - DNA, 25 bp, E. coli
gattaaccgcgccaccgatttaggc

SEQ ID NO: 16047 - DNA, 25 bp, E. coli
caatataacgcttcgcggatgggac

SEQ ID NO: 16048 - DNA, 25 bp, E. coli
caatataacgctacgcggatgggac

SEQ ID NO: 16049 - DNA, 25 bp, E. coli
cactgagcggcggtaatcaacagaa

SEQ ID NO: 16050 - DNA, 25 bp, E. coli
cactgagcggcgctaatcaacagaa

SEQ ID NO: 16051 - DNA, 25 bp, E. coli
catcaatcaccgtcaagaagaggcg

SEQ ID NO: 16052 - DNA, 25 bp, E. coli
catcaatcaccgacaagaagaggcg

SEQ ID NO: 16053 - DNA, 25 bp, E. coli
taaagccttaaggtatgcagcggat

SEQ ID NO: 16054 - DNA, 25 bp, E. coli
taaagccttaagctatgcagcggat

SEQ ID NO: 16055 - DNA, 25 bp, E. coli
tatcgaagtggctggagaaaactcc

SEQ ID NO: 16056 - DNA, 25 bp, E. coli
tatcgaagtggcaggagaaaactcc

SEQ ID NO: 16057 - DNA, 25 bp, E. coli
tttatgccaataatgaaccgcgacg

SEQ ID NO: 16058 - DNA, 25 bp, E. coli
tttatgccaatattgaaccgcgacg

SEQ ID NO: 16059 - DNA, 25 bp, E. coli
tgaaaaatatttcgccagcacgtct

SEQ ID NO: 16060 - DNA, 25 bp, E. coli
tgaaaaatatttggccagcacgtct

SEQ ID NO: 16061 - DNA, 25 bp, E. coli
tgtcgatggcacataggcaactggt

SEQ ID NO: 16062 - DNA, 25 bp, E. coli
tgtcgatggcacttaggcaactggt

SEQ ID NO: 16063 - DNA, 25 bp, E. coli
taacgtgatacgacaactggctgcg

SEQ ID NO: 16064 - DNA, 25 bp, E. coli
taacgcagacactggtaatgaccgc

SEQ ID NO: 16065 - DNA, 25 bp, E. coli
taatgaccgctgcaacaggagtacg

SEQ ID NO: 16066 - DNA, 25 bp, E. coli
taatgaccgctggaacaggagtacg

SEQ ID NO: 16067 - DNA, 25 bp, E. coli
taacgtgatacgtcaactggctgcg

SEQ ID NO: 16068 - DNA, 25 bp, E. coli
taacgcagacacaggtaatgaccgc

SEQ ID NO: 16069 - DNA, 25 bp, E. coli
caactggcagaagaaaccggtggct

SEQ ID NO: 16070 - DNA, 25 bp, E. coli
caactggcagaacaaaccggtggct

SEQ ID NO: 16071 - DNA, 25 bp, E. coli
caggcggtgccagataaagagttac

SEQ ID NO: 16072 - DNA, 25 bp, E. coli
caggcggtgccacataaagagttac

SEQ ID NO: 16073 - DNA, 25 bp, E. coli
aacgtaatgcggagatggttgccca

SEQ ID NO: 16074 - DNA, 25 bp, E. coli
aacgtaatgcggtgatggttgccca

SEQ ID NO: 16075 - DNA, 25 bp, E. coli
tgtttgatccagacacggcgattta

SEQ ID NO: 16076 - DNA, 25 bp, E. coli
tgtttgatccagtcacggcgattta

SEQ ID NO: 16077 - DNA, 25 bp, E. coli
tcggctgccctgatgaagaatttaa

SEQ ID NO: 16078 - DNA, 25 bp, E. coli
tcggctgccctgttgaagaatttaa

SEQ ID NO: 16079 - DNA, 25 bp, E. coli
tctacaaaatgctgcaggcggtgcc

SEQ ID NO: 16080 - DNA, 25 bp, E. coli
tctacaaaatgcagcaggcggtgcc

SEQ ID NO: 16081 - DNA, 25 bp, E. coli
gccgacgccgtttagcattgatgaa

SEQ ID NO: 16082 - DNA, 25 bp, E. coli
gccgacgccgttaagcattgatgaa

SEQ ID NO: 16083 - DNA, 25 bp, E. coli
gccaacacttctgctgcggtaaaag

SEQ ID NO: 16084 - DNA, 25 bp, E. coli
gccaacacttctcctgcggtaaaag

SEQ ID NO: 16085 - DNA, 25 bp, E. coli
gctggtgccgctgaatcgtatgctg

SEQ ID NO: 16086 - DNA, 25 bp, E. coli
gctggtgccgctcaatcgtatgctg

SEQ ID NO: 16087 - DNA, 25 bp, E. coli
gaatacccggatcctgccatactgg

SEQ ID NO: 16088 - DNA, 25 bp, E. coli
gaatacccggatgctgccatactgg

SEQ ID NO: 16089 - DNA, 25 bp, E. coli
gattctctggaaatggcgcgcttcg

SEQ ID NO: 16090 - DNA, 25 bp, E. coli
gattctctggaattggcgcgcttcg

SEQ ID NO: 16091 - DNA, 25 bp, E. coli
aattgtgaagcgcatcaaatcccgc

SEQ ID NO: 16092 - DNA, 25 bp, E. coli
aattgtgaagcggatcaaatcccgc

SEQ ID NO: 16093 - DNA, 25 bp, E. coli
cagcgcacggattttttcttattga

SEQ ID NO: 16094 - DNA, 25 bp, E. coli
cagcgcacggatattttcttattga

SEQ ID NO: 16095 - DNA, 25 bp, E. coli
cagtaaaccggcacagagtggcgga

SEQ ID NO: 16096 - DNA, 25 bp, E. coli
cagtaaaccggctcagagtggcgga

SEQ ID NO: 16097 - DNA, 25 bp, E. coli
tactggaatcagactcgttgctcag

SEQ ID NO: 16098 - DNA, 25 bp, E. coli
tactggaatcagtctcgttgctcag

SEQ ID NO: 16099 - DNA, 25 bp, E. coli
actggactccagacttagatactgg

SEQ ID NO: 16100 - DNA, 25 bp, E. coli
actggactccagtcttagatactgg

SEQ ID NO: 16101 - DNA, 25 bp, E. coli
caacaggttggagaaattttgccgg

SEQ ID NO: 16102 - DNA, 25 bp, E. coli
caacaggttggacaaattttgccgg

SEQ ID NO: 16103 - DNA, 25 bp, E. coli
tcttattgagtacaacaggttggac

SEQ ID NO: 16104 - DNA, 25 bp, E. coli
tcttattgagtagaacaggttggac

SEQ ID NO: 16105 - DNA, 25 bp, E. coli
gcagactggagatattacgcacaaa

SEQ ID NO: 16106 - DNA, 25 bp, E. coli
gcagactggagaaattacgcacaaa

SEQ ID NO: 16107 - DNA, 25 bp, E. coli
gcacaaatttgtgaatcagcgcacg

SEQ ID NO: 16108 - DNA, 25 bp, E. coli
gaatgtgccggtccagtaaaccggc

SEQ ID NO: 16109 - DNA, 25 bp, E. coli
gcacaaatttgtcaatcagcgcacg

SEQ ID NO: 16110 - DNA, 25 bp, E. coli
gaatgtgccggtgcagtaaaccggc

SEQ ID NO: 16111 - DNA, 25 bp, E. coli
cgctcctcgtccagcagactggaga

SEQ ID NO: 16112 - DNA, 25 bp, E. coli
cgctcctcgtcctgcagactggaga

SEQ ID NO: 16113 - DNA, 25 bp, E. coli
catgaccggcgatcggtcgttcact

SEQ ID NO: 16114 - DNA, 25 bp, E. coli
catgaccggcgaacggtcgttcact

SEQ ID NO: 16115 - DNA, 25 bp, E. coli
accggcgaacggtcgttcactgtgg

SEQ ID NO: 16116 - DNA, 25 bp, E. coli
accggcgaacggacgttcactgtgg

SEQ ID NO: 16117 - DNA, 25 bp, E. coli
acgggatgcaggtggcggaaaatga

SEQ ID NO: 16118 - DNA, 25 bp, E. coli
atgaccggcgaacggtcgttcactg

SEQ ID NO: 16119 - DNA, 25 bp, E. coli
acgggatgcaggaggcggaaaatga

SEQ ID NO: 16120 - DNA, 25 bp, E. coli
atgaccggcgaagggtcgttcactg

SEQ ID NO: 16121 - DNA, 25 bp, E. coli
tgaccggcgaacggtcgttcactgt

SEQ ID NO: 16122 - DNA, 25 bp, E. coli
tgaccggcgaaccgtcgttcactgt

SEQ ID NO: 16123 - DNA, 25 bp, E. coli
gcatgaccggcgaacggtcgttcac

SEQ ID NO: 16124 - DNA, 25 bp, E. coli
gcatgaccggcgtacggtcgttcac

SEQ ID NO: 16125 - DNA, 25 bp, E. coli
gacgggatgcaggaggcggaaaatg

SEQ ID NO: 16126 - DNA, 25 bp, E. coli
ccggcgaacggtcgttcactgtggt

SEQ ID NO: 16127 - DNA, 25 bp, E. coli
ccggcgaacggtggttcactgtggt

SEQ ID NO: 16128 - DNA, 25 bp, E. coli
tggacgggatgctggaggcggaaaa

SEQ ID NO: 16129 - DNA, 25 bp, E. coli
ggacgggatgcacgaggcggaaaat

SEQ ID NO: 16130 - DNA, 25 bp, E. coli
ggacgggatgcaggaggcggaaaat

SEQ ID NO: 16131 - DNA, 25 bp, E. coli
tggacgggatgcaggaggcggaaaa

SEQ ID NO: 16132 - DNA, 25 bp, E. coli
gacgggatgcagcaggcggaaaatg

SEQ ID NO: 16133 - DNA, 25 bp, E. coli
gaccggcgaacgctcgttcactgtg

SEQ ID NO: 16134 - DNA, 25 bp, E. coli
gaccggcgaacggtcgttcactgtg

SEQ ID NO: 16135 - DNA, 25 bp, E. coli
caatcttatatggaatcgctacccg

SEQ ID NO: 16136 - DNA, 25 bp, E. coli
caatcttatatgcaatcgctacccg

SEQ ID NO: 16137 - DNA, 25 bp, E. coli
tatgcaatcgcttcccgatttcgtc

SEQ ID NO: 16138 - DNA, 25 bp, E. coli
tatgcaatcgctacccgatttcgtc

SEQ ID NO: 16139 - DNA, 25 bp, E. coli
tatatgcaatcggtacccgatttcg

SEQ ID NO: 16140 - DNA, 25 bp, E. coli
tatatgcaatcgctacccgatttcg

SEQ ID NO: 16141 - DNA, 25 bp, E. coli
tgggcatgtcggcatccagatttct

SEQ ID NO: 16142 - DNA, 25 bp, E. coli
tgggcatgtcgggatccagatttct

SEQ ID NO: 16143 - DNA, 25 bp, E. coli
tgatcatgtattagttcgtcatgag

SEQ ID NO: 16144 - DNA, 25 bp, E. coli
tgatcatgtatttgttcgtcatgag

SEQ ID NO: 16145 - DNA, 25 bp, E. coli
tgacgaagggagacgcttacgtgac

SEQ ID NO: 16146 - DNA, 25 bp, E. coli
tgacgaagggagtcgcttacgtgac

SEQ ID NO: 16147 - DNA, 25 bp, E. coli
tcgctacccgatttcgtccgtctgg

SEQ ID NO: 16148 - DNA, 25 bp, E. coli
tcgctacccgatatcgtccgtctgg

SEQ ID NO: 16149 - DNA, 25 bp, E. coli
gcgtcgctggatcaattccggtggc

SEQ ID NO: 16150 - DNA, 25 bp, E. coli
gcatgtcgggatccagatttctcat

SEQ ID NO: 16151 - DNA, 25 bp, E. coli
gcgtcgctggatgaattccggtggc

SEQ ID NO: 16152 - DNA, 25 bp, E. coli
gctacccgatttggtccgtctggcg

SEQ ID NO: 16153 - DNA, 25 bp, E. coli
gcatgtcgggatgcagatttctcat

SEQ ID NO: 16154 - DNA, 25 bp, E. coli
gctacccgatttcgtccgtctggcg

SEQ ID NO: 16155 - DNA, 25 bp, E. coli
ggtattgatcatgtattagttcgtc

SEQ ID NO: 16156 - DNA, 25 bp, E. coli
ggtattgatcatctattagttcgtc

SEQ ID NO: 16157 - DNA, 25 bp, E. coli
caaaaagctcaaaaacgccgatgcg

SEQ ID NO: 16158 - DNA, 25 bp, E. coli
caaaaagctcaataacgccgatgcg

SEQ ID NO: 16159 - DNA, 25 bp, E. coli
ttcaggcgacgcaggcacaaaaact

SEQ ID NO: 16160 - DNA, 25 bp, E. coli
ttcaggcgacgctggcacaaaaact

SEQ ID NO: 16161 - DNA, 25 bp, E. coli
tcagcgaaatctggcctggcgggat

SEQ ID NO: 16162 - DNA, 25 bp, E. coli
tcagcgaaatctcgcctggcgggat

SEQ ID NO: 16163 - DNA, 25 bp, E. coli
gctgcgggcagattacggtatcgat

SEQ ID NO: 16164 - DNA, 25 bp, E. coli
gctgcgggcagaatacggtatcgat

SEQ ID NO: 16165 - DNA, 25 bp, E. coli
gcagtattcatatgggtagccacga

SEQ ID NO: 16166 - DNA, 25 bp, E. coli
gcgcattagcgaggagcaactccaa

SEQ ID NO: 16167 - DNA, 25 bp, E. coli
gcgcattagcgacgagcaactccaa

SEQ ID NO: 16168 - DNA, 25 bp, E. coli
gcagtattcataagggtagccacga

SEQ ID NO: 16169 - DNA, 25 bp, E. coli
cgggataaattaggcgccatgccgc

SEQ ID NO: 16170 - DNA, 25 bp, E. coli
cgggataaattacgcgccatgccgc

SEQ ID NO: 16171 - DNA, 25 bp, E. coli
ggatgtttccaccagcgatacgcct

SEQ ID NO: 16172 - DNA, 25 bp, E. coli
ggtaaaaacgctatgggccgcgctg

SEQ ID NO: 16173 - DNA, 25 bp, E. coli
ggtaaaaacgctttgggccgcgctg

SEQ ID NO: 16174 - DNA, 25 bp, E. coli
ggcgaagcaacaacataaacccgtg

SEQ ID NO: 16175 - DNA, 25 bp, E. coli
ggatgtttccacgagcgatacgcct

SEQ ID NO: 16176 - DNA, 25 bp, E. coli
ggcgaagcaacatcataaacccgtg

SEQ ID NO: 16177 - DNA, 25 bp, E. coli
ggcaaatcgcgaaggttcttcaggc

SEQ ID NO: 16178 - DNA, 25 bp, E. coli
ggcaaatcgcgatggttcttcaggc

SEQ ID NO: 16179 - DNA, 25 bp, E. coli
caagaggagcaaggaagaaaggaac

SEQ ID NO: 16180 - DNA, 25 bp, E. coli
caagaggagcaacgaagaaaggaac

SEQ ID NO: 16181 - DNA, 25 bp, E. coli
tacaacgcaatcaaaaggatatccg

SEQ ID NO: 16182 - DNA, 25 bp, E. coli
tacaacgcaatctaaaggatatccg

SEQ ID NO: 16183 - DNA, 25 bp, E. coli
aaaagtatcgcctggcgggcaagag

SEQ ID NO: 16184 - DNA, 25 bp, E. coli
aaaagtatcgccaggcgggcaagag

SEQ ID NO: 16185 - DNA, 25 bp, E. coli
tagctgatcaggtaaaaagtatcgc

SEQ ID NO: 16186 - DNA, 25 bp, E. coli
tagctgatcaggaaaaaagtatcgc

SEQ ID NO: 16187 - DNA, 25 bp, E. coli
tttgacccgacaaaaggtagcgagc

SEQ ID NO: 16188 - DNA, 25 bp, E. coli
ttatccggtcaggaacgtgatggcg

SEQ ID NO: 16189 - DNA, 25 bp, E. coli
ttatccggtcagcaacgtgatggcg

SEQ ID NO: 16190 - DNA, 25 bp, E. coli
tttgacccgacataaggtagcgagc

SEQ ID NO: 16191 - DNA, 25 bp, E. coli
tgtacaacaacaaaacaggtatgtg

SEQ ID NO: 16192 - DNA, 25 bp, E. coli
tgtacaacaacataacaggtatgtg

SEQ ID NO: 16193 - DNA, 25 bp, E. coli
tctgtgtgttccatgtacaacgcaa

SEQ ID NO: 16194 - DNA, 25 bp, E. coli
tctgtgtgttccttgtacaacgcaa

SEQ ID NO: 16195 - DNA, 25 bp, E. coli
gttgccccagaggaattacaactca

SEQ ID NO: 16196 - DNA, 25 bp, E. coli
gttgccccagagcaattacaactca

SEQ ID NO: 16197 - DNA, 25 bp, E. coli
cgtgatggcgtagcgttagctgatc

SEQ ID NO: 16198 - DNA, 25 bp, E. coli
cgtgatggcgtaccgttagctgatc

SEQ ID NO: 16199 - DNA, 25 bp, E. coli
taagccgatacgaacccgatatggg

SEQ ID NO: 16200 - DNA, 25 bp, E. coli
taagccgatacgtacccgatatggg

SEQ ID NO: 16201 - DNA, 25 bp, E. coli
cataaaaataattcttccagacact

SEQ ID NO: 16202 - DNA, 25 bp, E. coli
cataaaaataatacttccagacact

SEQ ID NO: 16203 - DNA, 25 bp, E. coli
taaaagcctataatttgtgtgggta

SEQ ID NO: 16204 - DNA, 25 bp, E. coli
taaaagcctatattttgtgtgggta

SEQ ID NO: 16205 - DNA, 25 bp, E. coli
tccagacactatgaagttgtgaaac

SEQ ID NO: 16206 - DNA, 25 bp, E. coli
tccagacactatcaagttgtgaaac

SEQ ID NO: 16207 - DNA, 25 bp, E. coli
taatgttaacttgtccatactttgg

SEQ ID NO: 16208 - DNA, 25 bp, E. coli
taatgttaacttctccatactttgg

SEQ ID NO: 16209 - DNA, 25 bp, E. coli
cctggcttaaatggccatgcggtga

SEQ ID NO: 16210 - DNA, 25 bp, E. coli
cctatcccgtctaacacaaagtgca

SEQ ID NO: 16211 - DNA, 25 bp, E. coli
ccatactttggataaggaaatacag

SEQ ID NO: 16212 - DNA, 25 bp, E. coli
ccatactttggaaaaggaaatacag

SEQ ID NO: 16213 - DNA, 25 bp, E. coli
cctggcttaaatcgccatgcggtga

SEQ ID NO: 16214 - DNA, 25 bp, E. coli
cctatcccgtcttacacaaagtgca

SEQ ID NO: 16215 - DNA, 25 bp, E. coli
gcatacattacctcgacaaaacggg

SEQ ID NO: 16216 - DNA, 25 bp, E. coli
gcatacattaccacgacaaaacggg

SEQ ID NO: 16217 - DNA, 25 bp, E. coli
gaaacgtttcgctggtaatcaaaca

SEQ ID NO: 16218 - DNA, 25 bp, E. coli
gaaacgtttcgcaggtaatcaaaca

SEQ ID NO: 16219 - DNA, 25 bp, E. coli
gggattcgcggcgttctgaaagatt

SEQ ID NO: 16220 - DNA, 25 bp, E. coli
gggattcgcggccttctgaaagatt

SEQ ID NO: 16221 - DNA, 25 bp, E. coli
ggccttctgaaacattgttgcaatc

SEQ ID NO: 16222 - DNA, 25 bp, E. coli
ggccttctgaaagattgttgcaatc

SEQ ID NO: 16223 - DNA, 25 bp, E. coli
tacgtctggacgttttgcgtttgct

SEQ ID NO: 16224 - DNA, 25 bp, E. coli
tacgtctggacgatttgcgtttgct

SEQ ID NO: 16225 - DNA, 25 bp, E. coli
ttactgtcgaaaagctgaacaccag

SEQ ID NO: 16226 - DNA, 25 bp, E. coli
ttactgtcgaaatgctgaacaccag

SEQ ID NO: 16227 - DNA, 25 bp, E. coli
tcgttgcagtaggaaatgccgcgca

SEQ ID NO: 16228 - DNA, 25 bp, E. coli
tgcgacagcgtaccagctcgctatt

SEQ ID NO: 16229 - DNA, 25 bp, E. coli
tgcgacagcgtagcagctcgctatt

SEQ ID NO: 16230 - DNA, 25 bp, E. coli
tcgttgcagtagcaaatgccgcgca

SEQ ID NO: 16231 - DNA, 25 bp, E. coli
gcgtttcaccgaggaagggcacatt

SEQ ID NO: 16232 - DNA, 25 bp, E. coli
gcgtttcaccgacgaagggcacatt

SEQ ID NO: 16233 - DNA, 25 bp, E. coli
gctcacccagcgtattactgtcgaa

SEQ ID NO: 16234 - DNA, 25 bp, E. coli
gctcacccagcgaattactgtcgaa

SEQ ID NO: 16235 - DNA, 25 bp, E. coli
gcaggcgctgcaacgcttgctggat

SEQ ID NO: 16236 - DNA, 25 bp, E. coli
gcaggcgctgcatcgcttgctggat

SEQ ID NO: 16237 - DNA, 25 bp, E. coli
ccctcttgcagatcaaacgcaggcg

SEQ ID NO: 16238 - DNA, 25 bp, E. coli
ccgcgcaggcaatagaggcattgca

SEQ ID NO: 16239 - DNA, 25 bp, E. coli
ccgcgcaggcaaaagaggcattgca

SEQ ID NO: 16240 - DNA, 25 bp, E. coli
ccctcttgcagaacaaacgcaggcg

SEQ ID NO: 16241 - DNA, 25 bp, E. coli
cttgctggatggtgatatcgactcc

SEQ ID NO: 16242 - DNA, 25 bp, E. coli
cttgctggatggagatatcgactcc

SEQ ID NO: 16243 - DNA, 25 bp, E. coli
ggattagtttctgtttgcgcactga

SEQ ID NO: 16244 - DNA, 25 bp, E. coli
ggattagtttctctttgcgcactga

SEQ ID NO: 16245 - DNA, 25 bp, E. coli
aaccgactctgttttggcacctgcg

SEQ ID NO: 16246 - DNA, 25 bp, E. coli
aatggccttccaattcgggctgaaa

SEQ ID NO: 16247 - DNA, 25 bp, E. coli
aatggccttccatttcgggctgaaa

SEQ ID NO: 16248 - DNA, 25 bp, E. coli
caccgttaccgactgagagttggca

SEQ ID NO: 16249 - DNA, 25 bp, E. coli
caccgttaccgagtgagagttggca

SEQ ID NO: 16250 - DNA, 25 bp, E. coli
catgctttcagacgcaatactggcg

SEQ ID NO: 16251 - DNA, 25 bp, E. coli
catgctttcagaggcaatactggcg

SEQ ID NO: 16252 - DNA, 25 bp, E. coli
aaccgactctgtattggcacctgcg

SEQ ID NO: 16253 - DNA, 25 bp, E. coli
gcgagaacctctcctgaaatggcct

SEQ ID NO: 16254 - DNA, 25 bp, E. coli
ccagtttgaacatgcagaggcgcaa

SEQ ID NO: 16255 - DNA, 25 bp, E. coli
gcgagaacctctgctgaaatggcct

SEQ ID NO: 16256 - DNA, 25 bp, E. coli
ccagtttgaacaagcagaggcgcaa

SEQ ID NO: 16257 - DNA, 25 bp, E. coli
gctagagggcttgactacgcgtaag

SEQ ID NO: 16258 - DNA, 25 bp, E. coli
gctagagggcttcactacgcgtaag

SEQ ID NO: 16259 - DNA, 25 bp, E. coli
gcagtattagaggagcaagcaacaa

SEQ ID NO: 16260 - DNA, 25 bp, E. coli
gcagtattagagcagcaagcaacaa

SEQ ID NO: 16261 - DNA, 25 bp, E. coli
cgtaatttcaatggcgctcaccctg

SEQ ID NO: 16262 - DNA, 25 bp, E. coli
cgtaatttcaatcgcgctcaccctg

SEQ ID NO: 16263 - DNA, 25 bp, E. coli
ggcgcagtccctaaaaattgagcaa

SEQ ID NO: 16264 - DNA, 25 bp, E. coli
ggcgcagtcccttaaaattgagcaa

SEQ ID NO: 16265 - DNA, 25 bp, E. coli
taatcatgtgattgacgctgcacca

SEQ ID NO: 16266 - DNA, 25 bp, E. coli
taatcatgtgatagacgctgcacca

SEQ ID NO: 16267 - DNA, 25 bp, E. coli
aaattgccgggcctatcgacaccat

SEQ ID NO: 16268 - DNA, 25 bp, E. coli
aaattgccgggcgtatcgacaccat

SEQ ID NO: 16269 - DNA, 25 bp, E. coli
tttctgcgcaacagctggatgacga

SEQ ID NO: 16270 - DNA, 25 bp, E. coli
tttctgcgcaactgctggatgacga

SEQ ID NO: 16271 - DNA, 25 bp, E. coli
tgaatatggtcgttctcagcgacgt

SEQ ID NO: 16272 - DNA, 25 bp, E. coli
tgaagaacttccctggcctgacgac

SEQ ID NO: 16273 - DNA, 25 bp, E. coli
tgaatatggtcgatctcagcgacgt

SEQ ID NO: 16274 - DNA, 25 bp, E. coli
tgaagaacttccgtggcctgacgac

SEQ ID NO: 16275 - DNA, 25 bp, E. coli
tcgatgacagcgaactgaaagcccc

SEQ ID NO: 16276 - DNA, 25 bp, E. coli
tcgatgacagcgtactgaaagcccc

SEQ ID NO: 16277 - DNA, 25 bp, E. coli
gcggcacgcacctatatcattcagg

SEQ ID NO: 16278 - DNA, 25 bp, E. coli
gcattgccgcagttatcgatgacag

SEQ ID NO: 16279 - DNA, 25 bp, E. coli
gcattgccgcagatatcgatgacag

SEQ ID NO: 16280 - DNA, 25 bp, E. coli
gcggcacgcaccaatatcattcagg

SEQ ID NO: 16281 - DNA, 25 bp, E. coli
gaagatggatacacgcgtgttgcag

SEQ ID NO: 16282 - DNA, 25 bp, E. coli
gaagatggatactcgcgtgttgcag

SEQ ID NO: 16283 - DNA, 25 bp, E. coli
cgcattgaagcgtcggaagtggata

SEQ ID NO: 16284 - DNA, 25 bp, E. coli
cgcattgaagcgacggaagtggata

SEQ ID NO: 16285 - DNA, 25 bp, E. coli
tggataagagtaagcgccatctggc

SEQ ID NO: 16286 - DNA, 25 bp, E. coli
tggataagagtatgcgccatctggc

SEQ ID NO: 16287 - DNA, 25 bp, E. coli
tcaaagcgcgtaacccaccggaatt

SEQ ID NO: 16288 - DNA, 25 bp, E. coli
tcaaagcgcgtatcccaccggaatt

SEQ ID NO: 16289 - DNA, 25 bp, E. coli
aattctggccaggattttaccgggc

SEQ ID NO: 16290 - DNA, 25 bp, E. coli
aattctggccagcattttaccgggc

SEQ ID NO: 16291 - DNA, 25 bp, E. coli
caaatctcagcgatgtccgtgggca

SEQ ID NO: 16292 - DNA, 25 bp, E. coli
caaatctcagcgttgtccgtgggca

SEQ ID NO: 16293 - DNA, 25 bp, E. coli
catgtctttgacgttggcgcaggcc

SEQ ID NO: 16294 - DNA, 25 bp, E. coli
catgtctttgaccttggcgcaggcc

SEQ ID NO: 16295 - DNA, 25 bp, E. coli
tatggctacggttatccaccgcgga

SEQ ID NO: 16296 - DNA, 25 bp, E. coli
tatggctacggtaatccaccgcgga

SEQ ID NO: 16297 - DNA, 25 bp, E. coli
tgattgagcgtttcggcctagccct

SEQ ID NO: 16298 - DNA, 25 bp, E. coli
tgattgagcgttacggcctagccct

SEQ ID NO: 16299 - DNA, 25 bp, E. coli
tgccggtgaaagtgcgcaaatctca

SEQ ID NO: 16300 - DNA, 25 bp, E. coli
tgccggtgaaagagcgcaaatctca

SEQ ID NO: 16301 - DNA, 25 bp, E. coli
tctccgacggtgcaagaaagttctt

SEQ ID NO: 16302 - DNA, 25 bp, E. coli
tctccgacggtggaagaaagttctt

SEQ ID NO: 16303 - DNA, 25 bp, E. coli
tcaggagatccacaaacgctacggc

SEQ ID NO: 16304 - DNA, 25 bp, E. coli
tcaggagatccagaaacgctacggc

SEQ ID NO: 16305 - DNA, 25 bp, E. coli
gctttaaaggttccgccagtctgat

SEQ ID NO: 16306 - DNA, 25 bp, E. coli
gctttaaaggttgcgccagtctgat

SEQ ID NO: 16307 - DNA, 25 bp, E. coli
gcaatcatggtgttgttcccgcgca

SEQ ID NO: 16308 - DNA, 25 bp, E. coli
gcaatcatggtgatgttcccgcgca

SEQ ID NO: 16309 - DNA, 25 bp, E. coli
gattacatcctgtctctcggcggta

SEQ ID NO: 16310 - DNA, 25 bp, E. coli
gattacatcctgactctcggcggta

SEQ ID NO: 16311 - DNA, 25 bp, E. coli
aagcgaatatctgtgcacctaatag

SEQ ID NO: 16312 - DNA, 25 bp, E. coli
aatcttatatttccctctgcgcgcc

SEQ ID NO: 16313 - DNA, 25 bp, E. coli
aagcgaatatctctgcacctaatag

SEQ ID NO: 16314 - DNA, 25 bp, E. coli
aatcttatatttgcctctgcgcgcc

SEQ ID NO: 16315 - DNA, 25 bp, E. coli
cacaaggatgttatactcaaagtag

SEQ ID NO: 16316 - DNA, 25 bp, E. coli
cacaaggatgttttactcaaagtag

SEQ ID NO: 16317 - DNA, 25 bp, E. coli
taacagccagttttagtaccacttg

SEQ ID NO: 16318 - DNA, 25 bp, E. coli
tactcaaagtagtcaatcctgatct

SEQ ID NO: 16319 - DNA, 25 bp, E. coli
tactcaaagtagacaatcctgatct

SEQ ID NO: 16320 - DNA, 25 bp, E. coli
tgatctcaagcgaacgtattgtcgg

SEQ ID NO: 16321 - DNA, 25 bp, E. coli
tgatctcaagcgtacgtattgtcgg

SEQ ID NO: 16322 - DNA, 25 bp, E. coli
gcgcctttcctagccgcagtatata

SEQ ID NO: 16323 - DNA, 25 bp, E. coli
gcgcctttcctacccgcagtatata

SEQ ID NO: 16324 - DNA, 25 bp, E. coli
gctcacaagtcgaatttccagaggg

SEQ ID NO: 16325 - DNA, 25 bp, E. coli
gctcacaagtcgtatttccagaggg

SEQ ID NO: 16326 - DNA, 25 bp, E. coli
cgcagtatatagagcaagcggtatg

SEQ ID NO: 16327 - DNA, 25 bp, E. coli
cgcagtatatagtgcaagcggtatg

SEQ ID NO: 16328 - DNA, 25 bp, E. coli
cggtatgaggaatgggagatttcac

SEQ ID NO: 16329 - DNA, 25 bp, E. coli
cggtatgaggaaagggagatttcac

SEQ ID NO: 16330 - DNA, 25 bp, E. coli
taacagccagttatagtaccacttg

SEQ ID NO: 16331 - DNA, 25 bp, E. coli
gacgctgcttgtttaaagctgactg

SEQ ID NO: 16332 - DNA, 25 bp, E. coli
gacgctgcttgtataaagctgactg

SEQ ID NO: 16333 - DNA, 25 bp, E. coli
aacgctgtctctcccgctaatatgg

SEQ ID NO: 16334 - DNA, 25 bp, E. coli
aaaaatcacgcttcagggctaagta

SEQ ID NO: 16335 - DNA, 25 bp, E. coli
aacgctgtctctgccgctaatatgg

SEQ ID NO: 16336 - DNA, 25 bp, E. coli
aaaaatcacgctacagggctaagta

SEQ ID NO: 16337 - DNA, 25 bp, E. coli
tatataagagacagcgtaatcagga

SEQ ID NO: 16338 - DNA, 25 bp, E. coli
tatataagagactgcgtaatcagga

SEQ ID NO: 16339 - DNA, 25 bp, E. coli
tggtagggtttaaataagagacagc

SEQ ID NO: 16340 - DNA, 25 bp, E. coli
tctctgccgctaatatggtagggtt

SEQ ID NO: 16341 - DNA, 25 bp, E. coli
tcaggagtaaccgaccgttggatgc

SEQ ID NO: 16342 - DNA, 25 bp, E. coli
tcagggctaagttaaacgctgtctc

SEQ ID NO: 16343 - DNA, 25 bp, E. coli
tcaggagtaacccaccgttggatgc

SEQ ID NO: 16344 - DNA, 25 bp, E. coli
tcagggctaagtaaaacgctgtctc

SEQ ID NO: 16345 - DNA, 25 bp, E. coli
tctctgccgctattatggtagggtt

SEQ ID NO: 16346 - DNA, 25 bp, E. coli
gcgtaatcaggagtaaccgaccgtt

SEQ ID NO: 16347 - DNA, 25 bp, E. coli
gcgtaatcaggactaaccgaccgtt

SEQ ID NO: 16348 - DNA, 25 bp, E. coli
tggtagggtttatataagagacagc

SEQ ID NO: 16349 - DNA, 25 bp, E. coli
taaccgaccgttcgatgccacaaca

SEQ ID NO: 16350 - DNA, 25 bp, E. coli
taagtaaaacgcagtctctgccgct

SEQ ID NO: 16351 - DNA, 25 bp, E. coli
taaccgaccgttggatgccacaaca

SEQ ID NO: 16352 - DNA, 25 bp, E. coli
taagtaaaacgctgtctctgccgct

SEQ ID NO: 16353 - DNA, 25 bp, E. coli
gagacagcgtaaacaggagtaaccg

SEQ ID NO: 16354 - DNA, 25 bp, E. coli
gagacagcgtaatcaggagtaaccg

SEQ ID NO: 16355 - DNA, 25 bp, E. coli
aatagtgacaattgcgccggaggac

SEQ ID NO: 16356 - DNA, 25 bp, E. coli
aatagtgacaatagcgccggaggac

SEQ ID NO: 16357 - DNA, 25 bp, E. coli
tttgcccgaacgaacagtaaacagg

SEQ ID NO: 16358 - DNA, 25 bp, E. coli
tactggctgatgtccgcatttggca

SEQ ID NO: 16359 - DNA, 25 bp, E. coli
taaacaggacgttgggaaagccaca

SEQ ID NO: 16360 - DNA, 25 bp, E. coli
tactggctgatgaccgcatttggca

SEQ ID NO: 16361 - DNA, 25 bp, E. coli
tttgcccgaacgtacagtaaacagg

SEQ ID NO: 16362 - DNA, 25 bp, E. coli
taaacaggacgtagggaaagccaca

SEQ ID NO: 16363 - DNA, 25 bp, E. coli
tagtagctttgtgatgcaggcggcc

SEQ ID NO: 16364 - DNA, 25 bp, E. coli
tagtagctttgtcatgcaggcggcc

SEQ ID NO: 16365 - DNA, 25 bp, E. coli
tattgtcgttaggtccatgctggga

SEQ ID NO: 16366 - DNA, 25 bp, E. coli
tattgtcgttagctccatgctggga

SEQ ID NO: 16367 - DNA, 25 bp, E. coli
tcctcagtggcaacggaaatgacgc

SEQ ID NO: 16368 - DNA, 25 bp, E. coli
tcctcagtggcatcggaaatgacgc

SEQ ID NO: 16369 - DNA, 25 bp, E. coli
tcaggcagaactagcgcaggtcagt

SEQ ID NO: 16370 - DNA, 25 bp, E. coli
tcaggcagaacttgcgcaggtcagt

SEQ ID NO: 16371 - DNA, 25 bp, E. coli
gcctggaccatgctatgcgctgaaa

SEQ ID NO: 16372 - DNA, 25 bp, E. coli
gcctggaccatggtatgcgctgaaa

SEQ ID NO: 16373 - DNA, 25 bp, E. coli
gattatttctgtactggccggctgg

SEQ ID NO: 16374 - DNA, 25 bp, E. coli
gattatttctgttctggccggctgg

SEQ ID NO: 16375 - DNA, 25 bp, E. coli
taattttcttgtactgtccgggacg

SEQ ID NO: 16376 - DNA, 25 bp, E. coli
taattttcttgttctgtccgggacg

SEQ ID NO: 16377 - DNA, 25 bp, E. coli
taaacgtgcgcagaaatatctcggc

SEQ ID NO: 16378 - DNA, 25 bp, E. coli
taaacgtgcgcacaaatatctcggc

SEQ ID NO: 16379 - DNA, 25 bp, E. coli
aaatatctcggcatggtccgccagg

SEQ ID NO: 16380 - DNA, 25 bp, E. coli
aaatatctcggcttggtccgccagg

SEQ ID NO: 16381 - DNA, 25 bp, E. coli
tattattaacaccatgacgccgggc

SEQ ID NO: 16382 - DNA, 25 bp, E. coli
tattattaacacgatgacgccgggc

SEQ ID NO: 16383 - DNA, 25 bp, E. coli
tgaaaaaccgtctgaagagccgcag

SEQ ID NO: 16384 - DNA, 25 bp, E. coli
tgaaaaaccgtcagaagagccgcag

SEQ ID NO: 16385 - DNA, 25 bp, E. coli
tcctgttcgacgaccaaaaaaggcg

SEQ ID NO: 16386 - DNA, 25 bp, E. coli
tcctttacggtctggtggtggacaa

SEQ ID NO: 16387 - DNA, 25 bp, E. coli
tcctttacggtcaggtggtggacaa

SEQ ID NO: 16388 - DNA, 25 bp, E. coli
tcctgttcgacgtccaaaaaaggcg

SEQ ID NO: 16389 - DNA, 25 bp, E. coli
gcaacgggctgcctatcatctacag

SEQ ID NO: 16390 - DNA, 25 bp, E. coli
gaatcttccttttacccgtatgcgg

SEQ ID NO: 16391 - DNA, 25 bp, E. coli
gcaacgggctgcgtatcatctacag

SEQ ID NO: 16392 - DNA, 25 bp, E. coli
gaatcttcctttaacccgtatgcgg

SEQ ID NO: 16393 - DNA, 25 bp, E. coli
gaaaaaatatctggcgctggctttg

SEQ ID NO: 16394 - DNA, 25 bp, E. coli
gaaaaaatatctcgcgctggctttg

SEQ ID NO: 16395 - DNA, 25 bp, E. coli
cgccgagccgcactttcttgtttga

SEQ ID NO: 16396 - DNA, 25 bp, E. coli
cgccgagccgcagtttcttgtttga

SEQ ID NO: 16397 - DNA, 25 bp, E. coli
gattactatcgataccatcgccggg

SEQ ID NO: 16398 - DNA, 25 bp, E. coli
gattactatcgaaaccatcgccggg

SEQ ID NO: 16399 - DNA, 25 bp, E. coli
aagagacgctcgacgtgaccacgaa

SEQ ID NO: 16400 - DNA, 25 bp, E. coli
aagagacgctcgtcgtgaccacgaa

SEQ ID NO: 16401 - DNA, 25 bp, E. coli
caaaaatcagcatcgaagagacgct

SEQ ID NO: 16402 - DNA, 25 bp, E. coli
caaaaatcagcaacgaagagacgct

SEQ ID NO: 16403 - DNA, 25 bp, E. coli
taacagacaactgcttggcaggccg

SEQ ID NO: 16404 - DNA, 25 bp, E. coli
tgaccacgaatccttcggcaagcaa

SEQ ID NO: 16405 - DNA, 25 bp, E. coli
tgaccacgaatcgttcggcaagcaa

SEQ ID NO: 16406 - DNA, 25 bp, E. coli
tccccggagtagtgataacagacaa

SEQ ID NO: 16407 - DNA, 25 bp, E. coli
tccccggagtagagataacagacaa

SEQ ID NO: 16408 - DNA, 25 bp, E. coli
gcaagcaaccttagggaaagcccgg

SEQ ID NO: 16409 - DNA, 25 bp, E. coli
gcaagcaacctttgggaaagcccgg

SEQ ID NO: 16410 - DNA, 25 bp, E. coli
gaaagcccggcgactatacaggtta

SEQ ID NO: 16411 - DNA, 25 bp, E. coli
gaaagcccggcgtctatacaggtta

SEQ ID NO: 16412 - DNA, 25 bp, E. coli
gataatttgcaggacatccccggag

SEQ ID NO: 16413 - DNA, 25 bp, E. coli
gataatttgcagcacatccccggag

SEQ ID NO: 16414 - DNA, 25 bp, E. coli
gggatagtttcttctgcaaccgcaa

SEQ ID NO: 16415 - DNA, 25 bp, E. coli
ggttattgaccatcaaacattgcag

SEQ ID NO: 16416 - DNA, 25 bp, E. coli
ggttattgaccaacaaacattgcag

SEQ ID NO: 16417 - DNA, 25 bp, E. coli
gggatagtttctactgcaaccgcaa

SEQ ID NO: 16418 - DNA, 25 bp, E. coli
ggcaggccgtaatcaaatccgcatt

SEQ ID NO: 16419 - DNA, 25 bp, E. coli
ggcaggccgtaaacaaatccgcatt

SEQ ID NO: 16420 - DNA, 25 bp, E. coli
taacagacaactccttggcaggccg

SEQ ID NO: 16421 - DNA, 25 bp, E. coli
aatacgacgagtgcctgcgttctga

SEQ ID NO: 16422 - DNA, 25 bp, E. coli
aatacgacgagtccctgcgttctga

SEQ ID NO: 16423 - DNA, 25 bp, E. coli
catggtagttcgtcagccgctggaa

SEQ ID NO: 16424 - DNA, 25 bp, E. coli
catggtagttcgacagccgctggaa

SEQ ID NO: 16425 - DNA, 25 bp, E. coli
taaagctggcttcgttactcgtgac

SEQ ID NO: 16426 - DNA, 25 bp, E. coli
taaagctggcttggttactcgtgac

SEQ ID NO: 16427 - DNA, 25 bp, E. coli
aaatcaatactagggcactggtcgc

SEQ ID NO: 16428 - DNA, 25 bp, E. coli
aaatcaatactacggcactggtcgc

SEQ ID NO: 16429 - DNA, 25 bp, E. coli
tctggtcaggctggtgcgatccgtc

SEQ ID NO: 16430 - DNA, 25 bp, E. coli
tctggtcaggctcgtgcgatccgtc

SEQ ID NO: 16431 - DNA, 25 bp, E. coli
gcgttttcatcaaaccgggcaacgg

SEQ ID NO: 16432 - DNA, 25 bp, E. coli
gcgttttcatcataccgggcaacgg

SEQ ID NO: 16433 - DNA, 25 bp, E. coli
gaaagtcggtctgcgtaaagcacgt

SEQ ID NO: 16434 - DNA, 25 bp, E. coli
gaaagtcggtctccgtaaagcacgt

SEQ ID NO: 16435 - DNA, 25 bp, E. coli
cccgcgctctgaaggaatacgacga

SEQ ID NO: 16436 - DNA, 25 bp, E. coli
cccgcgctctgatggaatacgacga

SEQ ID NO: 16437 - DNA, 25 bp, E. coli
tggaacagtacttcggtcgtgaaac

SEQ ID NO: 16438 - DNA, 25 bp, E. coli
tggaacagtactacggtcgtgaaac

SEQ ID NO: 16439 - DNA, 25 bp, E. coli
gagaaactggacctgtacatcaccg

SEQ ID NO: 16440 - DNA, 25 bp, E. coli
gacgctcgtcaggttgaacgtaaga

SEQ ID NO: 16441 - DNA, 25 bp, E. coli
gagaaactggacgtgtacatcaccg

SEQ ID NO: 16442 - DNA, 25 bp, E. coli
gacgctcgtcagcttgaacgtaaga

SEQ ID NO: 16443 - DNA, 25 bp, E. coli
taaaacggttgatgaactggcggca

SEQ ID NO: 16444 - DNA, 25 bp, E. coli
taaagtctctctggcacactcggat

SEQ ID NO: 16445 - DNA, 25 bp, E. coli
taaagtctctctcgcacactcggat

SEQ ID NO: 16446 - DNA, 25 bp, E. coli
taaaacggttgaagaactggcggca

SEQ ID NO: 16447 - DNA, 25 bp, E. coli
aactttatctcgctcggtggtcgca

SEQ ID NO: 16448 - DNA, 25 bp, E. coli
aactttatctcggtcggtggtcgca

SEQ ID NO: 16449 - DNA, 25 bp, E. coli
tagacattacctacccgaaagaggg

SEQ ID NO: 16450 - DNA, 25 bp, E. coli
tagacattaccttcccgaaagaggg

SEQ ID NO: 16451 - DNA, 25 bp, E. coli
tgttaggtgaaatgggcgtctcgcc

SEQ ID NO: 16452 - DNA, 25 bp, E. coli
tgttaggtgaaaagggcgtctcgcc

SEQ ID NO: 16453 - DNA, 25 bp, E. coli
tctcattgagttcggatacgccgat

SEQ ID NO: 16454 - DNA, 25 bp, E. coli
tctatcggacgagatgcgcaggcat

SEQ ID NO: 16455 - DNA, 25 bp, E. coli
tctatcggacgacatgcgcaggcat

SEQ ID NO: 16456 - DNA, 25 bp, E. coli
tctcattgagttgggatacgccgat

SEQ ID NO: 16457 - DNA, 25 bp, E. coli
cattgttgatgccacagggtctgag

SEQ ID NO: 16458 - DNA, 25 bp, E. coli
cattgttgatgcgacagggtctgag

SEQ ID NO: 16459 - DNA, 25 bp, E. coli
gattatctacaatctgtgacgggcc

SEQ ID NO: 16460 - DNA, 25 bp, E. coli
gattatctacaaactgtgacgggcc

SEQ ID NO: 16461 - DNA, 25 bp, E. coli
gagcgcggcgtccataaaacgatcc

SEQ ID NO: 16462 - DNA, 25 bp, E. coli
gatgaatattcacatgccgggctgg

SEQ ID NO: 16463 - DNA, 25 bp, E. coli
gagcgcggcgtcgataaaacgatcc

SEQ ID NO: 16464 - DNA, 25 bp, E. coli
gatgaatattcagatgccgggctgg

SEQ ID NO: 16465 - DNA, 25 bp, E. coli
caactgcttatgtttcgcacgacac

SEQ ID NO: 16466 - DNA, 25 bp, E. coli
caactgcttatgattcgcacgacac

SEQ ID NO: 16467 - DNA, 25 bp, E. coli
tactgatttcagacttgagcgcaac

SEQ ID NO: 16468 - DNA, 25 bp, E. coli
tactgatttcagtcttgagcgcaac

SEQ ID NO: 16469 - DNA, 25 bp, E. coli
tatgattcgcacgacacgaccagaa

SEQ ID NO: 16470 - DNA, 25 bp, E. coli
tatgattcgcaccacacgaccagaa

SEQ ID NO: 16471 - DNA, 25 bp, E. coli
tcgcacgacacgaccagaaataatg

SEQ ID NO: 16472 - DNA, 25 bp, E. coli
tcgcacgacacgtccagaaataatg

SEQ ID NO: 16473 - DNA, 25 bp, E. coli
gcgacttctggtggtgtgttatgca

SEQ ID NO: 16474 - DNA, 25 bp, E. coli
gcgacttctggtcgtgtgttatgca

SEQ ID NO: 16475 - DNA, 25 bp, E. coli
gaaataatgcgagttctggtcgtgt

SEQ ID NO: 16476 - DNA, 25 bp, E. coli
gacttgagcgcatcaaaaatttcga

SEQ ID NO: 16477 - DNA, 25 bp, E. coli
gaaataatgcgacttctggtcgtgt

SEQ ID NO: 16478 - DNA, 25 bp, E. coli
gacttgagcgcaacaaaaatttcga

SEQ ID NO: 16479 - DNA, 25 bp, E. coli
cggcggcatatattactgatttcag

SEQ ID NO: 16480 - DNA, 25 bp, E. coli
cggcggcatataatactgatttcag

SEQ ID NO: 16481 - DNA, 25 bp, E. coli
gatcactcaactccttatgattcgc

SEQ ID NO: 16482 - DNA, 25 bp, E. coli
gtttgatatcccctggcaacggcgg

SEQ ID NO: 16483 - DNA, 25 bp, E. coli
gtttgatatcccgtggcaacggcgg

SEQ ID NO: 16484 - DNA, 25 bp, E. coli
gatcactcaactgcttatgattcgc

SEQ ID NO: 16485 - DNA, 25 bp, E. coli
ggcaacggcggcttatattactgat

SEQ ID NO: 16486 - DNA, 25 bp, E. coli
ggcaacggcggcatatattactgat

SEQ ID NO: 16487 - DNA, 25 bp, E. coli
caacgacgctggatgaagcgcttta

SEQ ID NO: 16488 - DNA, 25 bp, E. coli
caacgacgctggttgaagcgcttta

SEQ ID NO: 16489 - DNA, 25 bp, E. coli
agccacgtcctccagttttggcgga

SEQ ID NO: 16490 - DNA, 25 bp, E. coli
agccacgtcctcgagttttggcgga

SEQ ID NO: 16491 - DNA, 25 bp, E. coli
ttttggtgctaagcgggatggctcc

SEQ ID NO: 16492 - DNA, 25 bp, E. coli
ttttggtgctaaccgggatggctcc

SEQ ID NO: 16493 - DNA, 25 bp, E. coli
tccatggttctgtctcagccacgtc

SEQ ID NO: 16494 - DNA, 25 bp, E. coli
tccatggttctgactcagccacgtc

SEQ ID NO: 16495 - DNA, 25 bp, E. coli
ccaatgattcatccaaccgacactg

SEQ ID NO: 16496 - DNA, 25 bp, E. coli
ccaatgattcatgcaaccgacactg

SEQ ID NO: 16497 - DNA, 25 bp, E. coli
gcggaactcaggacgcctttgtacg

SEQ ID NO: 16498 - DNA, 25 bp, E. coli
gctacatcggagttcttccaccgga

SEQ ID NO: 16499 - DNA, 25 bp, E. coli
gctacatcggagatcttccaccgga

SEQ ID NO: 16500 - DNA, 25 bp, E. coli
gcggaactcaggtcgcctttgtacg

SEQ ID NO: 16501 - DNA, 25 bp, E. coli
gacaatcaggctggcgttaccgcgt

SEQ ID NO: 16502 - DNA, 25 bp, E. coli
gacaatcaggctcgcgttaccgcgt

SEQ ID NO: 16503 - DNA, 25 bp, E. coli
ccgacactgcaacgaccaaagatgg

SEQ ID NO: 16504 - DNA, 25 bp, E. coli
ccgacactgcaaggaccaaagatgg

SEQ ID NO: 16505 - DNA, 25 bp, E. coli
tggacattgcgtaagccgtcgttcg

SEQ ID NO: 16506 - DNA, 25 bp, E. coli
tggacattgcgttagccgtcgttcg

SEQ ID NO: 16507 - DNA, 25 bp, E. coli
tggaaaatcagattgcaacgacgct

SEQ ID NO: 16508 - DNA, 25 bp, E. coli
tggaaaatcagaatgcaacgacgct

SEQ ID NO: 16509 - DNA, 25 bp, E. coli
caccggcgggcattggataaaagcg

SEQ ID NO: 16510 - DNA, 25 bp, E. coli
caccggcgggcaatggataaaagcg

SEQ ID NO: 16511 - DNA, 25 bp, E. coli
cacccgggtgaatcagtgaatggcg

SEQ ID NO: 16512 - DNA, 25 bp, E. coli
caaatggtcgtcagattgtgcaggc

SEQ ID NO: 16513 - DNA, 25 bp, E. coli
caaatggtcgtctgattgtgcaggc

SEQ ID NO: 16514 - DNA, 25 bp, E. coli
cacccgggtgaaacagtgaatggcg

SEQ ID NO: 16515 - DNA, 25 bp, E. coli
cagggacatttgagccggcgactct

SEQ ID NO: 16516 - DNA, 25 bp, E. coli
cagggacatttgtgccggcgactct

SEQ ID NO: 16517 - DNA, 25 bp, E. coli
tatccggaacaggtaatggcgtgac

SEQ ID NO: 16518 - DNA, 25 bp, E. coli
tatccggaacagctaatggcgtgac

SEQ ID NO: 16519 - DNA, 25 bp, E. coli
tgattaaggaaggaggaactgccgc

SEQ ID NO: 16520 - DNA, 25 bp, E. coli
tgattaaggaagcaggaactgccgc

SEQ ID NO: 16521 - DNA, 25 bp, E. coli
tgaatggcggaagactggtaaacca

SEQ ID NO: 16522 - DNA, 25 bp, E. coli
tgaatggcggaacactggtaaacca

SEQ ID NO: 16523 - DNA, 25 bp, E. coli
cgctgataaaccgtgatggctggca

SEQ ID NO: 16524 - DNA, 25 bp, E. coli
cgctgataaaccctgatggctggca

SEQ ID NO: 16525 - DNA, 25 bp, E. coli
cgtgactgtcagtaccgggcttgag

SEQ ID NO: 16526 - DNA, 25 bp, E. coli
cgtgactgtcagaaccgggcttgag

SEQ ID NO: 16527 - DNA, 25 bp, E. coli
gtatgtacacaacggtggcacggca

SEQ ID NO: 16528 - DNA, 25 bp, E. coli
gtatgtacacaagggtggcacggca

SEQ ID NO: 16529 - DNA, 25 bp, E. coli
taacagaggtgaccagtgggtacac

SEQ ID NO: 16530 - DNA, 25 bp, E. coli
taacagaggtgagcagtgggtacac

SEQ ID NO: 16531 - DNA, 25 bp, E. coli
aagatgctgtttagcagcttttgcg

SEQ ID NO: 16532 - DNA, 25 bp, E. coli
aagatgctgttttgcagcttttgcg

SEQ ID NO: 16533 - DNA, 25 bp, E. coli
catttcaggggatgaagcgaacggc

SEQ ID NO: 16534 - DNA, 25 bp, E. coli
catttcaggggaagaagcgaacggc

SEQ ID NO: 16535 - DNA, 25 bp, E. coli
tacgcaaaattgaatcggttggcta

SEQ ID NO: 16536 - DNA, 25 bp, E. coli
tacgcaaaattgtatcggttggcta

SEQ ID NO: 16537 - DNA, 25 bp, E. coli
tccgggaaagatcctgttttgcagc

SEQ ID NO: 16538 - DNA, 25 bp, E. coli
tccgggaaagatgctgttttgcagc

SEQ ID NO: 16539 - DNA, 25 bp, E. coli
tcttgatgctggatccgggaaagat

SEQ ID NO: 16540 - DNA, 25 bp, E. coli
tcttgatgctggttccgggaaagat

SEQ ID NO: 16541 - DNA, 25 bp, E. coli
gcagcttttgcgagatgcttatgaa

SEQ ID NO: 16542 - DNA, 25 bp, E. coli
gaagcaagtacggaaaattgtatcg

SEQ ID NO: 16543 - DNA, 25 bp, E. coli
gcagcttttgcgtgatgcttatgaa

SEQ ID NO: 16544 - DNA, 25 bp, E. coli
gaagcaagtacgcaaaattgtatcg

SEQ ID NO: 16545 - DNA, 25 bp, E. coli
gaagcgaacggcgagttcttgatgc

SEQ ID NO: 16546 - DNA, 25 bp, E. coli
gaagcgaacggccagttcttgatgc

SEQ ID NO: 16547 - DNA, 25 bp, E. coli
cgagttcttgatgctggttccggga

SEQ ID NO: 16548 - DNA, 25 bp, E. coli
cgagttcttgatcctggttccggga

SEQ ID NO: 16549 - DNA, 25 bp, E. coli
gataccggagtttatcatttcaggg

SEQ ID NO: 16550 - DNA, 25 bp, E. coli
gataccggagttaatcatttcaggg

SEQ ID NO: 16551 - DNA, 25 bp, E. coli
gatgcttatgaaccaagtacgcaaa

SEQ ID NO: 16552 - DNA, 25 bp, E. coli
gatgcttatgaagcaagtacgcaaa

SEQ ID NO: 16553 - DNA, 25 bp, E. coli
aacgcactatctctgtcatccggag

SEQ ID NO: 16554 - DNA, 25 bp, E. coli
caatttaccgaagacatgggcgcag

SEQ ID NO: 16555 - DNA, 25 bp, E. coli
caagcgtgcaaatgcctgggagcaa

SEQ ID NO: 16556 - DNA, 25 bp, E. coli
caatttaccgaacacatgggcgcag

SEQ ID NO: 16557 - DNA, 25 bp, E. coli
aacgcactatctgtgtcatccggag

SEQ ID NO: 16558 - DNA, 25 bp, E. coli
cactgtcgttacagtctggaaggca

SEQ ID NO: 16559 - DNA, 25 bp, E. coli
caagcgtgcaaaagcctgggagcaa

SEQ ID NO: 16560 - DNA, 25 bp, E. coli
cactgtcgttactgtctggaaggca

SEQ ID NO: 16561 - DNA, 25 bp, E. coli
aaacagcgggttgtgcggtcaccgt

SEQ ID NO: 16562 - DNA, 25 bp, E. coli
aaattggcctgggtcatgaatgcgc

SEQ ID NO: 16563 - DNA, 25 bp, E. coli
aaacagcgggttctgcggtcaccgt

SEQ ID NO: 16564 - DNA, 25 bp, E. coli
aaattggcctggctcatgaatgcgc

SEQ ID NO: 16565 - DNA, 25 bp, E. coli
aaagcaatattgcaggtgccgggca

SEQ ID NO: 16566 - DNA, 25 bp, E. coli
aaagcaatattggaggtgccgggca

SEQ ID NO: 16567 - DNA, 25 bp, E. coli
tattaacggcgcaaaagaagacact

SEQ ID NO: 16568 - DNA, 25 bp, E. coli
tattaacggcgctaaagaagacact

SEQ ID NO: 16569 - DNA, 25 bp, E. coli
gatcgggtaaatatcgaacctggcg

SEQ ID NO: 16570 - DNA, 25 bp, E. coli
gatcgggtaaatttcgaacctggcg

SEQ ID NO: 16571 - DNA, 25 bp, E. coli
cccggacgttgaatttatggcgaca

SEQ ID NO: 16572 - DNA, 25 bp, E. coli
cccggacgttgattttatggcgaca

SEQ ID NO: 16573 - DNA, 25 bp, E. coli
gattatcgggatgtacaacaggcat

SEQ ID NO: 16574 - DNA, 25 bp, E. coli
gattatcgggatctacaacaggcat

SEQ ID NO: 16575 - DNA, 25 bp, E. coli
catggcgtctatggtatatgccgga

SEQ ID NO: 16576 - DNA, 25 bp, E. coli
catggcgtctatcgtatatgccgga

SEQ ID NO: 16577 - DNA, 25 bp, E. coli
acctggtaacttctgccgctatgta

SEQ ID NO: 16578 - DNA, 25 bp, E. coli
agatccgcgctctacctgcagtaca

SEQ ID NO: 16579 - DNA, 25 bp, E. coli
acctggtaacttgtgccgctatgta

SEQ ID NO: 16580 - DNA, 25 bp, E. coli
agatccgcgctcaacctgcagtaca

SEQ ID NO: 16581 - DNA, 25 bp, E. coli
tatgaaggcatgcaaaccgacgagc

SEQ ID NO: 16582 - DNA, 25 bp, E. coli
tatgaaggcatggaaaccgacgagc

SEQ ID NO: 16583 - DNA, 25 bp, E. coli
tcttggcgaatttcaggaactgtct

SEQ ID NO: 16584 - DNA, 25 bp, E. coli
tcttggcgaattacaggaactgtct

SEQ ID NO: 16585 - DNA, 25 bp, E. coli
cctcggcaaaggaacgctgactgtt

SEQ ID NO: 16586 - DNA, 25 bp, E. coli
cctcggcaaaggtacgctgactgtt

SEQ ID NO: 16587 - DNA, 25 bp, E. coli
gcgtatccatcaagggtcgccacgg

SEQ ID NO: 16588 - DNA, 25 bp, E. coli
gcgtatccatcatgggtcgccacgg

SEQ ID NO: 16589 - DNA, 25 bp, E. coli
gcacgcgccaaacgaaaaaacctgg

SEQ ID NO: 16590 - DNA, 25 bp, E. coli
gcacgcgccaaaggaaaaaacctgg

SEQ ID NO: 16591 - DNA, 25 bp, E. coli
gaactgtctcaacgtctgggctatg

SEQ ID NO: 16592 - DNA, 25 bp, E. coli
gaactgtctcaaggtctgggctatg

SEQ ID NO: 16593 - DNA, 25 bp, E. coli
ctgtttggtaaaccgcctgtcgttg

SEQ ID NO: 16594 - DNA, 25 bp, E. coli
ctgtttggtaaagcgcctgtcgttg

SEQ ID NO: 16595 - DNA, 25 bp, E. coli
gtcatcggttttggccctggtaaag

SEQ ID NO: 16596 - DNA, 25 bp, E. coli
gtcatcggttttcgccctggtaaag

SEQ ID NO: 16597 - DNA, 25 bp, E. coli
aaatctcacctgcaataaagcgact

SEQ ID NO: 16598 - DNA, 25 bp, E. coli
aaatctcacctggaataaagcgact

SEQ ID NO: 16599 - DNA, 25 bp, E. coli
tattacgacgctgacctggcggact

SEQ ID NO: 16600 - DNA, 25 bp, E. coli
tattacgacgctcacctggcggact

SEQ ID NO: 16601 - DNA, 25 bp, E. coli
tcccttcatttctaataaccctata

SEQ ID NO: 16602 - DNA, 25 bp, E. coli
tcccttcatttcaaataaccctata

SEQ ID NO: 16603 - DNA, 25 bp, E. coli
gcaataaagcgagtaaaagtaaggc

SEQ ID NO: 16604 - DNA, 25 bp, E. coli
gcaataaagcgactaaaagtaaggc

SEQ ID NO: 16605 - DNA, 25 bp, E. coli
cgactaaaagtatggcattaacaag

SEQ ID NO: 16606 - DNA, 25 bp, E. coli
cgactaaaagtaaggcattaacaag

SEQ ID NO: 16607 - DNA, 25 bp, E. coli
ctgacctggcggtctgctgccgtca

SEQ ID NO: 16608 - DNA, 25 bp, E. coli
ctgacctggcggactgctgccgtca

SEQ ID NO: 16609 - DNA, 25 bp, E. coli
gttgatgccgcggaaatctcacctg

SEQ ID NO: 16610 - DNA, 25 bp, E. coli
gttgatgccgcgcaaatctcacctg

SEQ ID NO: 16611 - DNA, 25 bp, E. coli
ggtcaatatgcttaaaatcccttca

SEQ ID NO: 16612 - DNA, 25 bp, E. coli
ggactgctgccgtcaggtcaatatg

SEQ ID NO: 16613 - DNA, 25 bp, E. coli
ggtcaatatgctaaaaatcccttca

SEQ ID NO: 16614 - DNA, 25 bp, E. coli
ggactgctgccgacaggtcaatatg

SEQ ID NO: 16615 - DNA, 25 bp, E. coli
taagtgttaccgttgatgccgcgca

SEQ ID NO: 16616 - DNA, 25 bp, E. coli
taaccctataataaatcaacgaaat

SEQ ID NO: 16617 - DNA, 25 bp, E. coli
taaccctataattaatcaacgaaat

SEQ ID NO: 16618 - DNA, 25 bp, E. coli
taagtgttaccgatgatgccgcgca

SEQ ID NO: 16619 - DNA, 25 bp, E. coli
caaaacgtgaaatggatgacccgca

SEQ ID NO: 16620 - DNA, 25 bp, E. coli
caaaacgtgaaaaggatgacccgca

SEQ ID NO: 16621 - DNA, 25 bp, E. coli
tactacatgggtcaagaaggctggc

SEQ ID NO: 16622 - DNA, 25 bp, E. coli
tactacatgggtgaagaaggctggc

SEQ ID NO: 16623 - DNA, 25 bp, E. coli
tatggacgatcaggaaacctacggt

SEQ ID NO: 16624 - DNA, 25 bp, E. coli
tatggacgatcacgaaacctacggt

SEQ ID NO: 16625 - DNA, 25 bp, E. coli
tattgaaggattctccagccgcgac

SEQ ID NO: 16626 - DNA, 25 bp, E. coli
tattgaaggattgtccagccgcgac

SEQ ID NO: 16627 - DNA, 25 bp, E. coli
ttataccatctgcaataccggcgcg

SEQ ID NO: 16628 - DNA, 25 bp, E. coli
ttataccatctggaataccggcgcg

SEQ ID NO: 16629 - DNA, 25 bp, E. coli
tgcaacttagccgtgactggacgag

SEQ ID NO: 16630 - DNA, 25 bp, E. coli
tgcaacttagccctgactggacgag

SEQ ID NO: 16631 - DNA, 25 bp, E. coli
gctgcaccgggctaccaaaactttg

SEQ ID NO: 16632 - DNA, 25 bp, E. coli
gctgcaccgggcaaccaaaactttg

SEQ ID NO: 16633 - DNA, 25 bp, E. coli
gaactactccgtgagccataatggg

SEQ ID NO: 16634 - DNA, 25 bp, E. coli
gaatgaaagcttacggcagcctggc

SEQ ID NO: 16635 - DNA, 25 bp, E. coli
gaactactccgtcagccataatggg

SEQ ID NO: 16636 - DNA, 25 bp, E. coli
gaatgaaagctttcggcagcctggc

SEQ ID NO: 16637 - DNA, 25 bp, E. coli
gacaaacttagccatgcggtgaacc

SEQ ID NO: 16638 - DNA, 25 bp, E. coli
gacaaacttagcgatgcggtgaacc

SEQ ID NO: 16639 - DNA, 25 bp, E. coli
gatgtcctcaaacaagtgcctggcg

SEQ ID NO: 16640 - DNA, 25 bp, E. coli
gatgtcctcaaagaagtgcctggcg

SEQ ID NO: 16641 - DNA, 25 bp, E. coli
aatatcgaaaaattggcgtctggcg

SEQ ID NO: 16642 - DNA, 25 bp, E. coli
aatatcgaaaaaatggcgtctggcg

SEQ ID NO: 16643 - DNA, 25 bp, E. coli
ttgcaggcgctgtacgacgccgcgt

SEQ ID NO: 16644 - DNA, 25 bp, E. coli
ttgcaggcgctgaacgacgccgcgt

SEQ ID NO: 16645 - DNA, 25 bp, E. coli
ttgaaagccgccagaaagcgcgcaa

SEQ ID NO: 16646 - DNA, 25 bp, E. coli
ttgaaagccgcctgaaagcgcgcaa

SEQ ID NO: 16647 - DNA, 25 bp, E. coli
gcgtatcgggcagcggcaaatctgc

SEQ ID NO: 16648 - DNA, 25 bp, E. coli
gcgtatcgggcaccggcaaatctgc

SEQ ID NO: 16649 - DNA, 25 bp, E. coli
gaatgacgacgatcgcaaaccgtgg

SEQ ID NO: 16650 - DNA, 25 bp, E. coli
gaagtggcgcatgaacttcatgccg

SEQ ID NO: 16651 - DNA, 25 bp, E. coli
gaagtggcgcatcaacttcatgccg

SEQ ID NO: 16652 - DNA, 25 bp, E. coli
gaatgacgacgaacgcaaaccgtgg

SEQ ID NO: 16653 - DNA, 25 bp, E. coli
cgaaaccgatgttctggtggtggat

SEQ ID NO: 16654 - DNA, 25 bp, E. coli
cgcagtttgaaacgctgcaggagcc

SEQ ID NO: 16655 - DNA, 25 bp, E. coli
cgaaaccgatgtactggtggtggat

SEQ ID NO: 16656 - DNA, 25 bp, E. coli
cgcagtttgaaaggctgcaggagcc

SEQ ID NO: 16657 - DNA, 25 bp, E. coli
cttcatgccgcgtttcttgatggcg

SEQ ID NO: 16658 - DNA, 25 bp, E. coli
cttcatgccgcgattcttgatggcg

SEQ ID NO: 16659 - DNA, 25 bp, E. coli
gattttgatgtgtttgaaagccgcc

SEQ ID NO: 16660 - DNA, 25 bp, E. coli
gattttgatgtgattgaaagccgcc

SEQ ID NO: 16661 - DNA, 25 bp, E. coli
gacgccgcgtttcctatgcagcgca

SEQ ID NO: 16662 - DNA, 25 bp, E. coli
gacgccgcgtttgctatgcagcgca

SEQ ID NO: 16663 - DNA, 25 bp, E. coli
cagacggaggtctgtaatggcaaac

SEQ ID NO: 16664 - DNA, 25 bp, E. coli
cagacggaggtcagtaatggcaaac

SEQ ID NO: 16665 - DNA, 25 bp, E. coli
catacgccgcgttaattctatgcaa

SEQ ID NO: 16666 - DNA, 25 bp, E. coli
catacgccgcgtaaattctatgcaa

SEQ ID NO: 16667 - DNA, 25 bp, E. coli
tatgatgtctatacccagacggagg

SEQ ID NO: 16668 - DNA, 25 bp, E. coli
tatgatgtctattcccagacggagg

SEQ ID NO: 16669 - DNA, 25 bp, E. coli
cggttccggcaattttgcagaagac

SEQ ID NO: 16670 - DNA, 25 bp, E. coli
cggttccggcaaatttgcagaagac

SEQ ID NO: 16671 - DNA, 25 bp, E. coli
gatatctattctcgctaagaagctg

SEQ ID NO: 16672 - DNA, 25 bp, E. coli
gtagcgaaaatatggcagccgccat

SEQ ID NO: 16673 - DNA, 25 bp, E. coli
gatatctattctggctaagaagctg

SEQ ID NO: 16674 - DNA, 25 bp, E. coli
ggatattaccaaacgcgggtctgcc

SEQ ID NO: 16675 - DNA, 25 bp, E. coli
ggtctgcccgcgacagttcactaag

SEQ ID NO: 16676 - DNA, 25 bp, E. coli
ggatattaccaatcgcgggtctgcc

SEQ ID NO: 16677 - DNA, 25 bp, E. coli
gtagcgaaaataaggcagccgccat

SEQ ID NO: 16678 - DNA, 25 bp, E. coli
ggtctgcccgcgtcagttcactaag

SEQ ID NO: 16679 - DNA, 25 bp, E. coli
taagaagctgttgcaggatattacc

SEQ ID NO: 16680 - DNA, 25 bp, E. coli
taagaagctgttccaggatattacc

SEQ ID NO: 16681 - DNA, 25 bp, E. coli
taagcttagtccgacgtagcgaaaa

SEQ ID NO: 16682 - DNA, 25 bp, E. coli
taatggcaaaccttcgaggcggttc

SEQ ID NO: 16683 - DNA, 25 bp, E. coli
taatggcaaaccatcgaggcggttc

SEQ ID NO: 16684 - DNA, 25 bp, E. coli
taagcttagtcccacgtagcgaaaa

SEQ ID NO: 16685 - DNA, 25 bp, E. coli
aagatggttatcaggcggacacgct

SEQ ID NO: 16686 - DNA, 25 bp, E. coli
aatattgatcttcgtgcggcacagc

SEQ ID NO: 16687 - DNA, 25 bp, E. coli
aatattgatcttggtgcggcacagc

SEQ ID NO: 16688 - DNA, 25 bp, E. coli
aacgaaatgtgtatgcggcgctgga

SEQ ID NO: 16689 - DNA, 25 bp, E. coli
aagatggttatctggcggacacgct

SEQ ID NO: 16690 - DNA, 25 bp, E. coli
catgcgatgcaaaatggctactggg

SEQ ID NO: 16691 - DNA, 25 bp, E. coli
catgcgatgcaatatggctactggg

SEQ ID NO: 16692 - DNA, 25 bp, E. coli
tacacgttgcccagtcgataattga

SEQ ID NO: 16693 - DNA, 25 bp, E. coli
tacacgttgccctgtcgataattga

SEQ ID NO: 16694 - DNA, 25 bp, E. coli
aacgaaatgtgtttgcggcgctgga

SEQ ID NO: 16695 - DNA, 25 bp, E. coli
tatcattggacttatcttcgcgagc

SEQ ID NO: 16696 - DNA, 25 bp, E. coli
tatcattggactaatcttcgcgagc

SEQ ID NO: 16697 - DNA, 25 bp, E. coli
tgtttagctctgtaccgttggcgca

SEQ ID NO: 16698 - DNA, 25 bp, E. coli
tgtttagctctgaaccgttggcgca

SEQ ID NO: 16699 - DNA, 25 bp, E. coli
tgaaaaatgttctggtcaccgtccc

SEQ ID NO: 16700 - DNA, 25 bp, E. coli
tgaaaaatgttcaggtcaccgtccc

SEQ ID NO: 16701 - DNA, 25 bp, E. coli
tcgcgagcatgacaaatatccctgg

SEQ ID NO: 16702 - DNA, 25 bp, E. coli
tcgcgagcatgagaaatatccctgg

SEQ ID NO: 16703 - DNA, 25 bp, E. coli
tctatttgcgcgctcatcgccggaa

SEQ ID NO: 16704 - DNA, 25 bp, E. coli
tctatttgcgcggtcatcgccggaa

SEQ ID NO: 16705 - DNA, 25 bp, E. coli
gttgagtcataccagcaaaccggga

SEQ ID NO: 16706 - DNA, 25 bp, E. coli
gttgagtcatacgagcaaaccggga

SEQ ID NO: 16707 - DNA, 25 bp, E. coli
tattagcggtttatcactgccgacc

SEQ ID NO: 16708 - DNA, 25 bp, E. coli
tataatgcagtatgtacagaccctc

SEQ ID NO: 16709 - DNA, 25 bp, E. coli
tataatgcagtaagtacagaccctc

SEQ ID NO: 16710 - DNA, 25 bp, E. coli
tattagcggtttttcactgccgacc

SEQ ID NO: 16711 - DNA, 25 bp, E. coli
ttttgtcgctggtccgaacctggag

SEQ ID NO: 16712 - DNA, 25 bp, E. coli
ttttgtcgctggaccgaacctggag

SEQ ID NO: 16713 - DNA, 25 bp, E. coli
tgccgacctggatcatggagcagaa

SEQ ID NO: 16714 - DNA, 25 bp, E. coli
tgccgacctggaacatggagcagaa

SEQ ID NO: 16715 - DNA, 25 bp, E. coli
cctggacgcaatcggatataatgca

SEQ ID NO: 16716 - DNA, 25 bp, E. coli
cctggacgcaatgggatataatgca

SEQ ID NO: 16717 - DNA, 25 bp, E. coli
gcgtcatcgcgaagatattagcggt

SEQ ID NO: 16718 - DNA, 25 bp, E. coli
gcgtcatcgcgatgatattagcggt

SEQ ID NO: 16719 - DNA, 25 bp, E. coli
gaacttgttaatcatcgccctacca

SEQ ID NO: 16720 - DNA, 25 bp, E. coli
gaacttgttaatgatcgccctacca

SEQ ID NO: 16721 - DNA, 25 bp, E. coli
ctatgaaatgcggaacctggacgca

SEQ ID NO: 16722 - DNA, 25 bp, E. coli
ctatgaaatgcgcaacctggacgca

SEQ ID NO: 16723 - DNA, 25 bp, E. coli
cattgctccggataaggatgtcccg

SEQ ID NO: 16724 - DNA, 25 bp, E. coli
cattgctccggaaaaggatgtcccg

SEQ ID NO: 16725 - DNA, 25 bp, E. coli
gatctgcaacgcacaggaaaacgct

SEQ ID NO: 16726 - DNA, 25 bp, E. coli
gatctgcaacgctcaggaaaacgct

SEQ ID NO: 16727 - DNA, 25 bp, E. coli
tcaaagtcgacgaaatgacgagcgt

SEQ ID NO: 16728 - DNA, 25 bp, E. coli
tcaaagtcgacgtaatgacgagcgt

SEQ ID NO: 16729 - DNA, 25 bp, E. coli
caggcaaccggcttgggcgttagat

SEQ ID NO: 16730 - DNA, 25 bp, E. coli
caggcaaccggctcgggcgttagat

SEQ ID NO: 16731 - DNA, 25 bp, E. coli
caggcaaccggcacggacgttggat

SEQ ID NO: 16732 - DNA, 25 bp, E. coli
caggcaaccggctcggacgttggat

SEQ ID NO: 16733 - DNA, 25 bp, E. coli
caggcaaccggcatgggcgttagat

SEQ ID NO: 16734 - DNA, 25 bp, E. coli
caggcaaccggcacgggcgttagat

SEQ ID NO: 16735 - DNA, 25 bp, E. coli
tagatgttggatgcggcgtaaccgc

SEQ ID NO: 16736 - DNA, 25 bp, E. coli
tagatgttggatccggcgtaaccgc

SEQ ID NO: 16737 - DNA, 25 bp, E. coli
tcgcatcaggcatccggctcgggcg

SEQ ID NO: 16738 - DNA, 25 bp, E. coli
tcgcatcaggcaaccggctcgggcg

SEQ ID NO: 16739 - DNA, 25 bp, E. coli
ccggatgtggcgtatgctgataaga

SEQ ID NO: 16740 - DNA, 25 bp, E. coli
ccggatgtggcgaatgctgataaga

SEQ ID NO: 16741 - DNA, 25 bp, E. coli
cgccacatccggcatggtatgccgg

SEQ ID NO: 16742 - DNA, 25 bp, E. coli
cgccacatccgggatggtatgccgg

SEQ ID NO: 16743 - DNA, 25 bp, E. coli
gtggcgtatgctcataagacgcgcc

SEQ ID NO: 16744 - DNA, 25 bp, E. coli
gggtgccgcacttcacagcggtgta

SEQ ID NO: 16745 - DNA, 25 bp, E. coli
gtggcgtatgctgataagacgcgcc

SEQ ID NO: 16746 - DNA, 25 bp, E. coli
gggtgccgcactacacagcggtgta

SEQ ID NO: 16747 - DNA, 25 bp, E. coli
gtgaccgccttgtctgacctacggg

SEQ ID NO: 16748 - DNA, 25 bp, E. coli
gtgaccgccttgactgacctacggg

SEQ ID NO: 16749 - DNA, 25 bp, E. coli
gagcacttcacaccggtgtaggcct

SEQ ID NO: 16750 - DNA, 25 bp, E. coli
gagcacttcacagcggtgtaggcct

SEQ ID NO: 16751 - DNA, 25 bp, E. coli
caatttgccgtgcactggcgcagga

SEQ ID NO: 16752 - DNA, 25 bp, E. coli
caatttgccgtggactggcgcagga

SEQ ID NO: 16753 - DNA, 25 bp, E. coli
aactaaagtgcgagacctggtggac

SEQ ID NO: 16754 - DNA, 25 bp, E. coli
aactaaagtgcgtgacctggtggac

SEQ ID NO: 16755 - DNA, 25 bp, E. coli
tatgtttcggaacatcgcatgtcgc

SEQ ID NO: 16756 - DNA, 25 bp, E. coli
tatgtttcggaagatcgcatgtcgc

SEQ ID NO: 16757 - DNA, 25 bp, E. coli
tgattctcgataccccgacagtcgg

SEQ ID NO: 16758 - DNA, 25 bp, E. coli
tgattctcgatagcccgacagtcgg

SEQ ID NO: 16759 - DNA, 25 bp, E. coli
tggtatgacccgtccagatgctggc

SEQ ID NO: 16760 - DNA, 25 bp, E. coli
tgacagcagttctcaggccaggatt

SEQ ID NO: 16761 - DNA, 25 bp, E. coli
tgacagcagttcacaggccaggatt

SEQ ID NO: 16762 - DNA, 25 bp, E. coli
gctttctggtggtaacgcgcagcga

SEQ ID NO: 16763 - DNA, 25 bp, E. coli
gctttctggtggaaacgcgcagcga

SEQ ID NO: 16764 - DNA, 25 bp, E. coli
gcattatcagcgatctggcggctca

SEQ ID NO: 16765 - DNA, 25 bp, E. coli
gcattatcagcgttctggcggctca

SEQ ID NO: 16766 - DNA, 25 bp, E. coli
gacttttccggctgcagagatgacc

SEQ ID NO: 16767 - DNA, 25 bp, E. coli
gacttttccggcagcagagatgacc

SEQ ID NO: 16768 - DNA, 25 bp, E. coli
gatcctcatcaagggccagctggtt

SEQ ID NO: 16769 - DNA, 25 bp, E. coli
tggtatgacccgaccagatgctggc

SEQ ID NO: 16770 - DNA, 25 bp, E. coli
gatcctcatcaacggccagctggtt

SEQ ID NO: 16771 - DNA, 25 bp, E. coli
gatggatgaaccaaccgcttcgctg

SEQ ID NO: 16772 - DNA, 25 bp, E. coli
gatggatgaacctaccgcttcgctg

SEQ ID NO: 16773 - DNA, 25 bp, E. coli
cacgatttgcggagcttgtcacagc

SEQ ID NO: 16774 - DNA, 25 bp, E. coli
cacgatttgcggtgcttgtcacagc

SEQ ID NO: 16775 - DNA, 25 bp, E. coli
agcgaatgtcacagcgaaaaaagtg

SEQ ID NO: 16776 - DNA, 25 bp, E. coli
agcgaatgtcactgcgaaaaaagtg

SEQ ID NO: 16777 - DNA, 25 bp, E. coli
aaaagtgactttacttgtcgctgcg

SEQ ID NO: 16778 - DNA, 25 bp, E. coli
aaaagtgacttttcttgtcgctgcg

SEQ ID NO: 16779 - DNA, 25 bp, E. coli
tataggaaataagtcttgtcaggca

SEQ ID NO: 16780 - DNA, 25 bp, E. coli
tataggaaataactcttgtcaggca

SEQ ID NO: 16781 - DNA, 25 bp, E. coli
ttgcaataaacgaagctaatgagcc

SEQ ID NO: 16782 - DNA, 25 bp, E. coli
ttgcaataaacgtagctaatgagcc

SEQ ID NO: 16783 - DNA, 25 bp, E. coli
tgtcacagctgagaaagcgaatgtc

SEQ ID NO: 16784 - DNA, 25 bp, E. coli
tgtcacagctgacaaagcgaatgtc

SEQ ID NO: 16785 - DNA, 25 bp, E. coli
tgcgtacactgatatcacactgggt

SEQ ID NO: 16786 - DNA, 25 bp, E. coli
tgcgtacactgaaatcacactgggt

SEQ ID NO: 16787 - DNA, 25 bp, E. coli
tcaggcatagagtcataagcggtta

SEQ ID NO: 16788 - DNA, 25 bp, E. coli
tcaggcatagagacataagcggtta

SEQ ID NO: 16789 - DNA, 25 bp, E. coli
gctaatgagcctgactataggaaat

SEQ ID NO: 16790 - DNA, 25 bp, E. coli
gctaatgagcctcactataggaaat

SEQ ID NO: 16791 - DNA, 25 bp, E. coli
gcacgttttcgcactgtgaaatgta

SEQ ID NO: 16792 - DNA, 25 bp, E. coli
gcacgttttcgctctgtgaaatgta

SEQ ID NO: 16793 - DNA, 25 bp, E. coli
taagcggttattgtcacgatttgcg

SEQ ID NO: 16794 - DNA, 25 bp, E. coli
taagcggttattctcacgatttgcg

SEQ ID NO: 16795 - DNA, 25 bp, E. coli
cacgaatcacggttgttgatggtgg

SEQ ID NO: 16796 - DNA, 25 bp, E. coli
cacgaatcacggatgttgatggtgg

SEQ ID NO: 16797 - DNA, 25 bp, E. coli
caacttgttgaaggccgcgcggata

SEQ ID NO: 16798 - DNA, 25 bp, E. coli
caacttgttgaacgccgcgcggata

SEQ ID NO: 16799 - DNA, 25 bp, E. coli
taccattaccgaagaggcctcggcg

SEQ ID NO: 16800 - DNA, 25 bp, E. coli
taccattaccgatgaggcctcggcg

SEQ ID NO: 16801 - DNA, 25 bp, E. coli
ttcatccgcaacatgttgaaggccg

SEQ ID NO: 16802 - DNA, 25 bp, E. coli
ttcatccgcaacttgttgaaggccg

SEQ ID NO: 16803 - DNA, 25 bp, E. coli
tgatggtggtgaagagcgtgccgat

SEQ ID NO: 16804 - DNA, 25 bp, E. coli
tgaaggcgctaccattaccgatgag

SEQ ID NO: 16805 - DNA, 25 bp, E. coli
tgatggtggtgatgagcgtgccgat

SEQ ID NO: 16806 - DNA, 25 bp, E. coli
tgaaggcgctacgattaccgatgag

SEQ ID NO: 16807 - DNA, 25 bp, E. coli
tcgctgcgccggagcgcgatacgat

SEQ ID NO: 16808 - DNA, 25 bp, E. coli
tcgctgcgccggtgcgcgatacgat

SEQ ID NO: 16809 - DNA, 25 bp, E. coli
tctggcgaatcatccacgaatcacg

SEQ ID NO: 16810 - DNA, 25 bp, E. coli
tctggcgaatcaaccacgaatcacg

SEQ ID NO: 16811 - DNA, 25 bp, E. coli
gcgccggtgcgcgatacgatgaaac

SEQ ID NO: 16812 - DNA, 25 bp, E. coli
gcgccggtgcgccatacgatgaaac

SEQ ID NO: 16813 - DNA, 25 bp, E. coli
cgaatcatccaccaatcacggttgt

SEQ ID NO: 16814 - DNA, 25 bp, E. coli
cgaatcatccacgaatcacggttgt

SEQ ID NO: 16815 - DNA, 25 bp, E. coli
tggaatattgcgcttttcatccgca

SEQ ID NO: 16816 - DNA, 25 bp, E. coli
tggaatattgcggttttcatccgca

SEQ ID NO: 16817 - DNA, 25 bp, E. coli
aagcttgaaggctaatcaccggaca

SEQ ID NO: 16818 - DNA, 25 bp, E. coli
aagcttgaaggcaaatcaccggaca

SEQ ID NO: 16819 - DNA, 25 bp, E. coli
taaaatgcgcgctgcggcgctggat

SEQ ID NO: 16820 - DNA, 25 bp, E. coli
taaaatgcgcgcagcggcgctggat

SEQ ID NO: 16821 - DNA, 25 bp, E. coli
agcgacgccgcccaagcttgaaggc

SEQ ID NO: 16822 - DNA, 25 bp, E. coli
agcgacgccgccgaagcttgaaggc

SEQ ID NO: 16823 - DNA, 25 bp, E. coli
gccgccgaagctagaaggcaaatca

SEQ ID NO: 16824 - DNA, 25 bp, E. coli
gccgccgaagcttgaaggcaaatca

SEQ ID NO: 16825 - DNA, 25 bp, E. coli
gccgaagcttgaaggcaaatcaccg

SEQ ID NO: 16826 - DNA, 25 bp, E. coli
gccgaagcttgatggcaaatcaccg

SEQ ID NO: 16827 - DNA, 25 bp, E. coli
gcttgaaggcaaatcaccggacagc

SEQ ID NO: 16828 - DNA, 25 bp, E. coli
gcttgaaggcaattcaccggacagc

SEQ ID NO: 16829 - DNA, 25 bp, E. coli
gcgttaactaaattgcgcgctgcgg

SEQ ID NO: 16830 - DNA, 25 bp, E. coli
gcgttaactaaaatgcgcgctgcgg

SEQ ID NO: 16831 - DNA, 25 bp, E. coli
gaagcttgaagggaaatcaccggac

SEQ ID NO: 16832 - DNA, 25 bp, E. coli
gaagcttgaaggcaaatcaccggac

SEQ ID NO: 16833 - DNA, 25 bp, E. coli
gacgccgccgaagcttgaaggcaaa

SEQ ID NO: 16834 - DNA, 25 bp, E. coli
gacgccgccgaaccttgaaggcaaa

SEQ ID NO: 16835 - DNA, 25 bp, E. coli
gttaactaaaatccgcgctgcggcg

SEQ ID NO: 16836 - DNA, 25 bp, E. coli
gttaactaaaatgcgcgctgcggcg

SEQ ID NO: 16837 - DNA, 25 bp, E. coli
gacgcgttaacttaaatgcgcgctg

SEQ ID NO: 16838 - DNA, 25 bp, E. coli
gacgcgttaactaaaatgcgcgctg

SEQ ID NO: 16839 - DNA, 25 bp, E. coli
aaggtgaagcgttccgtgcattctg

SEQ ID NO: 16840 - DNA, 25 bp, E. coli
caacgccagcaagtacttttaacga

SEQ ID NO: 16841 - DNA, 25 bp, E. coli
aaggtgaagcgtaccgtgcattctg

SEQ ID NO: 16842 - DNA, 25 bp, E. coli
aagcgtaccgtggattctggagcca

SEQ ID NO: 16843 - DNA, 25 bp, E. coli
caacgccagcaactacttttaacga

SEQ ID NO: 16844 - DNA, 25 bp, E. coli
caactacttttaacgacattgacgg

SEQ ID NO: 16845 - DNA, 25 bp, E. coli
caactacttttatcgacattgacgg

SEQ ID NO: 16846 - DNA, 25 bp, E. coli
aagcgtaccgtgcattctggagcca

SEQ ID NO: 16847 - DNA, 25 bp, E. coli
tttaacgacattgacgggttatgca

SEQ ID NO: 16848 - DNA, 25 bp, E. coli
tttaacgacattcacgggttatgca

SEQ ID NO: 16849 - DNA, 25 bp, E. coli
tgaacaacgccaccaactactttta

SEQ ID NO: 16850 - DNA, 25 bp, E. coli
tgaagcgtaccgagcattctggagc

SEQ ID NO: 16851 - DNA, 25 bp, E. coli
tgaacaacgccagcaactactttta

SEQ ID NO: 16852 - DNA, 25 bp, E. coli
tgaagcgtaccgtgcattctggagc

SEQ ID NO: 16853 - DNA, 25 bp, E. coli
gccagcaactacttttaacgacatt

SEQ ID NO: 16854 - DNA, 25 bp, E. coli
gccagcaactacatttaacgacatt

SEQ ID NO: 16855 - DNA, 25 bp, E. coli
gcgtaccgtgcattctggagccaga

SEQ ID NO: 16856 - DNA, 25 bp, E. coli
gcgtaccgtgcaatctggagccaga

SEQ ID NO: 16857 - DNA, 25 bp, E. coli
gaaaggtgaagcgtaccgtgcattc

SEQ ID NO: 16858 - DNA, 25 bp, E. coli
gaaaggtgaagcctaccgtgcattc

SEQ ID NO: 16859 - DNA, 25 bp, E. coli
gtaccgtgcattctggagccagaat

SEQ ID NO: 16860 - DNA, 25 bp, E. coli
gtaccgtgcattgtggagccagaat

SEQ ID NO: 16861 - DNA, 25 bp, E. coli
aatgctttacttggagctcgtggcg

SEQ ID NO: 16862 - DNA, 25 bp, E. coli
aatgctttacttcgagctcgtggcg

SEQ ID NO: 16863 - DNA, 25 bp, E. coli
catagctggaactatgctgggtcaa

SEQ ID NO: 16864 - DNA, 25 bp, E. coli
catagctggaacaatgctgggtcaa

SEQ ID NO: 16865 - DNA, 25 bp, E. coli
tattccccggtctcctgtaaagcag

SEQ ID NO: 16866 - DNA, 25 bp, E. coli
tattccccggtcacctgtaaagcag

SEQ ID NO: 16867 - DNA, 25 bp, E. coli
tacagctcatctatcgccgttctcg

SEQ ID NO: 16868 - DNA, 25 bp, E. coli
tacagctcatctttcgccgttctcg

SEQ ID NO: 16869 - DNA, 25 bp, E. coli
tgtttgccctgcgtgtaagactccc

SEQ ID NO: 16870 - DNA, 25 bp, E. coli
tgtttgccctgcctgtaagactccc

SEQ ID NO: 16871 - DNA, 25 bp, E. coli
tctcccaggagggaaaatacacaaa

SEQ ID NO: 16872 - DNA, 25 bp, E. coli
tctcccaggaggcaaaatacacaaa

SEQ ID NO: 16873 - DNA, 25 bp, E. coli
tcatggatgaaagagcctgtttgcc

SEQ ID NO: 16874 - DNA, 25 bp, E. coli
tcatggatgaaacagcctgtttgcc

SEQ ID NO: 16875 - DNA, 25 bp, E. coli
ccgttctcgatcacaaaatggcaag

SEQ ID NO: 16876 - DNA, 25 bp, E. coli
gctgggtcaatcagtaaaaacttgc

SEQ ID NO: 16877 - DNA, 25 bp, E. coli
gctgggtcaatctgtaaaaacttgc

SEQ ID NO: 16878 - DNA, 25 bp, E. coli
ccgttctcgatctcaaaatggcaag

SEQ ID NO: 16879 - DNA, 25 bp, E. coli
gatatgtcctgcgtgttctcccagg

SEQ ID NO: 16880 - DNA, 25 bp, E. coli
gatatgtcctgcctgttctcccagg

SEQ ID NO: 16881 - DNA, 25 bp, E. coli
tggcgtatcctaagatattccccgg

SEQ ID NO: 16882 - DNA, 25 bp, E. coli
tggcgtatcctatgatattccccgg

SEQ ID NO: 16883 - DNA, 25 bp, E. coli
aatgggatacggctgatactgtcgc

SEQ ID NO: 16884 - DNA, 25 bp, E. coli
aatgggatacgggtgatactgtcgc

SEQ ID NO: 16885 - DNA, 25 bp, E. coli
catcccggtgaccataccgtacagg

SEQ ID NO: 16886 - DNA, 25 bp, E. coli
catcccggtgacgataccgtacagg

SEQ ID NO: 16887 - DNA, 25 bp, E. coli
tccgcacgggtgcattcattcagtg

SEQ ID NO: 16888 - DNA, 25 bp, E. coli
tccgcacgggtggattcattcagtg

SEQ ID NO: 16889 - DNA, 25 bp, E. coli
tcagtgtttcctgccggatatcctg

SEQ ID NO: 16890 - DNA, 25 bp, E. coli
tcagtgtttcctcccggatatcctg

SEQ ID NO: 16891 - DNA, 25 bp, E. coli
cccctgaatgggttacggctgatac

SEQ ID NO: 16892 - DNA, 25 bp, E. coli
cgactgctccgcacgggtgcattca

SEQ ID NO: 16893 - DNA, 25 bp, E. coli
cgactgctccgctcgggtgcattca

SEQ ID NO: 16894 - DNA, 25 bp, E. coli
cccctgaatgggatacggctgatac

SEQ ID NO: 16895 - DNA, 25 bp, E. coli
cattcattcagtgtttcctgccgga

SEQ ID NO: 16896 - DNA, 25 bp, E. coli
cattcattcagtctttcctgccgga

SEQ ID NO: 16897 - DNA, 25 bp, E. coli
gatacggctgattctgtcgcccctg

SEQ ID NO: 16898 - DNA, 25 bp, E. coli
gatacggctgatactgtcgcccctg

SEQ ID NO: 16899 - DNA, 25 bp, E. coli
gtgcctttgccattcagttcaaaac

SEQ ID NO: 16900 - DNA, 25 bp, E. coli
ggtgaccataccgtacaggttagaa

SEQ ID NO: 16901 - DNA, 25 bp, E. coli
ggtgaccataccctacaggttagaa

SEQ ID NO: 16902 - DNA, 25 bp, E. coli
gtgcctttgccaatcagttcaaaac

SEQ ID NO: 16903 - DNA, 25 bp, E. coli
gggcgcgtactgctgcctttgccat

SEQ ID NO: 16904 - DNA, 25 bp, E. coli
gggcgcgtactggtgcctttgccat

SEQ ID NO: 16905 - DNA, 25 bp, E. coli
tacaacgtgcagaacgctggcgaga

SEQ ID NO: 16906 - DNA, 25 bp, E. coli
tacaaagctgagtaggttaacccgc

SEQ ID NO: 16907 - DNA, 25 bp, E. coli
tacaacgtgcagtacgctggcgaga

SEQ ID NO: 16908 - DNA, 25 bp, E. coli
tacaaagctgagaaggttaacccgc

SEQ ID NO: 16909 - DNA, 25 bp, E. coli
aaaaacgtggccagcatagccgcga

SEQ ID NO: 16910 - DNA, 25 bp, E. coli
aaaaacgtggcctgcatagccgcga

SEQ ID NO: 16911 - DNA, 25 bp, E. coli
tatttatcaggcacagagcggtctg

SEQ ID NO: 16912 - DNA, 25 bp, E. coli
tatttatcaggctcagagcggtctg

SEQ ID NO: 16913 - DNA, 25 bp, E. coli
tgcaacagtattacgcgacggcgtg

SEQ ID NO: 16914 - DNA, 25 bp, E. coli
tgcaacagtatttcgcgacggcgtg

SEQ ID NO: 16915 - DNA, 25 bp, E. coli
tcattcagaagatgtcgccgaccac

SEQ ID NO: 16916 - DNA, 25 bp, E. coli
tcattcagaagaagtcgccgaccac

SEQ ID NO: 16917 - DNA, 25 bp, E. coli
tcatgatctggcaagcctgggagca

SEQ ID NO: 16918 - DNA, 25 bp, E. coli
tcatgatctggctagcctgggagca

SEQ ID NO: 16919 - DNA, 25 bp, E. coli
gctaatctgggttacggcatcgccg

SEQ ID NO: 16920 - DNA, 25 bp, E. coli
gctaatctgggtaacggcatcgccg

SEQ ID NO: 16921 - DNA, 25 bp, E. coli
gaaggtcaaaaccaactgcaggtgc

SEQ ID NO: 16922 - DNA, 25 bp, E. coli
gaaggtcaaaacgaactgcaggtgc

SEQ ID NO: 16923 - DNA, 25 bp, E. coli
ggtaaccattatacagcagcagctg

SEQ ID NO: 16924 - DNA, 25 bp, E. coli
ggtaaccattattcagcagcagctg

SEQ ID NO: 16925 - DNA, 25 bp, E. coli
taagaccgacgtgcttgatctgacc

SEQ ID NO: 16926 - DNA, 25 bp, E. coli
taagaccgacgtccttgatctgacc

SEQ ID NO: 16927 - DNA, 25 bp, E. coli
catatctgagaaaaacccttggaca

SEQ ID NO: 16928 - DNA, 25 bp, E. coli
catatctgagaataacccttggaca

SEQ ID NO: 16929 - DNA, 25 bp, E. coli
aacattctgaggatgggagggttca

SEQ ID NO: 16930 - DNA, 25 bp, E. coli
aacattctgaggttgggagggttca

SEQ ID NO: 16931 - DNA, 25 bp, E. coli
taccttgcctataaccctgctggag

SEQ ID NO: 16932 - DNA, 25 bp, E. coli
taccttgcctattaccctgctggag

SEQ ID NO: 16933 - DNA, 25 bp, E. coli
tattccgtaacctgcaaggatgaga

SEQ ID NO: 16934 - DNA, 25 bp, E. coli
tattccgtaaccagcaaggatgaga

SEQ ID NO: 16935 - DNA, 25 bp, E. coli
tattacgatgcgtgagatattccag

SEQ ID NO: 16936 - DNA, 25 bp, E. coli
tattacgatgcgagagatattccag

SEQ ID NO: 16937 - DNA, 25 bp, E. coli
ttggcgatatcctcggaggtcctga

SEQ ID NO: 16938 - DNA, 25 bp, E. coli
ttggcgatatccacggaggtcctga

SEQ ID NO: 16939 - DNA, 25 bp, E. coli
tcatgtgatttacaccggagcgtca

SEQ ID NO: 16940 - DNA, 25 bp, E. coli
tcatgtgatttagaccggagcgtca

SEQ ID NO: 16941 - DNA, 25 bp, E. coli
cctcccgtgaaggaagaacattctg

SEQ ID NO: 16942 - DNA, 25 bp, E. coli
cctcccgtgaagcaagaacattctg

SEQ ID NO: 16943 - DNA, 25 bp, E. coli
cggagcgtcaattaagtacatcgag

SEQ ID NO: 16944 - DNA, 25 bp, E. coli
cggagcgtcaataaagtacatcgag

SEQ ID NO: 16945 - DNA, 25 bp, E. coli
tcaaaaagttctatctgcaagtggt

SEQ ID NO: 16946 - DNA, 25 bp, E. coli
tcaaaaagttctttctgcaagtggt

SEQ ID NO: 16947 - DNA, 25 bp, E. coli
gagtcaatttttggccctcccgtga

SEQ ID NO: 16948 - DNA, 25 bp, E. coli
gagtcaatttttcgccctcccgtga

SEQ ID NO: 16949 - DNA, 25 bp, E. coli
aagccgcgcgccagcgtgcgttcga

SEQ ID NO: 16950 - DNA, 25 bp, E. coli
aagccgcgcgcctgcgtgcgttcga

SEQ ID NO: 16951 - DNA, 25 bp, E. coli
taaagatctcgggttaatggagcag

SEQ ID NO: 16952 - DNA, 25 bp, E. coli
taaagatctcggcttaatggagcag

SEQ ID NO: 16953 - DNA, 25 bp, E. coli
ttgatcccgtcagcggtacggtaac

SEQ ID NO: 16954 - DNA, 25 bp, E. coli
ttgatcccgtcaccggtacggtaac

SEQ ID NO: 16955 - DNA, 25 bp, E. coli
tcgggttaatggtgcagattgacga

SEQ ID NO: 16956 - DNA, 25 bp, E. coli
tcgggttaatggagcagattgacga

SEQ ID NO: 16957 - DNA, 25 bp, E. coli
tcggcgtattcgagatgaacgaagc

SEQ ID NO: 16958 - DNA, 25 bp, E. coli
tcggcgtattcgtgatgaacgaagc

SEQ ID NO: 16959 - DNA, 25 bp, E. coli
tctcgggttaatcgagcagattgac

SEQ ID NO: 16960 - DNA, 25 bp, E. coli
tctcgggttaatggagcagattgac

SEQ ID NO: 16961 - DNA, 25 bp, E. coli
cctgccgtgtattaaagatctcggg

SEQ ID NO: 16962 - DNA, 25 bp, E. coli
cctgccgtgtataaaagatctcggg

SEQ ID NO: 16963 - DNA, 25 bp, E. coli
gcgatatcggcgaattcgagatgaa

SEQ ID NO: 16964 - DNA, 25 bp, E. coli
gcgatatcggcgtattcgagatgaa

SEQ ID NO: 16965 - DNA, 25 bp, E. coli
cgtattcgagatcaacgaagccttt

SEQ ID NO: 16966 - DNA, 25 bp, E. coli
cgtattcgagatgaacgaagccttt

SEQ ID NO: 16967 - DNA, 25 bp, E. coli
gtttgatcccgtcagcggtacggta

SEQ ID NO: 16968 - DNA, 25 bp, E. coli
gtttgatcccgtgagcggtacggta

SEQ ID NO: 16969 - DNA, 25 bp, E. coli
tccggcgtttgaacccgtcagcggt

SEQ ID NO: 16970 - DNA, 25 bp, E. coli
tccggcgtttgatcccgtcagcggt

SEQ ID NO: 16971 - DNA, 25 bp, E. coli
tacatagcggcgttaatttacccgg

SEQ ID NO: 16972 - DNA, 25 bp, E. coli
tacatagcggcgataatttacccgg

SEQ ID NO: 16973 - DNA, 25 bp, E. coli
aaaaggagtttcacgctcacctgca

SEQ ID NO: 16974 - DNA, 25 bp, E. coli
aaaaggagtttctcgctcacctgca

SEQ ID NO: 16975 - DNA, 25 bp, E. coli
tagccttactggagcgacgcagtca

SEQ ID NO: 16976 - DNA, 25 bp, E. coli
tagccttactggtgcgacgcagtca

SEQ ID NO: 16977 - DNA, 25 bp, E. coli
tttacgcgcggcgatggcctggcta

SEQ ID NO: 16978 - DNA, 25 bp, E. coli
tttacgcgcggccatggcctggcta

SEQ ID NO: 16979 - DNA, 25 bp, E. coli
tgtgtgaatctaacggcagaccgga

SEQ ID NO: 16980 - DNA, 25 bp, E. coli
tgtgtgaatctatcggcagaccgga

SEQ ID NO: 16981 - DNA, 25 bp, E. coli
tcacctgcatagctggcaagcgctt

SEQ ID NO: 16982 - DNA, 25 bp, E. coli
cgatcgcacgctgtggctgtgtgaa

SEQ ID NO: 16983 - DNA, 25 bp, E. coli
cgatcgcacgctctggctgtgtgaa

SEQ ID NO: 16984 - DNA, 25 bp, E. coli
cggcagaccggatgaaaaggagttt

SEQ ID NO: 16985 - DNA, 25 bp, E. coli
cggcagaccggaagaaaaggagttt

SEQ ID NO: 16986 - DNA, 25 bp, E. coli
ggcgtttctcttactgcggcggtag

SEQ ID NO: 16987 - DNA, 25 bp, E. coli
ggcgtttctctttctgcggcggtag

SEQ ID NO: 16988 - DNA, 25 bp, E. coli
tcacctgcataggtggcaagcgctt

SEQ ID NO: 16989 - DNA, 25 bp, E. coli
tcaactggcctgacagccggcattt

SEQ ID NO: 16990 - DNA, 25 bp, E. coli
tcaactggcctgtcagccggcattt

SEQ ID NO: 16991 - DNA, 25 bp, E. coli
gatgctggcgcacttatccccggca

SEQ ID NO: 16992 - DNA, 25 bp, E. coli
gatgctggcgcagttatccccggca

SEQ ID NO: 16993 - DNA, 25 bp, E. coli
cacgctggatacgacgttgatggag

SEQ ID NO: 16994 - DNA, 25 bp, E. coli
cacgctggataccacgttgatggag

SEQ ID NO: 16995 - DNA, 25 bp, E. coli
tactacgaacttagcccggcagtgt

SEQ ID NO: 16996 - DNA, 25 bp, E. coli
tactacgaactttgcccggcagtgt

SEQ ID NO: 16997 - DNA, 25 bp, E. coli
ttgccagaacccttgcggaagacga

SEQ ID NO: 16998 - DNA, 25 bp, E. coli
ttgccagaacccatgcggaagacga

SEQ ID NO: 16999 - DNA, 25 bp, E. coli
tgcttgagcatttcagcgcagcaga

SEQ ID NO: 17000 - DNA, 25 bp, E. coli
tgcttgagcattacagcgcagcaga

SEQ ID NO: 17001 - DNA, 25 bp, E. coli
tgcgcgtctcgctaatcaacggctg

SEQ ID NO: 17002 - DNA, 25 bp, E. coli
tgcgcgtctcgcaaatcaacggctg

SEQ ID NO: 17003 - DNA, 25 bp, E. coli
gccatcattttgatgaacgcgagcg

SEQ ID NO: 17004 - DNA, 25 bp, E. coli
gccatcattttgttgaacgcgagcg

SEQ ID NO: 17005 - DNA, 25 bp, E. coli
gaagacgaggttaatcagcctttgc

SEQ ID NO: 17006 - DNA, 25 bp, E. coli
gaagacgaggtttatcagcctttgc

SEQ ID NO: 17007 - DNA, 25 bp, E. coli
gacttaacgtttgccatcgggctga

SEQ ID NO: 17008 - DNA, 25 bp, E. coli
gacttaacgtttcccatcgggctga

SEQ ID NO: 17009 - DNA, 25 bp, E. coli
ggcactggaaaaaagcacgctggat

SEQ ID NO: 17010 - DNA, 25 bp, E. coli
ggcactggaaaatagcacgctggat

SEQ ID NO: 17011 - DNA, 25 bp, E. coli
gatgaattgtttaaaccgtctggcc

SEQ ID NO: 17012 - DNA, 25 bp, E. coli
gagatgcacagctaagcattgcgca

SEQ ID NO: 17013 - DNA, 25 bp, E. coli
gagatgcacagcaaagcattgcgca

SEQ ID NO: 17014 - DNA, 25 bp, E. coli
gatgaattgttttaaccgtctggcc

SEQ ID NO: 17015 - DNA, 25 bp, E. coli
aagtatgtatgacgcgcgccgatca

SEQ ID NO: 17016 - DNA, 25 bp, E. coli
aagtatgtatgaggcgcgccgatca

SEQ ID NO: 17017 - DNA, 25 bp, E. coli
aatcaggtgccgtgcgcatcatcgt

SEQ ID NO: 17018 - DNA, 25 bp, E. coli
aatcaggtgccgagcgcatcatcgt

SEQ ID NO: 17019 - DNA, 25 bp, E. coli
tcctggcacaggagtggatacccct

SEQ ID NO: 17020 - DNA, 25 bp, E. coli
tcgttaatgtgcagggtgatgaacc

SEQ ID NO: 17021 - DNA, 25 bp, E. coli
tcctggcacaggtgtggatacccct

SEQ ID NO: 17022 - DNA, 25 bp, E. coli
tcgtggcaaccgatcatgaggatgt

SEQ ID NO: 17023 - DNA, 25 bp, E. coli
tcgttaatgtgctgggtgatgaacc

SEQ ID NO: 17024 - DNA, 25 bp, E. coli
tcgtggcaaccgttcatgaggatgt

SEQ ID NO: 17025 - DNA, 25 bp, E. coli
gcgtctgcccggaaaaccattggtt

SEQ ID NO: 17026 - DNA, 25 bp, E. coli
gcgtctgcccggtaaaccattggtt

SEQ ID NO: 17027 - DNA, 25 bp, E. coli
cccgaatgcggtgaaagtggttctc

SEQ ID NO: 17028 - DNA, 25 bp, E. coli
cccgaatgcggtcaaagtggttctc

SEQ ID NO: 17029 - DNA, 25 bp, E. coli
gttttgtggtcaatattcccgcgcg

SEQ ID NO: 17030 - DNA, 25 bp, E. coli
gatattaacggctaacccatgattg

SEQ ID NO: 17031 - DNA, 25 bp, E. coli
gatattaacggcaaacccatgattg

SEQ ID NO: 17032 - DNA, 25 bp, E. coli
gttttgtggtcattattcccgcgcg

SEQ ID NO: 17033 - DNA, 25 bp, E. coli
tggcggtgccaaaccacaatgcgga

SEQ ID NO: 17034 - DNA, 25 bp, E. coli
tggcggtgccaatccacaatgcgga

SEQ ID NO: 17035 - DNA, 25 bp, E. coli
gatgaaccgatgatccctgcgacaa

SEQ ID NO: 17036 - DNA, 25 bp, E. coli
gatgaaccgatgttccctgcgacaa

SEQ ID NO: 17037 - DNA, 25 bp, E. coli
caaatgcgggcacagtgtctgcgtc

SEQ ID NO: 17038 - DNA, 25 bp, E. coli
caaatgcgggcagagtgtctgcgtc

SEQ ID NO: 17039 - DNA, 25 bp, E. coli
aaaattctggtccagcgtcgtaccg

SEQ ID NO: 17040 - DNA, 25 bp, E. coli
aaaattctggtcgagcgtcgtaccg

SEQ ID NO: 17041 - DNA, 25 bp, E. coli
tagtccaggccgatgagcaactgct

SEQ ID NO: 17042 - DNA, 25 bp, E. coli
tacccggcatgttagatgcgaccgc

SEQ ID NO: 17043 - DNA, 25 bp, E. coli
tagtccaggccgttgagcaactgct

SEQ ID NO: 17044 - DNA, 25 bp, E. coli
tacccggcatgtaagatgcgaccgc

SEQ ID NO: 17045 - DNA, 25 bp, E. coli
tcagtgaagtttgctggctgacgcc

SEQ ID NO: 17046 - DNA, 25 bp, E. coli
tcagtgaagtttcctggctgacgcc

SEQ ID NO: 17047 - DNA, 25 bp, E. coli
gccaaaaatgaagccgtagagactg

SEQ ID NO: 17048 - DNA, 25 bp, E. coli
gccaaaaatgaacccgtagagactg

SEQ ID NO: 17049 - DNA, 25 bp, E. coli
cgttgtggatgatgcgcaatgccaa

SEQ ID NO: 17050 - DNA, 25 bp, E. coli
cgttgtggatgaagcgcaatgccaa

SEQ ID NO: 17051 - DNA, 25 bp, E. coli
tggaacagcgtcctttggcaagtac

SEQ ID NO: 17052 - DNA, 25 bp, E. coli
tggaacagcgtcgtttggcaagtac

SEQ ID NO: 17053 - DNA, 25 bp, E. coli
gagcacgggcagatctatttcgaag

SEQ ID NO: 17054 - DNA, 25 bp, E. coli
gagcacgggcagttctatttcgaag

SEQ ID NO: 17055 - DNA, 25 bp, E. coli
gagaacgaagtcattgcacaagcca

SEQ ID NO: 17056 - DNA, 25 bp, E. coli
gatgagttcactccagactcgctga

SEQ ID NO: 17057 - DNA, 25 bp, E. coli
gatgagttcactgcagactcgctga

SEQ ID NO: 17058 - DNA, 25 bp, E. coli
gagaacgaagtctttgcacaagcca

SEQ ID NO: 17059 - DNA, 25 bp, E. coli
aatggccctccatccgtgttgacga

SEQ ID NO: 17060 - DNA, 25 bp, E. coli
aatggccctccaaccgtgttgacga

SEQ ID NO: 17061 - DNA, 25 bp, E. coli
atggccctccaaccgtgttgacgaa

SEQ ID NO: 17062 - DNA, 25 bp, E. coli
atggccctccaagcgtgttgacgaa

SEQ ID NO: 17063 - DNA, 25 bp, E. coli
acggcggcgagcctggagcactgct

SEQ ID NO: 17064 - DNA, 25 bp, E. coli
acggcggcgagcgtggagcactgct

SEQ ID NO: 17065 - DNA, 25 bp, E. coli
gaatggccctcctaccgtgttgacg

SEQ ID NO: 17066 - DNA, 25 bp, E. coli
gaatggccctccaaccgtgttgacg

SEQ ID NO: 17067 - DNA, 25 bp, E. coli
ggaacgtagttctcaccaataaata

SEQ ID NO: 17068 - DNA, 25 bp, E. coli
ggaacgtagttcacaccaataaata

SEQ ID NO: 17069 - DNA, 25 bp, E. coli
ctccaaccgtgttgacgaactcctg

SEQ ID NO: 17070 - DNA, 25 bp, E. coli
ctccaaccgtgtagacgaactcctg

SEQ ID NO: 17071 - DNA, 25 bp, E. coli
gtgttcttcggttgcgatcacggcg

SEQ ID NO: 17072 - DNA, 25 bp, E. coli
gtgttcttcggtagcgatcacggcg

SEQ ID NO: 17073 - DNA, 25 bp, E. coli
tggagcactgctgtacgggctgatc

SEQ ID NO: 17074 - DNA, 25 bp, E. coli
ggaatggccctccaaccgtgttgac

SEQ ID NO: 17075 - DNA, 25 bp, E. coli
tggagcactgctctacgggctgatc

SEQ ID NO: 17076 - DNA, 25 bp, E. coli
tggccctccaacggtgttgacgaac

SEQ ID NO: 17077 - DNA, 25 bp, E. coli
tgctgtacgggctgatcggcacctg

SEQ ID NO: 17078 - DNA, 25 bp, E. coli
tggccctccaaccgtgttgacgaac

SEQ ID NO: 17079 - DNA, 25 bp, E. coli
tgctgtacgggcagatcggcacctg

SEQ ID NO: 17080 - DNA, 25 bp, E. coli
ggaatggccctcgaaccgtgttgac

SEQ ID NO: 17081 - DNA, 25 bp, E. coli
aatctgacaaccgttatgcctgaac

SEQ ID NO: 17082 - DNA, 25 bp, E. coli
caatacgctgttcgtgaatactggc

SEQ ID NO: 17083 - DNA, 25 bp, E. coli
caatacgctgttggtgaatactggc

SEQ ID NO: 17084 - DNA, 25 bp, E. coli
aatctgacaacccttatgcctgaac

SEQ ID NO: 17085 - DNA, 25 bp, E. coli
caccactgcataaacttggtggcga

SEQ ID NO: 17086 - DNA, 25 bp, E. coli
caccactgcatatacttggtggcga

SEQ ID NO: 17087 - DNA, 25 bp, E. coli
cacgctcgaagcaggaggcattact

SEQ ID NO: 17088 - DNA, 25 bp, E. coli
cacgctcgaagctggaggcattact

SEQ ID NO: 17089 - DNA, 25 bp, E. coli
tactggcagccgctattcttcagcg

SEQ ID NO: 17090 - DNA, 25 bp, E. coli
tactggcagccggtattcttcagcg

SEQ ID NO: 17091 - DNA, 25 bp, E. coli
actggtacctgaagcgcggattgcc

SEQ ID NO: 17092 - DNA, 25 bp, E. coli
actggtacctgatgcgcggattgcc

SEQ ID NO: 17093 - DNA, 25 bp, E. coli
gccgctattcttcagcgaaccgctg

SEQ ID NO: 17094 - DNA, 25 bp, E. coli
gccgctattcttgagcgaaccgctg

SEQ ID NO: 17095 - DNA, 25 bp, E. coli
gaatgaccacgctcgaagctggagg

SEQ ID NO: 17096 - DNA, 25 bp, E. coli
gaatgaccacgcacgaagctggagg

SEQ ID NO: 17097 - DNA, 25 bp, E. coli
cgcagaagaaaaggcaccactgcat

SEQ ID NO: 17098 - DNA, 25 bp, E. coli
cgcagaagaaaacgcaccactgcat

SEQ ID NO: 17099 - DNA, 25 bp, E. coli
gggatcgacattgctaccgccaaca

SEQ ID NO: 17100 - DNA, 25 bp, E. coli
gggatcgacattcctaccgccaaca

SEQ ID NO: 17101 - DNA, 25 bp, E. coli
tggcacagttgcaccagttgcgcgg

SEQ ID NO: 17102 - DNA, 25 bp, E. coli
tggcacagttgctccagttgcgcgg

SEQ ID NO: 17103 - DNA, 25 bp, E. coli
caatcccggcgaaaaaatgagtctg

SEQ ID NO: 17104 - DNA, 25 bp, E. coli
caatcccggcgataaaatgagtctg

SEQ ID NO: 17105 - DNA, 25 bp, E. coli
aaatgagtctggcaccgtttataga

SEQ ID NO: 17106 - DNA, 25 bp, E. coli
aaatgagtctgggaccgtttataga

SEQ ID NO: 17107 - DNA, 25 bp, E. coli
tattctggcgttactgttactcacc

SEQ ID NO: 17108 - DNA, 25 bp, E. coli
tattctggcgtttctgttactcacc

SEQ ID NO: 17109 - DNA, 25 bp, E. coli
ttgaagtgggtatagacaaatgggc

SEQ ID NO: 17110 - DNA, 25 bp, E. coli
ttctgttactcaccagttctgcagc

SEQ ID NO: 17111 - DNA, 25 bp, E. coli
ttgaagtgggtaaagacaaatgggc

SEQ ID NO: 17112 - DNA, 25 bp, E. coli
ttctgttactcagcagttctgcagc

SEQ ID NO: 17113 - DNA, 25 bp, E. coli
taccctcgtgcagtatcctttaaac

SEQ ID NO: 17114 - DNA, 25 bp, E. coli
taccctcgtgcactatcctttaaac

SEQ ID NO: 17115 - DNA, 25 bp, E. coli
gcccaacccatttcggtgattcaga

SEQ ID NO: 17116 - DNA, 25 bp, E. coli
gcccaacccattacggtgattcaga

SEQ ID NO: 17117 - DNA, 25 bp, E. coli
gccgaccgggtaatgctttgtatgt

SEQ ID NO: 17118 - DNA, 25 bp, E. coli
gccgaccgggtattgctttgtatgt

SEQ ID NO: 17119 - DNA, 25 bp, E. coli
gacaaatgggcgtttaatcgcgaag

SEQ ID NO: 17120 - DNA, 25 bp, E. coli
gacaaatgggcgattaatcgcgaag

SEQ ID NO: 17121 - DNA, 25 bp, E. coli
cgtttaatcgcgaagaggtgatgct

SEQ ID NO: 17122 - DNA, 25 bp, E. coli
cgtttaatcgcgtagaggtgatgct

SEQ ID NO: 17123 - DNA, 25 bp, E. coli
gtgatgctgactagccgaccgggta

SEQ ID NO: 17124 - DNA, 25 bp, E. coli
gtgatgctgacttgccgaccgggta

SEQ ID NO: 17125 - DNA, 25 bp, E. coli
aacgattaaactccgcttcggcgca

SEQ ID NO: 17126 - DNA, 25 bp, E. coli
taactctgccttgaagataaatgcg

SEQ ID NO: 17127 - DNA, 25 bp, E. coli
taactctgccttcaagataaatgcg

SEQ ID NO: 17128 - DNA, 25 bp, E. coli
tacaggatgttgaaagggaaaattc

SEQ ID NO: 17129 - DNA, 25 bp, E. coli
tacaggatgttgtaagggaaaattc

SEQ ID NO: 17130 - DNA, 25 bp, E. coli
agataaatgcgcatttacagcgggc

SEQ ID NO: 17131 - DNA, 25 bp, E. coli
agataaatgcgcttttacagcgggc

SEQ ID NO: 17132 - DNA, 25 bp, E. coli
actcgccgctttaccacaacgtgga

SEQ ID NO: 17133 - DNA, 25 bp, E. coli
actcgccgcttttccacaacgtgga

SEQ ID NO: 17134 - DNA, 25 bp, E. coli
aacgattaaactgcgcttcggcgca

SEQ ID NO: 17135 - DNA, 25 bp, E. coli
tcggcgcagtttacgtttacaggat

SEQ ID NO: 17136 - DNA, 25 bp, E. coli
tcggcgcagttttcgtttacaggat

SEQ ID NO: 17137 - DNA, 25 bp, E. coli
ccacaacgtggatgagagggatgaa

SEQ ID NO: 17138 - DNA, 25 bp, E. coli
ccacaacgtggaagagagggatgaa

SEQ ID NO: 17139 - DNA, 25 bp, E. coli
gaaatagcaatgaggagtatcagca

SEQ ID NO: 17140 - DNA, 25 bp, E. coli
gaaatagcaatgtggagtatcagca

SEQ ID NO: 17141 - DNA, 25 bp, E. coli
gtatcagcaagaatactcgccgctt

SEQ ID NO: 17142 - DNA, 25 bp, E. coli
gtatcagcaagattactcgccgctt

SEQ ID NO: 17143 - DNA, 25 bp, E. coli
tgggaacagccttaaggtgtaaagg

SEQ ID NO: 17144 - DNA, 25 bp, E. coli
tgggaacagcctaaaggtgtaaagg

SEQ ID NO: 17145 - DNA, 25 bp, E. coli
gagggatgaaaatctcaaggcagag

SEQ ID NO: 17146 - DNA, 25 bp, E. coli
gagggatgaaaaactcaaggcagag

SEQ ID NO: 17147 - DNA, 25 bp, E. coli
aatatgcagggcatccaggtgtggc

SEQ ID NO: 17148 - DNA, 25 bp, E. coli
aatatgcagggcttccaggtgtggc

SEQ ID NO: 17149 - DNA, 25 bp, E. coli
caccaatgcggtgagtcaggtaaca

SEQ ID NO: 17150 - DNA, 25 bp, E. coli
caccaatgcggtcagtcaggtaaca

SEQ ID NO: 17151 - DNA, 25 bp, E. coli
caggtaacacctgagctggtcaaat

SEQ ID NO: 17152 - DNA, 25 bp, E. coli
caggtaacacctcagctggtcaaat

SEQ ID NO: 17153 - DNA, 25 bp, E. coli
cacctataacctgtgggattacggc

SEQ ID NO: 17154 - DNA, 25 bp, E. coli
cacctataacctctgggattacggc

SEQ ID NO: 17155 - DNA, 25 bp, E. coli
aaagcggcttccttgatccagtgaa

SEQ ID NO: 17156 - DNA, 25 bp, E. coli
aaagcggcttccatgatccagtgaa

SEQ ID NO: 17157 - DNA, 25 bp, E. coli
tatgttggtcaagaagcgcgctttg

SEQ ID NO: 17158 - DNA, 25 bp, E. coli
tatgttggtcaacaagcgcgctttg

SEQ ID NO: 17159 - DNA, 25 bp, E. coli
tattgaagccaagtatcagggccga

SEQ ID NO: 17160 - DNA, 25 bp, E. coli
tattgaagccaactatcagggccga

SEQ ID NO: 17161 - DNA, 25 bp, E. coli
ttgttgctgttcataaccagccggg

SEQ ID NO: 17162 - DNA, 25 bp, E. coli
ttgttgctgttcttaaccagccggg

SEQ ID NO: 17163 - DNA, 25 bp, E. coli
gctatggtgcattctggccggaacc

SEQ ID NO: 17164 - DNA, 25 bp, E. coli
gctatggtgcatactggccggaacc

SEQ ID NO: 17165 - DNA, 25 bp, E. coli
gactgctcgccagacaaagcggctt

SEQ ID NO: 17166 - DNA, 25 bp, E. coli
gactgctcgccacacaaagcggctt

SEQ ID NO: 17167 - DNA, 25 bp, E. coli
cattcagggtgatcaacctggcttt

SEQ ID NO: 17168 - DNA, 25 bp, E. coli
cattcagggtgaacaacctggcttt

SEQ ID NO: 17169 - DNA, 25 bp, E. coli
caacaaggtattccagagcggcgta

SEQ ID NO: 17170 - DNA, 25 bp, E. coli
caacaaggtattgcagagcggcgta

SEQ ID NO: 17171 - DNA, 25 bp, E. coli
tagtaagtgggtaggctcagcaaac

SEQ ID NO: 17172 - DNA, 25 bp, E. coli
tatgtatgatgtagcgccgaacagc

SEQ ID NO: 17173 - DNA, 25 bp, E. coli
tagtaagtgggttggctcagcaaac

SEQ ID NO: 17174 - DNA, 25 bp, E. coli
tatgtatgatgttgcgccgaacagc

SEQ ID NO: 17175 - DNA, 25 bp, E. coli
tgtaacttcaggctcacagactccg

SEQ ID NO: 17176 - DNA, 25 bp, E. coli
tgtaacttcagggtcacagactccg

SEQ ID NO: 17177 - DNA, 25 bp, E. coli
tcgctgaccacatcggcaatgtagt

SEQ ID NO: 17178 - DNA, 25 bp, E. coli
tcgctgaccacaacggcaatgtagt

SEQ ID NO: 17179 - DNA, 25 bp, E. coli
gctcaggctaactacggctacggtg

SEQ ID NO: 17180 - DNA, 25 bp, E. coli
gctcaggctaacaacggctacggtg

SEQ ID NO: 17181 - DNA, 25 bp, E. coli
gaaacgttctataccgctctgggtg

SEQ ID NO: 17182 - DNA, 25 bp, E. coli
gactccgctggaagaaagcaatggc

SEQ ID NO: 17183 - DNA, 25 bp, E. coli
gaaacgttctattccgctctgggtg

SEQ ID NO: 17184 - DNA, 25 bp, E. coli
gactccgctggatgaaagcaatggc

SEQ ID NO: 17185 - DNA, 25 bp, E. coli
taatttaaccgaatctactggctgg

SEQ ID NO: 17186 - DNA, 25 bp, E. coli
taatttaaccgattctactggctgg

SEQ ID NO: 17187 - DNA, 25 bp, E. coli
gacggtgtccttcataccaacggtg

SEQ ID NO: 17188 - DNA, 25 bp, E. coli
gatgtcgagttcacaagccactgga

SEQ ID NO: 17189 - DNA, 25 bp, E. coli
gatgtcgagttctcaagccactgga

SEQ ID NO: 17190 - DNA, 25 bp, E. coli
gacggtgtccttgataccaacggtg

SEQ ID NO: 17191 - DNA, 25 bp, E. coli
aagatatgacgattactgtgacggg

SEQ ID NO: 17192 - DNA, 25 bp, E. coli
aagatatgacgaatactgtgacggg

SEQ ID NO: 17193 - DNA, 25 bp, E. coli
aagtcagcatccctgtgatttccgg

SEQ ID NO: 17194 - DNA, 25 bp, E. coli
aagtcagcatccgtgtgatttccgg

SEQ ID NO: 17195 - DNA, 25 bp, E. coli
caccctgaccgttactgtggaaccg

SEQ ID NO: 17196 - DNA, 25 bp, E. coli
caccctgaccgtaactgtggaaccg

SEQ ID NO: 17197 - DNA, 25 bp, E. coli
catcaaaagccagcattagcgtgaa

SEQ ID NO: 17198 - DNA, 25 bp, E. coli
catcaaaagccaccattagcgtgaa

SEQ ID NO: 17199 - DNA, 25 bp, E. coli
tgatttccggtattggtcagtttgc

SEQ ID NO: 17200 - DNA, 25 bp, E. coli
tgatttccggtaatggtcagtttgc

SEQ ID NO: 17201 - DNA, 25 bp, E. coli
tgtggaaccggataatgcaacggat

SEQ ID NO: 17202 - DNA, 25 bp, E. coli
tgtggaaccggaaaatgcaacggat

SEQ ID NO: 17203 - DNA, 25 bp, E. coli
tgcaacggataagacattcagggcg

SEQ ID NO: 17204 - DNA, 25 bp, E. coli
tgcaacggataacacattcagggcg

SEQ ID NO: 17205 - DNA, 25 bp, E. coli
tgctgcggtggctgaaattaccgtt

SEQ ID NO: 17206 - DNA, 25 bp, E. coli
tgctgcggtggcagaaattaccgtt

SEQ ID NO: 17207 - DNA, 25 bp, E. coli
gcgatttccgccgatccatcaaaag

SEQ ID NO: 17208 - DNA, 25 bp, E. coli
gcgattaaggtaacgccgacaggta

SEQ ID NO: 17209 - DNA, 25 bp, E. coli
gcgatttccgcccatccatcaaaag

SEQ ID NO: 17210 - DNA, 25 bp, E. coli
gcgattaaggtatcgccgacaggta

SEQ ID NO: 17211 - DNA, 25 bp, E. coli
ccgttaataatgagccgggtggcta

SEQ ID NO: 17212 - DNA, 25 bp, E. coli
ccgttaataatgtgccgggtggcta

SEQ ID NO: 17213 - DNA, 25 bp, E. coli
cactggtttcgttactcggcctgga

SEQ ID NO: 17214 - DNA, 25 bp, E. coli
cactggtttcgtaactcggcctgga

SEQ ID NO: 17215 - DNA, 25 bp, E. coli
caggcattggcaacaactggcaggt

SEQ ID NO: 17216 - DNA, 25 bp, E. coli
cagattgcgctatacacggtgacgg

SEQ ID NO: 17217 - DNA, 25 bp, E. coli
catcggtttaattggcgctggcggt

SEQ ID NO: 17218 - DNA, 25 bp, E. coli
caggcattggcatcaactggcaggt

SEQ ID NO: 17219 - DNA, 25 bp, E. coli
cagattgcgctaaacacggtgacgg

SEQ ID NO: 17220 - DNA, 25 bp, E. coli
catcggtttaataggcgctggcggt

SEQ ID NO: 17221 - DNA, 25 bp, E. coli
tattttacagggagcgctcgtcacg

SEQ ID NO: 17222 - DNA, 25 bp, E. coli
tattttacagggtgcgctcgtcacg

SEQ ID NO: 17223 - DNA, 25 bp, E. coli
ttactcgtgggcaagtgtttcggcg

SEQ ID NO: 17224 - DNA, 25 bp, E. coli
ttactcgtgggctagtgtttcggcg

SEQ ID NO: 17225 - DNA, 25 bp, E. coli
tgtagtgctcgcagtaatcatcggt

SEQ ID NO: 17226 - DNA, 25 bp, E. coli
tgtgctgctgttgcttgagcgccgc

SEQ ID NO: 17227 - DNA, 25 bp, E. coli
tgtagtgctcgctgtaatcatcggt

SEQ ID NO: 17228 - DNA, 25 bp, E. coli
tgtgctgctgttccttgagcgccgc

SEQ ID NO: 17229 - DNA, 25 bp, E. coli
tcgtcacgctggtgctggctatcag

SEQ ID NO: 17230 - DNA, 25 bp, E. coli
tcgtcacgctggagctggctatcag

SEQ ID NO: 17231 - DNA, 25 bp, E. coli
tcggcctggaagttgtggtcaaagc

SEQ ID NO: 17232 - DNA, 25 bp, E. coli
tcggcctggaagatgtggtcaaagc

SEQ ID NO: 17233 - DNA, 25 bp, E. coli
ccgaaaggacatatagaggcggcga

SEQ ID NO: 17234 - DNA, 25 bp, E. coli
ccgaaaggacatttagaggcggcga

SEQ ID NO: 17235 - DNA, 25 bp, E. coli
caggctggcgtcttcgattacaaaa

SEQ ID NO: 17236 - DNA, 25 bp, E. coli
caggctggcgtcatcgattacaaaa

SEQ ID NO: 17237 - DNA, 25 bp, E. coli
taaaaagagcgggtatccgatcccg

SEQ ID NO: 17238 - DNA, 25 bp, E. coli
taactacgcggtaagctccatcgga

SEQ ID NO: 17239 - DNA, 25 bp, E. coli
taactacgcggttagctccatcgga

SEQ ID NO: 17240 - DNA, 25 bp, E. coli
taaaaagagcggctatccgatcccg

SEQ ID NO: 17241 - DNA, 25 bp, E. coli
tattacatgacatcaacagccggaa

SEQ ID NO: 17242 - DNA, 25 bp, E. coli
tattacatgacaacaacagccggaa

SEQ ID NO: 17243 - DNA, 25 bp, E. coli
tttttacagggaagcgacacggtga

SEQ ID NO: 17244 - DNA, 25 bp, E. coli
tttttacagggatgcgacacggtga

SEQ ID NO: 17245 - DNA, 25 bp, E. coli
tcaccgtcggtgaactggcacagaa

SEQ ID NO: 17246 - DNA, 25 bp, E. coli
gaataatgtccttaatgcccgtgcc

SEQ ID NO: 17247 - DNA, 25 bp, E. coli
gaataatgtcctaaatgcccgtgcc

SEQ ID NO: 17248 - DNA, 25 bp, E. coli
cgacgcaggcacaaaccgggttata

SEQ ID NO: 17249 - DNA, 25 bp, E. coli
cgacgcaggcactaaccgggttata

SEQ ID NO: 17250 - DNA, 25 bp, E. coli
gattttacgctaccaaagaccgacg

SEQ ID NO: 17251 - DNA, 25 bp, E. coli
gattttacgctagcaaagaccgacg

SEQ ID NO: 17252 - DNA, 25 bp, E. coli
ggaagaaccgtacccacagtgaact

SEQ ID NO: 17253 - DNA, 25 bp, E. coli
ggaatgttcagctttgccgccgaaa

SEQ ID NO: 17254 - DNA, 25 bp, E. coli
ggaagaaccgtagccacagtgaact

SEQ ID NO: 17255 - DNA, 25 bp, E. coli
ggaatgttcagcattgccgccgaaa

SEQ ID NO: 17256 - DNA, 25 bp, E. coli
tcaccgtcggtgtactggcacagaa

SEQ ID NO: 17257 - DNA, 25 bp, E. coli
caatggcatcatagacgttaaaaag

SEQ ID NO: 17258 - DNA, 25 bp, E. coli
caatggcatcattgacgttaaaaag

SEQ ID NO: 17259 - DNA, 25 bp, E. coli
aacctgcatttttggttatccgcaa

SEQ ID NO: 17260 - DNA, 25 bp, E. coli
aacctgcattttaggttatccgcaa

SEQ ID NO: 17261 - DNA, 25 bp, E. coli
catacgcgcaattgttatagtggga

SEQ ID NO: 17262 - DNA, 25 bp, E. coli
catacgcgcaatagttatagtggga

SEQ ID NO: 17263 - DNA, 25 bp, E. coli
agattttttcactgcactgagaggg

SEQ ID NO: 17264 - DNA, 25 bp, E. coli
agattttttcacagcactgagaggg

SEQ ID NO: 17265 - DNA, 25 bp, E. coli
tacctgatgataacgctaagcaatg

SEQ ID NO: 17266 - DNA, 25 bp, E. coli
tacctgatgatatcgctaagcaatg

SEQ ID NO: 17267 - DNA, 25 bp, E. coli
tccgcaaacggattacctgatgata

SEQ ID NO: 17268 - DNA, 25 bp, E. coli
tccgcaaacggaatacctgatgata

SEQ ID NO: 17269 - DNA, 25 bp, E. coli
ccattccgggaaatgttatccagcg

SEQ ID NO: 17270 - DNA, 25 bp, E. coli
ccattccgggaattgttatccagcg

SEQ ID NO: 17271 - DNA, 25 bp, E. coli
gcactttcagacaagtcctttgtaa

SEQ ID NO: 17272 - DNA, 25 bp, E. coli
gcactttcagactagtcctttgtaa

SEQ ID NO: 17273 - DNA, 25 bp, E. coli
gggaaacggcagctaatgttcacta

SEQ ID NO: 17274 - DNA, 25 bp, E. coli
gggaaacggcaggtaatgttcacta

SEQ ID NO: 17275 - DNA, 25 bp, E. coli
ggcttaacggcgatatgttctgcta

SEQ ID NO: 17276 - DNA, 25 bp, E. coli
ggcttaacggcgttatgttctgcta

SEQ ID NO: 17277 - DNA, 25 bp, E. coli
taatctgttacaaataactgaggcg

SEQ ID NO: 17278 - DNA, 25 bp, E. coli
taatctgttacatataactgaggcg

SEQ ID NO: 17279 - DNA, 25 bp, E. coli
caatatgcggtttgttatggaggcc

SEQ ID NO: 17280 - DNA, 25 bp, E. coli
aatgagcattgacgccgatctacgc

SEQ ID NO: 17281 - DNA, 25 bp, E. coli
aatgagcattgaggccgatctacgc

SEQ ID NO: 17282 - DNA, 25 bp, E. coli
caatatgcggttagttatggaggcc

SEQ ID NO: 17283 - DNA, 25 bp, E. coli
aaattggctgttatactcgcacggc

SEQ ID NO: 17284 - DNA, 25 bp, E. coli
aaattggctgttttactcgcacggc

SEQ ID NO: 17285 - DNA, 25 bp, E. coli
tatacttcttgaggcggatgctgga

SEQ ID NO: 17286 - DNA, 25 bp, E. coli
tatacttcttgacgcggatgctgga

SEQ ID NO: 17287 - DNA, 25 bp, E. coli
ttgagtatggtatccgcattcccgg

SEQ ID NO: 17288 - DNA, 25 bp, E. coli
ttgagtatggtaaccgcattcccgg

SEQ ID NO: 17289 - DNA, 25 bp, E. coli
tgtgtcctcgcggtaagtattgggt

SEQ ID NO: 17290 - DNA, 25 bp, E. coli
tgtgtcctcgcgctaagtattgggt

SEQ ID NO: 17291 - DNA, 25 bp, E. coli
tctacgcgccgggatcattgatgca

SEQ ID NO: 17292 - DNA, 25 bp, E. coli
tctacgcgccggcatcattgatgca

SEQ ID NO: 17293 - DNA, 25 bp, E. coli
ccgtgcagcgcaattcagaggtaat

SEQ ID NO: 17294 - DNA, 25 bp, E. coli
gccttagcattaaggagcccacgag

SEQ ID NO: 17295 - DNA, 25 bp, E. coli
ccgtgcagcgcatttcagaggtaat

SEQ ID NO: 17296 - DNA, 25 bp, E. coli
gccttagcattatggagcccacgag

SEQ ID NO: 17297 - DNA, 25 bp, E. coli
gaatcagagatgctgtcaggcctac

SEQ ID NO: 17298 - DNA, 25 bp, E. coli
gaatcagagatggtgtcaggcctac

SEQ ID NO: 17299 - DNA, 25 bp, E. coli
taattcagcgtctgatccaggagcg

SEQ ID NO: 17300 - DNA, 25 bp, E. coli
taattcagcgtcagatccaggagcg

SEQ ID NO: 17301 - DNA, 25 bp, E. coli
tttcatgcccgctgtcaggtgttgt

SEQ ID NO: 17302 - DNA, 25 bp, E. coli
tttcatgcccgcagtcaggtgttgt

SEQ ID NO: 17303 - DNA, 25 bp, E. coli
tcaggtgttgttgcccgatgacaac

SEQ ID NO: 17304 - DNA, 25 bp, E. coli
tcaggtgttgttccccgatgacaac

SEQ ID NO: 17305 - DNA, 25 bp, E. coli
gcagtcaggtgttgttgcccgatga

SEQ ID NO: 17306 - DNA, 25 bp, E. coli
gcagtcaggtgtagttgcccgatga

SEQ ID NO: 17307 - DNA, 25 bp, E. coli
ccataacaccgggagcgaaaaactg

SEQ ID NO: 17308 - DNA, 25 bp, E. coli
cccgcagtcaggagttgttgcccga

SEQ ID NO: 17309 - DNA, 25 bp, E. coli
cccgcagtcaggtgttgttgcccga

SEQ ID NO: 17310 - DNA, 25 bp, E. coli
ccataacaccggcagcgaaaaactg

SEQ ID NO: 17311 - DNA, 25 bp, E. coli
tgtacacgggggcactattaccgcg

SEQ ID NO: 17312 - DNA, 25 bp, E. coli
gtcgaaagctctcgcggtgggccgc

SEQ ID NO: 17313 - DNA, 25 bp, E. coli
tgtacacggggggactattaccgcg

SEQ ID NO: 17314 - DNA, 25 bp, E. coli
gtttgctgaccgtctggcgcgcatc

SEQ ID NO: 17315 - DNA, 25 bp, E. coli
gtttgctgaccgactggcgcgcatc

SEQ ID NO: 17316 - DNA, 25 bp, E. coli
gtcgaaagctctggcggtgggccgc

SEQ ID NO: 17317 - DNA, 25 bp, E. coli
ggggcactattagcgcgttcaaccg

SEQ ID NO: 17318 - DNA, 25 bp, E. coli
gggtagggcttgcactggcaatttg

SEQ ID NO: 17319 - DNA, 25 bp, E. coli
gggtagggcttggactggcaatttg

SEQ ID NO: 17320 - DNA, 25 bp, E. coli
ggaaacgtttgctgaccgactggcg

SEQ ID NO: 17321 - DNA, 25 bp, E. coli
ggggcactattaccgcgttcaaccg

SEQ ID NO: 17322 - DNA, 25 bp, E. coli
ggaaacgtttgcagaccgactggcg

SEQ ID NO: 17323 - DNA, 25 bp, E. coli
aattctgaccggaattggcgcttcg

SEQ ID NO: 17324 - DNA, 25 bp, E. coli
aattctgaccggtattggcgcttcg

SEQ ID NO: 17325 - DNA, 25 bp, E. coli
cttcgggtctggtggcgcaaaactt

SEQ ID NO: 17326 - DNA, 25 bp, E. coli
cttcgggtctggaggcgcaaaactt

SEQ ID NO: 17327 - DNA, 25 bp, E. coli
tataccattgcccaagaacaagcga

SEQ ID NO: 17328 - DNA, 25 bp, E. coli
tataccattgccgaagaacaagcga

SEQ ID NO: 17329 - DNA, 25 bp, E. coli
ttcgtatccgtcagcgttaccaggg

SEQ ID NO: 17330 - DNA, 25 bp, E. coli
ttcgtatccgtctgcgttaccaggg

SEQ ID NO: 17331 - DNA, 25 bp, E. coli
tgaagttcgcgcaaaaactcggcta

SEQ ID NO: 17332 - DNA, 25 bp, E. coli
tgaagttcgcgctaaaactcggcta

SEQ ID NO: 17333 - DNA, 25 bp, E. coli
tgctgctacaacgtgatacggcgcg

SEQ ID NO: 17334 - DNA, 25 bp, E. coli
tgctgctacaacctgatacggcgcg

SEQ ID NO: 17335 - DNA, 25 bp, E. coli
gaagattggcttcaatgctgccgca

SEQ ID NO: 17336 - DNA, 25 bp, E. coli
gaagattggcttgaatgctgccgca

SEQ ID NO: 17337 - DNA, 25 bp, E. coli
gaagcgctggtgtaaaaactggtct

SEQ ID NO: 17338 - DNA, 25 bp, E. coli
gaagcgctggtgaaaaaactggtct

SEQ ID NO: 17339 - DNA, 25 bp, E. coli
gtgtacgacgcgtgttaaacctggc

SEQ ID NO: 17340 - DNA, 25 bp, E. coli
gtgtacgacgcgagttaaacctggc

SEQ ID NO: 17341 - DNA, 25 bp, E. coli
taagctctcagctactggccaacga

SEQ ID NO: 17342 - DNA, 25 bp, E. coli
taagctctcagcaactggccaacga

SEQ ID NO: 17343 - DNA, 25 bp, E. coli
gagtcagtcagtgcagcgtcgtgaa

SEQ ID NO: 17344 - DNA, 25 bp, E. coli
gagtcagtcagtccagcgtcgtgaa

SEQ ID NO: 17345 - DNA, 25 bp, E. coli
caaagtctggcagaccttgatgtgg

SEQ ID NO: 17346 - DNA, 25 bp, E. coli
cacgcagctgctcgaaacggtcggt

SEQ ID NO: 17347 - DNA, 25 bp, E. coli
caaagtctggcacaccttgatgtgg

SEQ ID NO: 17348 - DNA, 25 bp, E. coli
cacgcagctgctggaaacggtcggt

SEQ ID NO: 17349 - DNA, 25 bp, E. coli
aaaggtctgatctccgcgttcgcta

SEQ ID NO: 17350 - DNA, 25 bp, E. coli
aaaggtctgatcaccgcgttcgcta

SEQ ID NO: 17351 - DNA, 25 bp, E. coli
taccgtctttccctcactggtcagt

SEQ ID NO: 17352 - DNA, 25 bp, E. coli
taccgtctttccgtcactggtcagt

SEQ ID NO: 17353 - DNA, 25 bp, E. coli
tgaaagacgcaccaaaacaggaagt

SEQ ID NO: 17354 - DNA, 25 bp, E. coli
tgaaagacgcacgaaaacaggaagt

SEQ ID NO: 17355 - DNA, 25 bp, E. coli
gacagcgcattctgacaacctgatg

SEQ ID NO: 17356 - DNA, 25 bp, E. coli
gacagcgcattcagacaacctgatg

SEQ ID NO: 17357 - DNA, 25 bp, E. coli
cgcgctttccgccaagctggatgcg

SEQ ID NO: 17358 - DNA, 25 bp, E. coli
cgcgctttccgcgaagctggatgcg

SEQ ID NO: 17359 - DNA, 25 bp, E. coli
ggttcccggagcgtaaaggtctgat

SEQ ID NO: 17360 - DNA, 25 bp, E. coli
ggttcccggagcctaaaggtctgat

SEQ ID NO: 17361 - DNA, 25 bp, E. coli
taactttggcggcactattaccgtc

SEQ ID NO: 17362 - DNA, 25 bp, E. coli
taactttggcgggactattaccgtc

SEQ ID NO: 17363 - DNA, 25 bp, E. coli
gagaaagattacacgctggcagagt

SEQ ID NO: 17364 - DNA, 25 bp, E. coli
gatgcgccggtatgccaggtcgctt

SEQ ID NO: 17365 - DNA, 25 bp, E. coli
gagaaagattactcgctggcagagt

SEQ ID NO: 17366 - DNA, 25 bp, E. coli
gatgcgccggtaagccaggtcgctt

SEQ ID NO: 17367 - DNA, 25 bp, E. coli
catttgcagattatggaactcgagg

SEQ ID NO: 17368 - DNA, 25 bp, E. coli
catttgcagattttggaactcgagg

SEQ ID NO: 17369 - DNA, 25 bp, E. coli
tacattcagcagtccgggctttctc

SEQ ID NO: 17370 - DNA, 25 bp, E. coli
tacattcagcagaccgggctttctc

SEQ ID NO: 17371 - DNA, 25 bp, E. coli
agctcccgcgcgaactggatgatcc

SEQ ID NO: 17372 - DNA, 25 bp, E. coli
agctcccgcgcgtactggatgatcc

SEQ ID NO: 17373 - DNA, 25 bp, E. coli
tattgctggccggaattctgctggc

SEQ ID NO: 17374 - DNA, 25 bp, E. coli
tattgctggccgcaattctgctggc

SEQ ID NO: 17375 - DNA, 25 bp, E. coli
tcccaaagttgatgtagcgattatc

SEQ ID NO: 17376 - DNA, 25 bp, E. coli
tcccaaagttgaagtagcgattatc

SEQ ID NO: 17377 - DNA, 25 bp, E. coli
gctttctccggtgcacgacagcgta

SEQ ID NO: 17378 - DNA, 25 bp, E. coli
gctttctccggtccacgacagcgta

SEQ ID NO: 17379 - DNA, 25 bp, E. coli
gcaccacttacattcagcagaccgg

SEQ ID NO: 17380 - DNA, 25 bp, E. coli
gcaccacttacaatcagcagaccgg

SEQ ID NO: 17381 - DNA, 25 bp, E. coli
cgataatcctcgacatttgcagatt

SEQ ID NO: 17382 - DNA, 25 bp, E. coli
cgataatcctcgtcatttgcagatt

SEQ ID NO: 17383 - DNA, 25 bp, E. coli
tggatgatcccaaagttgatgtagc

SEQ ID NO: 17384 - DNA, 25 bp, E. coli
tggatgatcccatagttgatgtagc

SEQ ID NO: 17385 - DNA, 25 bp, E. coli
gaccagagtagctgcgatgcaaaac

SEQ ID NO: 17386 - DNA, 25 bp, E. coli
gatgcaaaacactttaaagttggcg

SEQ ID NO: 17387 - DNA, 25 bp, E. coli
gaccagagtagcagcgatgcaaaac

SEQ ID NO: 17388 - DNA, 25 bp, E. coli
gatgcaaaacacattaaagttggcg

SEQ ID NO: 17389 - DNA, 25 bp, E. coli
caatttggaactcacagcatgccgg

SEQ ID NO: 17390 - DNA, 25 bp, E. coli
caatttggaactgacagcatgccgg

SEQ ID NO: 17391 - DNA, 25 bp, E. coli
cacgggcaccgtttgttatgggcaa

SEQ ID NO: 17392 - DNA, 25 bp, E. coli
cacgggcaccgtatgttatgggcaa

SEQ ID NO: 17393 - DNA, 25 bp, E. coli
catgagctgcatgggcgtaacggtc

SEQ ID NO: 17394 - DNA, 25 bp, E. coli
catccgttgggaatgagtggtgccc

SEQ ID NO: 17395 - DNA, 25 bp, E. coli
catgagctgcatcggcgtaacggtc

SEQ ID NO: 17396 - DNA, 25 bp, E. coli
catccgttgggattgagtggtgccc

SEQ ID NO: 17397 - DNA, 25 bp, E. coli
aacatgatgagcttctgcgcccgga

SEQ ID NO: 17398 - DNA, 25 bp, E. coli
aacatgatgagcatctgcgcccgga

SEQ ID NO: 17399 - DNA, 25 bp, E. coli
tattggctggcgttttgtgaacccg

SEQ ID NO: 17400 - DNA, 25 bp, E. coli
tattggctggcgatttgtgaacccg

SEQ ID NO: 17401 - DNA, 25 bp, E. coli
ccctttgcgggaactgctggtgcga

SEQ ID NO: 17402 - DNA, 25 bp, E. coli
ccctttgcgggatctgctggtgcga

SEQ ID NO: 17403 - DNA, 25 bp, E. coli
gatcctcggctgagctaatcaggcg

SEQ ID NO: 17404 - DNA, 25 bp, E. coli
ggcaaaagcgcattcctcaggcatt

SEQ ID NO: 17405 - DNA, 25 bp, E. coli
ggcaaaagcgcaatcctcaggcatt

SEQ ID NO: 17406 - DNA, 25 bp, E. coli
taatcaggcgggtgaagataaccgt

SEQ ID NO: 17407 - DNA, 25 bp, E. coli
taatcaggcgggagaagataaccgt

SEQ ID NO: 17408 - DNA, 25 bp, E. coli
taaccgtaacgttgcccggatggcg

SEQ ID NO: 17409 - DNA, 25 bp, E. coli
taaccgtaacgtagcccggatggcg

SEQ ID NO: 17410 - DNA, 25 bp, E. coli
gatcctcggctgtgctaatcaggcg

SEQ ID NO: 17411 - DNA, 25 bp, E. coli
caagcgtgatgagccaaaacttggc

SEQ ID NO: 17412 - DNA, 25 bp, E. coli
caagcgtgatgacccaaaacttggc

SEQ ID NO: 17413 - DNA, 25 bp, E. coli
catcgctttgatatctatgcaggta

SEQ ID NO: 17414 - DNA, 25 bp, E. coli
catcgctttgatttctatgcaggta

SEQ ID NO: 17415 - DNA, 25 bp, E. coli
ctgcacgcttgctggcgaccaaacg

SEQ ID NO: 17416 - DNA, 25 bp, E. coli
ctgcacgcttgcaggcgaccaaacg

SEQ ID NO: 17417 - DNA, 25 bp, E. coli
acatctggaattccgcaagcgtgat

SEQ ID NO: 17418 - DNA, 25 bp, E. coli
acatctggaattgcgcaagcgtgat

SEQ ID NO: 17419 - DNA, 25 bp, E. coli
ttactggagcctgcacgcttgctgg

SEQ ID NO: 17420 - DNA, 25 bp, E. coli
ttactggagcctccacgcttgctgg

SEQ ID NO: 17421 - DNA, 25 bp, E. coli
ccggaacatctggaattgcgcaagc

SEQ ID NO: 17422 - DNA, 25 bp, E. coli
gccgatggattagtggagcctgcac

SEQ ID NO: 17423 - DNA, 25 bp, E. coli
ccggaacatctgcaattgcgcaagc

SEQ ID NO: 17424 - DNA, 25 bp, E. coli
gccgatggattactggagcctgcac

SEQ ID NO: 17425 - DNA, 25 bp, E. coli
ctttgatatctaagcaggtacgcca

SEQ ID NO: 17426 - DNA, 25 bp, E. coli
ctttgatatctatgcaggtacgcca

SEQ ID NO: 17427 - DNA, 25 bp, E. coli
tggtaaagcgcccggactacgcgcc

SEQ ID NO: 17428 - DNA, 25 bp, E. coli
tggtaaagcgccgggactacgcgcc

SEQ ID NO: 17429 - DNA, 25 bp, E. coli
gatggattactgcagcctgcacgct

SEQ ID NO: 17430 - DNA, 25 bp, E. coli
gagccaaaacttggcggcatctttg

SEQ ID NO: 17431 - DNA, 25 bp, E. coli
gagccaaaacttcgcggcatctttg

SEQ ID NO: 17432 - DNA, 25 bp, E. coli
gatggattactggagcctgcacgct

SEQ ID NO: 17433 - DNA, 25 bp, E. coli
aatgcgaaggtcctaggttcgactc

SEQ ID NO: 17434 - DNA, 25 bp, E. coli
caatcaacgggtttattgctataac

SEQ ID NO: 17435 - DNA, 25 bp, E. coli
aatgcgaaggtcgtaggttcgactc

SEQ ID NO: 17436 - DNA, 25 bp, E. coli
caatcaacgggtatattgctataac

SEQ ID NO: 17437 - DNA, 25 bp, E. coli
caaaatactgttgtgacatcaggca

SEQ ID NO: 17438 - DNA, 25 bp, E. coli
caaaatactgttctgacatcaggca

SEQ ID NO: 17439 - DNA, 25 bp, E. coli
taacatcgcattcgtaatgcgaagg

SEQ ID NO: 17440 - DNA, 25 bp, E. coli
taaatacaccacctttcctcctgtg

SEQ ID NO: 17441 - DNA, 25 bp, E. coli
taacatcgcattggtaatgcgaagg

SEQ ID NO: 17442 - DNA, 25 bp, E. coli
taaatacaccacgtttcctcctgtg

SEQ ID NO: 17443 - DNA, 25 bp, E. coli
tatcggcaccattaaaatcaaagag

SEQ ID NO: 17444 - DNA, 25 bp, E. coli
tatcggcaccataaaaatcaaagag

SEQ ID NO: 17445 - DNA, 25 bp, E. coli
tgattgctcaagtagttaaaaatgc

SEQ ID NO: 17446 - DNA, 25 bp, E. coli
tgattgctcaagaagttaaaaatgc

SEQ ID NO: 17447 - DNA, 25 bp, E. coli
gacatcaggcagtgcaggtgcagac

SEQ ID NO: 17448 - DNA, 25 bp, E. coli
gacatcaggcagagcaggtgcagac

SEQ ID NO: 17449 - DNA, 25 bp, E. coli
ccttggcaattcttcaaaatactgt

SEQ ID NO: 17450 - DNA, 25 bp, E. coli
ccttggcaattcatcaaaatactgt

SEQ ID NO: 17451 - DNA, 25 bp, E. coli
gtgccgtatttgtgccattgtaacc

SEQ ID NO: 17452 - DNA, 25 bp, E. coli
gtgccgtatttgagccattgtaacc

SEQ ID NO: 17453 - DNA, 25 bp, E. coli
ggttcgactccttttatcggcacca

SEQ ID NO: 17454 - DNA, 25 bp, E. coli
ggttcgactcctattatcggcacca

SEQ ID NO: 17455 - DNA, 25 bp, E. coli
caccatgaacatcatgtacgaccgc

SEQ ID NO: 17456 - DNA, 25 bp, E. coli
caccatgaacatgatgtacgaccgc

SEQ ID NO: 17457 - DNA, 25 bp, E. coli
catgatgtacgaccgctatcagaag

SEQ ID NO: 17458 - DNA, 25 bp, E. coli
catgatgtacgagcgctatcagaag

SEQ ID NO: 17459 - DNA, 25 bp, E. coli
agggtgatgaacagacgcccaacca

SEQ ID NO: 17460 - DNA, 25 bp, E. coli
agggtgatgaactgacgcccaacca

SEQ ID NO: 17461 - DNA, 25 bp, E. coli
aactgacgcccatccagcagggcat

SEQ ID NO: 17462 - DNA, 25 bp, E. coli
aactgacgcccaaccagcagggcat

SEQ ID NO: 17463 - DNA, 25 bp, E. coli
tgaaggtggcaaaggactgacaacg

SEQ ID NO: 17464 - DNA, 25 bp, E. coli
tgaacatgatgttcgaccgctatca

SEQ ID NO: 17465 - DNA, 25 bp, E. coli
tgaacatgatgtacgaccgctatca

SEQ ID NO: 17466 - DNA, 25 bp, E. coli
tgaaggtggcaatggactgacaacg

SEQ ID NO: 17467 - DNA, 25 bp, E. coli
tcccgcagggtgatgaactgacgcc

SEQ ID NO: 17468 - DNA, 25 bp, E. coli
tcccgcagggtgttgaactgacgcc

SEQ ID NO: 17469 - DNA, 25 bp, E. coli
gactgacaacggacgatatgatccc

SEQ ID NO: 17470 - DNA, 25 bp, E. coli
gactgacaacggtcgatatgatccc

SEQ ID NO: 17471 - DNA, 25 bp, E. coli
gccccttcccgcagggtgatgaact

SEQ ID NO: 17472 - DNA, 25 bp, E. coli
gccccttcccgctgggtgatgaact

SEQ ID NO: 17473 - DNA, 25 bp, E. coli
cgtgaaggtggcaaaggactgacaa

SEQ ID NO: 17474 - DNA, 25 bp, E. coli
cgtgaaggtggctaaggactgacaa

SEQ ID NO: 17475 - DNA, 25 bp, E. coli
ggcaaaggactgacaacggtcgata

SEQ ID NO: 17476 - DNA, 25 bp, E. coli
ggcaaaggactgtcaacggtcgata

SEQ ID NO: 17477 - DNA, 25 bp, E. coli
caactttgctgcgtgaaaaagggca

SEQ ID NO: 17478 - DNA, 25 bp, E. coli
caactttgctgcctgaaaaagggca

SEQ ID NO: 17479 - DNA, 25 bp, E. coli
catcttagggatcctgttcagcaac

SEQ ID NO: 17480 - DNA, 25 bp, E. coli
catcttagggatgctgttcagcaac

SEQ ID NO: 17481 - DNA, 25 bp, E. coli
taaaccaacgcttttcaggagagga

SEQ ID NO: 17482 - DNA, 25 bp, E. coli
taaaccaacgctattcaggagagga

SEQ ID NO: 17483 - DNA, 25 bp, E. coli
tatttagaataattaagccgagcgc

SEQ ID NO: 17484 - DNA, 25 bp, E. coli
tattctgatgcgaccaaaggagcta

SEQ ID NO: 17485 - DNA, 25 bp, E. coli
tattctgatgcgtccaaaggagcta

SEQ ID NO: 17486 - DNA, 25 bp, E. coli
tatttagaataaataagccgagcgc

SEQ ID NO: 17487 - DNA, 25 bp, E. coli
tgatgagttacgcaaggctagcaat

SEQ ID NO: 17488 - DNA, 25 bp, E. coli
tgtatcagagcacgacgaacagcgc

SEQ ID NO: 17489 - DNA, 25 bp, E. coli
tgtatcagagcaggacgaacagcgc

SEQ ID NO: 17490 - DNA, 25 bp, E. coli
tgatgagttacggaaggctagcaat

SEQ ID NO: 17491 - DNA, 25 bp, E. coli
gccgagcgcatggagaaatcttcct

SEQ ID NO: 17492 - DNA, 25 bp, E. coli
gccgagcgcatgcagaaatcttcct

SEQ ID NO: 17493 - DNA, 25 bp, E. coli
gctttaatgaaaggccaaccaagga

SEQ ID NO: 17494 - DNA, 25 bp, E. coli
gctttaatgaaacgccaaccaagga

SEQ ID NO: 17495 - DNA, 25 bp, E. coli
cgaacagcgcggttttgaagcacta

SEQ ID NO: 17496 - DNA, 25 bp, E. coli
cgaacagcgcggatttgaagcacta

SEQ ID NO: 17497 - DNA, 25 bp, E. coli
gaggaagaaaaacccgcaatgcggt

SEQ ID NO: 17498 - DNA, 25 bp, E. coli
gaggaagaaaaagccgcaatgcggt

SEQ ID NO: 17499 - DNA, 25 bp, E. coli
caaactgcgtagagtactggcaacc

SEQ ID NO: 17500 - DNA, 25 bp, E. coli
caaactgcgtagtgtactggcaacc

SEQ ID NO: 17501 - DNA, 25 bp, E. coli
cattaccacttaaggcgaaccggaa

SEQ ID NO: 17502 - DNA, 25 bp, E. coli
cattaccacttatggcgaaccggaa

SEQ ID NO: 17503 - DNA, 25 bp, E. coli
aaagctatcagcttgggctggcgca

SEQ ID NO: 17504 - DNA, 25 bp, E. coli
aaagctatcagcatgggctggcgca

SEQ ID NO: 17505 - DNA, 25 bp, E. coli
tatgttgtgcaagaggacgcgttac

SEQ ID NO: 17506 - DNA, 25 bp, E. coli
tatgttgtgcaacaggacgcgttac

SEQ ID NO: 17507 - DNA, 25 bp, E. coli
tatctgccgcatggatgaatgccgg

SEQ ID NO: 17508 - DNA, 25 bp, E. coli
tatctgccgcatcgatgaatgccgg

SEQ ID NO: 17509 - DNA, 25 bp, E. coli
tcagctaccgaatacagtgggcgcg

SEQ ID NO: 17510 - DNA, 25 bp, E. coli
tcagctaccgaaaacagtgggcgcg

SEQ ID NO: 17511 - DNA, 25 bp, E. coli
gccgagttgtcaccgatagccagca

SEQ ID NO: 17512 - DNA, 25 bp, E. coli
gccgagttgtcagcgatagccagca

SEQ ID NO: 17513 - DNA, 25 bp, E. coli
gaatttacgctctcaggtgacgatg

SEQ ID NO: 17514 - DNA, 25 bp, E. coli
gaatttacgctcacaggtgacgatg

SEQ ID NO: 17515 - DNA, 25 bp, E. coli
gttcttaacgttgttcccggagcag

SEQ ID NO: 17516 - DNA, 25 bp, E. coli
gttcttaacgttcttcccggagcag

SEQ ID NO: 17517 - DNA, 25 bp, E. coli
gatttaccgcttacgctaaccgtag

SEQ ID NO: 17518 - DNA, 25 bp, E. coli
gatttaccgctttcgctaaccgtag

SEQ ID NO: 17519 - DNA, 25 bp, E. coli
tggttgcaggaatacggcatcaccc

SEQ ID NO: 17520 - DNA, 25 bp, E. coli
tggttgcaggaaaacggcatcaccc

SEQ ID NO: 17521 - DNA, 25 bp, E. coli
caaatgattattagcgccctgcacc

SEQ ID NO: 17522 - DNA, 25 bp, E. coli
caaatgattatttgcgccctgcacc

SEQ ID NO: 17523 - DNA, 25 bp, E. coli
catcaactggatgggtaacctgcgt

SEQ ID NO: 17524 - DNA, 25 bp, E. coli
catcaactggatcggtaacctgcgt

SEQ ID NO: 17525 - DNA, 25 bp, E. coli
taaaatcgtgatcacctacaccctg

SEQ ID NO: 17526 - DNA, 25 bp, E. coli
taaaatcgtgatgacctacaccctg

SEQ ID NO: 17527 - DNA, 25 bp, E. coli
atataaagacgacccgcgaatgccg

SEQ ID NO: 17528 - DNA, 25 bp, E. coli
atataaagacgagccgcgaatgccg

SEQ ID NO: 17529 - DNA, 25 bp, E. coli
tgattcgcgcgagagaacgctttaa

SEQ ID NO: 17530 - DNA, 25 bp, E. coli
tgattcgcgcgacagaacgctttaa

SEQ ID NO: 17531 - DNA, 25 bp, E. coli
tcgccgcaagatgaggagaagttct

SEQ ID NO: 17532 - DNA, 25 bp, E. coli
tcgccgcaagatcaggagaagttct

SEQ ID NO: 17533 - DNA, 25 bp, E. coli
tcttctggatcttctggcggttgcc

SEQ ID NO: 17534 - DNA, 25 bp, E. coli
tcttctggatctactggcggttgcc

SEQ ID NO: 17535 - DNA, 25 bp, E. coli
gccaaccggttaatgcgcacctgat

SEQ ID NO: 17536 - DNA, 25 bp, E. coli
gccaaccggttattgcgcacctgat

SEQ ID NO: 17537 - DNA, 25 bp, E. coli
gcggaacatttcaggctgctattgg

SEQ ID NO: 17538 - DNA, 25 bp, E. coli
gcggaacatttctggctgctattgg

SEQ ID NO: 17539 - DNA, 25 bp, E. coli
cgtggattgccaccgccgaatataa

SEQ ID NO: 17540 - DNA, 25 bp, E. coli
cgtggattgccagcgccgaatataa

SEQ ID NO: 17541 - DNA, 25 bp, E. coli
gatctggagcaccagccgattaagc

SEQ ID NO: 17542 - DNA, 25 bp, E. coli
gatctggagcacgagccgattaagc

SEQ ID NO: 17543 - DNA, 25 bp, E. coli
aatcgggcttttccgcctgaatatt

SEQ ID NO: 17544 - DNA, 25 bp, E. coli
aatcgggcttttgcgcctgaatatt

SEQ ID NO: 17545 - DNA, 25 bp, E. coli
cagaagaacagaaaatcgggctttt

SEQ ID NO: 17546 - DNA, 25 bp, E. coli
cagaagaacagataatcgggctttt

SEQ ID NO: 17547 - DNA, 25 bp, E. coli
agaaaatcgggcatttgcgcctgaa

SEQ ID NO: 17548 - DNA, 25 bp, E. coli
agaaaatcgggcttttgcgcctgaa

SEQ ID NO: 17549 - DNA, 25 bp, E. coli
aagaacagaaaaacgggcttttgcg

SEQ ID NO: 17550 - DNA, 25 bp, E. coli
aacagaagaacacaaaatcgggctt

SEQ ID NO: 17551 - DNA, 25 bp, E. coli
aaaatcgggcttttgcgcctgaata

SEQ ID NO: 17552 - DNA, 25 bp, E. coli
aacagaagaacagaaaatcgggctt

SEQ ID NO: 17553 - DNA, 25 bp, E. coli
aaaatcgggcttatgcgcctgaata

SEQ ID NO: 17554 - DNA, 25 bp, E. coli
aagaacagaaaatcgggcttttgcg

SEQ ID NO: 17555 - DNA, 25 bp, E. coli
ttgagagatatcatcttctgtcttg

SEQ ID NO: 17556 - DNA, 25 bp, E. coli
ttgagagatatcttcttctgtcttg

SEQ ID NO: 17557 - DNA, 25 bp, E. coli
tgcgcctgaatattgcggagaaaaa

SEQ ID NO: 17558 - DNA, 25 bp, E. coli
tgcgcctgaataatgcggagaaaaa

SEQ ID NO: 17559 - DNA, 25 bp, E. coli
cgcctgaatattgcggagaaaaagc

SEQ ID NO: 17560 - DNA, 25 bp, E. coli
cgcctgaatattccggagaaaaagc

SEQ ID NO: 17561 - DNA, 25 bp, E. coli
cttttgcgcctgtatattgcggaga

SEQ ID NO: 17562 - DNA, 25 bp, E. coli
cttttgcgcctgaatattgcggaga

SEQ ID NO: 17563 - DNA, 25 bp, E. coli
ggcttttgcgccagaatattgcgga

SEQ ID NO: 17564 - DNA, 25 bp, E. coli
ggcttttgcgcctgaatattgcgga

SEQ ID NO: 17565 - DNA, 25 bp, E. coli
caacttctggcgctggaacgtcaac

SEQ ID NO: 17566 - DNA, 25 bp, E. coli
caacttctggcggtggaacgtcaac

SEQ ID NO: 17567 - DNA, 25 bp, E. coli
acttctggcggtggaacgtcaacca

SEQ ID NO: 17568 - DNA, 25 bp, E. coli
acttctggcggtcgaacgtcaacca

SEQ ID NO: 17569 - DNA, 25 bp, E. coli
tatggctcctgatgaacaacttctg

SEQ ID NO: 17570 - DNA, 25 bp, E. coli
tatggctcctgaagaacaacttctg

SEQ ID NO: 17571 - DNA, 25 bp, E. coli
ttctggcggtggaacgtcaaccaac

SEQ ID NO: 17572 - DNA, 25 bp, E. coli
ttatggctcctgttgaacaacttct

SEQ ID NO: 17573 - DNA, 25 bp, E. coli
ttctggcggtggtacgtcaaccaac

SEQ ID NO: 17574 - DNA, 25 bp, E. coli
ttatggctcctgatgaacaacttct

SEQ ID NO: 17575 - DNA, 25 bp, E. coli
tcctgatgaacaacttctggcggtg

SEQ ID NO: 17576 - DNA, 25 bp, E. coli
tcctgatgaacatcttctggcggtg

SEQ ID NO: 17577 - DNA, 25 bp, E. coli
gctcctgatgaagaacttctggcgg

SEQ ID NO: 17578 - DNA, 25 bp, E. coli
gctcctgatgaacaacttctggcgg

SEQ ID NO: 17579 - DNA, 25 bp, E. coli
cttctggcggtggaacgtcaaccaa

SEQ ID NO: 17580 - DNA, 25 bp, E. coli
ctcctgatgaactacttctggcggt

SEQ ID NO: 17581 - DNA, 25 bp, E. coli
ctcctgatgaacaacttctggcggt

SEQ ID NO: 17582 - DNA, 25 bp, E. coli
cttctggcggtgcaacgtcaaccaa

SEQ ID NO: 17583 - DNA, 25 bp, E. coli
ggctcctgatgaacaacttctggcg

SEQ ID NO: 17584 - DNA, 25 bp, E. coli
ggctcctgatgatcaacttctggcg

SEQ ID NO: 17585 - DNA, 25 bp, E. coli
tggctcctgatgaacaacttctggc

SEQ ID NO: 17586 - DNA, 25 bp, E. coli
tggctcctgatgtacaacttctggc

SEQ ID NO: 17587 - DNA, 25 bp, E. coli
attcctctgtatcggtagttatctg

SEQ ID NO: 17588 - DNA, 25 bp, E. coli
attgatggtattcctctgtatcggt

SEQ ID NO: 17589 - DNA, 25 bp, E. coli
attcctctgtatgggtagttatctg

SEQ ID NO: 17590 - DNA, 25 bp, E. coli
attgatggtattgctctgtatcggt

SEQ ID NO: 17591 - DNA, 25 bp, E. coli
tattcctctgtaacggtagttatct

SEQ ID NO: 17592 - DNA, 25 bp, E. coli
tattcctctgtatcggtagttatct

SEQ ID NO: 17593 - DNA, 25 bp, E. coli
ttgatggtattcctctgtatcggta

SEQ ID NO: 17594 - DNA, 25 bp, E. coli
ttgatggtattcgtctgtatcggta

SEQ ID NO: 17595 - DNA, 25 bp, E. coli
tgatggtattccactgtatcggtag

SEQ ID NO: 17596 - DNA, 25 bp, E. coli
tgatggtattcctctgtatcggtag

SEQ ID NO: 17597 - DNA, 25 bp, E. coli
tcctctgtatcgctagttatctgtt

SEQ ID NO: 17598 - DNA, 25 bp, E. coli
tcctctgtatcggtagttatctgtt

SEQ ID NO: 17599 - DNA, 25 bp, E. coli
cctctgtatcggaagttatctgtta

SEQ ID NO: 17600 - DNA, 25 bp, E. coli
cctctgtatcggtagttatctgtta

SEQ ID NO: 17601 - DNA, 25 bp, E. coli
gtattcctctgtatcggtagttatc

SEQ ID NO: 17602 - DNA, 25 bp, E. coli
ggtattcctctgaatcggtagttat

SEQ ID NO: 17603 - DNA, 25 bp, E. coli
tggtattcctctgtatcggtagtta

SEQ ID NO: 17604 - DNA, 25 bp, E. coli
gtattcctctgtttcggtagttatc

SEQ ID NO: 17605 - DNA, 25 bp, E. coli
tggtattcctctctatcggtagtta

SEQ ID NO: 17606 - DNA, 25 bp, E. coli
ggtattcctctgtatcggtagttat

SEQ ID NO: 17607 - DNA, 25 bp, E. coli
gatggtattcctgtgtatcggtagt

SEQ ID NO: 17608 - DNA, 25 bp, E. coli
gatggtattcctctgtatcggtagt

SEQ ID NO: 17609 - DNA, 25 bp, E. coli
catatgccacctatctggtcgatgg

SEQ ID NO: 17610 - DNA, 25 bp, E. coli
catatgccacctttctggtcgatgg

SEQ ID NO: 17611 - DNA, 25 bp, E. coli
taaacatcttcaggaactgctggag

SEQ ID NO: 17612 - DNA, 25 bp, E. coli
taaacatcttcacgaactgctggag

SEQ ID NO: 17613 - DNA, 25 bp, E. coli
aaagatgaagatactgcatagcgcg

SEQ ID NO: 17614 - DNA, 25 bp, E. coli
actgctggagtaaaccttgtttcgc

SEQ ID NO: 17615 - DNA, 25 bp, E. coli
aaagatgaagattctgcatagcgcg

SEQ ID NO: 17616 - DNA, 25 bp, E. coli
actgctggagtataccttgtttcgc

SEQ ID NO: 17617 - DNA, 25 bp, E. coli
tattgaaccccgttcacaccatatg

SEQ ID NO: 17618 - DNA, 25 bp, E. coli
tataaaaatgtaccaataaaggcgt

SEQ ID NO: 17619 - DNA, 25 bp, E. coli
tataaaaatgtagcaataaaggcgt

SEQ ID NO: 17620 - DNA, 25 bp, E. coli
tattgaaccccgatcacaccatatg

SEQ ID NO: 17621 - DNA, 25 bp, E. coli
tggtcgatggcaatacgcggtgtat

SEQ ID NO: 17622 - DNA, 25 bp, E. coli
tgaacaccagacactataaaagatg

SEQ ID NO: 17623 - DNA, 25 bp, E. coli
tgaacaccagactctataaaagatg

SEQ ID NO: 17624 - DNA, 25 bp, E. coli
gcatagcgcgatttacgcaacagga

SEQ ID NO: 17625 - DNA, 25 bp, E. coli
gcaacaggaatagactgaacaccag

SEQ ID NO: 17626 - DNA, 25 bp, E. coli
gcatagcgcgatatacgcaacagga

SEQ ID NO: 17627 - DNA, 25 bp, E. coli
gcaacaggaatacactgaacaccag

SEQ ID NO: 17628 - DNA, 25 bp, E. coli
ggcgtttgtaccagaaaagatgaag

SEQ ID NO: 17629 - DNA, 25 bp, E. coli
ggcgtttgtacctgaaaagatgaag

SEQ ID NO: 17630 - DNA, 25 bp, E. coli
tggtcgatggcattacgcggtgtat

SEQ ID NO: 17631 - DNA, 25 bp, E. coli
ttggctcccggcgaatctcccagga

SEQ ID NO: 17632 - DNA, 25 bp, E. coli
ttggctcccggccaatctcccagga

SEQ ID NO: 17633 - DNA, 25 bp, E. coli
tggttggctccccgcgaatctccca

SEQ ID NO: 17634 - DNA, 25 bp, E. coli
tcccggcgaatcacccaggacatca

SEQ ID NO: 17635 - DNA, 25 bp, E. coli
tcccggcgaatctcccaggacatca

SEQ ID NO: 17636 - DNA, 25 bp, E. coli
ccggcgaatctcgcaggacatcagt

SEQ ID NO: 17637 - DNA, 25 bp, E. coli
gctcccggcgaaactcccaggacat

SEQ ID NO: 17638 - DNA, 25 bp, E. coli
gctcccggcgaatctcccaggacat

SEQ ID NO: 17639 - DNA, 25 bp, E. coli
ccggcgaatctcccaggacatcagt

SEQ ID NO: 17640 - DNA, 25 bp, E. coli
gctggttggctcgcggcgaatctcc

SEQ ID NO: 17641 - DNA, 25 bp, E. coli
gctggttggctcccggcgaatctcc

SEQ ID NO: 17642 - DNA, 25 bp, E. coli
cccggcgaatctgccaggacatcag

SEQ ID NO: 17643 - DNA, 25 bp, E. coli
cccggcgaatctcccaggacatcag

SEQ ID NO: 17644 - DNA, 25 bp, E. coli
ctcccggcgaatctcccaggacatc

SEQ ID NO: 17645 - DNA, 25 bp, E. coli
ctggttggctcccggcgaatctccc

SEQ ID NO: 17646 - DNA, 25 bp, E. coli
ctggttggctccgggcgaatctccc

SEQ ID NO: 17647 - DNA, 25 bp, E. coli
ctcccggcgaatgtcccaggacatc

SEQ ID NO: 17648 - DNA, 25 bp, E. coli
tggctcccggcgtatctcccaggac

SEQ ID NO: 17649 - DNA, 25 bp, E. coli
ggctcccggcgattctcccaggaca

SEQ ID NO: 17650 - DNA, 25 bp, E. coli
tggctcccggcgaatctcccaggac

SEQ ID NO: 17651 - DNA, 25 bp, E. coli
tggttggctcccggcgaatctccca

SEQ ID NO: 17652 - DNA, 25 bp, E. coli
ggctcccggcgaatctcccaggaca

SEQ ID NO: 17653 - DNA, 25 bp, E. coli
caatcgcgaaggattattccaggcg

SEQ ID NO: 17654 - DNA, 25 bp, E. coli
caatcgcgaaggtttattccaggcg

SEQ ID NO: 17655 - DNA, 25 bp, E. coli
tactggcgctgtcagcaatcgcgaa

SEQ ID NO: 17656 - DNA, 25 bp, E. coli
tactggcgctgtgagcaatcgcgaa

SEQ ID NO: 17657 - DNA, 25 bp, E. coli
aaatcacctgttccgccaggcggca

SEQ ID NO: 17658 - DNA, 25 bp, E. coli
aaatcacctgttgcgccaggcggca

SEQ ID NO: 17659 - DNA, 25 bp, E. coli
tgttgcaggagcgtaaagtgcgccc

SEQ ID NO: 17660 - DNA, 25 bp, E. coli
tgttgcaggagcctaaagtgcgccc

SEQ ID NO: 17661 - DNA, 25 bp, E. coli
gctgggcagtaaccgcgatattgat

SEQ ID NO: 17662 - DNA, 25 bp, E. coli
gctgggcagtaagcgcgatattgat

SEQ ID NO: 17663 - DNA, 25 bp, E. coli
gaaagagattttggcccaggctatc

SEQ ID NO: 17664 - DNA, 25 bp, E. coli
gaaagagattttcgcccaggctatc

SEQ ID NO: 17665 - DNA, 25 bp, E. coli
gattgctgaaacagcttggcctgcg

SEQ ID NO: 17666 - DNA, 25 bp, E. coli
gatttagtcatcagcgacctgcgga

SEQ ID NO: 17667 - DNA, 25 bp, E. coli
gattgctgaaactgcttggcctgcg

SEQ ID NO: 17668 - DNA, 25 bp, E. coli
gatttagtcatctgcgacctgcgga

SEQ ID NO: 17669 - DNA, 25 bp, E. coli
gggcgcaaccggacagaattttata

SEQ ID NO: 17670 - DNA, 25 bp, E. coli
gggcgcaaccggtcagaattttata

SEQ ID NO: 17671 - DNA, 25 bp, E. coli
ggcggcagagcgtcataaaccgttt

SEQ ID NO: 17672 - DNA, 25 bp, E. coli
tggcggagcgcacagaagacattcc

SEQ ID NO: 17673 - DNA, 25 bp, E. coli
tggcggagcgcagagaagacattcc

SEQ ID NO: 17674 - DNA, 25 bp, E. coli
ggcggcagagcgacataaaccgttt

SEQ ID NO: 17675 - DNA, 25 bp, E. coli
aatgctggcgaatccacgcgagaag

SEQ ID NO: 17676 - DNA, 25 bp, E. coli
aatgctggcgaaaccacgcgagaag

SEQ ID NO: 17677 - DNA, 25 bp, E. coli
aggcttatgcgatatccggcgcagt

SEQ ID NO: 17678 - DNA, 25 bp, E. coli
aggcttatgcgaaatccggcgcagt

SEQ ID NO: 17679 - DNA, 25 bp, E. coli
tagacagttgcttataccttgccgc

SEQ ID NO: 17680 - DNA, 25 bp, E. coli
tagacagttgctaataccttgccgc

SEQ ID NO: 17681 - DNA, 25 bp, E. coli
taccttgccgccagggctgaaggaa

SEQ ID NO: 17682 - DNA, 25 bp, E. coli
taccttgccgcctgggctgaaggaa

SEQ ID NO: 17683 - DNA, 25 bp, E. coli
tgctgcgtgggtgaatgtggtgcct

SEQ ID NO: 17684 - DNA, 25 bp, E. coli
tgctgcgtgggtcaatgtggtgcct

SEQ ID NO: 17685 - DNA, 25 bp, E. coli
gctaagtgtcaaacaagggtgctgc

SEQ ID NO: 17686 - DNA, 25 bp, E. coli
gctaagtgtcaatcaagggtgctgc

SEQ ID NO: 17687 - DNA, 25 bp, E. coli
gaaaccacgcgacaagccattaacc

SEQ ID NO: 17688 - DNA, 25 bp, E. coli
gaaaccacgcgagaagccattaacc

SEQ ID NO: 17689 - DNA, 25 bp, E. coli
ctcatgttcagcaggcttatgcgaa

SEQ ID NO: 17690 - DNA, 25 bp, E. coli
ctcatgttcagctggcttatgcgaa

SEQ ID NO: 17691 - DNA, 25 bp, E. coli
gttgcttataccttgccgcctgggc

SEQ ID NO: 17692 - DNA, 25 bp, E. coli
gttgcttataccatgccgcctgggc

SEQ ID NO: 17693 - DNA, 25 bp, E. coli
ggaaaactttctcatgttcagcagg

SEQ ID NO: 17694 - DNA, 25 bp, E. coli
ggaaaactttctgatgttcagcagg

SEQ ID NO: 17695 - DNA, 25 bp, E. coli
tcagcaggcttatgcgaaatccggc

SEQ ID NO: 17696 - DNA, 25 bp, E. coli
tcagcaggcttaagcgaaatccggc

SEQ ID NO: 17697 - DNA, 25 bp, E. coli
cagatgctttcaaggcgcaagtaaa

SEQ ID NO: 17698 - DNA, 25 bp, E. coli
cagatgctttcatggcgcaagtaaa

SEQ ID NO: 17699 - DNA, 25 bp, E. coli
tacccaaaaagacgcaagcgaaatt

SEQ ID NO: 17700 - DNA, 25 bp, E. coli
tagtgaaggttccaaaaaagctctc

SEQ ID NO: 17701 - DNA, 25 bp, E. coli
tagtgaaggttcgaaaaaagctctc

SEQ ID NO: 17702 - DNA, 25 bp, E. coli
tacccaaaaagaggcaagcgaaatt

SEQ ID NO: 17703 - DNA, 25 bp, E. coli
aaacagtattgaaaggtatccacgg

SEQ ID NO: 17704 - DNA, 25 bp, E. coli
caagtaaaggcatttcgggcttcgg

SEQ ID NO: 17705 - DNA, 25 bp, E. coli
aaacagtattgataggtatccacgg

SEQ ID NO: 17706 - DNA, 25 bp, E. coli
caagtaaaggcaattcgggcttcgg

SEQ ID NO: 17707 - DNA, 25 bp, E. coli
tgtccattgcgatgagagcatcatg

SEQ ID NO: 17708 - DNA, 25 bp, E. coli
tgccaccagggagaaatggtttctg

SEQ ID NO: 17709 - DNA, 25 bp, E. coli
tgtccattgcgaagagagcatcatg

SEQ ID NO: 17710 - DNA, 25 bp, E. coli
tgccaccagggacaaatggtttctg

SEQ ID NO: 17711 - DNA, 25 bp, E. coli
tacaccttccgtcgacgaaaaacag

SEQ ID NO: 17712 - DNA, 25 bp, E. coli
tacaccttccgtggacgaaaaacag

SEQ ID NO: 17713 - DNA, 25 bp, E. coli
tgaaatgtccggattgccaccaggg

SEQ ID NO: 17714 - DNA, 25 bp, E. coli
tgaaatgtccggtttgccaccaggg

SEQ ID NO: 17715 - DNA, 25 bp, E. coli
tcgcgttacgaataaggcaatgccc

SEQ ID NO: 17716 - DNA, 25 bp, E. coli
tcgcgttacgaaaaaggcaatgccc

SEQ ID NO: 17717 - DNA, 25 bp, E. coli
tcggtgaatgccgaaacagtggcac

SEQ ID NO: 17718 - DNA, 25 bp, E. coli
tcggtgaatgcccaaacagtggcac

SEQ ID NO: 17719 - DNA, 25 bp, E. coli
aacgagaatgcaatgtgacgccacg

SEQ ID NO: 17720 - DNA, 25 bp, E. coli
ccgaaggtgaaatccgcggtcttgt

SEQ ID NO: 17721 - DNA, 25 bp, E. coli
ccgaaggtgaaaaccgcggtcttgt

SEQ ID NO: 17722 - DNA, 25 bp, E. coli
tacaaatgcttagccaatgggcgga

SEQ ID NO: 17723 - DNA, 25 bp, E. coli
tacaaatgcttacccaatgggcgga

SEQ ID NO: 17724 - DNA, 25 bp, E. coli
aaattaacgtgcattactgcggtca

SEQ ID NO: 17725 - DNA, 25 bp, E. coli
aaattaacgtgctttactgcggtca

SEQ ID NO: 17726 - DNA, 25 bp, E. coli
aacgagaatgcattgtgacgccacg

SEQ ID NO: 17727 - DNA, 25 bp, E. coli
tataaaggccgttggtggcagcgtt

SEQ ID NO: 17728 - DNA, 25 bp, E. coli
tataaaggccgtaggtggcagcgtt

SEQ ID NO: 17729 - DNA, 25 bp, E. coli
tgatccgcgcgataccagacttcgg

SEQ ID NO: 17730 - DNA, 25 bp, E. coli
tgatccgcgcgaaaccagacttcgg

SEQ ID NO: 17731 - DNA, 25 bp, E. coli
tgccattgaactgctgcaccgcgtg

SEQ ID NO: 17732 - DNA, 25 bp, E. coli
tgccattgaactcctgcaccgcgtg

SEQ ID NO: 17733 - DNA, 25 bp, E. coli
gcagttttccctatgagttgaccga

SEQ ID NO: 17734 - DNA, 25 bp, E. coli
gcagttttccctttgagttgaccga

SEQ ID NO: 17735 - DNA, 25 bp, E. coli
cccgctgaacatggagaaagagtga

SEQ ID NO: 17736 - DNA, 25 bp, E. coli
cccgctgaacatcgagaaagagtga

SEQ ID NO: 17737 - DNA, 25 bp, E. coli
gattttccaggaaccgcagtcgtgt

SEQ ID NO: 17738 - DNA, 25 bp, E. coli
gattttccaggatccgcagtcgtgt

SEQ ID NO: 17739 - DNA, 25 bp, E. coli
gatgccgcataaaagtcgcctcaat

SEQ ID NO: 17740 - DNA, 25 bp, E. coli
gatgccgcataatagtcgcctcaat

SEQ ID NO: 17741 - DNA, 25 bp, E. coli
aaccagttgagggtggtcattctct

SEQ ID NO: 17742 - DNA, 25 bp, E. coli
catgaggaacgagagtggcaaccag

SEQ ID NO: 17743 - DNA, 25 bp, E. coli
catgaggaacgacagtggcaaccag

SEQ ID NO: 17744 - DNA, 25 bp, E. coli
atgcgctgttcatgaggaacgagag

SEQ ID NO: 17745 - DNA, 25 bp, E. coli
atgcgctgttcaagaggaacgagag

SEQ ID NO: 17746 - DNA, 25 bp, E. coli
aaccagttgaggctggtcattctct

SEQ ID NO: 17747 - DNA, 25 bp, E. coli
ttcatgaggaacgagagtggcaacc

SEQ ID NO: 17748 - DNA, 25 bp, E. coli
ttcatgaggaaccagagtggcaacc

SEQ ID NO: 17749 - DNA, 25 bp, E. coli
tgttcatgaggaacgagagtggcaa

SEQ ID NO: 17750 - DNA, 25 bp, E. coli
tgttcatgaggatcgagagtggcaa

SEQ ID NO: 17751 - DNA, 25 bp, E. coli
tgaggaacgagagtggcaaccagtt

SEQ ID NO: 17752 - DNA, 25 bp, E. coli
tgaggaacgagactggcaaccagtt

SEQ ID NO: 17753 - DNA, 25 bp, E. coli
tgcgctgttcatgaggaacgagagt

SEQ ID NO: 17754 - DNA, 25 bp, E. coli
tgcgctgttcatcaggaacgagagt

SEQ ID NO: 17755 - DNA, 25 bp, E. coli
tcatgaggaacgtgagtggcaacca

SEQ ID NO: 17756 - DNA, 25 bp, E. coli
tcatgaggaacgagagtggcaacca

SEQ ID NO: 17757 - DNA, 25 bp, E. coli
ccagttgaggctcgtcattctctga

SEQ ID NO: 17758 - DNA, 25 bp, E. coli
ccagttgaggctggtcattctctga

SEQ ID NO: 17759 - DNA, 25 bp, E. coli
gcaaccagttgaggctggtcattct

SEQ ID NO: 17760 - DNA, 25 bp, E. coli
gcaaccagttgacgctggtcattct

SEQ ID NO: 17761 - DNA, 25 bp, E. coli
ctgttcatgaggtacgagagtggca

SEQ ID NO: 17762 - DNA, 25 bp, E. coli
ctgttcatgaggaacgagagtggca

SEQ ID NO: 17763 - DNA, 25 bp, E. coli
aagtggaacataaattatcggatat

SEQ ID NO: 17764 - DNA, 25 bp, E. coli
aagtggaacatatattatcggatat

SEQ ID NO: 17765 - DNA, 25 bp, E. coli
aaagtggaacataaattatcggata

SEQ ID NO: 17766 - DNA, 25 bp, E. coli
aaagtggaacattaattatcggata

SEQ ID NO: 17767 - DNA, 25 bp, E. coli
agtggaacataaattatcggatatt

SEQ ID NO: 17768 - DNA, 25 bp, E. coli
agtggaacataatttatcggatatt

SEQ ID NO: 17769 - DNA, 25 bp, E. coli
aacacatcccgaagttttgaagtga

SEQ ID NO: 17770 - DNA, 25 bp, E. coli
aaacacatcccgttgttttgaagtg

SEQ ID NO: 17771 - DNA, 25 bp, E. coli
aacacatcccgatgttttgaagtga

SEQ ID NO: 17772 - DNA, 25 bp, E. coli
aaacacatcccgatgttttgaagtg

SEQ ID NO: 17773 - DNA, 25 bp, E. coli
gaaagtggaacaaaaattatcggat

SEQ ID NO: 17774 - DNA, 25 bp, E. coli
gaaagtggaacataaattatcggat

SEQ ID NO: 17775 - DNA, 25 bp, E. coli
gaaacacatcccgatgttttgaagt

SEQ ID NO: 17776 - DNA, 25 bp, E. coli
gaaacacatccccatgttttgaagt

SEQ ID NO: 17777 - DNA, 25 bp, E. coli
ctggaaagtggatcataaattatcg

SEQ ID NO: 17778 - DNA, 25 bp, E. coli
ctggaaagtggaacataaattatcg

SEQ ID NO: 17779 - DNA, 25 bp, E. coli
ggaaagtggaacataaattatcgga

SEQ ID NO: 17780 - DNA, 25 bp, E. coli
ggaaagtggaacttaaattatcgga

SEQ ID NO: 17781 - DNA, 25 bp, E. coli
ggaacataaattatcggatattcta

SEQ ID NO: 17782 - DNA, 25 bp, E. coli
tggaaagtggaagataaattatcgg

SEQ ID NO: 17783 - DNA, 25 bp, E. coli
ggaacataaattttcggatattcta

SEQ ID NO: 17784 - DNA, 25 bp, E. coli
tggaaagtggaacataaattatcgg

SEQ ID NO: 17785 - DNA, 25 bp, E. coli
cagccttggcgggcagcttgacgtc

SEQ ID NO: 17786 - DNA, 25 bp, E. coli
cagccttggcggccagcttgacgtc

SEQ ID NO: 17787 - DNA, 25 bp, E. coli
agctatgattctgccgctcggccca

SEQ ID NO: 17788 - DNA, 25 bp, E. coli
atgattctgccggtcggcccacaaa

SEQ ID NO: 17789 - DNA, 25 bp, E. coli
agctatgattctcccgctcggccca

SEQ ID NO: 17790 - DNA, 25 bp, E. coli
atgattctgccgctcggcccacaaa

SEQ ID NO: 17791 - DNA, 25 bp, E. coli
ttctgccgctcgccccacaaaatgc

SEQ ID NO: 17792 - DNA, 25 bp, E. coli
ttctgccgctcggcccacaaaatgc

SEQ ID NO: 17793 - DNA, 25 bp, E. coli
tgattctgccgctcggcccacaaaa

SEQ ID NO: 17794 - DNA, 25 bp, E. coli
tgattctgccgcacggcccacaaaa

SEQ ID NO: 17795 - DNA, 25 bp, E. coli
tgctcttggggctgctatgattctg

SEQ ID NO: 17796 - DNA, 25 bp, E. coli
tgctcttggggcagctatgattctg

SEQ ID NO: 17797 - DNA, 25 bp, E. coli
gctcttggggcagctatgattctgc

SEQ ID NO: 17798 - DNA, 25 bp, E. coli
gctcttggggcacctatgattctgc

SEQ ID NO: 17799 - DNA, 25 bp, E. coli
gcagctatgattctgccgctcggcc

SEQ ID NO: 17800 - DNA, 25 bp, E. coli
gcagctatgattgtgccgctcggcc

SEQ ID NO: 17801 - DNA, 25 bp, E. coli
gattctgccgctcggcccacaaaat

SEQ ID NO: 17802 - DNA, 25 bp, E. coli
gattctgccgctgggcccacaaaat

SEQ ID NO: 17803 - DNA, 25 bp, E. coli
gggcagctatgaatctgccgctcgg

SEQ ID NO: 17804 - DNA, 25 bp, E. coli
ggcagctatgattctgccgctcggc

SEQ ID NO: 17805 - DNA, 25 bp, E. coli
ggcagctatgatactgccgctcggc

SEQ ID NO: 17806 - DNA, 25 bp, E. coli
gggcagctatgattctgccgctcgg

SEQ ID NO: 17807 - DNA, 25 bp, E. coli
gtcgggtatttatccttcagtgcca

SEQ ID NO: 17808 - DNA, 25 bp, E. coli
gtcgggtatttaaccttcagtgcca

SEQ ID NO: 17809 - DNA, 25 bp, E. coli
tatcgtggcgtttgtacctgttgtc

SEQ ID NO: 17810 - DNA, 25 bp, E. coli
tatcgtggcgttagtacctgttgtc

SEQ ID NO: 17811 - DNA, 25 bp, E. coli
tatttacttgacagatttagtcggg

SEQ ID NO: 17812 - DNA, 25 bp, E. coli
tattgcatagcacggtcaagtctga

SEQ ID NO: 17813 - DNA, 25 bp, E. coli
tttgtacctgttctcggatgcggcg

SEQ ID NO: 17814 - DNA, 25 bp, E. coli
tttgtacctgttgtcggatgcggcg

SEQ ID NO: 17815 - DNA, 25 bp, E. coli
tattgcatagcagggtcaagtctga

SEQ ID NO: 17816 - DNA, 25 bp, E. coli
tatttacttgactgatttagtcggg

SEQ ID NO: 17817 - DNA, 25 bp, E. coli
gcgtgaacgccatatccgccctggg

SEQ ID NO: 17818 - DNA, 25 bp, E. coli
gcgtgaacgccaaatccgccctggg

SEQ ID NO: 17819 - DNA, 25 bp, E. coli
ccgacctacggttctgttcactgta

SEQ ID NO: 17820 - DNA, 25 bp, E. coli
ccgacctacggtactgttcactgta

SEQ ID NO: 17821 - DNA, 25 bp, E. coli
cattcccgagtaaattggtcaacta

SEQ ID NO: 17822 - DNA, 25 bp, E. coli
cattcccgagtatattggtcaacta

SEQ ID NO: 17823 - DNA, 25 bp, E. coli
gttctgttcactctaggcctgataa

SEQ ID NO: 17824 - DNA, 25 bp, E. coli
gttctgttcactgtaggcctgataa

SEQ ID NO: 17825 - DNA, 25 bp, E. coli
gggttctgtacactgtaggcctgat

SEQ ID NO: 17826 - DNA, 25 bp, E. coli
gggttctgtacagtgtaggcctgat

SEQ ID NO: 17827 - DNA, 25 bp, E. coli
gtcaagtctgacattcccgagtaaa

SEQ ID NO: 17828 - DNA, 25 bp, E. coli
gtcaagtctgactttcccgagtaaa

SEQ ID NO: 17829 - DNA, 25 bp, E. coli
aatgaccgggttgtcaatcttgaca

SEQ ID NO: 17830 - DNA, 25 bp, E. coli
aatgaccgggttctcaatcttgaca

SEQ ID NO: 17831 - DNA, 25 bp, E. coli
agttgagacgttcacccgctcatga

SEQ ID NO: 17832 - DNA, 25 bp, E. coli
agttgagacgttgacccgctcatga

SEQ ID NO: 17833 - DNA, 25 bp, E. coli
aaaaattgtcgctgcagttgagacg

SEQ ID NO: 17834 - DNA, 25 bp, E. coli
aaaaattgtcgcagcagttgagacg

SEQ ID NO: 17835 - DNA, 25 bp, E. coli
tatgccacctattgatagagctgag

SEQ ID NO: 17836 - DNA, 25 bp, E. coli
tatgccacctatagatagagctgag

SEQ ID NO: 17837 - DNA, 25 bp, E. coli
tattagtcttgctggatcatgtgct

SEQ ID NO: 17838 - DNA, 25 bp, E. coli
tattagtcttgcaggatcatgtgct

SEQ ID NO: 17839 - DNA, 25 bp, E. coli
ttggcagcaaaatgcgttacaagca

SEQ ID NO: 17840 - DNA, 25 bp, E. coli
ttggcagcaaaaagcgttacaagca

SEQ ID NO: 17841 - DNA, 25 bp, E. coli
tgatctccgcttatgctaactatgc

SEQ ID NO: 17842 - DNA, 25 bp, E. coli
tgatctccgcttttgctaactatgc

SEQ ID NO: 17843 - DNA, 25 bp, E. coli
tcatgaaatacaccaagcgaaagtg

SEQ ID NO: 17844 - DNA, 25 bp, E. coli
tcatgaaatacagcaagcgaaagtg

SEQ ID NO: 17845 - DNA, 25 bp, E. coli
gctaactatgctgtacaaactgaaa

SEQ ID NO: 17846 - DNA, 25 bp, E. coli
gctaactatgctctacaaactgaaa

SEQ ID NO: 17847 - DNA, 25 bp, E. coli
gacaacccggatgataaaatgatct

SEQ ID NO: 17848 - DNA, 25 bp, E. coli
gacaacccggatcataaaatgatct

SEQ ID NO: 17849 - DNA, 25 bp, E. coli
ggtttcattggtcggaacattagca

SEQ ID NO: 17850 - DNA, 25 bp, E. coli
ggtttcattggtgggaacattagca

SEQ ID NO: 17851 - DNA, 25 bp, E. coli
caaaatcgttaagcgtgatggtgtc

SEQ ID NO: 17852 - DNA, 25 bp, E. coli
caaaatcgttaaccgtgatggtgtc

SEQ ID NO: 17853 - DNA, 25 bp, E. coli
tttgcagtgccgtgccgaagcataa

SEQ ID NO: 17854 - DNA, 25 bp, E. coli
tttgcagtgccgagccgaagcataa

SEQ ID NO: 17855 - DNA, 25 bp, E. coli
tgtgatttgcagagccgagccgaag

SEQ ID NO: 17856 - DNA, 25 bp, E. coli
tgcttccgtcaacaaattatgccgt

SEQ ID NO: 17857 - DNA, 25 bp, E. coli
tgaaagttcgtgcttccgtcaagaa

SEQ ID NO: 17858 - DNA, 25 bp, E. coli
tgaaagttcgtggttccgtcaagaa

SEQ ID NO: 17859 - DNA, 25 bp, E. coli
tgcttccgtcaagaaattatgccgt

SEQ ID NO: 17860 - DNA, 25 bp, E. coli
tgccgagccgaaccataaacagcgc

SEQ ID NO: 17861 - DNA, 25 bp, E. coli
tgccgagccgaagcataaacagcgc

SEQ ID NO: 17862 - DNA, 25 bp, E. coli
tcatccgtgtgaattgcagtgccga

SEQ ID NO: 17863 - DNA, 25 bp, E. coli
tcatccgtgtgatttgcagtgccga

SEQ ID NO: 17864 - DNA, 25 bp, E. coli
gccgtaactgcataatcgttaagcg

SEQ ID NO: 17865 - DNA, 25 bp, E. coli
gccgtaactgcaaaatcgttaagcg

SEQ ID NO: 17866 - DNA, 25 bp, E. coli
gaagcataaacagcgccaaggctga

SEQ ID NO: 17867 - DNA, 25 bp, E. coli
gaagcataaacaccgccaaggctga

SEQ ID NO: 17868 - DNA, 25 bp, E. coli
cgtcaagaaattatgccgtaactgc

SEQ ID NO: 17869 - DNA, 25 bp, E. coli
cgtcaagaaattttgccgtaactgc

SEQ ID NO: 17870 - DNA, 25 bp, E. coli
tgtgatttgcagtgccgagccgaag

SEQ ID NO: 17871 - DNA, 25 bp, E. coli
taagcgtgatggagtcatccgtgtg

SEQ ID NO: 17872 - DNA, 25 bp, E. coli
taagcgtgatggtgtcatccgtgtg

SEQ ID NO: 17873 - DNA, 25 bp, E. coli
cacagtcgtctgtcggcggaggtaa

SEQ ID NO: 17874 - DNA, 25 bp, E. coli
cacagtcgtctgacggcggaggtaa

SEQ ID NO: 17875 - DNA, 25 bp, E. coli
tatggtgcctgggtgatttatcccc

SEQ ID NO: 17876 - DNA, 25 bp, E. coli
tatctcgaccgtacacagtcgtctg

SEQ ID NO: 17877 - DNA, 25 bp, E. coli
tatggtgcctggctgatttatcccc

SEQ ID NO: 17878 - DNA, 25 bp, E. coli
tatctcgaccgttcacagtcgtctg

SEQ ID NO: 17879 - DNA, 25 bp, E. coli
ttctcgcgcctcaggtgggcgtgct

SEQ ID NO: 17880 - DNA, 25 bp, E. coli
ttctcgcgcctctggtgggcgtgct

SEQ ID NO: 17881 - DNA, 25 bp, E. coli
tgcgcttttgctggcgtatggtgcc

SEQ ID NO: 17882 - DNA, 25 bp, E. coli
tgcgcttttgctcgcgtatggtgcc

SEQ ID NO: 17883 - DNA, 25 bp, E. coli
cctgttctggtcgtggctggtggcg

SEQ ID NO: 17884 - DNA, 25 bp, E. coli
cctgttctggtcctggctggtggcg

SEQ ID NO: 17885 - DNA, 25 bp, E. coli
gctggtggcgcgttatctcgaccgt

SEQ ID NO: 17886 - DNA, 25 bp, E. coli
gctggtggcgcgatatctcgaccgt

SEQ ID NO: 17887 - DNA, 25 bp, E. coli
cttttgctggcgaatggtgcctggc

SEQ ID NO: 17888 - DNA, 25 bp, E. coli
cttttgctggcgtatggtgcctggc

SEQ ID NO: 17889 - DNA, 25 bp, E. coli
gatcatgctgatactcgcgcctctg

SEQ ID NO: 17890 - DNA, 25 bp, E. coli
gatcatgctgattctcgcgcctctg

SEQ ID NO: 17891 - DNA, 25 bp, E. coli
ggcgcgatatctcgaccgtacacag

SEQ ID NO: 17892 - DNA, 25 bp, E. coli
ggcgcgatatctggaccgtacacag

SEQ ID NO: 17893 - DNA, 25 bp, E. coli
tggctgatttatgccccggcgggtt

SEQ ID NO: 17894 - DNA, 25 bp, E. coli
tggctgatttatcccccggcgggtt

SEQ ID NO: 17895 - DNA, 25 bp, E. coli
catatgctgtttcatgtgcaaatgc

SEQ ID NO: 17896 - DNA, 25 bp, E. coli
catatgctgtttgatgtgcaaatgc

SEQ ID NO: 17897 - DNA, 25 bp, E. coli
attgaaagccgaaggcacgcctgct

SEQ ID NO: 17898 - DNA, 25 bp, E. coli
attcaggatgcctgggcgcaggatc

SEQ ID NO: 17899 - DNA, 25 bp, E. coli
attcaggatgccagggcgcaggatc

SEQ ID NO: 17900 - DNA, 25 bp, E. coli
attgaaagccgatggcacgcctgct

SEQ ID NO: 17901 - DNA, 25 bp, E. coli
tattggtctgggttccatccgttgc

SEQ ID NO: 17902 - DNA, 25 bp, E. coli
tattgtcggtattggtctgggatcc

SEQ ID NO: 17903 - DNA, 25 bp, E. coli
tattggtctgggatccatccgttgc

SEQ ID NO: 17904 - DNA, 25 bp, E. coli
tattgtcggtataggtctgggatcc

SEQ ID NO: 17905 - DNA, 25 bp, E. coli
ttactcaacaaaaaagcttcttgtg

SEQ ID NO: 17906 - DNA, 25 bp, E. coli
ttactcaacaaataagcttcttgtg

SEQ ID NO: 17907 - DNA, 25 bp, E. coli
tgtcggtattggtctgggatccatc

SEQ ID NO: 17908 - DNA, 25 bp, E. coli
tgtcggtattggactgggatccatc

SEQ ID NO: 17909 - DNA, 25 bp, E. coli
tgccagggcgcaggatctttcaccg

SEQ ID NO: 17910 - DNA, 25 bp, E. coli
tgccagggcgcacgatctttcaccg

SEQ ID NO: 17911 - DNA, 25 bp, E. coli
tctgggatccatccgttgctgccgt

SEQ ID NO: 17912 - DNA, 25 bp, E. coli
tctgggatccatgcgttgctgccgt

SEQ ID NO: 17913 - DNA, 25 bp, E. coli
ccccgtcatatggtgtttgatgtgc

SEQ ID NO: 17914 - DNA, 25 bp, E. coli
ccccgtcatatgctgtttgatgtgc

SEQ ID NO: 17915 - DNA, 25 bp, E. coli
gatgccagggcggaggatctttcac

SEQ ID NO: 17916 - DNA, 25 bp, E. coli
gatgccagggcgcaggatctttcac

SEQ ID NO: 17917 - DNA, 25 bp, E. coli
caaccgaacagaagaagagtggcgc

SEQ ID NO: 17918 - DNA, 25 bp, E. coli
caccggcatcgggaaggcattgatc

SEQ ID NO: 17919 - DNA, 25 bp, E. coli
caccggcatcggcaaggcattgatc

SEQ ID NO: 17920 - DNA, 25 bp, E. coli
caccgcaggcgcacaaacgttatta

SEQ ID NO: 17921 - DNA, 25 bp, E. coli
caccgcaggcgctcaaacgttatta

SEQ ID NO: 17922 - DNA, 25 bp, E. coli
caaccgaacagatgaagagtggcgc

SEQ ID NO: 17923 - DNA, 25 bp, E. coli
tacgaaattgccgagcccgttttgc

SEQ ID NO: 17924 - DNA, 25 bp, E. coli
taccaactgggtgccaaactgatcg

SEQ ID NO: 17925 - DNA, 25 bp, E. coli
taccaactgggtcccaaactgatcg

SEQ ID NO: 17926 - DNA, 25 bp, E. coli
tacgaaattgcccagcccgttttgc

SEQ ID NO: 17927 - DNA, 25 bp, E. coli
agtggcgcacgcagtttaagacctg

SEQ ID NO: 17928 - DNA, 25 bp, E. coli
agtggcgcacgctgtttaagacctg

SEQ ID NO: 17929 - DNA, 25 bp, E. coli
aaaagtatcggccagttcaccggca

SEQ ID NO: 17930 - DNA, 25 bp, E. coli
aaaagtatcggcgagttcaccggca

SEQ ID NO: 17931 - DNA, 25 bp, E. coli
tgatctggaagacaacgagccgact

SEQ ID NO: 17932 - DNA, 25 bp, E. coli
tgatctggaagagaacgagccgact

SEQ ID NO: 17933 - DNA, 25 bp, E. coli
tcctgtgcagaacagatatccgctg

SEQ ID NO: 17934 - DNA, 25 bp, E. coli
tcctgtgcagaagagatatccgctg

SEQ ID NO: 17935 - DNA, 25 bp, E. coli
tcaggagaaacgaatggcagaaacc

SEQ ID NO: 17936 - DNA, 25 bp, E. coli
tcaggagaaacgtatggcagaaacc

SEQ ID NO: 17937 - DNA, 25 bp, E. coli
tctggtggaacaacgctatctgcgc

SEQ ID NO: 17938 - DNA, 25 bp, E. coli
tctggtggaacatcgctatctgcgc

SEQ ID NO: 17939 - DNA, 25 bp, E. coli
aatggctcaacgctctctgcggtga

SEQ ID NO: 17940 - DNA, 25 bp, E. coli
aatggctcaacggtctctgcggtga

SEQ ID NO: 17941 - DNA, 25 bp, E. coli
cacacattggcggttcgactcagga

SEQ ID NO: 17942 - DNA, 25 bp, E. coli
cacacattggcgcttcgactcagga

SEQ ID NO: 17943 - DNA, 25 bp, E. coli
tagaaggcgtgcaccaaaaggcgct

SEQ ID NO: 17944 - DNA, 25 bp, E. coli
tagaaggcgtgctccaaaaggcgct

SEQ ID NO: 17945 - DNA, 25 bp, E. coli
tcgaatttcacaaaggcgcgctgga

SEQ ID NO: 17946 - DNA, 25 bp, E. coli
tcgaatttcacataggcgcgctgga

SEQ ID NO: 17947 - DNA, 25 bp, E. coli
tcaggaagcgcaggagaatatcggc

SEQ ID NO: 17948 - DNA, 25 bp, E. coli
tcaggaagcgcacgagaatatcggc

SEQ ID NO: 17949 - DNA, 25 bp, E. coli
gcaatgaaagcttttccgggtacca

SEQ ID NO: 17950 - DNA, 25 bp, E. coli
gcaatgaaagctattccgggtacca

SEQ ID NO: 17951 - DNA, 25 bp, E. coli
gactgaagacgtcatcaacgccgca

SEQ ID NO: 17952 - DNA, 25 bp, E. coli
gactgaagacgtgatcaacgccgca

SEQ ID NO: 17953 - DNA, 25 bp, E. coli
cgcgcggcaaaaagctgggtatcat

SEQ ID NO: 17954 - DNA, 25 bp, E. coli
cgcgcggcaaaatgctgggtatcat

SEQ ID NO: 17955 - DNA, 25 bp, E. coli
cgggttcttttgtagcgcgcggcaa

SEQ ID NO: 17956 - DNA, 25 bp, E. coli
cgggttcttttgaagcgcgcggcaa

SEQ ID NO: 17957 - DNA, 25 bp, E. coli
ggcaatcgacgttttcccgacggaa

SEQ ID NO: 17958 - DNA, 25 bp, E. coli
ggcaatcgacgtattcccgacggaa

SEQ ID NO: 17959 - DNA, 25 bp, E. coli
gacgttgccgaataagcgctgcagg

SEQ ID NO: 17960 - DNA, 25 bp, E. coli
gacgttgccgaaaaagcgctgcagg

SEQ ID NO: 17961 - DNA, 25 bp, E. coli
caggcctacggcatacgggcgaagt

SEQ ID NO: 17962 - DNA, 25 bp, E. coli
caggcctacggcttacgggcgaagt

SEQ ID NO: 17963 - DNA, 25 bp, E. coli
atgggcgaagtgaagaccggataag

SEQ ID NO: 17964 - DNA, 25 bp, E. coli
atgggcgaagtgtagaccggataag

SEQ ID NO: 17965 - DNA, 25 bp, E. coli
tttatgggcgaactgtagaccggat

SEQ ID NO: 17966 - DNA, 25 bp, E. coli
ttatcaggcctagggcttacgggcg

SEQ ID NO: 17967 - DNA, 25 bp, E. coli
ttatcaggcctacggcttacgggcg

SEQ ID NO: 17968 - DNA, 25 bp, E. coli
tttatgggcgaagtgtagaccggat

SEQ ID NO: 17969 - DNA, 25 bp, E. coli
ttatgggcgaagtgtagaccggata

SEQ ID NO: 17970 - DNA, 25 bp, E. coli
ttatgggcgaagagtagaccggata

SEQ ID NO: 17971 - DNA, 25 bp, E. coli
cctacggcttaccggcgaagtgtag

SEQ ID NO: 17972 - DNA, 25 bp, E. coli
cctacggcttacgggcgaagtgtag

SEQ ID NO: 17973 - DNA, 25 bp, E. coli
ttacgggcgaagagtaggccggata

SEQ ID NO: 17974 - DNA, 25 bp, E. coli
cttacgggcgaagtgtaggccggat

SEQ ID NO: 17975 - DNA, 25 bp, E. coli
ttacgggcgaagtgtaggccggata

SEQ ID NO: 17976 - DNA, 25 bp, E. coli
cttacgggcgaactgtaggccggat

SEQ ID NO: 17977 - DNA, 25 bp, E. coli
ggcctacggctttcgggcgaagtgt

SEQ ID NO: 17978 - DNA, 25 bp, E. coli
ggcctacggcttacgggcgaagtgt

SEQ ID NO: 17979 - DNA, 25 bp, E. coli
ggcttacgggcgtagtgtaggccgg

SEQ ID NO: 17980 - DNA, 25 bp, E. coli
ggcttacgggcgaagtgtaggccgg

SEQ ID NO: 17981 - DNA, 25 bp, E. coli
tatgggcgaagtctagaccggataa

SEQ ID NO: 17982 - DNA, 25 bp, E. coli
tatgggcgaagtgtagaccggataa

SEQ ID NO: 17983 - DNA, 25 bp, E. coli
caaccgaagtgggtgcggatttccc

SEQ ID NO: 17984 - DNA, 25 bp, E. coli
caaccgaagtggctgcggatttccc

SEQ ID NO: 17985 - DNA, 25 bp, E. coli
cagatgcaaccgtagtggctgcgga

SEQ ID NO: 17986 - DNA, 25 bp, E. coli
cagatgcaaccgaagtggctgcgga

SEQ ID NO: 17987 - DNA, 25 bp, E. coli
agagcgatcgctgggcgctggcgct

SEQ ID NO: 17988 - DNA, 25 bp, E. coli
accgaagtggctgcggatttcccaa

SEQ ID NO: 17989 - DNA, 25 bp, E. coli
agagcgatcgctcggcgctggcgct

SEQ ID NO: 17990 - DNA, 25 bp, E. coli
aaccagacgctggtgagttttgacc

SEQ ID NO: 17991 - DNA, 25 bp, E. coli
accgaagtggctccggatttcccaa

SEQ ID NO: 17992 - DNA, 25 bp, E. coli
aaccagacgctgctgagttttgacc

SEQ ID NO: 17993 - DNA, 25 bp, E. coli
ttttcgcccaggtgcgcgagttggt

SEQ ID NO: 17994 - DNA, 25 bp, E. coli
ttttcgcccaggagcgcgagttggt

SEQ ID NO: 17995 - DNA, 25 bp, E. coli
ttttttcgcccaggtgcgcgagttg

SEQ ID NO: 17996 - DNA, 25 bp, E. coli
ttttttcgcccacgtgcgcgagttg

SEQ ID NO: 17997 - DNA, 25 bp, E. coli
ccagacgctggtgagttttgaccat

SEQ ID NO: 17998 - DNA, 25 bp, E. coli
ccagacgctggtcagttttgaccat

SEQ ID NO: 17999 - DNA, 25 bp, E. coli
tggctgcgcagaccgatcgctgggc

SEQ ID NO: 18000 - DNA, 25 bp, E. coli
ggaacagatgcaaccgaagtggctg

SEQ ID NO: 18001 - DNA, 25 bp, E. coli
ggaacagatgcatccgaagtggctg

SEQ ID NO: 18002 - DNA, 25 bp, E. coli
tggctgcgcagagcgatcgctgggc

SEQ ID NO: 18003 - DNA, 25 bp, E. coli
gatgcaaccgaagtggctgcggatt

SEQ ID NO: 18004 - DNA, 25 bp, E. coli
gatgcaaccgaactggctgcggatt

SEQ ID NO: 18005 - DNA, 25 bp, E. coli
cacaatccctatgaatatcatggtg

SEQ ID NO: 18006 - DNA, 25 bp, E. coli
cacaatccctatcaatatcatggtg

SEQ ID NO: 18007 - DNA, 25 bp, E. coli
taaattcccacaatagattaccggg

SEQ ID NO: 18008 - DNA, 25 bp, E. coli
taaaaaggaaattatagactacgtg

SEQ ID NO: 18009 - DNA, 25 bp, E. coli
taaaaaggaaataatagactacgtg

SEQ ID NO: 18010 - DNA, 25 bp, E. coli
taaattcccacattagattaccggg

SEQ ID NO: 18011 - DNA, 25 bp, E. coli
taaaaatcatcatccaggactaatc

SEQ ID NO: 18012 - DNA, 25 bp, E. coli
taaaaatcatcaaccaggactaatc

SEQ ID NO: 18013 - DNA, 25 bp, E. coli
aaattatagacttcgtgagaaacag

SEQ ID NO: 18014 - DNA, 25 bp, E. coli
aaattatagactacgtgagaaacag

SEQ ID NO: 18015 - DNA, 25 bp, E. coli
tagattaccgggtatatataaccca

SEQ ID NO: 18016 - DNA, 25 bp, E. coli
tagattaccgggaatatataaccca

SEQ ID NO: 18017 - DNA, 25 bp, E. coli
tccggcgaaaatattacttctgcac

SEQ ID NO: 18018 - DNA, 25 bp, E. coli
tccggcgaaaattttacttctgcac

SEQ ID NO: 18019 - DNA, 25 bp, E. coli
gaagcggcaaatatttgccatgctg

SEQ ID NO: 18020 - DNA, 25 bp, E. coli
gaagcggcaaatttttgccatgctg

SEQ ID NO: 18021 - DNA, 25 bp, E. coli
gactaatcttaagaacgaagcggca

SEQ ID NO: 18022 - DNA, 25 bp, E. coli
gactaatcttaacaacgaagcggca

SEQ ID NO: 18023 - DNA, 25 bp, E. coli
taatcggatcattccaatcacaatc

SEQ ID NO: 18024 - DNA, 25 bp, E. coli
taatcggatcataccaatcacaatc

SEQ ID NO: 18025 - DNA, 25 bp, E. coli
gttgctctcctgtgggcttaaaaag

SEQ ID NO: 18026 - DNA, 25 bp, E. coli
gttgctctcctgagggcttaaaaag

SEQ ID NO: 18027 - DNA, 25 bp, E. coli
aactgatggcgtagaagcgaagaaa

SEQ ID NO: 18028 - DNA, 25 bp, E. coli
aactgatggcgttgaagcgaagaaa

SEQ ID NO: 18029 - DNA, 25 bp, E. coli
tagtgaaaccaaaaaccagattgtt

SEQ ID NO: 18030 - DNA, 25 bp, E. coli
tagtgaaaccaataaccagattgtt

SEQ ID NO: 18031 - DNA, 25 bp, E. coli
tatcatgactggttacgtgacgccc

SEQ ID NO: 18032 - DNA, 25 bp, E. coli
tatcatgactggatacgtgacgccc

SEQ ID NO: 18033 - DNA, 25 bp, E. coli
ttagcagcagcataaaatgccggtg

SEQ ID NO: 18034 - DNA, 25 bp, E. coli
ttaattcgctctcaaactgatggcg

SEQ ID NO: 18035 - DNA, 25 bp, E. coli
ttaattcgctctgaaactgatggcg

SEQ ID NO: 18036 - DNA, 25 bp, E. coli
ttagcagcagcaaaaaatgccggtg

SEQ ID NO: 18037 - DNA, 25 bp, E. coli
tctgatgaaatactcaaaggctcta

SEQ ID NO: 18038 - DNA, 25 bp, E. coli
tctgatgaaatagtcaaaggctcta

SEQ ID NO: 18039 - DNA, 25 bp, E. coli
tcttcgagcaatatgaaatcgcctg

SEQ ID NO: 18040 - DNA, 25 bp, E. coli
tcttcgagcaatttgaaatcgcctg

SEQ ID NO: 18041 - DNA, 25 bp, E. coli
tctattagcggaaatgtcttcgagc

SEQ ID NO: 18042 - DNA, 25 bp, E. coli
tctattagcggatatgtcttcgagc

SEQ ID NO: 18043 - DNA, 25 bp, E. coli
gcagtcaatcggtggtatattccct

SEQ ID NO: 18044 - DNA, 25 bp, E. coli
gctcgtattgaacaacatcttagtg

SEQ ID NO: 18045 - DNA, 25 bp, E. coli
gctcgtattgaagaacatcttagtg

SEQ ID NO: 18046 - DNA, 25 bp, E. coli
gcagtcaatcggaggtatattccct

SEQ ID NO: 18047 - DNA, 25 bp, E. coli
gacatttcacgttcagtcattaaag

SEQ ID NO: 18048 - DNA, 25 bp, E. coli
gacatttcacgtacagtcattaaag

SEQ ID NO: 18049 - DNA, 25 bp, E. coli
cacggtgtgtgatggcgcaatgctc

SEQ ID NO: 18050 - DNA, 25 bp, E. coli
cacggtgtgtgaaggcgcaatgctc

SEQ ID NO: 18051 - DNA, 25 bp, E. coli
cacgccggaggaagtggaacaactg

SEQ ID NO: 18052 - DNA, 25 bp, E. coli
cacgccggaggatgtggaacaactg

SEQ ID NO: 18053 - DNA, 25 bp, E. coli
accatgtccgcaaagcggttctgtt

SEQ ID NO: 18054 - DNA, 25 bp, E. coli
aggatgtggaacaactggctgatgc

SEQ ID NO: 18055 - DNA, 25 bp, E. coli
accatgtccgcatagcggttctgtt

SEQ ID NO: 18056 - DNA, 25 bp, E. coli
aggatgtggaactactggctgatgc

SEQ ID NO: 18057 - DNA, 25 bp, E. coli
tattgaagggataacggtaagcggc

SEQ ID NO: 18058 - DNA, 25 bp, E. coli
tattgaagggattacggtaagcggc

SEQ ID NO: 18059 - DNA, 25 bp, E. coli
tgtgccatctcacctgcctcgtgga

SEQ ID NO: 18060 - DNA, 25 bp, E. coli
tgtgccatctcagctgcctcgtgga

SEQ ID NO: 18061 - DNA, 25 bp, E. coli
gcttaaccatgtccgcaaagcggtt

SEQ ID NO: 18062 - DNA, 25 bp, E. coli
gcttaaccatgtgcgcaaagcggtt

SEQ ID NO: 18063 - DNA, 25 bp, E. coli
gcaaagtggcgtggagcgcggctgt

SEQ ID NO: 18064 - DNA, 25 bp, E. coli
gcaaagtggcgtcgagcgcggctgt

SEQ ID NO: 18065 - DNA, 25 bp, E. coli
gaaaaattgctctcggtgtgtgatg

SEQ ID NO: 18066 - DNA, 25 bp, E. coli
gaaaaattgctcacggtgtgtgatg

SEQ ID NO: 18067 - DNA, 25 bp, E. coli
taatgattgcggagagtgcgtgccg

SEQ ID NO: 18068 - DNA, 25 bp, E. coli
taatgattgcggtgagtgcgtgccg

SEQ ID NO: 18069 - DNA, 25 bp, E. coli
gagcgcggctgtctgcgagcaatgt

SEQ ID NO: 18070 - DNA, 25 bp, E. coli
gagcgcggctgtgtgcgagcaatgt

SEQ ID NO: 18071 - DNA, 25 bp, E. coli
catcatgaccctttccttatttaag

SEQ ID NO: 18072 - DNA, 25 bp, E. coli
cacgatgatgatgcacttcatcatg

SEQ ID NO: 18073 - DNA, 25 bp, E. coli
cacgatgatgatccacttcatcatg

SEQ ID NO: 18074 - DNA, 25 bp, E. coli
catcatgaccctatccttatttaag

SEQ ID NO: 18075 - DNA, 25 bp, E. coli
acgatgatgatccacttcatcatga

SEQ ID NO: 18076 - DNA, 25 bp, E. coli
tcctttcgccctgaattcagtctat

SEQ ID NO: 18077 - DNA, 25 bp, E. coli
tcctttcgccctcaattcagtctat

SEQ ID NO: 18078 - DNA, 25 bp, E. coli
acgatgatgatcgacttcatcatga

SEQ ID NO: 18079 - DNA, 25 bp, E. coli
atgatgatccacttcatcatgaccc

SEQ ID NO: 18080 - DNA, 25 bp, E. coli
atgatgatccacatcatcatgaccc

SEQ ID NO: 18081 - DNA, 25 bp, E. coli
tgatccacttcatcatgaccctttc

SEQ ID NO: 18082 - DNA, 25 bp, E. coli
tgatccacttcaacatgaccctttc

SEQ ID NO: 18083 - DNA, 25 bp, E. coli
tgatgatccacttcatcatgaccct

SEQ ID NO: 18084 - DNA, 25 bp, E. coli
tgactaagagcagcacgatgatgat

SEQ ID NO: 18085 - DNA, 25 bp, E. coli
tgactaagagcaccacgatgatgat

SEQ ID NO: 18086 - DNA, 25 bp, E. coli
tgatgatccactacatcatgaccct

SEQ ID NO: 18087 - DNA, 25 bp, E. coli
tcatgaccctttccttatttaaggc

SEQ ID NO: 18088 - DNA, 25 bp, E. coli
tcatgaccctttgcttatttaaggc

SEQ ID NO: 18089 - DNA, 25 bp, E. coli
gcaccacgatgaagatccacttcat

SEQ ID NO: 18090 - DNA, 25 bp, E. coli
gcaccacgatgatgatccacttcat

SEQ ID NO: 18091 - DNA, 25 bp, E. coli
cgccctgaattcagtctatcgctga

SEQ ID NO: 18092 - DNA, 25 bp, E. coli
cgccctgaattctgtctatcgctga

SEQ ID NO: 18093 - DNA, 25 bp, E. coli
caagattcatgtggttccgatgtcg

SEQ ID NO: 18094 - DNA, 25 bp, E. coli
caagattcatgtcgttccgatgtcg

SEQ ID NO: 18095 - DNA, 25 bp, E. coli
tggtcagccgccaatgcgactgaac

SEQ ID NO: 18096 - DNA, 25 bp, E. coli
tcccgtttttacctgccgaccagat

SEQ ID NO: 18097 - DNA, 25 bp, E. coli
tcccgtttttacgtgccgaccagat

SEQ ID NO: 18098 - DNA, 25 bp, E. coli
gcctatgcgactgaacttgcaaaaa

SEQ ID NO: 18099 - DNA, 25 bp, E. coli
gcctatgcgactcaacttgcaaaaa

SEQ ID NO: 18100 - DNA, 25 bp, E. coli
gaagaagtcaatctgtgagaacgct

SEQ ID NO: 18101 - DNA, 25 bp, E. coli
gaagaagtcaatgtgtgagaacgct

SEQ ID NO: 18102 - DNA, 25 bp, E. coli
gactgaacttgctaaaatgtttgat

SEQ ID NO: 18103 - DNA, 25 bp, E. coli
gactgaacttgcaaaaatgtttgat

SEQ ID NO: 18104 - DNA, 25 bp, E. coli
ccgatgtcggaccaggttgttgaac

SEQ ID NO: 18105 - DNA, 25 bp, E. coli
ccgatgtcggacgaggttgttgaac

SEQ ID NO: 18106 - DNA, 25 bp, E. coli
gattcatgtggtaccgatgtcggac

SEQ ID NO: 18107 - DNA, 25 bp, E. coli
gattcatgtggttccgatgtcggac

SEQ ID NO: 18108 - DNA, 25 bp, E. coli
tggtcagccgcctatgcgactgaac

SEQ ID NO: 18109 - DNA, 25 bp, E. coli
tggtacgagcattagaggcaagtct

SEQ ID NO: 18110 - DNA, 25 bp, E. coli
tggtacgagcataagaggcaagtct

SEQ ID NO: 18111 - DNA, 25 bp, E. coli
tcaatctgtgagtacgctgtactgc

SEQ ID NO: 18112 - DNA, 25 bp, E. coli
taagaggcaagtgtggtcagccgcc

SEQ ID NO: 18113 - DNA, 25 bp, E. coli
taagaggcaagtctggtcagccgcc

SEQ ID NO: 18114 - DNA, 25 bp, E. coli
tcaatctgtgagaacgctgtactgc

SEQ ID NO: 18115 - DNA, 25 bp, E. coli
caactgttaagtgatgcgcttggcg

SEQ ID NO: 18116 - DNA, 25 bp, E. coli
caactgttaagtcatgcgcttggcg

SEQ ID NO: 18117 - DNA, 25 bp, E. coli
acccattctggtcaacggtgcggaa

SEQ ID NO: 18118 - DNA, 25 bp, E. coli
acccattctggtgaacggtgcggaa

SEQ ID NO: 18119 - DNA, 25 bp, E. coli
tatttctcacgatctgcgtacgcca

SEQ ID NO: 18120 - DNA, 25 bp, E. coli
tatttctcacgaactgcgtacgcca

SEQ ID NO: 18121 - DNA, 25 bp, E. coli
tgattgtcgccctggcaacgttact

SEQ ID NO: 18122 - DNA, 25 bp, E. coli
tgattgtcgcccaggcaacgttact

SEQ ID NO: 18123 - DNA, 25 bp, E. coli
tgaagatgaactgggcaaactggcg

SEQ ID NO: 18124 - DNA, 25 bp, E. coli
tgaagatgaactcggcaaactggcg

SEQ ID NO: 18125 - DNA, 25 bp, E. coli
tcttgctgatcagtatgcactgggc

SEQ ID NO: 18126 - DNA, 25 bp, E. coli
tcttgctgatcactatgcactgggc

SEQ ID NO: 18127 - DNA, 25 bp, E. coli
tctttacaggcggaggtcggtacac

SEQ ID NO: 18128 - DNA, 25 bp, E. coli
tctttacaggcgcaggtcggtacac

SEQ ID NO: 18129 - DNA, 25 bp, E. coli
gcgtaacgcccaccagtgaagatga

SEQ ID NO: 18130 - DNA, 25 bp, E. coli
gcgtaacgcccagcagtgaagatga

SEQ ID NO: 18131 - DNA, 25 bp, E. coli
cgcttggcgagcagtatgcgcagca

SEQ ID NO: 18132 - DNA, 25 bp, E. coli
cgcttggcgagctgtatgcgcagca

SEQ ID NO: 18133 - DNA, 25 bp, E. coli
gggcgatttcactacccgcgtaacg

SEQ ID NO: 18134 - DNA, 25 bp, E. coli
gggcgatttcacaacccgcgtaacg

SEQ ID NO: 18135 - DNA, 25 bp, E. coli
tcaatttcgataaacaacagcggca

SEQ ID NO: 18136 - DNA, 25 bp, E. coli
tcaatttcgatatacaacagcggca

SEQ ID NO: 18137 - DNA, 25 bp, E. coli
tacagtacatccagtgacaacaaag

SEQ ID NO: 18138 - DNA, 25 bp, E. coli
tacagtacatcctgtgacaacaaag

SEQ ID NO: 18139 - DNA, 25 bp, E. coli
tgcctattttcgaagttaacggatc

SEQ ID NO: 18140 - DNA, 25 bp, E. coli
tgcctattttcgtagttaacggatc

SEQ ID NO: 18141 - DNA, 25 bp, E. coli
tccagtgacaacaaagatcaaccct

SEQ ID NO: 18142 - DNA, 25 bp, E. coli
tccagtgacaactaagatcaaccct

SEQ ID NO: 18143 - DNA, 25 bp, E. coli
tcaatccagcccctgtgagttactg

SEQ ID NO: 18144 - DNA, 25 bp, E. coli
tcttgccccttaagaataagttgcc

SEQ ID NO: 18145 - DNA, 25 bp, E. coli
tcttgccccttatgaataagttgcc

SEQ ID NO: 18146 - DNA, 25 bp, E. coli
tcaatccagcccgtgtgagttactg

SEQ ID NO: 18147 - DNA, 25 bp, E. coli
cctgtgagttactgtatggatgtac

SEQ ID NO: 18148 - DNA, 25 bp, E. coli
cctgtgagttacagtatggatgtac

SEQ ID NO: 18149 - DNA, 25 bp, E. coli
gaaaacataaataaatcttgcccct

SEQ ID NO: 18150 - DNA, 25 bp, E. coli
gaaaacataaattaatcttgcccct

SEQ ID NO: 18151 - DNA, 25 bp, E. coli
gaaagagcctcggaaattttgtcgt

SEQ ID NO: 18152 - DNA, 25 bp, E. coli
gaaagagcctcgcaaattttgtcgt

SEQ ID NO: 18153 - DNA, 25 bp, E. coli
tttgtcgttggtgacgggaaaacat

SEQ ID NO: 18154 - DNA, 25 bp, E. coli
tttgtcgttggtcacgggaaaacat

SEQ ID NO: 18155 - DNA, 25 bp, E. coli
taacggatccgttaatgtgaatcat

SEQ ID NO: 18156 - DNA, 25 bp, E. coli
taacggatccgtaaatgtgaatcat

SEQ ID NO: 18157 - DNA, 25 bp, E. coli
gatcaaccctattttcggaaagagc

SEQ ID NO: 18158 - DNA, 25 bp, E. coli
gatcaaccctatattcggaaagagc

SEQ ID NO: 18159 - DNA, 25 bp, E. coli
caccattgagctcttaagcattgaa

SEQ ID NO: 18160 - DNA, 25 bp, E. coli
caccattgagctgttaagcattgaa

SEQ ID NO: 18161 - DNA, 25 bp, E. coli
tgaaagtatcaaacgttgtgtcgcg

SEQ ID NO: 18162 - DNA, 25 bp, E. coli
tgaaagtatcaatcgttgtgtcgcg

SEQ ID NO: 18163 - DNA, 25 bp, E. coli
ccgacgagaattcggtgagcaatcg

SEQ ID NO: 18164 - DNA, 25 bp, E. coli
gcaatcgctggtcctggtagcttca

SEQ ID NO: 18165 - DNA, 25 bp, E. coli
gcaatcgctggtgctggtagcttca

SEQ ID NO: 18166 - DNA, 25 bp, E. coli
gaaaaagagcttcagagcggagaat

SEQ ID NO: 18167 - DNA, 25 bp, E. coli
gaaaaagagcttgagagcggagaat

SEQ ID NO: 18168 - DNA, 25 bp, E. coli
cccgctttgcggtggaaaaagagct

SEQ ID NO: 18169 - DNA, 25 bp, E. coli
ccgacgagaattgggtgagcaatcg

SEQ ID NO: 18170 - DNA, 25 bp, E. coli
cccgctttgcggaggaaaaagagct

SEQ ID NO: 18171 - DNA, 25 bp, E. coli
cggatgtgcctctctcgcgaaggta

SEQ ID NO: 18172 - DNA, 25 bp, E. coli
cggatgtgcctcactcgcgaaggta

SEQ ID NO: 18173 - DNA, 25 bp, E. coli
cggcgaatatcgctgtcagttactt

SEQ ID NO: 18174 - DNA, 25 bp, E. coli
cggcgaatatcggtgtcagttactt

SEQ ID NO: 18175 - DNA, 25 bp, E. coli
gtgtcagttactagccccgctttgc

SEQ ID NO: 18176 - DNA, 25 bp, E. coli
gtgtcagttacttgccccgctttgc

SEQ ID NO: 18177 - DNA, 25 bp, E. coli
tcactcgcgaaggtaaaaagctgct

SEQ ID NO: 18178 - DNA, 25 bp, E. coli
tcaccagagtgaaggatacccttcg

SEQ ID NO: 18179 - DNA, 25 bp, E. coli
tcactcgcgaagctaaaaagctgct

SEQ ID NO: 18180 - DNA, 25 bp, E. coli
tcaccagagtgatggatacccttcg

SEQ ID NO: 18181 - DNA, 25 bp, E. coli
taaaagccatccagatgttgggcca

SEQ ID NO: 18182 - DNA, 25 bp, E. coli
taaaagccatcctgatgttgggcca

SEQ ID NO: 18183 - DNA, 25 bp, E. coli
tagtttattgttgcaggcatccaag

SEQ ID NO: 18184 - DNA, 25 bp, E. coli
tagtttattgttccaggcatccaag

SEQ ID NO: 18185 - DNA, 25 bp, E. coli
ttataaaatagtagcggtggatcct

SEQ ID NO: 18186 - DNA, 25 bp, E. coli
ttataaaatagttgcggtggatcct

SEQ ID NO: 18187 - DNA, 25 bp, E. coli
tgttgggccacattcaattcatatg

SEQ ID NO: 18188 - DNA, 25 bp, E. coli
tgtatatacgttacaacgggctgca

SEQ ID NO: 18189 - DNA, 25 bp, E. coli
tgttgggccacaatcaattcatatg

SEQ ID NO: 18190 - DNA, 25 bp, E. coli
tgtatatacgtttcaacgggctgca

SEQ ID NO: 18191 - DNA, 25 bp, E. coli
tgctcaaaaggacgtacggcagccg

SEQ ID NO: 18192 - DNA, 25 bp, E. coli
tgctcaaaaggaggtacggcagccg

SEQ ID NO: 18193 - DNA, 25 bp, E. coli
gctgatatcggaggaattactggct

SEQ ID NO: 18194 - DNA, 25 bp, E. coli
gctgatatcggacgaattactggct

SEQ ID NO: 18195 - DNA, 25 bp, E. coli
cggcagccgtttttcatggattaac

SEQ ID NO: 18196 - DNA, 25 bp, E. coli
cggcagccgtttatcatggattaac

SEQ ID NO: 18197 - DNA, 25 bp, E. coli
gatgtcgtacttaatggatgctcaa

SEQ ID NO: 18198 - DNA, 25 bp, E. coli
gagataaaaaacctctggattccag

SEQ ID NO: 18199 - DNA, 25 bp, E. coli
gagataaaaaacgtctggattccag

SEQ ID NO: 18200 - DNA, 25 bp, E. coli
gagggagtttttgctcagccaaagg

SEQ ID NO: 18201 - DNA, 25 bp, E. coli
gagggagtttttcctcagccaaagg

SEQ ID NO: 18202 - DNA, 25 bp, E. coli
gatgtcgtactttatggatgctcaa

SEQ ID NO: 18203 - DNA, 25 bp, E. coli
acgctttcggaagagacgccggacg

SEQ ID NO: 18204 - DNA, 25 bp, E. coli
acgctttcggaacagacgccggacg

SEQ ID NO: 18205 - DNA, 25 bp, E. coli
tattgtctccggcattagcgacggt

SEQ ID NO: 18206 - DNA, 25 bp, E. coli
tattgtctccgggattagcgacggt

SEQ ID NO: 18207 - DNA, 25 bp, E. coli
ttcgatttagttaccgccacagcgt

SEQ ID NO: 18208 - DNA, 25 bp, E. coli
ttcgatttagtttccgccacagcgt

SEQ ID NO: 18209 - DNA, 25 bp, E. coli
tgatttcaggtcgacacgaccgcaa

SEQ ID NO: 18210 - DNA, 25 bp, E. coli
tgtatgatggtgtcagaacgccggt

SEQ ID NO: 18211 - DNA, 25 bp, E. coli
tgatttcaggtccacacgaccgcaa

SEQ ID NO: 18212 - DNA, 25 bp, E. coli
tgtatgatggtgacagaacgccggt

SEQ ID NO: 18213 - DNA, 25 bp, E. coli
tcgcaaagtgcccttgtatgatggt

SEQ ID NO: 18214 - DNA, 25 bp, E. coli
tcgcaaagtgccgttgtatgatggt

SEQ ID NO: 18215 - DNA, 25 bp, E. coli
gccacagcgttaattaacttcggtg

SEQ ID NO: 18216 - DNA, 25 bp, E. coli
gccacagcgttatttaacttcggtg

SEQ ID NO: 18217 - DNA, 25 bp, E. coli
gaaattgcgctgtacgtcggcggca

SEQ ID NO: 18218 - DNA, 25 bp, E. coli
gaaattgcgctgaacgtcggcggca

SEQ ID NO: 18219 - DNA, 25 bp, E. coli
cgaccgcaaaccatattacgcaggg

SEQ ID NO: 18220 - DNA, 25 bp, E. coli
cgaccgcaaaccttattacgcaggg

SEQ ID NO: 18221 - DNA, 25 bp, E. coli
gattgtcgcgttctcggcgctgttc

SEQ ID NO: 18222 - DNA, 25 bp, E. coli
gattgtcgcgttgtcggcgctgttc

SEQ ID NO: 18223 - DNA, 25 bp, E. coli
tcacgccgatgagcgtatttgatac

SEQ ID NO: 18224 - DNA, 25 bp, E. coli
tcacgccgatgaccgtatttgatac

SEQ ID NO: 18225 - DNA, 25 bp, E. coli
catgagcgagccttcagtgtactga

SEQ ID NO: 18226 - DNA, 25 bp, E. coli
catgagcgagccatcagtgtactga

SEQ ID NO: 18227 - DNA, 25 bp, E. coli
caacgggagccggactttattgata

SEQ ID NO: 18228 - DNA, 25 bp, E. coli
caacgggagccgcactttattgata

SEQ ID NO: 18229 - DNA, 25 bp, E. coli
tgttaaggccgcgacagcttttcgc

SEQ ID NO: 18230 - DNA, 25 bp, E. coli
tgttaaggccgccacagcttttcgc

SEQ ID NO: 18231 - DNA, 25 bp, E. coli
tgaacgccgctcataaaggactggc

SEQ ID NO: 18232 - DNA, 25 bp, E. coli
tgctgtgtggcatgacttctccggc

SEQ ID NO: 18233 - DNA, 25 bp, E. coli
tgaacgccgctcttaaaggactggc

SEQ ID NO: 18234 - DNA, 25 bp, E. coli
tgctgtgtggcaagacttctccggc

SEQ ID NO: 18235 - DNA, 25 bp, E. coli
tccggctctctgcatacggcagaag

SEQ ID NO: 18236 - DNA, 25 bp, E. coli
tccggctctctggatacggcagaag

SEQ ID NO: 18237 - DNA, 25 bp, E. coli
gaagtgcttgatgcatacgacgctg

SEQ ID NO: 18238 - DNA, 25 bp, E. coli
gaagtgcttgatccatacgacgctg

SEQ ID NO: 18239 - DNA, 25 bp, E. coli
cgccatcaggatgcggttatgctca

SEQ ID NO: 18240 - DNA, 25 bp, E. coli
cgccatcaggatccggttatgctca

SEQ ID NO: 18241 - DNA, 25 bp, E. coli
ggttcagagctgatacgcaccggcg

SEQ ID NO: 18242 - DNA, 25 bp, E. coli
ggttcagagctgttacgcaccggcg

SEQ ID NO: 18243 - DNA, 25 bp, E. coli
ggcaggtaatcgaatcatcccggaa

SEQ ID NO: 18244 - DNA, 25 bp, E. coli
tggatgcatcccgaaaaccggcctt

SEQ ID NO: 18245 - DNA, 25 bp, E. coli
ggcaggtaatcgtatcatcccggaa

SEQ ID NO: 18246 - DNA, 25 bp, E. coli
tggatgcatccccaaaaccggcctt

SEQ ID NO: 18247 - DNA, 25 bp, E. coli
tacgctgatgcaacggatgggtgac

SEQ ID NO: 18248 - DNA, 25 bp, E. coli
tactggacagtcagaacaacggcgt

SEQ ID NO: 18249 - DNA, 25 bp, E. coli
tactggacagtctgaacaacggcgt

SEQ ID NO: 18250 - DNA, 25 bp, E. coli
tacgctgatgcatcggatgggtgac

SEQ ID NO: 18251 - DNA, 25 bp, E. coli
tatgtgaagactcgcgctatccgcg

SEQ ID NO: 18252 - DNA, 25 bp, E. coli
tatgtgaagactggcgctatccgcg

SEQ ID NO: 18253 - DNA, 25 bp, E. coli
tattggctcaactcatgcatcgccg

SEQ ID NO: 18254 - DNA, 25 bp, E. coli
tatctcgaagcggattacacgcagg

SEQ ID NO: 18255 - DNA, 25 bp, E. coli
tatctcgaagcgcattacacgcagg

SEQ ID NO: 18256 - DNA, 25 bp, E. coli
tattggctcaacacatgcatcgccg

SEQ ID NO: 18257 - DNA, 25 bp, E. coli
tgaatcactacgaatcgctgctggg

SEQ ID NO: 18258 - DNA, 25 bp, E. coli
tgaatcactacgtatcgctgctggg

SEQ ID NO: 18259 - DNA, 25 bp, E. coli
tcgttataaaaggatcgcgccagaa

SEQ ID NO: 18260 - DNA, 25 bp, E. coli
tcgttataaaagcatcgcgccagaa

SEQ ID NO: 18261 - DNA, 25 bp, E. coli
tctgttgaacaactcccgggagaag

SEQ ID NO: 18262 - DNA, 25 bp, E. coli
tctgttgaacaagtcccgggagaag

SEQ ID NO: 18263 - DNA, 25 bp, E. coli
gaatgagcatctccctggaagccgg

SEQ ID NO: 18264 - DNA, 25 bp, E. coli
gaatgagcatctgcctggaagccgg

SEQ ID NO: 18265 - DNA, 25 bp, E. coli
cgtattggctatgcgcaaccagggc

SEQ ID NO: 18266 - DNA, 25 bp, E. coli
cgtattggctatccgcaaccagggc

SEQ ID NO: 18267 - DNA, 25 bp, E. coli
taactgggagctatacgcttccggg

SEQ ID NO: 18268 - DNA, 25 bp, E. coli
taactgggagctttacgcttccggg

SEQ ID NO: 18269 - DNA, 25 bp, E. coli
tactgttgtcatgctcaagcctcgg

SEQ ID NO: 18270 - DNA, 25 bp, E. coli
tactgttgtcatcctcaagcctcgg

SEQ ID NO: 18271 - DNA, 25 bp, E. coli
aaaaggcttattgaccctgacgacg

SEQ ID NO: 18272 - DNA, 25 bp, E. coli
aaaattgcccaagttgccgtgccgg

SEQ ID NO: 18273 - DNA, 25 bp, E. coli
aaaaggcttattcaccctgacgacg

SEQ ID NO: 18274 - DNA, 25 bp, E. coli
aaaattgcccaacttgccgtgccgg

SEQ ID NO: 18275 - DNA, 25 bp, E. coli
tatgtggcaaccgataccgaagtgg

SEQ ID NO: 18276 - DNA, 25 bp, E. coli
tatgtggcaacccataccgaagtgg

SEQ ID NO: 18277 - DNA, 25 bp, E. coli
tatcaagagtcagtgttagcccagg

SEQ ID NO: 18278 - DNA, 25 bp, E. coli
tatcaagagtcactgttagcccagg

SEQ ID NO: 18279 - DNA, 25 bp, E. coli
tgggtatcctttgcgccatcgtagg

SEQ ID NO: 18280 - DNA, 25 bp, E. coli
tgggtatcctttccgccatcgtagg

SEQ ID NO: 18281 - DNA, 25 bp, E. coli
ccaaatggcagaataccgtggcgct

SEQ ID NO: 18282 - DNA, 25 bp, E. coli
ccaaatggcagattaccgtggcgct

SEQ ID NO: 18283 - DNA, 25 bp, E. coli
gacttactggctcaacatggactgg

SEQ ID NO: 18284 - DNA, 25 bp, E. coli
gacttactggctgaacatggactgg

SEQ ID NO: 18285 - DNA, 25 bp, E. coli
cattagcgtgggagaaaaagcccgc

SEQ ID NO: 18286 - DNA, 25 bp, E. coli
cattagcgtgggtgaaaaagcccgc

SEQ ID NO: 18287 - DNA, 25 bp, E. coli
tggttgccacacagcctgatttcgg

SEQ ID NO: 18288 - DNA, 25 bp, E. coli
tggttgccacactgcctgatttcgg

SEQ ID NO: 18289 - DNA, 25 bp, E. coli
taacgcgggcaatatgttccagggc

SEQ ID NO: 18290 - DNA, 25 bp, E. coli
taacgcgggcaaaatgttccagggc

SEQ ID NO: 18291 - DNA, 25 bp, E. coli
cagctttatgttcaaaacgcaccag

SEQ ID NO: 18292 - DNA, 25 bp, E. coli
cactggctgttagcgctaatggcgt

SEQ ID NO: 18293 - DNA, 25 bp, E. coli
cagctttatgttgaaaacgcaccag

SEQ ID NO: 18294 - DNA, 25 bp, E. coli
cactggctgttaccgctaatggcgt

SEQ ID NO: 18295 - DNA, 25 bp, E. coli
catcgcattatgtgtcgccagcttt

SEQ ID NO: 18296 - DNA, 25 bp, E. coli
catcgcattatgagtcgccagcttt

SEQ ID NO: 18297 - DNA, 25 bp, E. coli
tatggaccgcctggaacggcatgat

SEQ ID NO: 18298 - DNA, 25 bp, E. coli
taccgcgctttaagccgatatgtcg

SEQ ID NO: 18299 - DNA, 25 bp, E. coli
taccgcgctttatgccgatatgtcg

SEQ ID NO: 18300 - DNA, 25 bp, E. coli
tatggaccgcctcgaacggcatgat

SEQ ID NO: 18301 - DNA, 25 bp, E. coli
tttggcttagcggataacggcctgc

SEQ ID NO: 18302 - DNA, 25 bp, E. coli
tttggcttagcgcataacggcctgc

SEQ ID NO: 18303 - DNA, 25 bp, E. coli
ttaatggctggtcaatggctgctgc

SEQ ID NO: 18304 - DNA, 25 bp, E. coli
ttaatggctggtgaatggctgctgc

SEQ ID NO: 18305 - DNA, 25 bp, E. coli
tcaggtgatgaatagagatcgcgca

SEQ ID NO: 18306 - DNA, 25 bp, E. coli
tcaggtgatgaaaagagatcgcgca

SEQ ID NO: 18307 - DNA, 25 bp, E. coli
gcggctttttcaacattaacggtgg

SEQ ID NO: 18308 - DNA, 25 bp, E. coli
gcggctttttcatcattaacggtgg

SEQ ID NO: 18309 - DNA, 25 bp, E. coli
cgtcgctgtcgtcggcatcgcatta

SEQ ID NO: 18310 - DNA, 25 bp, E. coli
cgtcgctgtcgtgggcatcgcatta

SEQ ID NO: 18311 - DNA, 25 bp, E. coli
gtggaattgcccactttaccgcgct

SEQ ID NO: 18312 - DNA, 25 bp, E. coli
gtggaattgccctctttaccgcgct

SEQ ID NO: 18313 - DNA, 25 bp, E. coli
caaaacgtgaggacagcgtcgatgt

SEQ ID NO: 18314 - DNA, 25 bp, E. coli
caaaacgtgaggtcagcgtcgatgt

SEQ ID NO: 18315 - DNA, 25 bp, E. coli
tacatggcgtgatttggcggatgcc

SEQ ID NO: 18316 - DNA, 25 bp, E. coli
tacatggcgtgaattggcggatgcc

SEQ ID NO: 18317 - DNA, 25 bp, E. coli
aaagcgaagttcatcgcagccagaa

SEQ ID NO: 18318 - DNA, 25 bp, E. coli
aaagcgaagttcttcgcagccagaa

SEQ ID NO: 18319 - DNA, 25 bp, E. coli
cctgctggcggccatcaatgaaatt

SEQ ID NO: 18320 - DNA, 25 bp, E. coli
cctgctggcggcgatcaatgaaatt

SEQ ID NO: 18321 - DNA, 25 bp, E. coli
gcagccagaacgattctgaacacgt

SEQ ID NO: 18322 - DNA, 25 bp, E. coli
gcgtcgatgtcgttgccctgctggc

SEQ ID NO: 18323 - DNA, 25 bp, E. coli
gcagccagaacgtttctgaacacgt

SEQ ID NO: 18324 - DNA, 25 bp, E. coli
gcgtcgatggacctgaatatcatac

SEQ ID NO: 18325 - DNA, 25 bp, E. coli
gcgtcgatgtcgatgccctgctggc

SEQ ID NO: 18326 - DNA, 25 bp, E. coli
gcgtcgatggacgtgaatatcatac

SEQ ID NO: 18327 - DNA, 25 bp, E. coli
ggcggatgccttggaactggatatt

SEQ ID NO: 18328 - DNA, 25 bp, E. coli
ggcggatgccttcgaactggatatt

SEQ ID NO: 18329 - DNA, 25 bp, E. coli
tcaatgaaattagcgaaagcgaagt

SEQ ID NO: 18330 - DNA, 25 bp, E. coli
tcaatgaaattaccgaaagcgaagt

SEQ ID NO: 18331 - DNA, 25 bp, E. coli
gagtacagcgataccgcaaaacgtg

SEQ ID NO: 18332 - DNA, 25 bp, E. coli
gatgaaaaccgctaaagagtacagc

SEQ ID NO: 18333 - DNA, 25 bp, E. coli
gagtacagcgattccgcaaaacgtg

SEQ ID NO: 18334 - DNA, 25 bp, E. coli
gatgaaaaccgcaaaagagtacagc

SEQ ID NO: 18335 - DNA, 25 bp, E. coli
cagccgcattaaacgccaaagcgaa

SEQ ID NO: 18336 - DNA, 25 bp, E. coli
cagccgcattaatcgccaaagcgaa

SEQ ID NO: 18337 - DNA, 25 bp, E. coli
taacagccgcataaaacgccaaagc

SEQ ID NO: 18338 - DNA, 25 bp, E. coli
acgccaaagcgaacaatggcaactg

SEQ ID NO: 18339 - DNA, 25 bp, E. coli
agccgcattaaacgccaaagcgaac

SEQ ID NO: 18340 - DNA, 25 bp, E. coli
agccgcattaaaggccaaagcgaac

SEQ ID NO: 18341 - DNA, 25 bp, E. coli
aaacgccaaagccaacaatggcaac

SEQ ID NO: 18342 - DNA, 25 bp, E. coli
aacagccgcattaaacgccaaagcg

SEQ ID NO: 18343 - DNA, 25 bp, E. coli
acgccaaagcgatcaatggcaactg

SEQ ID NO: 18344 - DNA, 25 bp, E. coli
aacagccgcatttaacgccaaagcg

SEQ ID NO: 18345 - DNA, 25 bp, E. coli
aaacgccaaagcgaacaatggcaac

SEQ ID NO: 18346 - DNA, 25 bp, E. coli
ttaaacgccaaaccgaacaatggca

SEQ ID NO: 18347 - DNA, 25 bp, E. coli
ttaacagccgcattaaacgccaaag

SEQ ID NO: 18348 - DNA, 25 bp, E. coli
ttaacagccgcaataaacgccaaag

SEQ ID NO: 18349 - DNA, 25 bp, E. coli
ttaaacgccaaagcgaacaatggca

SEQ ID NO: 18350 - DNA, 25 bp, E. coli
cgcattaaacgccaaagcgaacaat

SEQ ID NO: 18351 - DNA, 25 bp, E. coli
cgcattaaacgcgaaagcgaacaat

SEQ ID NO: 18352 - DNA, 25 bp, E. coli
ctttaacagccggattaaacgccaa

SEQ ID NO: 18353 - DNA, 25 bp, E. coli
cattaaacgccaaagcgaacaatgg

SEQ ID NO: 18354 - DNA, 25 bp, E. coli
ctttaacagccgcattaaacgccaa

SEQ ID NO: 18355 - DNA, 25 bp, E. coli
cattaaacgccatagcgaacaatgg

SEQ ID NO: 18356 - DNA, 25 bp, E. coli
taacagccgcattaaacgccaaagc

SEQ ID NO: 18357 - DNA, 25 bp, E. coli
catctttaaagaatatacaggcaga

SEQ ID NO: 18358 - DNA, 25 bp, E. coli
catctttaaagattatacaggcaga

SEQ ID NO: 18359 - DNA, 25 bp, E. coli
taaatgcctgactttgctgcgccag

SEQ ID NO: 18360 - DNA, 25 bp, E. coli
tacaggcagaaatatttcattgaac

SEQ ID NO: 18361 - DNA, 25 bp, E. coli
tacaggcagaaaaatttcattgaac

SEQ ID NO: 18362 - DNA, 25 bp, E. coli
taaatgcctgacattgctgcgccag

SEQ ID NO: 18363 - DNA, 25 bp, E. coli
aacataactcctattgctatcggcg

SEQ ID NO: 18364 - DNA, 25 bp, E. coli
aacataactccttttgctatcggcg

SEQ ID NO: 18365 - DNA, 25 bp, E. coli
tataaccttatcgttgtaacaagta

SEQ ID NO: 18366 - DNA, 25 bp, E. coli
tataatgcgtgagtgttacataagt

SEQ ID NO: 18367 - DNA, 25 bp, E. coli
tataaccttatccttgtaacaagta

SEQ ID NO: 18368 - DNA, 25 bp, E. coli
tataatgcgtgactgttacataagt

SEQ ID NO: 18369 - DNA, 25 bp, E. coli
tgttcaacccagacaaatgttattt

SEQ ID NO: 18370 - DNA, 25 bp, E. coli
tgttcaacccagtcaaatgttattt

SEQ ID NO: 18371 - DNA, 25 bp, E. coli
gctatcggcgttttgttcaacccag

SEQ ID NO: 18372 - DNA, 25 bp, E. coli
gctatcggcgttatgttcaacccag

SEQ ID NO: 18373 - DNA, 25 bp, E. coli
cattgaacattaaatagactgaact

SEQ ID NO: 18374 - DNA, 25 bp, E. coli
cattgaacattatatagactgaact

SEQ ID NO: 18375 - DNA, 25 bp, E. coli
gtattcaaaagagtataaatgcctg

SEQ ID NO: 18376 - DNA, 25 bp, E. coli
gtattcaaaagactataaatgcctg

SEQ ID NO: 18377 - DNA, 25 bp, E. coli
ggcgagtcagaaaacgaggtgattt

SEQ ID NO: 18378 - DNA, 25 bp, E. coli
ggcgagtcagaatacgaggtgattt

SEQ ID NO: 18379 - DNA, 25 bp, E. coli
aattggttgctcgatgacattcccg

SEQ ID NO: 18380 - DNA, 25 bp, E. coli
aattggttgctccatgacattcccg

SEQ ID NO: 18381 - DNA, 25 bp, E. coli
cacgctgtgtctggacgtgcgcaaa

SEQ ID NO: 18382 - DNA, 25 bp, E. coli
cacgctgtgtctcgacgtgcgcaaa

SEQ ID NO: 18383 - DNA, 25 bp, E. coli
cagttttggcgattcaggcgtgttc

SEQ ID NO: 18384 - DNA, 25 bp, E. coli
cagtcagacggatcagcattgccag

SEQ ID NO: 18385 - DNA, 25 bp, E. coli
cagtcagacggaacagcattgccag

SEQ ID NO: 18386 - DNA, 25 bp, E. coli
cagttttggcgaatcaggcgtgttc

SEQ ID NO: 18387 - DNA, 25 bp, E. coli
tactcgcggacaagctgattatctg

SEQ ID NO: 18388 - DNA, 25 bp, E. coli
tactcgcggacatgctgattatctg

SEQ ID NO: 18389 - DNA, 25 bp, E. coli
gccagtcgctattgcccaacgtttg

SEQ ID NO: 18390 - DNA, 25 bp, E. coli
gccagtcgctatagcccaacgtttg

SEQ ID NO: 18391 - DNA, 25 bp, E. coli
gcgtgttccttgtcgagcatggcga

SEQ ID NO: 18392 - DNA, 25 bp, E. coli
gctggttgctggtacattacccgct

SEQ ID NO: 18393 - DNA, 25 bp, E. coli
gcgtgttccttgacgagcatggcga

SEQ ID NO: 18394 - DNA, 25 bp, E. coli
gctggttgctggaacattacccgct

SEQ ID NO: 18395 - DNA, 25 bp, E. coli
cattacatcatcgagaggaacacta

SEQ ID NO: 18396 - DNA, 25 bp, E. coli
cattacatcatccagaggaacacta

SEQ ID NO: 18397 - DNA, 25 bp, E. coli
gatgggtcagcgtgtcactttgcaa

SEQ ID NO: 18398 - DNA, 25 bp, E. coli
gagatcgccgcatcacttactcgcg

SEQ ID NO: 18399 - DNA, 25 bp, E. coli
gatgggtcagcgagtcactttgcaa

SEQ ID NO: 18400 - DNA, 25 bp, E. coli
gagatcgccgcaacacttactcgcg

SEQ ID NO: 18401 - DNA, 25 bp, E. coli
caagattctggcctaccgttcctgt

SEQ ID NO: 18402 - DNA, 25 bp, E. coli
caagattctggcgtaccgttcctgt

SEQ ID NO: 18403 - DNA, 25 bp, E. coli
tatcttctgctggtggttcgttcgg

SEQ ID NO: 18404 - DNA, 25 bp, E. coli
tacgctttcaggacagaagggttct

SEQ ID NO: 18405 - DNA, 25 bp, E. coli
tacgctttcaggtcagaagggttct

SEQ ID NO: 18406 - DNA, 25 bp, E. coli
tattcaaagcaaacaggcgaatccg

SEQ ID NO: 18407 - DNA, 25 bp, E. coli
tatcttctgctgctggttcgttcgg

SEQ ID NO: 18408 - DNA, 25 bp, E. coli
tattcaaagcaatcaggcgaatccg

SEQ ID NO: 18409 - DNA, 25 bp, E. coli
tgataattccgcaccttctggtggt

SEQ ID NO: 18410 - DNA, 25 bp, E. coli
tgataattccgctccttctggtggt

SEQ ID NO: 18411 - DNA, 25 bp, E. coli
tgttttagggctatcagttcgcgca

SEQ ID NO: 18412 - DNA, 25 bp, E. coli
tgttttagggctttcagttcgcgca

SEQ ID NO: 18413 - DNA, 25 bp, E. coli
tcaaagcaaccatagtacgcgccct

SEQ ID NO: 18414 - DNA, 25 bp, E. coli
tcaaagcaaccaaagtacgcgccct

SEQ ID NO: 18415 - DNA, 25 bp, E. coli
gaagggttctatctctgttggccag

SEQ ID NO: 18416 - DNA, 25 bp, E. coli
gaagggttctatgtctgttggccag

SEQ ID NO: 18417 - DNA, 25 bp, E. coli
gaaatgaataattcgcctctgcgcg

SEQ ID NO: 18418 - DNA, 25 bp, E. coli
gaaatgaataatacgcctctgcgcg

SEQ ID NO: 18419 - DNA, 25 bp, E. coli
gacagactcttttactcggtggcct

SEQ ID NO: 18420 - DNA, 25 bp, E. coli
gacagactctttaactcggtggcct

SEQ ID NO: 18421 - DNA, 25 bp, E. coli
tggatattaccaccaaggccgatag

SEQ ID NO: 18422 - DNA, 25 bp, E. coli
tggatattaccagcaaggccgatag

SEQ ID NO: 18423 - DNA, 25 bp, E. coli
aatcgaagttatatgcgcactggca

SEQ ID NO: 18424 - DNA, 25 bp, E. coli
aatcgaagttatttgcgcactggca

SEQ ID NO: 18425 - DNA, 25 bp, E. coli
catgatgaccgagagcgaatcaggg

SEQ ID NO: 18426 - DNA, 25 bp, E. coli
cttagcggtgagctctgcgtattcc

SEQ ID NO: 18427 - DNA, 25 bp, E. coli
catgatgaccgacagcgaatcaggg

SEQ ID NO: 18428 - DNA, 25 bp, E. coli
cttagcggtgaggtctgcgtattcc

SEQ ID NO: 18429 - DNA, 25 bp, E. coli
ttacttaaacgcgttagcggtgagg

SEQ ID NO: 18430 - DNA, 25 bp, E. coli
ttacttaaacgccttagcggtgagg

SEQ ID NO: 18431 - DNA, 25 bp, E. coli
tgaacaggaaagtagaacgcttatt

SEQ ID NO: 18432 - DNA, 25 bp, E. coli
tgaacaggaaagaagaacgcttatt

SEQ ID NO: 18433 - DNA, 25 bp, E. coli
tgcgcactggcagaggattaccctg

SEQ ID NO: 18434 - DNA, 25 bp, E. coli
tgcgcactggcacaggattaccctg

SEQ ID NO: 18435 - DNA, 25 bp, E. coli
tctgcgtattccagagcgatgaaca

SEQ ID NO: 18436 - DNA, 25 bp, E. coli
tctgcgtattcctgagcgatgaaca

SEQ ID NO: 18437 - DNA, 25 bp, E. coli
gaaatcacactacaacaggcagcag

SEQ ID NO: 18438 - DNA, 25 bp, E. coli
gaacgcgcccaccaaatcgaagtta

SEQ ID NO: 18439 - DNA, 25 bp, E. coli
gaaatcacactagaacaggcagcag

SEQ ID NO: 18440 - DNA, 25 bp, E. coli
gaacgcgcccacgaaatcgaagtta

SEQ ID NO: 18441 - DNA, 25 bp, E. coli
ggcaatcatcgggttacttaaacgc

SEQ ID NO: 18442 - DNA, 25 bp, E. coli
ggcaatcatcggcttacttaaacgc

SEQ ID NO: 18443 - DNA, 25 bp, E. coli
gaggattaccctcgcatgatgaccg

SEQ ID NO: 18444 - DNA, 25 bp, E. coli
gaggattaccctggcatgatgaccg

SEQ ID NO: 18445 - DNA, 25 bp, E. coli
caaattatctgtgggcagcaggtca

SEQ ID NO: 18446 - DNA, 25 bp, E. coli
caaattatctgtcggcagcaggtca

SEQ ID NO: 18447 - DNA, 25 bp, E. coli
tacacagtgtggctgctccgcatga

SEQ ID NO: 18448 - DNA, 25 bp, E. coli
tacacagtgtgggtgctccgcatga

SEQ ID NO: 18449 - DNA, 25 bp, E. coli
tatgcttacgcaagaggaccgccaa

SEQ ID NO: 18450 - DNA, 25 bp, E. coli
tatgccgagagggtcaggaaatcgc

SEQ ID NO: 18451 - DNA, 25 bp, E. coli
tatgcttacgcatgaggaccgccaa

SEQ ID NO: 18452 - DNA, 25 bp, E. coli
tatgccgagaggctcaggaaatcgc

SEQ ID NO: 18453 - DNA, 25 bp, E. coli
tattccgctggagaaagcgccaggg

SEQ ID NO: 18454 - DNA, 25 bp, E. coli
tattgaaccggaagtgccagtggcc

SEQ ID NO: 18455 - DNA, 25 bp, E. coli
tattccgctggacaaagcgccaggg

SEQ ID NO: 18456 - DNA, 25 bp, E. coli
tattgaaccggatgtgccagtggcc

SEQ ID NO: 18457 - DNA, 25 bp, E. coli
tggtgacggcaatgaacaactcttc

SEQ ID NO: 18458 - DNA, 25 bp, E. coli
tggtgacggcaaagaacaactcttc

SEQ ID NO: 18459 - DNA, 25 bp, E. coli
tctactggatcagcgaaggtccgcg

SEQ ID NO: 18460 - DNA, 25 bp, E. coli
tctactggatcaccgaaggtccgcg

SEQ ID NO: 18461 - DNA, 25 bp, E. coli
gcttatcggcagtaaacggtgtgct

SEQ ID NO: 18462 - DNA, 25 bp, E. coli
gcttatcggcagaaaacggtgtgct

SEQ ID NO: 18463 - DNA, 25 bp, E. coli
cgccctgcgactggaagaacatgag

SEQ ID NO: 18464 - DNA, 25 bp, E. coli
cgccctgcgactcgaagaacatgag

SEQ ID NO: 18465 - DNA, 25 bp, E. coli
tggaaaccagttagcagcgcagcgg

SEQ ID NO: 18466 - DNA, 25 bp, E. coli
tggaaaccagtttgcagcgcagcgg

SEQ ID NO: 18467 - DNA, 25 bp, E. coli
cacgccgattttacttagcccagac

SEQ ID NO: 18468 - DNA, 25 bp, E. coli
cacgccgatttttcttagcccagac

SEQ ID NO: 18469 - DNA, 25 bp, E. coli
cagactggtgagctaaatatcttta

SEQ ID NO: 18470 - DNA, 25 bp, E. coli
cagactggtgaggtaaatatcttta

SEQ ID NO: 18471 - DNA, 25 bp, E. coli
ttttcttagcccagactggtgagct

SEQ ID NO: 18472 - DNA, 25 bp, E. coli
ttttcttagccctgactggtgagct

SEQ ID NO: 18473 - DNA, 25 bp, E. coli
tgcgccacgccgttttttcttagcc

SEQ ID NO: 18474 - DNA, 25 bp, E. coli
tcagtttgcgccacgccgatttttc

SEQ ID NO: 18475 - DNA, 25 bp, E. coli
tgcgccacgccgatttttcttagcc

SEQ ID NO: 18476 - DNA, 25 bp, E. coli
tcagtttgcgcctcgccgatttttc

SEQ ID NO: 18477 - DNA, 25 bp, E. coli
gcccagactggtcagctaaatatct

SEQ ID NO: 18478 - DNA, 25 bp, E. coli
gcccagactggtgagctaaatatct

SEQ ID NO: 18479 - DNA, 25 bp, E. coli
gccacgccgattattcttagcccag

SEQ ID NO: 18480 - DNA, 25 bp, E. coli
gccacgccgatttttcttagcccag

SEQ ID NO: 18481 - DNA, 25 bp, E. coli
gactggtgagctaaatatctttaat

SEQ ID NO: 18482 - DNA, 25 bp, E. coli
gactggtgagcttaatatctttaat

SEQ ID NO: 18483 - DNA, 25 bp, E. coli
cgatttttcttaccccagactggtg

SEQ ID NO: 18484 - DNA, 25 bp, E. coli
cgatttttcttagcccagactggtg

SEQ ID NO: 18485 - DNA, 25 bp, E. coli
cgaggatggctctgtttgcgccacg

SEQ ID NO: 18486 - DNA, 25 bp, E. coli
cgaggatggctcagtttgcgccacg

SEQ ID NO: 18487 - DNA, 25 bp, E. coli
ggatggctcagtatgcgccacgccg

SEQ ID NO: 18488 - DNA, 25 bp, E. coli
ggatggctcagtttgcgccacgccg

SEQ ID NO: 18489 - DNA, 25 bp, E. coli
catctctgttgatgaagtgcgtgca

SEQ ID NO: 18490 - DNA, 25 bp, E. coli
catctctgttgaagaagtgcgtgca

SEQ ID NO: 18491 - DNA, 25 bp, E. coli
taaaatgcgcgcagttcaggagcaa

SEQ ID NO: 18492 - DNA, 25 bp, E. coli
taaaatgcgcgctgttcaggagcaa

SEQ ID NO: 18493 - DNA, 25 bp, E. coli
tatcgttcgtaccatggacatcggc

SEQ ID NO: 18494 - DNA, 25 bp, E. coli
tatcgttcgtacgatggacatcggc

SEQ ID NO: 18495 - DNA, 25 bp, E. coli
tgaagattatcgacctgagcgccat

SEQ ID NO: 18496 - DNA, 25 bp, E. coli
tgaagattatcgtcctgagcgccat

SEQ ID NO: 18497 - DNA, 25 bp, E. coli
tcatgctgaagggaaatggactggc

SEQ ID NO: 18498 - DNA, 25 bp, E. coli
tcatgctgaaggcaaatggactggc

SEQ ID NO: 18499 - DNA, 25 bp, E. coli
gcttgctggcgatgaacgtgctaca

SEQ ID NO: 18500 - DNA, 25 bp, E. coli
gcttgctggcgaagaacgtgctaca

SEQ ID NO: 18501 - DNA, 25 bp, E. coli
gaatacctgaaacaacgtgcggctg

SEQ ID NO: 18502 - DNA, 25 bp, E. coli
gaatacctgaaagaacgtgcggctg

SEQ ID NO: 18503 - DNA, 25 bp, E. coli
cgtgatatcggtaagcgcctgctgc

SEQ ID NO: 18504 - DNA, 25 bp, E. coli
cgtgatatcggttagcgcctgctgc

SEQ ID NO: 18505 - DNA, 25 bp, E. coli
cgtaatggtggatacaccggctgcc

SEQ ID NO: 18506 - DNA, 25 bp, E. coli
cgtaatggtggaaacaccggctgcc

SEQ ID NO: 18507 - DNA, 25 bp, E. coli
gatttaacgcagtacactctggcag

SEQ ID NO: 18508 - DNA, 25 bp, E. coli
gatttaacgcagaacactctggcag

SEQ ID NO: 18509 - DNA, 25 bp, E. coli
gacgcagctgctcatgaagttatcg

SEQ ID NO: 18510 - DNA, 25 bp, E. coli
gacgcagctgctgatgaagttatcg

SEQ ID NO: 18511 - DNA, 25 bp, E. coli
tatctcggcgcattgggcagctatc

SEQ ID NO: 18512 - DNA, 25 bp, E. coli
tatctcggcgcaatgggcagctatc

SEQ ID NO: 18513 - DNA, 25 bp, E. coli
tgctgtgccatgatctcaaccggga

SEQ ID NO: 18514 - DNA, 25 bp, E. coli
tgctgtgccatgttctcaaccggga

SEQ ID NO: 18515 - DNA, 25 bp, E. coli
tccatcaggaggaggattcatgcct

SEQ ID NO: 18516 - DNA, 25 bp, E. coli
tccatcaggaggtggattcatgcct

SEQ ID NO: 18517 - DNA, 25 bp, E. coli
tcaggctgatgaattacggacgttc

SEQ ID NO: 18518 - DNA, 25 bp, E. coli
tcaggctgatgatttacggacgttc

SEQ ID NO: 18519 - DNA, 25 bp, E. coli
gccgcgcgagaagcaaaaccctttt

SEQ ID NO: 18520 - DNA, 25 bp, E. coli
gccgcgcgagaaccaaaaccctttt

SEQ ID NO: 18521 - DNA, 25 bp, E. coli
cgtagaggcgcttatgtccggtaaa

SEQ ID NO: 18522 - DNA, 25 bp, E. coli
cgtagaggcgctaatgtccggtaaa

SEQ ID NO: 18523 - DNA, 25 bp, E. coli
gttacgtctgcaaaagctccacgag

SEQ ID NO: 18524 - DNA, 25 bp, E. coli
gttacgtctgcataagctccacgag

SEQ ID NO: 18525 - DNA, 25 bp, E. coli
ggtttgacatcgatctgccctgcgg

SEQ ID NO: 18526 - DNA, 25 bp, E. coli
ggtttgacatcgttctgccctgcgg

SEQ ID NO: 18527 - DNA, 25 bp, E. coli
taagccagagcacgcgtttctcacc

SEQ ID NO: 18528 - DNA, 25 bp, E. coli
taagccagagcaggcgtttctcacc

SEQ ID NO: 18529 - DNA, 25 bp, E. coli
gacgttctcttgtggcgcaggcaac

SEQ ID NO: 18530 - DNA, 25 bp, E. coli
gagtcttgcagcagccacaggctat

SEQ ID NO: 18531 - DNA, 25 bp, E. coli
gagtcttgcagctgccacaggctat

SEQ ID NO: 18532 - DNA, 25 bp, E. coli
gacgttctcttgaggcgcaggcaac

SEQ ID NO: 18533 - DNA, 25 bp, E. coli
aatcaacgcgctaaatagcctggcg

SEQ ID NO: 18534 - DNA, 25 bp, E. coli
aagccaggccattggagattatgtc

SEQ ID NO: 18535 - DNA, 25 bp, E. coli
aagccaggccataggagattatgtc

SEQ ID NO: 18536 - DNA, 25 bp, E. coli
aacgcgcttaattgcctggcgaaga

SEQ ID NO: 18537 - DNA, 25 bp, E. coli
aacgcgcttaatagcctggcgaaga

SEQ ID NO: 18538 - DNA, 25 bp, E. coli
aatcaacgcgcttaatagcctggcg

SEQ ID NO: 18539 - DNA, 25 bp, E. coli
caggagacacacatgaataataagg

SEQ ID NO: 18540 - DNA, 25 bp, E. coli
caggagacacacttgaataataagg

SEQ ID NO: 18541 - DNA, 25 bp, E. coli
aaaccgttacatggtgagattaagc

SEQ ID NO: 18542 - DNA, 25 bp, E. coli
acatggtgagattaagcttcccggc

SEQ ID NO: 18543 - DNA, 25 bp, E. coli
aaaccgttacatcgtgagattaagc

SEQ ID NO: 18544 - DNA, 25 bp, E. coli
acatggtgagataaagcttcccggc

SEQ ID NO: 18545 - DNA, 25 bp, E. coli
tgcgctttatgaggctaccaagtta

SEQ ID NO: 18546 - DNA, 25 bp, E. coli
tgcgctttatgacgctaccaagtta

SEQ ID NO: 18547 - DNA, 25 bp, E. coli
ccaggccattggagattatgtcctt

SEQ ID NO: 18548 - DNA, 25 bp, E. coli
ccaagttagtcaccggcaggcctgg

SEQ ID NO: 18549 - DNA, 25 bp, E. coli
ccaagttagtcagcggcaggcctgg

SEQ ID NO: 18550 - DNA, 25 bp, E. coli
ccaggccattggtgattatgtcctt

SEQ ID NO: 18551 - DNA, 25 bp, E. coli
cgcattttgatgctcgccgggttga

SEQ ID NO: 18552 - DNA, 25 bp, E. coli
cgcattttgatggtcgccgggttga

SEQ ID NO: 18553 - DNA, 25 bp, E. coli
ctaccaagttagacagcggcaggcc

SEQ ID NO: 18554 - DNA, 25 bp, E. coli
ctaccaagttagtcagcggcaggcc

SEQ ID NO: 18555 - DNA, 25 bp, E. coli
aatgtatgcttctgacctggtgacg

SEQ ID NO: 18556 - DNA, 25 bp, E. coli
aatgtatgcttcagacctggtgacg

SEQ ID NO: 18557 - DNA, 25 bp, E. coli
cgccgggaagtggtaagccagaaat

SEQ ID NO: 18558 - DNA, 25 bp, E. coli
agccagcgggatgccctgaatcaga

SEQ ID NO: 18559 - DNA, 25 bp, E. coli
cgccgggaagtgctaagccagaaat

SEQ ID NO: 18560 - DNA, 25 bp, E. coli
agccagcgggatcccctgaatcaga

SEQ ID NO: 18561 - DNA, 25 bp, E. coli
ttcccgccgcgttccagtgaaatgg

SEQ ID NO: 18562 - DNA, 25 bp, E. coli
ttcccgccgcgtaccagtgaaatgg

SEQ ID NO: 18563 - DNA, 25 bp, E. coli
tgcacgcgactactggaataacggt

SEQ ID NO: 18564 - DNA, 25 bp, E. coli
tgaccaacgtgcctattccggcgtg

SEQ ID NO: 18565 - DNA, 25 bp, E. coli
tgaccaacgtgcgtattccggcgtg

SEQ ID NO: 18566 - DNA, 25 bp, E. coli
tgcacgcgactagtggaataacggt

SEQ ID NO: 18567 - DNA, 25 bp, E. coli
gcgaccgtacgcacagcattattaa

SEQ ID NO: 18568 - DNA, 25 bp, E. coli
gcgaccgtacgctcagcattattaa

SEQ ID NO: 18569 - DNA, 25 bp, E. coli
tgaaatggagcagaccctgtggaac

SEQ ID NO: 18570 - DNA, 25 bp, E. coli
tgaaatggagcacaccctgtggaac

SEQ ID NO: 18571 - DNA, 25 bp, E. coli
cttagcagcctgaaaccgaagtttg

SEQ ID NO: 18572 - DNA, 25 bp, E. coli
cttagcagcctgtaaccgaagtttg

SEQ ID NO: 18573 - DNA, 25 bp, E. coli
gatttcgatatctccgtggcggcgt

SEQ ID NO: 18574 - DNA, 25 bp, E. coli
gatttcgatatcaccgtggcggcgt

SEQ ID NO: 18575 - DNA, 25 bp, E. coli
ggaactccatcgttcgccttagcag

SEQ ID NO: 18576 - DNA, 25 bp, E. coli
ggaactccatcgatcgccttagcag

SEQ ID NO: 18577 - DNA, 25 bp, E. coli
caaggcaggtttgcaagcaggcgac

SEQ ID NO: 18578 - DNA, 25 bp, E. coli
caaggcaggtttccaagcaggcgac

SEQ ID NO: 18579 - DNA, 25 bp, E. coli
taaaattggcgaagaaagcaccacc

SEQ ID NO: 18580 - DNA, 25 bp, E. coli
taaaattggcgatgaaagcaccacc

SEQ ID NO: 18581 - DNA, 25 bp, E. coli
taaagtcgatggacagcccttaacg

SEQ ID NO: 18582 - DNA, 25 bp, E. coli
cctcgtgggccgcaaattgaacctg

SEQ ID NO: 18583 - DNA, 25 bp, E. coli
cctcgtgggccggaaattgaacctg

SEQ ID NO: 18584 - DNA, 25 bp, E. coli
aaatgctggatgagcgcgcagaacc

SEQ ID NO: 18585 - DNA, 25 bp, E. coli
aaagctcgatttacgtcactgggcg

SEQ ID NO: 18586 - DNA, 25 bp, E. coli
aaaatgtgcagcgaaactcggcggc

SEQ ID NO: 18587 - DNA, 25 bp, E. coli
aaaatgtgcagccaaactcggcggc

SEQ ID NO: 18588 - DNA, 25 bp, E. coli
aaatgctggatgtgcgcgcagaacc

SEQ ID NO: 18589 - DNA, 25 bp, E. coli
aaagctcgattttcgtcactgggcg

SEQ ID NO: 18590 - DNA, 25 bp, E. coli
tatcgaaacgcctgattgggatgcc

SEQ ID NO: 18591 - DNA, 25 bp, E. coli
tatccgagcgggatcaagacttttg

SEQ ID NO: 18592 - DNA, 25 bp, E. coli
tatcgaaacgccagattgggatgcc

SEQ ID NO: 18593 - DNA, 25 bp, E. coli
tatccgagcgggttcaagacttttg

SEQ ID NO: 18594 - DNA, 25 bp, E. coli
ccaacggcgggatgtaaagctcgat

SEQ ID NO: 18595 - DNA, 25 bp, E. coli
ccaacggcgggaagtaaagctcgat

SEQ ID NO: 18596 - DNA, 25 bp, E. coli
taaagtcgatggtcagcccttaacg

SEQ ID NO: 18597 - DNA, 25 bp, E. coli
taataaatctgtcggccaacgagcg

SEQ ID NO: 18598 - DNA, 25 bp, E. coli
taataaatctgtgggccaacgagcg

SEQ ID NO: 18599 - DNA, 25 bp, E. coli
ttaaaattaacctcaataagcgaat

SEQ ID NO: 18600 - DNA, 25 bp, E. coli
ttaaaattaaccacaataagcgaat

SEQ ID NO: 18601 - DNA, 25 bp, E. coli
aaaaatatttattgttcattatccg

SEQ ID NO: 18602 - DNA, 25 bp, E. coli
aaaaatatttatagttcattatccg

SEQ ID NO: 18603 - DNA, 25 bp, E. coli
ttaacggattaaagataagtggatc

SEQ ID NO: 18604 - DNA, 25 bp, E. coli
ttaacggattaatgataagtggatc

SEQ ID NO: 18605 - DNA, 25 bp, E. coli
tttggccgggttcgcccggccacat

SEQ ID NO: 18606 - DNA, 25 bp, E. coli
tttggccgggttggcccggccacat

SEQ ID NO: 18607 - DNA, 25 bp, E. coli
gcccggccacatgattaacggatta

SEQ ID NO: 18608 - DNA, 25 bp, E. coli
ccacaataagcgtattgattaaaaa

SEQ ID NO: 18609 - DNA, 25 bp, E. coli
gcccggccacatcattaacggatta

SEQ ID NO: 18610 - DNA, 25 bp, E. coli
ccacaataagcgaattgattaaaaa

SEQ ID NO: 18611 - DNA, 25 bp, E. coli
gttcgcccggccacatcattaacgg

SEQ ID NO: 18612 - DNA, 25 bp, E. coli
cattatccgttattagactggcccc

SEQ ID NO: 18613 - DNA, 25 bp, E. coli
cggccacatcataaacggattaatg

SEQ ID NO: 18614 - DNA, 25 bp, E. coli
cggccacatcattaacggattaatg

SEQ ID NO: 18615 - DNA, 25 bp, E. coli
cattatccgttaatagactggcccc

SEQ ID NO: 18616 - DNA, 25 bp, E. coli
gttcgcccggcctcatcattaacgg

SEQ ID NO: 18617 - DNA, 25 bp, E. coli
cggattaatgataagtggatcagat

SEQ ID NO: 18618 - DNA, 25 bp, E. coli
cggattaatgattagtggatcagat

SEQ ID NO: 18619 - DNA, 25 bp, E. coli
gataagtggatcagatgtataaaaa

SEQ ID NO: 18620 - DNA, 25 bp, E. coli
gataagtggatctgatgtataaaaa

SEQ ID NO: 18621 - DNA, 25 bp, E. coli
agttcaaccgtatttcctggataga

SEQ ID NO: 18622 - DNA, 25 bp, E. coli
cagccacctgactggtaagggtttc

SEQ ID NO: 18623 - DNA, 25 bp, E. coli
cagccacctgacaggtaagggtttc

SEQ ID NO: 18624 - DNA, 25 bp, E. coli
agttcaaccgtaattcctggataga

SEQ ID NO: 18625 - DNA, 25 bp, E. coli
tatgaagtttgctcatcgcaatagc

SEQ ID NO: 18626 - DNA, 25 bp, E. coli
tatgaagtttgcacatcgcaatagc

SEQ ID NO: 18627 - DNA, 25 bp, E. coli
tcttcaatgcccgttagtctaccga

SEQ ID NO: 18628 - DNA, 25 bp, E. coli
tcttcaatgccccttagtctaccga

SEQ ID NO: 18629 - DNA, 25 bp, E. coli
gcttttttccggcacgatcgatttc

SEQ ID NO: 18630 - DNA, 25 bp, E. coli
gcttttttccgggacgatcgatttc

SEQ ID NO: 18631 - DNA, 25 bp, E. coli
gcactatgccccttataaggcggac

SEQ ID NO: 18632 - DNA, 25 bp, E. coli
gcactatgccccatataaggcggac

SEQ ID NO: 18633 - DNA, 25 bp, E. coli
ggcatatgcctgaattccgcagtgc

SEQ ID NO: 18634 - DNA, 25 bp, E. coli
tggaaaataacacccgcactatgcc

SEQ ID NO: 18635 - DNA, 25 bp, E. coli
tggaaaataacagccgcactatgcc

SEQ ID NO: 18636 - DNA, 25 bp, E. coli
ggcatatgcctgtattccgcagtgc

SEQ ID NO: 18637 - DNA, 25 bp, E. coli
taagggcacttctgcgtacaggtct

SEQ ID NO: 18638 - DNA, 25 bp, E. coli
taacccttgtataatcagccacctg

SEQ ID NO: 18639 - DNA, 25 bp, E. coli
taaggcggacaagtcatattatgaa

SEQ ID NO: 18640 - DNA, 25 bp, E. coli
taaggcggacaactcatattatgaa

SEQ ID NO: 18641 - DNA, 25 bp, E. coli
taagggcacttcagcgtacaggtct

SEQ ID NO: 18642 - DNA, 25 bp, E. coli
taacccttgtattatcagccacctg

SEQ ID NO: 18643 - DNA, 25 bp, E. coli
aaatacagggtaatgtcatcaaggg

SEQ ID NO: 18644 - DNA, 25 bp, E. coli
aaatacagggtattgtcatcaaggg

SEQ ID NO: 18645 - DNA, 25 bp, E. coli
tattcaagaggtctttcctgaaggg

SEQ ID NO: 18646 - DNA, 25 bp, E. coli
tattcaagaggtgtttcctgaaggg

SEQ ID NO: 18647 - DNA, 25 bp, E. coli
tattatagttgaaggcggctctaca

SEQ ID NO: 18648 - DNA, 25 bp, E. coli
tatatgatgcgatgaataagggccg

SEQ ID NO: 18649 - DNA, 25 bp, E. coli
tattatagttgatggcggctctaca

SEQ ID NO: 18650 - DNA, 25 bp, E. coli
tatatgatgcgaagaataagggccg

SEQ ID NO: 18651 - DNA, 25 bp, E. coli
tcctgaagggttaagatctctatct

SEQ ID NO: 18652 - DNA, 25 bp, E. coli
tcctgaagggtttagatctctatct

SEQ ID NO: 18653 - DNA, 25 bp, E. coli
cctgaacgtttaagaagagtattgc

SEQ ID NO: 18654 - DNA, 25 bp, E. coli
gccggcgatagcctaattggagata

SEQ ID NO: 18655 - DNA, 25 bp, E. coli
cctgaacgtttatgaagagtattgc

SEQ ID NO: 18656 - DNA, 25 bp, E. coli
gccggcgatagcgtaattggagata

SEQ ID NO: 18657 - DNA, 25 bp, E. coli
ggctctacagatcgaacgaatcgtg

SEQ ID NO: 18658 - DNA, 25 bp, E. coli
ggctctacagatggaacgaatcgtg

SEQ ID NO: 18659 - DNA, 25 bp, E. coli
tggccaaaggcgacttaatacatta

SEQ ID NO: 18660 - DNA, 25 bp, E. coli
tggccaaaggcgtcttaatacatta

SEQ ID NO: 18661 - DNA, 25 bp, E. coli
taagggccgaatcttggccaaaggc

SEQ ID NO: 18662 - DNA, 25 bp, E. coli
taagggccgaatgttggccaaaggc

SEQ ID NO: 18663 - DNA, 25 bp, E. coli
taatacattatttaaacgccggcga

SEQ ID NO: 18664 - DNA, 25 bp, E. coli
taatacattattaaaacgccggcga

SEQ ID NO: 18665 - DNA, 25 bp, E. coli
cattattggcagcatactttgagca

SEQ ID NO: 18666 - DNA, 25 bp, E. coli
cattattggcaggatactttgagca

SEQ ID NO: 18667 - DNA, 25 bp, E. coli
tactcatcgggataaagagatcctg

SEQ ID NO: 18668 - DNA, 25 bp, E. coli
tactcatcgggaaaaagagatcctg

SEQ ID NO: 18669 - DNA, 25 bp, E. coli
tgggcaaacgataacctcaggcgat

SEQ ID NO: 18670 - DNA, 25 bp, E. coli
tgggcaaacgattacctcaggcgat

SEQ ID NO: 18671 - DNA, 25 bp, E. coli
tacccgtaccgccacattgaaaact

SEQ ID NO: 18672 - DNA, 25 bp, E. coli
tacccgtaccgcgacattgaaaact

SEQ ID NO: 18673 - DNA, 25 bp, E. coli
tgaataagctgcctatcggcgcgtc

SEQ ID NO: 18674 - DNA, 25 bp, E. coli
tgaataagctgcgtatcggcgcgtc

SEQ ID NO: 18675 - DNA, 25 bp, E. coli
tcggcgcgtctattaacgagatcgc

SEQ ID NO: 18676 - DNA, 25 bp, E. coli
tcggcgcgtctaataacgagatcgc

SEQ ID NO: 18677 - DNA, 25 bp, E. coli
cctgcgcggcgaatgctactttacg

SEQ ID NO: 18678 - DNA, 25 bp, E. coli
cctgcgcggcgattgctactttacg

SEQ ID NO: 18679 - DNA, 25 bp, E. coli
gctaaatacgcctgaagattacccg

SEQ ID NO: 18680 - DNA, 25 bp, E. coli
gctaaatacgccagaagattacccg

SEQ ID NO: 18681 - DNA, 25 bp, E. coli
gaaaactggcctgatatcaacggcg

SEQ ID NO: 18682 - DNA, 25 bp, E. coli
gacacaagcggtatcctgggcaaac

SEQ ID NO: 18683 - DNA, 25 bp, E. coli
gacacaagcggtttcctgggcaaac

SEQ ID NO: 18684 - DNA, 25 bp, E. coli
gaaaactggcctcatatcaacggcg

SEQ ID NO: 18685 - DNA, 25 bp, E. coli
gttataacagcacggaatcagccct

SEQ ID NO: 18686 - DNA, 25 bp, E. coli
gttataacagcagggaatcagccct

SEQ ID NO: 18687 - DNA, 25 bp, E. coli
cagccgcagtgtagattacgatttt

SEQ ID NO: 18688 - DNA, 25 bp, E. coli
caaaagatatggcttcagccgcagt

SEQ ID NO: 18689 - DNA, 25 bp, E. coli
cagccgcagtgttgattacgatttt

SEQ ID NO: 18690 - DNA, 25 bp, E. coli
caaaagatatgggttcagccgcagt

SEQ ID NO: 18691 - DNA, 25 bp, E. coli
taaagcagcgggttattcatggaaa

SEQ ID NO: 18692 - DNA, 25 bp, E. coli
taaagcagcgggatattcatggaaa

SEQ ID NO: 18693 - DNA, 25 bp, E. coli
ttaccagaattattaaagcagcggg

SEQ ID NO: 18694 - DNA, 25 bp, E. coli
ttaccagaattaataaagcagcggg

SEQ ID NO: 18695 - DNA, 25 bp, E. coli
ttcatggaaagggttatgtgcggca

SEQ ID NO: 18696 - DNA, 25 bp, E. coli
ttcatggaaaggcttatgtgcggca

SEQ ID NO: 18697 - DNA, 25 bp, E. coli
gctggatgttgactctgttactcga

SEQ ID NO: 18698 - DNA, 25 bp, E. coli
gctggatgttgagtctgttactcga

SEQ ID NO: 18699 - DNA, 25 bp, E. coli
gaagcagcctttcgtcaggagtgca

SEQ ID NO: 18700 - DNA, 25 bp, E. coli
gaagcagcctttggtcaggagtgca

SEQ ID NO: 18701 - DNA, 25 bp, E. coli
gaacatcacgaaatatcaggcagag

SEQ ID NO: 18702 - DNA, 25 bp, E. coli
gaacatcacgaattatcaggcagag

SEQ ID NO: 18703 - DNA, 25 bp, E. coli
cgagtattactctttggttcggcaa

SEQ ID NO: 18704 - DNA, 25 bp, E. coli
cgagtattactcattggttcggcaa

SEQ ID NO: 18705 - DNA, 25 bp, E. coli
ggagtgcattctggttctgtcagca

SEQ ID NO: 18706 - DNA, 25 bp, E. coli
ggagtgcattctcgttctgtcagca

SEQ ID NO: 18707 - DNA, 25 bp, E. coli
taatacgaccacaggtgttaccaga

SEQ ID NO: 18708 - DNA, 25 bp, E. coli
taatacgaccactggtgttaccaga

SEQ ID NO: 18709 - DNA, 25 bp, E. coli
aagcaaaactgaagcaacccggcag

SEQ ID NO: 18710 - DNA, 25 bp, E. coli
aacccggcagcactgatatcaatct

SEQ ID NO: 18711 - DNA, 25 bp, E. coli
aagcaaaactgatgcaacccggcag

SEQ ID NO: 18712 - DNA, 25 bp, E. coli
taaaaatggacaccggcaaaattgc

SEQ ID NO: 18713 - DNA, 25 bp, E. coli
taaaaatggacagcggcaaaattgc

SEQ ID NO: 18714 - DNA, 25 bp, E. coli
agcaccagtgtgtcgttaagcgacg

SEQ ID NO: 18715 - DNA, 25 bp, E. coli
agcaccagtgtgacgttaagcgacg

SEQ ID NO: 18716 - DNA, 25 bp, E. coli
aaaattgccgatccgctgatcaacg

SEQ ID NO: 18717 - DNA, 25 bp, E. coli
aaaattgccgatgcgctgatcaacg

SEQ ID NO: 18718 - DNA, 25 bp, E. coli
aacccggcagcagtgatatcaatct

SEQ ID NO: 18719 - DNA, 25 bp, E. coli
tatcaatcttgatcgtgtcgaagcg

SEQ ID NO: 18720 - DNA, 25 bp, E. coli
tatcaatcttgaacgtgtcgaagcg

SEQ ID NO: 18721 - DNA, 25 bp, E. coli
gtaagcaccgttcaaccgcgcgaaa

SEQ ID NO: 18722 - DNA, 25 bp, E. coli
gtaagcaccgttgaaccgcgcgaaa

SEQ ID NO: 18723 - DNA, 25 bp, E. coli
ctggcgattcgtaacggtgaactaa

SEQ ID NO: 18724 - DNA, 25 bp, E. coli
ctggcgattcgttacggtgaactaa

SEQ ID NO: 18725 - DNA, 25 bp, E. coli
taagcgacgcgctagcaaaactgat

SEQ ID NO: 18726 - DNA, 25 bp, E. coli
tcaacgaagcgctgcaagacttgca

SEQ ID NO: 18727 - DNA, 25 bp, E. coli
taagcgacgcgcaagcaaaactgat

SEQ ID NO: 18728 - DNA, 25 bp, E. coli
tcaacgaagcgcagcaagacttgca

SEQ ID NO: 18729 - DNA, 25 bp, E. coli
gagtattgatcgcacttcgcctctg

SEQ ID NO: 18730 - DNA, 25 bp, E. coli
gagtattgatcggacttcgcctctg

SEQ ID NO: 18731 - DNA, 25 bp, E. coli
atgaacaaaattgcccagcagcgaa

SEQ ID NO: 18732 - DNA, 25 bp, E. coli
atgaacaaaattccccagcagcgaa

SEQ ID NO: 18733 - DNA, 25 bp, E. coli
aaaatcggagtttcgcaagctgtac

SEQ ID NO: 18734 - DNA, 25 bp, E. coli
aaaatcggagttacgcaagctgtac

SEQ ID NO: 18735 - DNA, 25 bp, E. coli
tccatccagtaagaaagccgcctaa

SEQ ID NO: 18736 - DNA, 25 bp, E. coli
tccatccagtaacaaagccgcctaa

SEQ ID NO: 18737 - DNA, 25 bp, E. coli
gccaactatgaggtgaatatccgta

SEQ ID NO: 18738 - DNA, 25 bp, E. coli
gccaactatgagctgaatatccgta

SEQ ID NO: 18739 - DNA, 25 bp, E. coli
gcctcaggaagttagggtgccaatg

SEQ ID NO: 18740 - DNA, 25 bp, E. coli
gcctcaggaagtaagggtgccaatg

SEQ ID NO: 18741 - DNA, 25 bp, E. coli
gctgtactagctacggcaattggtt

SEQ ID NO: 18742 - DNA, 25 bp, E. coli
gctgtactagcttcggcaattggtt

SEQ ID NO: 18743 - DNA, 25 bp, E. coli
gaatatccgtactcctggccttaac

SEQ ID NO: 18744 - DNA, 25 bp, E. coli
gaatatccgtacacctggccttaac

SEQ ID NO: 18745 - DNA, 25 bp, E. coli
cgaatgatcgtacaaggcctcagga

SEQ ID NO: 18746 - DNA, 25 bp, E. coli
cgaatgatcgtagaaggcctcagga

SEQ ID NO: 18747 - DNA, 25 bp, E. coli
ggatgatgttttccctccatccagt

SEQ ID NO: 18748 - DNA, 25 bp, E. coli
ggatgatgttttgcctccatccagt

SEQ ID NO: 18749 - DNA, 25 bp, E. coli
ggccttaacgattgccgaatgatcg

SEQ ID NO: 18750 - DNA, 25 bp, E. coli
ggccttaacgatagccgaatgatcg

SEQ ID NO: 18751 - DNA, 25 bp, E. coli
ggcaatcccgcaacgccaactatga

SEQ ID NO: 18752 - DNA, 25 bp, E. coli
ggcaatcccgcatcgccaactatga

SEQ ID NO: 18753 - DNA, 25 bp, E. coli
aacgtccggtgcctattggcgatac

SEQ ID NO: 18754 - DNA, 25 bp, E. coli
cagcagcgtgatgcactcttccaga

SEQ ID NO: 18755 - DNA, 25 bp, E. coli
cagcagcgtgatccactcttccaga

SEQ ID NO: 18756 - DNA, 25 bp, E. coli
aacgtccggtgcgtattggcgatac

SEQ ID NO: 18757 - DNA, 25 bp, E. coli
aaacgctgccctcggcggatgaact

SEQ ID NO: 18758 - DNA, 25 bp, E. coli
aaacgctgccctgggcggatgaact

SEQ ID NO: 18759 - DNA, 25 bp, E. coli
ttgaccatgcaggtcaacatcagcg

SEQ ID NO: 18760 - DNA, 25 bp, E. coli
ttgaccatgcagctcaacatcagcg

SEQ ID NO: 18761 - DNA, 25 bp, E. coli
tgatgcactcttccagagcgatgcg

SEQ ID NO: 18762 - DNA, 25 bp, E. coli
tgatgcactcttgcagagcgatgcg

SEQ ID NO: 18763 - DNA, 25 bp, E. coli
gcctgctgttgtctcgtatccttta

SEQ ID NO: 18764 - DNA, 25 bp, E. coli
gcctgctgttgtgtcgtatccttta

SEQ ID NO: 18765 - DNA, 25 bp, E. coli
gcggttggcctgattctgttgacca

SEQ ID NO: 18766 - DNA, 25 bp, E. coli
gcggttggcctgtttctgttgacca

SEQ ID NO: 18767 - DNA, 25 bp, E. coli
gaagttaaccagcagcgtgatgcac

SEQ ID NO: 18768 - DNA, 25 bp, E. coli
gaagttaaccaggagcgtgatgcac

SEQ ID NO: 18769 - DNA, 25 bp, E. coli
cgaactgctatggtcgttcagcaaa

SEQ ID NO: 18770 - DNA, 25 bp, E. coli
cgtttttatcgctttcctcgctggt

SEQ ID NO: 18771 - DNA, 25 bp, E. coli
cgaactgctatgctcgttcagcaaa

SEQ ID NO: 18772 - DNA, 25 bp, E. coli
cgtttttatcgcattcctcgctggt

SEQ ID NO: 18773 - DNA, 25 bp, E. coli
tcaacatcagcgaactgctatggtc

SEQ ID NO: 18774 - DNA, 25 bp, E. coli
tcaacatcagcgtactgctatggtc

SEQ ID NO: 18775 - DNA, 25 bp, E. coli
cacgttgtgcagcagtctcgcgcag

SEQ ID NO: 18776 - DNA, 25 bp, E. coli
cacgttgtgcaggagtctcgcgcag

SEQ ID NO: 18777 - DNA, 25 bp, E. coli
catgtcatgcagcaagagagccgtc

SEQ ID NO: 18778 - DNA, 25 bp, E. coli
catgtcatgcaggaagagagccgtc

SEQ ID NO: 18779 - DNA, 25 bp, E. coli
acagcgccgactcgattgtcgtgga

SEQ ID NO: 18780 - DNA, 25 bp, E. coli
acagcgccgactggattgtcgtgga

SEQ ID NO: 18781 - DNA, 25 bp, E. coli
tgtatgaactggaaaaactctggag

SEQ ID NO: 18782 - DNA, 25 bp, E. coli
tgtatgaactggtaaaactctggag

SEQ ID NO: 18783 - DNA, 25 bp, E. coli
tggatttgggcgttgtgattgtcca

SEQ ID NO: 18784 - DNA, 25 bp, E. coli
tcatctgtacggctacgtccagccg

SEQ ID NO: 18785 - DNA, 25 bp, E. coli
tcatctgtacgggtacgtccagccg

SEQ ID NO: 18786 - DNA, 25 bp, E. coli
gatgtgattgtcgatgtcatgcagg

SEQ ID NO: 18787 - DNA, 25 bp, E. coli
gatgtgattgtccatgtcatgcagg

SEQ ID NO: 18788 - DNA, 25 bp, E. coli
gtagaaggtgaaaacagcgccgact

SEQ ID NO: 18789 - DNA, 25 bp, E. coli
gtagaaggtgaatacagcgccgact

SEQ ID NO: 18790 - DNA, 25 bp, E. coli
tggatttgggcgatgtgattgtcca

SEQ ID NO: 18791 - DNA, 25 bp, E. coli
ggaagagagccgtcgcctgtatgaa

SEQ ID NO: 18792 - DNA, 25 bp, E. coli
ggaagagagccgacgcctgtatgaa

SEQ ID NO: 18793 - DNA, 25 bp, E. coli
gagccgtcgcctgtatgaactggaa

SEQ ID NO: 18794 - DNA, 25 bp, E. coli
gagtctcgcgcaccgggcctgttac

SEQ ID NO: 18795 - DNA, 25 bp, E. coli
gagccgtcgcctctatgaactggaa

SEQ ID NO: 18796 - DNA, 25 bp, E. coli
gagtctcgcgcagcgggcctgttac

SEQ ID NO: 18797 - DNA, 25 bp, E. coli
caccactacagtatgttcagtgaag

SEQ ID NO: 18798 - DNA, 25 bp, E. coli
caccactacagtttgttcagtgaag

SEQ ID NO: 18799 - DNA, 25 bp, E. coli
ttaggtcttttgtttggctgtgtac

SEQ ID NO: 18800 - DNA, 25 bp, E. coli
ttaggtcttttgattggctgtgtac

SEQ ID NO: 18801 - DNA, 25 bp, E. coli
ttcgcggcttagctcttttgattgg

SEQ ID NO: 18802 - DNA, 25 bp, E. coli
ttcgcggcttaggtcttttgattgg

SEQ ID NO: 18803 - DNA, 25 bp, E. coli
tgtgtgaccgccacaatgcgttgct

SEQ ID NO: 18804 - DNA, 25 bp, E. coli
tgtgtgaccgcctcaatgcgttgct

SEQ ID NO: 18805 - DNA, 25 bp, E. coli
tgccagtgcgctgattgacgacgcc

SEQ ID NO: 18806 - DNA, 25 bp, E. coli
tgcgctgattgaggacgccacctgt

SEQ ID NO: 18807 - DNA, 25 bp, E. coli
tgccagtgcgctcattgacgacgcc

SEQ ID NO: 18808 - DNA, 25 bp, E. coli
tgcgctgattgacgacgccacctgt

SEQ ID NO: 18809 - DNA, 25 bp, E. coli
tccattaatcacgactacagtttgt

SEQ ID NO: 18810 - DNA, 25 bp, E. coli
tccattaatcaccactacagtttgt

SEQ ID NO: 18811 - DNA, 25 bp, E. coli
gccacaatgcgttgctgatctttga

SEQ ID NO: 18812 - DNA, 25 bp, E. coli
gccacaatgcgtagctgatctttga

SEQ ID NO: 18813 - DNA, 25 bp, E. coli
cgttgctgatctttgatgaagtaca

SEQ ID NO: 18814 - DNA, 25 bp, E. coli
cgttgctgatctatgatgaagtaca

SEQ ID NO: 18815 - DNA, 25 bp, E. coli
gtttgttgagcgactaaattccatt

SEQ ID NO: 18816 - DNA, 25 bp, E. coli
gtttgttgagcgtctaaattccatt

SEQ ID NO: 18817 - DNA, 25 bp, E. coli
gagcgtctaaattccattaatcacc

SEQ ID NO: 18818 - DNA, 25 bp, E. coli
gagcgtctaaataccattaatcacc

SEQ ID NO: 18819 - DNA, 25 bp, E. coli
cagagacgggaataactggatgcca

SEQ ID NO: 18820 - DNA, 25 bp, E. coli
cagagacgggaaaaactggatgcca

SEQ ID NO: 18821 - DNA, 25 bp, E. coli
taccgagcagatctggatttcagca

SEQ ID NO: 18822 - DNA, 25 bp, E. coli
taccgagcagatgtggatttcagca

SEQ ID NO: 18823 - DNA, 25 bp, E. coli
tatcccagaaggtaaggactctttg

SEQ ID NO: 18824 - DNA, 25 bp, E. coli
tatcccagaaggaaaggactctttg

SEQ ID NO: 18825 - DNA, 25 bp, E. coli
tatgctcctgatggtatcgctgtgc

SEQ ID NO: 18826 - DNA, 25 bp, E. coli
tatgctcctgatcgtatcgctgtgc

SEQ ID NO: 18827 - DNA, 25 bp, E. coli
tgtcaatcgtagaaatcatccagca

SEQ ID NO: 18828 - DNA, 25 bp, E. coli
tgtcaatcgtagtaatcatccagca

SEQ ID NO: 18829 - DNA, 25 bp, E. coli
tccagcttcagacgaaagacagctt

SEQ ID NO: 18830 - DNA, 25 bp, E. coli
tccagcttcagaggaaagacagctt

SEQ ID NO: 18831 - DNA, 25 bp, E. coli
tctaggaaagggtatcaagcggcat

SEQ ID NO: 18832 - DNA, 25 bp, E. coli
tctaggaaagggaatcaagcggcat

SEQ ID NO: 18833 - DNA, 25 bp, E. coli
ccagcattacttgcaggcctcgata

SEQ ID NO: 18834 - DNA, 25 bp, E. coli
ccagcattacttccaggcctcgata

SEQ ID NO: 18835 - DNA, 25 bp, E. coli
gaatcataccctgccagtgagaggg

SEQ ID NO: 18836 - DNA, 25 bp, E. coli
gaatcataccctcccagtgagaggg

SEQ ID NO: 18837 - DNA, 25 bp, E. coli
ggtttgaagcaacgccagagcgata

SEQ ID NO: 18838 - DNA, 25 bp, E. coli
ggtttgaagcaaggccagagcgata

SEQ ID NO: 18839 - DNA, 25 bp, E. coli
gatgccataacatatcgccctgtag

SEQ ID NO: 18840 - DNA, 25 bp, E. coli
gatgccataacaaatcgccctgtag

SEQ ID NO: 18841 - DNA, 25 bp, E. coli
caataaggaaaggaatgcgcaaatt

SEQ ID NO: 18842 - DNA, 25 bp, E. coli
caataaggaaagcaatgcgcaaatt

SEQ ID NO: 18843 - DNA, 25 bp, E. coli
aaggcgcgccttcttttagacaccg

SEQ ID NO: 18844 - DNA, 25 bp, E. coli
aaaaatttcctcactgctctttcag

SEQ ID NO: 18845 - DNA, 25 bp, E. coli
aaggcgcgccttgttttagacaccg

SEQ ID NO: 18846 - DNA, 25 bp, E. coli
aaaaaatgcatagtgcatttacccg

SEQ ID NO: 18847 - DNA, 25 bp, E. coli
aaaaatttcctctctgctctttcag

SEQ ID NO: 18848 - DNA, 25 bp, E. coli
aaaaaatgcatactgcatttacccg

SEQ ID NO: 18849 - DNA, 25 bp, E. coli
ttgaatgacaaataatgcatactgc

SEQ ID NO: 18850 - DNA, 25 bp, E. coli
ttttagacaccgtcccagagaagag

SEQ ID NO: 18851 - DNA, 25 bp, E. coli
ttgaatgacaaaaaatgcatactgc

SEQ ID NO: 18852 - DNA, 25 bp, E. coli
ttttagacaccgacccagagaagag

SEQ ID NO: 18853 - DNA, 25 bp, E. coli
tcctcactgctctttcagatagcat

SEQ ID NO: 18854 - DNA, 25 bp, E. coli
tcctcactgctcattcagatagcat

SEQ ID NO: 18855 - DNA, 25 bp, E. coli
ccagagaagaggattaatgaggtga

SEQ ID NO: 18856 - DNA, 25 bp, E. coli
ccagagaagaggtttaatgaggtga

SEQ ID NO: 18857 - DNA, 25 bp, E. coli
ccgacccagagatgaggattaatga

SEQ ID NO: 18858 - DNA, 25 bp, E. coli
ccgacccagagaagaggattaatga

SEQ ID NO: 18859 - DNA, 25 bp, E. coli
gattaatgaggtgaaaaatttcctc

SEQ ID NO: 18860 - DNA, 25 bp, E. coli
gattaatgaggtcaaaaatttcctc

SEQ ID NO: 18861 - DNA, 25 bp, E. coli
tgcgcaaattggatttttaactcgt

SEQ ID NO: 18862 - DNA, 25 bp, E. coli
tgcgcaaattggttttttaactcgt

SEQ ID NO: 18863 - DNA, 25 bp, E. coli
cacttcttagaatgcaatgaagaca

SEQ ID NO: 18864 - DNA, 25 bp, E. coli
cacttcttagaaagcaatgaagaca

SEQ ID NO: 18865 - DNA, 25 bp, E. coli
caacgggagtttcccactaaatggg

SEQ ID NO: 18866 - DNA, 25 bp, E. coli
caacgggagtttgccactaaatggg

SEQ ID NO: 18867 - DNA, 25 bp, E. coli
taaaaaggctggagcaactgttaca

SEQ ID NO: 18868 - DNA, 25 bp, E. coli
taaaaaggctggtgcaactgttaca

SEQ ID NO: 18869 - DNA, 25 bp, E. coli
atgaatgagaacaaaataaaaaggc

SEQ ID NO: 18870 - DNA, 25 bp, E. coli
aggctggagcaagtgttacaggcac

SEQ ID NO: 18871 - DNA, 25 bp, E. coli
atgaatgagaactaaataaaaaggc

SEQ ID NO: 18872 - DNA, 25 bp, E. coli
aggctggagcaactgttacaggcac

SEQ ID NO: 18873 - DNA, 25 bp, E. coli
ttacaggcacgcgaacgggagtttg

SEQ ID NO: 18874 - DNA, 25 bp, E. coli
ttacaggcacgccaacgggagtttg

SEQ ID NO: 18875 - DNA, 25 bp, E. coli
tgaagacctcataaaaaataatggc

SEQ ID NO: 18876 - DNA, 25 bp, E. coli
tgaagacctcattaaaaataatggc

SEQ ID NO: 18877 - DNA, 25 bp, E. coli
tcaggtctgataagaaacacttctt

SEQ ID NO: 18878 - DNA, 25 bp, E. coli
tcaggtctgatatgaaacacttctt

SEQ ID NO: 18879 - DNA, 25 bp, E. coli
gcctaacctattatccacttgaaga

SEQ ID NO: 18880 - DNA, 25 bp, E. coli
gcctaacctattttccacttgaaga

SEQ ID NO: 18881 - DNA, 25 bp, E. coli
gctgccacatgaacgcctaacctat

SEQ ID NO: 18882 - DNA, 25 bp, E. coli
gctgccacatgatcgcctaacctat

SEQ ID NO: 18883 - DNA, 25 bp, E. coli
ggacgtgccgcgctgccacatgaac

SEQ ID NO: 18884 - DNA, 25 bp, E. coli
ggacgtgccgcggtgccacatgaac

SEQ ID NO: 18885 - DNA, 25 bp, E. coli
gaacaaaccggatgcccagttccag

SEQ ID NO: 18886 - DNA, 25 bp, E. coli
gaacaaaccggaagcccagttccag

SEQ ID NO: 18887 - DNA, 25 bp, E. coli
caaagccgtattctgtttgccggag

SEQ ID NO: 18888 - DNA, 25 bp, E. coli
caaagccgtattgtgtttgccggag

SEQ ID NO: 18889 - DNA, 25 bp, E. coli
cagtgatgatttggaacaaagccgt

SEQ ID NO: 18890 - DNA, 25 bp, E. coli
cagtgatgatttcgaacaaagccgt

SEQ ID NO: 18891 - DNA, 25 bp, E. coli
ttccacgatgggatgcaaaccagcc

SEQ ID NO: 18892 - DNA, 25 bp, E. coli
ttccacgatgggttgcaaaccagcc

SEQ ID NO: 18893 - DNA, 25 bp, E. coli
tgtctgcatttaccccggcaagtga

SEQ ID NO: 18894 - DNA, 25 bp, E. coli
tgtctgcatttagcccggcaagtga

SEQ ID NO: 18895 - DNA, 25 bp, E. coli
tgccggagacttacaggatgacctg

SEQ ID NO: 18896 - DNA, 25 bp, E. coli
tgccggagactttcaggatgacctg

SEQ ID NO: 18897 - DNA, 25 bp, E. coli
ccggacgtgctggatgagacatttg

SEQ ID NO: 18898 - DNA, 25 bp, E. coli
gaattgtagcgatcgccttcctgcc

SEQ ID NO: 18899 - DNA, 25 bp, E. coli
gccagcaacgtcttttccgaggtga

SEQ ID NO: 18900 - DNA, 25 bp, E. coli
gaattgtagcgaacgccttcctgcc

SEQ ID NO: 18901 - DNA, 25 bp, E. coli
gccagcaacgtcatttccgaggtga

SEQ ID NO: 18902 - DNA, 25 bp, E. coli
ccggacgtgctgcatgagacatttg

SEQ ID NO: 18903 - DNA, 25 bp, E. coli
gcttcaaggtgtatcgcgccattat

SEQ ID NO: 18904 - DNA, 25 bp, E. coli
gcttcaaggtgtttcgcgccattat

SEQ ID NO: 18905 - DNA, 25 bp, E. coli
gaaggtgaagtcattgccagcaacg

SEQ ID NO: 18906 - DNA, 25 bp, E. coli
gaaggtgaagtctttgccagcaacg

SEQ ID NO: 18907 - DNA, 25 bp, E. coli
caatttcagtatgaatgttgttccc

SEQ ID NO: 18908 - DNA, 25 bp, E. coli
caatttcagtatcaatgttgttccc

SEQ ID NO: 18909 - DNA, 25 bp, E. coli
cagcagcgatatcttatgcacataa

SEQ ID NO: 18910 - DNA, 25 bp, E. coli
cagcagcgatatgttatgcacataa

SEQ ID NO: 18911 - DNA, 25 bp, E. coli
aaattcacgaattagcgggctacag

SEQ ID NO: 18912 - DNA, 25 bp, E. coli
aaattcacgaataagcgggctacag

SEQ ID NO: 18913 - DNA, 25 bp, E. coli
tttgcgagcatcattccaccgccag

SEQ ID NO: 18914 - DNA, 25 bp, E. coli
tttgcgagcatctttccaccgccag

SEQ ID NO: 18915 - DNA, 25 bp, E. coli
ttgcacaaataaacaggaatcagcc

SEQ ID NO: 18916 - DNA, 25 bp, E. coli
ttagcgggctactgcagcgatatct

SEQ ID NO: 18917 - DNA, 25 bp, E. coli
ttagcgggctacagcagcgatatct

SEQ ID NO: 18918 - DNA, 25 bp, E. coli
ttgcacaaataatcaggaatcagcc

SEQ ID NO: 18919 - DNA, 25 bp, E. coli
tgttgttcccttgctcgtagttcat

SEQ ID NO: 18920 - DNA, 25 bp, E. coli
tgttgttcccttcctcgtagttcat

SEQ ID NO: 18921 - DNA, 25 bp, E. coli
gcacgctgcatttttgcgagcatca

SEQ ID NO: 18922 - DNA, 25 bp, E. coli
gcacgctgcattattgcgagcatca

SEQ ID NO: 18923 - DNA, 25 bp, E. coli
cgccagaacaactcaacttcacttg

SEQ ID NO: 18924 - DNA, 25 bp, E. coli
cgccagaacaacacaacttcacttg

SEQ ID NO: 18925 - DNA, 25 bp, E. coli
cgtagttcatcctttgcacgctgca

SEQ ID NO: 18926 - DNA, 25 bp, E. coli
cgtagttcatccattgcacgctgca

SEQ ID NO: 18927 - DNA, 25 bp, E. coli
ggaatcagccacaaaaattcacgaa

SEQ ID NO: 18928 - DNA, 25 bp, E. coli
ggaatcagccactaaaattcacgaa

SEQ ID NO: 18929 - DNA, 25 bp, E. coli
catcaggcaatggtgctcggatgcc

SEQ ID NO: 18930 - DNA, 25 bp, E. coli
catcaggcaatgctgctcggatgcc

SEQ ID NO: 18931 - DNA, 25 bp, E. coli
tacatcattgcgcatgcgctgcttt

SEQ ID NO: 18932 - DNA, 25 bp, E. coli
tacatcattgcggatgcgctgcttt

SEQ ID NO: 18933 - DNA, 25 bp, E. coli
atcattgcggatccgctgctttagg

SEQ ID NO: 18934 - DNA, 25 bp, E. coli
atcattgcggatgcgctgctttagg

SEQ ID NO: 18935 - DNA, 25 bp, E. coli
tatccggcctaccagatgaagcgat

SEQ ID NO: 18936 - DNA, 25 bp, E. coli
tatccggcctacgagatgaagcgat

SEQ ID NO: 18937 - DNA, 25 bp, E. coli
ttggcatcgacgcatgactgccgga

SEQ ID NO: 18938 - DNA, 25 bp, E. coli
ttggcatcgacggatgactgccgga

SEQ ID NO: 18939 - DNA, 25 bp, E. coli
ttagggtggcgcatttggcatcgac

SEQ ID NO: 18940 - DNA, 25 bp, E. coli
ttagggtggcgcttttggcatcgac

SEQ ID NO: 18941 - DNA, 25 bp, E. coli
tccggcctacggatcaggcacaggt

SEQ ID NO: 18942 - DNA, 25 bp, E. coli
tccggcctacggttcaggcacaggt

SEQ ID NO: 18943 - DNA, 25 bp, E. coli
gcgcatttggcatcgacgcatgact

SEQ ID NO: 18944 - DNA, 25 bp, E. coli
gcgcatttggcaacgacgcatgact

SEQ ID NO: 18945 - DNA, 25 bp, E. coli
ctgctttagggtcgcgcatttggca

SEQ ID NO: 18946 - DNA, 25 bp, E. coli
ctacgagatgaagcgatgttttggc

SEQ ID NO: 18947 - DNA, 25 bp, E. coli
ctacgagatgaaccgatgttttggc

SEQ ID NO: 18948 - DNA, 25 bp, E. coli
ctgctttagggtggcgcatttggca

SEQ ID NO: 18949 - DNA, 25 bp, E. coli
cggttcaggcacaggtttgtaggcc

SEQ ID NO: 18950 - DNA, 25 bp, E. coli
cggttcaggcactggtttgtaggcc

SEQ ID NO: 18951 - DNA, 25 bp, E. coli
aaaagattctgatggctgccatccc

SEQ ID NO: 18952 - DNA, 25 bp, E. coli
aaaagattctgaaggctgccatccc

SEQ ID NO: 18953 - DNA, 25 bp, E. coli
acgggagtgagaagtcaatgacgct

SEQ ID NO: 18954 - DNA, 25 bp, E. coli
acgggagtgagatgtcaatgacgct

SEQ ID NO: 18955 - DNA, 25 bp, E. coli
ttcgctggacagtacccgcgcggtg

SEQ ID NO: 18956 - DNA, 25 bp, E. coli
ttcgctggacagaacccgcgcggtg

SEQ ID NO: 18957 - DNA, 25 bp, E. coli
tgagaagtcaatcacgcttgatatc

SEQ ID NO: 18958 - DNA, 25 bp, E. coli
tgtttgttatatccggggcagacgc

SEQ ID NO: 18959 - DNA, 25 bp, E. coli
tgagaagtcaatgacgcttgatatc

SEQ ID NO: 18960 - DNA, 25 bp, E. coli
tgtttgttatatgcggggcagacgc

SEQ ID NO: 18961 - DNA, 25 bp, E. coli
tcgaaaaaagatactgatggctgcc

SEQ ID NO: 18962 - DNA, 25 bp, E. coli
tcgaaaaaagattctgatggctgcc

SEQ ID NO: 18963 - DNA, 25 bp, E. coli
gctgtttcgctgcacagaacccgcg

SEQ ID NO: 18964 - DNA, 25 bp, E. coli
gctgtttcgctggacagaacccgcg

SEQ ID NO: 18965 - DNA, 25 bp, E. coli
gcagacgctgctctttcgctggaca

SEQ ID NO: 18966 - DNA, 25 bp, E. coli
gcagacgctgctgtttcgctggaca

SEQ ID NO: 18967 - DNA, 25 bp, E. coli
gaacccgcgcggtgtttgacgggag

SEQ ID NO: 18968 - DNA, 25 bp, E. coli
gaacccgcgcggagtttgacgggag

SEQ ID NO: 18969 - DNA, 25 bp, E. coli
tgtggaaattaagtatgattcgaaa

SEQ ID NO: 18970 - DNA, 25 bp, E. coli
tgtggaaattaactatgattcgaaa

SEQ ID NO: 18971 - DNA, 25 bp, E. coli
gatggctgccatgcccctgtttgtt

SEQ ID NO: 18972 - DNA, 25 bp, E. coli
gatggctgccatccccctgtttgtt

SEQ ID NO: 18973 - DNA, 25 bp, E. coli
caagttgtatatattttgaaacgct

SEQ ID NO: 18974 - DNA, 25 bp, E. coli
caagttgtatattttttgaaacgct

SEQ ID NO: 18975 - DNA, 25 bp, E. coli
caaacaaaatcagacaaataacgcg

SEQ ID NO: 18976 - DNA, 25 bp, E. coli
caaacaaaatcacacaaataacgcg

SEQ ID NO: 18977 - DNA, 25 bp, E. coli
taactgtagcaaatgagcgatgata

SEQ ID NO: 18978 - DNA, 25 bp, E. coli
tatcagcatatatcaatctaaccaa

SEQ ID NO: 18979 - DNA, 25 bp, E. coli
tatcagcatataacaatctaaccaa

SEQ ID NO: 18980 - DNA, 25 bp, E. coli
tgactcttgaatcgtttcagcactt

SEQ ID NO: 18981 - DNA, 25 bp, E. coli
tgactcttgaatggtttcagcactt

SEQ ID NO: 18982 - DNA, 25 bp, E. coli
tccctggaacgttaaatctttgata

SEQ ID NO: 18983 - DNA, 25 bp, E. coli
tccctggaacgtaaaatctttgata

SEQ ID NO: 18984 - DNA, 25 bp, E. coli
cctatttatcatcccaactatcagc

SEQ ID NO: 18985 - DNA, 25 bp, E. coli
ccttttggattattttcagcgtata

SEQ ID NO: 18986 - DNA, 25 bp, E. coli
cctatttatcatgccaactatcagc

SEQ ID NO: 18987 - DNA, 25 bp, E. coli
ccttttggattaatttcagcgtata

SEQ ID NO: 18988 - DNA, 25 bp, E. coli
cgcgataaattattttaactgtagc

SEQ ID NO: 18989 - DNA, 25 bp, E. coli
cgcgataaattaatttaactgtagc

SEQ ID NO: 18990 - DNA, 25 bp, E. coli
taatgcgcgccaattgactcttgaa

SEQ ID NO: 18991 - DNA, 25 bp, E. coli
taatttcagcgtataatgcgcgcca

SEQ ID NO: 18992 - DNA, 25 bp, E. coli
taatttcagcgtttaatgcgcgcca

SEQ ID NO: 18993 - DNA, 25 bp, E. coli
taactgtagcaattgagcgatgata

SEQ ID NO: 18994 - DNA, 25 bp, E. coli
taatgcgcgccatttgactcttgaa

SEQ ID NO: 18995 - DNA, 25 bp, E. coli
caccgaattctctacgcttatagcg

SEQ ID NO: 18996 - DNA, 25 bp, E. coli
caccgaattctcaacgcttatagcg

SEQ ID NO: 18997 - DNA, 25 bp, E. coli
cagatggcaatgtgatccactgctt

SEQ ID NO: 18998 - DNA, 25 bp, E. coli
cagatggcaatgagatccactgctt

SEQ ID NO: 18999 - DNA, 25 bp, E. coli
cagtcctgcgcgagattatttcagc

SEQ ID NO: 19000 - DNA, 25 bp, E. coli
cagtcctgcgcgtgattatttcagc

SEQ ID NO: 19001 - DNA, 25 bp, E. coli
taaaagaaaacaaccatcactggtg

SEQ ID NO: 19002 - DNA, 25 bp, E. coli
taaaagaaaacatccatcactggtg

SEQ ID NO: 19003 - DNA, 25 bp, E. coli
tacgctatgcgaaaatgcagatggc

SEQ ID NO: 19004 - DNA, 25 bp, E. coli
tacgctatgcgataatgcagatggc

SEQ ID NO: 19005 - DNA, 25 bp, E. coli
tgacccagctactacatacaccgaa

SEQ ID NO: 19006 - DNA, 25 bp, E. coli
tgacccagctacaacatacaccgaa

SEQ ID NO: 19007 - DNA, 25 bp, E. coli
tcgtcgcgtagtgtaagcgatcact

SEQ ID NO: 19008 - DNA, 25 bp, E. coli
tcgtcgcgtagtctaagcgatcact

SEQ ID NO: 19009 - DNA, 25 bp, E. coli
cccattacgcttttattaaggagca

SEQ ID NO: 19010 - DNA, 25 bp, E. coli
cccattacgcttatattaaggagca

SEQ ID NO: 19011 - DNA, 25 bp, E. coli
cattagtgatattaaaggtaaggcc

SEQ ID NO: 19012 - DNA, 25 bp, E. coli
cattagtgatataaaaggtaaggcc

SEQ ID NO: 19013 - DNA, 25 bp, E. coli
taattgattagtcatagccagcgat

SEQ ID NO: 19014 - DNA, 25 bp, E. coli
taatctatttacagtcctgcgcgag

SEQ ID NO: 19015 - DNA, 25 bp, E. coli
taattgattagtgatagccagcgat

SEQ ID NO: 19016 - DNA, 25 bp, E. coli
taatctatttactgtcctgcgcgag

SEQ ID NO: 19017 - DNA, 25 bp, E. coli
cattagaagaagtgacagaatttgc

SEQ ID NO: 19018 - DNA, 25 bp, E. coli
actaagcggttctcttcattagaag

SEQ ID NO: 19019 - DNA, 25 bp, E. coli
actaagcggttcacttcattagaag

SEQ ID NO: 19020 - DNA, 25 bp, E. coli
tagacatgagtctacgccgcatcac

SEQ ID NO: 19021 - DNA, 25 bp, E. coli
tagacatgagtcaacgccgcatcac

SEQ ID NO: 19022 - DNA, 25 bp, E. coli
tgtacaggtacatcagcaaaagtta

SEQ ID NO: 19023 - DNA, 25 bp, E. coli
tgttaataaaaaggtggcacagctt

SEQ ID NO: 19024 - DNA, 25 bp, E. coli
tgtacaggtacaacagcaaaagtta

SEQ ID NO: 19025 - DNA, 25 bp, E. coli
tgttaataaaaacgtggcacagctt

SEQ ID NO: 19026 - DNA, 25 bp, E. coli
taaatgaaaaccacaagtccctggc

SEQ ID NO: 19027 - DNA, 25 bp, E. coli
taaatgaaaacctcaagtccctggc

SEQ ID NO: 19028 - DNA, 25 bp, E. coli
cggaatctgtcctgttactaagcgg

SEQ ID NO: 19029 - DNA, 25 bp, E. coli
cggaatctgtccagttactaagcgg

SEQ ID NO: 19030 - DNA, 25 bp, E. coli
cattagaagaagagacagaatttgc

SEQ ID NO: 19031 - DNA, 25 bp, E. coli
gtatcattatagaattgccacgcct

SEQ ID NO: 19032 - DNA, 25 bp, E. coli
gtatcattatagtattgccacgcct

SEQ ID NO: 19033 - DNA, 25 bp, E. coli
ggccacttgaactccgggacattgt

SEQ ID NO: 19034 - DNA, 25 bp, E. coli
ggccacttgaacaccgggacattgt

SEQ ID NO: 19035 - DNA, 25 bp, E. coli
ggcacagcttacatttacaacggca

SEQ ID NO: 19036 - DNA, 25 bp, E. coli
ggcattatctattaatacggcgtag

SEQ ID NO: 19037 - DNA, 25 bp, E. coli
ggcacagcttacttttacaacggca

SEQ ID NO: 19038 - DNA, 25 bp, E. coli
ggcattatctataaatacggcgtag

SEQ ID NO: 19039 - DNA, 25 bp, E. coli
caggcgttccggcagtatctgaaaa

SEQ ID NO: 19040 - DNA, 25 bp, E. coli
caggcgttccgggagtatctgaaaa

SEQ ID NO: 19041 - DNA, 25 bp, E. coli
tacaacgtctggtgtattatcgtca

SEQ ID NO: 19042 - DNA, 25 bp, E. coli
tacaacgtctggagtattatcgtca

SEQ ID NO: 19043 - DNA, 25 bp, E. coli
aacgttccgcttcttatcgataaag

SEQ ID NO: 19044 - DNA, 25 bp, E. coli
aacgttccgcttgttatcgataaag

SEQ ID NO: 19045 - DNA, 25 bp, E. coli
tatcgtccgaaacaggtagaggaga

SEQ ID NO: 19046 - DNA, 25 bp, E. coli
tatcgtccgaaagaggtagaggaga

SEQ ID NO: 19047 - DNA, 25 bp, E. coli
tattatcgtcaggtttatcgtccga

SEQ ID NO: 19048 - DNA, 25 bp, E. coli
tattatcgtcagctttatcgtccga

SEQ ID NO: 19049 - DNA, 25 bp, E. coli
taacgcgattccgtccggaatacct

SEQ ID NO: 19050 - DNA, 25 bp, E. coli
tcgataaagccgaagatttcatggc

SEQ ID NO: 19051 - DNA, 25 bp, E. coli
tcgataaagccgtagatttcatggc

SEQ ID NO: 19052 - DNA, 25 bp, E. coli
tccggaatacctgatgaaagcgtgc

SEQ ID NO: 19053 - DNA, 25 bp, E. coli
tccggaatacctcatgaaagcgtgc

SEQ ID NO: 19054 - DNA, 25 bp, E. coli
taacgcgattccctccggaatacct

SEQ ID NO: 19055 - DNA, 25 bp, E. coli
gcaaattaggtgtaaacgttccgct

SEQ ID NO: 19056 - DNA, 25 bp, E. coli
gcaaattaggtgaaaacgttccgct

SEQ ID NO: 19057 - DNA, 25 bp, E. coli
gaaagcgtgccgttatatctacaac

SEQ ID NO: 19058 - DNA, 25 bp, E. coli
gaaagcgtgccgatatatctacaac

SEQ ID NO: 19059 - DNA, 25 bp, E. coli
gatttcatggcaaccagccaggcgt

SEQ ID NO: 19060 - DNA, 25 bp, E. coli
gatttcatggcatccagccaggcgt

SEQ ID NO: 19061 - DNA, 25 bp, E. coli
cacctgaaaaatagggatgtgcatc

SEQ ID NO: 19062 - DNA, 25 bp, E. coli
cacctgaaaaattgggatgtgcatc

SEQ ID NO: 19063 - DNA, 25 bp, E. coli
cacttattcagctctataacacctg

SEQ ID NO: 19064 - DNA, 25 bp, E. coli
cacttattcagcactataacacctg

SEQ ID NO: 19065 - DNA, 25 bp, E. coli
caggaacttttttgagcaataggcc

SEQ ID NO: 19066 - DNA, 25 bp, E. coli
caggaactttttagagcaataggcc

SEQ ID NO: 19067 - DNA, 25 bp, E. coli
tgatgctcgacagaagaagtgttct

SEQ ID NO: 19068 - DNA, 25 bp, E. coli
tgatgctcgacacaagaagtgttct

SEQ ID NO: 19069 - DNA, 25 bp, E. coli
tcaggagtatagagatgctcgacag

SEQ ID NO: 19070 - DNA, 25 bp, E. coli
tctgaatattcagactctttacagg

SEQ ID NO: 19071 - DNA, 25 bp, E. coli
tctgaatattcacactctttacagg

SEQ ID NO: 19072 - DNA, 25 bp, E. coli
tcaggagtatagtgatgctcgacag

SEQ ID NO: 19073 - DNA, 25 bp, E. coli
gaagtgttctgaatgaaagcgacta

SEQ ID NO: 19074 - DNA, 25 bp, E. coli
gaagtgttctgattgaaagcgacta

SEQ ID NO: 19075 - DNA, 25 bp, E. coli
gaaagcgactaagttaaggagtgag

SEQ ID NO: 19076 - DNA, 25 bp, E. coli
gaaagcgactaacttaaggagtgag

SEQ ID NO: 19077 - DNA, 25 bp, E. coli
cgcgggatggttccagtaagttcca

SEQ ID NO: 19078 - DNA, 25 bp, E. coli
cgcgggatggttgcagtaagttcca

SEQ ID NO: 19079 - DNA, 25 bp, E. coli
ggatgtgcatctttatatattctga

SEQ ID NO: 19080 - DNA, 25 bp, E. coli
ggatgtgcatctatatatattctga

SEQ ID NO: 19081 - DNA, 25 bp, E. coli
gagcaataggccatcaggagtatag

SEQ ID NO: 19082 - DNA, 25 bp, E. coli
gagcaataggccttcaggagtatag

SEQ ID NO: 19083 - DNA, 25 bp, E. coli
caaagtgcggcaattaagcgaagga

SEQ ID NO: 19084 - DNA, 25 bp, E. coli
caaagtgcggcatttaagcgaagga

SEQ ID NO: 19085 - DNA, 25 bp, E. coli
tacaacgggtaggaaaacagatcga

SEQ ID NO: 19086 - DNA, 25 bp, E. coli
tacaacgggtagcaaaacagatcga

SEQ ID NO: 19087 - DNA, 25 bp, E. coli
ttaaagctggaacccattctggcgc

SEQ ID NO: 19088 - DNA, 25 bp, E. coli
ttacggacagaagtaccgcggctgg

SEQ ID NO: 19089 - DNA, 25 bp, E. coli
ttaaagctggaagccattctggcgc

SEQ ID NO: 19090 - DNA, 25 bp, E. coli
ttacggacagaactaccgcggctgg

SEQ ID NO: 19091 - DNA, 25 bp, E. coli
gctgcgcagtgaacaacgggtgatt

SEQ ID NO: 19092 - DNA, 25 bp, E. coli
gctgcgcagtgatcaacgggtgatt

SEQ ID NO: 19093 - DNA, 25 bp, E. coli
gaatctggtgtaaatggcgagcgca

SEQ ID NO: 19094 - DNA, 25 bp, E. coli
gaatacaaaaccctgcgcggcttaa

SEQ ID NO: 19095 - DNA, 25 bp, E. coli
gaatacaaaaccgtgcgcggcttaa

SEQ ID NO: 19096 - DNA, 25 bp, E. coli
gaatctggtgtatatggcgagcgca

SEQ ID NO: 19097 - DNA, 25 bp, E. coli
gaatcgcaggcttttctggtggccg

SEQ ID NO: 19098 - DNA, 25 bp, E. coli
gaatcgcaggctattctggtggccg

SEQ ID NO: 19099 - DNA, 25 bp, E. coli
gaacaggcagcggaaaagcatcttc

SEQ ID NO: 19100 - DNA, 25 bp, E. coli
gaacaggcagcgcaaaagcatcttc

SEQ ID NO: 19101 - DNA, 25 bp, E. coli
tggctggcctttagcccggaacaag

SEQ ID NO: 19102 - DNA, 25 bp, E. coli
tggctggccttttgcccggaacaag

SEQ ID NO: 19103 - DNA, 25 bp, E. coli
gatgcaatggtggtacgcgaaacca

SEQ ID NO: 19104 - DNA, 25 bp, E. coli
gatgcaatggtgctacgcgaaacca

SEQ ID NO: 19105 - DNA, 25 bp, E. coli
aatttgtcacccaggaagatacgcc

SEQ ID NO: 19106 - DNA, 25 bp, E. coli
aatttgtcaccctggaagatacgcc

SEQ ID NO: 19107 - DNA, 25 bp, E. coli
tacgccgctgattggtgttacccag

SEQ ID NO: 19108 - DNA, 25 bp, E. coli
tacgccgctgataggtgttacccag

SEQ ID NO: 19109 - DNA, 25 bp, E. coli
tacctatgaaggactgggaaccggc

SEQ ID NO: 19110 - DNA, 25 bp, E. coli
tacctatgaaggtctgggaaccggc

SEQ ID NO: 19111 - DNA, 25 bp, E. coli
tatacggaacgtccatgccaatgct

SEQ ID NO: 19112 - DNA, 25 bp, E. coli
tatacggaacgtgcatgccaatgct

SEQ ID NO: 19113 - DNA, 25 bp, E. coli
tcgtttgtcgaattcggcggtcgca

SEQ ID NO: 19114 - DNA, 25 bp, E. coli
tcgtttgtcgaaatcggcggtcgca

SEQ ID NO: 19115 - DNA, 25 bp, E. coli
tctggctggaagctcatctggatca

SEQ ID NO: 19116 - DNA, 25 bp, E. coli
tctggctggaaggtcatctggatca

SEQ ID NO: 19117 - DNA, 25 bp, E. coli
gaatgtttaaagatgtcactggcca

SEQ ID NO: 19118 - DNA, 25 bp, E. coli
gaatgtttaaagttgtcactggcca

SEQ ID NO: 19119 - DNA, 25 bp, E. coli
cgaaagcaggttattccaagtggca

SEQ ID NO: 19120 - DNA, 25 bp, E. coli
cgaaagcaggtttttccaagtggca

SEQ ID NO: 19121 - DNA, 25 bp, E. coli
gattctggacatcgcgctgcaatac

SEQ ID NO: 19122 - DNA, 25 bp, E. coli
gatattgagcgaaactacccggcag

SEQ ID NO: 19123 - DNA, 25 bp, E. coli
gattctggacatggcgctgcaatac

SEQ ID NO: 19124 - DNA, 25 bp, E. coli
gatattgagcgatactacccggcag

SEQ ID NO: 19125 - DNA, 25 bp, E. coli
gatcaggccggctttattcgcgacc

SEQ ID NO: 19126 - DNA, 25 bp, E. coli
gatcaggccggcattattcgcgacc

SEQ ID NO: 19127 - DNA, 25 bp, E. coli
gaaatgggcgttgtgaccgttaccg

SEQ ID NO: 19128 - DNA, 25 bp, E. coli
gaaatgggcgttctgaccgttaccg

SEQ ID NO: 19129 - DNA, 25 bp, E. coli
taaaacgcattagtacagtgtggcc

SEQ ID NO: 19130 - DNA, 25 bp, E. coli
taaaacgcattactacagtgtggcc

SEQ ID NO: 19131 - DNA, 25 bp, E. coli
aaaaatgaagatggccggacagccg

SEQ ID NO: 19132 - DNA, 25 bp, E. coli
aaaaatgaagatcgccggacagccg

SEQ ID NO: 19133 - DNA, 25 bp, E. coli
tatcggcaacgtggtcggcaaaacc

SEQ ID NO: 19134 - DNA, 25 bp, E. coli
tatcggcaacgtcgtcggcaaaacc

SEQ ID NO: 19135 - DNA, 25 bp, E. coli
ttgctgatgaagtcctgaaccccgt

SEQ ID NO: 19136 - DNA, 25 bp, E. coli
ttttgttaagtcagcagcagcgtgc

SEQ ID NO: 19137 - DNA, 25 bp, E. coli
ttttgttaagtctgcagcagcgtgc

SEQ ID NO: 19138 - DNA, 25 bp, E. coli
ttgctgatgaagacctgaaccccgt

SEQ ID NO: 19139 - DNA, 25 bp, E. coli
tttcaacctggtcagctggcagagc

SEQ ID NO: 19140 - DNA, 25 bp, E. coli
tttcaacctggtgagctggcagagc

SEQ ID NO: 19141 - DNA, 25 bp, E. coli
gctttacaccaccatgcttaccggg

SEQ ID NO: 19142 - DNA, 25 bp, E. coli
gctttacaccacgatgcttaccggg

SEQ ID NO: 19143 - DNA, 25 bp, E. coli
gattatcgctacatcctcgaagagg

SEQ ID NO: 19144 - DNA, 25 bp, E. coli
gattatcgctacttcctcgaagagg

SEQ ID NO: 19145 - DNA, 25 bp, E. coli
ggatgaatatcacgagcacgccaca

SEQ ID NO: 19146 - DNA, 25 bp, E. coli
ggatgaatatcaggagcacgccaca

SEQ ID NO: 19147 - DNA, 25 bp, E. coli
tcacattgagtcctacgggatccgc

SEQ ID NO: 19148 - DNA, 25 bp, E. coli
tcacattgagtcgtacgggatccgc

SEQ ID NO: 19149 - DNA, 25 bp, E. coli
aatacgcctgttcctgctctgcggg

SEQ ID NO: 19150 - DNA, 25 bp, E. coli
aatacgcctgttgctgctctgcggg

SEQ ID NO: 19151 - DNA, 25 bp, E. coli
aaacttgtctatttggtcagccccg

SEQ ID NO: 19152 - DNA, 25 bp, E. coli
aaacttgtctatatggtcagccccg

SEQ ID NO: 19153 - DNA, 25 bp, E. coli
taccaccactggacatcagacagga

SEQ ID NO: 19154 - DNA, 25 bp, E. coli
taccaccactggtcatcagacagga

SEQ ID NO: 19155 - DNA, 25 bp, E. coli
tattacaaactctatgacagcctgg

SEQ ID NO: 19156 - DNA, 25 bp, E. coli
tattacaaactcaatgacagcctgg

SEQ ID NO: 19157 - DNA, 25 bp, E. coli
tgttgatatccacatcctgcgctta

SEQ ID NO: 19158 - DNA, 25 bp, E. coli
tgttgatatccagatcctgcgctta

SEQ ID NO: 19159 - DNA, 25 bp, E. coli
ccagacagataaggtgacaggacgg

SEQ ID NO: 19160 - DNA, 25 bp, E. coli
ccagacagataacgtgacaggacgg

SEQ ID NO: 19161 - DNA, 25 bp, E. coli
ggtgcgacaaattacagcagtgtgg

SEQ ID NO: 19162 - DNA, 25 bp, E. coli
ggtgcgacaaataacagcagtgtgg

SEQ ID NO: 19163 - DNA, 25 bp, E. coli
gggagtttacctgtgcaacgctaag

SEQ ID NO: 19164 - DNA, 25 bp, E. coli
gggagtttacctctgcaacgctaag

SEQ ID NO: 19165 - DNA, 25 bp, E. coli
tgcgggtaaggcagttaaacttgtc

SEQ ID NO: 19166 - DNA, 25 bp, E. coli
tgcgggtaaggctgttaaacttgtc

SEQ ID NO: 19167 - DNA, 25 bp, E. coli
taagtagcactatctggcaatacgc

SEQ ID NO: 19168 - DNA, 25 bp, E. coli
taagtagcactaactggcaatacgc

SEQ ID NO: 19169 - DNA, 25 bp, E. coli
gatgatgttacggtgaaccagacag

SEQ ID NO: 19170 - DNA, 25 bp, E. coli
gatgatgttacgctgaaccagacag

SEQ ID NO: 19171 - DNA, 25 bp, E. coli
aatggctacgccaacaaactgctgt

SEQ ID NO: 19172 - DNA, 25 bp, E. coli
aatggctacgcctacaaactgctgt

SEQ ID NO: 19173 - DNA, 25 bp, E. coli
cacccggatggtcggtcaaaaacag

SEQ ID NO: 19174 - DNA, 25 bp, E. coli
cacccggatggtgggtcaaaaacag

SEQ ID NO: 19175 - DNA, 25 bp, E. coli
tacatgttctgctcaacgacgacgc

SEQ ID NO: 19176 - DNA, 25 bp, E. coli
tacatgttctgcacaacgacgacgc

SEQ ID NO: 19177 - DNA, 25 bp, E. coli
ttcgtcgacaagaaagaggccagcg

SEQ ID NO: 19178 - DNA, 25 bp, E. coli
ttcgtcgacaagtaagaggccagcg

SEQ ID NO: 19179 - DNA, 25 bp, E. coli
ttacgtgcgctgcacaaactgatcg

SEQ ID NO: 19180 - DNA, 25 bp, E. coli
ttacgtgcgctggacaaactgatcg

SEQ ID NO: 19181 - DNA, 25 bp, E. coli
tcgataaactcgtcggcaaaccgtt

SEQ ID NO: 19182 - DNA, 25 bp, E. coli
tcgataaactcgacggcaaaccgtt

SEQ ID NO: 19183 - DNA, 25 bp, E. coli
gcaaacgttcccctgccattgaaga

SEQ ID NO: 19184 - DNA, 25 bp, E. coli
gcaaacgttcccgtgccattgaaga

SEQ ID NO: 19185 - DNA, 25 bp, E. coli
ctgatcgtcaaagcgaacgccgtga

SEQ ID NO: 19186 - DNA, 25 bp, E. coli
ctgatcgtcaaaccgaacgccgtga

SEQ ID NO: 19187 - DNA, 25 bp, E. coli
cattctgcaaaatgatgacagccgc

SEQ ID NO: 19188 - DNA, 25 bp, E. coli
cattctgcaaaaagatgacagccgc

SEQ ID NO: 19189 - DNA, 25 bp, E. coli
gtaattttgccgtcctgctggccca

SEQ ID NO: 19190 - DNA, 25 bp, E. coli
ggcctgaaaaatttccccgtcgaat

SEQ ID NO: 19191 - DNA, 25 bp, E. coli
gtaattttgccgacctgctggccca

SEQ ID NO: 19192 - DNA, 25 bp, E. coli
ggcctgaaaaatatccccgtcgaat

SEQ ID NO: 19193 - DNA, 25 bp, E. coli
aagtgattccgcgtaataccactat

SEQ ID NO: 19194 - DNA, 25 bp, E. coli
aagtgattccgcctaataccactat

SEQ ID NO: 19195 - DNA, 25 bp, E. coli
cgtcctgcgcttacttaacgaaccg

SEQ ID NO: 19196 - DNA, 25 bp, E. coli
cgtcctgcgctttcttaacgaaccg

SEQ ID NO: 19197 - DNA, 25 bp, E. coli
tgattccgcgtaataccactattcc

SEQ ID NO: 19198 - DNA, 25 bp, E. coli
tgattccgcgtattaccactattcc

SEQ ID NO: 19199 - DNA, 25 bp, E. coli
tgcagcgctcgataccgccaacaca

SEQ ID NO: 19200 - DNA, 25 bp, E. coli
tgcagcgctcgaaaccgccaacaca

SEQ ID NO: 19201 - DNA, 25 bp, E. coli
tcaggtcattgacgatgctgccgct

SEQ ID NO: 19202 - DNA, 25 bp, E. coli
tcaggtcattgaggatgctgccgct

SEQ ID NO: 19203 - DNA, 25 bp, E. coli
gcagaacgtcagctcattgacgatg

SEQ ID NO: 19204 - DNA, 25 bp, E. coli
gaacgtcaggtctttgacgatgctg

SEQ ID NO: 19205 - DNA, 25 bp, E. coli
gaacgtcaggtcattgacgatgctg

SEQ ID NO: 19206 - DNA, 25 bp, E. coli
gcagaacgtcaggtcattgacgatg

SEQ ID NO: 19207 - DNA, 25 bp, E. coli
gtctggcgggccttcacgtcctgcg

SEQ ID NO: 19208 - DNA, 25 bp, E. coli
ggatgccgccatagcagccaaaatc

SEQ ID NO: 19209 - DNA, 25 bp, E. coli
gtctggcgggccatcacgtcctgcg

SEQ ID NO: 19210 - DNA, 25 bp, E. coli
gggccttcacgtgctgcgcttactt

SEQ ID NO: 19211 - DNA, 25 bp, E. coli
gggccttcacgtcctgcgcttactt

SEQ ID NO: 19212 - DNA, 25 bp, E. coli
ggatgccgccattgcagccaaaatc

SEQ ID NO: 19213 - DNA, 25 bp, E. coli
tcacgtcctgcgcttacttaacgaa

SEQ ID NO: 19214 - DNA, 25 bp, E. coli
tcacgtcctgcggttacttaacgaa

SEQ ID NO: 19215 - DNA, 25 bp, E. coli
caaagagttttcaggacaccacggg

SEQ ID NO: 19216 - DNA, 25 bp, E. coli
caaagagttttctggacaccacggg

SEQ ID NO: 19217 - DNA, 25 bp, E. coli
aaaaaagtctgtgagttctgggccg

SEQ ID NO: 19218 - DNA, 25 bp, E. coli
aaaaaagtctgtcagttctgggccg

SEQ ID NO: 19219 - DNA, 25 bp, E. coli
tgaaatgtcctccaccagccttgag

SEQ ID NO: 19220 - DNA, 25 bp, E. coli
tgaaatgtcctcgaccagccttgag

SEQ ID NO: 19221 - DNA, 25 bp, E. coli
tctaccagggcgtagagattggcat

SEQ ID NO: 19222 - DNA, 25 bp, E. coli
tctaccagggcgaagagattggcat

SEQ ID NO: 19223 - DNA, 25 bp, E. coli
tctggtgtaacctcgatcagccgcg

SEQ ID NO: 19224 - DNA, 25 bp, E. coli
tctggtgtaaccacgatcagccgcg

SEQ ID NO: 19225 - DNA, 25 bp, E. coli
tctttgcaccagaacaggcggatct

SEQ ID NO: 19226 - DNA, 25 bp, E. coli
tctttgcaccagtacaggcggatct

SEQ ID NO: 19227 - DNA, 25 bp, E. coli
gaaaacattgttgcgccactggcaa

SEQ ID NO: 19228 - DNA, 25 bp, E. coli
gaaaacattgttccgccactggcaa

SEQ ID NO: 19229 - DNA, 25 bp, E. coli
cgggccacgagcacacgagtttttg

SEQ ID NO: 19230 - DNA, 25 bp, E. coli
cttgagcattgcgagcgatacgcgg

SEQ ID NO: 19231 - DNA, 25 bp, E. coli
cgggccacgagctcacgagtttttg

SEQ ID NO: 19232 - DNA, 25 bp, E. coli
cttgagcattgccagcgatacgcgg

SEQ ID NO: 19233 - DNA, 25 bp, E. coli
tggactatctgcataaactgggcgt

SEQ ID NO: 19234 - DNA, 25 bp, E. coli
tggactatctgcttaaactgggcgt

SEQ ID NO: 19235 - DNA, 25 bp, E. coli
tggacgctggcttaacctgactttg

SEQ ID NO: 19236 - DNA, 25 bp, E. coli
tggacgctggctaaacctgactttg

SEQ ID NO: 19237 - DNA, 25 bp, E. coli
aattatcacctgactgctgttgcta

SEQ ID NO: 19238 - DNA, 25 bp, E. coli
aattatcacctgtctgctgttgcta

SEQ ID NO: 19239 - DNA, 25 bp, E. coli
attgccgccgccatgctggtgcggc

SEQ ID NO: 19240 - DNA, 25 bp, E. coli
attgccgccgccttgctggtgcggc

SEQ ID NO: 19241 - DNA, 25 bp, E. coli
tagtgcttaccgcagctgccactgc

SEQ ID NO: 19242 - DNA, 25 bp, E. coli
tagtgcttaccggagctgccactgc

SEQ ID NO: 19243 - DNA, 25 bp, E. coli
tattcgccgcgtagatgggcgacac

SEQ ID NO: 19244 - DNA, 25 bp, E. coli
tattcgccgcgttgatgggcgacac

SEQ ID NO: 19245 - DNA, 25 bp, E. coli
ttaatgatgctggtcgccgtagtgc

SEQ ID NO: 19246 - DNA, 25 bp, E. coli
ttaatgatgctgctcgccgtagtgc

SEQ ID NO: 19247 - DNA, 25 bp, E. coli
tcgccgcgttgaagggcgacacgcc

SEQ ID NO: 19248 - DNA, 25 bp, E. coli
tcgccgattaataatcacctgtctg

SEQ ID NO: 19249 - DNA, 25 bp, E. coli
tcgccgcgttgatgggcgacacgcc

SEQ ID NO: 19250 - DNA, 25 bp, E. coli
tcgccgattaattatcacctgtctg

SEQ ID NO: 19251 - DNA, 25 bp, E. coli
cctgtctgctgtagctaatagcttg

SEQ ID NO: 19252 - DNA, 25 bp, E. coli
cctgtctgctgttgctaatagcttg

SEQ ID NO: 19253 - DNA, 25 bp, E. coli
ggtgcggcgaatccgcttgctggaa

SEQ ID NO: 19254 - DNA, 25 bp, E. coli
ggtgcggcgaatgcgcttgctggaa

SEQ ID NO: 19255 - DNA, 25 bp, E. coli
tggtcgccgtagagcttaccgcagc

SEQ ID NO: 19256 - DNA, 25 bp, E. coli
tggtcgccgtagtgcttaccgcagc

SEQ ID NO: 19257 - DNA, 25 bp, E. coli
taatagcttgtgagatggcaggcgt

SEQ ID NO: 19258 - DNA, 25 bp, E. coli
taatagcttgtgtgatggcaggcgt

SEQ ID NO: 19259 - DNA, 25 bp, E. coli
taccattctggacagtgagcaggag

SEQ ID NO: 19260 - DNA, 25 bp, E. coli
taccattctggagagtgagcaggag

SEQ ID NO: 19261 - DNA, 25 bp, E. coli
tttggtaaaacacatcgctccgtgc

SEQ ID NO: 19262 - DNA, 25 bp, E. coli
tttggtaaaacagatcgctccgtgc

SEQ ID NO: 19263 - DNA, 25 bp, E. coli
tgacaaacagtcaacgggtacgctg

SEQ ID NO: 19264 - DNA, 25 bp, E. coli
tgagttgcagaataaccgtacctct

SEQ ID NO: 19265 - DNA, 25 bp, E. coli
tgacaaacagtctacgggtacgctg

SEQ ID NO: 19266 - DNA, 25 bp, E. coli
tgagttgcagaaaaaccgtacctct

SEQ ID NO: 19267 - DNA, 25 bp, E. coli
gatagcctgactcccggtacgatta

SEQ ID NO: 19268 - DNA, 25 bp, E. coli
gatagcctgactgccggtacgatta

SEQ ID NO: 19269 - DNA, 25 bp, E. coli
gtgtcattgtggtacgcggtacgca

SEQ ID NO: 19270 - DNA, 25 bp, E. coli
gtgtcattgtggaacgcggtacgca

SEQ ID NO: 19271 - DNA, 25 bp, E. coli
ggcgggcgtagcgttaatcctcaac

SEQ ID NO: 19272 - DNA, 25 bp, E. coli
tggataccgaatgcgaacgtgcgat

SEQ ID NO: 19273 - DNA, 25 bp, E. coli
tggataccgaatccgaacgtgcgat

SEQ ID NO: 19274 - DNA, 25 bp, E. coli
ggcgggcgtagccttaatcctcaac

SEQ ID NO: 19275 - DNA, 25 bp, E. coli
tcagcaaccgaatgcgtcttcaggg

SEQ ID NO: 19276 - DNA, 25 bp, E. coli
tcagcaaccgaaagcgtcttcaggg

SEQ ID NO: 19277 - DNA, 25 bp, E. coli
gatggtcacgatgtgcgcgagtata

SEQ ID NO: 19278 - DNA, 25 bp, E. coli
gatggtcacgatctgcgcgagtata

SEQ ID NO: 19279 - DNA, 25 bp, E. coli
gagccttgttgcgtgatagcccgat

SEQ ID NO: 19280 - DNA, 25 bp, E. coli
gagccttgttgcctgatagcccgat

SEQ ID NO: 19281 - DNA, 25 bp, E. coli
aacgcgccacgaatcgctcgccgga

SEQ ID NO: 19282 - DNA, 25 bp, E. coli
agcgcgattgcctggccgctgctca

SEQ ID NO: 19283 - DNA, 25 bp, E. coli
agcgcgattgccaggccgctgctca

SEQ ID NO: 19284 - DNA, 25 bp, E. coli
aaaacgcgccaccattcgctcgccg

SEQ ID NO: 19285 - DNA, 25 bp, E. coli
aaaacgcgccacgattcgctcgccg

SEQ ID NO: 19286 - DNA, 25 bp, E. coli
aacgcgccacgattcgctcgccgga

SEQ ID NO: 19287 - DNA, 25 bp, E. coli
ttgcctggccgctgctcatcccttg

SEQ ID NO: 19288 - DNA, 25 bp, E. coli
ttgcctggccgcagctcatcccttg

SEQ ID NO: 19289 - DNA, 25 bp, E. coli
ttttgctgctgttcatgggtgagtg

SEQ ID NO: 19290 - DNA, 25 bp, E. coli
ttttgctgctgtacatgggtgagtg

SEQ ID NO: 19291 - DNA, 25 bp, E. coli
tactcgtcttcaacctcaaaacgcg

SEQ ID NO: 19292 - DNA, 25 bp, E. coli
tactcgtcttcatcctcaaaacgcg

SEQ ID NO: 19293 - DNA, 25 bp, E. coli
gccatcagttcctggatccgctcga

SEQ ID NO: 19294 - DNA, 25 bp, E. coli
gccatcagttccaggatccgctcga

SEQ ID NO: 19295 - DNA, 25 bp, E. coli
gcacgcagctcttctgccaccagcg

SEQ ID NO: 19296 - DNA, 25 bp, E. coli
gcacgcagctctactgccaccagcg

SEQ ID NO: 19297 - DNA, 25 bp, E. coli
gtcttcatcctcaaaacgcgccacg

SEQ ID NO: 19298 - DNA, 25 bp, E. coli
gtcttcatcctctaaacgcgccacg

SEQ ID NO: 19299 - DNA, 25 bp, E. coli
tggcacgcagctgttctgccaccag

SEQ ID NO: 19300 - DNA, 25 bp, E. coli
tggttggcacgctgctcttctgcca

SEQ ID NO: 19301 - DNA, 25 bp, E. coli
tggttggcacgcagctcttctgcca

SEQ ID NO: 19302 - DNA, 25 bp, E. coli
tggcacgcagctcttctgccaccag

SEQ ID NO: 19303 - DNA, 25 bp, E. coli
caacgataacggctccatgtttaac

SEQ ID NO: 19304 - DNA, 25 bp, E. coli
caacgataacgggtccatgtttaac

SEQ ID NO: 19305 - DNA, 25 bp, E. coli
caaagtgactgttgatggtctgcgc

SEQ ID NO: 19306 - DNA, 25 bp, E. coli
caaagtgactgtagatggtctgcgc

SEQ ID NO: 19307 - DNA, 25 bp, E. coli
cagttggcggacagtgcgcttgaca

SEQ ID NO: 19308 - DNA, 25 bp, E. coli
cagttggcggactgtgcgcttgaca

SEQ ID NO: 19309 - DNA, 25 bp, E. coli
tactgcacgcctaatgtctttgacg

SEQ ID NO: 19310 - DNA, 25 bp, E. coli
tactgcacgccttatgtctttgacg

SEQ ID NO: 19311 - DNA, 25 bp, E. coli
tcatgcactgaatggtcaccgtgtg

SEQ ID NO: 19312 - DNA, 25 bp, E. coli
tctgcgcgcggtaaagccaatgcgt

SEQ ID NO: 19313 - DNA, 25 bp, E. coli
tcatgcactgaaaggtcaccgtgtg

SEQ ID NO: 19314 - DNA, 25 bp, E. coli
tctgcgcgcggttaagccaatgcgt

SEQ ID NO: 19315 - DNA, 25 bp, E. coli
gcggcaagtgccattaaagaagcga

SEQ ID NO: 19316 - DNA, 25 bp, E. coli
gcggcaagtgcctttaaagaagcga

SEQ ID NO: 19317 - DNA, 25 bp, E. coli
gacatttgcctggtatctatctggt

SEQ ID NO: 19318 - DNA, 25 bp, E. coli
gacatttgcctgctatctatctggt

SEQ ID NO: 19319 - DNA, 25 bp, E. coli
cggcggtgtagcagaaatggataaa

SEQ ID NO: 19320 - DNA, 25 bp, E. coli
ctatctggtctggtctttaaatggc

SEQ ID NO: 19321 - DNA, 25 bp, E. coli
cggcggtgtagctgaaatggataaa

SEQ ID NO: 19322 - DNA, 25 bp, E. coli
ctatctggtctgctctttaaatggc

SEQ ID NO: 19323 - DNA, 25 bp, E. coli
gtatcgccatcgacgaaacgccaga

SEQ ID NO: 19324 - DNA, 25 bp, E. coli
gtatcgccatcgtcgaaacgccaga

SEQ ID NO: 19325 - DNA, 25 bp, E. coli
caggtaaatgatccaacggcagccc

SEQ ID NO: 19326 - DNA, 25 bp, E. coli
caggtaaatgatgcaacggcagccc

SEQ ID NO: 19327 - DNA, 25 bp, E. coli
aactcagaaaccgtggcagatgcgc

SEQ ID NO: 19328 - DNA, 25 bp, E. coli
aactcagaaaccctggcagatgcgc

SEQ ID NO: 19329 - DNA, 25 bp, E. coli
ttttcgctggatccaaatcacggcg

SEQ ID NO: 19330 - DNA, 25 bp, E. coli
ttttcgctggatgcaaatcacggcg

SEQ ID NO: 19331 - DNA, 25 bp, E. coli
tggtaaccagtattgccgccggtga

SEQ ID NO: 19332 - DNA, 25 bp, E. coli
tgacgctgggcgaaaatctgctgga

SEQ ID NO: 19333 - DNA, 25 bp, E. coli
tgacgctgggcgtaaatctgctgga

SEQ ID NO: 19334 - DNA, 25 bp, E. coli
tctcttgaacatgtggcgggctcct

SEQ ID NO: 19335 - DNA, 25 bp, E. coli
tctcttgaacatctggcgggctcct

SEQ ID NO: 19336 - DNA, 25 bp, E. coli
gaactggttttcactcaggccggca

SEQ ID NO: 19337 - DNA, 25 bp, E. coli
gaactggttttctctcaggccggca

SEQ ID NO: 19338 - DNA, 25 bp, E. coli
cgttttcagatcacgctcagcggac

SEQ ID NO: 19339 - DNA, 25 bp, E. coli
cgttttcagatctcgctcagcggac

SEQ ID NO: 19340 - DNA, 25 bp, E. coli
gatatcaacctggtgacggctgtca

SEQ ID NO: 19341 - DNA, 25 bp, E. coli
gatatcaacctgctgacggctgtca

SEQ ID NO: 19342 - DNA, 25 bp, E. coli
gtacggtgacagacagtgccatcca

SEQ ID NO: 19343 - DNA, 25 bp, E. coli
gtacggtgacagtcagtgccatcca

SEQ ID NO: 19344 - DNA, 25 bp, E. coli
tggtaaccagtaatgccgccggtga

SEQ ID NO: 19345 - DNA, 25 bp, E. coli
tggaattgcgcaatgacggtcagcc

SEQ ID NO: 19346 - DNA, 25 bp, E. coli
tggaattgcgcattgacggtcagcc

SEQ ID NO: 19347 - DNA, 25 bp, E. coli
aatggctcactctagcttgctcacg

SEQ ID NO: 19348 - DNA, 25 bp, E. coli
aatggctcactcaagcttgctcacg

SEQ ID NO: 19349 - DNA, 25 bp, E. coli
cactcgaaagtactattacgtgtaa

SEQ ID NO: 19350 - DNA, 25 bp, E. coli
cactcgaaagtagtattacgtgtaa

SEQ ID NO: 19351 - DNA, 25 bp, E. coli
agataggtagatattcactcgaaag

SEQ ID NO: 19352 - DNA, 25 bp, E. coli
agataggtagattttcactcgaaag

SEQ ID NO: 19353 - DNA, 25 bp, E. coli
tattgttcggtatcaaagggagaca

SEQ ID NO: 19354 - DNA, 25 bp, E. coli
tattgttcggtaacaaagggagaca

SEQ ID NO: 19355 - DNA, 25 bp, E. coli
tgtaattatttcaatagcagttcgc

SEQ ID NO: 19356 - DNA, 25 bp, E. coli
tgtaattatttctatagcagttcgc

SEQ ID NO: 19357 - DNA, 25 bp, E. coli
gcttgctcacgattgattccagtaa

SEQ ID NO: 19358 - DNA, 25 bp, E. coli
gcttgctcacgaatgattccagtaa

SEQ ID NO: 19359 - DNA, 25 bp, E. coli
gcagttcgctatataggcttgtata

SEQ ID NO: 19360 - DNA, 25 bp, E. coli
gcagttcgctatttaggcttgtata

SEQ ID NO: 19361 - DNA, 25 bp, E. coli
cccgcaggcgctatttagattcaga

SEQ ID NO: 19362 - DNA, 25 bp, E. coli
cccgcaggcgctttttagattcaga

SEQ ID NO: 19363 - DNA, 25 bp, E. coli
gattttcgttttcataatggctcac

SEQ ID NO: 19364 - DNA, 25 bp, E. coli
gattttcgttttgataatggctcac

SEQ ID NO: 19365 - DNA, 25 bp, E. coli
gattccagtaacaaaccgtattgtg

SEQ ID NO: 19366 - DNA, 25 bp, E. coli
gattccagtaactaaccgtattgtg

SEQ ID NO: 19367 - DNA, 25 bp, E. coli
ggcttgtatacatcgaataatttga

SEQ ID NO: 19368 - DNA, 25 bp, E. coli
ggcttgtatacaacgaataatttga

SEQ ID NO: 19369 - DNA, 25 bp, E. coli
caatccacagtatgtggctcgcgaa

SEQ ID NO: 19370 - DNA, 25 bp, E. coli
caatccacagtaagtggctcgcgaa

SEQ ID NO: 19371 - DNA, 25 bp, E. coli
cagtatgtggctcgcgaatcaatca

SEQ ID NO: 19372 - DNA, 25 bp, E. coli
cagtatgtggctggcgaatcaatca

SEQ ID NO: 19373 - DNA, 25 bp, E. coli
attccggaaggcactcaacttatac

SEQ ID NO: 19374 - DNA, 25 bp, E. coli
aattccggaagggactcaacttata

SEQ ID NO: 19375 - DNA, 25 bp, E. coli
aattccggaaggcactcaacttata

SEQ ID NO: 19376 - DNA, 25 bp, E. coli
attggcctcgcgcatctgctcggca

SEQ ID NO: 19377 - DNA, 25 bp, E. coli
attccggaaggctctcaacttatac

SEQ ID NO: 19378 - DNA, 25 bp, E. coli
attggcctcgcggatctgctcggca

SEQ ID NO: 19379 - DNA, 25 bp, E. coli
ttccggaaggcagtcaacttataca

SEQ ID NO: 19380 - DNA, 25 bp, E. coli
ttccggaaggcactcaacttataca

SEQ ID NO: 19381 - DNA, 25 bp, E. coli
tgtggctcgcgattcaatcactcag

SEQ ID NO: 19382 - DNA, 25 bp, E. coli
tgtggctcgcgaatcaatcactcag

SEQ ID NO: 19383 - DNA, 25 bp, E. coli
tccggaaggcacacaacttatacac

SEQ ID NO: 19384 - DNA, 25 bp, E. coli
tccggaaggcactcaacttatacac

SEQ ID NO: 19385 - DNA, 25 bp, E. coli
gccgttcgccggacaaatgttcgca

SEQ ID NO: 19386 - DNA, 25 bp, E. coli
gctcggcacgcctgaaattccggaa

SEQ ID NO: 19387 - DNA, 25 bp, E. coli
gctcggcacgccagaaattccggaa

SEQ ID NO: 19388 - DNA, 25 bp, E. coli
gccgttcgccggtcaaatgttcgca

SEQ ID NO: 19389 - DNA, 25 bp, E. coli
gcatctgctcgggacgccagaaatt

SEQ ID NO: 19390 - DNA, 25 bp, E. coli
gcatctgctcggcacgccagaaatt

SEQ ID NO: 19391 - DNA, 25 bp, E. coli
caaaaattggctgagatcattaaga

SEQ ID NO: 19392 - DNA, 25 bp, E. coli
caaaaattggctcagatcattaaga

SEQ ID NO: 19393 - DNA, 25 bp, E. coli
tacaggcaggtttgatgcaaaaatt

SEQ ID NO: 19394 - DNA, 25 bp, E. coli
tacaggcaggttagatgcaaaaatt

SEQ ID NO: 19395 - DNA, 25 bp, E. coli
agcggcgtattaagttttcaaggat

SEQ ID NO: 19396 - DNA, 25 bp, E. coli
agcggcgtattatgttttcaaggat

SEQ ID NO: 19397 - DNA, 25 bp, E. coli
gcaggtttgatgcaaaaattggctc

SEQ ID NO: 19398 - DNA, 25 bp, E. coli
gcaggtttgatggaaaaattggctc

SEQ ID NO: 19399 - DNA, 25 bp, E. coli
gaagcggcgtataatgttttcaagg

SEQ ID NO: 19400 - DNA, 25 bp, E. coli
gaagcggcgtattatgttttcaagg

SEQ ID NO: 19401 - DNA, 25 bp, E. coli
cattaagaataaaatgaagcggcgt

SEQ ID NO: 19402 - DNA, 25 bp, E. coli
cattaagaataatatgaagcggcgt

SEQ ID NO: 19403 - DNA, 25 bp, E. coli
gttacaggcaggattgatgcaaaaa

SEQ ID NO: 19404 - DNA, 25 bp, E. coli
gttacaggcaggtttgatgcaaaaa

SEQ ID NO: 19405 - DNA, 25 bp, E. coli
ggtttgatgcaataattggctcaga

SEQ ID NO: 19406 - DNA, 25 bp, E. coli
ggtttgatgcaaaaattggctcaga

SEQ ID NO: 19407 - DNA, 25 bp, E. coli
tggctcagatcattaagaataaaat

SEQ ID NO: 19408 - DNA, 25 bp, E. coli
tggctcagatcaataagaataaaat

SEQ ID NO: 19409 - DNA, 25 bp, E. coli
taagaataaaatgaagcggcgtatt

SEQ ID NO: 19410 - DNA, 25 bp, E. coli
taagaataaaatcaagcggcgtatt

SEQ ID NO: 19411 - DNA, 25 bp, E. coli
gatgcaaaaattggctcagatcatt

SEQ ID NO: 19412 - DNA, 25 bp, E. coli
gatgcaaaaattcgctcagatcatt

SEQ ID NO: 19413 - DNA, 25 bp, E. coli
aagtcagttcttttctggtcgggca

SEQ ID NO: 19414 - DNA, 25 bp, E. coli
aagtcagttcttatctggtcgggca

SEQ ID NO: 19415 - DNA, 25 bp, E. coli
cagaaacgtgcggaagggatctcca

SEQ ID NO: 19416 - DNA, 25 bp, E. coli
catatgctgaatctgctgcgcagcg

SEQ ID NO: 19417 - DNA, 25 bp, E. coli
catatgctgaatgtgctgcgcagcg

SEQ ID NO: 19418 - DNA, 25 bp, E. coli
cagaaacgtgcgcaagggatctcca

SEQ ID NO: 19419 - DNA, 25 bp, E. coli
aaaattattcgcgtgattgcccgcg

SEQ ID NO: 19420 - DNA, 25 bp, E. coli
aaaattattcgcctgattgcccgcg

SEQ ID NO: 19421 - DNA, 25 bp, E. coli
tgttctttggtctgccggtcaacgt

SEQ ID NO: 19422 - DNA, 25 bp, E. coli
tgttctttggtcagccggtcaacgt

SEQ ID NO: 19423 - DNA, 25 bp, E. coli
tgatcgaaatgaccagctactggca

SEQ ID NO: 19424 - DNA, 25 bp, E. coli
tgatcgaaatgagcagctactggca

SEQ ID NO: 19425 - DNA, 25 bp, E. coli
tctctgcctgatcagcgttaacgcg

SEQ ID NO: 19426 - DNA, 25 bp, E. coli
tctctgcctgatgagcgttaacgcg

SEQ ID NO: 19427 - DNA, 25 bp, E. coli
gaagtggacacccacgatttgagta

SEQ ID NO: 19428 - DNA, 25 bp, E. coli
gaagtggacaccgacgatttgagta

SEQ ID NO: 19429 - DNA, 25 bp, E. coli
gaaacctgggcgttctcagaaacga

SEQ ID NO: 19430 - DNA, 25 bp, E. coli
gaaacctgggcgatctcagaaacga

SEQ ID NO: 19431 - DNA, 25 bp, E. coli
gataacgtgcagcttgctccgcagg

SEQ ID NO: 19432 - DNA, 25 bp, E. coli
gataacgtgcaggttgctccgcagg

SEQ ID NO: 19433 - DNA, 25 bp, E. coli
tcaccaacgagcagatccagaaacg

SEQ ID NO: 19434 - DNA, 25 bp, E. coli
tcaccaacgagctgatccagaaacg

SEQ ID NO: 19435 - DNA, 25 bp, E. coli
caggcactgaagcacaatcgggcaa

SEQ ID NO: 19436 - DNA, 25 bp, E. coli
caggcactgaaggacaatcgggcaa

SEQ ID NO: 19437 - DNA, 25 bp, E. coli
aaaatgcctgcgtttctcggcggtc

SEQ ID NO: 19438 - DNA, 25 bp, E. coli
aaaatgcctgcgattctcggcggtc

SEQ ID NO: 19439 - DNA, 25 bp, E. coli
tatcgggccacaagttcagtcagta

SEQ ID NO: 19440 - DNA, 25 bp, E. coli
tatcgggccacatgttcagtcagta

SEQ ID NO: 19441 - DNA, 25 bp, E. coli
tgaccatcttccaggcgcaattgag

SEQ ID NO: 19442 - DNA, 25 bp, E. coli
tgaccatcttcctggcgcaattgag

SEQ ID NO: 19443 - DNA, 25 bp, E. coli
tcagtaaaagatgaaatggccggtc

SEQ ID NO: 19444 - DNA, 25 bp, E. coli
tctgtatgtcatgcacgcgctgtta

SEQ ID NO: 19445 - DNA, 25 bp, E. coli
tctgtatgtcatccacgcgctgtta

SEQ ID NO: 19446 - DNA, 25 bp, E. coli
tcagtaaaagatcaaatggccggtc

SEQ ID NO: 19447 - DNA, 25 bp, E. coli
ccgatgctgtttcgtaccggtgaac

SEQ ID NO: 19448 - DNA, 25 bp, E. coli
ccgatgctgtttggtaccggtgaac

SEQ ID NO: 19449 - DNA, 25 bp, E. coli
cattaattcgctataccgacgcagg

SEQ ID NO: 19450 - DNA, 25 bp, E. coli
cattaattcgctttaccgacgcagg

SEQ ID NO: 19451 - DNA, 25 bp, E. coli
ggcaaaaccttcatgttacccgtgg

SEQ ID NO: 19452 - DNA, 25 bp, E. coli
ggcaaaaccttcttgttacccgtgg

SEQ ID NO: 19453 - DNA, 25 bp, E. coli
tcaatcgaaaaagccgttgccggtg

SEQ ID NO: 19454 - DNA, 25 bp, E. coli
taacctgcaggttgttatcgggcca

SEQ ID NO: 19455 - DNA, 25 bp, E. coli
tcaatcgaaaaacccgttgccggtg

SEQ ID NO: 19456 - DNA, 25 bp, E. coli
taacctgcaggtagttatcgggcca

SEQ ID NO: 19457 - DNA, 25 bp, E. coli
cacgatgggctgcaccgagtaccag

SEQ ID NO: 19458 - DNA, 25 bp, E. coli
cacgatgggctggaccgagtaccag

SEQ ID NO: 19459 - DNA, 25 bp, E. coli
tacgccagccagtacatgcagctta

SEQ ID NO: 19460 - DNA, 25 bp, E. coli
cacgactaaagacctgggcaattca

SEQ ID NO: 19461 - DNA, 25 bp, E. coli
cacgactaaagagctgggcaattca

SEQ ID NO: 19462 - DNA, 25 bp, E. coli
aaaaatgggtcagtcaggatcaggc

SEQ ID NO: 19463 - DNA, 25 bp, E. coli
aaaaatgggtcactcaggatcaggc

SEQ ID NO: 19464 - DNA, 25 bp, E. coli
tacgccagccagaacatgcagctta

SEQ ID NO: 19465 - DNA, 25 bp, E. coli
tattacaggcctcttcagccacgac

SEQ ID NO: 19466 - DNA, 25 bp, E. coli
tattacaggcctgttcagccacgac

SEQ ID NO: 19467 - DNA, 25 bp, E. coli
gctggccttcgctgaagacggacaa

SEQ ID NO: 19468 - DNA, 25 bp, E. coli
gcggcgacaaccagattgaagtgaa

SEQ ID NO: 19469 - DNA, 25 bp, E. coli
gctggccttcgcagaagacggacaa

SEQ ID NO: 19470 - DNA, 25 bp, E. coli
gcggcgacaacctgattgaagtgaa

SEQ ID NO: 19471 - DNA, 25 bp, E. coli
cggaacagtatctcggcgcggatta

SEQ ID NO: 19472 - DNA, 25 bp, E. coli
cggaacagtatcacggcgcggatta

SEQ ID NO: 19473 - DNA, 25 bp, E. coli
ggcaaattcgccagtcggaacagta

SEQ ID NO: 19474 - DNA, 25 bp, E. coli
ggcaaattcgcctgtcggaacagta

SEQ ID NO: 19475 - DNA, 25 bp, E. coli
ggcataaccgcttttggatcgacag

SEQ ID NO: 19476 - DNA, 25 bp, E. coli
ggcataaccgctattggatcgacag

SEQ ID NO: 19477 - DNA, 25 bp, E. coli
gagtaccagcaggtacgctacgcca

SEQ ID NO: 19478 - DNA, 25 bp, E. coli
gagtaccagcagctacgctacgcca

SEQ ID NO: 19479 - DNA, 25 bp, E. coli
aagagttgcgggtatacctattact

SEQ ID NO: 19480 - DNA, 25 bp, E. coli
aagagttgcgggaatacctattact

SEQ ID NO: 19481 - DNA, 25 bp, E. coli
ccccgtctattctgaaattaacgat

SEQ ID NO: 19482 - DNA, 25 bp, E. coli
ccccgtctattcagaaattaacgat

SEQ ID NO: 19483 - DNA, 25 bp, E. coli
tgtctggctagtgtctcaatggaag

SEQ ID NO: 19484 - DNA, 25 bp, E. coli
tgtctggctagtctctcaatggaag

SEQ ID NO: 19485 - DNA, 25 bp, E. coli
tgctatagatactagccaacttgct

SEQ ID NO: 19486 - DNA, 25 bp, E. coli
tgctatagatacaagccaacttgct

SEQ ID NO: 19487 - DNA, 25 bp, E. coli
tcgcggaacgttagggaattgctcc

SEQ ID NO: 19488 - DNA, 25 bp, E. coli
tcgcggaacgtttgggaattgctcc

SEQ ID NO: 19489 - DNA, 25 bp, E. coli
tctctcaatggatgacgtgaccaat

SEQ ID NO: 19490 - DNA, 25 bp, E. coli
tctctcaatggaagacgtgaccaat

SEQ ID NO: 19491 - DNA, 25 bp, E. coli
cctgattggatggatgctatagata

SEQ ID NO: 19492 - DNA, 25 bp, E. coli
cctgattggatgcatgctatagata

SEQ ID NO: 19493 - DNA, 25 bp, E. coli
gaattgctcctgtttggatggatgc

SEQ ID NO: 19494 - DNA, 25 bp, E. coli
gaattgctcctgattggatggatgc

SEQ ID NO: 19495 - DNA, 25 bp, E. coli
gaaattaacgatagtctggctagtc

SEQ ID NO: 19496 - DNA, 25 bp, E. coli
gaccaatgaagacttcgcggaacgt

SEQ ID NO: 19497 - DNA, 25 bp, E. coli
gaccaatgaagagttcgcggaacgt

SEQ ID NO: 19498 - DNA, 25 bp, E. coli
gaaattaacgattgtctggctagtc

SEQ ID NO: 19499 - DNA, 25 bp, E. coli
tggaaaaagaccagaaagagttgcg

SEQ ID NO: 19500 - DNA, 25 bp, E. coli
tggaaaaagacctgaaagagttgcg

SEQ ID NO: 19501 - DNA, 25 bp, E. coli
caaccgatgttgctgggcattggct

SEQ ID NO: 19502 - DNA, 25 bp, E. coli
caaccgatgttggtgggcattggct

SEQ ID NO: 19503 - DNA, 25 bp, E. coli
catttgcgtagaaggagacgttttc

SEQ ID NO: 19504 - DNA, 25 bp, E. coli
accgatgttgctgggcattggcttt

SEQ ID NO: 19505 - DNA, 25 bp, E. coli
accgatgttgctcggcattggcttt

SEQ ID NO: 19506 - DNA, 25 bp, E. coli
tatccaaccgatcttgctgggcatt

SEQ ID NO: 19507 - DNA, 25 bp, E. coli
tatccaaccgatgttgctgggcatt

SEQ ID NO: 19508 - DNA, 25 bp, E. coli
tttatccaaccgttgttgctgggca

SEQ ID NO: 19509 - DNA, 25 bp, E. coli
tttatccaaccgatgttgctgggca

SEQ ID NO: 19510 - DNA, 25 bp, E. coli
tcgctggcatttgcgtagaaggaga

SEQ ID NO: 19511 - DNA, 25 bp, E. coli
tgcctcgctggcatttgcgtagaag

SEQ ID NO: 19512 - DNA, 25 bp, E. coli
tgcctcgctggcttttgcgtagaag

SEQ ID NO: 19513 - DNA, 25 bp, E. coli
tcgctggcatttccgtagaaggaga

SEQ ID NO: 19514 - DNA, 25 bp, E. coli
gcgtagaaggagacgttttcccgca

SEQ ID NO: 19515 - DNA, 25 bp, E. coli
gcgtagaaggagtcgttttcccgca

SEQ ID NO: 19516 - DNA, 25 bp, E. coli
cgagtgcctcgctggcatttgcgta

SEQ ID NO: 19517 - DNA, 25 bp, E. coli
cgagtgcctcgcaggcatttgcgta

SEQ ID NO: 19518 - DNA, 25 bp, E. coli
catttgcgtagatggagacgttttc

SEQ ID NO: 19519 - DNA, 25 bp, E. coli
gattttatccaagcgatgttgctgg

SEQ ID NO: 19520 - DNA, 25 bp, E. coli
gattttatccaaccgatgttgctgg

SEQ ID NO: 19521 - DNA, 25 bp, E. coli
gtgggtgattttttccaaccgatgt

SEQ ID NO: 19522 - DNA, 25 bp, E. coli
gtgggtgattttatccaaccgatgt

SEQ ID NO: 19523 - DNA, 25 bp, E. coli
caatccagggccgtgttgctcagat

SEQ ID NO: 19524 - DNA, 25 bp, E. coli
caatccagggccctgttgctcagat

SEQ ID NO: 19525 - DNA, 25 bp, E. coli
aggatatcgcaaccctgactggcgg

SEQ ID NO: 19526 - DNA, 25 bp, E. coli
aggatatcgcaagcctgactggcgg

SEQ ID NO: 19527 - DNA, 25 bp, E. coli
taccggtctgcacgacgaactggac

SEQ ID NO: 19528 - DNA, 25 bp, E. coli
tatgcagttcgaccgtggctacctg

SEQ ID NO: 19529 - DNA, 25 bp, E. coli
tatgcagttcgagcgtggctacctg

SEQ ID NO: 19530 - DNA, 25 bp, E. coli
taccggtctgcaggacgaactggac

SEQ ID NO: 19531 - DNA, 25 bp, E. coli
tgcactgcgtgctatggaagctccg

SEQ ID NO: 19532 - DNA, 25 bp, E. coli
tgcactgcgtgcaatggaagctccg

SEQ ID NO: 19533 - DNA, 25 bp, E. coli
tgaacccgatggtcctgaaacgtgg

SEQ ID NO: 19534 - DNA, 25 bp, E. coli
tgaacccgatggacctgaaacgtgg

SEQ ID NO: 19535 - DNA, 25 bp, E. coli
tctaaactggctcacctgcgtggtc

SEQ ID NO: 19536 - DNA, 25 bp, E. coli
tctaaactggctgacctgcgtggtc

SEQ ID NO: 19537 - DNA, 25 bp, E. coli
gaagcaacttctgactacgaccgtg

SEQ ID NO: 19538 - DNA, 25 bp, E. coli
gaagcaacttctcactacgaccgtg

SEQ ID NO: 19539 - DNA, 25 bp, E. coli
gaaaaagcaaccctggaagacctgg

SEQ ID NO: 19540 - DNA, 25 bp, E. coli
gaaaaagcaaccgtggaagacctgg

SEQ ID NO: 19541 - DNA, 25 bp, E. coli
tcaacaagccggaaactggcgcagt

SEQ ID NO: 19542 - DNA, 25 bp, E. coli
tcaacaagccggtaactggcgcagt

SEQ ID NO: 19543 - DNA, 25 bp, E. coli
gatgcagtgaaagttaccctcggtc

SEQ ID NO: 19544 - DNA, 25 bp, E. coli
gatgcagtgaaacttaccctcggtc

SEQ ID NO: 19545 - DNA, 25 bp, E. coli
aatgcgcctgctactacccggcagg

SEQ ID NO: 19546 - DNA, 25 bp, E. coli
aatgcgcctgcttctacccggcagg

SEQ ID NO: 19547 - DNA, 25 bp, E. coli
caggcgcgttatgtttttacggaca

SEQ ID NO: 19548 - DNA, 25 bp, E. coli
caggcgcgttatctttttacggaca

SEQ ID NO: 19549 - DNA, 25 bp, E. coli
tacggacaaacaatcatgcaaccag

SEQ ID NO: 19550 - DNA, 25 bp, E. coli
caaccagaagttcaagtattaaccg

SEQ ID NO: 19551 - DNA, 25 bp, E. coli
caaccagaagttgaagtattaaccg

SEQ ID NO: 19552 - DNA, 25 bp, E. coli
tacggacaaacattcatgcaaccag

SEQ ID NO: 19553 - DNA, 25 bp, E. coli
tttacctattgcctaatgcgcctgc

SEQ ID NO: 19554 - DNA, 25 bp, E. coli
tatagtgagcgaagccctatcaggc

SEQ ID NO: 19555 - DNA, 25 bp, E. coli
tatagtgagcgatgccctatcaggc

SEQ ID NO: 19556 - DNA, 25 bp, E. coli
tttacctattgcgtaatgcgcctgc

SEQ ID NO: 19557 - DNA, 25 bp, E. coli
tgcagccaaggaagtatagtgagcg

SEQ ID NO: 19558 - DNA, 25 bp, E. coli
tgcagccaaggatgtatagtgagcg

SEQ ID NO: 19559 - DNA, 25 bp, E. coli
tcgagctttattcaacacattgcca

SEQ ID NO: 19560 - DNA, 25 bp, E. coli
tcgagctttattgaacacattgcca

SEQ ID NO: 19561 - DNA, 25 bp, E. coli
tcaggcctttttcgtcagtagataa

SEQ ID NO: 19562 - DNA, 25 bp, E. coli
tcaggcctttttggtcagtagataa

SEQ ID NO: 19563 - DNA, 25 bp, E. coli
cattgcgtacaaccttcccgattta

SEQ ID NO: 19564 - DNA, 25 bp, E. coli
cattgcgtacaagcttcccgattta

SEQ ID NO: 19565 - DNA, 25 bp, E. coli
gtgtacaactaaacctgcagccaag

SEQ ID NO: 19566 - DNA, 25 bp, E. coli
gtgtacaactaatcctgcagccaag

SEQ ID NO: 19567 - DNA, 25 bp, E. coli
cattcgccgggtccaaacagacttt

SEQ ID NO: 19568 - DNA, 25 bp, E. coli
cagattatccagaggccagagcgcg

SEQ ID NO: 19569 - DNA, 25 bp, E. coli
cagattatccagtggccagagcgcg

SEQ ID NO: 19570 - DNA, 25 bp, E. coli
cattcgccgggtgcaaacagacttt

SEQ ID NO: 19571 - DNA, 25 bp, E. coli
taaagggattatcgccgcaggcaat

SEQ ID NO: 19572 - DNA, 25 bp, E. coli
taaagggattatggccgcaggcaat

SEQ ID NO: 19573 - DNA, 25 bp, E. coli
tatggctgccatgaacgctggacgc

SEQ ID NO: 19574 - DNA, 25 bp, E. coli
taccgagagcatgaaactggcacac

SEQ ID NO: 19575 - DNA, 25 bp, E. coli
taccgagagcatcaaactggcacac

SEQ ID NO: 19576 - DNA, 25 bp, E. coli
tatggctgccatcaacgctggacgc

SEQ ID NO: 19577 - DNA, 25 bp, E. coli
tgttatgcgccattgccatcgacgg

SEQ ID NO: 19578 - DNA, 25 bp, E. coli
tgttatgcgccaatgccatcgacgg

SEQ ID NO: 19579 - DNA, 25 bp, E. coli
tcaggacagcgacggcgattacatc

SEQ ID NO: 19580 - DNA, 25 bp, E. coli
tcaggacagcgagggcgattacatc

SEQ ID NO: 19581 - DNA, 25 bp, E. coli
gccgccgcgcgtgaactgttagatg

SEQ ID NO: 19582 - DNA, 25 bp, E. coli
gccgccgcgcgtcaactgttagatg

SEQ ID NO: 19583 - DNA, 25 bp, E. coli
gaacaacgggaaattatcggcagcg

SEQ ID NO: 19584 - DNA, 25 bp, E. coli
gaacaacgggaatttatcggcagcg

SEQ ID NO: 19585 - DNA, 25 bp, E. coli
ggctttgaaaccacactcgacctgg

SEQ ID NO: 19586 - DNA, 25 bp, E. coli
ggctttgaaacctcactcgacctgg

SEQ ID NO: 19587 - DNA, 25 bp, E. coli
tcaatcgtcagcttgtgcagcgcac

SEQ ID NO: 19588 - DNA, 25 bp, E. coli
tcaatcgtcagcatgtgcagcgcac

SEQ ID NO: 19589 - DNA, 25 bp, E. coli
catcgaggcgttttcatgagaatac

SEQ ID NO: 19590 - DNA, 25 bp, E. coli
catcgaggcgttatcatgagaatac

SEQ ID NO: 19591 - DNA, 25 bp, E. coli
taaagcggcatccaggcgttatcat

SEQ ID NO: 19592 - DNA, 25 bp, E. coli
taaaaattccttttacagatgtggt

SEQ ID NO: 19593 - DNA, 25 bp, E. coli
taaagcggcatcgaggcgttatcat

SEQ ID NO: 19594 - DNA, 25 bp, E. coli
tacagacacgtcttagtgatgagcg

SEQ ID NO: 19595 - DNA, 25 bp, E. coli
tacagacacgtcatagtgatgagcg

SEQ ID NO: 19596 - DNA, 25 bp, E. coli
taaaaattccttatacagatgtggt

SEQ ID NO: 19597 - DNA, 25 bp, E. coli
tatgataacttactaaagcggcatc

SEQ ID NO: 19598 - DNA, 25 bp, E. coli
tatgataacttagtaaagcggcatc

SEQ ID NO: 19599 - DNA, 25 bp, E. coli
ttcagtggcgttagtggatggacca

SEQ ID NO: 19600 - DNA, 25 bp, E. coli
ttcagtggcgtttgtggatggacca

SEQ ID NO: 19601 - DNA, 25 bp, E. coli
tgtagctagcttgcgttcagtggcg

SEQ ID NO: 19602 - DNA, 25 bp, E. coli
tgtagctagcttccgttcagtggcg

SEQ ID NO: 19603 - DNA, 25 bp, E. coli
tgagcgtgtctgaagctagcttgcg

SEQ ID NO: 19604 - DNA, 25 bp, E. coli
tgagcgtgtctgtagctagcttgcg

SEQ ID NO: 19605 - DNA, 25 bp, E. coli
tcatagtgatgagcgtgtctgtagc

SEQ ID NO: 19606 - DNA, 25 bp, E. coli
tcatagtgatgaccgtgtctgtagc

SEQ ID NO: 19607 - DNA, 25 bp, E. coli
tggaccagtggctgttatgataact

SEQ ID NO: 19608 - DNA, 25 bp, E. coli
tggaccagtggcagttatgataact

SEQ ID NO: 19609 - DNA, 25 bp, E. coli
taacttactaaagcggcatcgaggc

SEQ ID NO: 19610 - DNA, 25 bp, E. coli
taacttactaaaccggcatcgaggc

SEQ ID NO: 19611 - DNA, 25 bp, E. coli
aatggattgctgttgtcggtttcgg

SEQ ID NO: 19612 - DNA, 25 bp, E. coli
aatggattgctgatgtcggtttcgg

SEQ ID NO: 19613 - DNA, 25 bp, E. coli
aaactggtgatagcccgtcgtggcg

SEQ ID NO: 19614 - DNA, 25 bp, E. coli
aaactggtgataccccgtcgtggcg

SEQ ID NO: 19615 - DNA, 25 bp, E. coli
tttcggtgggcacacgctaaccgcg

SEQ ID NO: 19616 - DNA, 25 bp, E. coli
tttcggtgggcagacgctaaccgcg

SEQ ID NO: 19617 - DNA, 25 bp, E. coli
tcgacgttttgcagccgagggaaat

SEQ ID NO: 19618 - DNA, 25 bp, E. coli
tcgacgttttgctgccgagggaaat

SEQ ID NO: 19619 - DNA, 25 bp, E. coli
ccacgccacacgcagagtatcggtt

SEQ ID NO: 19620 - DNA, 25 bp, E. coli
ccacgccacacggagagtatcggtt

SEQ ID NO: 19621 - DNA, 25 bp, E. coli
gcagtcgcatttacgccatcatttg

SEQ ID NO: 19622 - DNA, 25 bp, E. coli
gcagtcgcattttcgccatcatttg

SEQ ID NO: 19623 - DNA, 25 bp, E. coli
cccatcgtttgctgttggtggaact

SEQ ID NO: 19624 - DNA, 25 bp, E. coli
cccatcgtttgcagttggtggaact

SEQ ID NO: 19625 - DNA, 25 bp, E. coli
ccgtcgtggcggttactgttttgag

SEQ ID NO: 19626 - DNA, 25 bp, E. coli
ccgtcgtggcggatactgttttgag

SEQ ID NO: 19627 - DNA, 25 bp, E. coli
gatctctgcgagcagcaacaaagcg

SEQ ID NO: 19628 - DNA, 25 bp, E. coli
gatctctgcgaggagcaacaaagcg

SEQ ID NO: 19629 - DNA, 25 bp, E. coli
gtagtgttatcaaatccgccagcat

SEQ ID NO: 19630 - DNA, 25 bp, E. coli
gtagtgttatcatatccgccagcat

SEQ ID NO: 19631 - DNA, 25 bp, E. coli
gatgtaccgttttgatctctgcgag

SEQ ID NO: 19632 - DNA, 25 bp, E. coli
gatgtaccgtttagatctctgcgag

SEQ ID NO: 19633 - DNA, 25 bp, E. coli
tactgggttatttggtttatgccct

SEQ ID NO: 19634 - DNA, 25 bp, E. coli
tactgggttattaggtttatgccct

SEQ ID NO: 19635 - DNA, 25 bp, E. coli
atagccggcgtgttgctggtgtttt

SEQ ID NO: 19636 - DNA, 25 bp, E. coli
atagccggcgtgatgctggtgtttt

SEQ ID NO: 19637 - DNA, 25 bp, E. coli
agccggcgtgttcctggtgttttta

SEQ ID NO: 19638 - DNA, 25 bp, E. coli
agccggcgtgttgctggtgttttta

SEQ ID NO: 19639 - DNA, 25 bp, E. coli
tattactgggttatttggtttatgc

SEQ ID NO: 19640 - DNA, 25 bp, E. coli
tatttggtttatgccctgatccatg

SEQ ID NO: 19641 - DNA, 25 bp, E. coli
tattactgggttttttggtttatgc

SEQ ID NO: 19642 - DNA, 25 bp, E. coli
tatttggtttatcccctgatccatg

SEQ ID NO: 19643 - DNA, 25 bp, E. coli
tgagtgcaggcgtgatagccggcgt

SEQ ID NO: 19644 - DNA, 25 bp, E. coli
tgagtgcaggcgagatagccggcgt

SEQ ID NO: 19645 - DNA, 25 bp, E. coli
cctgatccatgccgaggcattctga

SEQ ID NO: 19646 - DNA, 25 bp, E. coli
cctgatccatgcggaggcattctga

SEQ ID NO: 19647 - DNA, 25 bp, E. coli
gttatttggtttttgccctgatcca

SEQ ID NO: 19648 - DNA, 25 bp, E. coli
gttatttggtttatgccctgatcca

SEQ ID NO: 19649 - DNA, 25 bp, E. coli
ctgggttatttggtttatgccctga

SEQ ID NO: 19650 - DNA, 25 bp, E. coli
ctgggttatttgctttatgccctga

SEQ ID NO: 19651 - DNA, 25 bp, E. coli
gggttatttggtatatgccctgatc

SEQ ID NO: 19652 - DNA, 25 bp, E. coli
ggttatttggtttatgccctgatcc

SEQ ID NO: 19653 - DNA, 25 bp, E. coli
ggttatttggttaatgccctgatcc

SEQ ID NO: 19654 - DNA, 25 bp, E. coli
gggttatttggtttatgccctgatc

SEQ ID NO: 19655 - DNA, 25 bp, E. coli
caatagcggtggaaatttaagcggc

SEQ ID NO: 19656 - DNA, 25 bp, E. coli
caatgccgcgctgattggcctgtta

SEQ ID NO: 19657 - DNA, 25 bp, E. coli
caatgccgcgctcattggcctgtta

SEQ ID NO: 19658 - DNA, 25 bp, E. coli
caatagcggtggtaatttaagcggc

SEQ ID NO: 19659 - DNA, 25 bp, E. coli
catggtgacggtagccgaacatcaa

SEQ ID NO: 19660 - DNA, 25 bp, E. coli
catggtgacggttgccgaacatcaa

SEQ ID NO: 19661 - DNA, 25 bp, E. coli
tactggtcacgtagggaaaatatct

SEQ ID NO: 19662 - DNA, 25 bp, E. coli
tactggtcacgttgggaaaatatct

SEQ ID NO: 19663 - DNA, 25 bp, E. coli
taaaacgcgcaatctggaatgggtg

SEQ ID NO: 19664 - DNA, 25 bp, E. coli
taaaacgcgcaaactggaatgggtg

SEQ ID NO: 19665 - DNA, 25 bp, E. coli
taccttacctgttgggatgatggcg

SEQ ID NO: 19666 - DNA, 25 bp, E. coli
taccttacctgtagggatgatggcg

SEQ ID NO: 19667 - DNA, 25 bp, E. coli
tgattgcgggtgaaaaactgacggc

SEQ ID NO: 19668 - DNA, 25 bp, E. coli
tgattgcgggtgtaaaactgacggc

SEQ ID NO: 19669 - DNA, 25 bp, E. coli
gaaagctggcctgcgttaatgatgg

SEQ ID NO: 19670 - DNA, 25 bp, E. coli
gaaagctggcctccgttaatgatgg

SEQ ID NO: 19671 - DNA, 25 bp, E. coli
tcaggcttccttccggtcggctatc

SEQ ID NO: 19672 - DNA, 25 bp, E. coli
tcaggcttccttgcggtcggctatc

SEQ ID NO: 19673 - DNA, 25 bp, E. coli
gggcttgccggattcatcatgctca

SEQ ID NO: 19674 - DNA, 25 bp, E. coli
gggcttgccggaatcatcatgctca

SEQ ID NO: 19675 - DNA, 25 bp, E. coli
tcaaaatgttccttccggcatcgcc

SEQ ID NO: 19676 - DNA, 25 bp, E. coli
tcaaaatgttccatccggcatcgcc

SEQ ID NO: 19677 - DNA, 25 bp, E. coli
cagatatgactgtagaagccacgct

SEQ ID NO: 19678 - DNA, 25 bp, E. coli
caggaattacaacaagccagcgatc

SEQ ID NO: 19679 - DNA, 25 bp, E. coli
cagatatgactgaagaagccacgct

SEQ ID NO: 19680 - DNA, 25 bp, E. coli
caggaattacaagaagccagcgatc

SEQ ID NO: 19681 - DNA, 25 bp, E. coli
tgtgacagggtctcaaatcccgctg

SEQ ID NO: 19682 - DNA, 25 bp, E. coli
tgtgacagggtcacaaatcccgctg

SEQ ID NO: 19683 - DNA, 25 bp, E. coli
tgatgccggaataccatcgcccgga

SEQ ID NO: 19684 - DNA, 25 bp, E. coli
tgcagcgttccgtgcagggttatat

SEQ ID NO: 19685 - DNA, 25 bp, E. coli
tgatgccggaattccatcgcccgga

SEQ ID NO: 19686 - DNA, 25 bp, E. coli
tgcagcgttccgagcagggttatat

SEQ ID NO: 19687 - DNA, 25 bp, E. coli
gctgagttacgctctgacggacaaa

SEQ ID NO: 19688 - DNA, 25 bp, E. coli
gctgagttacgcactgacggacaaa

SEQ ID NO: 19689 - DNA, 25 bp, E. coli
gcaaggccatgagccaaaacctgcg

SEQ ID NO: 19690 - DNA, 25 bp, E. coli
gcaaggccatgacccaaaacctgcg

SEQ ID NO: 19691 - DNA, 25 bp, E. coli
cgatcgcggtatagtggtggtcaac

SEQ ID NO: 19692 - DNA, 25 bp, E. coli
cgatcgcggtattgtggtggtcaac

SEQ ID NO: 19693 - DNA, 25 bp, E. coli
gatactgaaaccattcgcaaggcca

SEQ ID NO: 19694 - DNA, 25 bp, E. coli
gatactgaaacctttcgcaaggcca

SEQ ID NO: 19695 - DNA, 25 bp, E. coli
ggatttctgctgtcgtcgtgcgcaa

SEQ ID NO: 19696 - DNA, 25 bp, E. coli
ggatttctgctgacgtcgtgcgcaa

SEQ ID NO: 19697 - DNA, 25 bp, E. coli
ggtaatgcgccacaaaacaaagcct

SEQ ID NO: 19698 - DNA, 25 bp, E. coli
ggtaatgcgccagaaaacaaagcct

SEQ ID NO: 19699 - DNA, 25 bp, E. coli
gaaaggtccgctgtatttcccgcct

SEQ ID NO: 19700 - DNA, 25 bp, E. coli
aaggcactcactctattacttactc

SEQ ID NO: 19701 - DNA, 25 bp, E. coli
aaggcactcactgtattacttactc

SEQ ID NO: 19702 - DNA, 25 bp, E. coli
cgcaatccacggagccggataaaaa

SEQ ID NO: 19703 - DNA, 25 bp, E. coli
cgcaatccacggtgccggataaaaa

SEQ ID NO: 19704 - DNA, 25 bp, E. coli
tacttactctctacagcctgacggg

SEQ ID NO: 19705 - DNA, 25 bp, E. coli
tacttactctcttcagcctgacggg

SEQ ID NO: 19706 - DNA, 25 bp, E. coli
gaaaggtccgctctatttcccgcct

SEQ ID NO: 19707 - DNA, 25 bp, E. coli
tctcttcagcctcacgggctgcggt

SEQ ID NO: 19708 - DNA, 25 bp, E. coli
tctatttcccgcgtgcagataaaaa

SEQ ID NO: 19709 - DNA, 25 bp, E. coli
tctatttcccgcctgcagataaaaa

SEQ ID NO: 19710 - DNA, 25 bp, E. coli
tctcttcagcctgacgggctgcggt

SEQ ID NO: 19711 - DNA, 25 bp, E. coli
gccgccgaccaatccggtagagacg

SEQ ID NO: 19712 - DNA, 25 bp, E. coli
gccgccgaccaaaccggtagagacg

SEQ ID NO: 19713 - DNA, 25 bp, E. coli
gctgcggtctgataggtccgctcta

SEQ ID NO: 19714 - DNA, 25 bp, E. coli
gcgatggtccatgccaggtgaatta

SEQ ID NO: 19715 - DNA, 25 bp, E. coli
gctgcggtctgaaaggtccgctcta

SEQ ID NO: 19716 - DNA, 25 bp, E. coli
gcgatggtccatcccaggtgaatta

SEQ ID NO: 19717 - DNA, 25 bp, E. coli
gaaaaacgtgtttaaggcactcact

SEQ ID NO: 19718 - DNA, 25 bp, E. coli
gaaaaacgtgttaaaggcactcact

SEQ ID NO: 19719 - DNA, 25 bp, E. coli
gtagagacgcaatcgcaatccacgg

SEQ ID NO: 19720 - DNA, 25 bp, E. coli
gtagagacgcaaacgcaatccacgg

SEQ ID NO: 19721 - DNA, 25 bp, E. coli
aactggtgccgcagttagaggaaaa

SEQ ID NO: 19722 - DNA, 25 bp, E. coli
cactgcgcgcagacgggcgaaatat

SEQ ID NO: 19723 - DNA, 25 bp, E. coli
caactgcaagctatacgcgaacgag

SEQ ID NO: 19724 - DNA, 25 bp, E. coli
cacccgccagagcagaaaatattgg

SEQ ID NO: 19725 - DNA, 25 bp, E. coli
cacccgccagaggagaaaatattgg

SEQ ID NO: 19726 - DNA, 25 bp, E. coli
caactgcaagctttacgcgaacgag

SEQ ID NO: 19727 - DNA, 25 bp, E. coli
cactgcgcgcagtcgggcgaaatat

SEQ ID NO: 19728 - DNA, 25 bp, E. coli
aactggtgccgctgttagaggaaaa

SEQ ID NO: 19729 - DNA, 25 bp, E. coli
tgtgccgatggtggcggattatcct

SEQ ID NO: 19730 - DNA, 25 bp, E. coli
tgtgccgatggtcgcggattatcct

SEQ ID NO: 19731 - DNA, 25 bp, E. coli
tcgactggttacaacaacgcctggg

SEQ ID NO: 19732 - DNA, 25 bp, E. coli
tcgactggttactacaacgcctggg

SEQ ID NO: 19733 - DNA, 25 bp, E. coli
gcttttagagcatcgagacacggca

SEQ ID NO: 19734 - DNA, 25 bp, E. coli
gcttttagagcaacgagacacggca

SEQ ID NO: 19735 - DNA, 25 bp, E. coli
gctgacgttcttactggtgtgccga

SEQ ID NO: 19736 - DNA, 25 bp, E. coli
gctgacgttctttctggtgtgccga

SEQ ID NO: 19737 - DNA, 25 bp, E. coli
cattgctgacgactctggcagtggc

SEQ ID NO: 19738 - DNA, 25 bp, E. coli
cattgctgacgagtctggcagtggc

SEQ ID NO: 19739 - DNA, 25 bp, E. coli
gatagtcaggcagacctggagccag

SEQ ID NO: 19740 - DNA, 25 bp, E. coli
gatagtcaggcacacctggagccag

SEQ ID NO: 19741 - DNA, 25 bp, E. coli
gaggaaaaatctacatggatgagcc

SEQ ID NO: 19742 - DNA, 25 bp, E. coli
gaggaaaaatcttcatggatgagcc

SEQ ID NO: 19743 - DNA, 25 bp, E. coli
taaccgggcgttatttccaggagat

SEQ ID NO: 19744 - DNA, 25 bp, E. coli
taaccgggcgttttttccaggagat

SEQ ID NO: 19745 - DNA, 25 bp, E. coli
aaagagcagttttgtgaatcggcgc

SEQ ID NO: 19746 - DNA, 25 bp, E. coli
aaagagcagtttagtgaatcggcgc

SEQ ID NO: 19747 - DNA, 25 bp, E. coli
tttgaggccggtaatagtagcccga

SEQ ID NO: 19748 - DNA, 25 bp, E. coli
tttgaggccggttatagtagcccga

SEQ ID NO: 19749 - DNA, 25 bp, E. coli
tttacgtcattaccgcgaagaacag

SEQ ID NO: 19750 - DNA, 25 bp, E. coli
tttacgtcattagcgcgaagaacag

SEQ ID NO: 19751 - DNA, 25 bp, E. coli
tgaatttccgcgaaacagggctgga

SEQ ID NO: 19752 - DNA, 25 bp, E. coli
tgaatttccgcgtaacagggctgga

SEQ ID NO: 19753 - DNA, 25 bp, E. coli
tccaggagattaacggtaagcgcgt

SEQ ID NO: 19754 - DNA, 25 bp, E. coli
tccaggagattatcggtaagcgcgt

SEQ ID NO: 19755 - DNA, 25 bp, E. coli
gcttcgcaggtaaaccggaccaata

SEQ ID NO: 19756 - DNA, 25 bp, E. coli
gcttcgcaggtataccggaccaata

SEQ ID NO: 19757 - DNA, 25 bp, E. coli
cgcagtggctgaaaagtacggtaga

SEQ ID NO: 19758 - DNA, 25 bp, E. coli
cgcagtggctgataagtacggtaga

SEQ ID NO: 19759 - DNA, 25 bp, E. coli
gtatcagcggacagcatcagcacga

SEQ ID NO: 19760 - DNA, 25 bp, E. coli
gtatcagcggactgcatcagcacga

SEQ ID NO: 19761 - DNA, 25 bp, E. coli
ggaaattgccacagcccgagaacag

SEQ ID NO: 19762 - DNA, 25 bp, E. coli
ggaaattgccactgcccgagaacag

SEQ ID NO: 19763 - DNA, 25 bp, E. coli
gatgcagccagtgattaacgcgccg

SEQ ID NO: 19764 - DNA, 25 bp, E. coli
gatgcagccagtcattaacgcgccg

SEQ ID NO: 19765 - DNA, 25 bp, E. coli
aagcatcggaggaaaaactgccccg

SEQ ID NO: 19766 - DNA, 25 bp, E. coli
aatctcggtgctgacggaaagcatc

SEQ ID NO: 19767 - DNA, 25 bp, E. coli
aagcatcggaggtaaaactgccccg

SEQ ID NO: 19768 - DNA, 25 bp, E. coli
aatctcggtgctcacggaaagcatc

SEQ ID NO: 19769 - DNA, 25 bp, E. coli
tacccggaatcttgatcgcgaaatc

SEQ ID NO: 19770 - DNA, 25 bp, E. coli
tacccggaatctagatcgcgaaatc

SEQ ID NO: 19771 - DNA, 25 bp, E. coli
tccgcgcatatctcgttcagaaaac

SEQ ID NO: 19772 - DNA, 25 bp, E. coli
tccgcgcatatcacgttcagaaaac

SEQ ID NO: 19773 - DNA, 25 bp, E. coli
ccattacccggaatcttgatcgcga

SEQ ID NO: 19774 - DNA, 25 bp, E. coli
ccattacccggattcttgatcgcga

SEQ ID NO: 19775 - DNA, 25 bp, E. coli
gcatatcacgttgagaaaaccagaa

SEQ ID NO: 19776 - DNA, 25 bp, E. coli
gcatatcacgttcagaaaaccagaa

SEQ ID NO: 19777 - DNA, 25 bp, E. coli
gcaaaacactatcctgatatgctgg

SEQ ID NO: 19778 - DNA, 25 bp, E. coli
gcaaaacactatgctgatatgctgg

SEQ ID NO: 19779 - DNA, 25 bp, E. coli
tcggaggtaaaactgccccggactg

SEQ ID NO: 19780 - DNA, 25 bp, E. coli
tcggaggtaaaagtgccccggactg

SEQ ID NO: 19781 - DNA, 25 bp, E. coli
ctatcctgatatcctggcagtatag

SEQ ID NO: 19782 - DNA, 25 bp, E. coli
ctatcctgatatgctggcagtatag

SEQ ID NO: 19783 - DNA, 25 bp, E. coli
gggaaacatcacgcttcgtctggat

SEQ ID NO: 19784 - DNA, 25 bp, E. coli
gggctccgcgcatatcacgttcaga

SEQ ID NO: 19785 - DNA, 25 bp, E. coli
gggaaacatcacccttcgtctggat

SEQ ID NO: 19786 - DNA, 25 bp, E. coli
gggctccgcgcaaatcacgttcaga

SEQ ID NO: 19787 - DNA, 25 bp, E. coli
caggagcgccacagtgtattagctg

SEQ ID NO: 19788 - DNA, 25 bp, E. coli
caggagcgccactgtgtattagctg

SEQ ID NO: 19789 - DNA, 25 bp, E. coli
catggagcattgagttgatatgggc

SEQ ID NO: 19790 - DNA, 25 bp, E. coli
catggagcattgtgttgatatgggc

SEQ ID NO: 19791 - DNA, 25 bp, E. coli
tattagctggttcggtcttgtcggc

SEQ ID NO: 19792 - DNA, 25 bp, E. coli
tattagctggttgggtcttgtcggc

SEQ ID NO: 19793 - DNA, 25 bp, E. coli
ttgtcactggtacctgcggcggtca

SEQ ID NO: 19794 - DNA, 25 bp, E. coli
ttgtcactggtagctgcggcggtca

SEQ ID NO: 19795 - DNA, 25 bp, E. coli
tgcaacgctgcatcggatttttgat

SEQ ID NO: 19796 - DNA, 25 bp, E. coli
tgcaacgctgcaacggatttttgat

SEQ ID NO: 19797 - DNA, 25 bp, E. coli
gcattctttgccagttcagccagag

SEQ ID NO: 19798 - DNA, 25 bp, E. coli
gcattctttgcctgttcagccagag

SEQ ID NO: 19799 - DNA, 25 bp, E. coli
cggtatttgcttttttccatggagc

SEQ ID NO: 19800 - DNA, 25 bp, E. coli
cggtatttgcttatttccatggagc

SEQ ID NO: 19801 - DNA, 25 bp, E. coli
gatttctggcatggcccttacggca

SEQ ID NO: 19802 - DNA, 25 bp, E. coli
gatttctggcatcgcccttacggca

SEQ ID NO: 19803 - DNA, 25 bp, E. coli
ggctcatttatttagtactcacccg

SEQ ID NO: 19804 - DNA, 25 bp, E. coli
ggcttctattttggcgcattgtcac

SEQ ID NO: 19805 - DNA, 25 bp, E. coli
ggctcatttattaagtactcacccg

SEQ ID NO: 19806 - DNA, 25 bp, E. coli
ggcttctattttcgcgcattgtcac

SEQ ID NO: 19807 - DNA, 25 bp, E. coli
tcagccagagcgcataatcaacacg

SEQ ID NO: 19808 - DNA, 25 bp, E. coli
tcagccagagcggataatcaacacg

SEQ ID NO: 19809 - DNA, 25 bp, E. coli
caaatggcggaagtaccaacctttg

SEQ ID NO: 19810 - DNA, 25 bp, E. coli
caaatggcggaactaccaacctttg

SEQ ID NO: 19811 - DNA, 25 bp, E. coli
acaaagtcatggtgttcgttggacc

SEQ ID NO: 19812 - DNA, 25 bp, E. coli
acaaagtcatggagttcgttggacc

SEQ ID NO: 19813 - DNA, 25 bp, E. coli
aaagtcatggagttcgttggaccgg

SEQ ID NO: 19814 - DNA, 25 bp, E. coli
aaagtcatggagatcgttggaccgg

SEQ ID NO: 19815 - DNA, 25 bp, E. coli
ttggaccgggcgatagcgcgctctc

SEQ ID NO: 19816 - DNA, 25 bp, E. coli
ttaccgctgcaattggcggaagtac

SEQ ID NO: 19817 - DNA, 25 bp, E. coli
ttaccgctgcaaatggcggaagtac

SEQ ID NO: 19818 - DNA, 25 bp, E. coli
ttggaccgggcgttagcgcgctctc

SEQ ID NO: 19819 - DNA, 25 bp, E. coli
tcattggcgcggagttcaaaaacgg

SEQ ID NO: 19820 - DNA, 25 bp, E. coli
tcattggcgcggtgttcaaaaacgg

SEQ ID NO: 19821 - DNA, 25 bp, E. coli
tctcgccgcgatgccggttatgtta

SEQ ID NO: 19822 - DNA, 25 bp, E. coli
tctcgccgcgatcccggttatgtta

SEQ ID NO: 19823 - DNA, 25 bp, E. coli
ctgcaaatggcggaagtaccaacct

SEQ ID NO: 19824 - DNA, 25 bp, E. coli
ctggctatcattcgcgcggtgttca

SEQ ID NO: 19825 - DNA, 25 bp, E. coli
ctgcaaatggcgcaagtaccaacct

SEQ ID NO: 19826 - DNA, 25 bp, E. coli
cattggcgcggtgttcaaaaacggt

SEQ ID NO: 19827 - DNA, 25 bp, E. coli
cattggcgcggtcttcaaaaacggt

SEQ ID NO: 19828 - DNA, 25 bp, E. coli
ctggctatcattggcgcggtgttca

SEQ ID NO: 19829 - DNA, 25 bp, E. coli
gggcgttagcgcgctctctaccgat

SEQ ID NO: 19830 - DNA, 25 bp, E. coli
gggcgttagcgccctctctaccgat

SEQ ID NO: 19831 - DNA, 25 bp, E. coli
tactgaaaggttcgtggcgcacttc

SEQ ID NO: 19832 - DNA, 25 bp, E. coli
tactgaaaggttggtggcgcacttc

SEQ ID NO: 19833 - DNA, 25 bp, E. coli
actgaaaggttggtggcgcacttcc

SEQ ID NO: 19834 - DNA, 25 bp, E. coli
actgaaaggttgctggcgcacttcc

SEQ ID NO: 19835 - DNA, 25 bp, E. coli
tcgtactgaaaggttggtggcgcac

SEQ ID NO: 19836 - DNA, 25 bp, E. coli
tcgtactgaaagcttggtggcgcac

SEQ ID NO: 19837 - DNA, 25 bp, E. coli
tgaaagcaattttcgtactgaaagg

SEQ ID NO: 19838 - DNA, 25 bp, E. coli
tgaaaggttggtcgcgcacttcctg

SEQ ID NO: 19839 - DNA, 25 bp, E. coli
tgaaagcaatttacgtactgaaagg

SEQ ID NO: 19840 - DNA, 25 bp, E. coli
tgaaaggttggtggcgcacttcctg

SEQ ID NO: 19841 - DNA, 25 bp, E. coli
gtactgaaaggttggtggcgcactt

SEQ ID NO: 19842 - DNA, 25 bp, E. coli
gtactgaaaggtaggtggcgcactt

SEQ ID NO: 19843 - DNA, 25 bp, E. coli
gaaaggttggtggcgcacttcctga

SEQ ID NO: 19844 - DNA, 25 bp, E. coli
gaaaggttggtgccgcacttcctga

SEQ ID NO: 19845 - DNA, 25 bp, E. coli
ctgaaaggttggtggcgcacttcct

SEQ ID NO: 19846 - DNA, 25 bp, E. coli
ctgaaaggttggaggcgcacttcct

SEQ ID NO: 19847 - DNA, 25 bp, E. coli
cgtactgaaaggatggtggcgcact

SEQ ID NO: 19848 - DNA, 25 bp, E. coli
cgtactgaaaggttggtggcgcact

SEQ ID NO: 19849 - DNA, 25 bp, E. coli
caccatgacgcagtatcaactgaaa

SEQ ID NO: 19850 - DNA, 25 bp, E. coli
caaaacgaaagaataatatcgcagt

SEQ ID NO: 19851 - DNA, 25 bp, E. coli
caaaacgaaagattaatatcgcagt

SEQ ID NO: 19852 - DNA, 25 bp, E. coli
caccatgacgcactatcaactgaaa

SEQ ID NO: 19853 - DNA, 25 bp, E. coli
attaagcaaatgcaagcccaccttg

SEQ ID NO: 19854 - DNA, 25 bp, E. coli
attaagcaaatggaagcccaccttg

SEQ ID NO: 19855 - DNA, 25 bp, E. coli
tatttttatctcaccatgacgcagt

SEQ ID NO: 19856 - DNA, 25 bp, E. coli
tatttttatctctccatgacgcagt

SEQ ID NO: 19857 - DNA, 25 bp, E. coli
tgtgaatcagatgagaaaaccatta

SEQ ID NO: 19858 - DNA, 25 bp, E. coli
tgtgaatcagatcagaaaaccatta

SEQ ID NO: 19859 - DNA, 25 bp, E. coli
tgcccattgacggaagctactctcg

SEQ ID NO: 19860 - DNA, 25 bp, E. coli
tgcccattgacgcaagctactctcg

SEQ ID NO: 19861 - DNA, 25 bp, E. coli
gctactctcgtttcagtgactttca

SEQ ID NO: 19862 - DNA, 25 bp, E. coli
gctactctcgttacagtgactttca

SEQ ID NO: 19863 - DNA, 25 bp, E. coli
cgcagtaatctgaactggagaggaa

SEQ ID NO: 19864 - DNA, 25 bp, E. coli
cgcagtaatctgtactggagaggaa

SEQ ID NO: 19865 - DNA, 25 bp, E. coli
gtatcaactgaatcaaaacgaaaga

SEQ ID NO: 19866 - DNA, 25 bp, E. coli
gtatcaactgaaacaaaacgaaaga

SEQ ID NO: 19867 - DNA, 25 bp, E. coli
taacgcctttctattaagcaaatgc

SEQ ID NO: 19868 - DNA, 25 bp, E. coli
taacgcctttcttttaagcaaatgc

SEQ ID NO: 19869 - DNA, 25 bp, E. coli
tcatttcgttttccctattaacgcc

SEQ ID NO: 19870 - DNA, 25 bp, E. coli
tcatttcgttttgcctattaacgcc

SEQ ID NO: 19871 - DNA, 25 bp, E. coli
accagtccttgctaagaagattcga

SEQ ID NO: 19872 - DNA, 25 bp, E. coli
accagtccttgcaaagaagattcga

SEQ ID NO: 19873 - DNA, 25 bp, E. coli
tgattaacagcccagaaaacatgaa

SEQ ID NO: 19874 - DNA, 25 bp, E. coli
tgattaacagccgagaaaacatgaa

SEQ ID NO: 19875 - DNA, 25 bp, E. coli
tgaaaaaccagtgcttgcaaagaag

SEQ ID NO: 19876 - DNA, 25 bp, E. coli
tgaaaaaccagtccttgcaaagaag

SEQ ID NO: 19877 - DNA, 25 bp, E. coli
tgcgcgatgacagactactgaaagc

SEQ ID NO: 19878 - DNA, 25 bp, E. coli
tgcgcgatgacacactactgaaagc

SEQ ID NO: 19879 - DNA, 25 bp, E. coli
gcccagaaaacaagaaaaaccagtc

SEQ ID NO: 19880 - DNA, 25 bp, E. coli
gcccagaaaacatgaaaaaccagtc

SEQ ID NO: 19881 - DNA, 25 bp, E. coli
gcgatgacacacaactgaaagcgga

SEQ ID NO: 19882 - DNA, 25 bp, E. coli
gcgatgacacactactgaaagcgga

SEQ ID NO: 19883 - DNA, 25 bp, E. coli
gaagattcgaaatgcgcgatgacac

SEQ ID NO: 19884 - DNA, 25 bp, E. coli
gaagattcgaaaagcgcgatgacac

SEQ ID NO: 19885 - DNA, 25 bp, E. coli
gaaaacatgaaaaaccagtccttgc

SEQ ID NO: 19886 - DNA, 25 bp, E. coli
gaaatgttatgcataaggatcggta

SEQ ID NO: 19887 - DNA, 25 bp, E. coli
gaaaacatgaaataccagtccttgc

SEQ ID NO: 19888 - DNA, 25 bp, E. coli
gaaatgttatgcttaaggatcggta

SEQ ID NO: 19889 - DNA, 25 bp, E. coli
cgatgacacactactgaaagcggaa

SEQ ID NO: 19890 - DNA, 25 bp, E. coli
cgatgacacacttctgaaagcggaa

SEQ ID NO: 19891 - DNA, 25 bp, E. coli
gatgacacactactgaaagcggaag

SEQ ID NO: 19892 - DNA, 25 bp, E. coli
gatgacacactagtgaaagcggaag

SEQ ID NO: 19893 - DNA, 25 bp, E. coli
taaaagaggcgaaaatcgacgaact

SEQ ID NO: 19894 - DNA, 25 bp, E. coli
taaaagaggcgataatcgacgaact

SEQ ID NO: 19895 - DNA, 25 bp, E. coli
tttaccgcgccatccagtgaagagg

SEQ ID NO: 19896 - DNA, 25 bp, E. coli
ttgccagtgaaataagacggtccgg

SEQ ID NO: 19897 - DNA, 25 bp, E. coli
tttaccgcgccaaccagtgaagagg

SEQ ID NO: 19898 - DNA, 25 bp, E. coli
ttgccagtgaaaaaagacggtccgg

SEQ ID NO: 19899 - DNA, 25 bp, E. coli
tgaagaggcgcacaccgttttgagc

SEQ ID NO: 19900 - DNA, 25 bp, E. coli
tgaagaggcgcagaccgttttgagc

SEQ ID NO: 19901 - DNA, 25 bp, E. coli
tcggttagcttggtggaagagtacc

SEQ ID NO: 19902 - DNA, 25 bp, E. coli
tcggttagcttgctggaagagtacc

SEQ ID NO: 19903 - DNA, 25 bp, E. coli
tcagttaagcccgtcattgccagtg

SEQ ID NO: 19904 - DNA, 25 bp, E. coli
taagaaaaaagaagaaccgtcactg

SEQ ID NO: 19905 - DNA, 25 bp, E. coli
tcagttaagcccctcattgccagtg

SEQ ID NO: 19906 - DNA, 25 bp, E. coli
taagaaaaaagatgaaccgtcactg

SEQ ID NO: 19907 - DNA, 25 bp, E. coli
gaaccgtcactgaatacctcctgga

SEQ ID NO: 19908 - DNA, 25 bp, E. coli
gaaccgtcactgtatacctcctgga

SEQ ID NO: 19909 - DNA, 25 bp, E. coli
tggacgctaagtattaccgcgccaa

SEQ ID NO: 19910 - DNA, 25 bp, E. coli
tggacgctaagttttaccgcgccaa

SEQ ID NO: 19911 - DNA, 25 bp, E. coli
taatctcagtttaatggcgggccaa

SEQ ID NO: 19912 - DNA, 25 bp, E. coli
taatctcagttttatggcgggccaa

SEQ ID NO: 19913 - DNA, 25 bp, E. coli
gacgaactggatatgcatcgcgcaa

SEQ ID NO: 19914 - DNA, 25 bp, E. coli
gacgaactggatttgcatcgcgcaa

SEQ ID NO: 19915 - DNA, 25 bp, E. coli
aattctttattggactggcaagccg

SEQ ID NO: 19916 - DNA, 25 bp, E. coli
aattctttattgcactggcaagccg

SEQ ID NO: 19917 - DNA, 25 bp, E. coli
taccctactaatcatggaacaggtg

SEQ ID NO: 19918 - DNA, 25 bp, E. coli
taccctactaatgatggaacaggtg

SEQ ID NO: 19919 - DNA, 25 bp, E. coli
aacagatgttataggactcgtggcg

SEQ ID NO: 19920 - DNA, 25 bp, E. coli
aacagatgttattggactcgtggcg

SEQ ID NO: 19921 - DNA, 25 bp, E. coli
taggtgaggctcgatctggtatccc

SEQ ID NO: 19922 - DNA, 25 bp, E. coli
taggtgaggctccatctggtatccc

SEQ ID NO: 19923 - DNA, 25 bp, E. coli
tataacaattacaggagatgctggg

SEQ ID NO: 19924 - DNA, 25 bp, E. coli
tataacaattactggagatgctggg

SEQ ID NO: 19925 - DNA, 25 bp, E. coli
tgctgggtgtagcaagacactctcc

SEQ ID NO: 19926 - DNA, 25 bp, E. coli
tgctgggtgtaggaagacactctcc

SEQ ID NO: 19927 - DNA, 25 bp, E. coli
tgcgacagtctatggtgaaccagag

SEQ ID NO: 19928 - DNA, 25 bp, E. coli
tgcgacagtctaaggtgaaccagag

SEQ ID NO: 19929 - DNA, 25 bp, E. coli
tctagaggatgttagttccacggga

SEQ ID NO: 19930 - DNA, 25 bp, E. coli
tctagaggatgtaagttccacggga

SEQ ID NO: 19931 - DNA, 25 bp, E. coli
ctgtcggtgctcattctagtggtaa

SEQ ID NO: 19932 - DNA, 25 bp, E. coli
ctgtcggtgctctttctagtggtaa

SEQ ID NO: 19933 - DNA, 25 bp, E. coli
ggaggaactacgaatccatatggca

SEQ ID NO: 19934 - DNA, 25 bp, E. coli
ggaggaactacgtatccatatggca

SEQ ID NO: 19935 - DNA, 25 bp, E. coli
tggcaagccgaacaaactctagaac

SEQ ID NO: 19936 - DNA, 25 bp, E. coli
tggcaagccgaagaaactctagaac

SEQ ID NO: 19937 - DNA, 25 bp, E. coli
acgcagtgcccgagcgcagcacgac

SEQ ID NO: 19938 - DNA, 25 bp, E. coli
acgcagtgcccgtgcgcagcacgac

SEQ ID NO: 19939 - DNA, 25 bp, E. coli
acagcgacatcatccggataaacgc

SEQ ID NO: 19940 - DNA, 25 bp, E. coli
acagcgacatcaaccggataaacgc

SEQ ID NO: 19941 - DNA, 25 bp, E. coli
tattgccccgtctacgtattaccat

SEQ ID NO: 19942 - DNA, 25 bp, E. coli
tattgccccgtcaacgtattaccat

SEQ ID NO: 19943 - DNA, 25 bp, E. coli
ttgtcagcaacagcgacatcatccg

SEQ ID NO: 19944 - DNA, 25 bp, E. coli
ttgtcagcaacaccgacatcatccg

SEQ ID NO: 19945 - DNA, 25 bp, E. coli
tcggaccggtatgcagcgaactgca

SEQ ID NO: 19946 - DNA, 25 bp, E. coli
tcggaccggtatccagcgaactgca

SEQ ID NO: 19947 - DNA, 25 bp, E. coli
gcaacagcgacatcatccggataaa

SEQ ID NO: 19948 - DNA, 25 bp, E. coli
gcaacagcgacaacatccggataaa

SEQ ID NO: 19949 - DNA, 25 bp, E. coli
gtcggaccggtatgcagcgaactgc

SEQ ID NO: 19950 - DNA, 25 bp, E. coli
gtatgcagcgaactgcatattgccc

SEQ ID NO: 19951 - DNA, 25 bp, E. coli
gtcggaccggtaagcagcgaactgc

SEQ ID NO: 19952 - DNA, 25 bp, E. coli
gtatgcagcgaagtgcatattgccc

SEQ ID NO: 19953 - DNA, 25 bp, E. coli
gtcaacgtattagcattgtcagcaa

SEQ ID NO: 19954 - DNA, 25 bp, E. coli
gtcaacgtattaccattgtcagcaa

SEQ ID NO: 19955 - DNA, 25 bp, E. coli
tcagcaacagcgtcatcatccggat

SEQ ID NO: 19956 - DNA, 25 bp, E. coli
tcagcaacagcgacatcatccggat

SEQ ID NO: 19957 - DNA, 25 bp, E. coli
gaccggtatgcagcgaactgcatat

SEQ ID NO: 19958 - DNA, 25 bp, E. coli
gaccggtatgcaccgaactgcatat

SEQ ID NO: 19959 - DNA, 25 bp, E. coli
cagaagctgttaacggatttccgct

SEQ ID NO: 19960 - DNA, 25 bp, E. coli
cagaagctgttatcggatttccgct

SEQ ID NO: 19961 - DNA, 25 bp, E. coli
tatcgcggagtcaaaacgatttccg

SEQ ID NO: 19962 - DNA, 25 bp, E. coli
tatcgcggagtctaaacgatttccg

SEQ ID NO: 19963 - DNA, 25 bp, E. coli
tttccgctcagatctactcgattca

SEQ ID NO: 19964 - DNA, 25 bp, E. coli
tttccgctcagaactactcgattca

SEQ ID NO: 19965 - DNA, 25 bp, E. coli
ccataaattgatggatttgtcgatc

SEQ ID NO: 19966 - DNA, 25 bp, E. coli
ccataaattgatcgatttgtcgatc

SEQ ID NO: 19967 - DNA, 25 bp, E. coli
gcaaaggccatttctactatcgcgg

SEQ ID NO: 19968 - DNA, 25 bp, E. coli
gcaaaggccattactactatcgcgg

SEQ ID NO: 19969 - DNA, 25 bp, E. coli
cggagtcaaaaccatttccgctgca

SEQ ID NO: 19970 - DNA, 25 bp, E. coli
cggagtcaaaacgatttccgctgca

SEQ ID NO: 19971 - DNA, 25 bp, E. coli
gatttgtcgatcaataaaaactgga

SEQ ID NO: 19972 - DNA, 25 bp, E. coli
gatttgtcgatctataaaaactgga

SEQ ID NO: 19973 - DNA, 25 bp, E. coli
gattcacgttttggcgcaaaggcca

SEQ ID NO: 19974 - DNA, 25 bp, E. coli
gattcacgttttcgcgcaaaggcca

SEQ ID NO: 19975 - DNA, 25 bp, E. coli
ggatttccgctctgaactactcgat

SEQ ID NO: 19976 - DNA, 25 bp, E. coli
ggatttccgctcagaactactcgat

SEQ ID NO: 19977 - DNA, 25 bp, E. coli
tggaccagaagcagttaacggattt

SEQ ID NO: 19978 - DNA, 25 bp, E. coli
ggccatttctactatcgcggagtca

SEQ ID NO: 19979 - DNA, 25 bp, E. coli
ggccatttctacaatcgcggagtca

SEQ ID NO: 19980 - DNA, 25 bp, E. coli
tggaccagaagctgttaacggattt

SEQ ID NO: 19981 - DNA, 25 bp, E. coli
aagttgaagatagcaggtatagcgg

SEQ ID NO: 19982 - DNA, 25 bp, E. coli
aagttgaagataccaggtatagcgg

SEQ ID NO: 19983 - DNA, 25 bp, E. coli
caaaatgtcgaggatttgatcgcgg

SEQ ID NO: 19984 - DNA, 25 bp, E. coli
caaaatgtcgagcatttgatcgcgg

SEQ ID NO: 19985 - DNA, 25 bp, E. coli
caggtatagcggatgaatcgcagcg

SEQ ID NO: 19986 - DNA, 25 bp, E. coli
caggtatagcggttgaatcgcagcg

SEQ ID NO: 19987 - DNA, 25 bp, E. coli
tagcggttgaatcgcagcgtttcga

SEQ ID NO: 19988 - DNA, 25 bp, E. coli
tagcggttgaatggcagcgtttcga

SEQ ID NO: 19989 - DNA, 25 bp, E. coli
tgatcgcggttggaaaattgccctg

SEQ ID NO: 19990 - DNA, 25 bp, E. coli
tgatcgcggttgcaaaattgccctg

SEQ ID NO: 19991 - DNA, 25 bp, E. coli
tgaatggcagaatcaaaatgtcgag

SEQ ID NO: 19992 - DNA, 25 bp, E. coli
tgaatggcagaaacaaaatgtcgag

SEQ ID NO: 19993 - DNA, 25 bp, E. coli
tgccctgaaacagggcaacagcgga

SEQ ID NO: 19994 - DNA, 25 bp, E. coli
tgccctgaaacacggcaacagcgga

SEQ ID NO: 19995 - DNA, 25 bp, E. coli
gcagcgtttcgattgaatggcagaa

SEQ ID NO: 19996 - DNA, 25 bp, E. coli
gcagcgtttcgaatgaatggcagaa

SEQ ID NO: 19997 - DNA, 25 bp, E. coli
cgaggatttgatcgcggttgcaaaa

SEQ ID NO: 19998 - DNA, 25 bp, E. coli
cgaggatttgatggcggttgcaaaa

SEQ ID NO: 19999 - DNA, 25 bp, E. coli
gatagcaggtatagcggttgaatcg

SEQ ID NO: 20000 - DNA, 25 bp, E. coli
gatagcaggtattgcggttgaatcg

SEQ ID NO: 20001 - DNA, 25 bp, E. coli
ggttgcaaaattcccctgaaacagg

SEQ ID NO: 20002 - DNA, 25 bp, E. coli
ggttgcaaaattgccctgaaacagg

SEQ ID NO: 20003 - DNA, 25 bp, E. coli
cactttcttctggtacggcgtcggt

SEQ ID NO: 20004 - DNA, 25 bp, E. coli
cactttcttctgctacggcgtcggt

SEQ ID NO: 20005 - DNA, 25 bp, E. coli
taccacaaagtagaagaagaccgtc

SEQ ID NO: 20006 - DNA, 25 bp, E. coli
taccacaaagtacaagaagaccgtc

SEQ ID NO: 20007 - DNA, 25 bp, E. coli
tttcttctgctagggcgtcggtgtt

SEQ ID NO: 20008 - DNA, 25 bp, E. coli
tttcttctgctacggcgtcggtgtt

SEQ ID NO: 20009 - DNA, 25 bp, E. coli
tgttggtgagtaacgctacactgca

SEQ ID NO: 20010 - DNA, 25 bp, E. coli
tgttggtgagtatcgctacactgca

SEQ ID NO: 20011 - DNA, 25 bp, E. coli
tgcataatgctgacgaaatcgaacg

SEQ ID NO: 20012 - DNA, 25 bp, E. coli
tgcataatgctgtcgaaatcgaacg

SEQ ID NO: 20013 - DNA, 25 bp, E. coli
ccacaaagtagatgaagaccgtccg

SEQ ID NO: 20014 - DNA, 25 bp, E. coli
ccacaaagtagaagaagaccgtccg

SEQ ID NO: 20015 - DNA, 25 bp, E. coli
gctcactttcttctgctacggcgtc

SEQ ID NO: 20016 - DNA, 25 bp, E. coli
gctcactttcttgtgctacggcgtc

SEQ ID NO: 20017 - DNA, 25 bp, E. coli
ctggcgtgttggtgagtaacgctac

SEQ ID NO: 20018 - DNA, 25 bp, E. coli
ctggcgtgttggagagtaacgctac

SEQ ID NO: 20019 - DNA, 25 bp, E. coli
gtaacgctacactgcataatgctga

SEQ ID NO: 20020 - DNA, 25 bp, E. coli
gtaacgctacacagcataatgctga

SEQ ID NO: 20021 - DNA, 25 bp, E. coli
ggtgagtaacgctacactgcataat

SEQ ID NO: 20022 - DNA, 25 bp, E. coli
ggtgagtaacgcaacactgcataat

SEQ ID NO: 20023 - DNA, 25 bp, E. coli
taatgctgacgaaatcgaacgtctt

SEQ ID NO: 20024 - DNA, 25 bp, E. coli
taatgctgacgatatcgaacgtctt

SEQ ID NO: 20025 - DNA, 25 bp, E. coli
gaattactaaaaccccgtcagcgga

SEQ ID NO: 20026 - DNA, 25 bp, E. coli
caaaggtctcttgctaaagccctga

SEQ ID NO: 20027 - DNA, 25 bp, E. coli
gaattactaaaagcccgtcagcgga

SEQ ID NO: 20028 - DNA, 25 bp, E. coli
caaaggtctcttcctaaagccctga

SEQ ID NO: 20029 - DNA, 25 bp, E. coli
cacctgttgagaagccagttgcctt

SEQ ID NO: 20030 - DNA, 25 bp, E. coli
cacctgttgagatgccagttgcctt

SEQ ID NO: 20031 - DNA, 25 bp, E. coli
taaagccctgaatatctcccatgtg

SEQ ID NO: 20032 - DNA, 25 bp, E. coli
taaagccctgaaaatctcccatgtg

SEQ ID NO: 20033 - DNA, 25 bp, E. coli
tagtgaacctactgggaagaacctt

SEQ ID NO: 20034 - DNA, 25 bp, E. coli
tagtgaacctacagggaagaacctt

SEQ ID NO: 20035 - DNA, 25 bp, E. coli
tatcggcgaacgcatcaggtatcgt

SEQ ID NO: 20036 - DNA, 25 bp, E. coli
tatttggcgatgaagacaagcaacc

SEQ ID NO: 20037 - DNA, 25 bp, E. coli
tatcggcgaacggatcaggtatcgt

SEQ ID NO: 20038 - DNA, 25 bp, E. coli
tatttggcgatgtagacaagcaacc

SEQ ID NO: 20039 - DNA, 25 bp, E. coli
tccttgagctgtttaatgcactgcc

SEQ ID NO: 20040 - DNA, 25 bp, E. coli
tccttgagctgtataatgcactgcc

SEQ ID NO: 20041 - DNA, 25 bp, E. coli
tcagtaaagtatagcaatgctcacc

SEQ ID NO: 20042 - DNA, 25 bp, E. coli
tcagtaaagtattgcaatgctcacc

SEQ ID NO: 20043 - DNA, 25 bp, E. coli
gaatcagaacagcatacccagctcg

SEQ ID NO: 20044 - DNA, 25 bp, E. coli
gaatcagaacaggatacccagctcg

SEQ ID NO: 20045 - DNA, 25 bp, E. coli
cgccgaaatgcgtgctcgagtaaaa

SEQ ID NO: 20046 - DNA, 25 bp, E. coli
cgccgaaatgcgagctcgagtaaaa

SEQ ID NO: 20047 - DNA, 25 bp, E. coli
aaaactggcgcaccttgagttccgc

SEQ ID NO: 20048 - DNA, 25 bp, E. coli
aaaactggcgcagcttgagttccgc

SEQ ID NO: 20049 - DNA, 25 bp, E. coli
aacagccggatgtctggaacgaacc

SEQ ID NO: 20050 - DNA, 25 bp, E. coli
aacagccggatgactggaacgaacc

SEQ ID NO: 20051 - DNA, 25 bp, E. coli
tgttctctggcgtatatgacagcgc

SEQ ID NO: 20052 - DNA, 25 bp, E. coli
tgatgactcccgcattaaagatctg

SEQ ID NO: 20053 - DNA, 25 bp, E. coli
tgttctctggcgaatatgacagcgc

SEQ ID NO: 20054 - DNA, 25 bp, E. coli
tgatgactcccggattaaagatctg

SEQ ID NO: 20055 - DNA, 25 bp, E. coli
tcgacgccctggaagaaaaactggc

SEQ ID NO: 20056 - DNA, 25 bp, E. coli
tcgacgccctggtagaaaaactggc

SEQ ID NO: 20057 - DNA, 25 bp, E. coli
tctggaagaagtaaacgccgagctg

SEQ ID NO: 20058 - DNA, 25 bp, E. coli
tctggaagaagttaacgccgagctg

SEQ ID NO: 20059 - DNA, 25 bp, E. coli
gactgctacctcgatattcaggcgg

SEQ ID NO: 20060 - DNA, 25 bp, E. coli
gactgctacctccatattcaggcgg

SEQ ID NO: 20061 - DNA, 25 bp, E. coli
gacggcagcctggatcaatttatcg

SEQ ID NO: 20062 - DNA, 25 bp, E. coli
ggtaaagagcgttcctccctcgaag

SEQ ID NO: 20063 - DNA, 25 bp, E. coli
ggtaaagagcgtacctccctcgaag

SEQ ID NO: 20064 - DNA, 25 bp, E. coli
ggcgattacgcttacggctggctgc

SEQ ID NO: 20065 - DNA, 25 bp, E. coli
ggcgattacgctaacggctggctgc

SEQ ID NO: 20066 - DNA, 25 bp, E. coli
taacgaagccgtagctgaactcgac

SEQ ID NO: 20067 - DNA, 25 bp, E. coli
taacgaagccgttgctgaactcgac

SEQ ID NO: 20068 - DNA, 25 bp, E. coli
gacggcagcctgcatcaatttatcg

SEQ ID NO: 20069 - DNA, 25 bp, E. coli
aacgccagttaggagaactgccgcg

SEQ ID NO: 20070 - DNA, 25 bp, E. coli
agtgttggtcatagccgacagcggc

SEQ ID NO: 20071 - DNA, 25 bp, E. coli
agtgttggtcattgccgacagcggc

SEQ ID NO: 20072 - DNA, 25 bp, E. coli
aacgccagttagcagaactgccgcg

SEQ ID NO: 20073 - DNA, 25 bp, E. coli
tagcgtgaaagctcgcggtgatgac

SEQ ID NO: 20074 - DNA, 25 bp, E. coli
tagcgtgaaagcacgcggtgatgac

SEQ ID NO: 20075 - DNA, 25 bp, E. coli
tatggcgcatcatgttgccgaagcc

SEQ ID NO: 20076 - DNA, 25 bp, E. coli
tatggcgcatcaagttgccgaagcc

SEQ ID NO: 20077 - DNA, 25 bp, E. coli
ttgccgaagccgacgaacgccagtt

SEQ ID NO: 20078 - DNA, 25 bp, E. coli
ttgccgaagccgtcgaacgccagtt

SEQ ID NO: 20079 - DNA, 25 bp, E. coli
tgatgacgccctgcgggaatatagc

SEQ ID NO: 20080 - DNA, 25 bp, E. coli
tgatgacgccctccgggaatatagc

SEQ ID NO: 20081 - DNA, 25 bp, E. coli
cccgtcggaagtcttggtcattgcc

SEQ ID NO: 20082 - DNA, 25 bp, E. coli
cccgtcggaagtgttggtcattgcc

SEQ ID NO: 20083 - DNA, 25 bp, E. coli
ggtgtctgctgaggaaattgccgcc

SEQ ID NO: 20084 - DNA, 25 bp, E. coli
tgtcgaaagtaggtttctccgcgct

SEQ ID NO: 20085 - DNA, 25 bp, E. coli
tgtcgaaagtagctttctccgcgct

SEQ ID NO: 20086 - DNA, 25 bp, E. coli
ggtgtctgctgacgaaattgccgcc

SEQ ID NO: 20087 - DNA, 25 bp, E. coli
gactggcggatttccagaagcggat

SEQ ID NO: 20088 - DNA, 25 bp, E. coli
gacgcctgacgctgatatggcgcat

SEQ ID NO: 20089 - DNA, 25 bp, E. coli
gactggcggattaccagaagcggat

SEQ ID NO: 20090 - DNA, 25 bp, E. coli
gacgcctgacgcagatatggcgcat

SEQ ID NO: 20091 - DNA, 25 bp, E. coli
caggtcgtcactctcaaccagggaa

SEQ ID NO: 20092 - DNA, 25 bp, E. coli
caggtcgtcactgtcaaccagggaa

SEQ ID NO: 20093 - DNA, 25 bp, E. coli
aaattacggtaaagcatgcctgcgg

SEQ ID NO: 20094 - DNA, 25 bp, E. coli
aaattacggtaatgcatgcctgcgg

SEQ ID NO: 20095 - DNA, 25 bp, E. coli
tatcaggcgatctttggtcaccagg

SEQ ID NO: 20096 - DNA, 25 bp, E. coli
tatcaggcgatcattggtcaccagg

SEQ ID NO: 20097 - DNA, 25 bp, E. coli
ttcatcgaaagcgttgacggcagcg

SEQ ID NO: 20098 - DNA, 25 bp, E. coli
ttcatcgaaagccttgacggcagcg

SEQ ID NO: 20099 - DNA, 25 bp, E. coli
tcgtgctcgcgcagaactgaactgg

SEQ ID NO: 20100 - DNA, 25 bp, E. coli
tcgtgctcgcgctgaactgaactgg

SEQ ID NO: 20101 - DNA, 25 bp, E. coli
tccctgaaatcgaacggcggtaaag

SEQ ID NO: 20102 - DNA, 25 bp, E. coli
tccctgaaatcgtacggcggtaaag

SEQ ID NO: 20103 - DNA, 25 bp, E. coli
gcaagggcaattgcagcaagcgact

SEQ ID NO: 20104 - DNA, 25 bp, E. coli
gcaagggcaattccagcaagcgact

SEQ ID NO: 20105 - DNA, 25 bp, E. coli
gatttcaaagatgtgttcctcgcgc

SEQ ID NO: 20106 - DNA, 25 bp, E. coli
gataccgaccagatggacatgcgca

SEQ ID NO: 20107 - DNA, 25 bp, E. coli
gatttcaaagatctgttcctcgcgc

SEQ ID NO: 20108 - DNA, 25 bp, E. coli
gataccgaccagttggacatgcgca

SEQ ID NO: 20109 - DNA, 25 bp, E. coli
tcaaaagttagtgaggatcctcggc

SEQ ID NO: 20110 - DNA, 25 bp, E. coli
tcaaaagttagtcaggatcctcggc

SEQ ID NO: 20111 - DNA, 25 bp, E. coli
gacgctgggcaaactgtataccgaa

SEQ ID NO: 20112 - DNA, 25 bp, E. coli
gacgctgggcaatctgtataccgaa

SEQ ID NO: 20113 - DNA, 25 bp, E. coli
aagggaatgcgcgtaagccctcctc

SEQ ID NO: 20114 - DNA, 25 bp, E. coli
aagggaatgcgcctaagccctcctc

SEQ ID NO: 20115 - DNA, 25 bp, E. coli
acaacagcggatggacgggaaatca

SEQ ID NO: 20116 - DNA, 25 bp, E. coli
acaacagcggatcgacgggaaatca

SEQ ID NO: 20117 - DNA, 25 bp, E. coli
tcttctggcgcgatggataacgtcg

SEQ ID NO: 20118 - DNA, 25 bp, E. coli
tcaggagcaacatcagcggatcgac

SEQ ID NO: 20119 - DNA, 25 bp, E. coli
tcttctggcgcgttggataacgtcg

SEQ ID NO: 20120 - DNA, 25 bp, E. coli
tcaggagcaacaacagcggatcgac

SEQ ID NO: 20121 - DNA, 25 bp, E. coli
gccgatgaacagtctaactctctgg

SEQ ID NO: 20122 - DNA, 25 bp, E. coli
gccgatgaacagactaactctctgg

SEQ ID NO: 20123 - DNA, 25 bp, E. coli
gcgcgatggataacgtcgccattac

SEQ ID NO: 20124 - DNA, 25 bp, E. coli
gcgcgatggatatcgtcgccattac

SEQ ID NO: 20125 - DNA, 25 bp, E. coli
gctatccgggtcacagaccacttca

SEQ ID NO: 20126 - DNA, 25 bp, E. coli
gctatccgggtctcagaccacttca

SEQ ID NO: 20127 - DNA, 25 bp, E. coli
gactaactctctcgtcattaccgct

SEQ ID NO: 20128 - DNA, 25 bp, E. coli
gactaactctctggtcattaccgct

SEQ ID NO: 20129 - DNA, 25 bp, E. coli
gttaccgtcaggtgcaacaacagcg

SEQ ID NO: 20130 - DNA, 25 bp, E. coli
gttaccgtcaggagcaacaacagcg

SEQ ID NO: 20131 - DNA, 25 bp, E. coli
gggagtactgcttaccgcgctggcc

SEQ ID NO: 20132 - DNA, 25 bp, E. coli
gggagtactgctaaccgcgctggcc

SEQ ID NO: 20133 - DNA, 25 bp, E. coli
taagccctcctcttctggcgcgatg

SEQ ID NO: 20134 - DNA, 25 bp, E. coli
taagccctcctcatctggcgcgatg

SEQ ID NO: 20135 - DNA, 25 bp, E. coli
taacgctgcgctcgaaagactggct

SEQ ID NO: 20136 - DNA, 25 bp, E. coli
tacgaagaaaaagttgcgcaggcgc

SEQ ID NO: 20137 - DNA, 25 bp, E. coli
tacgaagaaaaacttgcgcaggcgc

SEQ ID NO: 20138 - DNA, 25 bp, E. coli
acaaacctttgctgacgtcgtcggc

SEQ ID NO: 20139 - DNA, 25 bp, E. coli
acaaacctttgcagacgtcgtcggc

SEQ ID NO: 20140 - DNA, 25 bp, E. coli
taccaaaactggtcgaacaggtggc

SEQ ID NO: 20141 - DNA, 25 bp, E. coli
taccaaaactggacgaacaggtggc

SEQ ID NO: 20142 - DNA, 25 bp, E. coli
tgcaatttcatctcaaggcgctgga

SEQ ID NO: 20143 - DNA, 25 bp, E. coli
tgaagatgataaacccgcggtgcgt

SEQ ID NO: 20144 - DNA, 25 bp, E. coli
tgaagatgataatcccgcggtgcgt

SEQ ID NO: 20145 - DNA, 25 bp, E. coli
tgcaatttcatcacaaggcgctgga

SEQ ID NO: 20146 - DNA, 25 bp, E. coli
gcaaaaaagagtcaaccggcagccg

SEQ ID NO: 20147 - DNA, 25 bp, E. coli
gcaaaaaagagtgaaccggcagccg

SEQ ID NO: 20148 - DNA, 25 bp, E. coli
ggtcttagcccgtaaatggcgccca

SEQ ID NO: 20149 - DNA, 25 bp, E. coli
ggtcttagcccgaaaatggcgccca

SEQ ID NO: 20150 - DNA, 25 bp, E. coli
ggaacatgaaaaaacgccggaactg

SEQ ID NO: 20151 - DNA, 25 bp, E. coli
ggaacatgaaaatacgccggaactg

SEQ ID NO: 20152 - DNA, 25 bp, E. coli
taacgctgcgctggaaagactggct

SEQ ID NO: 20153 - DNA, 25 bp, E. coli
gatgcagcaaaatgaagtggtcgcc

SEQ ID NO: 20154 - DNA, 25 bp, E. coli
gatgcagcaaaaagaagtggtcgcc

SEQ ID NO: 20155 - DNA, 25 bp, E. coli
gatgccttaagtctgaccgaccagg

SEQ ID NO: 20156 - DNA, 25 bp, E. coli
gatgccttaagtgtgaccgaccagg

SEQ ID NO: 20157 - DNA, 25 bp, E. coli
caaaactgaaactggtgctgtgcta

SEQ ID NO: 20158 - DNA, 25 bp, E. coli
caaaactgaaacaggtgctgtgcta

SEQ ID NO: 20159 - DNA, 25 bp, E. coli
tacttttgctcgacgactttatgat

SEQ ID NO: 20160 - DNA, 25 bp, E. coli
tacttttgctcgtcgactttatgat

SEQ ID NO: 20161 - DNA, 25 bp, E. coli
atattccgacgagacccgaactggc

SEQ ID NO: 20162 - DNA, 25 bp, E. coli
atattccgacgacacccgaactggc

SEQ ID NO: 20163 - DNA, 25 bp, E. coli
acggttgatgtctgtaaaaaagagg

SEQ ID NO: 20164 - DNA, 25 bp, E. coli
acggttgatgtcagtaaaaaagagg

SEQ ID NO: 20165 - DNA, 25 bp, E. coli
ttgtttcccacaggcacaatgggcg

SEQ ID NO: 20166 - DNA, 25 bp, E. coli
ttgtttcccacacgcacaatgggcg

SEQ ID NO: 20167 - DNA, 25 bp, E. coli
gcgaagacggttcatgtcagtaaaa

SEQ ID NO: 20168 - DNA, 25 bp, E. coli
gcgaagacggttgatgtcagtaaaa

SEQ ID NO: 20169 - DNA, 25 bp, E. coli
gactttatgattcattacccgttaa

SEQ ID NO: 20170 - DNA, 25 bp, E. coli
gacacccgaactcgcaaaactgaaa

SEQ ID NO: 20171 - DNA, 25 bp, E. coli
gacacccgaactggcaaaactgaaa

SEQ ID NO: 20172 - DNA, 25 bp, E. coli
gactttatgattgattacccgttaa

SEQ ID NO: 20173 - DNA, 25 bp, E. coli
gacggcgtacagtgaagacaatcag

SEQ ID NO: 20174 - DNA, 25 bp, E. coli
cgcacaatgggcgaagacggttgat

SEQ ID NO: 20175 - DNA, 25 bp, E. coli
cgcacaatgggccaagacggttgat

SEQ ID NO: 20176 - DNA, 25 bp, E. coli
gattgattgtttcccacacgcacaa

SEQ ID NO: 20177 - DNA, 25 bp, E. coli
gattgattgtttgccacacgcacaa

SEQ ID NO: 20178 - DNA, 25 bp, E. coli
gacggcgtacagagaagacaatcag

SEQ ID NO: 20179 - DNA, 25 bp, E. coli
caaacatctacacgacgaagcgaaa

SEQ ID NO: 20180 - DNA, 25 bp, E. coli
caaacatctacaggacgaagcgaaa

SEQ ID NO: 20181 - DNA, 25 bp, E. coli
catgttgaatctcgcagatcaaacc

SEQ ID NO: 20182 - DNA, 25 bp, E. coli
catgttgaatctggcagatcaaacc

SEQ ID NO: 20183 - DNA, 25 bp, E. coli
tctacaggacgatgcgaaacgtcgc

SEQ ID NO: 20184 - DNA, 25 bp, E. coli
tctacaggacgaagcgaaacgtcgc

SEQ ID NO: 20185 - DNA, 25 bp, E. coli
gcgcaaacatctacaggacgaagcg

SEQ ID NO: 20186 - DNA, 25 bp, E. coli
gcgcaaacatcttcaggacgaagcg

SEQ ID NO: 20187 - DNA, 25 bp, E. coli
gaaggcatgttgaatctggcagatc

SEQ ID NO: 20188 - DNA, 25 bp, E. coli
gaagcgaaacgtggcctgaatgact

SEQ ID NO: 20189 - DNA, 25 bp, E. coli
gaagcgaaacgtcgcctgaatgact

SEQ ID NO: 20190 - DNA, 25 bp, E. coli
gaaggcatgttgtatctggcagatc

SEQ ID NO: 20191 - DNA, 25 bp, E. coli
gaaacgtcgcctcaatgactgggcc

SEQ ID NO: 20192 - DNA, 25 bp, E. coli
gaaacgtcgcctgaatgactgggcc

SEQ ID NO: 20193 - DNA, 25 bp, E. coli
ccgcgaatggtgtaaacggtgccgc

SEQ ID NO: 20194 - DNA, 25 bp, E. coli
ccgcgaatggtgaaaacggtgccgc

SEQ ID NO: 20195 - DNA, 25 bp, E. coli
cgtcgcctgaatgactgggccgagc

SEQ ID NO: 20196 - DNA, 25 bp, E. coli
cgtcgcctgaatcactgggccgagc

SEQ ID NO: 20197 - DNA, 25 bp, E. coli
ggacgaagcgaatcgtcgcctgaat

SEQ ID NO: 20198 - DNA, 25 bp, E. coli
ggacgaagcgaaacgtcgcctgaat

SEQ ID NO: 20199 - DNA, 25 bp, E. coli
taatgaaaccgcgaatggtgaaaac

SEQ ID NO: 20200 - DNA, 25 bp, E. coli
taatgaaaccgccaatggtgaaaac

SEQ ID NO: 20201 - DNA, 25 bp, E. coli
taaaccttatctcaatctggccgca

SEQ ID NO: 20202 - DNA, 25 bp, E. coli
taacgtcgctaaactgcaggctgac

SEQ ID NO: 20203 - DNA, 25 bp, E. coli
taaaccttatctgaatctggccgca

SEQ ID NO: 20204 - DNA, 25 bp, E. coli
tatgacttcgctgtgggcaacgcga

SEQ ID NO: 20205 - DNA, 25 bp, E. coli
tatgacttcgctctgggcaacgcga

SEQ ID NO: 20206 - DNA, 25 bp, E. coli
tttggtcactacagcaacacggcag

SEQ ID NO: 20207 - DNA, 25 bp, E. coli
tttggtcactactgcaacacggcag

SEQ ID NO: 20208 - DNA, 25 bp, E. coli
tatcagcggtaaagcgagcggtgac

SEQ ID NO: 20209 - DNA, 25 bp, E. coli
tatcagcggtaatgcgagcggtgac

SEQ ID NO: 20210 - DNA, 25 bp, E. coli
tctgagcgaaaaagacaagggtggc

SEQ ID NO: 20211 - DNA, 25 bp, E. coli
tctgagcgaaaatgacaagggtggc

SEQ ID NO: 20212 - DNA, 25 bp, E. coli
gtaaacagaaacataccaccgcggg

SEQ ID NO: 20213 - DNA, 25 bp, E. coli
gtaaacagaaacttaccaccgcggg

SEQ ID NO: 20214 - DNA, 25 bp, E. coli
gattatcaactcaacggcgtggacg

SEQ ID NO: 20215 - DNA, 25 bp, E. coli
gatatctctggaagcgaccacggga

SEQ ID NO: 20216 - DNA, 25 bp, E. coli
gattatcaactctacggcgtggacg

SEQ ID NO: 20217 - DNA, 25 bp, E. coli
gatatctctggatgcgaccacggga

SEQ ID NO: 20218 - DNA, 25 bp, E. coli
tacacatggaaagacggtaatggcc

SEQ ID NO: 20219 - DNA, 25 bp, E. coli
tacacatggaaacacggtaatggcc

SEQ ID NO: 20220 - DNA, 25 bp, E. coli
taacgtcgctaatctgcaggctgac

SEQ ID NO: 20221 - DNA, 25 bp, E. coli
gagttacagcaacggctctacggca

SEQ ID NO: 20222 - DNA, 25 bp, E. coli
gagttacagcaagggctctacggca

SEQ ID NO: 20223 - DNA, 25 bp, E. coli
aagaggagctgatccgtttatcggc

SEQ ID NO: 20224 - DNA, 25 bp, E. coli
aagaggagctgaaccgtttatcggc

SEQ ID NO: 20225 - DNA, 25 bp, E. coli
caatctggggcacgaaaagctgacc

SEQ ID NO: 20226 - DNA, 25 bp, E. coli
caatctggggcaggaaaagctgacc

SEQ ID NO: 20227 - DNA, 25 bp, E. coli
cggtgaaagaggagctgaaccgttt

SEQ ID NO: 20228 - DNA, 25 bp, E. coli
cagcgatgcggcaggtaatgcctcc

SEQ ID NO: 20229 - DNA, 25 bp, E. coli
cagcgatgcggctggtaatgcctcc

SEQ ID NO: 20230 - DNA, 25 bp, E. coli
cggtgaaagaggtgctgaaccgttt

SEQ ID NO: 20231 - DNA, 25 bp, E. coli
caggctcccgcggtatatgccattt

SEQ ID NO: 20232 - DNA, 25 bp, E. coli
caggctcccgcgctatatgccattt

SEQ ID NO: 20233 - DNA, 25 bp, E. coli
ttatttccctgctagcctgaagacg

SEQ ID NO: 20234 - DNA, 25 bp, E. coli
ttatttccctgcaagcctgaagacg

SEQ ID NO: 20235 - DNA, 25 bp, E. coli
gtttatcggcttttttccctgcaag

SEQ ID NO: 20236 - DNA, 25 bp, E. coli
gtttatcggcttatttccctgcaag

SEQ ID NO: 20237 - DNA, 25 bp, E. coli
cgcgctatatgcgatttcactggtc

SEQ ID NO: 20238 - DNA, 25 bp, E. coli
cgatgcggcaggtaatgcctccatc

SEQ ID NO: 20239 - DNA, 25 bp, E. coli
cgcgctatatgccatttcactggtc

SEQ ID NO: 20240 - DNA, 25 bp, E. coli
cgatgcggcaggaaatgcctccatc

SEQ ID NO: 20241 - DNA, 25 bp, E. coli
tggatacctcgccagcggtgaaaga

SEQ ID NO: 20242 - DNA, 25 bp, E. coli
tggatacctcgcgagcggtgaaaga

SEQ ID NO: 20243 - DNA, 25 bp, E. coli
tcaaaccaggctcccgcgctatatg

SEQ ID NO: 20244 - DNA, 25 bp, E. coli
tcaaaccaggctgccgcgctatatg

SEQ ID NO: 20245 - DNA, 25 bp, E. coli
aatcaagatgagtggctaatcgccg

SEQ ID NO: 20246 - DNA, 25 bp, E. coli
aatcaagatgagaggctaatcgccg

SEQ ID NO: 20247 - DNA, 25 bp, E. coli
ttcagatggtgtacggcgatgccag

SEQ ID NO: 20248 - DNA, 25 bp, E. coli
ttcagatggtgttcggcgatgccag

SEQ ID NO: 20249 - DNA, 25 bp, E. coli
tgccagggtcgaggccgttgaattt

SEQ ID NO: 20250 - DNA, 25 bp, E. coli
tgccagggtcgacgccgttgaattt

SEQ ID NO: 20251 - DNA, 25 bp, E. coli
tcgtctggagacaggtggcaacagc

SEQ ID NO: 20252 - DNA, 25 bp, E. coli
tcgtctggagactggtggcaacagc

SEQ ID NO: 20253 - DNA, 25 bp, E. coli
gcaaacctgcgtggtctggagacag

SEQ ID NO: 20254 - DNA, 25 bp, E. coli
gcaaacctgcgtcgtctggagacag

SEQ ID NO: 20255 - DNA, 25 bp, E. coli
cgagaacgccggagacattgtggca

SEQ ID NO: 20256 - DNA, 25 bp, E. coli
cgagaacgccggtgacattgtggca

SEQ ID NO: 20257 - DNA, 25 bp, E. coli
cattgtggcaaacctggagaagtta

SEQ ID NO: 20258 - DNA, 25 bp, E. coli
cattgtggcaaagctggagaagtta

SEQ ID NO: 20259 - DNA, 25 bp, E. coli
tggcaacagcggaggaggatttctg

SEQ ID NO: 20260 - DNA, 25 bp, E. coli
ggcaaagctggacaagttagtaagc

SEQ ID NO: 20261 - DNA, 25 bp, E. coli
ggcaaagctggagaagttagtaagc

SEQ ID NO: 20262 - DNA, 25 bp, E. coli
tggcaacagcggtggaggatttctg

SEQ ID NO: 20263 - DNA, 25 bp, E. coli
tcacaatcaagatgagtggctaatc

SEQ ID NO: 20264 - DNA, 25 bp, E. coli
tcacaatcaagaagagtggctaatc

SEQ ID NO: 20265 - DNA, 25 bp, E. coli
gatgagtggctaatcgccgtggatt

SEQ ID NO: 20266 - DNA, 25 bp, E. coli
gatgagtggctattcgccgtggatt

SEQ ID NO: 20267 - DNA, 25 bp, E. coli
cacgttgccattttgggtatataca

SEQ ID NO: 20268 - DNA, 25 bp, E. coli
cacgttgccattatgggtatataca

SEQ ID NO: 20269 - DNA, 25 bp, E. coli
aaacctggcgaagcgattcttcatg

SEQ ID NO: 20270 - DNA, 25 bp, E. coli
aaacctggcgaaccgattcttcatg

SEQ ID NO: 20271 - DNA, 25 bp, E. coli
tattaacgtgacgtcaccttccgga

SEQ ID NO: 20272 - DNA, 25 bp, E. coli
tattaacgtgacctcaccttccgga

SEQ ID NO: 20273 - DNA, 25 bp, E. coli
ttgaaagaggtgataacagcggtgt

SEQ ID NO: 20274 - DNA, 25 bp, E. coli
ttgaaagaggtgttaacagcggtgt

SEQ ID NO: 20275 - DNA, 25 bp, E. coli
tgctgttcagaaatcacaatgtgaa

SEQ ID NO: 20276 - DNA, 25 bp, E. coli
tgctattaacattcctgactatgag

SEQ ID NO: 20277 - DNA, 25 bp, E. coli
tgctgttcagaattcacaatgtgaa

SEQ ID NO: 20278 - DNA, 25 bp, E. coli
tgctattaacatacctgactatgag

SEQ ID NO: 20279 - DNA, 25 bp, E. coli
ccttccggacaggaagaaacattta

SEQ ID NO: 20280 - DNA, 25 bp, E. coli
ccttccggacagcaagaaacattta

SEQ ID NO: 20281 - DNA, 25 bp, E. coli
gcttatcaaccccaagatctttgta

SEQ ID NO: 20282 - DNA, 25 bp, E. coli
gcttatcaacccgaagatctttgta

SEQ ID NO: 20283 - DNA, 25 bp, E. coli
gacggaccagaaactcccgaagaag

SEQ ID NO: 20284 - DNA, 25 bp, E. coli
gacggaccagaatctcccgaagaag

SEQ ID NO: 20285 - DNA, 25 bp, E. coli
ccgaagatctttctaccatccataa

SEQ ID NO: 20286 - DNA, 25 bp, E. coli
ccgaagatctttgtaccatccataa

SEQ ID NO: 20287 - DNA, 25 bp, E. coli
ggtatatacaaatccctccagtgac

SEQ ID NO: 20288 - DNA, 25 bp, E. coli
ggtatatacaaaaccctccagtgac

SEQ ID NO: 20289 - DNA, 25 bp, E. coli
accatatctcgataaaggagacatc

SEQ ID NO: 20290 - DNA, 25 bp, E. coli
accatatctcgaaaaaggagacatc

SEQ ID NO: 20291 - DNA, 25 bp, E. coli
taccggtgtttctggcggtgaagag

SEQ ID NO: 20292 - DNA, 25 bp, E. coli
taccggtgtttcaggcggtgaagag

SEQ ID NO: 20293 - DNA, 25 bp, E. coli
tattcgtcgtaatcgtgagctttca

SEQ ID NO: 20294 - DNA, 25 bp, E. coli
tattcgtcgtaaacgtgagctttca

SEQ ID NO: 20295 - DNA, 25 bp, E. coli
tgaattggtagctccgatcctgacc

SEQ ID NO: 20296 - DNA, 25 bp, E. coli
tgaagcggctaagaaaggtaccggt

SEQ ID NO: 20297 - DNA, 25 bp, E. coli
tgaagcggctaacaaaggtaccggt

SEQ ID NO: 20298 - DNA, 25 bp, E. coli
tgaattggtagcaccgatcctgacc

SEQ ID NO: 20299 - DNA, 25 bp, E. coli
tcgtgagctttctgcagagggcttt

SEQ ID NO: 20300 - DNA, 25 bp, E. coli
tcgtgagctttcagcagagggcttt

SEQ ID NO: 20301 - DNA, 25 bp, E. coli
cctcaaaccataactcgataaagga

SEQ ID NO: 20302 - DNA, 25 bp, E. coli
cctcaaaccatatctcgataaagga

SEQ ID NO: 20303 - DNA, 25 bp, E. coli
gaagcctatgaattggtagcaccga

SEQ ID NO: 20304 - DNA, 25 bp, E. coli
gaagcctatgaaatggtagcaccga

SEQ ID NO: 20305 - DNA, 25 bp, E. coli
cgccgccgtagcagaagacggtgaa

SEQ ID NO: 20306 - DNA, 25 bp, E. coli
cgccgccgtagctgaagacggtgaa

SEQ ID NO: 20307 - DNA, 25 bp, E. coli
cgtagctgaagacggtgaaccatgc

SEQ ID NO: 20308 - DNA, 25 bp, E. coli
cgtagctgaagagggtgaaccatgc

SEQ ID NO: 20309 - DNA, 25 bp, E. coli
taatcgtgagctttcagcagagggc

SEQ ID NO: 20310 - DNA, 25 bp, E. coli
taatcgtgagctatcagcagagggc

SEQ ID NO: 20311 - DNA, 25 bp, E. coli
aaagaagagtgtaattgaatatcgc

SEQ ID NO: 20312 - DNA, 25 bp, E. coli
aaagaagagtgttattgaatatcgc

SEQ ID NO: 20313 - DNA, 25 bp, E. coli
gccccgaacattaatgcgattgttg

SEQ ID NO: 20314 - DNA, 25 bp, E. coli
gccccgaacatttatgcgattgttg

SEQ ID NO: 20315 - DNA, 25 bp, E. coli
gcaattgactgctgaaccgtatgtg

SEQ ID NO: 20316 - DNA, 25 bp, E. coli
gaattcgcaattcactgctgaaccg

SEQ ID NO: 20317 - DNA, 25 bp, E. coli
gaattcgcaattgactgctgaaccg

SEQ ID NO: 20318 - DNA, 25 bp, E. coli
gcaattgactgcagaaccgtatgtg

SEQ ID NO: 20319 - DNA, 25 bp, E. coli
gaaccgtatgtgtttggagagcaac

SEQ ID NO: 20320 - DNA, 25 bp, E. coli
gaaccgtatgtgattggagagcaac

SEQ ID NO: 20321 - DNA, 25 bp, E. coli
ccatgcgcacatcgggaccgggaca

SEQ ID NO: 20322 - DNA, 25 bp, E. coli
ccatgcgcacatggggaccgggaca

SEQ ID NO: 20323 - DNA, 25 bp, E. coli
cattaatgcgatagttgatgctgta

SEQ ID NO: 20324 - DNA, 25 bp, E. coli
cattaatgcgattgttgatgctgta

SEQ ID NO: 20325 - DNA, 25 bp, E. coli
gtatgtgtttggagagcaactaacg

SEQ ID NO: 20326 - DNA, 25 bp, E. coli
gtatgtgtttggtgagcaactaacg

SEQ ID NO: 20327 - DNA, 25 bp, E. coli
gtgtaattgaatttcgcaaatcgct

SEQ ID NO: 20328 - DNA, 25 bp, E. coli
gtgtaattgaatatcgcaaatcgct

SEQ ID NO: 20329 - DNA, 25 bp, E. coli
gaccgggacacgaatggtttcagga

SEQ ID NO: 20330 - DNA, 25 bp, E. coli
gataatgccccgaacattaatgcga

SEQ ID NO: 20331 - DNA, 25 bp, E. coli
gaccgggacacgtatggtttcagga

SEQ ID NO: 20332 - DNA, 25 bp, E. coli
gataatgccccgtacattaatgcga

SEQ ID NO: 20333 - DNA, 25 bp, E. coli
caactggatgccagggatgctgaaa

SEQ ID NO: 20334 - DNA, 25 bp, E. coli
caactggatgcctgggatgctgaaa

SEQ ID NO: 20335 - DNA, 25 bp, E. coli
tacgatcaacaaactgatgcctgga

SEQ ID NO: 20336 - DNA, 25 bp, E. coli
tacgatcaacaatctgatgcctgga

SEQ ID NO: 20337 - DNA, 25 bp, E. coli
tatccctgccctgctaaatggcgaa

SEQ ID NO: 20338 - DNA, 25 bp, E. coli
taggcgcttttgtaatcgacgacgg

SEQ ID NO: 20339 - DNA, 25 bp, E. coli
taggcgcttttgaaatcgacgacgg

SEQ ID NO: 20340 - DNA, 25 bp, E. coli
tatccctgccctcctaaatggcgaa

SEQ ID NO: 20341 - DNA, 25 bp, E. coli
tgaaaaccagtgagcgcataggcgc

SEQ ID NO: 20342 - DNA, 25 bp, E. coli
tgaaaaccagtgtgcgcataggcgc

SEQ ID NO: 20343 - DNA, 25 bp, E. coli
gatcgaacgttatccattccttgta

SEQ ID NO: 20344 - DNA, 25 bp, E. coli
gatcgaacgttaaccattccttgta

SEQ ID NO: 20345 - DNA, 25 bp, E. coli
ggagagcacgaacatgaaaaccagt

SEQ ID NO: 20346 - DNA, 25 bp, E. coli
ggagagcacgaagatgaaaaccagt

SEQ ID NO: 20347 - DNA, 25 bp, E. coli
ggcgaacactctgtcctttaccgta

SEQ ID NO: 20348 - DNA, 25 bp, E. coli
ggcgaacactctctcctttaccgta

SEQ ID NO: 20349 - DNA, 25 bp, E. coli
gatgcctggattatgcgtcttgcct

SEQ ID NO: 20350 - DNA, 25 bp, E. coli
gatgctgaaacctgtatccctgccc

SEQ ID NO: 20351 - DNA, 25 bp, E. coli
gaccccgatttaagtatgcaactgg

SEQ ID NO: 20352 - DNA, 25 bp, E. coli
gatgcctggattttgcgtcttgcct

SEQ ID NO: 20353 - DNA, 25 bp, E. coli
gatgctgaaaccagtatccctgccc

SEQ ID NO: 20354 - DNA, 25 bp, E. coli
gaccccgatttatgtatgcaactgg

SEQ ID NO: 20355 - DNA, 25 bp, E. coli
aaccatcagctttgcaggacgacct

SEQ ID NO: 20356 - DNA, 25 bp, E. coli
aaccatcagcttagcaggacgacct

SEQ ID NO: 20357 - DNA, 25 bp, E. coli
tatccgttcaacgatcagctttgca

SEQ ID NO: 20358 - DNA, 25 bp, E. coli
tatccgttcaaccatcagctttgca

SEQ ID NO: 20359 - DNA, 25 bp, E. coli
tatcttagttattgctggtctgctg

SEQ ID NO: 20360 - DNA, 25 bp, E. coli
tatcttagttatagctggtctgctg

SEQ ID NO: 20361 - DNA, 25 bp, E. coli
ttaccagtagggacggcttatgccg

SEQ ID NO: 20362 - DNA, 25 bp, E. coli
ttaccagtagggtcggcttatgccg

SEQ ID NO: 20363 - DNA, 25 bp, E. coli
tcggtgagtccgctaacccgatgcg

SEQ ID NO: 20364 - DNA, 25 bp, E. coli
tcggtgagtccggtaacccgatgcg

SEQ ID NO: 20365 - DNA, 25 bp, E. coli
ccggagcctgatttgtcctggatta

SEQ ID NO: 20366 - DNA, 25 bp, E. coli
gccacctggcaaaatatccgttcaa

SEQ ID NO: 20367 - DNA, 25 bp, E. coli
gccacctggcaatatatccgttcaa

SEQ ID NO: 20368 - DNA, 25 bp, E. coli
gcgctacttgccagggcgatgaaat

SEQ ID NO: 20369 - DNA, 25 bp, E. coli
gcgctacttgcctgggcgatgaaat

SEQ ID NO: 20370 - DNA, 25 bp, E. coli
gcgatgaaatcgttaccagtaggga

SEQ ID NO: 20371 - DNA, 25 bp, E. coli
gcgatgaaatcgataccagtaggga

SEQ ID NO: 20372 - DNA, 25 bp, E. coli
ccggagcctgatatgtcctggatta

SEQ ID NO: 20373 - DNA, 25 bp, E. coli
cattgtgctgctcggtgagtccgct

SEQ ID NO: 20374 - DNA, 25 bp, E. coli
cattgtgctgctgggtgagtccgct

SEQ ID NO: 20375 - DNA, 25 bp, E. coli
gggattattggtctgaaactcagca

SEQ ID NO: 20376 - DNA, 25 bp, E. coli
gggattattggtgtgaaactcagca

SEQ ID NO: 20377 - DNA, 25 bp, E. coli
cacgcggtggtgatttttgctacag

SEQ ID NO: 20378 - DNA, 25 bp, E. coli
cacgcggtggtgttttttgctacag

SEQ ID NO: 20379 - DNA, 25 bp, E. coli
tacagcgacggtcagtttgccgcca

SEQ ID NO: 20380 - DNA, 25 bp, E. coli
tactggaaatttcctgttacagcat

SEQ ID NO: 20381 - DNA, 25 bp, E. coli
tactggaaatttgctgttacagcat

SEQ ID NO: 20382 - DNA, 25 bp, E. coli
tacagcgacggtgagtttgccgcca

SEQ ID NO: 20383 - DNA, 25 bp, E. coli
ttgctacagcgacggtgagtttgcc

SEQ ID NO: 20384 - DNA, 25 bp, E. coli
ttgctacagcgagggtgagtttgcc

SEQ ID NO: 20385 - DNA, 25 bp, E. coli
tgatttttgctagagcgacggtgag

SEQ ID NO: 20386 - DNA, 25 bp, E. coli
tgatttttgctacagcgacggtgag

SEQ ID NO: 20387 - DNA, 25 bp, E. coli
tccgcgaattagcttttcctggact

SEQ ID NO: 20388 - DNA, 25 bp, E. coli
tccgcgaattaggttttcctggact

SEQ ID NO: 20389 - DNA, 25 bp, E. coli
gcccacgcggtggtgatttttgcta

SEQ ID NO: 20390 - DNA, 25 bp, E. coli
gcccacgcggtgctgatttttgcta

SEQ ID NO: 20391 - DNA, 25 bp, E. coli
gacggtgagtttgccgccattcttg

SEQ ID NO: 20392 - DNA, 25 bp, E. coli
cggtggtgatttatgctacagcgac

SEQ ID NO: 20393 - DNA, 25 bp, E. coli
cggtggtgatttttgctacagcgac

SEQ ID NO: 20394 - DNA, 25 bp, E. coli
ggaaatttgctgatacagcatggaa

SEQ ID NO: 20395 - DNA, 25 bp, E. coli
ggcattactggaaatttgctgttac

SEQ ID NO: 20396 - DNA, 25 bp, E. coli
ggaaatttgctgttacagcatggaa

SEQ ID NO: 20397 - DNA, 25 bp, E. coli
ggcattactggatatttgctgttac

SEQ ID NO: 20398 - DNA, 25 bp, E. coli
gacggtgagtttcccgccattcttg

SEQ ID NO: 20399 - DNA, 25 bp, E. coli
cagatgctgaataccccgggaaacg

SEQ ID NO: 20400 - DNA, 25 bp, E. coli
cagatgctgaattccccgggaaacg

SEQ ID NO: 20401 - DNA, 25 bp, E. coli
tatctcagtcgtggcaaaaggtatg

SEQ ID NO: 20402 - DNA, 25 bp, E. coli
tatctcagtcgtcgcaaaaggtatg

SEQ ID NO: 20403 - DNA, 25 bp, E. coli
tgtaatcatctgcaacccgacatgg

SEQ ID NO: 20404 - DNA, 25 bp, E. coli
tgtaatcatctggaacccgacatgg

SEQ ID NO: 20405 - DNA, 25 bp, E. coli
tcagaccagaaatagggaagacgcg

SEQ ID NO: 20406 - DNA, 25 bp, E. coli
tcagaccagaaaaagggaagacgcg

SEQ ID NO: 20407 - DNA, 25 bp, E. coli
gacagtctggcaaaaaagcccggtg

SEQ ID NO: 20408 - DNA, 25 bp, E. coli
gacagtctggcataaaagcccggtg

SEQ ID NO: 20409 - DNA, 25 bp, E. coli
gaaactggctgctggatacgacgat

SEQ ID NO: 20410 - DNA, 25 bp, E. coli
gaaacgtggatcagcaccggctgat

SEQ ID NO: 20411 - DNA, 25 bp, E. coli
gaaacgtggatctgcaccggctgat

SEQ ID NO: 20412 - DNA, 25 bp, E. coli
gaaactggctgcaggatacgacgat

SEQ ID NO: 20413 - DNA, 25 bp, E. coli
cggctgatgcgcatcctgggtataa

SEQ ID NO: 20414 - DNA, 25 bp, E. coli
cggctgatgcgcttcctgggtataa

SEQ ID NO: 20415 - DNA, 25 bp, E. coli
tgtaggtcaactcttacgggtccgg

SEQ ID NO: 20416 - DNA, 25 bp, E. coli
tgtaggtcaactgttacgggtccgg

SEQ ID NO: 20417 - DNA, 25 bp, E. coli
gagaaatgacatgctgccagacgat

SEQ ID NO: 20418 - DNA, 25 bp, E. coli
gagaaatgacatcctgccagacgat

SEQ ID NO: 20419 - DNA, 25 bp, E. coli
gatggtacatgcactgaaactggct

SEQ ID NO: 20420 - DNA, 25 bp, E. coli
gatggtacatgctctgaaactggct

SEQ ID NO: 20421 - DNA, 25 bp, E. coli
caatgctgctgggtgaccgaagcaa

SEQ ID NO: 20422 - DNA, 25 bp, E. coli
caatgctgctggctgaccgaagcaa

SEQ ID NO: 20423 - DNA, 25 bp, E. coli
tgaccgaagcaatcagcgaatgaat

SEQ ID NO: 20424 - DNA, 25 bp, E. coli
tgctcgtccgtctatgctgctgggt

SEQ ID NO: 20425 - DNA, 25 bp, E. coli
tgagccaggtttaaattacaggcgc

SEQ ID NO: 20426 - DNA, 25 bp, E. coli
tgaccgaagcaaacagcgaatgaat

SEQ ID NO: 20427 - DNA, 25 bp, E. coli
tgagccaggttttaattacaggcgc

SEQ ID NO: 20428 - DNA, 25 bp, E. coli
tgctcgtccgtcaatgctgctgggt

SEQ ID NO: 20429 - DNA, 25 bp, E. coli
tgcgccgcttttacgtttgctaccg

SEQ ID NO: 20430 - DNA, 25 bp, E. coli
tgcgccgctttttcgtttgctaccg

SEQ ID NO: 20431 - DNA, 25 bp, E. coli
ccaggttttaataacaggcgcaacg

SEQ ID NO: 20432 - DNA, 25 bp, E. coli
ccaggttttaattacaggcgcaacg

SEQ ID NO: 20433 - DNA, 25 bp, E. coli
ccgtcaatgctggtgggtgaccgaa

SEQ ID NO: 20434 - DNA, 25 bp, E. coli
gaagcaaacagccaatgaatgaaac

SEQ ID NO: 20435 - DNA, 25 bp, E. coli
gaagcaaacagcgaatgaatgaaac

SEQ ID NO: 20436 - DNA, 25 bp, E. coli
ccgtcaatgctgctgggtgaccgaa

SEQ ID NO: 20437 - DNA, 25 bp, E. coli
cggcggctcggtccgcagcatatgc

SEQ ID NO: 20438 - DNA, 25 bp, E. coli
cggcggctcggtgcgcagcatatgc

SEQ ID NO: 20439 - DNA, 25 bp, E. coli
tgggtgaccgaaccaaacagcgaat

SEQ ID NO: 20440 - DNA, 25 bp, E. coli
tgggtgaccgaagcaaacagcgaat

SEQ ID NO: 20441 - DNA, 25 bp, E. coli
gaccattgctcgtccgtcaatgctg

SEQ ID NO: 20442 - DNA, 25 bp, E. coli
gaccattgctcgaccgtcaatgctg

SEQ ID NO: 20443 - DNA, 25 bp, E. coli
caaaagaaaggcagaaaagaggccg

SEQ ID NO: 20444 - DNA, 25 bp, E. coli
caaaagaaaggctgaaaagaggccg

SEQ ID NO: 20445 - DNA, 25 bp, E. coli
taaaaataaacctagtgtggtcgcg

SEQ ID NO: 20446 - DNA, 25 bp, E. coli
taaaaataaaccaagtgtggtcgcg

SEQ ID NO: 20447 - DNA, 25 bp, E. coli
tattcaggcagcaatgaatgcttgg

SEQ ID NO: 20448 - DNA, 25 bp, E. coli
tattcaggcagctatgaatgcttgg

SEQ ID NO: 20449 - DNA, 25 bp, E. coli
tgtggtcgcgtgtatatcctgctta

SEQ ID NO: 20450 - DNA, 25 bp, E. coli
tgatacaatgaaaaccttaagtggg

SEQ ID NO: 20451 - DNA, 25 bp, E. coli
tgtggtcgcgtgaatatcctgctta

SEQ ID NO: 20452 - DNA, 25 bp, E. coli
tgatacaatgaataccttaagtggg

SEQ ID NO: 20453 - DNA, 25 bp, E. coli
tgaatcatgcgctgagggtatagac

SEQ ID NO: 20454 - DNA, 25 bp, E. coli
tgaatcatgcgcagagggtatagac

SEQ ID NO: 20455 - DNA, 25 bp, E. coli
gaatgagttattagccttatccctg

SEQ ID NO: 20456 - DNA, 25 bp, E. coli
gaatgagttatttgccttatccctg

SEQ ID NO: 20457 - DNA, 25 bp, E. coli
cgaagaggatgctgcgctatatgca

SEQ ID NO: 20458 - DNA, 25 bp, E. coli
cgaagaggatgcagcgctatatgca

SEQ ID NO: 20459 - DNA, 25 bp, E. coli
gatcctttgtttgctgaatgcgtag

SEQ ID NO: 20460 - DNA, 25 bp, E. coli
ggtatagacgctcataaagatctca

SEQ ID NO: 20461 - DNA, 25 bp, E. coli
ggtatagacgctgataaagatctca

SEQ ID NO: 20462 - DNA, 25 bp, E. coli
gatcctttgtttcctgaatgcgtag

SEQ ID NO: 20463 - DNA, 25 bp, E. coli
gaccttgaatgtgaaatagctatga

SEQ ID NO: 20464 - DNA, 25 bp, E. coli
gaccttgaatgtcaaatagctatga

SEQ ID NO: 20465 - DNA, 25 bp, E. coli
aatatggccgggtcaacggcatccg

SEQ ID NO: 20466 - DNA, 25 bp, E. coli
aatatggccgggacaacggcatccg

SEQ ID NO: 20467 - DNA, 25 bp, E. coli
catccgtctgtctgccgtgtggctg

SEQ ID NO: 20468 - DNA, 25 bp, E. coli
catccgtctgtcagccgtgtggctg

SEQ ID NO: 20469 - DNA, 25 bp, E. coli
acttccggctggtactgaccacgca

SEQ ID NO: 20470 - DNA, 25 bp, E. coli
acttccggctggaactgaccacgca

SEQ ID NO: 20471 - DNA, 25 bp, E. coli
acaggtgcgcaggtttacttacgat

SEQ ID NO: 20472 - DNA, 25 bp, E. coli
acaggtgcgcagctttacttacgat

SEQ ID NO: 20473 - DNA, 25 bp, E. coli
tttacttacgatcataaataccggg

SEQ ID NO: 20474 - DNA, 25 bp, E. coli
tttacttacgatgataaataccggg

SEQ ID NO: 20475 - DNA, 25 bp, E. coli
tgccgggttacagcgaatatggccg

SEQ ID NO: 20476 - DNA, 25 bp, E. coli
tgccgggttacaccgaatatggccg

SEQ ID NO: 20477 - DNA, 25 bp, E. coli
gccggtgaattcagcggcgaaatca

SEQ ID NO: 20478 - DNA, 25 bp, E. coli
gccggtgaattctgcggcgaaatca

SEQ ID NO: 20479 - DNA, 25 bp, E. coli
gcttcgggcgcacacagacgttcca

SEQ ID NO: 20480 - DNA, 25 bp, E. coli
gcttcgggcgcagacagacgttcca

SEQ ID NO: 20481 - DNA, 25 bp, E. coli
gcttttcctgattccctgccgggtt

SEQ ID NO: 20482 - DNA, 25 bp, E. coli
gcttttcctgataccctgccgggtt

SEQ ID NO: 20483 - DNA, 25 bp, E. coli
gaatacccggagtatttacctgccg

SEQ ID NO: 20484 - DNA, 25 bp, E. coli
gaatacccggagaatttacctgccg

SEQ ID NO: 20485 - DNA, 25 bp, E. coli
gttccaccgcgaagccgccggtgaa

SEQ ID NO: 20486 - DNA, 25 bp, E. coli
gttccaccgcgatgccgccggtgaa

SEQ ID NO: 20487 - DNA, 25 bp, E. coli
caagttttgtaattcagacgcaggc

SEQ ID NO: 20488 - DNA, 25 bp, E. coli
caagttttgtaaatcagacgcaggc

SEQ ID NO: 20489 - DNA, 25 bp, E. coli
tacggcagtaatgtgacattgtagc

SEQ ID NO: 20490 - DNA, 25 bp, E. coli
tacggcagtaatctgacattgtagc

SEQ ID NO: 20491 - DNA, 25 bp, E. coli
tagacctgcctttacagagggacgc

SEQ ID NO: 20492 - DNA, 25 bp, E. coli
tagacctgccttaacagagggacgc

SEQ ID NO: 20493 - DNA, 25 bp, E. coli
tttgcgctcgcctacgaaacgtatt

SEQ ID NO: 20494 - DNA, 25 bp, E. coli
tttgcgctcgccaacgaaacgtatt

SEQ ID NO: 20495 - DNA, 25 bp, E. coli
tattcgtttcttgtctgatgccggc

SEQ ID NO: 20496 - DNA, 25 bp, E. coli
tattcgtttcttctctgatgccggc

SEQ ID NO: 20497 - DNA, 25 bp, E. coli
tgatgccggcaaactggcgtattta

SEQ ID NO: 20498 - DNA, 25 bp, E. coli
tgatgccggcaatctggcgtattta

SEQ ID NO: 20499 - DNA, 25 bp, E. coli
tcagacgcaggcatgatagacctgc

SEQ ID NO: 20500 - DNA, 25 bp, E. coli
tcagtgcggcatcggaaaataacat

SEQ ID NO: 20501 - DNA, 25 bp, E. coli
tcagacgcaggcttgatagacctgc

SEQ ID NO: 20502 - DNA, 25 bp, E. coli
gcttcctcaaacttctttacggcag

SEQ ID NO: 20503 - DNA, 25 bp, E. coli
gcttcctcaaacatctttacggcag

SEQ ID NO: 20504 - DNA, 25 bp, E. coli
cattgtagcgggacagtgcggcatc

SEQ ID NO: 20505 - DNA, 25 bp, E. coli
cattgtagcgggtcagtgcggcatc

SEQ ID NO: 20506 - DNA, 25 bp, E. coli
taaccatttttagctttcactgctg

SEQ ID NO: 20507 - DNA, 25 bp, E. coli
tcagtgcggcatgggaaaataacat

SEQ ID NO: 20508 - DNA, 25 bp, E. coli
taaccatttttacctttcactgctg

SEQ ID NO: 20509 - DNA, 25 bp, E. coli
caatgcacttgatcaggctgtcgcc

SEQ ID NO: 20510 - DNA, 25 bp, E. coli
caatgcacttgaacaggctgtcgcc

SEQ ID NO: 20511 - DNA, 25 bp, E. coli
cccgtaccgataaaaagattgccat

SEQ ID NO: 20512 - DNA, 25 bp, E. coli
cccgtaccgatataaagattgccat

SEQ ID NO: 20513 - DNA, 25 bp, E. coli
tagccgttctcacgcaggtttaacc

SEQ ID NO: 20514 - DNA, 25 bp, E. coli
tagccgttctcaggcaggtttaacc

SEQ ID NO: 20515 - DNA, 25 bp, E. coli
tatcacgggagtactggtagccgac

SEQ ID NO: 20516 - DNA, 25 bp, E. coli
tatcacgggagttctggtagccgac

SEQ ID NO: 20517 - DNA, 25 bp, E. coli
tgtgcgacccgcaaaattagccgtt

SEQ ID NO: 20518 - DNA, 25 bp, E. coli
tgtatgccgactgccaacaggctgg

SEQ ID NO: 20519 - DNA, 25 bp, E. coli
tgtgcgacccgctaaattagccgtt

SEQ ID NO: 20520 - DNA, 25 bp, E. coli
tgtcaatcgaggtctacctggcctg

SEQ ID NO: 20521 - DNA, 25 bp, E. coli
tgtatgccgactcccaacaggctgg

SEQ ID NO: 20522 - DNA, 25 bp, E. coli
tgtcaatcgaggactacctggcctg

SEQ ID NO: 20523 - DNA, 25 bp, E. coli
gctgaactggtttttggcaacggcg

SEQ ID NO: 20524 - DNA, 25 bp, E. coli
gctgaactggttattggcaacggcg

SEQ ID NO: 20525 - DNA, 25 bp, E. coli
ctgaagcgccgctaccaggatgaag

SEQ ID NO: 20526 - DNA, 25 bp, E. coli
ctgaagcgccgcaaccaggatgaag

SEQ ID NO: 20527 - DNA, 25 bp, E. coli
gttgcaatgacacaccacgacggta

SEQ ID NO: 20528 - DNA, 25 bp, E. coli
gttgcaatgacagaccacgacggta

SEQ ID NO: 20529 - DNA, 25 bp, E. coli
gaccattggtggagaaatcgccgcc

SEQ ID NO: 20530 - DNA, 25 bp, E. coli
gaccattggtggtgaaatcgccgcc

SEQ ID NO: 20531 - DNA, 25 bp, E. coli
caagacagctaatgatctcggcgta

SEQ ID NO: 20532 - DNA, 25 bp, E. coli
caagacagctaaagatctcggcgta

SEQ ID NO: 20533 - DNA, 25 bp, E. coli
agatctcggcgtttatcaaagcgcg

SEQ ID NO: 20534 - DNA, 25 bp, E. coli
agatctcggcgtatatcaaagcgcg

SEQ ID NO: 20535 - DNA, 25 bp, E. coli
tatgcaatgcgctttgggcaaacca

SEQ ID NO: 20536 - DNA, 25 bp, E. coli
tatgcaatgcgcattgggcaaacca

SEQ ID NO: 20537 - DNA, 25 bp, E. coli
tttatgcggaagaggtaaagccctt

SEQ ID NO: 20538 - DNA, 25 bp, E. coli
tatcaaagcgcgatcaacaaggcca

SEQ ID NO: 20539 - DNA, 25 bp, E. coli
tttaactataaaggctgatggaagc

SEQ ID NO: 20540 - DNA, 25 bp, E. coli
tttatgcggaagtggtaaagccctt

SEQ ID NO: 20541 - DNA, 25 bp, E. coli
tatcaaagcgcgttcaacaaggcca

SEQ ID NO: 20542 - DNA, 25 bp, E. coli
tttaactataaacgctgatggaagc

SEQ ID NO: 20543 - DNA, 25 bp, E. coli
gccattcatgcaggccgaaagattt

SEQ ID NO: 20544 - DNA, 25 bp, E. coli
gccattcatgcacgccgaaagattt

SEQ ID NO: 20545 - DNA, 25 bp, E. coli
cgctttgggcaaaccaagacagcta

SEQ ID NO: 20546 - DNA, 25 bp, E. coli
cgctttgggcaatccaagacagcta

SEQ ID NO: 20547 - DNA, 25 bp, E. coli
gatcaacaaggccattcatgcaggc

SEQ ID NO: 20548 - DNA, 25 bp, E. coli
gatcaacaaggcgattcatgcaggc

SEQ ID NO: 20549 - DNA, 25 bp, E. coli
tggaacaacgcaaaaccctgaaaga

SEQ ID NO: 20550 - DNA, 25 bp, E. coli
tggaacaacgcataaccctgaaaga

SEQ ID NO: 20551 - DNA, 25 bp, E. coli
taaccctgaaagattatgcaatgcg

SEQ ID NO: 20552 - DNA, 25 bp, E. coli
taaccctgaaagtttatgcaatgcg

SEQ ID NO: 20553 - DNA, 25 bp, E. coli
cagctgtcggtgattatcatcggcc

SEQ ID NO: 20554 - DNA, 25 bp, E. coli
cagctgtcggtgtttatcatcggcc

SEQ ID NO: 20555 - DNA, 25 bp, E. coli
tcccaagtgtaatctgcgcaggtct

SEQ ID NO: 20556 - DNA, 25 bp, E. coli
tcctgaaagcagttcaaccggtaga

SEQ ID NO: 20557 - DNA, 25 bp, E. coli
tcccaagtgtaaactgcgcaggtct

SEQ ID NO: 20558 - DNA, 25 bp, E. coli
tcctgaaagcagatcaaccggtaga

SEQ ID NO: 20559 - DNA, 25 bp, E. coli
tctttcggcgtttcgattctggtgc

SEQ ID NO: 20560 - DNA, 25 bp, E. coli
tctttcggcgttacgattctggtgc

SEQ ID NO: 20561 - DNA, 25 bp, E. coli
tcagggtgtcgtatcggcgatgacc

SEQ ID NO: 20562 - DNA, 25 bp, E. coli
tcagggtgtcgtttcggcgatgacc

SEQ ID NO: 20563 - DNA, 25 bp, E. coli
tctatggcgtactggtgacgatccc

SEQ ID NO: 20564 - DNA, 25 bp, E. coli
tctatggcgtacaggtgacgatccc

SEQ ID NO: 20565 - DNA, 25 bp, E. coli
gcctttatcatgttagcgccgctgg

SEQ ID NO: 20566 - DNA, 25 bp, E. coli
gcctttatcatgatagcgccgctgg

SEQ ID NO: 20567 - DNA, 25 bp, E. coli
gaaactggcgatcccggcagtagca

SEQ ID NO: 20568 - DNA, 25 bp, E. coli
gaaactggcgatgccggcagtagca

SEQ ID NO: 20569 - DNA, 25 bp, E. coli
gatcactgtgcttattcgtctggcg

SEQ ID NO: 20570 - DNA, 25 bp, E. coli
gatcactgtgctaattcgtctggcg

SEQ ID NO: 20571 - DNA, 25 bp, E. coli
gttcctcggcaaacttgagcgccca

SEQ ID NO: 20572 - DNA, 25 bp, E. coli
gttcctcggcaatcttgagcgccca

SEQ ID NO: 20573 - DNA, 25 bp, E. coli
ggtctgcgctatgtacagctgtcgg

SEQ ID NO: 20574 - DNA, 25 bp, E. coli
ggtctgcgctatctacagctgtcgg

SEQ ID NO: 20575 - DNA, 25 bp, E. coli
caccttattagttatcttaattacg

SEQ ID NO: 20576 - DNA, 25 bp, E. coli
caccttattagtaatcttaattacg

SEQ ID NO: 20577 - DNA, 25 bp, E. coli
cattattggtaatagtactgttcac

SEQ ID NO: 20578 - DNA, 25 bp, E. coli
cattattggtaaaagtactgttcac

SEQ ID NO: 20579 - DNA, 25 bp, E. coli
taaatgccttaatgtgtatgacctg

SEQ ID NO: 20580 - DNA, 25 bp, E. coli
taaatgccttaaagtgtatgacctg

SEQ ID NO: 20581 - DNA, 25 bp, E. coli
tattcctctgtgttgtgtctcgtga

SEQ ID NO: 20582 - DNA, 25 bp, E. coli
tattcctctgtgatgtgtctcgtga

SEQ ID NO: 20583 - DNA, 25 bp, E. coli
ttatgagttttatgcttgcattgct

SEQ ID NO: 20584 - DNA, 25 bp, E. coli
ttatgagttttaagcttgcattgct

SEQ ID NO: 20585 - DNA, 25 bp, E. coli
ccttaatgtgtaagacctggattca

SEQ ID NO: 20586 - DNA, 25 bp, E. coli
ccttaatgtgtatgacctggattca

SEQ ID NO: 20587 - DNA, 25 bp, E. coli
gccaaattattattgattgactcat

SEQ ID NO: 20588 - DNA, 25 bp, E. coli
gccaaattattaatgattgactcat

SEQ ID NO: 20589 - DNA, 25 bp, E. coli
gcttgcattgctaatggtatatttt

SEQ ID NO: 20590 - DNA, 25 bp, E. coli
gcttgcattgcttatggtatatttt

SEQ ID NO: 20591 - DNA, 25 bp, E. coli
gtactgttcacttcaaactaataac

SEQ ID NO: 20592 - DNA, 25 bp, E. coli
gtactgttcactacaaactaataac

SEQ ID NO: 20593 - DNA, 25 bp, E. coli
taattacgacattacataaatgcct

SEQ ID NO: 20594 - DNA, 25 bp, E. coli
taattacgacataacataaatgcct

SEQ ID NO: 20595 - DNA, 25 bp, E. coli
gatgtgtctcgtgatgccaaattat

SEQ ID NO: 20596 - DNA, 25 bp, E. coli
gatgtgtctcgtcatgccaaattat

SEQ ID NO: 20597 - DNA, 25 bp, E. coli
catgatctatcgctacaccgggcaa

SEQ ID NO: 20598 - DNA, 25 bp, E. coli
catgatctatcggtacaccgggcaa

SEQ ID NO: 20599 - DNA, 25 bp, E. coli
tatgaacgccacattgcaggtgccg

SEQ ID NO: 20600 - DNA, 25 bp, E. coli
tatgaacgccactttgcaggtgccg

SEQ ID NO: 20601 - DNA, 25 bp, E. coli
tatgacaaggagaacctacgcccag

SEQ ID NO: 20602 - DNA, 25 bp, E. coli
tatgacaaggagtacctacgcccag

SEQ ID NO: 20603 - DNA, 25 bp, E. coli
tatccagattgctgcgcagctcagg

SEQ ID NO: 20604 - DNA, 25 bp, E. coli
tatccagattgcagcgcagctcagg

SEQ ID NO: 20605 - DNA, 25 bp, E. coli
ttacgtgcggtgaacaatacagcgg

SEQ ID NO: 20606 - DNA, 25 bp, E. coli
ttacgtgcggtgtacaatacagcgg

SEQ ID NO: 20607 - DNA, 25 bp, E. coli
tgttgatgagtgcttccggcagccc

SEQ ID NO: 20608 - DNA, 25 bp, E. coli
tgttgatgagtggttccggcagccc

SEQ ID NO: 20609 - DNA, 25 bp, E. coli
gcagcaatcttatcaggcgtcaacg

SEQ ID NO: 20610 - DNA, 25 bp, E. coli
gcagcaatcttaacaggcgtcaacg

SEQ ID NO: 20611 - DNA, 25 bp, E. coli
gaaccttggccagctattgaaccgc

SEQ ID NO: 20612 - DNA, 25 bp, E. coli
gaaccttggccacctattgaaccgc

SEQ ID NO: 20613 - DNA, 25 bp, E. coli
cgttactttacaccgcaggaccggg

SEQ ID NO: 20614 - DNA, 25 bp, E. coli
cgttactttacagcgcaggaccggg

SEQ ID NO: 20615 - DNA, 25 bp, E. coli
tggagagttactacagcggcgagca

SEQ ID NO: 20616 - DNA, 25 bp, E. coli
tggagagttacttcagcggcgagca

SEQ ID NO: 20617 - DNA, 25 bp, E. coli
taagggcgtgcaagtctctcatggc

SEQ ID NO: 20618 - DNA, 25 bp, E. coli
taagggcgtgcatgtctctcatggc

SEQ ID NO: 20619 - DNA, 25 bp, E. coli
catggttcttgctgggaaatgcgca

SEQ ID NO: 20620 - DNA, 25 bp, E. coli
catggttcttgcagggaaatgcgca

SEQ ID NO: 20621 - DNA, 25 bp, E. coli
tatgaataatatccacgttccggca

SEQ ID NO: 20622 - DNA, 25 bp, E. coli
tatgacatcatgtgtaagcgccgtc

SEQ ID NO: 20623 - DNA, 25 bp, E. coli
tatgaataatatgcacgttccggca

SEQ ID NO: 20624 - DNA, 25 bp, E. coli
tatgacatcatgagtaagcgccgtc

SEQ ID NO: 20625 - DNA, 25 bp, E. coli
tatcatcaccacgattctgtgggcc

SEQ ID NO: 20626 - DNA, 25 bp, E. coli
tattcgctatgaacaggtcaccgac

SEQ ID NO: 20627 - DNA, 25 bp, E. coli
tatcatcaccaccattctgtgggcc

SEQ ID NO: 20628 - DNA, 25 bp, E. coli
tattcgctatgatcaggtcaccgac

SEQ ID NO: 20629 - DNA, 25 bp, E. coli
tgatgtatatgctgagtttccgcgc

SEQ ID NO: 20630 - DNA, 25 bp, E. coli
tgatgtatatgcagagtttccgcgc

SEQ ID NO: 20631 - DNA, 25 bp, E. coli
gccgcactggccaacgtttattaca

SEQ ID NO: 20632 - DNA, 25 bp, E. coli
gccgcactggcctacgtttattaca

SEQ ID NO: 20633 - DNA, 25 bp, E. coli
gctactttatgtggaactacggcgc

SEQ ID NO: 20634 - DNA, 25 bp, E. coli
gctactttatgtcgaactacggcgc

SEQ ID NO: 20635 - DNA, 25 bp, E. coli
gcttttatggcgagtaccttgcggg

SEQ ID NO: 20636 - DNA, 25 bp, E. coli
gcttttatggcgtgtaccttgcggg

SEQ ID NO: 20637 - DNA, 25 bp, E. coli
cgccggaacgctgggcattatgaat

SEQ ID NO: 20638 - DNA, 25 bp, E. coli
cgccggaacgctcggcattatgaat

SEQ ID NO: 20639 - DNA, 25 bp, E. coli
gacgccgctctagatcacgctgatt

SEQ ID NO: 20640 - DNA, 25 bp, E. coli
gacgccgctctacatcacgctgatt

SEQ ID NO: 20641 - DNA, 25 bp, E. coli
aagaagaccggcctaaggcggcgcg

SEQ ID NO: 20642 - DNA, 25 bp, E. coli
aagaagaccggcgtaaggcggcgcg

SEQ ID NO: 20643 - DNA, 25 bp, E. coli
tttgggctgctgacatatctgacga

SEQ ID NO: 20644 - DNA, 25 bp, E. coli
tttgggctgctgtcatatctgacga

SEQ ID NO: 20645 - DNA, 25 bp, E. coli
tgggctgctgacatatctgacgaac

SEQ ID NO: 20646 - DNA, 25 bp, E. coli
tgggctgctgacttatctgacgaac

SEQ ID NO: 20647 - DNA, 25 bp, E. coli
tctgacgaacctctatttcaagatt

SEQ ID NO: 20648 - DNA, 25 bp, E. coli
tcccagtgggtgccgataggcgtgc

SEQ ID NO: 20649 - DNA, 25 bp, E. coli
tctgacgaacctgtatttcaagatt

SEQ ID NO: 20650 - DNA, 25 bp, E. coli
tcccagtgggtggcgataggcgtgc

SEQ ID NO: 20651 - DNA, 25 bp, E. coli
ccagtgggtggcgataggcgtgctg

SEQ ID NO: 20652 - DNA, 25 bp, E. coli
ccagtgggtggccataggcgtgctg

SEQ ID NO: 20653 - DNA, 25 bp, E. coli
gctgctgacatatctgacgaacctg

SEQ ID NO: 20654 - DNA, 25 bp, E. coli
gctgctgacataactgacgaacctg

SEQ ID NO: 20655 - DNA, 25 bp, E. coli
gtttgggctgctgacatatctgacg

SEQ ID NO: 20656 - DNA, 25 bp, E. coli
gtcccagtgggtggcgataggcgtg

SEQ ID NO: 20657 - DNA, 25 bp, E. coli
gtttgggctgctcacatatctgacg

SEQ ID NO: 20658 - DNA, 25 bp, E. coli
gtcccagtgggtcgcgataggcgtg

SEQ ID NO: 20659 - DNA, 25 bp, E. coli
gggctgctgacaaatctgacgaacc

SEQ ID NO: 20660 - DNA, 25 bp, E. coli
gggctgctgacatatctgacgaacc

SEQ ID NO: 20661 - DNA, 25 bp, E. coli
ggctgctgacatttctgacgaacct

SEQ ID NO: 20662 - DNA, 25 bp, E. coli
ggctgctgacatatctgacgaacct

SEQ ID NO: 20663 - DNA, 25 bp, E. coli
cagtgctctgtgaatgggaaacgga

SEQ ID NO: 20664 - DNA, 25 bp, E. coli
cagtgctctgtgtatgggaaacgga

SEQ ID NO: 20665 - DNA, 25 bp, E. coli
taaagagtggcagcagatcagcgaa

SEQ ID NO: 20666 - DNA, 25 bp, E. coli
taaagagtggcaccagatcagcgaa

SEQ ID NO: 20667 - DNA, 25 bp, E. coli
aactcaaggcgctggcggctaaaga

SEQ ID NO: 20668 - DNA, 25 bp, E. coli
aactcaaggcgcaggcggctaaaga

SEQ ID NO: 20669 - DNA, 25 bp, E. coli
tataacgaaccgatgcaaatagagt

SEQ ID NO: 20670 - DNA, 25 bp, E. coli
tataacgaaccgttgcaaatagagt

SEQ ID NO: 20671 - DNA, 25 bp, E. coli
tgtgtcggccctatctctggcagga

SEQ ID NO: 20672 - DNA, 25 bp, E. coli
tgtgtcggccctttctctggcagga

SEQ ID NO: 20673 - DNA, 25 bp, E. coli
tctggcaggagaagatgaatgcttc

SEQ ID NO: 20674 - DNA, 25 bp, E. coli
tctggcaggagatgatgaatgcttc

SEQ ID NO: 20675 - DNA, 25 bp, E. coli
ccatatttttggagatgagccgcca

SEQ ID NO: 20676 - DNA, 25 bp, E. coli
ccatatttttggtgatgagccgcca

SEQ ID NO: 20677 - DNA, 25 bp, E. coli
gctggcggttatggtgatcacttcg

SEQ ID NO: 20678 - DNA, 25 bp, E. coli
gctggcggttatcgtgatcacttcg

SEQ ID NO: 20679 - DNA, 25 bp, E. coli
gaaccggaaacggtacgtgaacact

SEQ ID NO: 20680 - DNA, 25 bp, E. coli
gaaccggaaacgctacgtgaacact

SEQ ID NO: 20681 - DNA, 25 bp, E. coli
gattacgcagatgccgaactcaagg

SEQ ID NO: 20682 - DNA, 25 bp, E. coli
gattacgcagatcccgaactcaagg

SEQ ID NO: 20683 - DNA, 25 bp, E. coli
ggcgcaatggcatgaaaccgtttta

SEQ ID NO: 20684 - DNA, 25 bp, E. coli
ggcgcaatggcaagaaaccgtttta

SEQ ID NO: 20685 - DNA, 25 bp, E. coli
tacagcggatgttaggaaataccac

SEQ ID NO: 20686 - DNA, 25 bp, E. coli
tacagcggatgtaaggaaataccac

SEQ ID NO: 20687 - DNA, 25 bp, E. coli
agatattttgcgcaactacctgcga

SEQ ID NO: 20688 - DNA, 25 bp, E. coli
agatattttgcggaactacctgcga

SEQ ID NO: 20689 - DNA, 25 bp, E. coli
aactgctggttgaccaacgcactgg

SEQ ID NO: 20690 - DNA, 25 bp, E. coli
aactgctggttgtccaacgcactgg

SEQ ID NO: 20691 - DNA, 25 bp, E. coli
tattggcttgctagtggtcgacgag

SEQ ID NO: 20692 - DNA, 25 bp, E. coli
tattggcttgcttgtggtcgacgag

SEQ ID NO: 20693 - DNA, 25 bp, E. coli
tgaaccaacggccaaaactgctggt

SEQ ID NO: 20694 - DNA, 25 bp, E. coli
tgaaccaacggcgaaaactgctggt

SEQ ID NO: 20695 - DNA, 25 bp, E. coli
ccatagacgcggaggtgaaccaacg

SEQ ID NO: 20696 - DNA, 25 bp, E. coli
ccatagacgcggtggtgaaccaacg

SEQ ID NO: 20697 - DNA, 25 bp, E. coli
gcaaaccaggacattatcgaaacgg

SEQ ID NO: 20698 - DNA, 25 bp, E. coli
gcaaaccaggactttatcgaaacgg

SEQ ID NO: 20699 - DNA, 25 bp, E. coli
gcacgcagctgaattgcttttacag

SEQ ID NO: 20700 - DNA, 25 bp, E. coli
gcacgcagctgatttgcttttacag

SEQ ID NO: 20701 - DNA, 25 bp, E. coli
gaaataccaccgctactttcaggga

SEQ ID NO: 20702 - DNA, 25 bp, E. coli
gaaataccaccggtactttcaggga

SEQ ID NO: 20703 - DNA, 25 bp, E. coli
cgattgcttgctggtttccccggaa

SEQ ID NO: 20704 - DNA, 25 bp, E. coli
cgattgcttgctcgtttccccggaa

SEQ ID NO: 20705 - DNA, 25 bp, E. coli
cggttttatatcgtatagccgatca

SEQ ID NO: 20706 - DNA, 25 bp, E. coli
cggttttatatcctatagccgatca

SEQ ID NO: 20707 - DNA, 25 bp, E. coli
tatgagtggataacaccatccggct

SEQ ID NO: 20708 - DNA, 25 bp, E. coli
tatgagtggatatcaccatccggct

SEQ ID NO: 20709 - DNA, 25 bp, E. coli
tatatggacattacagacaacggac

SEQ ID NO: 20710 - DNA, 25 bp, E. coli
tatatggacatttcagacaacggac

SEQ ID NO: 20711 - DNA, 25 bp, E. coli
tacggtgaaggtattcccctgccag

SEQ ID NO: 20712 - DNA, 25 bp, E. coli
tacggtgaaggttttcccctgccag

SEQ ID NO: 20713 - DNA, 25 bp, E. coli
tccttgttgcagtggaggtgccgcc

SEQ ID NO: 20714 - DNA, 25 bp, E. coli
tccttgttgcagaggaggtgccgcc

SEQ ID NO: 20715 - DNA, 25 bp, E. coli
tctatgaggacttagtagcccgggt

SEQ ID NO: 20716 - DNA, 25 bp, E. coli
tctatgaggactaagtagcccgggt

SEQ ID NO: 20717 - DNA, 25 bp, E. coli
gaataaactgctttctgtctgctgg

SEQ ID NO: 20718 - DNA, 25 bp, E. coli
gaataaactgctatctgtctgctgg

SEQ ID NO: 20719 - DNA, 25 bp, E. coli
cgcaggacagtctaatggtatggcc

SEQ ID NO: 20720 - DNA, 25 bp, E. coli
ccgtgtaaaacatctggctcgtcga

SEQ ID NO: 20721 - DNA, 25 bp, E. coli
ccgtgtaaaacaactggctcgtcga

SEQ ID NO: 20722 - DNA, 25 bp, E. coli
cgcaggacagtcaaatggtatggcc

SEQ ID NO: 20723 - DNA, 25 bp, E. coli
ctaatgagccagaagaagatgccga

SEQ ID NO: 20724 - DNA, 25 bp, E. coli
ctaatgagccagtagaagatgccga

SEQ ID NO: 20725 - DNA, 25 bp, E. coli
gtcgaaaaacaatcacaccaggagg

SEQ ID NO: 20726 - DNA, 25 bp, E. coli
gtcgaaaaacaaacacaccaggagg

SEQ ID NO: 20727 - DNA, 25 bp, E. coli
tggtatgtgatagccctcgcaggac

SEQ ID NO: 20728 - DNA, 25 bp, E. coli
tggtatgtgatacccctcgcaggac

SEQ ID NO: 20729 - DNA, 25 bp, E. coli
caatattagcaagggcacggtgacg

SEQ ID NO: 20730 - DNA, 25 bp, E. coli
caatattagcaacggcacggtgacg

SEQ ID NO: 20731 - DNA, 25 bp, E. coli
tacaggttaataccgcgctgccggg

SEQ ID NO: 20732 - DNA, 25 bp, E. coli
tacaggttaatagcgcgctgccggg

SEQ ID NO: 20733 - DNA, 25 bp, E. coli
tatcgtcaacagcatcgagcacggg

SEQ ID NO: 20734 - DNA, 25 bp, E. coli
taggcaatactggtaacggcacgcg

SEQ ID NO: 20735 - DNA, 25 bp, E. coli
taggcaatactgctaacggcacgcg

SEQ ID NO: 20736 - DNA, 25 bp, E. coli
tatcgtcaacaggatcgagcacggg

SEQ ID NO: 20737 - DNA, 25 bp, E. coli
tattatcaacgcttcagaggcaggc

SEQ ID NO: 20738 - DNA, 25 bp, E. coli
tattatcaacgcatcagaggcaggc

SEQ ID NO: 20739 - DNA, 25 bp, E. coli
ttttaacgacatactgaccggcagc

SEQ ID NO: 20740 - DNA, 25 bp, E. coli
ttttaacgacattctgaccggcagc

SEQ ID NO: 20741 - DNA, 25 bp, E. coli
tgattagcatcatcaccatcgcggg

SEQ ID NO: 20742 - DNA, 25 bp, E. coli
tgattagcatcaacaccatcgcggg

SEQ ID NO: 20743 - DNA, 25 bp, E. coli
gaatttactggtggacagcggcctg

SEQ ID NO: 20744 - DNA, 25 bp, E. coli
gcaaataagtatcgacggcggcaca

SEQ ID NO: 20745 - DNA, 25 bp, E. coli
gcaaataagtatggacggcggcaca

SEQ ID NO: 20746 - DNA, 25 bp, E. coli
gaatttactggtcgacagcggcctg

SEQ ID NO: 20747 - DNA, 25 bp, E. coli
gatattatcaactacgccgagcagc

SEQ ID NO: 20748 - DNA, 25 bp, E. coli
gatattatcaacaacgccgagcagc

SEQ ID NO: 20749 - DNA, 25 bp, E. coli
tttgtcaaagtctcccagagcggca

SEQ ID NO: 20750 - DNA, 25 bp, E. coli
tttgtcaaagtcacccagagcggca

SEQ ID NO: 20751 - DNA, 25 bp, E. coli
caaaatgccggatacgatgcgtgaa

SEQ ID NO: 20752 - DNA, 25 bp, E. coli
caaattgttcacgttagcggtgggc

SEQ ID NO: 20753 - DNA, 25 bp, E. coli
caaaatgccggaaacgatgcgtgaa

SEQ ID NO: 20754 - DNA, 25 bp, E. coli
caaattgttcaccttagcggtgggc

SEQ ID NO: 20755 - DNA, 25 bp, E. coli
tacgtatgctggatgactggcctgg

SEQ ID NO: 20756 - DNA, 25 bp, E. coli
tacgtatgctggttgactggcctgg

SEQ ID NO: 20757 - DNA, 25 bp, E. coli
tattcattggcgataatggcccggg

SEQ ID NO: 20758 - DNA, 25 bp, E. coli
tattcattggcgttaatggcccggg

SEQ ID NO: 20759 - DNA, 25 bp, E. coli
tgatagaagccgttctgcgtgccac

SEQ ID NO: 20760 - DNA, 25 bp, E. coli
tgtatctgtttagagcccgcagggc

SEQ ID NO: 20761 - DNA, 25 bp, E. coli
tgtatctgtttacagcccgcagggc

SEQ ID NO: 20762 - DNA, 25 bp, E. coli
tgatagaagccgatctgcgtgccac

SEQ ID NO: 20763 - DNA, 25 bp, E. coli
tcaggtgatgagctcagaacccagc

SEQ ID NO: 20764 - DNA, 25 bp, E. coli
tcaggtgatgaggtcagaacccagc

SEQ ID NO: 20765 - DNA, 25 bp, E. coli
gcaaggtacagcgacagtttcaggt

SEQ ID NO: 20766 - DNA, 25 bp, E. coli
gcaaggtacagccacagtttcaggt

SEQ ID NO: 20767 - DNA, 25 bp, E. coli
gacacagggtcgcttcagaacgtta

SEQ ID NO: 20768 - DNA, 25 bp, E. coli
gacacagggtcggttcagaacgtta

SEQ ID NO: 20769 - DNA, 25 bp, E. coli
ggaacgctgctggatcaaatcgcct

SEQ ID NO: 20770 - DNA, 25 bp, E. coli
ggaacgctgctgcatcaaatcgcct

SEQ ID NO: 20771 - DNA, 25 bp, E. coli
gatgcgtgaataagtcgccgcccaa

SEQ ID NO: 20772 - DNA, 25 bp, E. coli
gatgcgtgaatatgtcgccgcccaa

SEQ ID NO: 20773 - DNA, 25 bp, E. coli
caatgaccacgggacgcagtatcgt

SEQ ID NO: 20774 - DNA, 25 bp, E. coli
caatgaccacggcacgcagtatcgt

SEQ ID NO: 20775 - DNA, 25 bp, E. coli
aattggcggaataggcgtctgtctg

SEQ ID NO: 20776 - DNA, 25 bp, E. coli
aattggcggaattggcgtctgtctg

SEQ ID NO: 20777 - DNA, 25 bp, E. coli
tattttgggagattcacgatcccgc

SEQ ID NO: 20778 - DNA, 25 bp, E. coli
tattttgggagaatcacgatcccgc

SEQ ID NO: 20779 - DNA, 25 bp, E. coli
tattatgccgaagatgaccaccagc

SEQ ID NO: 20780 - DNA, 25 bp, E. coli
tattatgccgaacatgaccaccagc

SEQ ID NO: 20781 - DNA, 25 bp, E. coli
tgtacctgacggaatggagattgcc

SEQ ID NO: 20782 - DNA, 25 bp, E. coli
tgtacctgacggtatggagattgcc

SEQ ID NO: 20783 - DNA, 25 bp, E. coli
gctatacgccaattccgacttatcg

SEQ ID NO: 20784 - DNA, 25 bp, E. coli
gctatacgccaaatccgacttatcg

SEQ ID NO: 20785 - DNA, 25 bp, E. coli
cccagggaatgcctcagggcaatga

SEQ ID NO: 20786 - DNA, 25 bp, E. coli
cgacttatcgggtagtgtgctccgg

SEQ ID NO: 20787 - DNA, 25 bp, E. coli
cgacttatcgggaagtgtgctccgg

SEQ ID NO: 20788 - DNA, 25 bp, E. coli
cccagggaatgcgtcagggcaatga

SEQ ID NO: 20789 - DNA, 25 bp, E. coli
cgtcatcagctaagagcagttgcta

SEQ ID NO: 20790 - DNA, 25 bp, E. coli
cgtcatcagctatgagcagttgcta

SEQ ID NO: 20791 - DNA, 25 bp, E. coli
ggaaatcgctaacgccacaccgttt

SEQ ID NO: 20792 - DNA, 25 bp, E. coli
tggaacgttttctggcggcgatgct

SEQ ID NO: 20793 - DNA, 25 bp, E. coli
tggaacgttttcaggcggcgatgct

SEQ ID NO: 20794 - DNA, 25 bp, E. coli
ggaaatcgctaaggccacaccgttt

SEQ ID NO: 20795 - DNA, 25 bp, E. coli
aatttctgctgtagacgcgcaccgg

SEQ ID NO: 20796 - DNA, 25 bp, E. coli
aatttctgctgttgacgcgcaccgg

SEQ ID NO: 20797 - DNA, 25 bp, E. coli
acattgatatgctgattccgcggga

SEQ ID NO: 20798 - DNA, 25 bp, E. coli
acattgatatgcagattccgcggga

SEQ ID NO: 20799 - DNA, 25 bp, E. coli
tatcgaacgcgtcgcagatatcagc

SEQ ID NO: 20800 - DNA, 25 bp, E. coli
tatcgaacgcgtggcagatatcagc

SEQ ID NO: 20801 - DNA, 25 bp, E. coli
ttattgccgttgtccatctcgaccg

SEQ ID NO: 20802 - DNA, 25 bp, E. coli
ttcaaaatgcgcaaagctggtcagc

SEQ ID NO: 20803 - DNA, 25 bp, E. coli
ttcaaaatgcgctaagctggtcagc

SEQ ID NO: 20804 - DNA, 25 bp, E. coli
ttattgccgttgaccatctcgaccg

SEQ ID NO: 20805 - DNA, 25 bp, E. coli
tgattgtcctcgttccggaacgcca

SEQ ID NO: 20806 - DNA, 25 bp, E. coli
tgattgtcctcgatccggaacgcca

SEQ ID NO: 20807 - DNA, 25 bp, E. coli
gctgcagctggacaaaaaagacggc

SEQ ID NO: 20808 - DNA, 25 bp, E. coli
gctgcagctggagaaaaaagacggc

SEQ ID NO: 20809 - DNA, 25 bp, E. coli
gtcaggagcagataccagcgccttt

SEQ ID NO: 20810 - DNA, 25 bp, E. coli
tggacccgttttgcgctatcgaaag

SEQ ID NO: 20811 - DNA, 25 bp, E. coli
gtcaggagcagaaaccagcgccttt

SEQ ID NO: 20812 - DNA, 25 bp, E. coli
tggacccgttttccgctatcgaaag

SEQ ID NO: 20813 - DNA, 25 bp, E. coli
taatcatgaagctaaccgatgcgga

SEQ ID NO: 20814 - DNA, 25 bp, E. coli
taatcatgaagcaaaccgatgcgga

SEQ ID NO: 20815 - DNA, 25 bp, E. coli
gatgacctggtccacaaagccgtct

SEQ ID NO: 20816 - DNA, 25 bp, E. coli
gatgacctggtcgacaaagccgtct

SEQ ID NO: 20817 - DNA, 25 bp, E. coli
cagttagcgccgtgttcaaatgcgt

SEQ ID NO: 20818 - DNA, 25 bp, E. coli
cagttagcgccgagttcaaatgcgt

SEQ ID NO: 20819 - DNA, 25 bp, E. coli
tactggagtacggtggcgaaaattc

SEQ ID NO: 20820 - DNA, 25 bp, E. coli
tactggagtacgctggcgaaaattc

SEQ ID NO: 20821 - DNA, 25 bp, E. coli
tacgtcagggcgatattgatggcgc

SEQ ID NO: 20822 - DNA, 25 bp, E. coli
aactgttcaacggtgcgccgccgga

SEQ ID NO: 20823 - DNA, 25 bp, E. coli
aactgttcaacgctgcgccgccgga

SEQ ID NO: 20824 - DNA, 25 bp, E. coli
tacgtcagggcgttattgatggcgc

SEQ ID NO: 20825 - DNA, 25 bp, E. coli
taggcgaagcgagccatcgtgaaga

SEQ ID NO: 20826 - DNA, 25 bp, E. coli
taggcgaagcgacccatcgtgaaga

SEQ ID NO: 20827 - DNA, 25 bp, E. coli
tcgatcggctgtcgcagttagcgcc

SEQ ID NO: 20828 - DNA, 25 bp, E. coli
tcgatcggctgtggcagttagcgcc

SEQ ID NO: 20829 - DNA, 25 bp, E. coli
tcatgccgatggacgaggcagcacc

SEQ ID NO: 20830 - DNA, 25 bp, E. coli
tcatgccgatggtcgaggcagcacc

SEQ ID NO: 20831 - DNA, 25 bp, E. coli
gctttccctcggtctggccgtcatg

SEQ ID NO: 20832 - DNA, 25 bp, E. coli
gctttccctcggactggccgtcatg

SEQ ID NO: 20833 - DNA, 25 bp, E. coli
gaacttattgatgcgaataacccgg

SEQ ID NO: 20834 - DNA, 25 bp, E. coli
gacattgctgtcgagtactggagta

SEQ ID NO: 20835 - DNA, 25 bp, E. coli
gacattgctgtccagtactggagta

SEQ ID NO: 20836 - DNA, 25 bp, E. coli
gaacttattgatccgaataacccgg

SEQ ID NO: 20837 - DNA, 25 bp, E. coli
cggatggtcgtcaggcactgcaaca

SEQ ID NO: 20838 - DNA, 25 bp, E. coli
cggatggtcgtctggcactgcaaca

SEQ ID NO: 20839 - DNA, 25 bp, E. coli
aaaggacatgatggatgactggaac

SEQ ID NO: 20840 - DNA, 25 bp, E. coli
aaatatcaaatagcccagtctgacg

SEQ ID NO: 20841 - DNA, 25 bp, E. coli
aaaggacatgatcgatgactggaac

SEQ ID NO: 20842 - DNA, 25 bp, E. coli
aaatatcaaataccccagtctgacg

SEQ ID NO: 20843 - DNA, 25 bp, E. coli
tatttgatggttggatccggtaggc

SEQ ID NO: 20844 - DNA, 25 bp, E. coli
tatttgatggttcgatccggtaggc

SEQ ID NO: 20845 - DNA, 25 bp, E. coli
tgtgatcaaaagtcaaacgaatcgg

SEQ ID NO: 20846 - DNA, 25 bp, E. coli
tgtgatcaaaagacaaacgaatcgg

SEQ ID NO: 20847 - DNA, 25 bp, E. coli
tctacgaggattatacttgggagga

SEQ ID NO: 20848 - DNA, 25 bp, E. coli
tctacgaggattttacttgggagga

SEQ ID NO: 20849 - DNA, 25 bp, E. coli
tccggtaggcaactagttgatgcac

SEQ ID NO: 20850 - DNA, 25 bp, E. coli
tccggtaggcaagtagttgatgcac

SEQ ID NO: 20851 - DNA, 25 bp, E. coli
gcaatccctgaaggtatgatccccg

SEQ ID NO: 20852 - DNA, 25 bp, E. coli
gcaatccctgaacgtatgatccccg

SEQ ID NO: 20853 - DNA, 25 bp, E. coli
gaactggttcaaacgataagctgtg

SEQ ID NO: 20854 - DNA, 25 bp, E. coli
gaactggttcaatcgataagctgtg

SEQ ID NO: 20855 - DNA, 25 bp, E. coli
cgatcttatattctggcccgatgaa

SEQ ID NO: 20856 - DNA, 25 bp, E. coli
cgatcttatattgtggcccgatgaa

SEQ ID NO: 20857 - DNA, 25 bp, E. coli
gttgatgcacctgaaatcgacctga

SEQ ID NO: 20858 - DNA, 25 bp, E. coli
gatccccgtaaatgtcagcagcaaa

SEQ ID NO: 20859 - DNA, 25 bp, E. coli
gatccccgtaaaagtcagcagcaaa

SEQ ID NO: 20860 - DNA, 25 bp, E. coli
gttgatgcacctcaaatcgacctga

SEQ ID NO: 20861 - DNA, 25 bp, E. coli
cagaaatctgccgtgcaagaacgaa

SEQ ID NO: 20862 - DNA, 25 bp, E. coli
cagaaatctgccctgcaagaacgaa

SEQ ID NO: 20863 - DNA, 25 bp, E. coli
ataacgaaaacacgcctggatgcag

SEQ ID NO: 20864 - DNA, 25 bp, E. coli
ataacgaaaacaggcctggatgcag

SEQ ID NO: 20865 - DNA, 25 bp, E. coli
aacacgcctggaagcagaaatctgc

SEQ ID NO: 20866 - DNA, 25 bp, E. coli
aaacgcataacgaaaacacgcctgg

SEQ ID NO: 20867 - DNA, 25 bp, E. coli
aacacgcctggatgcagaaatctgc

SEQ ID NO: 20868 - DNA, 25 bp, E. coli
aaacgcataacgtaaacacgcctgg

SEQ ID NO: 20869 - DNA, 25 bp, E. coli
tgagaattttaaaagaccggaggag

SEQ ID NO: 20870 - DNA, 25 bp, E. coli
tgagaattttaatagaccggaggag

SEQ ID NO: 20871 - DNA, 25 bp, E. coli
tctgccgtgcaacaacgaagacatg

SEQ ID NO: 20872 - DNA, 25 bp, E. coli
tctgccgtgcaagaacgaagacatg

SEQ ID NO: 20873 - DNA, 25 bp, E. coli
ccagctgaatgatggtgagaatttt

SEQ ID NO: 20874 - DNA, 25 bp, E. coli
ccagctgaatgaaggtgagaatttt

SEQ ID NO: 20875 - DNA, 25 bp, E. coli
gcaagaacgaagacatgaaggacat

SEQ ID NO: 20876 - DNA, 25 bp, E. coli
gaaggacataaaccagctgaatgaa

SEQ ID NO: 20877 - DNA, 25 bp, E. coli
gcaagaacgaagtcatgaaggacat

SEQ ID NO: 20878 - DNA, 25 bp, E. coli
gaaggacataaagcagctgaatgaa

SEQ ID NO: 20879 - DNA, 25 bp, E. coli
gacatgaaggacttaaaccagctga

SEQ ID NO: 20880 - DNA, 25 bp, E. coli
gacatgaaggacataaaccagctga

SEQ ID NO: 20881 - DNA, 25 bp, E. coli
gagtaaagggagcaaaacgcataac

SEQ ID NO: 20882 - DNA, 25 bp, E. coli
gagtaaagggaggaaaacgcataac

SEQ ID NO: 20883 - DNA, 25 bp, E. coli
cacagaataattatcgcaccgtttg

SEQ ID NO: 20884 - DNA, 25 bp, E. coli
cacagaataattttcgcaccgtttg

SEQ ID NO: 20885 - DNA, 25 bp, E. coli
aaattgcataaacttcagaaagcgc

SEQ ID NO: 20886 - DNA, 25 bp, E. coli
aaattgcataaagttcagaaagcgc

SEQ ID NO: 20887 - DNA, 25 bp, E. coli
tatgaaacccatgaataaattgcat

SEQ ID NO: 20888 - DNA, 25 bp, E. coli
tatgaaacccatcaataaattgcat

SEQ ID NO: 20889 - DNA, 25 bp, E. coli
tccggacaattctaaaaccacacag

SEQ ID NO: 20890 - DNA, 25 bp, E. coli
tccggacaattcaaaaaccacacag

SEQ ID NO: 20891 - DNA, 25 bp, E. coli
tcagaaagcgcatctaactctgctt

SEQ ID NO: 20892 - DNA, 25 bp, E. coli
gaagatttatatttacatccggaca

SEQ ID NO: 20893 - DNA, 25 bp, E. coli
gaagatttatatatacatccggaca

SEQ ID NO: 20894 - DNA, 25 bp, E. coli
gcaccgtttgcaatatgaaacccat

SEQ ID NO: 20895 - DNA, 25 bp, E. coli
gcatctaactctccttttgaattaa

SEQ ID NO: 20896 - DNA, 25 bp, E. coli
gcaccgtttgcattatgaaacccat

SEQ ID NO: 20897 - DNA, 25 bp, E. coli
gcatctaactctgcttttgaattaa

SEQ ID NO: 20898 - DNA, 25 bp, E. coli
cgctttcagaagaccggcattcgca

SEQ ID NO: 20899 - DNA, 25 bp, E. coli
cgctttcagaagtccggcattcgca

SEQ ID NO: 20900 - DNA, 25 bp, E. coli
cggcattcgcactcatgaagattta

SEQ ID NO: 20901 - DNA, 25 bp, E. coli
cggcattcgcacacatgaagattta

SEQ ID NO: 20902 - DNA, 25 bp, E. coli
ggcagataacaatcgctttcagaag

SEQ ID NO: 20903 - DNA, 25 bp, E. coli
ggcagataacaaacgctttcagaag

SEQ ID NO: 20904 - DNA, 25 bp, E. coli
tcagaaagcgcaactaactctgctt

SEQ ID NO: 20905 - DNA, 25 bp, E. coli
tacgtcagccggaaaaccgttgctg

SEQ ID NO: 20906 - DNA, 25 bp, E. coli
tacgtcagccggtaaaccgttgctg

SEQ ID NO: 20907 - DNA, 25 bp, E. coli
accgttgctgcacgtgaccgcgtaa

SEQ ID NO: 20908 - DNA, 25 bp, E. coli
accgttgctgcaggtgaccgcgtaa

SEQ ID NO: 20909 - DNA, 25 bp, E. coli
aaaccgttgctgcaggtgaccgcgt

SEQ ID NO: 20910 - DNA, 25 bp, E. coli
aaaaccgttgctccaggtgaccgcg

SEQ ID NO: 20911 - DNA, 25 bp, E. coli
aaaaccgttgctgcaggtgaccgcg

SEQ ID NO: 20912 - DNA, 25 bp, E. coli
aaccgttgctgctggtgaccgcgta

SEQ ID NO: 20913 - DNA, 25 bp, E. coli
aaaccgttgctggaggtgaccgcgt

SEQ ID NO: 20914 - DNA, 25 bp, E. coli
aaccgttgctgcaggtgaccgcgta

SEQ ID NO: 20915 - DNA, 25 bp, E. coli
ttgtcagcagcagagacatcatcct

SEQ ID NO: 20916 - DNA, 25 bp, E. coli
ttgtcagcagcacagacatcatcct

SEQ ID NO: 20917 - DNA, 25 bp, E. coli
gccggaaaaccgatgctgcaggtga

SEQ ID NO: 20918 - DNA, 25 bp, E. coli
gccggaaaaccgttgctgcaggtga

SEQ ID NO: 20919 - DNA, 25 bp, E. coli
gaaaaccgttgctgcaggtgaccgc

SEQ ID NO: 20920 - DNA, 25 bp, E. coli
gaaaaccgttgcagcaggtgaccgc

SEQ ID NO: 20921 - DNA, 25 bp, E. coli
cggaaaaccgttcctgcaggtgacc

SEQ ID NO: 20922 - DNA, 25 bp, E. coli
ctacgtcagccggaaaaccgttgct

SEQ ID NO: 20923 - DNA, 25 bp, E. coli
ctacgtcagccgcaaaaccgttgct

SEQ ID NO: 20924 - DNA, 25 bp, E. coli
cggaaaaccgttgctgcaggtgacc

SEQ ID NO: 20925 - DNA, 25 bp, E. coli
gtcagccggaaatccgttgctgcag

SEQ ID NO: 20926 - DNA, 25 bp, E. coli
gtcagccggaaaaccgttgctgcag

SEQ ID NO: 20927 - DNA, 25 bp, E. coli
catgcaggataatctcaacgcgcgt

SEQ ID NO: 20928 - DNA, 25 bp, E. coli
catgcaggataaactcaacgcgcgt

SEQ ID NO: 20929 - DNA, 25 bp, E. coli
cagatttcgatgcttggcaacgacc

SEQ ID NO: 20930 - DNA, 25 bp, E. coli
cagatttcgatggttggcaacgacc

SEQ ID NO: 20931 - DNA, 25 bp, E. coli
attgatgacgaacgtacgccaggcc

SEQ ID NO: 20932 - DNA, 25 bp, E. coli
agaagatggcaatcgcgaacgcggt

SEQ ID NO: 20933 - DNA, 25 bp, E. coli
attgatgacgaaggtacgccaggcc

SEQ ID NO: 20934 - DNA, 25 bp, E. coli
agaagatggcaaacgcgaacgcggt

SEQ ID NO: 20935 - DNA, 25 bp, E. coli
tagatccgctgcaaagcatgagccg

SEQ ID NO: 20936 - DNA, 25 bp, E. coli
tagatccgctgctaagcatgagccg

SEQ ID NO: 20937 - DNA, 25 bp, E. coli
tgaccaacacctttatgctgccggg

SEQ ID NO: 20938 - DNA, 25 bp, E. coli
tgaccaacacctatatgctgccggg

SEQ ID NO: 20939 - DNA, 25 bp, E. coli
tgaacaattgcttgcggcgaacggc

SEQ ID NO: 20940 - DNA, 25 bp, E. coli
tgaacaattgctagcggcgaacggc

SEQ ID NO: 20941 - DNA, 25 bp, E. coli
ccggtatcgaaagcatgcagcagat

SEQ ID NO: 20942 - DNA, 25 bp, E. coli
ccggtatcgaaaccatgcagcagat

SEQ ID NO: 20943 - DNA, 25 bp, E. coli
ggttcttacaacatcgatcagggcg

SEQ ID NO: 20944 - DNA, 25 bp, E. coli
ggttcttacaacttcgatcagggcg

SEQ ID NO: 20945 - DNA, 25 bp, E. coli
tggcaacgacctcaaactggataac

SEQ ID NO: 20946 - DNA, 25 bp, E. coli
ggacaagcgcgtacaggaagtgact

SEQ ID NO: 20947 - DNA, 25 bp, E. coli
tggcaacgacctgaaactggataac

SEQ ID NO: 20948 - DNA, 25 bp, E. coli
ggacaagcgcgttcaggaagtgact

SEQ ID NO: 20949 - DNA, 25 bp, E. coli
tatccggcctactgaccggagccaa

SEQ ID NO: 20950 - DNA, 25 bp, E. coli
tatccggcctacagaccggagccaa

SEQ ID NO: 20951 - DNA, 25 bp, E. coli
ttctcgcttctgtgctgggccgttg

SEQ ID NO: 20952 - DNA, 25 bp, E. coli
ttctcgcttctgagctgggccgttg

SEQ ID NO: 20953 - DNA, 25 bp, E. coli
gccatgctgttcctggtcgccgtcg

SEQ ID NO: 20954 - DNA, 25 bp, E. coli
gccatgctgttcgtggtcgccgtcg

SEQ ID NO: 20955 - DNA, 25 bp, E. coli
ccgcgctggcggaggttctctccat

SEQ ID NO: 20956 - DNA, 25 bp, E. coli
ccgcgctggcggtggttctctccat

SEQ ID NO: 20957 - DNA, 25 bp, E. coli
cgcccgatttcacccagtggcagga

SEQ ID NO: 20958 - DNA, 25 bp, E. coli
cgcccgatttcagccagtggcagga

SEQ ID NO: 20959 - DNA, 25 bp, E. coli
cggtgcaagcacgttatccggccta

SEQ ID NO: 20960 - DNA, 25 bp, E. coli
cggtgcaagcaccttatccggccta

SEQ ID NO: 20961 - DNA, 25 bp, E. coli
gtggcaggattacctcaccgaaatg

SEQ ID NO: 20962 - DNA, 25 bp, E. coli
gtcacgctgcaattcgccgtctggg

SEQ ID NO: 20963 - DNA, 25 bp, E. coli
gtggcaggattagctcaccgaaatg

SEQ ID NO: 20964 - DNA, 25 bp, E. coli
gtcacgctgcaaatcgccgtctggg

SEQ ID NO: 20965 - DNA, 25 bp, E. coli
tggcgctgtttatccacaccaccgg

SEQ ID NO: 20966 - DNA, 25 bp, E. coli
tggcgctgtttaaccacaccaccgg

SEQ ID NO: 20967 - DNA, 25 bp, E. coli
taacgaaatggtgttcgccatgctg

SEQ ID NO: 20968 - DNA, 25 bp, E. coli
taacgaaatggtcttcgccatgctg

SEQ ID NO: 20969 - DNA, 25 bp, E. coli
gaccggagccaaacatgcaaaccat

SEQ ID NO: 20970 - DNA, 25 bp, E. coli
gaccggagccaatcatgcaaaccat

SEQ ID NO: 20971 - DNA, 25 bp, E. coli
taaacgcaacggatggcttaccgat

SEQ ID NO: 20972 - DNA, 25 bp, E. coli
tacggcaaaccggttgaatcgccaa

SEQ ID NO: 20973 - DNA, 25 bp, E. coli
taaacgcaacggttggcttaccgat

SEQ ID NO: 20974 - DNA, 25 bp, E. coli
tacggcaaaccgcttgaatcgccaa

SEQ ID NO: 20975 - DNA, 25 bp, E. coli
tgtggttaaccagcttggtgactct

SEQ ID NO: 20976 - DNA, 25 bp, E. coli
tgtggttaaccaccttggtgactct

SEQ ID NO: 20977 - DNA, 25 bp, E. coli
tgagggcggtaattctacggcaaac

SEQ ID NO: 20978 - DNA, 25 bp, E. coli
tgagggcggtaaatctacggcaaac

SEQ ID NO: 20979 - DNA, 25 bp, E. coli
taaggtaatgctcataaatattccc

SEQ ID NO: 20980 - DNA, 25 bp, E. coli
taaggtaatgctgataaatattccc

SEQ ID NO: 20981 - DNA, 25 bp, E. coli
ccttggtgactcttaatgagggcgg

SEQ ID NO: 20982 - DNA, 25 bp, E. coli
ccttggtgactcataatgagggcgg

SEQ ID NO: 20983 - DNA, 25 bp, E. coli
gctgataaatattcccgcttgcagg

SEQ ID NO: 20984 - DNA, 25 bp, E. coli
gcttgaatcgcctatctttgttgtg

SEQ ID NO: 20985 - DNA, 25 bp, E. coli
gcttgaatcgccaatctttgttgtg

SEQ ID NO: 20986 - DNA, 25 bp, E. coli
gctgataaatatacccgcttgcagg

SEQ ID NO: 20987 - DNA, 25 bp, E. coli
gactcttaatgagggcggtaattct

SEQ ID NO: 20988 - DNA, 25 bp, E. coli
gactcttaatgacggcggtaattct

SEQ ID NO: 20989 - DNA, 25 bp, E. coli
ctttgttgtgaattactggcttagc

SEQ ID NO: 20990 - DNA, 25 bp, E. coli
ctttgttgtgaaatactggcttagc

SEQ ID NO: 20991 - DNA, 25 bp, E. coli
tggcttagctttatattcattaagg

SEQ ID NO: 20992 - DNA, 25 bp, E. coli
tggcttagctttttattcattaagg

SEQ ID NO: 20993 - DNA, 25 bp, E. coli
cagatttacaggcttatgcgccaca

SEQ ID NO: 20994 - DNA, 25 bp, E. coli
cagatttacagggttatgcgccaca

SEQ ID NO: 20995 - DNA, 25 bp, E. coli
aaagtgatgaaagcatgctgccgcc

SEQ ID NO: 20996 - DNA, 25 bp, E. coli
aaagtgatgaaaccatgctgccgcc

SEQ ID NO: 20997 - DNA, 25 bp, E. coli
tatcgctaagtgttccccaggcatg

SEQ ID NO: 20998 - DNA, 25 bp, E. coli
tatcgctaagtgatccccaggcatg

SEQ ID NO: 20999 - DNA, 25 bp, E. coli
tttatcaaaccactgtcgcgccagg

SEQ ID NO: 21000 - DNA, 25 bp, E. coli
tttatcaaaccagtgtcgcgccagg

SEQ ID NO: 21001 - DNA, 25 bp, E. coli
tgatgtcactggtgcagacgcgtct

SEQ ID NO: 21002 - DNA, 25 bp, E. coli
tgctgatggacgctcggtaaaccgc

SEQ ID NO: 21003 - DNA, 25 bp, E. coli
tgatgtcactggagcagacgcgtct

SEQ ID NO: 21004 - DNA, 25 bp, E. coli
tgctgatggacggtcggtaaaccgc

SEQ ID NO: 21005 - DNA, 25 bp, E. coli
tctcctacagtatgcagcgaacggg

SEQ ID NO: 21006 - DNA, 25 bp, E. coli
tctcctacagtaagcagcgaacggg

SEQ ID NO: 21007 - DNA, 25 bp, E. coli
gcaatacttattcggacagcgccag

SEQ ID NO: 21008 - DNA, 25 bp, E. coli
gcaatacttattgggacagcgccag

SEQ ID NO: 21009 - DNA, 25 bp, E. coli
gattacaacgtgaacgccagccagt

SEQ ID NO: 21010 - DNA, 25 bp, E. coli
gattacaacgtgtacgccagccagt

SEQ ID NO: 21011 - DNA, 25 bp, E. coli
tggaatatttcaccgtcggcaacgg

SEQ ID NO: 21012 - DNA, 25 bp, E. coli
tggaatatttcagcgtcggcaacgg

SEQ ID NO: 21013 - DNA, 25 bp, E. coli
gagtacctcagcacgcgtaatggcg

SEQ ID NO: 21014 - DNA, 25 bp, E. coli
gagtacctcagctcgcgtaatggcg

SEQ ID NO: 21015 - DNA, 25 bp, E. coli
aatatacaacgatttaaccgcttgc

SEQ ID NO: 21016 - DNA, 25 bp, E. coli
aattactggacaccgaaatcattgt

SEQ ID NO: 21017 - DNA, 25 bp, E. coli
aatatacaacgaattaaccgcttgc

SEQ ID NO: 21018 - DNA, 25 bp, E. coli
aattactggacagcgaaatcattgt

SEQ ID NO: 21019 - DNA, 25 bp, E. coli
aaaaaggcccctgttgaaattgcag

SEQ ID NO: 21020 - DNA, 25 bp, E. coli
aaaaaggcccctcttgaaattgcag

SEQ ID NO: 21021 - DNA, 25 bp, E. coli
tatttttagcacaacgctatgcgca

SEQ ID NO: 21022 - DNA, 25 bp, E. coli
tatttttagcactacgctatgcgca

SEQ ID NO: 21023 - DNA, 25 bp, E. coli
tgggcgacatgaagcaacggtaaaa

SEQ ID NO: 21024 - DNA, 25 bp, E. coli
tgtcacccgctctacagatcacggt

SEQ ID NO: 21025 - DNA, 25 bp, E. coli
tgtcacccgctcaacagatcacggt

SEQ ID NO: 21026 - DNA, 25 bp, E. coli
gcaagcatcatattgggcgacatga

SEQ ID NO: 21027 - DNA, 25 bp, E. coli
gcacaacactgcgtgaaacaatcga

SEQ ID NO: 21028 - DNA, 25 bp, E. coli
gcacaacactgcctgaaacaatcga

SEQ ID NO: 21029 - DNA, 25 bp, E. coli
gcaagcatcataatgggcgacatga

SEQ ID NO: 21030 - DNA, 25 bp, E. coli
gggcctggtacgtgcaagcatcata

SEQ ID NO: 21031 - DNA, 25 bp, E. coli
gggcctggtacgagcaagcatcata

SEQ ID NO: 21032 - DNA, 25 bp, E. coli
tgggcgacatgatgcaacggtaaaa

SEQ ID NO: 21033 - DNA, 25 bp, E. coli
taattgctaaggaataacccagttg

SEQ ID NO: 21034 - DNA, 25 bp, E. coli
taaccgcttgcataattaggcacaa

SEQ ID NO: 21035 - DNA, 25 bp, E. coli
taaccgcttgcaaaattaggcacaa

SEQ ID NO: 21036 - DNA, 25 bp, E. coli
taattgctaaggtataacccagttg

SEQ ID NO: 21037 - DNA, 25 bp, E. coli
taacacccgcatcatggctgacgct

SEQ ID NO: 21038 - DNA, 25 bp, E. coli
aaaacgtgctgaacgacaccgtcga

SEQ ID NO: 21039 - DNA, 25 bp, E. coli
aaaacgtgctgatcgacaccgtcga

SEQ ID NO: 21040 - DNA, 25 bp, E. coli
tatcggcaacggcaaacagctcatt

SEQ ID NO: 21041 - DNA, 25 bp, E. coli
tatcggcaacgggaaacagctcatt

SEQ ID NO: 21042 - DNA, 25 bp, E. coli
tggtcatcaccatcatccggagtgg

SEQ ID NO: 21043 - DNA, 25 bp, E. coli
tggtcatcaccaacatccggagtgg

SEQ ID NO: 21044 - DNA, 25 bp, E. coli
tcgagctgtaccagaaatgggcggc

SEQ ID NO: 21045 - DNA, 25 bp, E. coli
tcgagctgtacctgaaatgggcggc

SEQ ID NO: 21046 - DNA, 25 bp, E. coli
gaatataaaacgctgcgcggcagca

SEQ ID NO: 21047 - DNA, 25 bp, E. coli
gcatgatgactttcctgacaggcga

SEQ ID NO: 21048 - DNA, 25 bp, E. coli
gaatataaaacggtgcgcggcagca

SEQ ID NO: 21049 - DNA, 25 bp, E. coli
gcatgatgacttacctgacaggcga

SEQ ID NO: 21050 - DNA, 25 bp, E. coli
gaaaattaccgacatcctgggcttt

SEQ ID NO: 21051 - DNA, 25 bp, E. coli
gaaaattaccgagatcctgggcttt

SEQ ID NO: 21052 - DNA, 25 bp, E. coli
gatacgccgatctactgtacagcca

SEQ ID NO: 21053 - DNA, 25 bp, E. coli
gatacgccgatcaactgtacagcca

SEQ ID NO: 21054 - DNA, 25 bp, E. coli
taacacccgcatgatggctgacgct

SEQ ID NO: 21055 - DNA, 25 bp, E. coli
taatgtggtgaaaactggcgacacg

SEQ ID NO: 21056 - DNA, 25 bp, E. coli
taatgtggtgaatactggcgacacg

SEQ ID NO: 21057 - DNA, 25 bp, E. coli
tcagccgcgaatttgtgcagaacct

SEQ ID NO: 21058 - DNA, 25 bp, E. coli
tcagccgcgaatatgtgcagaacct

SEQ ID NO: 21059 - DNA, 25 bp, E. coli
caggtagttaaataccattagtgct

SEQ ID NO: 21060 - DNA, 25 bp, E. coli
caggtagttaaaaaccattagtgct

SEQ ID NO: 21061 - DNA, 25 bp, E. coli
agtaaattgccgcatgacatcagaa

SEQ ID NO: 21062 - DNA, 25 bp, E. coli
agaacgatgccaaccgaacagtggc

SEQ ID NO: 21063 - DNA, 25 bp, E. coli
agtaaattgccggatgacatcagaa

SEQ ID NO: 21064 - DNA, 25 bp, E. coli
cgttgggttcgtgattagcgaagaa

SEQ ID NO: 21065 - DNA, 25 bp, E. coli
agaacgatgccatccgaacagtggc

SEQ ID NO: 21066 - DNA, 25 bp, E. coli
cgttgggttcgtcattagcgaagaa

SEQ ID NO: 21067 - DNA, 25 bp, E. coli
aaaccattagtgctgagtaaattgc

SEQ ID NO: 21068 - DNA, 25 bp, E. coli
aaaccattagtggtgagtaaattgc

SEQ ID NO: 21069 - DNA, 25 bp, E. coli
aaatctcattctccgaactgtcagg

SEQ ID NO: 21070 - DNA, 25 bp, E. coli
aaatctcattctgcgaactgtcagg

SEQ ID NO: 21071 - DNA, 25 bp, E. coli
tattagccagccagcggcgttgggt

SEQ ID NO: 21072 - DNA, 25 bp, E. coli
tattagccagcctgcggcgttgggt

SEQ ID NO: 21073 - DNA, 25 bp, E. coli
gccggatgacatcagaacgatgcca

SEQ ID NO: 21074 - DNA, 25 bp, E. coli
gccggatgacatgagaacgatgcca

SEQ ID NO: 21075 - DNA, 25 bp, E. coli
gcgaagaaaaatgatcataaattgg

SEQ ID NO: 21076 - DNA, 25 bp, E. coli
gcgaagaaaaatcatcataaattgg

SEQ ID NO: 21077 - DNA, 25 bp, E. coli
cgaaatagagtgttcaaataacgtc

SEQ ID NO: 21078 - DNA, 25 bp, E. coli
cgaaatagagtgatcaaataacgtc

SEQ ID NO: 21079 - DNA, 25 bp, E. coli
taacgtctgttttttagccagccag

SEQ ID NO: 21080 - DNA, 25 bp, E. coli
taacgtctgtttattagccagccag

SEQ ID NO: 21081 - DNA, 25 bp, E. coli
catttggtgtatgatgtgcgccgcg

SEQ ID NO: 21082 - DNA, 25 bp, E. coli
taccgggtgagtacgataaactgcg

SEQ ID NO: 21083 - DNA, 25 bp, E. coli
taccgggtgagttcgataaactgcg

SEQ ID NO: 21084 - DNA, 25 bp, E. coli
tataccctggaacgtaaagcacgcg

SEQ ID NO: 21085 - DNA, 25 bp, E. coli
tataccctggaaggtaaagcacgcg

SEQ ID NO: 21086 - DNA, 25 bp, E. coli
ttattgggcatgaacagcacgttgc

SEQ ID NO: 21087 - DNA, 25 bp, E. coli
ttattgggcatgtacagcacgttgc

SEQ ID NO: 21088 - DNA, 25 bp, E. coli
tgcacctggctgaaatgcgattgcg

SEQ ID NO: 21089 - DNA, 25 bp, E. coli
tgcacctggctgtaatgcgattgcg

SEQ ID NO: 21090 - DNA, 25 bp, E. coli
tgccgtggcgcactcgtcgataata

SEQ ID NO: 21091 - DNA, 25 bp, E. coli
tgccgtggcgcagtcgtcgataata

SEQ ID NO: 21092 - DNA, 25 bp, E. coli
gcaaaaactatcatgagcgccgtga

SEQ ID NO: 21093 - DNA, 25 bp, E. coli
gaattggtttttccgctgcacctgg

SEQ ID NO: 21094 - DNA, 25 bp, E. coli
gaattggtttttgcgctgcacctgg

SEQ ID NO: 21095 - DNA, 25 bp, E. coli
gcaaaaactatcttgagcgccgtga

SEQ ID NO: 21096 - DNA, 25 bp, E. coli
gaaaatatgcctaatgcccgcgact

SEQ ID NO: 21097 - DNA, 25 bp, E. coli
gaaaatatgccttatgcccgcgact

SEQ ID NO: 21098 - DNA, 25 bp, E. coli
catttggtgtatcatgtgcgccgcg

SEQ ID NO: 21099 - DNA, 25 bp, E. coli
gatcaaccgacggtgaaaaggctgg

SEQ ID NO: 21100 - DNA, 25 bp, E. coli
gatcaaccgacgctgaaaaggctgg

SEQ ID NO: 21101 - DNA, 25 bp, E. coli
gatgcttgccgatcgcgatggattt

SEQ ID NO: 21102 - DNA, 25 bp, E. coli
gatgcttgccgaacgcgatggattt

SEQ ID NO: 21103 - DNA, 25 bp, E. coli
catagcccgtgtcgtagatggtgcc

SEQ ID NO: 21104 - DNA, 25 bp, E. coli
catagcccgtgtggtagatggtgcc

SEQ ID NO: 21105 - DNA, 25 bp, E. coli
taaagagaattttcagcgcgctcgc

SEQ ID NO: 21106 - DNA, 25 bp, E. coli
taaagagaatttacagcgcgctcgc

SEQ ID NO: 21107 - DNA, 25 bp, E. coli
tatgggcgtggatcatacccaaccg

SEQ ID NO: 21108 - DNA, 25 bp, E. coli
tagttggtacccttacgctgcgtca

SEQ ID NO: 21109 - DNA, 25 bp, E. coli
tatgcaaatgtaggaacagtggcgg

SEQ ID NO: 21110 - DNA, 25 bp, E. coli
tatgggcgtggaacatacccaaccg

SEQ ID NO: 21111 - DNA, 25 bp, E. coli
tatgcaaatgtacgaacagtggcgg

SEQ ID NO: 21112 - DNA, 25 bp, E. coli
tagttggtacccatacgctgcgtca

SEQ ID NO: 21113 - DNA, 25 bp, E. coli
tatttccggtaatgaagaagcccgt

SEQ ID NO: 21114 - DNA, 25 bp, E. coli
tatttccggtaaagaagaagcccgt

SEQ ID NO: 21115 - DNA, 25 bp, E. coli
tattggccgcctgaaacagcgggtg

SEQ ID NO: 21116 - DNA, 25 bp, E. coli
tattggccgcctcaaacagcgggtg

SEQ ID NO: 21117 - DNA, 25 bp, E. coli
ttctcgttgaaagccgccggatggg

SEQ ID NO: 21118 - DNA, 25 bp, E. coli
ttctcgttgaaacccgccggatggg

SEQ ID NO: 21119 - DNA, 25 bp, E. coli
ccatgctgcatgtggtcgggttgaa

SEQ ID NO: 21120 - DNA, 25 bp, E. coli
ccatgctgcatgaggtcgggttgaa

SEQ ID NO: 21121 - DNA, 25 bp, E. coli
gctgcggtcgatgttggttcaaaca

SEQ ID NO: 21122 - DNA, 25 bp, E. coli
gctgcggtcgatcttggttcaaaca

SEQ ID NO: 21123 - DNA, 25 bp, E. coli
gacgggtgctggataccactatgca

SEQ ID NO: 21124 - DNA, 25 bp, E. coli
gacgggtgctggttaccactatgca

SEQ ID NO: 21125 - DNA, 25 bp, E. coli
aatactgaacttagtgctcgtgaaa

SEQ ID NO: 21126 - DNA, 25 bp, E. coli
aatactgaactttgtgctcgtgaaa

SEQ ID NO: 21127 - DNA, 25 bp, E. coli
tactgaacttagagctcgtgaaatt

SEQ ID NO: 21128 - DNA, 25 bp, E. coli
tactgaacttagtgctcgtgaaatt

SEQ ID NO: 21129 - DNA, 25 bp, E. coli
tagaaaatactgtacttagtgctcg

SEQ ID NO: 21130 - DNA, 25 bp, E. coli
tagaaaatactgaacttagtgctcg

SEQ ID NO: 21131 - DNA, 25 bp, E. coli
tgcactgttagaaaatactgaactt

SEQ ID NO: 21132 - DNA, 25 bp, E. coli
tgcactgttagataatactgaactt

SEQ ID NO: 21133 - DNA, 25 bp, E. coli
tgcggcgcgtgcactgttagaaaat

SEQ ID NO: 21134 - DNA, 25 bp, E. coli
tgcggcgcgtgctctgttagaaaat

SEQ ID NO: 21135 - DNA, 25 bp, E. coli
gcggcgcgtgcactgttagaaaata

SEQ ID NO: 21136 - DNA, 25 bp, E. coli
gcggcgcgtgcagtgttagaaaata

SEQ ID NO: 21137 - DNA, 25 bp, E. coli
gaaaatactgaagttagtgctcgtg

SEQ ID NO: 21138 - DNA, 25 bp, E. coli
gaaaatactgaacttagtgctcgtg

SEQ ID NO: 21139 - DNA, 25 bp, E. coli
cgcgtgcactgtaagaaaatactga

SEQ ID NO: 21140 - DNA, 25 bp, E. coli
cgcgtgcactgttagaaaatactga

SEQ ID NO: 21141 - DNA, 25 bp, E. coli
cgtgcactgttacaaaatactgaac

SEQ ID NO: 21142 - DNA, 25 bp, E. coli
cggcgcgtgcacagttagaaaatac

SEQ ID NO: 21143 - DNA, 25 bp, E. coli
cgtgcactgttagaaaatactgaac

SEQ ID NO: 21144 - DNA, 25 bp, E. coli
cggcgcgtgcactgttagaaaatac

SEQ ID NO: 21145 - DNA, 25 bp, E. coli
ggcgcgtgcactcttagaaaatact

SEQ ID NO: 21146 - DNA, 25 bp, E. coli
ggcgcgtgcactgttagaaaatact

SEQ ID NO: 21147 - DNA, 25 bp, E. coli
caaagaaccgtcacgtaaggcgctg

SEQ ID NO: 21148 - DNA, 25 bp, E. coli
caaagaaccgtctcgtaaggcgctg

SEQ ID NO: 21149 - DNA, 25 bp, E. coli
tattgagcaagatgcgaaagccgcg

SEQ ID NO: 21150 - DNA, 25 bp, E. coli
tattgagcaagaagcgaaagccgcg

SEQ ID NO: 21151 - DNA, 25 bp, E. coli
tttgattgctaaacactgggcggcg

SEQ ID NO: 21152 - DNA, 25 bp, E. coli
tttgattgctaatcactgggcggcg

SEQ ID NO: 21153 - DNA, 25 bp, E. coli
tgaacgatgctatcaaccaggcgaa

SEQ ID NO: 21154 - DNA, 25 bp, E. coli
tgaaggcactggcaatcaacctggt

SEQ ID NO: 21155 - DNA, 25 bp, E. coli
tgaacgatgctaacaaccaggcgaa

SEQ ID NO: 21156 - DNA, 25 bp, E. coli
tgaaggcactgggaatcaacctggt

SEQ ID NO: 21157 - DNA, 25 bp, E. coli
gaaagccgcgcctgatgttcagctg

SEQ ID NO: 21158 - DNA, 25 bp, E. coli
gaaagcgacctttgatctggcgaaa

SEQ ID NO: 21159 - DNA, 25 bp, E. coli
gaaagcgaccttagatctggcgaaa

SEQ ID NO: 21160 - DNA, 25 bp, E. coli
gaaagccgcgccagatgttcagctg

SEQ ID NO: 21161 - DNA, 25 bp, E. coli
cgaaagataagatggacgcctggct

SEQ ID NO: 21162 - DNA, 25 bp, E. coli
cgaaagataagaaggacgcctggct

SEQ ID NO: 21163 - DNA, 25 bp, E. coli
tggcgtagataatgacaacctggct

SEQ ID NO: 21164 - DNA, 25 bp, E. coli
tggcgtagataaagacaacctggct

SEQ ID NO: 21165 - DNA, 25 bp, E. coli
taaccctgtctggtgtgatggccag

SEQ ID NO: 21166 - DNA, 25 bp, E. coli
taaggcgctggaaagctacgacaaa

SEQ ID NO: 21167 - DNA, 25 bp, E. coli
taaccctgtctgctgtgatggccag

SEQ ID NO: 21168 - DNA, 25 bp, E. coli
taaggcgctggatagctacgacaaa

SEQ ID NO: 21169 - DNA, 25 bp, E. coli
caaaggtgttgctaccggtcgtagc

SEQ ID NO: 21170 - DNA, 25 bp, E. coli
caaaggtgttgcaaccggtcgtagc

SEQ ID NO: 21171 - DNA, 25 bp, E. coli
tactgccgcgaaggtttttacaaca

SEQ ID NO: 21172 - DNA, 25 bp, E. coli
tactgccgcgaacgtttttacaaca

SEQ ID NO: 21173 - DNA, 25 bp, E. coli
acttctctggcgaaagcctgcaagg

SEQ ID NO: 21174 - DNA, 25 bp, E. coli
gaaaaatacccgtggtacgctggca

SEQ ID NO: 21175 - DNA, 25 bp, E. coli
gaaaaatacccgaggtacgctggca

SEQ ID NO: 21176 - DNA, 25 bp, E. coli
acttctctggcgtaagcctgcaagg

SEQ ID NO: 21177 - DNA, 25 bp, E. coli
tgaaccgggcatcaaacaaaaagcc

SEQ ID NO: 21178 - DNA, 25 bp, E. coli
tgaaccgggcatgaaacaaaaagcc

SEQ ID NO: 21179 - DNA, 25 bp, E. coli
ttaaaaacttcctggactactgccg

SEQ ID NO: 21180 - DNA, 25 bp, E. coli
tcgtagcggtatccaccaggacgtg

SEQ ID NO: 21181 - DNA, 25 bp, E. coli
tcgtagcggtatgcaccaggacgtg

SEQ ID NO: 21182 - DNA, 25 bp, E. coli
ttaaaaacttccaggactactgccg

SEQ ID NO: 21183 - DNA, 25 bp, E. coli
cgtggttgataaggacttcctgaac

SEQ ID NO: 21184 - DNA, 25 bp, E. coli
cattgaaagcgtcaccgttagcgag

SEQ ID NO: 21185 - DNA, 25 bp, E. coli
cgtggttgataacgacttcctgaac

SEQ ID NO: 21186 - DNA, 25 bp, E. coli
cattgaaagcgtgaccgttagcgag

SEQ ID NO: 21187 - DNA, 25 bp, E. coli
gttactttccacaccaatcacggcg

SEQ ID NO: 21188 - DNA, 25 bp, E. coli
gttactttccactccaatcacggcg

SEQ ID NO: 21189 - DNA, 25 bp, E. coli
ggcatggacgtgctagacaaaatca

SEQ ID NO: 21190 - DNA, 25 bp, E. coli
ggcatggacgtggtagacaaaatca

SEQ ID NO: 21191 - DNA, 25 bp, E. coli
cagcgaatgcgtaaagattgttgcg

SEQ ID NO: 21192 - DNA, 25 bp, E. coli
cagcgaatgcgttaagattgttgcg

SEQ ID NO: 21193 - DNA, 25 bp, E. coli
agaggtggcgattaacagcctgcgc

SEQ ID NO: 21194 - DNA, 25 bp, E. coli
agaggtggcgataaacagcctgcgc

SEQ ID NO: 21195 - DNA, 25 bp, E. coli
gctggtgacagcgaatgcgttaaga

SEQ ID NO: 21196 - DNA, 25 bp, E. coli
gctggtgacagccaatgcgttaaga

SEQ ID NO: 21197 - DNA, 25 bp, E. coli
gaaagggatcttgctcgtcaccacg

SEQ ID NO: 21198 - DNA, 25 bp, E. coli
gaaagctgccgcgatcgggattgca

SEQ ID NO: 21199 - DNA, 25 bp, E. coli
gaaagctgccgccatcgggattgca

SEQ ID NO: 21200 - DNA, 25 bp, E. coli
gaaagggatcttcctcgtcaccacg

SEQ ID NO: 21201 - DNA, 25 bp, E. coli
cgttaagattgtagcgcaggagata

SEQ ID NO: 21202 - DNA, 25 bp, E. coli
cgttaagattgttgcgcaggagata

SEQ ID NO: 21203 - DNA, 25 bp, E. coli
ctgcccgtgtgcgttagttatctca

SEQ ID NO: 21204 - DNA, 25 bp, E. coli
ctgcccgtgtgccttagttatctca

SEQ ID NO: 21205 - DNA, 25 bp, E. coli
gttagttatctcaacgcctgcggcg

SEQ ID NO: 21206 - DNA, 25 bp, E. coli
gattaacagcctgcgccctggcgat

SEQ ID NO: 21207 - DNA, 25 bp, E. coli
gattaacagcctccgccctggcgat

SEQ ID NO: 21208 - DNA, 25 bp, E. coli
gttagttatctctacgcctgcggcg

SEQ ID NO: 21209 - DNA, 25 bp, E. coli
gggctgaaagggatcttcctcgtca

SEQ ID NO: 21210 - DNA, 25 bp, E. coli
gggctgaaagggttcttcctcgtca

SEQ ID NO: 21211 - DNA, 25 bp, E. coli
ggaaaccgccgacgcagcattaacc

SEQ ID NO: 21212 - DNA, 25 bp, E. coli
ggaaaccgccgaggcagcattaacc

SEQ ID NO: 21213 - DNA, 25 bp, E. coli
cagtgacggtccactaagacaataa

SEQ ID NO: 21214 - DNA, 25 bp, E. coli
cagtgacggtcctctaagacaataa

SEQ ID NO: 21215 - DNA, 25 bp, E. coli
agcccctttctttcgcgaacaggag

SEQ ID NO: 21216 - DNA, 25 bp, E. coli
agcccctttcttacgcgaacaggag

SEQ ID NO: 21217 - DNA, 25 bp, E. coli
aacaggaggttgctgtcataacagc

SEQ ID NO: 21218 - DNA, 25 bp, E. coli
aacaggaggttggtgtcataacagc

SEQ ID NO: 21219 - DNA, 25 bp, E. coli
tttcttacgcgatcaggaggttgct

SEQ ID NO: 21220 - DNA, 25 bp, E. coli
tttcttacgcgaacaggaggttgct

SEQ ID NO: 21221 - DNA, 25 bp, E. coli
tctgaacccgatcccggaaaggtgc

SEQ ID NO: 21222 - DNA, 25 bp, E. coli
tctgaacccgatgccggaaaggtgc

SEQ ID NO: 21223 - DNA, 25 bp, E. coli
gctgtacattacacttattttccga

SEQ ID NO: 21224 - DNA, 25 bp, E. coli
gctgtacattactcttattttccga

SEQ ID NO: 21225 - DNA, 25 bp, E. coli
gctcgccagtgacggtcctctaaga

SEQ ID NO: 21226 - DNA, 25 bp, E. coli
gctcgccagtgagggtcctctaaga

SEQ ID NO: 21227 - DNA, 25 bp, E. coli
gaaaggtgcttaatacgcggctcgc

SEQ ID NO: 21228 - DNA, 25 bp, E. coli
gaaaggtgcttattacgcggctcgc

SEQ ID NO: 21229 - DNA, 25 bp, E. coli
cttaatacgcgggtcgccagtgacg

SEQ ID NO: 21230 - DNA, 25 bp, E. coli
cttaatacgcggctcgccagtgacg

SEQ ID NO: 21231 - DNA, 25 bp, E. coli
cggaattctgaagccgatgccggaa

SEQ ID NO: 21232 - DNA, 25 bp, E. coli
cggaattctgaacccgatgccggaa

SEQ ID NO: 21233 - DNA, 25 bp, E. coli
tggcgctgccggtattctgaacccg

SEQ ID NO: 21234 - DNA, 25 bp, E. coli
tggcgctgccggaattctgaacccg

SEQ ID NO: 21235 - DNA, 25 bp, E. coli
tatgaaaagcaaaggaaggaagctg

SEQ ID NO: 21236 - DNA, 25 bp, E. coli
tatgaaaagcaatggaaggaagctg

SEQ ID NO: 21237 - DNA, 25 bp, E. coli
tatcaatccctccatatggcacgcg

SEQ ID NO: 21238 - DNA, 25 bp, E. coli
tatcaatccctcgatatggcacgcg

SEQ ID NO: 21239 - DNA, 25 bp, E. coli
tgaatgcccatacgagccttgtaaa

SEQ ID NO: 21240 - DNA, 25 bp, E. coli
tgaatgcccataggagccttgtaaa

SEQ ID NO: 21241 - DNA, 25 bp, E. coli
tcctcgcaagggttaagaaaaccca

SEQ ID NO: 21242 - DNA, 25 bp, E. coli
tcctcgcaagggataagaaaaccca

SEQ ID NO: 21243 - DNA, 25 bp, E. coli
tcatcaagtattaagccagtcgttg

SEQ ID NO: 21244 - DNA, 25 bp, E. coli
tcatcaagtatttagccagtcgttg

SEQ ID NO: 21245 - DNA, 25 bp, E. coli
ccaagaggtggtgttaaaaatgcca

SEQ ID NO: 21246 - DNA, 25 bp, E. coli
ccaagaggtggtcttaaaaatgcca

SEQ ID NO: 21247 - DNA, 25 bp, E. coli
gaaagaaaacataattcgccacctg

SEQ ID NO: 21248 - DNA, 25 bp, E. coli
gaaagaaaacattattcgccacctg

SEQ ID NO: 21249 - DNA, 25 bp, E. coli
cattcatggaaatgatctccgtgga

SEQ ID NO: 21250 - DNA, 25 bp, E. coli
cattgtattactatcctcgcaaggg

SEQ ID NO: 21251 - DNA, 25 bp, E. coli
cattcatggaaaagatctccgtgga

SEQ ID NO: 21252 - DNA, 25 bp, E. coli
cattgtattactttcctcgcaaggg

SEQ ID NO: 21253 - DNA, 25 bp, E. coli
ggtgtagcccagtctaatattcgtc

SEQ ID NO: 21254 - DNA, 25 bp, E. coli
ggtgtagcccagactaatattcgtc

SEQ ID NO: 21255 - DNA, 25 bp, E. coli
taagacaacgagttttgaatgccca

SEQ ID NO: 21256 - DNA, 25 bp, E. coli
taagacaacgagatttgaatgccca

SEQ ID NO: 21257 - DNA, 25 bp, E. coli
aagaactgaacgacacggtgaccgc

SEQ ID NO: 21258 - DNA, 25 bp, E. coli
aagaactgaacgtcacggtgaccgc

SEQ ID NO: 21259 - DNA, 25 bp, E. coli
cacggtgaccgctcatgaaatggag

SEQ ID NO: 21260 - DNA, 25 bp, E. coli
cacggtgaccgcacatgaaatggag

SEQ ID NO: 21261 - DNA, 25 bp, E. coli
cagagctggagacccgactggcttt

SEQ ID NO: 21262 - DNA, 25 bp, E. coli
catcgcgtcgcacgctgaagaaacg

SEQ ID NO: 21263 - DNA, 25 bp, E. coli
cagagctggagagccgactggcttt

SEQ ID NO: 21264 - DNA, 25 bp, E. coli
catcgcgtcgcaggctgaagaaacg

SEQ ID NO: 21265 - DNA, 25 bp, E. coli
taaaagccagcctgccgtcgaacat

SEQ ID NO: 21266 - DNA, 25 bp, E. coli
taaaagccagccagccgtcgaacat

SEQ ID NO: 21267 - DNA, 25 bp, E. coli
ttatcattggaagcacgcctggcag

SEQ ID NO: 21268 - DNA, 25 bp, E. coli
ttatcattggaaccacgcctggcag

SEQ ID NO: 21269 - DNA, 25 bp, E. coli
tgaaatggagatcgcgaaactgcgc

SEQ ID NO: 21270 - DNA, 25 bp, E. coli
tgaaatggagatggcgaaactgcgc

SEQ ID NO: 21271 - DNA, 25 bp, E. coli
tcatctgcgtctcctgaccgagaag

SEQ ID NO: 21272 - DNA, 25 bp, E. coli
tcatctgcgtctgctgaccgagaag

SEQ ID NO: 21273 - DNA, 25 bp, E. coli
gaaatcaccattgaagaactgaacg

SEQ ID NO: 21274 - DNA, 25 bp, E. coli
gaaatcaccattcaagaactgaacg

SEQ ID NO: 21275 - DNA, 25 bp, E. coli
cgactggcttttgaggaaatcacca

SEQ ID NO: 21276 - DNA, 25 bp, E. coli
cgactggcttttcaggaaatcacca

SEQ ID NO: 21277 - DNA, 25 bp, E. coli
gaccgagaagttaaaagccagccag

SEQ ID NO: 21278 - DNA, 25 bp, E. coli
gaccgagaagtttaaagccagccag

SEQ ID NO: 21279 - DNA, 25 bp, E. coli
caaattccgcagatgtatcagctgg

SEQ ID NO: 21280 - DNA, 25 bp, E. coli
caaattccgcagttgtatcagctgg

SEQ ID NO: 21281 - DNA, 25 bp, E. coli
tactggaaagtgtcggaagcgaacc

SEQ ID NO: 21282 - DNA, 25 bp, E. coli
tactggaaagtgacggaagcgaacc

SEQ ID NO: 21283 - DNA, 25 bp, E. coli
aaagcggccgggaatcatcagacct

SEQ ID NO: 21284 - DNA, 25 bp, E. coli
aaagcggccgggtatcatcagacct

SEQ ID NO: 21285 - DNA, 25 bp, E. coli
tccgctatttcgtgcaggtggccga

SEQ ID NO: 21286 - DNA, 25 bp, E. coli
tccgctatttcgagcaggtggccga

SEQ ID NO: 21287 - DNA, 25 bp, E. coli
gctctgcggctacgacgatcatctg

SEQ ID NO: 21288 - DNA, 25 bp, E. coli
gctctgcggctaggacgatcatctg

SEQ ID NO: 21289 - DNA, 25 bp, E. coli
gaatcttctgaaagcctggcgcgac

SEQ ID NO: 21290 - DNA, 25 bp, E. coli
gcagcatgatccataccgtcaaagg

SEQ ID NO: 21291 - DNA, 25 bp, E. coli
gcagcatgatccttaccgtcaaagg

SEQ ID NO: 21292 - DNA, 25 bp, E. coli
gaatcttctgaatgcctggcgcgac

SEQ ID NO: 21293 - DNA, 25 bp, E. coli
gacggcatcgtgctgatcaacccct

SEQ ID NO: 21294 - DNA, 25 bp, E. coli
gactcgcgcagcaatattatcggca

SEQ ID NO: 21295 - DNA, 25 bp, E. coli
gactcgcgcagctatattatcggca

SEQ ID NO: 21296 - DNA, 25 bp, E. coli
gacggcatcgtggtgatcaacccct

SEQ ID NO: 21297 - DNA, 25 bp, E. coli
gattcagcaaggagatctcatgccg

SEQ ID NO: 21298 - DNA, 25 bp, E. coli
gattcagcaaggtgatctcatgccg

SEQ ID NO: 21299 - DNA, 25 bp, E. coli
gatgctctataagttcccggcgctg

SEQ ID NO: 21300 - DNA, 25 bp, E. coli
gatgctctataacttcccggcgctg

SEQ ID NO: 21301 - DNA, 25 bp, E. coli
caactgggctgtcaaaaacggctgg

SEQ ID NO: 21302 - DNA, 25 bp, E. coli
cacaaatgtgtattcagcagacggg

SEQ ID NO: 21303 - DNA, 25 bp, E. coli
caactgggctgtgaaaaacggctgg

SEQ ID NO: 21304 - DNA, 25 bp, E. coli
cacggttggtgctgacggtaatgcc

SEQ ID NO: 21305 - DNA, 25 bp, E. coli
cacggttggtgcagacggtaatgcc

SEQ ID NO: 21306 - DNA, 25 bp, E. coli
cacaaatgtgtaatcagcagacggg

SEQ ID NO: 21307 - DNA, 25 bp, E. coli
tacggctacgtctttccctgaacag

SEQ ID NO: 21308 - DNA, 25 bp, E. coli
tacggctacgtcattccctgaacag

SEQ ID NO: 21309 - DNA, 25 bp, E. coli
aaatggcacgattggtattaccggc

SEQ ID NO: 21310 - DNA, 25 bp, E. coli
aaatggcacgataggtattaccggc

SEQ ID NO: 21311 - DNA, 25 bp, E. coli
tacgcccgggaatatgacgaggaaa

SEQ ID NO: 21312 - DNA, 25 bp, E. coli
tacgcccgggaaaatgacgaggaaa

SEQ ID NO: 21313 - DNA, 25 bp, E. coli
tattaccggcctcatgcagggatgc

SEQ ID NO: 21314 - DNA, 25 bp, E. coli
tattaccggcctgatgcagggatgc

SEQ ID NO: 21315 - DNA, 25 bp, E. coli
ttcaatcctgaacaccgtgcgtacg

SEQ ID NO: 21316 - DNA, 25 bp, E. coli
ttaataaagattccgtcctgcaggc

SEQ ID NO: 21317 - DNA, 25 bp, E. coli
ttcaatcctgaagaccgtgcgtacg

SEQ ID NO: 21318 - DNA, 25 bp, E. coli
ttaataaagattgcgtcctgcaggc

SEQ ID NO: 21319 - DNA, 25 bp, E. coli
tgtacgaatggaattcacccgcggt

SEQ ID NO: 21320 - DNA, 25 bp, E. coli
tgtacgaatggatttcacccgcggt

SEQ ID NO: 21321 - DNA, 25 bp, E. coli
gacgaggaaacatcagaaaccgctg

SEQ ID NO: 21322 - DNA, 25 bp, E. coli
gacgaggaaacaacagaaaccgctg

SEQ ID NO: 21323 - DNA, 25 bp, E. coli
aattcagaaactgccacagccggac

SEQ ID NO: 21324 - DNA, 25 bp, E. coli
gaaccacaattctgaaactcccaca

SEQ ID NO: 21325 - DNA, 25 bp, E. coli
gaaccacaattcagaaactcccaca

SEQ ID NO: 21326 - DNA, 25 bp, E. coli
aattcagaaactcccacagccggac

SEQ ID NO: 21327 - DNA, 25 bp, E. coli
cacagccggaccaccggcactgtaa

SEQ ID NO: 21328 - DNA, 25 bp, E. coli
cacagatacgtacagaaagacattc

SEQ ID NO: 21329 - DNA, 25 bp, E. coli
cacagatacgtagagaaagacattc

SEQ ID NO: 21330 - DNA, 25 bp, E. coli
cagaaccacaattcagaaactccca

SEQ ID NO: 21331 - DNA, 25 bp, E. coli
cagaaccacaatacagaaactccca

SEQ ID NO: 21332 - DNA, 25 bp, E. coli
acagaaagacattcagggaacaaca

SEQ ID NO: 21333 - DNA, 25 bp, E. coli
acaattcagaaagtcccacagccgg

SEQ ID NO: 21334 - DNA, 25 bp, E. coli
acaattcagaaactcccacagccgg

SEQ ID NO: 21335 - DNA, 25 bp, E. coli
acagaaagacatacagggaacaaca

SEQ ID NO: 21336 - DNA, 25 bp, E. coli
cacagccggacctccggcactgtaa

SEQ ID NO: 21337 - DNA, 25 bp, E. coli
tgcacagatacgtacagaaagacat

SEQ ID NO: 21338 - DNA, 25 bp, E. coli
tgcacagatacgaacagaaagacat

SEQ ID NO: 21339 - DNA, 25 bp, E. coli
tcagggaacaactgaaccacaattc

SEQ ID NO: 21340 - DNA, 25 bp, E. coli
tcagggaacaacagaaccacaattc

SEQ ID NO: 21341 - DNA, 25 bp, E. coli
gaacaacagaacgacaattcagaaa

SEQ ID NO: 21342 - DNA, 25 bp, E. coli
gaacaacagaaccacaattcagaaa

SEQ ID NO: 21343 - DNA, 25 bp, E. coli
gggaacaacagatccacaattcaga

SEQ ID NO: 21344 - DNA, 25 bp, E. coli
gggaacaacagaaccacaattcaga

SEQ ID NO: 21345 - DNA, 25 bp, E. coli
aacggatgcgcgtacgtattcaggc

SEQ ID NO: 21346 - DNA, 25 bp, E. coli
caaagtgagcaggagcgattagcgc

SEQ ID NO: 21347 - DNA, 25 bp, E. coli
caaagtgagcagcagcgattagcgc

SEQ ID NO: 21348 - DNA, 25 bp, E. coli
acatccgaactggagggatcgctaa

SEQ ID NO: 21349 - DNA, 25 bp, E. coli
acatccgaactgcagggatcgctaa

SEQ ID NO: 21350 - DNA, 25 bp, E. coli
aacggatgcgcgaacgtattcaggc

SEQ ID NO: 21351 - DNA, 25 bp, E. coli
tgtgctgtttgttttaccgatctgg

SEQ ID NO: 21352 - DNA, 25 bp, E. coli
tgtgctgtttgtattaccgatctgg

SEQ ID NO: 21353 - DNA, 25 bp, E. coli
tgcagaacatcccaactggagggat

SEQ ID NO: 21354 - DNA, 25 bp, E. coli
tgcagaacatccgaactggagggat

SEQ ID NO: 21355 - DNA, 25 bp, E. coli
tctggtcgcagtgaattgtcgcaaa

SEQ ID NO: 21356 - DNA, 25 bp, E. coli
tctggtcgcagtcaattgtcgcaaa

SEQ ID NO: 21357 - DNA, 25 bp, E. coli
ccgatctggttaaggctgcattaca

SEQ ID NO: 21358 - DNA, 25 bp, E. coli
ccgatctggttatggctgcattaca

SEQ ID NO: 21359 - DNA, 25 bp, E. coli
gctgatgaagcaaaacggatgcgcg

SEQ ID NO: 21360 - DNA, 25 bp, E. coli
gctgatgaagcataacggatgcgcg

SEQ ID NO: 21361 - DNA, 25 bp, E. coli
gaattgtcgcaatgtgagcagcagc

SEQ ID NO: 21362 - DNA, 25 bp, E. coli
gaattgtcgcaaagtgagcagcagc

SEQ ID NO: 21363 - DNA, 25 bp, E. coli
cgattagcgcaactggctgatgaag

SEQ ID NO: 21364 - DNA, 25 bp, E. coli
cgattagcgcaagtggctgatgaag

SEQ ID NO: 21365 - DNA, 25 bp, E. coli
cattacagcaatggttctggtcgca

SEQ ID NO: 21366 - DNA, 25 bp, E. coli
cattacagcaatcgttctggtcgca

SEQ ID NO: 21367 - DNA, 25 bp, E. coli
atcggcgggcttgcctcccgtccgg

SEQ ID NO: 21368 - DNA, 25 bp, E. coli
atcggcgggcttccctcccgtccgg

SEQ ID NO: 21369 - DNA, 25 bp, E. coli
agtatgcccgggttgtgcgcgacgg

SEQ ID NO: 21370 - DNA, 25 bp, E. coli
agtatgcccgggatgtgcgcgacgg

SEQ ID NO: 21371 - DNA, 25 bp, E. coli
acattcggggagtcctgtgcaccgt

SEQ ID NO: 21372 - DNA, 25 bp, E. coli
acattcggggagacctgtgcaccgt

SEQ ID NO: 21373 - DNA, 25 bp, E. coli
ttatccggaccacgctgcacatgca

SEQ ID NO: 21374 - DNA, 25 bp, E. coli
ttatccggaccaggctgcacatgca

SEQ ID NO: 21375 - DNA, 25 bp, E. coli
ccaagaaaaactggaagtccacgct

SEQ ID NO: 21376 - DNA, 25 bp, E. coli
ccaggctgcacatgcactggcgatt

SEQ ID NO: 21377 - DNA, 25 bp, E. coli
ccaggctgcacaagcactggcgatt

SEQ ID NO: 21378 - DNA, 25 bp, E. coli
ccaagaaaaactcgaagtccacgct

SEQ ID NO: 21379 - DNA, 25 bp, E. coli
gaaaaactcgaactccacgctggct

SEQ ID NO: 21380 - DNA, 25 bp, E. coli
gaaaaactcgaagtccacgctggct

SEQ ID NO: 21381 - DNA, 25 bp, E. coli
ccgggatccccgatgagagtgtggt

SEQ ID NO: 21382 - DNA, 25 bp, E. coli
ccgggatccccgttgagagtgtggt

SEQ ID NO: 21383 - DNA, 25 bp, E. coli
gattcacggtgatcagcccctgatg

SEQ ID NO: 21384 - DNA, 25 bp, E. coli
gattcacggtgaacagcccctgatg

SEQ ID NO: 21385 - DNA, 25 bp, E. coli
gggtgctgattcacggtgatcagcc

SEQ ID NO: 21386 - DNA, 25 bp, E. coli
gggtgctgattctcggtgatcagcc

SEQ ID NO: 21387 - DNA, 25 bp, E. coli
ggaccaggctgctcatgcactggcg

SEQ ID NO: 21388 - DNA, 25 bp, E. coli
ggaccaggctgcacatgcactggcg

SEQ ID NO: 21389 - DNA, 25 bp, E. coli
cagctgctagataaagtcactccct

SEQ ID NO: 21390 - DNA, 25 bp, E. coli
cagctgctagattaagtcactccct

SEQ ID NO: 21391 - DNA, 25 bp, E. coli
tacagctgctagataaagtcactcc

SEQ ID NO: 21392 - DNA, 25 bp, E. coli
tacagctgctagttaaagtcactcc

SEQ ID NO: 21393 - DNA, 25 bp, E. coli
agctgctagatatagtcactccctc

SEQ ID NO: 21394 - DNA, 25 bp, E. coli
ctgctagataaactcactccctcac

SEQ ID NO: 21395 - DNA, 25 bp, E. coli
agctgctagataaagtcactccctc

SEQ ID NO: 21396 - DNA, 25 bp, E. coli
ctgctagataaagtcactccctcac

SEQ ID NO: 21397 - DNA, 25 bp, E. coli
acagctgctagataaagtcactccc

SEQ ID NO: 21398 - DNA, 25 bp, E. coli
acagctgctagaaaaagtcactccc

SEQ ID NO: 21399 - DNA, 25 bp, E. coli
tttacagctgctagataaagtcact

SEQ ID NO: 21400 - DNA, 25 bp, E. coli
tttacagctgcttgataaagtcact

SEQ ID NO: 21401 - DNA, 25 bp, E. coli
ttacagctgctagataaagtcactc

SEQ ID NO: 21402 - DNA, 25 bp, E. coli
ttacagctgctacataaagtcactc

SEQ ID NO: 21403 - DNA, 25 bp, E. coli
gctgctagataatgtcactccctca

SEQ ID NO: 21404 - DNA, 25 bp, E. coli
gctgctagataaagtcactccctca

SEQ ID NO: 21405 - DNA, 25 bp, E. coli
caattacgacgagaaaagctggcag

SEQ ID NO: 21406 - DNA, 25 bp, E. coli
aattaccgggcaagagaaacaagcg

SEQ ID NO: 21407 - DNA, 25 bp, E. coli
caattacgacgacaaaagctggcag

SEQ ID NO: 21408 - DNA, 25 bp, E. coli
aattaccgggcatgagaaacaagcg

SEQ ID NO: 21409 - DNA, 25 bp, E. coli
cagggctttttaggccagtggagca

SEQ ID NO: 21410 - DNA, 25 bp, E. coli
cagggctttttacgccagtggagca

SEQ ID NO: 21411 - DNA, 25 bp, E. coli
tatttatgctaaaccgctgctcgcg

SEQ ID NO: 21412 - DNA, 25 bp, E. coli
tatttatgctaatccgctgctcgcg

SEQ ID NO: 21413 - DNA, 25 bp, E. coli
tttatgcgctgggaaccgagacgtt

SEQ ID NO: 21414 - DNA, 25 bp, E. coli
tttatgcgctggcaaccgagacgtt

SEQ ID NO: 21415 - DNA, 25 bp, E. coli
tgattttaattagcgcaaccggcgg

SEQ ID NO: 21416 - DNA, 25 bp, E. coli
tgattttaattaccgcaaccggcgg

SEQ ID NO: 21417 - DNA, 25 bp, E. coli
tgcaacggctctttatcggcgaacc

SEQ ID NO: 21418 - DNA, 25 bp, E. coli
tgcaacggctctatatcggcgaacc

SEQ ID NO: 21419 - DNA, 25 bp, E. coli
ggaacaactcggctttacgctggcg

SEQ ID NO: 21420 - DNA, 25 bp, E. coli
tggattactacaccgccatgcaagt

SEQ ID NO: 21421 - DNA, 25 bp, E. coli
tggattactacagcgccatgcaagt

SEQ ID NO: 21422 - DNA, 25 bp, E. coli
ggaacaactcgggtttacgctggcg

SEQ ID NO: 21423 - DNA, 25 bp, E. coli
gagtcactattcgtgttcgccggtg

SEQ ID NO: 21424 - DNA, 25 bp, E. coli
gagtcactattcctgttcgccggtg

SEQ ID NO: 21425 - DNA, 25 bp, E. coli
gagcaaatcaaaataccgccgcagc

SEQ ID NO: 21426 - DNA, 25 bp, E. coli
gagcaaatcaaattaccgccgcagc

SEQ ID NO: 21427 - DNA, 25 bp, E. coli
catacgattgatgaccgtctgacga

SEQ ID NO: 21428 - DNA, 25 bp, E. coli
catacgattgatcaccgtctgacga

SEQ ID NO: 21429 - DNA, 25 bp, E. coli
tactgacacgggaactgatggcagg

SEQ ID NO: 21430 - DNA, 25 bp, E. coli
tactgacacgggtactgatggcagg

SEQ ID NO: 21431 - DNA, 25 bp, E. coli
aggtgatgaagttcagccccgggaa

SEQ ID NO: 21432 - DNA, 25 bp, E. coli
aggtgatgaagtacagccccgggaa

SEQ ID NO: 21433 - DNA, 25 bp, E. coli
aggcgttcaactcccgactgcgggt

SEQ ID NO: 21434 - DNA, 25 bp, E. coli
aggcgttcaactgccgactgcgggt

SEQ ID NO: 21435 - DNA, 25 bp, E. coli
tattgacgcatttttcaggcgagcc

SEQ ID NO: 21436 - DNA, 25 bp, E. coli
tattgacgcattattcaggcgagcc

SEQ ID NO: 21437 - DNA, 25 bp, E. coli
tgatggcaggtaacactcacccgga

SEQ ID NO: 21438 - DNA, 25 bp, E. coli
tgatggcaggtatcactcacccgga

SEQ ID NO: 21439 - DNA, 25 bp, E. coli
tctgactcactgacagcccgcgtgg

SEQ ID NO: 21440 - DNA, 25 bp, E. coli
tctggctcatttcctgtcgtcaggc

SEQ ID NO: 21441 - DNA, 25 bp, E. coli
tctggctcatttgctgtcgtcaggc

SEQ ID NO: 21442 - DNA, 25 bp, E. coli
tcgggtaattgcgtcaggtcgcgaa

SEQ ID NO: 21443 - DNA, 25 bp, E. coli
tctgactcactgtcagcccgcgtgg

SEQ ID NO: 21444 - DNA, 25 bp, E. coli
tcgggtaattgcctcaggtcgcgaa

SEQ ID NO: 21445 - DNA, 25 bp, E. coli
ggctccgggctgattcaggttctga

SEQ ID NO: 21446 - DNA, 25 bp, E. coli
ggctccgggctgtttcaggttctga

SEQ ID NO: 21447 - DNA, 25 bp, E. coli
gagccactggcaccgcatacgattg

SEQ ID NO: 21448 - DNA, 25 bp, E. coli
gagccactggcagcgcatacgattg

SEQ ID NO: 21449 - DNA, 25 bp, E. coli
agcgtggagtgttctggatataccc

SEQ ID NO: 21450 - DNA, 25 bp, E. coli
agcgtggagtgtactggatataccc

SEQ ID NO: 21451 - DNA, 25 bp, E. coli
aacgttctgttacatgaaatggccc

SEQ ID NO: 21452 - DNA, 25 bp, E. coli
aacgttctgttagatgaaatggccc

SEQ ID NO: 21453 - DNA, 25 bp, E. coli
tatctagacttatgtaaagcgtgga

SEQ ID NO: 21454 - DNA, 25 bp, E. coli
tatctagacttaagtaaagcgtgga

SEQ ID NO: 21455 - DNA, 25 bp, E. coli
ttttgactaaaaagcgccaggattg

SEQ ID NO: 21456 - DNA, 25 bp, E. coli
ttttgactaaaatgcgccaggattg

SEQ ID NO: 21457 - DNA, 25 bp, E. coli
tgacagggaaaagatgcgtaatact

SEQ ID NO: 21458 - DNA, 25 bp, E. coli
tgacagggaaaacatgcgtaatact

SEQ ID NO: 21459 - DNA, 25 bp, E. coli
gatagcggtgtatggaaacgttctg

SEQ ID NO: 21460 - DNA, 25 bp, E. coli
gaataatctggatgaatgacaggga

SEQ ID NO: 21461 - DNA, 25 bp, E. coli
gatagcggtgtaaggaaacgttctg

SEQ ID NO: 21462 - DNA, 25 bp, E. coli
gaataatctggaagaatgacaggga

SEQ ID NO: 21463 - DNA, 25 bp, E. coli
gaaatggcccgttagacatcacaaa

SEQ ID NO: 21464 - DNA, 25 bp, E. coli
gaaatggcccgtaagacatcacaaa

SEQ ID NO: 21465 - DNA, 25 bp, E. coli
cttacgcagttctctgaaaaagtga

SEQ ID NO: 21466 - DNA, 25 bp, E. coli
cttacgcagttcactgaaaaagtga

SEQ ID NO: 21467 - DNA, 25 bp, E. coli
ggatatacccaaagctggttgagca

SEQ ID NO: 21468 - DNA, 25 bp, E. coli
ggatatacccaatgctggttgagca

SEQ ID NO: 21469 - DNA, 25 bp, E. coli
tcacaaatcgcgtagagtttcccat

SEQ ID NO: 21470 - DNA, 25 bp, E. coli
tcacaaatcgcgaagagtttcccat

SEQ ID NO: 21471 - DNA, 25 bp, E. coli
caaccattgacggatagaaagctac

SEQ ID NO: 21472 - DNA, 25 bp, E. coli
caaccattgacgcatagaaagctac

SEQ ID NO: 21473 - DNA, 25 bp, E. coli
taaagcgctgcgattgcaatccgat

SEQ ID NO: 21474 - DNA, 25 bp, E. coli
taaagcgctgcgtttgcaatccgat

SEQ ID NO: 21475 - DNA, 25 bp, E. coli
tagaaacaccaatgtgctatgccgg

SEQ ID NO: 21476 - DNA, 25 bp, E. coli
tagaaacaccaaagtgctatgccgg

SEQ ID NO: 21477 - DNA, 25 bp, E. coli
tgaataccagtagccgtgagccaat

SEQ ID NO: 21478 - DNA, 25 bp, E. coli
tgaataccagtacccgtgagccaat

SEQ ID NO: 21479 - DNA, 25 bp, E. coli
cctacctgatggtaagcggcaaact

SEQ ID NO: 21480 - DNA, 25 bp, E. coli
cctacctgatggaaagcggcaaact

SEQ ID NO: 21481 - DNA, 25 bp, E. coli
gactgattatagacgtacggacacc

SEQ ID NO: 21482 - DNA, 25 bp, E. coli
gtacggacacctgaaattgccctgg

SEQ ID NO: 21483 - DNA, 25 bp, E. coli
gtacggacacctcaaattgccctgg

SEQ ID NO: 21484 - DNA, 25 bp, E. coli
ggtacgtatacatgcccaacagttc

SEQ ID NO: 21485 - DNA, 25 bp, E. coli
ggtacgtatacaagcccaacagttc

SEQ ID NO: 21486 - DNA, 25 bp, E. coli
taatatcctggaccggatctggccc

SEQ ID NO: 21487 - DNA, 25 bp, E. coli
taatatcctggagcggatctggccc

SEQ ID NO: 21488 - DNA, 25 bp, E. coli
gatggttcgacattcacgactacgc

SEQ ID NO: 21489 - DNA, 25 bp, E. coli
gatgaaaaacgtaactgcttccggc

SEQ ID NO: 21490 - DNA, 25 bp, E. coli
gactgattatagtcgtacggacacc

SEQ ID NO: 21491 - DNA, 25 bp, E. coli
gatgaaaaacgttactgcttccggc

SEQ ID NO: 21492 - DNA, 25 bp, E. coli
gatggttcgacaatcacgactacgc

SEQ ID NO: 21493 - DNA, 25 bp, E. coli
catgctggtgatcacgctggttgaa

SEQ ID NO: 21494 - DNA, 25 bp, E. coli
catgctggtgatgacgctggttgaa

SEQ ID NO: 21495 - DNA, 25 bp, E. coli
tacgttgtatgtggaactgttccgc

SEQ ID NO: 21496 - DNA, 25 bp, E. coli
tacgttgtatgtcgaactgttccgc

SEQ ID NO: 21497 - DNA, 25 bp, E. coli
ccacctatcttgcttggatctggag

SEQ ID NO: 21498 - DNA, 25 bp, E. coli
ccacctatcttggttggatctggag

SEQ ID NO: 21499 - DNA, 25 bp, E. coli
gcttatcgcgttttcgtcccgccga

SEQ ID NO: 21500 - DNA, 25 bp, E. coli
gctttgtcgatctgcgcctggatta

SEQ ID NO: 21501 - DNA, 25 bp, E. coli
gctttgtcgatcagcgcctggatta

SEQ ID NO: 21502 - DNA, 25 bp, E. coli
gcttatcgcgttatcgtcccgccga

SEQ ID NO: 21503 - DNA, 25 bp, E. coli
gaactgttccgcaacgtgccgttga

SEQ ID NO: 21504 - DNA, 25 bp, E. coli
gaactgttccgctacgtgccgttga

SEQ ID NO: 21505 - DNA, 25 bp, E. coli
gaaaatcggcatctggtttaaggcc

SEQ ID NO: 21506 - DNA, 25 bp, E. coli
gaaaatcggcatgtggtttaaggcc

SEQ ID NO: 21507 - DNA, 25 bp, E. coli
ccgtgtttgcgatcaggtacgcgcc

SEQ ID NO: 21508 - DNA, 25 bp, E. coli
ccgtgtttgcgaacaggtacgcgcc

SEQ ID NO: 21509 - DNA, 25 bp, E. coli
gtactgctgcctaatgcttatcgcg

SEQ ID NO: 21510 - DNA, 25 bp, E. coli
gattatcgctttcctcgtcggttca

SEQ ID NO: 21511 - DNA, 25 bp, E. coli
gattatcgctttgctcgtcggttca

SEQ ID NO: 21512 - DNA, 25 bp, E. coli
gtactgctgccttatgcttatcgcg

SEQ ID NO: 21513 - DNA, 25 bp, E. coli
tggttgaacgtaaagttcgcctgcc

SEQ ID NO: 21514 - DNA, 25 bp, E. coli
tggttgaacgtatagttcgcctgcc

SEQ ID NO: 21515 - DNA, 25 bp, E. coli
cagcttcggtttgtacgggtgacgc

SEQ ID NO: 21516 - DNA, 25 bp, E. coli
cagcttcggtttctacgggtgacgc

SEQ ID NO: 21517 - DNA, 25 bp, E. coli
tacgggtgacgctgtacgtcctgag

SEQ ID NO: 21518 - DNA, 25 bp, E. coli
tacgggtgacgcagtacgtcctgag

SEQ ID NO: 21519 - DNA, 25 bp, E. coli
taccctgctctttacgtacttctgc

SEQ ID NO: 21520 - DNA, 25 bp, E. coli
taccctgctcttaacgtacttctgc

SEQ ID NO: 21521 - DNA, 25 bp, E. coli
ttaagcgcgaaccaagtcgatgtgc

SEQ ID NO: 21522 - DNA, 25 bp, E. coli
ttaagcgcgaacgaagtcgatgtgc

SEQ ID NO: 21523 - DNA, 25 bp, E. coli
tgttcatgactttgtcgtgatccag

SEQ ID NO: 21524 - DNA, 25 bp, E. coli
tgtacgtcctgagctttaactttga

SEQ ID NO: 21525 - DNA, 25 bp, E. coli
tgtacgtcctgacctttaactttga

SEQ ID NO: 21526 - DNA, 25 bp, E. coli
tgttcatgacttagtcgtgatccag

SEQ ID NO: 21527 - DNA, 25 bp, E. coli
tctttgccaccgtagatgattgccg

SEQ ID NO: 21528 - DNA, 25 bp, E. coli
tctttaccgtcaacaacgatggtca

SEQ ID NO: 21529 - DNA, 25 bp, E. coli
tctttgccaccgaagatgattgccg

SEQ ID NO: 21530 - DNA, 25 bp, E. coli
tctttaccgtcatcaacgatggtca

SEQ ID NO: 21531 - DNA, 25 bp, E. coli
cgatggtcagaagttcgctgtagaa

SEQ ID NO: 21532 - DNA, 25 bp, E. coli
cgatggtcagaacttcgctgtagaa

SEQ ID NO: 21533 - DNA, 25 bp, E. coli
cgtacttctgcgttgatagtaaaca

SEQ ID NO: 21534 - DNA, 25 bp, E. coli
cgtacttctgcgatgatagtaaaca

SEQ ID NO: 21535 - DNA, 25 bp, E. coli
gatgattgccgggaacttgttagcg

SEQ ID NO: 21536 - DNA, 25 bp, E. coli
gatgattgccggcaacttgttagcg

SEQ ID NO: 21537 - DNA, 25 bp, E. coli
tacgtacagcgatccagttagcccg

SEQ ID NO: 21538 - DNA, 25 bp, E. coli
tacgtacagcgaaccagttagcccg

SEQ ID NO: 21539 - DNA, 25 bp, E. coli
taaacgagggctagagagcaagacc

SEQ ID NO: 21540 - DNA, 25 bp, E. coli
tacagttacgtgtggaaacccgaag

SEQ ID NO: 21541 - DNA, 25 bp, E. coli
tacagttacgtgaggaaacccgaag

SEQ ID NO: 21542 - DNA, 25 bp, E. coli
taaacgagggcttgagagcaagacc

SEQ ID NO: 21543 - DNA, 25 bp, E. coli
aacaaatcaaggaatggtcaccgcg

SEQ ID NO: 21544 - DNA, 25 bp, E. coli
aaaagataatgttctgccaccgcgg

SEQ ID NO: 21545 - DNA, 25 bp, E. coli
aacaaatcaaggtatggtcaccgcg

SEQ ID NO: 21546 - DNA, 25 bp, E. coli
aaaagataatgtactgccaccgcgg

SEQ ID NO: 21547 - DNA, 25 bp, E. coli
tgtgatcaatacaaccaaaggcggg

SEQ ID NO: 21548 - DNA, 25 bp, E. coli
tgtgatcaatactaccaaaggcggg

SEQ ID NO: 21549 - DNA, 25 bp, E. coli
tctcagattacgaaggcagcagtcg

SEQ ID NO: 21550 - DNA, 25 bp, E. coli
tctcagattacgtaggcagcagtcg

SEQ ID NO: 21551 - DNA, 25 bp, E. coli
gaagagtgcggataaccagcgtagc

SEQ ID NO: 21552 - DNA, 25 bp, E. coli
gaagagtgcggaaaaccagcgtagc

SEQ ID NO: 21553 - DNA, 25 bp, E. coli
ccgcgggttagaacgaatggttaca

SEQ ID NO: 21554 - DNA, 25 bp, E. coli
ccgcgggttagatcgaatggttaca

SEQ ID NO: 21555 - DNA, 25 bp, E. coli
gattatcgacaacatcagaaggcgt

SEQ ID NO: 21556 - DNA, 25 bp, E. coli
gattatcgacaagatcagaaggcgt

SEQ ID NO: 21557 - DNA, 25 bp, E. coli
taactggtggaatcaggctaaacgc

SEQ ID NO: 21558 - DNA, 25 bp, E. coli
taactggtggaaacaggctaaacgc

SEQ ID NO: 21559 - DNA, 25 bp, E. coli
cactctcggtgttggactggctacc

SEQ ID NO: 21560 - DNA, 25 bp, E. coli
cactctcggtgtaggactggctacc

SEQ ID NO: 21561 - DNA, 25 bp, E. coli
tacagatgttcagattgccgagcga

SEQ ID NO: 21562 - DNA, 25 bp, E. coli
tacagatgttcacattgccgagcga

SEQ ID NO: 21563 - DNA, 25 bp, E. coli
agacccgggttgtatccagtgccaa

SEQ ID NO: 21564 - DNA, 25 bp, E. coli
agacccgggttgaatccagtgccaa

SEQ ID NO: 21565 - DNA, 25 bp, E. coli
tggatccaggcttacgttctcaaag

SEQ ID NO: 21566 - DNA, 25 bp, E. coli
tcgcggttatgatggtgcagcagtc

SEQ ID NO: 21567 - DNA, 25 bp, E. coli
tgccgatgcagtgaaagccagaggt

SEQ ID NO: 21568 - DNA, 25 bp, E. coli
tgccgatgcagtcaaagccagaggt

SEQ ID NO: 21569 - DNA, 25 bp, E. coli
tcgcggttatgaaggtgcagcagtc

SEQ ID NO: 21570 - DNA, 25 bp, E. coli
tctgattggcatggccgcggatgca

SEQ ID NO: 21571 - DNA, 25 bp, E. coli
tctgattggcatcgccgcggatgca

SEQ ID NO: 21572 - DNA, 25 bp, E. coli
ctttgcgtcagggaacatcaggctc

SEQ ID NO: 21573 - DNA, 25 bp, E. coli
ctttgcgtcaggcaacatcaggctc

SEQ ID NO: 21574 - DNA, 25 bp, E. coli
gttatcagatcaagacttccccgga

SEQ ID NO: 21575 - DNA, 25 bp, E. coli
gttatcagatcatgacttccccgga

SEQ ID NO: 21576 - DNA, 25 bp, E. coli
tggaatcacagcgtacaataccggg

SEQ ID NO: 21577 - DNA, 25 bp, E. coli
tggatccaggctaacgttctcaaag

SEQ ID NO: 21578 - DNA, 25 bp, E. coli
tggaatcacagcctacaataccggg

SEQ ID NO: 21579 - DNA, 25 bp, E. coli
gagtggactacagggaaaaattgcc

SEQ ID NO: 21580 - DNA, 25 bp, E. coli
gagtggactacacggaaaaattgcc

SEQ ID NO: 21581 - DNA, 25 bp, E. coli
aattcgctggtggttattaataccg

SEQ ID NO: 21582 - DNA, 25 bp, E. coli
aattcgctggtgcttattaataccg

SEQ ID NO: 21583 - DNA, 25 bp, E. coli
tacagcagcgcaataaattcgctgg

SEQ ID NO: 21584 - DNA, 25 bp, E. coli
tacagcagcgcattaaattcgctgg

SEQ ID NO: 21585 - DNA, 25 bp, E. coli
taccgttctttctggttgctggctt

SEQ ID NO: 21586 - DNA, 25 bp, E. coli
taccgttctttcaggttgctggctt

SEQ ID NO: 21587 - DNA, 25 bp, E. coli
tatacagcagcggaataaattcgct

SEQ ID NO: 21588 - DNA, 25 bp, E. coli
tatacagcagcgcaataaattcgct

SEQ ID NO: 21589 - DNA, 25 bp, E. coli
ttctttcaggttcctggctttttcg

SEQ ID NO: 21590 - DNA, 25 bp, E. coli
ttctttcaggttgctggctttttcg

SEQ ID NO: 21591 - DNA, 25 bp, E. coli
gcgcaataaattggctggtggttat

SEQ ID NO: 21592 - DNA, 25 bp, E. coli
gcgcaataaattcgctggtggttat

SEQ ID NO: 21593 - DNA, 25 bp, E. coli
cgctggtggttattaataccgttct

SEQ ID NO: 21594 - DNA, 25 bp, E. coli
cgctggtggttaataataccgttct

SEQ ID NO: 21595 - DNA, 25 bp, E. coli
cgtaatatacaggagcgcaataaat

SEQ ID NO: 21596 - DNA, 25 bp, E. coli
cgtaatatacagcagcgcaataaat

SEQ ID NO: 21597 - DNA, 25 bp, E. coli
gtgtccgtaatatacagcagcgcaa

SEQ ID NO: 21598 - DNA, 25 bp, E. coli
gtccgtaatatacagcagcgcaata

SEQ ID NO: 21599 - DNA, 25 bp, E. coli
gtgtccgtaataaacagcagcgcaa

SEQ ID NO: 21600 - DNA, 25 bp, E. coli
gtccgtaatatagagcagcgcaata

SEQ ID NO: 21601 - DNA, 25 bp, E. coli
taataccgttctatcaggttgctgg

SEQ ID NO: 21602 - DNA, 25 bp, E. coli
taataccgttctttcaggttgctgg

SEQ ID NO: 21603 - DNA, 25 bp, E. coli
caatttcgataagatcttatgggcg

SEQ ID NO: 21604 - DNA, 25 bp, E. coli
caatttcgataacatcttatgggcg

SEQ ID NO: 21605 - DNA, 25 bp, E. coli
caggtacctcttttgctactgtcag

SEQ ID NO: 21606 - DNA, 25 bp, E. coli
caggtacctcttatgctactgtcag

SEQ ID NO: 21607 - DNA, 25 bp, E. coli
caggttgatattgtaaggaccagaa

SEQ ID NO: 21608 - DNA, 25 bp, E. coli
caggttgatattctaaggaccagaa

SEQ ID NO: 21609 - DNA, 25 bp, E. coli
tttttactacggcttcccatggtgg

SEQ ID NO: 21610 - DNA, 25 bp, E. coli
tttttactacgggttcccatggtgg

SEQ ID NO: 21611 - DNA, 25 bp, E. coli
tatgcaagagctaaatgtatttcgc

SEQ ID NO: 21612 - DNA, 25 bp, E. coli
tatgcaagagcttaatgtatttcgc

SEQ ID NO: 21613 - DNA, 25 bp, E. coli
tattgcctacatgggatgccttgga

SEQ ID NO: 21614 - DNA, 25 bp, E. coli
tattgagacagaagattcaggtacc

SEQ ID NO: 21615 - DNA, 25 bp, E. coli
tattgagacagatgattcaggtacc

SEQ ID NO: 21616 - DNA, 25 bp, E. coli
tattgcctacatcggatgccttgga

SEQ ID NO: 21617 - DNA, 25 bp, E. coli
tgtggaattattctttgtgccggca

SEQ ID NO: 21618 - DNA, 25 bp, E. coli
tgtggaattattgtttgtgccggca

SEQ ID NO: 21619 - DNA, 25 bp, E. coli
tgctactgtcaggagcgattgcgct

SEQ ID NO: 21620 - DNA, 25 bp, E. coli
tgctactgtcagcagcgattgcgct

SEQ ID NO: 21621 - DNA, 25 bp, E. coli
cttcccatggtgcattgtaggtgca

SEQ ID NO: 21622 - DNA, 25 bp, E. coli
cttcccatggtggattgtaggtgca

SEQ ID NO: 21623 - DNA, 25 bp, E. coli
ggtgcgctgctcaggagttcttcac

SEQ ID NO: 21624 - DNA, 25 bp, E. coli
ggtgcgctgctctggagttcttcac

SEQ ID NO: 21625 - DNA, 25 bp, E. coli
caattgctgcaacccctgtgggcgc

SEQ ID NO: 21626 - DNA, 25 bp, E. coli
caattgctgcaagccctgtgggcgc

SEQ ID NO: 21627 - DNA, 25 bp, E. coli
caactctgggtttcatgctcggcaa

SEQ ID NO: 21628 - DNA, 25 bp, E. coli
caactctgggttacatgctcggcaa

SEQ ID NO: 21629 - DNA, 25 bp, E. coli
actgctgccgaccattgccgggtta

SEQ ID NO: 21630 - DNA, 25 bp, E. coli
actgctgccgacgattgccgggtta

SEQ ID NO: 21631 - DNA, 25 bp, E. coli
acgattctgctgctgaccgttgccg

SEQ ID NO: 21632 - DNA, 25 bp, E. coli
aaactggctatcacatttacccgcg

SEQ ID NO: 21633 - DNA, 25 bp, E. coli
acgattctgctggtgaccgttgccg

SEQ ID NO: 21634 - DNA, 25 bp, E. coli
aaactggctatctcatttacccgcg

SEQ ID NO: 21635 - DNA, 25 bp, E. coli
tatcagggctgaataacgcgcgctt

SEQ ID NO: 21636 - DNA, 25 bp, E. coli
tatcagggctgattaacgcgcgctt

SEQ ID NO: 21637 - DNA, 25 bp, E. coli
ttgaaaacggcttgcttccggcggc

SEQ ID NO: 21638 - DNA, 25 bp, E. coli
ttgaaaacggctagcttccggcggc

SEQ ID NO: 21639 - DNA, 25 bp, E. coli
tttttaaagtacgaggaccagctga

SEQ ID NO: 21640 - DNA, 25 bp, E. coli
tttttaaagtaccaggaccagctga

SEQ ID NO: 21641 - DNA, 25 bp, E. coli
tgcgtttgtcagaacactgctgccg

SEQ ID NO: 21642 - DNA, 25 bp, E. coli
tgcgtttgtcagtacactgctgccg

SEQ ID NO: 21643 - DNA, 25 bp, E. coli
cgcgatgggctaaccgcaaacgatt

SEQ ID NO: 21644 - DNA, 25 bp, E. coli
cgcgatgggctatccgcaaacgatt

SEQ ID NO: 21645 - DNA, 25 bp, E. coli
tgtgggcgcaggtttttgaaaccct

SEQ ID NO: 21646 - DNA, 25 bp, E. coli
tgtgggcgcaggattttgaaaccct

SEQ ID NO: 21647 - DNA, 25 bp, E. coli
aaaattgtcgctcatggcagtgccc

SEQ ID NO: 21648 - DNA, 25 bp, E. coli
aaaattgtcgctgatggcagtgccc

SEQ ID NO: 21649 - DNA, 25 bp, E. coli
tatcctgccggcgattatcacgctg

SEQ ID NO: 21650 - DNA, 25 bp, E. coli
tatcctgccggccattatcacgctg

SEQ ID NO: 21651 - DNA, 25 bp, E. coli
gcctgtatacagtgcgcaaacggat

SEQ ID NO: 21652 - DNA, 25 bp, E. coli
gcctgtatacagagcgcaaacggat

SEQ ID NO: 21653 - DNA, 25 bp, E. coli
gcatcggtaaaacgacgctactccg

SEQ ID NO: 21654 - DNA, 25 bp, E. coli
gctactccgtctgattggcgggcaa

SEQ ID NO: 21655 - DNA, 25 bp, E. coli
gctactccgtctcattggcgggcaa

SEQ ID NO: 21656 - DNA, 25 bp, E. coli
gaatattccggccatgtctcgttcg

SEQ ID NO: 21657 - DNA, 25 bp, E. coli
gcatcggtaaaaggacgctactccg

SEQ ID NO: 21658 - DNA, 25 bp, E. coli
gaatattccggcgatgtctcgttcg

SEQ ID NO: 21659 - DNA, 25 bp, E. coli
gatttctgagctcaacagcgcgctg

SEQ ID NO: 21660 - DNA, 25 bp, E. coli
gatttctgagctgaacagcgcgctg

SEQ ID NO: 21661 - DNA, 25 bp, E. coli
gataatatttccgtgaccgtgccgc

SEQ ID NO: 21662 - DNA, 25 bp, E. coli
gataatatttccctgaccgtgccgc

SEQ ID NO: 21663 - DNA, 25 bp, E. coli
tggtggtttctcacgatgtgccgga

SEQ ID NO: 21664 - DNA, 25 bp, E. coli
tggtggtttctctcgatgtgccgga

SEQ ID NO: 21665 - DNA, 25 bp, E. coli
taagtattgcggttcacgcctggat

SEQ ID NO: 21666 - DNA, 25 bp, E. coli
taagtattgcggatcacgcctggat

SEQ ID NO: 21667 - DNA, 25 bp, E. coli
gatccgcgcgtacgtcagtttctgg

SEQ ID NO: 21668 - DNA, 25 bp, E. coli
gatccgcgcgtaggtcagtttctgg

SEQ ID NO: 21669 - DNA, 25 bp, E. coli
catgacggaacgataccgtatccgc

SEQ ID NO: 21670 - DNA, 25 bp, E. coli
catgacggaacgttaccgtatccgc

SEQ ID NO: 21671 - DNA, 25 bp, E. coli
tatgcagtttgcgatccatgacgga

SEQ ID NO: 21672 - DNA, 25 bp, E. coli
taggtgtgggcgattgtaacagcac

SEQ ID NO: 21673 - DNA, 25 bp, E. coli
taggtgtgggcgtttgtaacagcac

SEQ ID NO: 21674 - DNA, 25 bp, E. coli
tatgcagtttgccatccatgacgga

SEQ ID NO: 21675 - DNA, 25 bp, E. coli
tgatcatagcctcgtaatcgccgcc

SEQ ID NO: 21676 - DNA, 25 bp, E. coli
tgatcatagcctggtaatcgccgcc

SEQ ID NO: 21677 - DNA, 25 bp, E. coli
cctgtaggctacatgattctataga

SEQ ID NO: 21678 - DNA, 25 bp, E. coli
cctgtaggctacttgattctataga

SEQ ID NO: 21679 - DNA, 25 bp, E. coli
cgtatccgcctgattaggtgtgggc

SEQ ID NO: 21680 - DNA, 25 bp, E. coli
cgtatccgcctgtttaggtgtgggc

SEQ ID NO: 21681 - DNA, 25 bp, E. coli
gattgtaacagcacgtcaactgatg

SEQ ID NO: 21682 - DNA, 25 bp, E. coli
gattgtaacagctcgtcaactgatg

SEQ ID NO: 21683 - DNA, 25 bp, E. coli
gattctatagaaacagaaaaaggca

SEQ ID NO: 21684 - DNA, 25 bp, E. coli
gattctatagaatcagaaaaaggca

SEQ ID NO: 21685 - DNA, 25 bp, E. coli
gtcaactgatgtccagacgccctga

SEQ ID NO: 21686 - DNA, 25 bp, E. coli
gtcaactgatgtgcagacgccctga

SEQ ID NO: 21687 - DNA, 25 bp, E. coli
taatcgccgccctgtaggctacttg

SEQ ID NO: 21688 - DNA, 25 bp, E. coli
taatcgccgcccagtaggctacttg

SEQ ID NO: 21689 - DNA, 25 bp, E. coli
gacgccctgatttgctgatttgatc

SEQ ID NO: 21690 - DNA, 25 bp, E. coli
gacgccctgattagctgatttgatc

SEQ ID NO: 21691 - DNA, 25 bp, E. coli
aagagatggcgtttctgtgccgcga

SEQ ID NO: 21692 - DNA, 25 bp, E. coli
aagagatggcgtatctgtgccgcga

SEQ ID NO: 21693 - DNA, 25 bp, E. coli
tatgagaatctggatgcggttgccg

SEQ ID NO: 21694 - DNA, 25 bp, E. coli
tatgagaatctgcatgcggttgccg

SEQ ID NO: 21695 - DNA, 25 bp, E. coli
taccagattacatagcgggtcgacc

SEQ ID NO: 21696 - DNA, 25 bp, E. coli
taccagattacaaagcgggtcgacc

SEQ ID NO: 21697 - DNA, 25 bp, E. coli
tattgcccgctttcaaaccgatttg

SEQ ID NO: 21698 - DNA, 25 bp, E. coli
tattgcccgcttacaaaccgatttg

SEQ ID NO: 21699 - DNA, 25 bp, E. coli
tgaaaaccgcagaagcggctggcgt

SEQ ID NO: 21700 - DNA, 25 bp, E. coli
tgaaaaccgcagtagcggctggcgt

SEQ ID NO: 21701 - DNA, 25 bp, E. coli
tcgaccgccaatcccggaagagttg

SEQ ID NO: 21702 - DNA, 25 bp, E. coli
tcgaccgccaatgccggaagagttg

SEQ ID NO: 21703 - DNA, 25 bp, E. coli
gcatatcgacggcaatttacagcaa

SEQ ID NO: 21704 - DNA, 25 bp, E. coli
gcatatcgacgggaatttacagcaa

SEQ ID NO: 21705 - DNA, 25 bp, E. coli
gaatttggcgttgaaccgcagcagt

SEQ ID NO: 21706 - DNA, 25 bp, E. coli
gaatttggcgttcaaccgcagcagt

SEQ ID NO: 21707 - DNA, 25 bp, E. coli
gatcagcagttcaaaggtaccgggt

SEQ ID NO: 21708 - DNA, 25 bp, E. coli
gatcagcagttctaaggtaccgggt

SEQ ID NO: 21709 - DNA, 25 bp, E. coli
ggtcaaagtgactcaggccgggcat

SEQ ID NO: 21710 - DNA, 25 bp, E. coli
gggcatcaggcatcgattgtttcga

SEQ ID NO: 21711 - DNA, 25 bp, E. coli
ggtcaaagtgacacaggccgggcat

SEQ ID NO: 21712 - DNA, 25 bp, E. coli
gggcatcaggcaacgattgtttcga

SEQ ID NO: 21713 - DNA, 25 bp, E. coli
tacttttggcgaatcagccgcgttg

SEQ ID NO: 21714 - DNA, 25 bp, E. coli
tacttttggcgattcagccgcgttg

SEQ ID NO: 21715 - DNA, 25 bp, E. coli
agtgattggcctccatttactgcgc

SEQ ID NO: 21716 - DNA, 25 bp, E. coli
agtgattggcctgcatttactgcgc

SEQ ID NO: 21717 - DNA, 25 bp, E. coli
aacagcttcctgtggttcgctggcg

SEQ ID NO: 21718 - DNA, 25 bp, E. coli
aacagcttcctgaggttcgctggcg

SEQ ID NO: 21719 - DNA, 25 bp, E. coli
tagaaaatagccgtggtgagcctgt

SEQ ID NO: 21720 - DNA, 25 bp, E. coli
tagaaaatagccctggtgagcctgt

SEQ ID NO: 21721 - DNA, 25 bp, E. coli
tattggcgtaatcaacaccgtcgtt

SEQ ID NO: 21722 - DNA, 25 bp, E. coli
tattgaagacaaggcatttccgatg

SEQ ID NO: 21723 - DNA, 25 bp, E. coli
tattgaagacaacgcatttccgatg

SEQ ID NO: 21724 - DNA, 25 bp, E. coli
tattggcgtaatgaacaccgtcgtt

SEQ ID NO: 21725 - DNA, 25 bp, E. coli
tttctgatgtcaccgcggagcttgc

SEQ ID NO: 21726 - DNA, 25 bp, E. coli
tttctgatgtcagcgcggagcttgc

SEQ ID NO: 21727 - DNA, 25 bp, E. coli
ttggccgatcacgtcgcaacgttga

SEQ ID NO: 21728 - DNA, 25 bp, E. coli
ttggccgatcacctcgcaacgttga

SEQ ID NO: 21729 - DNA, 25 bp, E. coli
ttcgctggcgggttgtattgaagac

SEQ ID NO: 21730 - DNA, 25 bp, E. coli
ttcgctggcgggatgtattgaagac

SEQ ID NO: 21731 - DNA, 25 bp, E. coli
tccaggcagaagcaagctattcacc

SEQ ID NO: 21732 - DNA, 25 bp, E. coli
tccaggcagaaggaagctattcacc

SEQ ID NO: 21733 - DNA, 25 bp, E. coli
gattgcgactggtgttaaaacagct

SEQ ID NO: 21734 - DNA, 25 bp, E. coli
gattgcgactggagttaaaacagct

SEQ ID NO: 21735 - DNA, 25 bp, E. coli
caaaggtaaattcttaatcgagagc

SEQ ID NO: 21736 - DNA, 25 bp, E. coli
caaaggtaaattgttaatcgagagc

SEQ ID NO: 21737 - DNA, 25 bp, E. coli
agcaatcattactgcgctgatggtg

SEQ ID NO: 21738 - DNA, 25 bp, E. coli
agcaatcattacagcgctgatggtg

SEQ ID NO: 21739 - DNA, 25 bp, E. coli
aactggcaaacggttgttcaacgcc

SEQ ID NO: 21740 - DNA, 25 bp, E. coli
aactggcaaacgcttgttcaacgcc

SEQ ID NO: 21741 - DNA, 25 bp, E. coli
tatcgatcgtcgcttaactggcaaa

SEQ ID NO: 21742 - DNA, 25 bp, E. coli
tatcgatcgtcggttaactggcaaa

SEQ ID NO: 21743 - DNA, 25 bp, E. coli
ttgttcaacgcccagctttatccgc

SEQ ID NO: 21744 - DNA, 25 bp, E. coli
ttgttcaacgccgagctttatccgc

SEQ ID NO: 21745 - DNA, 25 bp, E. coli
tcgatcgtcgcttaactggcaaacg

SEQ ID NO: 21746 - DNA, 25 bp, E. coli
tcgatcgtcgctaaactggcaaacg

SEQ ID NO: 21747 - DNA, 25 bp, E. coli
gctgggagcaatgattactgcgctg

SEQ ID NO: 21748 - DNA, 25 bp, E. coli
gctgggagcaatcattactgcgctg

SEQ ID NO: 21749 - DNA, 25 bp, E. coli
gcaaacgcttgtacaacgcccagct

SEQ ID NO: 21750 - DNA, 25 bp, E. coli
gcaaacgcttgttcaacgcccagct

SEQ ID NO: 21751 - DNA, 25 bp, E. coli
cgtaccgtgctgaccgctgcaggtg

SEQ ID NO: 21752 - DNA, 25 bp, E. coli
cgtaccgtgctgtccgctgcaggtg

SEQ ID NO: 21753 - DNA, 25 bp, E. coli
ggatcgcgctgggagcaatcattac

SEQ ID NO: 21754 - DNA, 25 bp, E. coli
ggatcgcgctggcagcaatcattac

SEQ ID NO: 21755 - DNA, 25 bp, E. coli
gaccattatcgatcgtcgcttaact

SEQ ID NO: 21756 - DNA, 25 bp, E. coli
gaccattatcgaacgtcgcttaact

SEQ ID NO: 21757 - DNA, 25 bp, E. coli
gatatcggccttcagctttccatta

SEQ ID NO: 21758 - DNA, 25 bp, E. coli
gatatcggccttgagctttccatta

SEQ ID NO: 21759 - DNA, 25 bp, E. coli
atccgcgtgaaagcgtttattgccg

SEQ ID NO: 21760 - DNA, 25 bp, E. coli
atccgcgtgaaaccgtttattgccg

SEQ ID NO: 21761 - DNA, 25 bp, E. coli
actcatcacttgaagccgcgcagcg

SEQ ID NO: 21762 - DNA, 25 bp, E. coli
aaatccggcgcatgtggctggcgat

SEQ ID NO: 21763 - DNA, 25 bp, E. coli
actcatcacttgtagccgcgcagcg

SEQ ID NO: 21764 - DNA, 25 bp, E. coli
actggcatcgtattggcgtgcggca

SEQ ID NO: 21765 - DNA, 25 bp, E. coli
actggcatcgtaatggcgtgcggca

SEQ ID NO: 21766 - DNA, 25 bp, E. coli
aaatccggcgcaagtggctggcgat

SEQ ID NO: 21767 - DNA, 25 bp, E. coli
ttgaagccgcgctgcgcgacgtgac

SEQ ID NO: 21768 - DNA, 25 bp, E. coli
ttgaagccgcgcagcgcgacgtgac

SEQ ID NO: 21769 - DNA, 25 bp, E. coli
tctctgtttaaaggaagggcttggc

SEQ ID NO: 21770 - DNA, 25 bp, E. coli
tctctgtttaaacgaagggcttggc

SEQ ID NO: 21771 - DNA, 25 bp, E. coli
gctaactggatgtccatcatctgcg

SEQ ID NO: 21772 - DNA, 25 bp, E. coli
gctaactggatgaccatcatctgcg

SEQ ID NO: 21773 - DNA, 25 bp, E. coli
tggcgcaggcgcaaactggatgacc

SEQ ID NO: 21774 - DNA, 25 bp, E. coli
ggctggcgatttccatgcgcaaatc

SEQ ID NO: 21775 - DNA, 25 bp, E. coli
tggcgtgcggcacgccatttatcat

SEQ ID NO: 21776 - DNA, 25 bp, E. coli
tggcgcaggcgctaactggatgacc

SEQ ID NO: 21777 - DNA, 25 bp, E. coli
ggctggcgatttgcatgcgcaaatc

SEQ ID NO: 21778 - DNA, 25 bp, E. coli
tggcgtgcggcaggccatttatcat

SEQ ID NO: 21779 - DNA, 25 bp, E. coli
aataatgccctcaatgcggtgctcg

SEQ ID NO: 21780 - DNA, 25 bp, E. coli
caatggtcggctcgaaaagtctcta

SEQ ID NO: 21781 - DNA, 25 bp, E. coli
aataatgccctctatgcggtgctcg

SEQ ID NO: 21782 - DNA, 25 bp, E. coli
caatggtcggctggaaaagtctcta

SEQ ID NO: 21783 - DNA, 25 bp, E. coli
catttatatacacagcttcgcccgc

SEQ ID NO: 21784 - DNA, 25 bp, E. coli
catttatatacagagcttcgcccgc

SEQ ID NO: 21785 - DNA, 25 bp, E. coli
tatctgttatgcatgctggcaggct

SEQ ID NO: 21786 - DNA, 25 bp, E. coli
tatctgttatgcttgctggcaggct

SEQ ID NO: 21787 - DNA, 25 bp, E. coli
tgttgttggcagaactcggtacgct

SEQ ID NO: 21788 - DNA, 25 bp, E. coli
tgttgttggcagtactcggtacgct

SEQ ID NO: 21789 - DNA, 25 bp, E. coli
tggtcgcaggcggaacataatcctg

SEQ ID NO: 21790 - DNA, 25 bp, E. coli
tgagtggactcaaacaagaactggg

SEQ ID NO: 21791 - DNA, 25 bp, E. coli
tgagtggactcatacaagaactggg

SEQ ID NO: 21792 - DNA, 25 bp, E. coli
tcgacgtcattaataggcactggcg

SEQ ID NO: 21793 - DNA, 25 bp, E. coli
tcgacgtcattattaggcactggcg

SEQ ID NO: 21794 - DNA, 25 bp, E. coli
gctttagagatcaatctggacgctc

SEQ ID NO: 21795 - DNA, 25 bp, E. coli
gctttagagatctatctggacgctc

SEQ ID NO: 21796 - DNA, 25 bp, E. coli
gcaataacagcctgtgggcgtggcc

SEQ ID NO: 21797 - DNA, 25 bp, E. coli
gcaataacagccagtgggcgtggcc

SEQ ID NO: 21798 - DNA, 25 bp, E. coli
cgttctgttactcgcaatggtcggc

SEQ ID NO: 21799 - DNA, 25 bp, E. coli
cgttctgttactggcaatggtcggc

SEQ ID NO: 21800 - DNA, 25 bp, E. coli
tggtcgcaggcgcaacataatcctg

SEQ ID NO: 21801 - DNA, 25 bp, E. coli
atcatcacggcggtcatggtccagg

SEQ ID NO: 21802 - DNA, 25 bp, E. coli
acggcggtcatggtccaggcaaaca

SEQ ID NO: 21803 - DNA, 25 bp, E. coli
acggcggtcatgctccaggcaaaca

SEQ ID NO: 21804 - DNA, 25 bp, E. coli
atcatcacggcgctcatggtccagg

SEQ ID NO: 21805 - DNA, 25 bp, E. coli
atcacggcggtcatggtccaggcaa

SEQ ID NO: 21806 - DNA, 25 bp, E. coli
atcacggcggtcttggtccaggcaa

SEQ ID NO: 21807 - DNA, 25 bp, E. coli
tggtccaggcaatcatcaccgctaa

SEQ ID NO: 21808 - DNA, 25 bp, E. coli
tggtccaggcaaacatcaccgctaa

SEQ ID NO: 21809 - DNA, 25 bp, E. coli
tcatggtccagggaaacatcaccgc

SEQ ID NO: 21810 - DNA, 25 bp, E. coli
tcatcacggcggtcatggtccaggc

SEQ ID NO: 21811 - DNA, 25 bp, E. coli
tcatgatcatcagggcggtcatggt

SEQ ID NO: 21812 - DNA, 25 bp, E. coli
tcatggtccaggcaaacatcaccgc

SEQ ID NO: 21813 - DNA, 25 bp, E. coli
tcatcacggcggacatggtccaggc

SEQ ID NO: 21814 - DNA, 25 bp, E. coli
tcatgatcatcacggcggtcatggt

SEQ ID NO: 21815 - DNA, 25 bp, E. coli
gcggtcatggtcgaggcaaacatca

SEQ ID NO: 21816 - DNA, 25 bp, E. coli
gcggtcatggtccaggcaaacatca

SEQ ID NO: 21817 - DNA, 25 bp, E. coli
ggtcatggtccaggcaaacatcacc

SEQ ID NO: 21818 - DNA, 25 bp, E. coli
ggtcatggtccacgcaaacatcacc

SEQ ID NO: 21819 - DNA, 25 bp, E. coli
ggcggtcatggtgcaggcaaacatc

SEQ ID NO: 21820 - DNA, 25 bp, E. coli
ggcggtcatggtccaggcaaacatc

SEQ ID NO: 21821 - DNA, 25 bp, E. coli
tcacggcggtcatggtccaggcaaa

SEQ ID NO: 21822 - DNA, 25 bp, E. coli
tcacggcggtcaaggtccaggcaaa

SEQ ID NO: 21823 - DNA, 25 bp, E. coli
cacagcgacgtaaaaaacactggga

SEQ ID NO: 21824 - DNA, 25 bp, E. coli
cagaaaattacggattacctggacg

SEQ ID NO: 21825 - DNA, 25 bp, E. coli
cacagcgacgtataaaacactggga

SEQ ID NO: 21826 - DNA, 25 bp, E. coli
catttacagaaacttgtaacgcgtc

SEQ ID NO: 21827 - DNA, 25 bp, E. coli
cagaaaattacgcattacctggacg

SEQ ID NO: 21828 - DNA, 25 bp, E. coli
catttacagaaagttgtaacgcgtc

SEQ ID NO: 21829 - DNA, 25 bp, E. coli
aacactgggatgaaagtgatgtcgt

SEQ ID NO: 21830 - DNA, 25 bp, E. coli
aacactgggatgtaagtgatgtcgt

SEQ ID NO: 21831 - DNA, 25 bp, E. coli
tttatccatggtcatctgatgatgg

SEQ ID NO: 21832 - DNA, 25 bp, E. coli
ttacctatgccgttcaatttcacag

SEQ ID NO: 21833 - DNA, 25 bp, E. coli
ttacctatgccgatcaatttcacag

SEQ ID NO: 21834 - DNA, 25 bp, E. coli
tttatccatggtgatctgatgatgg

SEQ ID NO: 21835 - DNA, 25 bp, E. coli
cctggacgaaatgtacggtggaaca

SEQ ID NO: 21836 - DNA, 25 bp, E. coli
cctggacgaaatctacggtggaaca

SEQ ID NO: 21837 - DNA, 25 bp, E. coli
cgaaacgattaattacacagcgacg

SEQ ID NO: 21838 - DNA, 25 bp, E. coli
cgaaacgattaaatacacagcgacg

SEQ ID NO: 21839 - DNA, 25 bp, E. coli
gattatcatcagctcgccagtgaag

SEQ ID NO: 21840 - DNA, 25 bp, E. coli
gattatcatcaggtcgccagtgaag

SEQ ID NO: 21841 - DNA, 25 bp, E. coli
taacgcgtcttgagagtgcgaaacg

SEQ ID NO: 21842 - DNA, 25 bp, E. coli
taacgcgtcttgtgagtgcgaaacg

SEQ ID NO: 21843 - DNA, 25 bp, E. coli
gatgtcgtgttatttacctatgccg

SEQ ID NO: 21844 - DNA, 25 bp, E. coli
gatgtcgtgttaattacctatgccg

SEQ ID NO: 21845 - DNA, 25 bp, E. coli
taacgatggcttcctgcaactgcgc

SEQ ID NO: 21846 - DNA, 25 bp, E. coli
aactttcactgggaaggtgacgccc

SEQ ID NO: 21847 - DNA, 25 bp, E. coli
aactttcactggcaaggtgacgccc

SEQ ID NO: 21848 - DNA, 25 bp, E. coli
tagatatggcgctggtcaacaaaca

SEQ ID NO: 21849 - DNA, 25 bp, E. coli
tagatatggcgcaggtcaacaaaca

SEQ ID NO: 21850 - DNA, 25 bp, E. coli
ttttattaatatcgcgacaggcgga

SEQ ID NO: 21851 - DNA, 25 bp, E. coli
ttcctgaggcacaggataaggcgct

SEQ ID NO: 21852 - DNA, 25 bp, E. coli
ttcctgaggcactggataaggcgct

SEQ ID NO: 21853 - DNA, 25 bp, E. coli
ttttattaatatggcgacaggcgga

SEQ ID NO: 21854 - DNA, 25 bp, E. coli
tgggacgcgtataaccacagaaacg

SEQ ID NO: 21855 - DNA, 25 bp, E. coli
tgggacgcgtattaccacagaaacg

SEQ ID NO: 21856 - DNA, 25 bp, E. coli
tgccaccagtgttgggattcctgag

SEQ ID NO: 21857 - DNA, 25 bp, E. coli
tgccaccagtgtagggattcctgag

SEQ ID NO: 21858 - DNA, 25 bp, E. coli
tcattggtattggtaacgggcgtca

SEQ ID NO: 21859 - DNA, 25 bp, E. coli
tcattggtattgctaacgggcgtca

SEQ ID NO: 21860 - DNA, 25 bp, E. coli
gacaatctacccatgcgcgaagcaa

SEQ ID NO: 21861 - DNA, 25 bp, E. coli
gacaatctacccttgcgcgaagcaa

SEQ ID NO: 21862 - DNA, 25 bp, E. coli
gatactctgcaagcggaccgttgtg

SEQ ID NO: 21863 - DNA, 25 bp, E. coli
ggaattttgccaataggaaccgcca

SEQ ID NO: 21864 - DNA, 25 bp, E. coli
ggaattttgccattaggaaccgcca

SEQ ID NO: 21865 - DNA, 25 bp, E. coli
taacgatggcttgctgcaactgcgc

SEQ ID NO: 21866 - DNA, 25 bp, E. coli
gatactctgcaaccggaccgttgtg

SEQ ID NO: 21867 - DNA, 25 bp, E. coli
agcgtgttatacactttccctgcaa

SEQ ID NO: 21868 - DNA, 25 bp, E. coli
agcgtgttatactctttccctgcaa

SEQ ID NO: 21869 - DNA, 25 bp, E. coli
tttccctgcaatgggttccgtagca

SEQ ID NO: 21870 - DNA, 25 bp, E. coli
tttccctgcaatcggttccgtagca

SEQ ID NO: 21871 - DNA, 25 bp, E. coli
tgaacttgtggaaaaaatcacggtc

SEQ ID NO: 21872 - DNA, 25 bp, E. coli
tgaacttgtggataaaatcacggtc

SEQ ID NO: 21873 - DNA, 25 bp, E. coli
tccgtagcagggaaagagaccccgt

SEQ ID NO: 21874 - DNA, 25 bp, E. coli
tccgtagcagggtaagagaccccgt

SEQ ID NO: 21875 - DNA, 25 bp, E. coli
gcgtaatttattgacaagcttgcat

SEQ ID NO: 21876 - DNA, 25 bp, E. coli
gcgtaatttattcacaagcttgcat

SEQ ID NO: 21877 - DNA, 25 bp, E. coli
gaagcgccagaacatatcgattgag

SEQ ID NO: 21878 - DNA, 25 bp, E. coli
gaagcgccagaagatatcgattgag

SEQ ID NO: 21879 - DNA, 25 bp, E. coli
cccggtatttcaactctatgtcaca

SEQ ID NO: 21880 - DNA, 25 bp, E. coli
cccggtatttcatctctatgtcaca

SEQ ID NO: 21881 - DNA, 25 bp, E. coli
gataaaacagtgaatgataacctcg

SEQ ID NO: 21882 - DNA, 25 bp, E. coli
gataaaacagtgtatgataacctcg

SEQ ID NO: 21883 - DNA, 25 bp, E. coli
gttgttgctaccactgaagcgccag

SEQ ID NO: 21884 - DNA, 25 bp, E. coli
gttgttgctacctctgaagcgccag

SEQ ID NO: 21885 - DNA, 25 bp, E. coli
taagctctggcacagttgttgctac

SEQ ID NO: 21886 - DNA, 25 bp, E. coli
taacctcgttgcacttaagctctgg

SEQ ID NO: 21887 - DNA, 25 bp, E. coli
taagctctggcagagttgttgctac

SEQ ID NO: 21888 - DNA, 25 bp, E. coli
taacctcgttgctcttaagctctgg

SEQ ID NO: 21889 - DNA, 25 bp, E. coli
caacttatgctcgaatgacagcaca

SEQ ID NO: 21890 - DNA, 25 bp, E. coli
caacttatgctccaatgacagcaca

SEQ ID NO: 21891 - DNA, 25 bp, E. coli
catgccatcaaaggaacgttgcagg

SEQ ID NO: 21892 - DNA, 25 bp, E. coli
catgccatcaaacgaacgttgcagg

SEQ ID NO: 21893 - DNA, 25 bp, E. coli
taaatacagcagaaaaaacggcgtt

SEQ ID NO: 21894 - DNA, 25 bp, E. coli
taaatacagcagtaaaaacggcgtt

SEQ ID NO: 21895 - DNA, 25 bp, E. coli
aaataataaattcacaccaagcggg

SEQ ID NO: 21896 - DNA, 25 bp, E. coli
aaataataaattgacaccaagcggg

SEQ ID NO: 21897 - DNA, 25 bp, E. coli
tattattggcaaacagaactgggta

SEQ ID NO: 21898 - DNA, 25 bp, E. coli
tattattggcaatcagaactgggta

SEQ ID NO: 21899 - DNA, 25 bp, E. coli
tgcgaaatacaacctaaagatcatg

SEQ ID NO: 21900 - DNA, 25 bp, E. coli
tgcgaaatacaagctaaagatcatg

SEQ ID NO: 21901 - DNA, 25 bp, E. coli
tcagttgttggctgtccttgataat

SEQ ID NO: 21902 - DNA, 25 bp, E. coli
tcttaaataatatagccatgtggag

SEQ ID NO: 21903 - DNA, 25 bp, E. coli
tcagttgttggcagtccttgataat

SEQ ID NO: 21904 - DNA, 25 bp, E. coli
tcttaaataataaagccatgtggag

SEQ ID NO: 21905 - DNA, 25 bp, E. coli
gtcgggtcactaggccttaatgaaa

SEQ ID NO: 21906 - DNA, 25 bp, E. coli
gtcgggtcactacgccttaatgaaa

SEQ ID NO: 21907 - DNA, 25 bp, E. coli
cgttgcaggagttgataaatacagc

SEQ ID NO: 21908 - DNA, 25 bp, E. coli
cgttgcaggagtagataaatacagc

SEQ ID NO: 21909 - DNA, 25 bp, E. coli
ctcggcgatcggtttagaagttata

SEQ ID NO: 21910 - DNA, 25 bp, E. coli
ctcggcgatcggattagaagttata

SEQ ID NO: 21911 - DNA, 25 bp, E. coli
cagcaactggttcaaaagccattga

SEQ ID NO: 21912 - DNA, 25 bp, E. coli
catagtgagctagatcagatgcggt

SEQ ID NO: 21913 - DNA, 25 bp, E. coli
catagtgagctacatcagatgcggt

SEQ ID NO: 21914 - DNA, 25 bp, E. coli
cagcaactggttgaaaagccattga

SEQ ID NO: 21915 - DNA, 25 bp, E. coli
tgataaccgtcgatggtttgccgcc

SEQ ID NO: 21916 - DNA, 25 bp, E. coli
tgataaccgtcgttggtttgccgcc

SEQ ID NO: 21917 - DNA, 25 bp, E. coli
tgaaaagtaaaagcttctgtacctg

SEQ ID NO: 21918 - DNA, 25 bp, E. coli
tgaaaagtaaaaccttctgtacctg

SEQ ID NO: 21919 - DNA, 25 bp, E. coli
tctgtacctggctgattcacaccta

SEQ ID NO: 21920 - DNA, 25 bp, E. coli
tctgtacctggcagattcacaccta

SEQ ID NO: 21921 - DNA, 25 bp, E. coli
gctacatcagatccggtcgtacact

SEQ ID NO: 21922 - DNA, 25 bp, E. coli
gctacatcagatgcggtcgtacact

SEQ ID NO: 21923 - DNA, 25 bp, E. coli
cgcgctgtcagttttcgttttctga

SEQ ID NO: 21924 - DNA, 25 bp, E. coli
cgcgctgtcagtattcgttttctga

SEQ ID NO: 21925 - DNA, 25 bp, E. coli
gattcacacctaacatgataaccgt

SEQ ID NO: 21926 - DNA, 25 bp, E. coli
gattcacacctatcatgataaccgt

SEQ ID NO: 21927 - DNA, 25 bp, E. coli
gtaaaaccttctgtacctggctgat

SEQ ID NO: 21928 - DNA, 25 bp, E. coli
gtaaaaccttctctacctggctgat

SEQ ID NO: 21929 - DNA, 25 bp, E. coli
ggtcgtacacttgttcagcaactgg

SEQ ID NO: 21930 - DNA, 25 bp, E. coli
ggtcgtacacttcttcagcaactgg

SEQ ID NO: 21931 - DNA, 25 bp, E. coli
ggtttgccgccaaagtgagctacat

SEQ ID NO: 21932 - DNA, 25 bp, E. coli
ggtttgccgccatagtgagctacat

SEQ ID NO: 21933 - DNA, 25 bp, E. coli
tacgttggcctgctgatgctgagca

SEQ ID NO: 21934 - DNA, 25 bp, E. coli
tacgttggcctggtgatgctgagca

SEQ ID NO: 21935 - DNA, 25 bp, E. coli
tatgggcgcgctgaatcctgtagtc

SEQ ID NO: 21936 - DNA, 25 bp, E. coli
tatgggcgcgctcaatcctgtagtc

SEQ ID NO: 21937 - DNA, 25 bp, E. coli
tatacatcgagtctgcggcgggtac

SEQ ID NO: 21938 - DNA, 25 bp, E. coli
tatttgatgccaccggaactatccg

SEQ ID NO: 21939 - DNA, 25 bp, E. coli
tatacatcgagtgtgcggcgggtac

SEQ ID NO: 21940 - DNA, 25 bp, E. coli
tatttgatgccagcggaactatccg

SEQ ID NO: 21941 - DNA, 25 bp, E. coli
tgtttacggtaatttctgccacggg

SEQ ID NO: 21942 - DNA, 25 bp, E. coli
tgtttacggtaaattctgccacggg

SEQ ID NO: 21943 - DNA, 25 bp, E. coli
gctgagcaacgtggcgaaaatcgac

SEQ ID NO: 21944 - DNA, 25 bp, E. coli
gctgagcaacgtcgcgaaaatcgac

SEQ ID NO: 21945 - DNA, 25 bp, E. coli
gcaattcactgattggcagcctgga

SEQ ID NO: 21946 - DNA, 25 bp, E. coli
gcaattcactgaatggcagcctgga

SEQ ID NO: 21947 - DNA, 25 bp, E. coli
gaaaaactgaaactccctggtggca

SEQ ID NO: 21948 - DNA, 25 bp, E. coli
gaaaaactgaaagtccctggtggca

SEQ ID NO: 21949 - DNA, 25 bp, E. coli
cgcaagttgaacatcggtacggtcg

SEQ ID NO: 21950 - DNA, 25 bp, E. coli
cgcaagttgaacttcggtacggtcg

SEQ ID NO: 21951 - DNA, 25 bp, E. coli
cttctatgcgggtggctgggctatc

SEQ ID NO: 21952 - DNA, 25 bp, E. coli
ctatcgtgatgggtctgtgggctaa

SEQ ID NO: 21953 - DNA, 25 bp, E. coli
ctatcgtgatggctctgtgggctaa

SEQ ID NO: 21954 - DNA, 25 bp, E. coli
cttctatgcgggaggctgggctatc

SEQ ID NO: 21955 - DNA, 25 bp, E. coli
tactgtcagaacgaataaattattc

SEQ ID NO: 21956 - DNA, 25 bp, E. coli
tactgtcagaaccaataaattattc

SEQ ID NO: 21957 - DNA, 25 bp, E. coli
aaatgcttcatttgtcaggcttttt

SEQ ID NO: 21958 - DNA, 25 bp, E. coli
aaatgcttcattagtcaggcttttt

SEQ ID NO: 21959 - DNA, 25 bp, E. coli
tatcttattcgtactgtcagaacga

SEQ ID NO: 21960 - DNA, 25 bp, E. coli
tatcttattcgttctgtcagaacga

SEQ ID NO: 21961 - DNA, 25 bp, E. coli
tttaaaatgcttgatttgtcaggct

SEQ ID NO: 21962 - DNA, 25 bp, E. coli
tttaaaatgcttcatttgtcaggct

SEQ ID NO: 21963 - DNA, 25 bp, E. coli
tcaggcttttttgttatttttaatg

SEQ ID NO: 21964 - DNA, 25 bp, E. coli
tcaggcttttttcttatttttaatg

SEQ ID NO: 21965 - DNA, 25 bp, E. coli
tcttattcgtacagtcagaacgaat

SEQ ID NO: 21966 - DNA, 25 bp, E. coli
tcttattcgtactgtcagaacgaat

SEQ ID NO: 21967 - DNA, 25 bp, E. coli
gcatatcttattcgtactgtcagaa

SEQ ID NO: 21968 - DNA, 25 bp, E. coli
gcatatcttattggtactgtcagaa

SEQ ID NO: 21969 - DNA, 25 bp, E. coli
gcttcatttgtctggcttttttctt

SEQ ID NO: 21970 - DNA, 25 bp, E. coli
gcttcatttgtcaggcttttttctt

SEQ ID NO: 21971 - DNA, 25 bp, E. coli
ctgtcagaacgaataaattattcat

SEQ ID NO: 21972 - DNA, 25 bp, E. coli
cgtactgtcagatcgaataaattat

SEQ ID NO: 21973 - DNA, 25 bp, E. coli
ctgtcagaacgattaaattattcat

SEQ ID NO: 21974 - DNA, 25 bp, E. coli
cgtactgtcagaacgaataaattat

SEQ ID NO: 21975 - DNA, 25 bp, E. coli
tgaatgtttctgtttttaaaatgct

SEQ ID NO: 21976 - DNA, 25 bp, E. coli
tgaatgtttctgattttaaaatgct

SEQ ID NO: 21977 - DNA, 25 bp, E. coli
aatctggcaaggctgtttatctgac

SEQ ID NO: 21978 - DNA, 25 bp, E. coli
aatcagcacagtcttacaagacggg

SEQ ID NO: 21979 - DNA, 25 bp, E. coli
aatctggcaagggtgtttatctgac

SEQ ID NO: 21980 - DNA, 25 bp, E. coli
aatcagcacagtgttacaagacggg

SEQ ID NO: 21981 - DNA, 25 bp, E. coli
cacgacgctggtacattttgccgct

SEQ ID NO: 21982 - DNA, 25 bp, E. coli
cacgacgctggttcattttgccgct

SEQ ID NO: 21983 - DNA, 25 bp, E. coli
tatctgacctcgtaccctgtggaca

SEQ ID NO: 21984 - DNA, 25 bp, E. coli
tatttgcaggcagtcagcaggtcgc

SEQ ID NO: 21985 - DNA, 25 bp, E. coli
tatttgcaggcactcagcaggtcgc

SEQ ID NO: 21986 - DNA, 25 bp, E. coli
tatctgacctcgaaccctgtggaca

SEQ ID NO: 21987 - DNA, 25 bp, E. coli
ttaactggcctgtgagcgtcgacac

SEQ ID NO: 21988 - DNA, 25 bp, E. coli
ttaactggcctgagagcgtcgacac

SEQ ID NO: 21989 - DNA, 25 bp, E. coli
tgtggacacgtctaagcagaaatca

SEQ ID NO: 21990 - DNA, 25 bp, E. coli
tgtggacacgtcaaagcagaaatca

SEQ ID NO: 21991 - DNA, 25 bp, E. coli
tgctggcggacattggcgagtttaa

SEQ ID NO: 21992 - DNA, 25 bp, E. coli
tgctggcggacaatggcgagtttaa

SEQ ID NO: 21993 - DNA, 25 bp, E. coli
gacaccgatgcgtaaaaatgcgccg

SEQ ID NO: 21994 - DNA, 25 bp, E. coli
gacaccgatgcgaaaaaatgcgccg

SEQ ID NO: 21995 - DNA, 25 bp, E. coli
ggatattcaatattgccgccgttaa

SEQ ID NO: 21996 - DNA, 25 bp, E. coli
ggatattcaataatgccgccgttaa

SEQ ID NO: 21997 - DNA, 25 bp, E. coli
taagccgtgggaaggtaaggaatct

SEQ ID NO: 21998 - DNA, 25 bp, E. coli
taagccgtgggatggtaaggaatct

SEQ ID NO: 21999 - DNA, 25 bp, E. coli
cacaaagaagtggattccggcgagt

SEQ ID NO: 22000 - DNA, 25 bp, E. coli
caaatatgagaagtatcgcggcggc

SEQ ID NO: 22001 - DNA, 25 bp, E. coli
caaatatgagaactatcgcggcggc

SEQ ID NO: 22002 - DNA, 25 bp, E. coli
cacaaagaagtgcattccggcgagt

SEQ ID NO: 22003 - DNA, 25 bp, E. coli
taaagccacggtggatggcatccag

SEQ ID NO: 22004 - DNA, 25 bp, E. coli
taaagccacggtcgatggcatccag

SEQ ID NO: 22005 - DNA, 25 bp, E. coli
taccggctctattcagcgtgacgat

SEQ ID NO: 22006 - DNA, 25 bp, E. coli
taccggctctatacagcgtgacgat

SEQ ID NO: 22007 - DNA, 25 bp, E. coli
tccattggtggtactgaattgctgc

SEQ ID NO: 22008 - DNA, 25 bp, E. coli
tccattggtggttctgaattgctgc

SEQ ID NO: 22009 - DNA, 25 bp, E. coli
ccatcaatggtgaggtgctctatga

SEQ ID NO: 22010 - DNA, 25 bp, E. coli
ccatcaatggtgtggtgctctatga

SEQ ID NO: 22011 - DNA, 25 bp, E. coli
gctacgcgaagctgaccatcaatgg

SEQ ID NO: 22012 - DNA, 25 bp, E. coli
gctacgcgaagcagaccatcaatgg

SEQ ID NO: 22013 - DNA, 25 bp, E. coli
gcttgatgacagagcgctggacaca

SEQ ID NO: 22014 - DNA, 25 bp, E. coli
gcttgatgacagtgcgctggacaca

SEQ ID NO: 22015 - DNA, 25 bp, E. coli
gaagtggaccttatcaacatggtgg

SEQ ID NO: 22016 - DNA, 25 bp, E. coli
gaagtggaccttttcaacatggtgg

SEQ ID NO: 22017 - DNA, 25 bp, E. coli
gtttaacgacgggaacaactggcag

SEQ ID NO: 22018 - DNA, 25 bp, E. coli
gtttaacgacggcaacaactggcag

SEQ ID NO: 22019 - DNA, 25 bp, E. coli
gagtcgctgacggtgccgaaattta

SEQ ID NO: 22020 - DNA, 25 bp, E. coli
gagtcgctgacgctgccgaaattta

SEQ ID NO: 22021 - DNA, 25 bp, E. coli
taaaaccggcatgacctttgacgcc

SEQ ID NO: 22022 - DNA, 25 bp, E. coli
taaaaccggcatcacctttgacgcc

SEQ ID NO: 22023 - DNA, 25 bp, E. coli
tatgcagcgtcgtaatttgccaccg

SEQ ID NO: 22024 - DNA, 25 bp, E. coli
tatgcagcgtcgaaatttgccaccg

SEQ ID NO: 22025 - DNA, 25 bp, E. coli
tacctctggctgttgggcgatgaca

SEQ ID NO: 22026 - DNA, 25 bp, E. coli
tacctctggctgatgggcgatgaca

SEQ ID NO: 22027 - DNA, 25 bp, E. coli
ttgccgttaattttccgcgtctgga

SEQ ID NO: 22028 - DNA, 25 bp, E. coli
ttgccgttaattatccgcgtctgga

SEQ ID NO: 22029 - DNA, 25 bp, E. coli
tgcgtgtcaactccattaacccagg

SEQ ID NO: 22030 - DNA, 25 bp, E. coli
tgcgtgtcaactgcattaacccagg

SEQ ID NO: 22031 - DNA, 25 bp, E. coli
ccaccgaagggatgatgcaggtact

SEQ ID NO: 22032 - DNA, 25 bp, E. coli
ccaccgaagggaagatgcaggtact

SEQ ID NO: 22033 - DNA, 25 bp, E. coli
gaaaaattacgtgaggtagccagcc

SEQ ID NO: 22034 - DNA, 25 bp, E. coli
gaaaaattacgtcaggtagccagcc

SEQ ID NO: 22035 - DNA, 25 bp, E. coli
gacgtatgcacgctatggtgcgaca

SEQ ID NO: 22036 - DNA, 25 bp, E. coli
cgcattatcctgctgacgggagcca

SEQ ID NO: 22037 - DNA, 25 bp, E. coli
cgcattatcctggtgacgggagcca

SEQ ID NO: 22038 - DNA, 25 bp, E. coli
ggtagccagccagataaacgaagaa

SEQ ID NO: 22039 - DNA, 25 bp, E. coli
ggtagccagccacataaacgaagaa

SEQ ID NO: 22040 - DNA, 25 bp, E. coli
gatgaatatcaggagcgcctgcgtg

SEQ ID NO: 22041 - DNA, 25 bp, E. coli
gacgtatgcacggtatggtgcgaca

SEQ ID NO: 22042 - DNA, 25 bp, E. coli
gatgaatatcagcagcgcctgcgtg

SEQ ID NO: 22043 - DNA, 25 bp, E. coli
aagaaatccgccacatattgctgac

SEQ ID NO: 22044 - DNA, 25 bp, E. coli
aagaaatccgcctcatattgctgac

SEQ ID NO: 22045 - DNA, 25 bp, E. coli
aagattggctattacttgcgggtat

SEQ ID NO: 22046 - DNA, 25 bp, E. coli
aagattggctataacttgcgggtat

SEQ ID NO: 22047 - DNA, 25 bp, E. coli
aaaaggcggaagaaatccgcctcat

SEQ ID NO: 22048 - DNA, 25 bp, E. coli
aaaaagattggctataacttgcggg

SEQ ID NO: 22049 - DNA, 25 bp, E. coli
aaagattggctataacttgcgggta

SEQ ID NO: 22050 - DNA, 25 bp, E. coli
aaaaggcggaagtaatccgcctcat

SEQ ID NO: 22051 - DNA, 25 bp, E. coli
aaaaaagattgggtataacttgcgg

SEQ ID NO: 22052 - DNA, 25 bp, E. coli
aaagattggctaaaacttgcgggta

SEQ ID NO: 22053 - DNA, 25 bp, E. coli
aaaaaagattggctataacttgcgg

SEQ ID NO: 22054 - DNA, 25 bp, E. coli
aaaaagattggcaataacttgcggg

SEQ ID NO: 22055 - DNA, 25 bp, E. coli
gaagaaatccgcctcatattgctga

SEQ ID NO: 22056 - DNA, 25 bp, E. coli
gaagaaatccgcgtcatattgctga

SEQ ID NO: 22057 - DNA, 25 bp, E. coli
ctataacttgcgcgtatatgttggg

SEQ ID NO: 22058 - DNA, 25 bp, E. coli
ctataacttgcgggtatatgttggg

SEQ ID NO: 22059 - DNA, 25 bp, E. coli
gattggctataagttgcgggtatat

SEQ ID NO: 22060 - DNA, 25 bp, E. coli
gattggctataacttgcgggtatat

SEQ ID NO: 22061 - DNA, 25 bp, E. coli
ggcggaagaaatccgcctcatattg

SEQ ID NO: 22062 - DNA, 25 bp, E. coli
tggctataacttccgggtatatgtt

SEQ ID NO: 22063 - DNA, 25 bp, E. coli
ggcggaagaaatgcgcctcatattg

SEQ ID NO: 22064 - DNA, 25 bp, E. coli
tggctataacttgcgggtatatgtt

SEQ ID NO: 22065 - DNA, 25 bp, E. coli
agacaaccagctctgctcaggtagc

SEQ ID NO: 22066 - DNA, 25 bp, E. coli
agacaaccagctgtgctcaggtagc

SEQ ID NO: 22067 - DNA, 25 bp, E. coli
aaccgggaaagcacagatgctcgaa

SEQ ID NO: 22068 - DNA, 25 bp, E. coli
aaaacctgtcgttgtggctctggac

SEQ ID NO: 22069 - DNA, 25 bp, E. coli
aaccgggaaagctcagatgctcgaa

SEQ ID NO: 22070 - DNA, 25 bp, E. coli
aaaacctgtcgtagtggctctggac

SEQ ID NO: 22071 - DNA, 25 bp, E. coli
gccagacgaagaatccgtttaacta

SEQ ID NO: 22072 - DNA, 25 bp, E. coli
ccggaaaacctgacgttgtggctct

SEQ ID NO: 22073 - DNA, 25 bp, E. coli
gccagacgaagattccgtttaacta

SEQ ID NO: 22074 - DNA, 25 bp, E. coli
ccggaaaacctgtcgttgtggctct

SEQ ID NO: 22075 - DNA, 25 bp, E. coli
gctcgaatacaatgacaaccagctg

SEQ ID NO: 22076 - DNA, 25 bp, E. coli
gctcgaatacaaagacaaccagctg

SEQ ID NO: 22077 - DNA, 25 bp, E. coli
gaagaatccgttaaactataaagat

SEQ ID NO: 22078 - DNA, 25 bp, E. coli
gaagaatccgtttaactataaagat

SEQ ID NO: 22079 - DNA, 25 bp, E. coli
gcacagatgctccaatacaaagaca

SEQ ID NO: 22080 - DNA, 25 bp, E. coli
gaattgccagaccaagaatccgttt

SEQ ID NO: 22081 - DNA, 25 bp, E. coli
gcacagatgctcgaatacaaagaca

SEQ ID NO: 22082 - DNA, 25 bp, E. coli
gaattgccagacgaagaatccgttt

SEQ ID NO: 22083 - DNA, 25 bp, E. coli
ggctctggacaaacttaaaacctga

SEQ ID NO: 22084 - DNA, 25 bp, E. coli
ggctctggacaatcttaaaacctga

SEQ ID NO: 22085 - DNA, 25 bp, E. coli
ggcgttttcctgtactgagattgac

SEQ ID NO: 22086 - DNA, 25 bp, E. coli
ggcgttttcctgaactgagattgac

SEQ ID NO: 22087 - DNA, 25 bp, E. coli
aatcatgtcactgcgtcggccacgg

SEQ ID NO: 22088 - DNA, 25 bp, E. coli
aatcatgtcactccgtcggccacgg

SEQ ID NO: 22089 - DNA, 25 bp, E. coli
cagaggattttaatcatgtcactcc

SEQ ID NO: 22090 - DNA, 25 bp, E. coli
cagaggattttattcatgtcactcc

SEQ ID NO: 22091 - DNA, 25 bp, E. coli
agcccagaggatattaatcatgtca

SEQ ID NO: 22092 - DNA, 25 bp, E. coli
agcccagaggattttaatcatgtca

SEQ ID NO: 22093 - DNA, 25 bp, E. coli
tttaatcatgtcactccgtcggcca

SEQ ID NO: 22094 - DNA, 25 bp, E. coli
tttaatcatgtctctccgtcggcca

SEQ ID NO: 22095 - DNA, 25 bp, E. coli
ttaatcatgtcagtccgtcggccac

SEQ ID NO: 22096 - DNA, 25 bp, E. coli
ttaatcatgtcactccgtcggccac

SEQ ID NO: 22097 - DNA, 25 bp, E. coli
tcatgtcactccgtcggccacggaa

SEQ ID NO: 22098 - DNA, 25 bp, E. coli
tcatgtcactccctcggccacggaa

SEQ ID NO: 22099 - DNA, 25 bp, E. coli
gcccagaggattataatcatgtcac

SEQ ID NO: 22100 - DNA, 25 bp, E. coli
gcccagaggattttaatcatgtcac

SEQ ID NO: 22101 - DNA, 25 bp, E. coli
cccagaggattttaatcatgtcact

SEQ ID NO: 22102 - DNA, 25 bp, E. coli
cccagaggatttaaatcatgtcact

SEQ ID NO: 22103 - DNA, 25 bp, E. coli
gattttaatcatgtcactccgtcgg

SEQ ID NO: 22104 - DNA, 25 bp, E. coli
gattttaatcatctcactccgtcgg

SEQ ID NO: 22105 - DNA, 25 bp, E. coli
taatcatgtcactccgtcggccacg

SEQ ID NO: 22106 - DNA, 25 bp, E. coli
taatcatgtcacaccgtcggccacg

SEQ ID NO: 22107 - DNA, 25 bp, E. coli
gaggattttaatcatgtcactccgt

SEQ ID NO: 22108 - DNA, 25 bp, E. coli
gaggattttaatgatgtcactccgt

SEQ ID NO: 22109 - DNA, 25 bp, E. coli
caacatatcgactatgcacttggct

SEQ ID NO: 22110 - DNA, 25 bp, E. coli
aagaagcgattgctttgtatgaaca

SEQ ID NO: 22111 - DNA, 25 bp, E. coli
aagaagcgattggtttgtatgaaca

SEQ ID NO: 22112 - DNA, 25 bp, E. coli
caacatatcgacaatgcacttggct

SEQ ID NO: 22113 - DNA, 25 bp, E. coli
aggaggcaagagaaatgggcttcaa

SEQ ID NO: 22114 - DNA, 25 bp, E. coli
aggaggcaagagtaatgggcttcaa

SEQ ID NO: 22115 - DNA, 25 bp, E. coli
tagtgaatcggacatttgcgaactg

SEQ ID NO: 22116 - DNA, 25 bp, E. coli
tagtgaatcggagatttgcgaactg

SEQ ID NO: 22117 - DNA, 25 bp, E. coli
ccttaaaggcgaaggaggaggcaag

SEQ ID NO: 22118 - DNA, 25 bp, E. coli
ccttaaaggcgatggaggaggcaag

SEQ ID NO: 22119 - DNA, 25 bp, E. coli
gaacatttaggttttcaacatatcg

SEQ ID NO: 22120 - DNA, 25 bp, E. coli
gaacatttaggtattcaacatatcg

SEQ ID NO: 22121 - DNA, 25 bp, E. coli
cgaccgcttttttgaaagaagcgat

SEQ ID NO: 22122 - DNA, 25 bp, E. coli
cgaccgctttttagaaagaagcgat

SEQ ID NO: 22123 - DNA, 25 bp, E. coli
cgattggtttgtttgaacatttagg

SEQ ID NO: 22124 - DNA, 25 bp, E. coli
cattagcaggtagtgaatcggacat

SEQ ID NO: 22125 - DNA, 25 bp, E. coli
cgattggtttgtatgaacatttagg

SEQ ID NO: 22126 - DNA, 25 bp, E. coli
cattagcaggtactgaatcggacat

SEQ ID NO: 22127 - DNA, 25 bp, E. coli
ggattgcgccataagcaggtagtga

SEQ ID NO: 22128 - DNA, 25 bp, E. coli
ggattgcgccattagcaggtagtga

SEQ ID NO: 22129 - DNA, 25 bp, E. coli
ggcaagagaaatgggcttcaaacgc

SEQ ID NO: 22130 - DNA, 25 bp, E. coli
ggcaagagaaatcggcttcaaacgc

SEQ ID NO: 22131 - DNA, 25 bp, E. coli
caaggtcgagctcaatgtcagatac

SEQ ID NO: 22132 - DNA, 25 bp, E. coli
caaggtcgagctgaatgtcagatac

SEQ ID NO: 22133 - DNA, 25 bp, E. coli
tattacatcagtgatcaaggtcgag

SEQ ID NO: 22134 - DNA, 25 bp, E. coli
tattacatcagtcatcaaggtcgag

SEQ ID NO: 22135 - DNA, 25 bp, E. coli
ttagcgtggtggactttcatgcgac

SEQ ID NO: 22136 - DNA, 25 bp, E. coli
ttagcgtggtggtctttcatgcgac

SEQ ID NO: 22137 - DNA, 25 bp, E. coli
ttttactcgaagtagccaggactgt

SEQ ID NO: 22138 - DNA, 25 bp, E. coli
ttttactcgaagaagccaggactgt

SEQ ID NO: 22139 - DNA, 25 bp, E. coli
tgaagcagcactcgataagattggc

SEQ ID NO: 22140 - DNA, 25 bp, E. coli
tgaagcagcactggataagattggc

SEQ ID NO: 22141 - DNA, 25 bp, E. coli
tccacgaagagaatgggatgccccg

SEQ ID NO: 22142 - DNA, 25 bp, E. coli
tccacgaagagattgggatgccccg

SEQ ID NO: 22143 - DNA, 25 bp, E. coli
tctgggattccatcaggtaagactg

SEQ ID NO: 22144 - DNA, 25 bp, E. coli
tctgggattccaacaggtaagactg

SEQ ID NO: 22145 - DNA, 25 bp, E. coli
tctacagagacacggcgtgtactcc

SEQ ID NO: 22146 - DNA, 25 bp, E. coli
tcttccagactaggagttatggcac

SEQ ID NO: 22147 - DNA, 25 bp, E. coli
tctacagagacagggcgtgtactcc

SEQ ID NO: 22148 - DNA, 25 bp, E. coli
tcttccagactacgagttatggcac

SEQ ID NO: 22149 - DNA, 25 bp, E. coli
gaatgcagttgaatatccctgtggg

SEQ ID NO: 22150 - DNA, 25 bp, E. coli
gaatgcagttgattatccctgtggg

SEQ ID NO: 22151 - DNA, 25 bp, E. coli
gaaagttgagagatcccgagcagaa

SEQ ID NO: 22152 - DNA, 25 bp, E. coli
gaaagttgagagttcccgagcagaa

SEQ ID NO: 22153 - DNA, 25 bp, E. coli
caactatggctaagccgcggaacag

SEQ ID NO: 22154 - DNA, 25 bp, E. coli
cacgaccggttaacgctacactaaa

SEQ ID NO: 22155 - DNA, 25 bp, E. coli
cacgaccggttatcgctacactaaa

SEQ ID NO: 22156 - DNA, 25 bp, E. coli
caactatggctatgccgcggaacag

SEQ ID NO: 22157 - DNA, 25 bp, E. coli
aacacgctacggcagcatgaagagc

SEQ ID NO: 22158 - DNA, 25 bp, E. coli
aacacgctacgggagcatgaagagc

SEQ ID NO: 22159 - DNA, 25 bp, E. coli
tatcactctatactggcccggtgat

SEQ ID NO: 22160 - DNA, 25 bp, E. coli
tatcactctatagtggcccggtgat

SEQ ID NO: 22161 - DNA, 25 bp, E. coli
ttaacttccatttccgcgggctacg

SEQ ID NO: 22162 - DNA, 25 bp, E. coli
ttaacttccattaccgcgggctacg

SEQ ID NO: 22163 - DNA, 25 bp, E. coli
tgcctttgcggaaaatacgccggtc

SEQ ID NO: 22164 - DNA, 25 bp, E. coli
tgcctttgcggataatacgccggtc

SEQ ID NO: 22165 - DNA, 25 bp, E. coli
gctgactgagcatcttaatctcggg

SEQ ID NO: 22166 - DNA, 25 bp, E. coli
gctgactgagcaacttaatctcggg

SEQ ID NO: 22167 - DNA, 25 bp, E. coli
gcaatatgatttgcgtgcgtctgaa

SEQ ID NO: 22168 - DNA, 25 bp, E. coli
gcaatatgatttccgtgcgtctgaa

SEQ ID NO: 22169 - DNA, 25 bp, E. coli
ctgaacatttcaatgccactcgcgg

SEQ ID NO: 22170 - DNA, 25 bp, E. coli
ctgaacatttcattgccactcgcgg

SEQ ID NO: 22171 - DNA, 25 bp, E. coli
tggaataactggctgacaacccgaa

SEQ ID NO: 22172 - DNA, 25 bp, E. coli
ggcgtcgtgattatgaaactgaaca

SEQ ID NO: 22173 - DNA, 25 bp, E. coli
tggaataactgggtgacaacccgaa

SEQ ID NO: 22174 - DNA, 25 bp, E. coli
ggcgtcgtgattttgaaactgaaca

SEQ ID NO: 22175 - DNA, 25 bp, E. coli
actaaatcctggacgctggttcgcg

SEQ ID NO: 22176 - DNA, 25 bp, E. coli
actaaatcctggtcgctggttcgcg

SEQ ID NO: 22177 - DNA, 25 bp, E. coli
tatcggtgacgtggttgaaatccgc

SEQ ID NO: 22178 - DNA, 25 bp, E. coli
ttcgcgttgtagtgaaagcggttct

SEQ ID NO: 22179 - DNA, 25 bp, E. coli
ttcgcgttgtagagaaagcggttct

SEQ ID NO: 22180 - DNA, 25 bp, E. coli
tatcggtgacgtcgttgaaatccgc

SEQ ID NO: 22181 - DNA, 25 bp, E. coli
ttgaaatccgcgaatgccgtccgct

SEQ ID NO: 22182 - DNA, 25 bp, E. coli
ttgaaatccgcgtatgccgtccgct

SEQ ID NO: 22183 - DNA, 25 bp, E. coli
ttttgtgaaacacccgatctacggt

SEQ ID NO: 22184 - DNA, 25 bp, E. coli
ttttgtgaaacagccgatctacggt

SEQ ID NO: 22185 - DNA, 25 bp, E. coli
tgttagcgacaaaatggagaaatcc

SEQ ID NO: 22186 - DNA, 25 bp, E. coli
tgttagcgacaatatggagaaatcc

SEQ ID NO: 22187 - DNA, 25 bp, E. coli
tgccgtccgctgaccaagactaaat

SEQ ID NO: 22188 - DNA, 25 bp, E. coli
tgccgtccgctgtccaagactaaat

SEQ ID NO: 22189 - DNA, 25 bp, E. coli
gacgagaacaaccaatgcggtatcg

SEQ ID NO: 22190 - DNA, 25 bp, E. coli
gacgagaacaacgaatgcggtatcg

SEQ ID NO: 22191 - DNA, 25 bp, E. coli
ggtaaattcatctagcgtacgacca

SEQ ID NO: 22192 - DNA, 25 bp, E. coli
ggtaaattcatcaagcgtacgacca

SEQ ID NO: 22193 - DNA, 25 bp, E. coli
taaaatccgtactctgcaaggtcgc

SEQ ID NO: 22194 - DNA, 25 bp, E. coli
taaaatccgtacactgcaaggtcgc

SEQ ID NO: 22195 - DNA, 25 bp, E. coli
gaccaaactgcacgtacatgacgag

SEQ ID NO: 22196 - DNA, 25 bp, E. coli
gaccaaactgcaggtacatgacgag

SEQ ID NO: 22197 - DNA, 25 bp, E. coli
cagtggcaataaaacgacatatcca

SEQ ID NO: 22198 - DNA, 25 bp, E. coli
cagtggcaataatacgacatatcca

SEQ ID NO: 22199 - DNA, 25 bp, E. coli
tatggataacggcaaagggcttcgt

SEQ ID NO: 22200 - DNA, 25 bp, E. coli
tatggataacgggaaagggcttcgt

SEQ ID NO: 22201 - DNA, 25 bp, E. coli
tatttcagtctctcatcctgttgcg

SEQ ID NO: 22202 - DNA, 25 bp, E. coli
tatttcagtctcacatcctgttgcg

SEQ ID NO: 22203 - DNA, 25 bp, E. coli
ttcatataatcagtggcgcaaggag

SEQ ID NO: 22204 - DNA, 25 bp, E. coli
ttttgacgccaccaaacaaccgtgc

SEQ ID NO: 22205 - DNA, 25 bp, E. coli
ttcatataatcactggcgcaaggag

SEQ ID NO: 22206 - DNA, 25 bp, E. coli
ttttgacgccacgaaacaaccgtgc

SEQ ID NO: 22207 - DNA, 25 bp, E. coli
tcctgttgcgctgctgtcatgtgca

SEQ ID NO: 22208 - DNA, 25 bp, E. coli
tcctgttgcgctcctgtcatgtgca

SEQ ID NO: 22209 - DNA, 25 bp, E. coli
ccgtgcggcctattgataaagagct

SEQ ID NO: 22210 - DNA, 25 bp, E. coli
cctgattgggcttctggtggtgact

SEQ ID NO: 22211 - DNA, 25 bp, E. coli
ccgtgcggcctaatgataaagagct

SEQ ID NO: 22212 - DNA, 25 bp, E. coli
cctgattgggctactggtggtgact

SEQ ID NO: 22213 - DNA, 25 bp, E. coli
cattgtcaaaaaacatcactatggt

SEQ ID NO: 22214 - DNA, 25 bp, E. coli
cattgtcaaaaatcatcactatggt

SEQ ID NO: 22215 - DNA, 25 bp, E. coli
gtcatcaggtcccaaaataacgaga

SEQ ID NO: 22216 - DNA, 25 bp, E. coli
gtcatcaggtccgaaaataacgaga

SEQ ID NO: 22217 - DNA, 25 bp, E. coli
tcagcactcacaaataaaggaacgc

SEQ ID NO: 22218 - DNA, 25 bp, E. coli
tcagcactcacatataaaggaacgc

SEQ ID NO: 22219 - DNA, 25 bp, E. coli
catttactggcaggcagctggctac

SEQ ID NO: 22220 - DNA, 25 bp, E. coli
catttactggcacgcagctggctac

SEQ ID NO: 22221 - DNA, 25 bp, E. coli
aacttttccgcccttgtagtgcacg

SEQ ID NO: 22222 - DNA, 25 bp, E. coli
aacttttccgccgttgtagtgcacg

SEQ ID NO: 22223 - DNA, 25 bp, E. coli
tagcgaagtcatccgtttacaggcg

SEQ ID NO: 22224 - DNA, 25 bp, E. coli
tagcgaagtcatgcgtttacaggcg

SEQ ID NO: 22225 - DNA, 25 bp, E. coli
tatattgctgctcgccagggtagcg

SEQ ID NO: 22226 - DNA, 25 bp, E. coli
tatattgctgctggccagggtagcg

SEQ ID NO: 22227 - DNA, 25 bp, E. coli
tttaacgccagataccatcggcctg

SEQ ID NO: 22228 - DNA, 25 bp, E. coli
tttactctgccgtcgcgatgggcgg

SEQ ID NO: 22229 - DNA, 25 bp, E. coli
tttaacgccagaaaccatcggcctg

SEQ ID NO: 22230 - DNA, 25 bp, E. coli
tttactctgccgacgcgatgggcgg

SEQ ID NO: 22231 - DNA, 25 bp, E. coli
ccgttgaccgatccactggcgaata

SEQ ID NO: 22232 - DNA, 25 bp, E. coli
ccgttgaccgatgcactggcgaata

SEQ ID NO: 22233 - DNA, 25 bp, E. coli
gcattatgggagcaactacggcgtt

SEQ ID NO: 22234 - DNA, 25 bp, E. coli
gcattatgggaggaactacggcgtt

SEQ ID NO: 22235 - DNA, 25 bp, E. coli
gcacatgcggccaattacggtttta

SEQ ID NO: 22236 - DNA, 25 bp, E. coli
gcacatgcggcctattacggtttta

SEQ ID NO: 22237 - DNA, 25 bp, E. coli
cgaatacgtggcaaaagcagttccc

SEQ ID NO: 22238 - DNA, 25 bp, E. coli
cgaatacgtggctaaagcagttccc

SEQ ID NO: 22239 - DNA, 25 bp, E. coli
tggttttgcaatgcacgcgctggtt

SEQ ID NO: 22240 - DNA, 25 bp, E. coli
tggttttgcaatccacgcgctggtt

SEQ ID NO: 22241 - DNA, 25 bp, E. coli
cacgtcttcgtaaggagctaaggct

SEQ ID NO: 22242 - DNA, 25 bp, E. coli
cacgtcttcgtatggagctaaggct

SEQ ID NO: 22243 - DNA, 25 bp, E. coli
tactgcgcataccattaccgggtca

SEQ ID NO: 22244 - DNA, 25 bp, E. coli
tactgcgcatacgattaccgggtca

SEQ ID NO: 22245 - DNA, 25 bp, E. coli
actgttacgacatcgctccgatgga

SEQ ID NO: 22246 - DNA, 25 bp, E. coli
actgttacgacaacgctccgatgga

SEQ ID NO: 22247 - DNA, 25 bp, E. coli
taccgggtcatagaggagcagtttg

SEQ ID NO: 22248 - DNA, 25 bp, E. coli
taccgggtcatacaggagcagtttg

SEQ ID NO: 22249 - DNA, 25 bp, E. coli
ttaaggtggcacttatccgcactcg

SEQ ID NO: 22250 - DNA, 25 bp, E. coli
ttaaggtggcacatatccgcactcg

SEQ ID NO: 22251 - DNA, 25 bp, E. coli
taaggctacgctctaagcagaaacg

SEQ ID NO: 22252 - DNA, 25 bp, E. coli
taaggctacgctgtaagcagaaacg

SEQ ID NO: 22253 - DNA, 25 bp, E. coli
tcgcgaaacatatggaacccggcgg

SEQ ID NO: 22254 - DNA, 25 bp, E. coli
tcgcgaaacataaggaacccggcgg

SEQ ID NO: 22255 - DNA, 25 bp, E. coli
tctgatcgaggtacacagtactgcg

SEQ ID NO: 22256 - DNA, 25 bp, E. coli
tctgatcgaggttcacagtactgcg

SEQ ID NO: 22257 - DNA, 25 bp, E. coli
ccacacaggaggcatggttgtacct

SEQ ID NO: 22258 - DNA, 25 bp, E. coli
ccacacaggagggatggttgtacct

SEQ ID NO: 22259 - DNA, 25 bp, E. coli
gaaattgtcggcaacgccatgggag

SEQ ID NO: 22260 - DNA, 25 bp, E. coli
gaaattgtcggctacgccatgggag

SEQ ID NO: 22261 - DNA, 25 bp, E. coli
cggacctgacgtttgttgccacaca

SEQ ID NO: 22262 - DNA, 25 bp, E. coli
cggacctgacgtatgttgccacaca

SEQ ID NO: 22263 - DNA, 25 bp, E. coli
aatccggcgcgtgtcgccatcgtga

SEQ ID NO: 22264 - DNA, 25 bp, E. coli
aatcttcgaaatgctgaatgtcccg

SEQ ID NO: 22265 - DNA, 25 bp, E. coli
aatccggcgcgtctcgccatcgtga

SEQ ID NO: 22266 - DNA, 25 bp, E. coli
aatcttcgaaatcctgaatgtcccg

SEQ ID NO: 22267 - DNA, 25 bp, E. coli
cagcgtctgaatcactggcgcaaag

SEQ ID NO: 22268 - DNA, 25 bp, E. coli
cactgagcggtgacgatagcctcta

SEQ ID NO: 22269 - DNA, 25 bp, E. coli
cactgagcggtgtcgatagcctcta

SEQ ID NO: 22270 - DNA, 25 bp, E. coli
cagcgtctgaatgactggcgcaaag

SEQ ID NO: 22271 - DNA, 25 bp, E. coli
taccatgcagttggccgccgaaatc

SEQ ID NO: 22272 - DNA, 25 bp, E. coli
taccatgcagttcgccgccgaaatc

SEQ ID NO: 22273 - DNA, 25 bp, E. coli
tatcaggtgatttttgcgggcgcag

SEQ ID NO: 22274 - DNA, 25 bp, E. coli
tatcaggtgattattgcgggcgcag

SEQ ID NO: 22275 - DNA, 25 bp, E. coli
tgataaagaactgcaccagcgtctg

SEQ ID NO: 22276 - DNA, 25 bp, E. coli
tgataaagaactccaccagcgtctg

SEQ ID NO: 22277 - DNA, 25 bp, E. coli
tgaagtggtttctgctcaccgcacc

SEQ ID NO: 22278 - DNA, 25 bp, E. coli
tgaagtggtttcagctcaccgcacc

SEQ ID NO: 22279 - DNA, 25 bp, E. coli
tccaaaagcgacagggctaccatgc

SEQ ID NO: 22280 - DNA, 25 bp, E. coli
tccaaaagcgactgggctaccatgc

SEQ ID NO: 22281 - DNA, 25 bp, E. coli
gaatgtcccgcagcacgttgaagtg

SEQ ID NO: 22282 - DNA, 25 bp, E. coli
gaatgtcccgcaccacgttgaagtg

SEQ ID NO: 22283 - DNA, 25 bp, E. coli
gattggtaaagcaggcgcggcaaac

SEQ ID NO: 22284 - DNA, 25 bp, E. coli
gattggtaaagctggcgcggcaaac

SEQ ID NO: 22285 - DNA, 25 bp, E. coli
catcaaaatgaatccccggattggc

SEQ ID NO: 22286 - DNA, 25 bp, E. coli
catcaaaatgaaaccccggattggc

SEQ ID NO: 22287 - DNA, 25 bp, E. coli
tacatcaaaatgaatccccggattg

SEQ ID NO: 22288 - DNA, 25 bp, E. coli
tacatcaaaatgtatccccggattg

SEQ ID NO: 22289 - DNA, 25 bp, E. coli
atcaaaatgaatgcccggattggct

SEQ ID NO: 22290 - DNA, 25 bp, E. coli
atcaaaatgaatccccggattggct

SEQ ID NO: 22291 - DNA, 25 bp, E. coli
ttgcgcttccagctctacatcaaaa

SEQ ID NO: 22292 - DNA, 25 bp, E. coli
ttgcgcttccaggtctacatcaaaa

SEQ ID NO: 22293 - DNA, 25 bp, E. coli
tccaggtctacaacaaaatgaatcc

SEQ ID NO: 22294 - DNA, 25 bp, E. coli
tccaggtctacatcaaaatgaatcc

SEQ ID NO: 22295 - DNA, 25 bp, E. coli
tctacatcaaaaagaatccccggat

SEQ ID NO: 22296 - DNA, 25 bp, E. coli
tcttgcgcttcctggtctacatcaa

SEQ ID NO: 22297 - DNA, 25 bp, E. coli
tctacatcaaaatgaatccccggat

SEQ ID NO: 22298 - DNA, 25 bp, E. coli
tcttgcgcttccaggtctacatcaa

SEQ ID NO: 22299 - DNA, 25 bp, E. coli
gcttccaggtctacatcaaaatgaa

SEQ ID NO: 22300 - DNA, 25 bp, E. coli
gcgcttccaggtgtacatcaaaatg

SEQ ID NO: 22301 - DNA, 25 bp, E. coli
gcgcttccaggtctacatcaaaatg

SEQ ID NO: 22302 - DNA, 25 bp, E. coli
gcttccaggtcttcatcaaaatgaa

SEQ ID NO: 22303 - DNA, 25 bp, E. coli
cgcttccaggtcaacatcaaaatga

SEQ ID NO: 22304 - DNA, 25 bp, E. coli
cgcttccaggtctacatcaaaatga

SEQ ID NO: 22305 - DNA, 25 bp, E. coli
ggtctacatcaatatgaatccccgg

SEQ ID NO: 22306 - DNA, 25 bp, E. coli
ggtctacatcaaaatgaatccccgg

SEQ ID NO: 22307 - DNA, 25 bp, E. coli
caccgggtggttaatcgccacggca

SEQ ID NO: 22308 - DNA, 25 bp, E. coli
caccgggtggtttatcgccacggca

SEQ ID NO: 22309 - DNA, 25 bp, E. coli
cttcactcgggcctttttccagatt

SEQ ID NO: 22310 - DNA, 25 bp, E. coli
ctcaggaagaaatgatggaaaaaga

SEQ ID NO: 22311 - DNA, 25 bp, E. coli
ctcaggaagaaaagatggaaaaaga

SEQ ID NO: 22312 - DNA, 25 bp, E. coli
cttcactcgggcgtttttccagatt

SEQ ID NO: 22313 - DNA, 25 bp, E. coli
actcgggcgtttttccagattatgc

SEQ ID NO: 22314 - DNA, 25 bp, E. coli
actcgggcgtttatccagattatgc

SEQ ID NO: 22315 - DNA, 25 bp, E. coli
tatgtcaccacttacggtgatgtgg

SEQ ID NO: 22316 - DNA, 25 bp, E. coli
tatgtcaccactaacggtgatgtgg

SEQ ID NO: 22317 - DNA, 25 bp, E. coli
cttacggtgatgaggcgaaactggc

SEQ ID NO: 22318 - DNA, 25 bp, E. coli
cattactggcagtaggtgtgatggt

SEQ ID NO: 22319 - DNA, 25 bp, E. coli
cattactggcagaaggtgtgatggt

SEQ ID NO: 22320 - DNA, 25 bp, E. coli
cttacggtgatgtggcgaaactggc

SEQ ID NO: 22321 - DNA, 25 bp, E. coli
gggcgtttttccagattatgctgaa

SEQ ID NO: 22322 - DNA, 25 bp, E. coli
gggcgtttttcctgattatgctgaa

SEQ ID NO: 22323 - DNA, 25 bp, E. coli
tggaaaaagaagattcatttcccca

SEQ ID NO: 22324 - DNA, 25 bp, E. coli
tggaaaaagaagtttcatttcccca

SEQ ID NO: 22325 - DNA, 25 bp, E. coli
tggcaccgggtgcttaatcgccacg

SEQ ID NO: 22326 - DNA, 25 bp, E. coli
tggcaccgggtggttaatcgccacg

SEQ ID NO: 22327 - DNA, 25 bp, E. coli
gatgtggcgaaagtggcgggatcgc

SEQ ID NO: 22328 - DNA, 25 bp, E. coli
gatgtggcgaaactggcgggatcgc

SEQ ID NO: 22329 - DNA, 25 bp, E. coli
cagagactctttagtatggctttga

SEQ ID NO: 22330 - DNA, 25 bp, E. coli
cagagactcttttgtatggctttga

SEQ ID NO: 22331 - DNA, 25 bp, E. coli
tactctgggacagcctgaaactgaa

SEQ ID NO: 22332 - DNA, 25 bp, E. coli
tactctgggacaccctgaaactgaa

SEQ ID NO: 22333 - DNA, 25 bp, E. coli
tatggctttgataccgcttatcgag

SEQ ID NO: 22334 - DNA, 25 bp, E. coli
tatggctttgattccgcttatcgag

SEQ ID NO: 22335 - DNA, 25 bp, E. coli
tggtggaaatgctaatttcattgcc

SEQ ID NO: 22336 - DNA, 25 bp, E. coli
tggtggaaatgcaaatttcattgcc

SEQ ID NO: 22337 - DNA, 25 bp, E. coli
tgatgcagcaaccattactctggga

SEQ ID NO: 22338 - DNA, 25 bp, E. coli
tgaaactgaaacaccgactatatcg

SEQ ID NO: 22339 - DNA, 25 bp, E. coli
tgaaactgaaactccgactatatcg

SEQ ID NO: 22340 - DNA, 25 bp, E. coli
tgatgcagcaacgattactctggga

SEQ ID NO: 22341 - DNA, 25 bp, E. coli
ccggaaatatttatgctgatgatgc

SEQ ID NO: 22342 - DNA, 25 bp, E. coli
ccggaaatatttttgctgatgatgc

SEQ ID NO: 22343 - DNA, 25 bp, E. coli
gaaatatggcatgtgtcaccggaaa

SEQ ID NO: 22344 - DNA, 25 bp, E. coli
gactatatcgtctgcttatcaggca

SEQ ID NO: 22345 - DNA, 25 bp, E. coli
gactatatcgtcagcttatcaggca

SEQ ID NO: 22346 - DNA, 25 bp, E. coli
gaaatatggcatctgtcaccggaaa

SEQ ID NO: 22347 - DNA, 25 bp, E. coli
cttatcaggcatcggcagagactct

SEQ ID NO: 22348 - DNA, 25 bp, E. coli
cttatcaggcatgggcagagactct

SEQ ID NO: 22349 - DNA, 25 bp, E. coli
gataccgcttatcgaggcgcaataa

SEQ ID NO: 22350 - DNA, 25 bp, E. coli
gataccgcttatggaggcgcaataa

SEQ ID NO: 22351 - DNA, 25 bp, E. coli
catgccggacttgtcatagacgacg

SEQ ID NO: 22352 - DNA, 25 bp, E. coli
catgccggacttctcatagacgacg

SEQ ID NO: 22353 - DNA, 25 bp, E. coli
tgacgcatgccggacttctcataga

SEQ ID NO: 22354 - DNA, 25 bp, E. coli
tgacgcatgccgcacttctcataga

SEQ ID NO: 22355 - DNA, 25 bp, E. coli
tgccggacttctgatagacgacgag

SEQ ID NO: 22356 - DNA, 25 bp, E. coli
tgccggacttctcatagacgacgag

SEQ ID NO: 22357 - DNA, 25 bp, E. coli
tctcatagacgaggagcagtttgat

SEQ ID NO: 22358 - DNA, 25 bp, E. coli
tctcatagacgacgagcagtttgat

SEQ ID NO: 22359 - DNA, 25 bp, E. coli
gacttctcatagacgacgagcagtt

SEQ ID NO: 22360 - DNA, 25 bp, E. coli
gacttctcatagtcgacgagcagtt

SEQ ID NO: 22361 - DNA, 25 bp, E. coli
gcatgccggacttctcatagacgac

SEQ ID NO: 22362 - DNA, 25 bp, E. coli
gcatgccggactactcatagacgac

SEQ ID NO: 22363 - DNA, 25 bp, E. coli
cgcatgccggacatctcatagacga

SEQ ID NO: 22364 - DNA, 25 bp, E. coli
cgcatgccggacttctcatagacga

SEQ ID NO: 22365 - DNA, 25 bp, E. coli
ccggacttctcatagacgacgagca

SEQ ID NO: 22366 - DNA, 25 bp, E. coli
cttctcatagaccacgagcagtttg

SEQ ID NO: 22367 - DNA, 25 bp, E. coli
ccggacttctcaaagacgacgagca

SEQ ID NO: 22368 - DNA, 25 bp, E. coli
cttctcatagacgacgagcagtttg

SEQ ID NO: 22369 - DNA, 25 bp, E. coli
ggacttctcatagacgacgagcagt

SEQ ID NO: 22370 - DNA, 25 bp, E. coli
ggacttctcatacacgacgagcagt

SEQ ID NO: 22371 - DNA, 25 bp, E. coli
gacgcatgccggacttctcatagac

SEQ ID NO: 22372 - DNA, 25 bp, E. coli
gacgcatgccggtcttctcatagac

SEQ ID NO: 22373 - DNA, 25 bp, E. coli
ctaccgaaaactggcggaacatgcg

SEQ ID NO: 22374 - DNA, 25 bp, E. coli
cacctaccgaaatctggcggaacat

SEQ ID NO: 22375 - DNA, 25 bp, E. coli
ctaccgaaaactcgcggaacatgcg

SEQ ID NO: 22376 - DNA, 25 bp, E. coli
caaaaaatataggtggcaagcgcgc

SEQ ID NO: 22377 - DNA, 25 bp, E. coli
cacctaccgaaaactggcggaacat

SEQ ID NO: 22378 - DNA, 25 bp, E. coli
caaaaaatatagctggcaagcgcgc

SEQ ID NO: 22379 - DNA, 25 bp, E. coli
aaaatggcaaaggaccgctgctgtc

SEQ ID NO: 22380 - DNA, 25 bp, E. coli
aaaaatatagctcgcaagcgcgcgg

SEQ ID NO: 22381 - DNA, 25 bp, E. coli
aaaatggcaaagcaccgctgctgtc

SEQ ID NO: 22382 - DNA, 25 bp, E. coli
aactaacgccgttttatcagggtat

SEQ ID NO: 22383 - DNA, 25 bp, E. coli
aaaaatatagctggcaagcgcgcgg

SEQ ID NO: 22384 - DNA, 25 bp, E. coli
aactaacgccgtattatcagggtat

SEQ ID NO: 22385 - DNA, 25 bp, E. coli
tatcagggtattggcccggcatgga

SEQ ID NO: 22386 - DNA, 25 bp, E. coli
tatcagggtattcgcccggcatgga

SEQ ID NO: 22387 - DNA, 25 bp, E. coli
ccttgatattcaagatgaaaatggc

SEQ ID NO: 22388 - DNA, 25 bp, E. coli
ccttgatattcatgatgaaaatggc

SEQ ID NO: 22389 - DNA, 25 bp, E. coli
ccggcaaaaaatatagctggcaagc

SEQ ID NO: 22390 - DNA, 25 bp, E. coli
ccggcaaaaaatttagctggcaagc

SEQ ID NO: 22391 - DNA, 25 bp, E. coli
cgtattatcaggctattggcccggc

SEQ ID NO: 22392 - DNA, 25 bp, E. coli
cgtattatcagggtattggcccggc

SEQ ID NO: 22393 - DNA, 25 bp, E. coli
gtattggcccggcatggacgaaaga

SEQ ID NO: 22394 - DNA, 25 bp, E. coli
gtattggcccgggatggacgaaaga

SEQ ID NO: 22395 - DNA, 25 bp, E. coli
tacaacggtgaagtgggtgaatccg

SEQ ID NO: 22396 - DNA, 25 bp, E. coli
tacaacggtgaactgggtgaatccg

SEQ ID NO: 22397 - DNA, 25 bp, E. coli
ttccgggtgtgatgaaaccacgcgc

SEQ ID NO: 22398 - DNA, 25 bp, E. coli
ttccgggtgtgaagaaaccacgcgc

SEQ ID NO: 22399 - DNA, 25 bp, E. coli
tcatcgcggaacagaccggtcgtgg

SEQ ID NO: 22400 - DNA, 25 bp, E. coli
tcatcgcggaactgaccggtcgtgg

SEQ ID NO: 22401 - DNA, 25 bp, E. coli
tgaatccgtgctgcaggactgtctg

SEQ ID NO: 22402 - DNA, 25 bp, E. coli
tgaatccgtgctccaggactgtctg

SEQ ID NO: 22403 - DNA, 25 bp, E. coli
tctggatgattagggccaccgcgtg

SEQ ID NO: 22404 - DNA, 25 bp, E. coli
tctggatgattacggccaccgcgtg

SEQ ID NO: 22405 - DNA, 25 bp, E. coli
gactggtgcgcatacgcgttctgat

SEQ ID NO: 22406 - DNA, 25 bp, E. coli
gactggtgcgcaaacgcgttctgat

SEQ ID NO: 22407 - DNA, 25 bp, E. coli
gatttcattactgaagatcagcgtc

SEQ ID NO: 22408 - DNA, 25 bp, E. coli
gttcacacccacattgcctggcttg

SEQ ID NO: 22409 - DNA, 25 bp, E. coli
gattaacggttaattcatcgcggaa

SEQ ID NO: 22410 - DNA, 25 bp, E. coli
gatttcattactcaagatcagcgtc

SEQ ID NO: 22411 - DNA, 25 bp, E. coli
gatcagcgtctgctcattctgcggt

SEQ ID NO: 22412 - DNA, 25 bp, E. coli
gttcacacccactttgcctggcttg

SEQ ID NO: 22413 - DNA, 25 bp, E. coli
gatcagcgtctggtcattctgcggt

SEQ ID NO: 22414 - DNA, 25 bp, E. coli
gattaacggttatttcatcgcggaa

SEQ ID NO: 22415 - DNA, 25 bp, E. coli
ggtcgctggcagtttacaacggtga

SEQ ID NO: 22416 - DNA, 25 bp, E. coli
ggtcgctggcagattacaacggtga

SEQ ID NO: 22417 - DNA, 25 bp, E. coli
cacatctggctcagtagacagggtg

SEQ ID NO: 22418 - DNA, 25 bp, E. coli
cacatctggctctgtagacagggtg

SEQ ID NO: 22419 - DNA, 25 bp, E. coli
cattgctgatgcttgatattgagca

SEQ ID NO: 22420 - DNA, 25 bp, E. coli
catctggctctgtagacagggtggt

SEQ ID NO: 22421 - DNA, 25 bp, E. coli
catctggctctgaagacagggtggt

SEQ ID NO: 22422 - DNA, 25 bp, E. coli
taaacatctcatagctgatgcttga

SEQ ID NO: 22423 - DNA, 25 bp, E. coli
taaacatctcattgctgatgcttga

SEQ ID NO: 22424 - DNA, 25 bp, E. coli
ttcacatctggcactgtagacaggg

SEQ ID NO: 22425 - DNA, 25 bp, E. coli
ttcacatctggctctgtagacaggg

SEQ ID NO: 22426 - DNA, 25 bp, E. coli
tttactcatcatccttcacatctgg

SEQ ID NO: 22427 - DNA, 25 bp, E. coli
tttactcatcatgcttcacatctgg

SEQ ID NO: 22428 - DNA, 25 bp, E. coli
tccttcacatctcgctctgtagaca

SEQ ID NO: 22429 - DNA, 25 bp, E. coli
tccttcacatctggctctgtagaca

SEQ ID NO: 22430 - DNA, 25 bp, E. coli
tcatcatccttctcatctggctctg

SEQ ID NO: 22431 - DNA, 25 bp, E. coli
tcatccttcacatctggctctgtag

SEQ ID NO: 22432 - DNA, 25 bp, E. coli
tcatccttcacaactggctctgtag

SEQ ID NO: 22433 - DNA, 25 bp, E. coli
tcatcatccttcacatctggctctg

SEQ ID NO: 22434 - DNA, 25 bp, E. coli
gcttgatattgaccatctggcgcgc

SEQ ID NO: 22435 - DNA, 25 bp, E. coli
gcttgatattgagcatctggcgcgc

SEQ ID NO: 22436 - DNA, 25 bp, E. coli
cattgctgatgcatgatattgagca

SEQ ID NO: 22437 - DNA, 25 bp, E. coli
taattttactcatcatccttcacat

SEQ ID NO: 22438 - DNA, 25 bp, E. coli
taattttactcaacatccttcacat

SEQ ID NO: 22439 - DNA, 25 bp, E. coli
catcagaaagcgagaaagggctgcg

SEQ ID NO: 22440 - DNA, 25 bp, E. coli
catcagaaagcgtgaaagggctgcg

SEQ ID NO: 22441 - DNA, 25 bp, E. coli
tacaccaaagcctcgggatcgatgt

SEQ ID NO: 22442 - DNA, 25 bp, E. coli
tacaccaaagccacgggatcgatgt

SEQ ID NO: 22443 - DNA, 25 bp, E. coli
tactacttgattggcgcctttgaca

SEQ ID NO: 22444 - DNA, 25 bp, E. coli
tactacttgattcgcgcctttgaca

SEQ ID NO: 22445 - DNA, 25 bp, E. coli
tttggcaactcgcttgatgacctgg

SEQ ID NO: 22446 - DNA, 25 bp, E. coli
tttggcaactcggttgatgacctgg

SEQ ID NO: 22447 - DNA, 25 bp, E. coli
gcggcccacgcgaagacatcattgg

SEQ ID NO: 22448 - DNA, 25 bp, E. coli
gctaaaagcatgactgcggttctcg

SEQ ID NO: 22449 - DNA, 25 bp, E. coli
gctaaaagcatgtctgcggttctcg

SEQ ID NO: 22450 - DNA, 25 bp, E. coli
gcggcccacgcgtagacatcattgg

SEQ ID NO: 22451 - DNA, 25 bp, E. coli
gacatcattggcagcatagagaact

SEQ ID NO: 22452 - DNA, 25 bp, E. coli
gacatcattggctgcatagagaact

SEQ ID NO: 22453 - DNA, 25 bp, E. coli
ctttttacgcaaccgcagactggcg

SEQ ID NO: 22454 - DNA, 25 bp, E. coli
ctttttacgcaagcgcagactggcg

SEQ ID NO: 22455 - DNA, 25 bp, E. coli
gattagcctaccatcagaaagcgtg

SEQ ID NO: 22456 - DNA, 25 bp, E. coli
gattagcctaccttcagaaagcgtg

SEQ ID NO: 22457 - DNA, 25 bp, E. coli
ggaaatcagtgtacccctacaccaa

SEQ ID NO: 22458 - DNA, 25 bp, E. coli
ggaaatcagtgttcccctacaccaa

SEQ ID NO: 22459 - DNA, 25 bp, E. coli
gatgacctggattgctactacttga

SEQ ID NO: 22460 - DNA, 25 bp, E. coli
gatgacctggatagctactacttga

SEQ ID NO: 22461 - DNA, 25 bp, E. coli
ttgtttttgatcaggcggaaaaccg

SEQ ID NO: 22462 - DNA, 25 bp, E. coli
ttgtttttgatctggcggaaaaccg

SEQ ID NO: 22463 - DNA, 25 bp, E. coli
tggttacggaatcccgcgccctggc

SEQ ID NO: 22464 - DNA, 25 bp, E. coli
tgcagttgaccggtaacccggaggt

SEQ ID NO: 22465 - DNA, 25 bp, E. coli
tgcagttgaccgctaacccggaggt

SEQ ID NO: 22466 - DNA, 25 bp, E. coli
tgccgccagcattgtttttgatcag

SEQ ID NO: 22467 - DNA, 25 bp, E. coli
tgccgccagcatagtttttgatcag

SEQ ID NO: 22468 - DNA, 25 bp, E. coli
tcaggtgaacaggaagatgatgcag

SEQ ID NO: 22469 - DNA, 25 bp, E. coli
tcaggtgaacagcaagatgatgcag

SEQ ID NO: 22470 - DNA, 25 bp, E. coli
gaagctgcgctggttacggaatgcc

SEQ ID NO: 22471 - DNA, 25 bp, E. coli
gcaagatgatgctgttgaccggtaa

SEQ ID NO: 22472 - DNA, 25 bp, E. coli
gcaagatgatgcagttgaccggtaa

SEQ ID NO: 22473 - DNA, 25 bp, E. coli
gaagctgcgctgcttacggaatgcc

SEQ ID NO: 22474 - DNA, 25 bp, E. coli
cgcttggcaagataatggcggaaga

SEQ ID NO: 22475 - DNA, 25 bp, E. coli
cgcttggcaagaaaatggcggaaga

SEQ ID NO: 22476 - DNA, 25 bp, E. coli
ggaggtcaaattcctccactgcctg

SEQ ID NO: 22477 - DNA, 25 bp, E. coli
ggaggtcaaattgctccactgcctg

SEQ ID NO: 22478 - DNA, 25 bp, E. coli
tggttacggaatgccgcgccctggc

SEQ ID NO: 22479 - DNA, 25 bp, E. coli
gatgaggtcttccaatctgccgcca

SEQ ID NO: 22480 - DNA, 25 bp, E. coli
gaccaaacgacggttggcaagaaaa

SEQ ID NO: 22481 - DNA, 25 bp, E. coli
gaccaaacgacgcttggcaagaaaa

SEQ ID NO: 22482 - DNA, 25 bp, E. coli
gatgaggtcttcgaatctgccgcca

SEQ ID NO: 22483 - DNA, 25 bp, E. coli
caatgtgctgagtaaaaatcttacc

SEQ ID NO: 22484 - DNA, 25 bp, E. coli
aagcaccgatgagtttttcatgaag

SEQ ID NO: 22485 - DNA, 25 bp, E. coli
caatgtgctgagaaaaaatcttacc

SEQ ID NO: 22486 - DNA, 25 bp, E. coli
aagcaccgatgactttttcatgaag

SEQ ID NO: 22487 - DNA, 25 bp, E. coli
cagaagggtgatgactccaattagt

SEQ ID NO: 22488 - DNA, 25 bp, E. coli
cagaatgaggtaaaaatctttggct

SEQ ID NO: 22489 - DNA, 25 bp, E. coli
cagaatgaggtataaatctttggct

SEQ ID NO: 22490 - DNA, 25 bp, E. coli
cagattgttacgctcaatgtgctga

SEQ ID NO: 22491 - DNA, 25 bp, E. coli
cagaagggtgatcactccaattagt

SEQ ID NO: 22492 - DNA, 25 bp, E. coli
cagattgttacggtcaatgtgctga

SEQ ID NO: 22493 - DNA, 25 bp, E. coli
cagtcagatgcttctcctttggtaa

SEQ ID NO: 22494 - DNA, 25 bp, E. coli
cagtcagatgctactcctttggtaa

SEQ ID NO: 22495 - DNA, 25 bp, E. coli
tatattttcgataaaagcaccgatg

SEQ ID NO: 22496 - DNA, 25 bp, E. coli
tattcagtctggaaatcatccaagg

SEQ ID NO: 22497 - DNA, 25 bp, E. coli
tattcagtctggtaatcatccaagg

SEQ ID NO: 22498 - DNA, 25 bp, E. coli
tatattttcgattaaagcaccgatg

SEQ ID NO: 22499 - DNA, 25 bp, E. coli
tgtcatttgagaaaaaagagcagaa

SEQ ID NO: 22500 - DNA, 25 bp, E. coli
tgtcatttgagataaaagagcagaa

SEQ ID NO: 22501 - DNA, 25 bp, E. coli
tccaaggaaagcacatcagaagggt

SEQ ID NO: 22502 - DNA, 25 bp, E. coli
tccaaggaaagctcatcagaagggt

SEQ ID NO: 22503 - DNA, 25 bp, E. coli
cgggttctcaggctcagattgttac

SEQ ID NO: 22504 - DNA, 25 bp, E. coli
cgggttctcagggtcagattgttac

SEQ ID NO: 22505 - DNA, 25 bp, E. coli
caactgtccagtaaggcaggaaact

SEQ ID NO: 22506 - DNA, 25 bp, E. coli
caactgtccagttaggcaggaaact

SEQ ID NO: 22507 - DNA, 25 bp, E. coli
caggaaacttaatggcaggtatgca

SEQ ID NO: 22508 - DNA, 25 bp, E. coli
caggaaacttaaaggcaggtatgca

SEQ ID NO: 22509 - DNA, 25 bp, E. coli
taaactcctggcaggttgaaccaca

SEQ ID NO: 22510 - DNA, 25 bp, E. coli
taaactcctggctggttgaaccaca

SEQ ID NO: 22511 - DNA, 25 bp, E. coli
cacggacgtgttaaactggaattgg

SEQ ID NO: 22512 - DNA, 25 bp, E. coli
cacggacgtgtttaactggaattgg

SEQ ID NO: 22513 - DNA, 25 bp, E. coli
tatatgaacatactcagcgatgctg

SEQ ID NO: 22514 - DNA, 25 bp, E. coli
tatatgaacatagtcagcgatgctg

SEQ ID NO: 22515 - DNA, 25 bp, E. coli
gcgatgctgcaaggaaaagaaaatt

SEQ ID NO: 22516 - DNA, 25 bp, E. coli
gcgatgctgcaacgaaaagaaaatt

SEQ ID NO: 22517 - DNA, 25 bp, E. coli
gaagttgattgtttttgccgggaag

SEQ ID NO: 22518 - DNA, 25 bp, E. coli
gaagttgattgtatttgccgggaag

SEQ ID NO: 22519 - DNA, 25 bp, E. coli
gattcagaacatgtaaactcctggc

SEQ ID NO: 22520 - DNA, 25 bp, E. coli
gttagctcgttgaatcggaacaggt

SEQ ID NO: 22521 - DNA, 25 bp, E. coli
gattcagaacatctaaactcctggc

SEQ ID NO: 22522 - DNA, 25 bp, E. coli
gattgttacagtcccagtatcagca

SEQ ID NO: 22523 - DNA, 25 bp, E. coli
gattgttacagtgccagtatcagca

SEQ ID NO: 22524 - DNA, 25 bp, E. coli
gttagctcgttgtatcggaacaggt

SEQ ID NO: 22525 - DNA, 25 bp, E. coli
gatgcgaatgaaaatcacggacgtg

SEQ ID NO: 22526 - DNA, 25 bp, E. coli
gatgcgaatgaatatcacggacgtg

SEQ ID NO: 22527 - DNA, 25 bp, E. coli
caatttgtgaaacctggcgcattcc

SEQ ID NO: 22528 - DNA, 25 bp, E. coli
caatttgtgaaagctggcgcattcc

SEQ ID NO: 22529 - DNA, 25 bp, E. coli
caaaaagcgtggataccggtgctgg

SEQ ID NO: 22530 - DNA, 25 bp, E. coli
caaaaagcgtggttaccggtgctgg

SEQ ID NO: 22531 - DNA, 25 bp, E. coli
taaacatcgtagcaatagcgtcggg

SEQ ID NO: 22532 - DNA, 25 bp, E. coli
taaacatcgtaggaatagcgtcggg

SEQ ID NO: 22533 - DNA, 25 bp, E. coli
aaagcctctctgcatggcggtacgc

SEQ ID NO: 22534 - DNA, 25 bp, E. coli
aaagcctctctggatggcggtacgc

SEQ ID NO: 22535 - DNA, 25 bp, E. coli
tatctgcatgtgctggataccgcgc

SEQ ID NO: 22536 - DNA, 25 bp, E. coli
tatctgcatgtggtggataccgcgc

SEQ ID NO: 22537 - DNA, 25 bp, E. coli
tgtctgtgtcgataaaccgctggca

SEQ ID NO: 22538 - DNA, 25 bp, E. coli
tgtctgtgtcgaaaaaccgctggca

SEQ ID NO: 22539 - DNA, 25 bp, E. coli
tgactggacgtttcaaggagcctgg

SEQ ID NO: 22540 - DNA, 25 bp, E. coli
tgactggacgttacaaggagcctgg

SEQ ID NO: 22541 - DNA, 25 bp, E. coli
gcgcgaaagcccagccaatttgtga

SEQ ID NO: 22542 - DNA, 25 bp, E. coli
gcgcgaaagccctgccaatttgtga

SEQ ID NO: 22543 - DNA, 25 bp, E. coli
gaaaatctgcgcgatgctgaacggc

SEQ ID NO: 22544 - DNA, 25 bp, E. coli
gaaaatctgcgccatgctgaacggc

SEQ ID NO: 22545 - DNA, 25 bp, E. coli
cgcagcctcgcttagaatggataaa

SEQ ID NO: 22546 - DNA, 25 bp, E. coli
cgcagcctcgctaagaatggataaa

SEQ ID NO: 22547 - DNA, 25 bp, E. coli
tggcggcgcggataaaactgacgtt

SEQ ID NO: 22548 - DNA, 25 bp, E. coli
tggcggcgcggaaaaaactgacgtt

SEQ ID NO: 22549 - DNA, 25 bp, E. coli
caagcgccgtggaatgaacattaca

SEQ ID NO: 22550 - DNA, 25 bp, E. coli
caagcgccgtggtatgaacattaca

SEQ ID NO: 22551 - DNA, 25 bp, E. coli
cagtccgcgagggagtcatgtcgca

SEQ ID NO: 22552 - DNA, 25 bp, E. coli
cagtccgcgaggcagtcatgtcgca

SEQ ID NO: 22553 - DNA, 25 bp, E. coli
accgttacgatctcgggcaaggtgc

SEQ ID NO: 22554 - DNA, 25 bp, E. coli
accgttacgatcacgggcaaggtgc

SEQ ID NO: 22555 - DNA, 25 bp, E. coli
tatttcacaaggtcaacgcgttgcg

SEQ ID NO: 22556 - DNA, 25 bp, E. coli
tatttcacaaggacaacgcgttgcg

SEQ ID NO: 22557 - DNA, 25 bp, E. coli
tgtgaaatgaatgtcggcgtctatc

SEQ ID NO: 22558 - DNA, 25 bp, E. coli
tgtgaaatgaatctcggcgtctatc

SEQ ID NO: 22559 - DNA, 25 bp, E. coli
tgactatatccgcaacgagctgccg

SEQ ID NO: 22560 - DNA, 25 bp, E. coli
tgactatatccggaacgagctgccg

SEQ ID NO: 22561 - DNA, 25 bp, E. coli
tcttgaaaagatgtgccaggagatg

SEQ ID NO: 22562 - DNA, 25 bp, E. coli
tcttgaaaagatctgccaggagatg

SEQ ID NO: 22563 - DNA, 25 bp, E. coli
gctggtgctggccttacgtaaccca

SEQ ID NO: 22564 - DNA, 25 bp, E. coli
gcgttacgcggctgagcacaacatt

SEQ ID NO: 22565 - DNA, 25 bp, E. coli
gcgttacgcggcagagcacaacatt

SEQ ID NO: 22566 - DNA, 25 bp, E. coli
gctggtgctggcgttacgtaaccca

SEQ ID NO: 22567 - DNA, 25 bp, E. coli
cgcgttgcggaaatcatggttgatc

SEQ ID NO: 22568 - DNA, 25 bp, E. coli
cgcgttgcggaattcatggttgatc

SEQ ID NO: 22569 - DNA, 25 bp, E. coli
gggttttacctgaacgcgacgcaag

SEQ ID NO: 22570 - DNA, 25 bp, E. coli
gggttttacctgtacgcgacgcaag

SEQ ID NO: 22571 - DNA, 25 bp, E. coli
aattcgccgcctccgtatggaaggc

SEQ ID NO: 22572 - DNA, 25 bp, E. coli
aattcgccgcctgcgtatggaaggc

SEQ ID NO: 22573 - DNA, 25 bp, E. coli
caaattcgccgcctgcgtatggaag

SEQ ID NO: 22574 - DNA, 25 bp, E. coli
caaattcgccgcgtgcgtatggaag

SEQ ID NO: 22575 - DNA, 25 bp, E. coli
aaattcgccgccagcgtatggaagg

SEQ ID NO: 22576 - DNA, 25 bp, E. coli
aaattcgccgcctgcgtatggaagg

SEQ ID NO: 22577 - DNA, 25 bp, E. coli
tatggaaggcaagcgcgtggcgctg

SEQ ID NO: 22578 - DNA, 25 bp, E. coli
tatggaaggcaaccgcgtggcgctg

SEQ ID NO: 22579 - DNA, 25 bp, E. coli
ttcgccgcctgcgtatggaaggcaa

SEQ ID NO: 22580 - DNA, 25 bp, E. coli
ttcgccgcctgcctatggaaggcaa

SEQ ID NO: 22581 - DNA, 25 bp, E. coli
tggtccagccggacatcgcctgctt

SEQ ID NO: 22582 - DNA, 25 bp, E. coli
tggtccagccggtcatcgcctgctt

SEQ ID NO: 22583 - DNA, 25 bp, E. coli
ccagcaaacgggcagtaattctggt

SEQ ID NO: 22584 - DNA, 25 bp, E. coli
ccagcaaacggggagtaattctggt

SEQ ID NO: 22585 - DNA, 25 bp, E. coli
gccggacatcgcgtgcttcggtgaa

SEQ ID NO: 22586 - DNA, 25 bp, E. coli
gccggacatcgcctgcttcggtgaa

SEQ ID NO: 22587 - DNA, 25 bp, E. coli
cgccgcctgcgtttggaaggcaagc

SEQ ID NO: 22588 - DNA, 25 bp, E. coli
ccgcctgcgtatggaaggcaagcgc

SEQ ID NO: 22589 - DNA, 25 bp, E. coli
cgccgcctgcgtatggaaggcaagc

SEQ ID NO: 22590 - DNA, 25 bp, E. coli
ccgcctgcgtatcgaaggcaagcgc

SEQ ID NO: 22591 - DNA, 25 bp, E. coli
cggacatcgcctgcttcggtgaaaa

SEQ ID NO: 22592 - DNA, 25 bp, E. coli
cggacatcgcctccttcggtgaaaa

SEQ ID NO: 22593 - DNA, 25 bp, E. coli
caaccctgttatcgtctgtcgtaaa

SEQ ID NO: 22594 - DNA, 25 bp, E. coli
tcagaccgataaccccggtattcgt

SEQ ID NO: 22595 - DNA, 25 bp, E. coli
tcagaccgataagcccggtattcgt

SEQ ID NO: 22596 - DNA, 25 bp, E. coli
caaccctgttatggtctgtcgtaaa

SEQ ID NO: 22597 - DNA, 25 bp, E. coli
cagccattttttgttagtcgccgaa

SEQ ID NO: 22598 - DNA, 25 bp, E. coli
cagccattttttcttagtcgccgaa

SEQ ID NO: 22599 - DNA, 25 bp, E. coli
taaactttgcgctattcagaccgat

SEQ ID NO: 22600 - DNA, 25 bp, E. coli
taaactttgcgcaattcagaccgat

SEQ ID NO: 22601 - DNA, 25 bp, E. coli
tattgggtttcctcccgtcggctca

SEQ ID NO: 22602 - DNA, 25 bp, E. coli
tattgggtttccacccgtcggctca

SEQ ID NO: 22603 - DNA, 25 bp, E. coli
tgattacgtattgggtttccacccg

SEQ ID NO: 22604 - DNA, 25 bp, E. coli
tgattacgtattcggtttccacccg

SEQ ID NO: 22605 - DNA, 25 bp, E. coli
tcgtctgtcgtataacaacctttag

SEQ ID NO: 22606 - DNA, 25 bp, E. coli
tcgtctgtcgtaaaacaacctttag

SEQ ID NO: 22607 - DNA, 25 bp, E. coli
gctcaatcgccgacaaccctgttat

SEQ ID NO: 22608 - DNA, 25 bp, E. coli
gctcaatcgccgtcaaccctgttat

SEQ ID NO: 22609 - DNA, 25 bp, E. coli
gaaatactctttactctgcccctta

SEQ ID NO: 22610 - DNA, 25 bp, E. coli
gaaatactcttttctctgcccctta

SEQ ID NO: 22611 - DNA, 25 bp, E. coli
cgttatcctataatgcaagtcgttg

SEQ ID NO: 22612 - DNA, 25 bp, E. coli
cgttatcctatattgcaagtcgttg

SEQ ID NO: 22613 - DNA, 25 bp, E. coli
gtgtcgaaagataaaaggaaatcgc

SEQ ID NO: 22614 - DNA, 25 bp, E. coli
gtgtcgaaagattaaaggaaatcgc

SEQ ID NO: 22615 - DNA, 25 bp, E. coli
caatagcacgatactgagcggcgca

SEQ ID NO: 22616 - DNA, 25 bp, E. coli
aattgatctacacgacgtacaggcc

SEQ ID NO: 22617 - DNA, 25 bp, E. coli
caatagcacgattctgagcggcgca

SEQ ID NO: 22618 - DNA, 25 bp, E. coli
aattgatctacaggacgtacaggcc

SEQ ID NO: 22619 - DNA, 25 bp, E. coli
caaaactggaaaagctgtgggcgtc

SEQ ID NO: 22620 - DNA, 25 bp, E. coli
caaatccggtcagcgataacgcggc

SEQ ID NO: 22621 - DNA, 25 bp, E. coli
caaatccggtcaccgataacgcggc

SEQ ID NO: 22622 - DNA, 25 bp, E. coli
caaaactggaaatgctgtgggcgtc

SEQ ID NO: 22623 - DNA, 25 bp, E. coli
tactggagtgttttaccgcgaccgt

SEQ ID NO: 22624 - DNA, 25 bp, E. coli
tactggagtgttataccgcgaccgt

SEQ ID NO: 22625 - DNA, 25 bp, E. coli
ttatcgataatgtgcccgcagagcc

SEQ ID NO: 22626 - DNA, 25 bp, E. coli
ttatcgataatgagcccgcagagcc

SEQ ID NO: 22627 - DNA, 25 bp, E. coli
gaagcgccttatgaacaatgtgccg

SEQ ID NO: 22628 - DNA, 25 bp, E. coli
gaagaaaaatctcatgccctggtga

SEQ ID NO: 22629 - DNA, 25 bp, E. coli
gaagcgccttatcaacaatgtgccg

SEQ ID NO: 22630 - DNA, 25 bp, E. coli
gaagaaaaatctgatgccctggtga

SEQ ID NO: 22631 - DNA, 25 bp, E. coli
gactatgtggcgcttttcccggaac

SEQ ID NO: 22632 - DNA, 25 bp, E. coli
gactatgtggcggttttcccggaac

SEQ ID NO: 22633 - DNA, 25 bp, E. coli
gattcgcgccttactggaaaagcac

SEQ ID NO: 22634 - DNA, 25 bp, E. coli
gattcgcgcctttctggaaaagcac

SEQ ID NO: 22635 - DNA, 25 bp, E. coli
taatattgcgcacctcgacggtgtg

SEQ ID NO: 22636 - DNA, 25 bp, E. coli
taatattgcgcagctcgacggtgtg

SEQ ID NO: 22637 - DNA, 25 bp, E. coli
taaaaatggcaacaccactctcggt

SEQ ID NO: 22638 - DNA, 25 bp, E. coli
taaaaatggcaagaccactctcggt

SEQ ID NO: 22639 - DNA, 25 bp, E. coli
taaagaaacggaatggcgatcggca

SEQ ID NO: 22640 - DNA, 25 bp, E. coli
taaagaaacggattggcgatcggca

SEQ ID NO: 22641 - DNA, 25 bp, E. coli
acctatcggtgctgtagcaggcgca

SEQ ID NO: 22642 - DNA, 25 bp, E. coli
agtatgtttattccacgcctgccga

SEQ ID NO: 22643 - DNA, 25 bp, E. coli
ataaaaggcgcggtgggaattcccg

SEQ ID NO: 22644 - DNA, 25 bp, E. coli
ataaaaggcgcgctgggaattcccg

SEQ ID NO: 22645 - DNA, 25 bp, E. coli
acctatcggtgcagtagcaggcgca

SEQ ID NO: 22646 - DNA, 25 bp, E. coli
agtatgtttattgcacgcctgccga

SEQ ID NO: 22647 - DNA, 25 bp, E. coli
aacaacatcgcgctgatcggcgggc

SEQ ID NO: 22648 - DNA, 25 bp, E. coli
aacaacatcgcggtgatcggcgggc

SEQ ID NO: 22649 - DNA, 25 bp, E. coli
ttatgaccgtaggtggatcgccgca

SEQ ID NO: 22650 - DNA, 25 bp, E. coli
ttatgaccgtagctggatcgccgca

SEQ ID NO: 22651 - DNA, 25 bp, E. coli
gccacctggctgacacgtaaagaaa

SEQ ID NO: 22652 - DNA, 25 bp, E. coli
gccacctggctgtcacgtaaagaaa

SEQ ID NO: 22653 - DNA, 25 bp, E. coli
gtatgctgcgtaacttaggcccggc

SEQ ID NO: 22654 - DNA, 25 bp, E. coli
gtatgctgcgtatcttaggcccggc

SEQ ID NO: 22655 - DNA, 25 bp, E. coli
gggtcatgctggtaacaaacgtggt

SEQ ID NO: 22656 - DNA, 25 bp, E. coli
ggtttaaccactttgccgctcgtca

SEQ ID NO: 22657 - DNA, 25 bp, E. coli
gggtcatgctggaaacaaacgtggt

SEQ ID NO: 22658 - DNA, 25 bp, E. coli
ggtttaaccactatgccgctcgtca

SEQ ID NO: 22659 - DNA, 25 bp, E. coli
ccgcaattactatcgtttcggttgg

SEQ ID NO: 22660 - DNA, 25 bp, E. coli
ccgcaattactaacgtttcggttgg

SEQ ID NO: 22661 - DNA, 25 bp, E. coli
tatccgcaattactatcgtttcggt

SEQ ID NO: 22662 - DNA, 25 bp, E. coli
tatccgcaattagtatcgtttcggt

SEQ ID NO: 22663 - DNA, 25 bp, E. coli
gcgttatccgcaattactatcgttt

SEQ ID NO: 22664 - DNA, 25 bp, E. coli
gcgttatccgcatttactatcgttt

SEQ ID NO: 22665 - DNA, 25 bp, E. coli
ccgcgttatccggaattactatcgt

SEQ ID NO: 22666 - DNA, 25 bp, E. coli
cgaagtgcggtgatatctcgggcgc

SEQ ID NO: 22667 - DNA, 25 bp, E. coli
ccgcgttatccgcaattactatcgt

SEQ ID NO: 22668 - DNA, 25 bp, E. coli
cgaagtgcggtgttatctcgggcgc

SEQ ID NO: 22669 - DNA, 25 bp, E. coli
ctggcaagcgaactgcggtgatatc

SEQ ID NO: 22670 - DNA, 25 bp, E. coli
ctggcaagcgaagtgcggtgatatc

SEQ ID NO: 22671 - DNA, 25 bp, E. coli
cggtgatatctcgggcgctgatgcc

SEQ ID NO: 22672 - DNA, 25 bp, E. coli
cggtgatatctccggcgctgatgcc

SEQ ID NO: 22673 - DNA, 25 bp, E. coli
gttatccgcaataactatcgtttcg

SEQ ID NO: 22674 - DNA, 25 bp, E. coli
gttatccgcaattactatcgtttcg

SEQ ID NO: 22675 - DNA, 25 bp, E. coli
gtgatatctcggccgctgatgccaa

SEQ ID NO: 22676 - DNA, 25 bp, E. coli
gtgatatctcgggcgctgatgccaa

SEQ ID NO: 22677 - DNA, 25 bp, E. coli
tggcaagcgaagagcggtgatatct

SEQ ID NO: 22678 - DNA, 25 bp, E. coli
tggcaagcgaagtgcggtgatatct

SEQ ID NO: 22679 - DNA, 25 bp, E. coli
ggcaagcgaagtccggtgatatctc

SEQ ID NO: 22680 - DNA, 25 bp, E. coli
ggcaagcgaagtgcggtgatatctc

SEQ ID NO: 22681 - DNA, 25 bp, E. coli
tatttcagcgcatggtacggcgacc

SEQ ID NO: 22682 - DNA, 25 bp, E. coli
tttgcgactaacagcgacgcggcac

SEQ ID NO: 22683 - DNA, 25 bp, E. coli
tatttcagcgcaaggtacggcgacc

SEQ ID NO: 22684 - DNA, 25 bp, E. coli
tttgcgactaactgcgacgcggcac

SEQ ID NO: 22685 - DNA, 25 bp, E. coli
tcatacgcttggagcctgtggcgcg

SEQ ID NO: 22686 - DNA, 25 bp, E. coli
tctggcgacagcaaccatttacggt

SEQ ID NO: 22687 - DNA, 25 bp, E. coli
tctggcgacagctaccatttacggt

SEQ ID NO: 22688 - DNA, 25 bp, E. coli
tcatacgcttggtgcctgtggcgcg

SEQ ID NO: 22689 - DNA, 25 bp, E. coli
gaagcctggatgtgtctgcaaatga

SEQ ID NO: 22690 - DNA, 25 bp, E. coli
gaagcctggatgagtctgcaaatga

SEQ ID NO: 22691 - DNA, 25 bp, E. coli
cgaaggttggtttgcgcctacgcta

SEQ ID NO: 22692 - DNA, 25 bp, E. coli
cgttcgatgaaatccgcgacgggct

SEQ ID NO: 22693 - DNA, 25 bp, E. coli
cgttcgatgaaaaccgcgacgggct

SEQ ID NO: 22694 - DNA, 25 bp, E. coli
cgaaggttggttagcgcctacgcta

SEQ ID NO: 22695 - DNA, 25 bp, E. coli
ggagcaatcgctgaaaatcgccggg

SEQ ID NO: 22696 - DNA, 25 bp, E. coli
ggagcaatcgctcaaaatcgccggg

SEQ ID NO: 22697 - DNA, 25 bp, E. coli
gaccgatcgcggtgatatggcagaa

SEQ ID NO: 22698 - DNA, 25 bp, E. coli
gagttcgccaccatgctgacggaaa

SEQ ID NO: 22699 - DNA, 25 bp, E. coli
gagtaacaactttgcctttggcggc

SEQ ID NO: 22700 - DNA, 25 bp, E. coli
gaccgatcgcggagatatggcagaa

SEQ ID NO: 22701 - DNA, 25 bp, E. coli
gagtaacaacttagcctttggcggc

SEQ ID NO: 22702 - DNA, 25 bp, E. coli
gagttcgccaccttgctgacggaaa

SEQ ID NO: 22703 - DNA, 25 bp, E. coli
cactgcttacgtttgttccggccga

SEQ ID NO: 22704 - DNA, 25 bp, E. coli
cactgcttacgtatgttccggccga

SEQ ID NO: 22705 - DNA, 25 bp, E. coli
ttccggccgacagcccaccggaata

SEQ ID NO: 22706 - DNA, 25 bp, E. coli
tgtcgcctggttgaagacccggtct

SEQ ID NO: 22707 - DNA, 25 bp, E. coli
tgtcgcctggttcaagacccggtct

SEQ ID NO: 22708 - DNA, 25 bp, E. coli
ttccggccgacaccccaccggaata

SEQ ID NO: 22709 - DNA, 25 bp, E. coli
ttcgctttatcctgcattcactgct

SEQ ID NO: 22710 - DNA, 25 bp, E. coli
ttcgctttatccagcattcactgct

SEQ ID NO: 22711 - DNA, 25 bp, E. coli
tcattcaggccttaccccattttcg

SEQ ID NO: 22712 - DNA, 25 bp, E. coli
tcattcaggcctaaccccattttcg

SEQ ID NO: 22713 - DNA, 25 bp, E. coli
tgacagtctgtgacgcctggttgaa

SEQ ID NO: 22714 - DNA, 25 bp, E. coli
tgacagtctgtgtcgcctggttgaa

SEQ ID NO: 22715 - DNA, 25 bp, E. coli
tctgtgtcgcctcgttgaagacccg

SEQ ID NO: 22716 - DNA, 25 bp, E. coli
ttaccccattttcgctttatccagc

SEQ ID NO: 22717 - DNA, 25 bp, E. coli
tctgtgtcgcctggttgaagacccg

SEQ ID NO: 22718 - DNA, 25 bp, E. coli
ttaccccattttggctttatccagc

SEQ ID NO: 22719 - DNA, 25 bp, E. coli
gcttacgtttgttccggccgacagc

SEQ ID NO: 22720 - DNA, 25 bp, E. coli
gcttacgtttgtaccggccgacagc

SEQ ID NO: 22721 - DNA, 25 bp, E. coli
gaagacccggtcttcattcaggcct

SEQ ID NO: 22722 - DNA, 25 bp, E. coli
gaagacccggtcatcattcaggcct

SEQ ID NO: 22723 - DNA, 25 bp, E. coli
cattcactgctttcgtttgttccgg

SEQ ID NO: 22724 - DNA, 25 bp, E. coli
cattcactgcttacgtttgttccgg

SEQ ID NO: 22725 - DNA, 25 bp, E. coli
aacctgctgatatggcaatgatgtg

SEQ ID NO: 22726 - DNA, 25 bp, E. coli
aacctgctgataaggcaatgatgtg

SEQ ID NO: 22727 - DNA, 25 bp, E. coli
cacttcccgggctacctgctgatat

SEQ ID NO: 22728 - DNA, 25 bp, E. coli
cacttcccgggcaacctgctgatat

SEQ ID NO: 22729 - DNA, 25 bp, E. coli
tgttcccgtcaggttatcgtgcacc

SEQ ID NO: 22730 - DNA, 25 bp, E. coli
tgttcccgtcagcttatcgtgcacc

SEQ ID NO: 22731 - DNA, 25 bp, E. coli
tgtgttttcattgccaaccacgcga

SEQ ID NO: 22732 - DNA, 25 bp, E. coli
tcaggttatcgtccacctccacggt

SEQ ID NO: 22733 - DNA, 25 bp, E. coli
tcaggttatcgtgcacctccacggt

SEQ ID NO: 22734 - DNA, 25 bp, E. coli
ccaaccacgcgaggaatacggtgag

SEQ ID NO: 22735 - DNA, 25 bp, E. coli
ccaaccacgcgacgaatacggtgag

SEQ ID NO: 22736 - DNA, 25 bp, E. coli
cccgggcaacctgctgatatggcaa

SEQ ID NO: 22737 - DNA, 25 bp, E. coli
cccgggcaacctcctgatatggcaa

SEQ ID NO: 22738 - DNA, 25 bp, E. coli
gttttcattcccaaccacgcgacga

SEQ ID NO: 22739 - DNA, 25 bp, E. coli
gttttcattccctaccacgcgacga

SEQ ID NO: 22740 - DNA, 25 bp, E. coli
ggttatcgtgcagctccacggtcgt

SEQ ID NO: 22741 - DNA, 25 bp, E. coli
gggttgttcccgacaggttatcgtg

SEQ ID NO: 22742 - DNA, 25 bp, E. coli
gggttgttcccgtcaggttatcgtg

SEQ ID NO: 22743 - DNA, 25 bp, E. coli
ggttatcgtgcacctccacggtcgt

SEQ ID NO: 22744 - DNA, 25 bp, E. coli
tgtgttttcattcccaaccacgcga

SEQ ID NO: 22745 - DNA, 25 bp, E. coli
ggcaacctgctgatatggcaatgat

SEQ ID NO: 22746 - DNA, 25 bp, E. coli
ggcaacctgctgttatggcaatgat

SEQ ID NO: 22747 - DNA, 25 bp, E. coli
caaacgtgataatccggtactgatt

SEQ ID NO: 22748 - DNA, 25 bp, E. coli
caaacgtgataaaccggtactgatt

SEQ ID NO: 22749 - DNA, 25 bp, E. coli
cagatctggatatcggcattggcga

SEQ ID NO: 22750 - DNA, 25 bp, E. coli
cagatctggataacggcattggcga

SEQ ID NO: 22751 - DNA, 25 bp, E. coli
atcccctcactggtgggtaatgtca

SEQ ID NO: 22752 - DNA, 25 bp, E. coli
atcccctcactgctgggtaatgtca

SEQ ID NO: 22753 - DNA, 25 bp, E. coli
tgaatatcagccgtacagatctgga

SEQ ID NO: 22754 - DNA, 25 bp, E. coli
tgaatatcagccctacagatctgga

SEQ ID NO: 22755 - DNA, 25 bp, E. coli
tcctgccggaagtgcgcgaatggat

SEQ ID NO: 22756 - DNA, 25 bp, E. coli
tcctgccggaagagcgcgaatggat

SEQ ID NO: 22757 - DNA, 25 bp, E. coli
tctttcctgccggaagagcgcgaat

SEQ ID NO: 22758 - DNA, 25 bp, E. coli
tctttcctgccgcaagagcgcgaat

SEQ ID NO: 22759 - DNA, 25 bp, E. coli
gcgtaccggtaaatgctctttcctg

SEQ ID NO: 22760 - DNA, 25 bp, E. coli
gcgtaccggtaattgctctttcctg

SEQ ID NO: 22761 - DNA, 25 bp, E. coli
cgaactcaaacgagataatccggta

SEQ ID NO: 22762 - DNA, 25 bp, E. coli
cgaactcaaacgtgataatccggta

SEQ ID NO: 22763 - DNA, 25 bp, E. coli
ggtaaatgctctatcctgccggaag

SEQ ID NO: 22764 - DNA, 25 bp, E. coli
ggtaaatgctctttcctgccggaag

SEQ ID NO: 22765 - DNA, 25 bp, E. coli
ggcggaaatcccgtcactgctgggt

SEQ ID NO: 22766 - DNA, 25 bp, E. coli
ggcggaaatcccctcactgctgggt

SEQ ID NO: 22767 - DNA, 25 bp, E. coli
tcagccctacagatctggatatcgg

SEQ ID NO: 22768 - DNA, 25 bp, E. coli
tcagccctacagttctggatatcgg

SEQ ID NO: 22769 - DNA, 25 bp, E. coli
caacgggacatttgggaatcatggc

SEQ ID NO: 22770 - DNA, 25 bp, E. coli
caacaaatgataaggtgcaagagca

SEQ ID NO: 22771 - DNA, 25 bp, E. coli
caacgggacattagggaatcatggc

SEQ ID NO: 22772 - DNA, 25 bp, E. coli
caacaaatgatatggtgcaagagca

SEQ ID NO: 22773 - DNA, 25 bp, E. coli
tactgagtcgtacaaacccatctgg

SEQ ID NO: 22774 - DNA, 25 bp, E. coli
taaaaccccagtacgctgacagaat

SEQ ID NO: 22775 - DNA, 25 bp, E. coli
tactgagtcgtagaaacccatctgg

SEQ ID NO: 22776 - DNA, 25 bp, E. coli
taaaaccccagttcgctgacagaat

SEQ ID NO: 22777 - DNA, 25 bp, E. coli
ttttaggtcttaacgcccgtgacag

SEQ ID NO: 22778 - DNA, 25 bp, E. coli
ttttaggtcttatcgcccgtgacag

SEQ ID NO: 22779 - DNA, 25 bp, E. coli
tgccaggacaatcctcggtgaggtt

SEQ ID NO: 22780 - DNA, 25 bp, E. coli
tcgatccggtcgaattagcggcaat

SEQ ID NO: 22781 - DNA, 25 bp, E. coli
tcgatccggtcgtattagcggcaat

SEQ ID NO: 22782 - DNA, 25 bp, E. coli
tgccaggacaatgctcggtgaggtt

SEQ ID NO: 22783 - DNA, 25 bp, E. coli
gaaggcgcacaatgttacagctctg

SEQ ID NO: 22784 - DNA, 25 bp, E. coli
gaaggcgcacaaagttacagctctg

SEQ ID NO: 22785 - DNA, 25 bp, E. coli
gaaatgaccaatcctctcgatccgg

SEQ ID NO: 22786 - DNA, 25 bp, E. coli
gaaatgaccaatgctctcgatccgg

SEQ ID NO: 22787 - DNA, 25 bp, E. coli
ggcctgagataagcactccctggaa

SEQ ID NO: 22788 - DNA, 25 bp, E. coli
ggcctgagataaccactccctggaa

SEQ ID NO: 22789 - DNA, 25 bp, E. coli
gatgattggcaaatagaacggttcc

SEQ ID NO: 22790 - DNA, 25 bp, E. coli
gatgattggcaattagaacggttcc

SEQ ID NO: 22791 - DNA, 25 bp, E. coli
caaaatgcgcaacagagtacagaac

SEQ ID NO: 22792 - DNA, 25 bp, E. coli
caaaatgcgcaagagagtacagaac

SEQ ID NO: 22793 - DNA, 25 bp, E. coli
catcaactgtctcgttactcagtca

SEQ ID NO: 22794 - DNA, 25 bp, E. coli
catcaactgtctggttactcagtca

SEQ ID NO: 22795 - DNA, 25 bp, E. coli
tactcagtcaactatcaaaatgcgc

SEQ ID NO: 22796 - DNA, 25 bp, E. coli
tactcagtcaacaatcaaaatgcgc

SEQ ID NO: 22797 - DNA, 25 bp, E. coli
tatatgtattatgtggtcacttcct

SEQ ID NO: 22798 - DNA, 25 bp, E. coli
tatatgtattatctggtcacttcct

SEQ ID NO: 22799 - DNA, 25 bp, E. coli
ttttcgtatattccacacaccgggt

SEQ ID NO: 22800 - DNA, 25 bp, E. coli
ttttcgtatattgcacacaccgggt

SEQ ID NO: 22801 - DNA, 25 bp, E. coli
tttttcgtgtatagcacacaccggg

SEQ ID NO: 22802 - DNA, 25 bp, E. coli
tttttcgtgtattgcacacaccggg

SEQ ID NO: 22803 - DNA, 25 bp, E. coli
gaaatcgtgcacatcaactgtctgg

SEQ ID NO: 22804 - DNA, 25 bp, E. coli
gaaatcgtgcacttcaactgtctgg

SEQ ID NO: 22805 - DNA, 25 bp, E. coli
gacagccagttgcacagaccgtgaa

SEQ ID NO: 22806 - DNA, 25 bp, E. coli
gacagccagttggacagaccgtgaa

SEQ ID NO: 22807 - DNA, 25 bp, E. coli
gggttcgacaacaggcgacagccag

SEQ ID NO: 22808 - DNA, 25 bp, E. coli
gggtcgacaactcgcgacagccagt

SEQ ID NO: 22809 - DNA, 25 bp, E. coli
gggtcgacaactggcgacagccagt

SEQ ID NO: 22810 - DNA, 25 bp, E. coli
gggttcgacaactggcgacagccag

SEQ ID NO: 22811 - DNA, 25 bp, E. coli
tggacagaccgtgaacgcagtgagc

SEQ ID NO: 22812 - DNA, 25 bp, E. coli
tggacagaccgtcaacgcagtgagc

SEQ ID NO: 22813 - DNA, 25 bp, E. coli
caaactgtagtgaaaagcgccggac

SEQ ID NO: 22814 - DNA, 25 bp, E. coli
caaactgtagtgtaaagcgccggac

SEQ ID NO: 22815 - DNA, 25 bp, E. coli
acgttccggtaggtcaggtgttgca

SEQ ID NO: 22816 - DNA, 25 bp, E. coli
acgttccggtagctcaggtgttgca

SEQ ID NO: 22817 - DNA, 25 bp, E. coli
tattatcgccagaccgcgtctgctg

SEQ ID NO: 22818 - DNA, 25 bp, E. coli
tattatcgccagtccgcgtctgctg

SEQ ID NO: 22819 - DNA, 25 bp, E. coli
ttacacatcagccagaacgttccgg

SEQ ID NO: 22820 - DNA, 25 bp, E. coli
ttacacatcagcgagaacgttccgg

SEQ ID NO: 22821 - DNA, 25 bp, E. coli
tgttacaaaaaggtcgcatccggct

SEQ ID NO: 22822 - DNA, 25 bp, E. coli
tggtgtttatcaggccacgactggt

SEQ ID NO: 22823 - DNA, 25 bp, E. coli
tgttacaaaaagctcgcatccggct

SEQ ID NO: 22824 - DNA, 25 bp, E. coli
tcgaggtcaaaagcggagaaacgtt

SEQ ID NO: 22825 - DNA, 25 bp, E. coli
tcgaggtcaaaaccggagaaacgtt

SEQ ID NO: 22826 - DNA, 25 bp, E. coli
cctggaagcagggactacaaactgt

SEQ ID NO: 22827 - DNA, 25 bp, E. coli
cctggaagcaggcactacaaactgt

SEQ ID NO: 22828 - DNA, 25 bp, E. coli
gccaaagggagtttgaccgtcgata

SEQ ID NO: 22829 - DNA, 25 bp, E. coli
gccaaagggagtatgaccgtcgata

SEQ ID NO: 22830 - DNA, 25 bp, E. coli
gcgcgacgtcggaggaatttaaaga

SEQ ID NO: 22831 - DNA, 25 bp, E. coli
gcgcgacgtcggtggaatttaaaga

SEQ ID NO: 22832 - DNA, 25 bp, E. coli
tggtgtttatcacgccacgactggt

SEQ ID NO: 22833 - DNA, 25 bp, E. coli
taagcaggagatcgaaacgcaggtc

SEQ ID NO: 22834 - DNA, 25 bp, E. coli
taagcaggagatggaaacgcaggtc

SEQ ID NO: 22835 - DNA, 25 bp, E. coli
aataaaccagccaaatctcatagag

SEQ ID NO: 22836 - DNA, 25 bp, E. coli
aataaaccagcctaatctcatagag

SEQ ID NO: 22837 - DNA, 25 bp, E. coli
cagtactacagtactactggaaaca

SEQ ID NO: 22838 - DNA, 25 bp, E. coli
cagtactacagttctactggaaaca

SEQ ID NO: 22839 - DNA, 25 bp, E. coli
tacgtgctgcgtccaaaatcactac

SEQ ID NO: 22840 - DNA, 25 bp, E. coli
tacgtgctgcgtgcaaaatcactac

SEQ ID NO: 22841 - DNA, 25 bp, E. coli
tatgagatgatcatgcgtactgtca

SEQ ID NO: 22842 - DNA, 25 bp, E. coli
tatgagatgatcttgcgtactgtca

SEQ ID NO: 22843 - DNA, 25 bp, E. coli
tattgcagatcgaaagagtatgaga

SEQ ID NO: 22844 - DNA, 25 bp, E. coli
tattgcagatcgtaagagtatgaga

SEQ ID NO: 22845 - DNA, 25 bp, E. coli
gcaataatactctttctgaagatgg

SEQ ID NO: 22846 - DNA, 25 bp, E. coli
gcaataatactcattctgaagatgg

SEQ ID NO: 22847 - DNA, 25 bp, E. coli
cattgcccctatgtgtatagtacgg

SEQ ID NO: 22848 - DNA, 25 bp, E. coli
ctgaagatggattagggcaagttgc

SEQ ID NO: 22849 - DNA, 25 bp, E. coli
cgtactgtcagagcactgatttctc

SEQ ID NO: 22850 - DNA, 25 bp, E. coli
cgtactgtcagaccactgatttctc

SEQ ID NO: 22851 - DNA, 25 bp, E. coli
cattgcccctatctgtatagtacgg

SEQ ID NO: 22852 - DNA, 25 bp, E. coli
ctgaagatggataagggcaagttgc

SEQ ID NO: 22853 - DNA, 25 bp, E. coli
gatttctctgactgtacgtgctgcg

SEQ ID NO: 22854 - DNA, 25 bp, E. coli
gatttctctgacagtacgtgctgcg

SEQ ID NO: 22855 - DNA, 25 bp, E. coli
taagagtaaacaaaccaacagcagc

SEQ ID NO: 22856 - DNA, 25 bp, E. coli
taagagtaaacataccaacagcagc

SEQ ID NO: 22857 - DNA, 25 bp, E. coli
cacgacaggctcctacattacagcg

SEQ ID NO: 22858 - DNA, 25 bp, E. coli
cacctggtgccgcatgatcttgctt

SEQ ID NO: 22859 - DNA, 25 bp, E. coli
gaaacgggtgtctgtttagtcaaca

SEQ ID NO: 22860 - DNA, 25 bp, E. coli
cacgacaggctcgtacattacagcg

SEQ ID NO: 22861 - DNA, 25 bp, E. coli
cacctggtgccggatgatcttgctt

SEQ ID NO: 22862 - DNA, 25 bp, E. coli
gaaacgggtgtcagtttagtcaaca

SEQ ID NO: 22863 - DNA, 25 bp, E. coli
tgcccctccaataatgtgtagctct

SEQ ID NO: 22864 - DNA, 25 bp, E. coli
tgcccctccaattatgtgtagctct

SEQ ID NO: 22865 - DNA, 25 bp, E. coli
gcgaataaatacagagaacgccatt

SEQ ID NO: 22866 - DNA, 25 bp, E. coli
gcgaataaatactgagaacgccatt

SEQ ID NO: 22867 - DNA, 25 bp, E. coli
gctgttttagctgtgactcatcaag

SEQ ID NO: 22868 - DNA, 25 bp, E. coli
gctgttttagctctgactcatcaag

SEQ ID NO: 22869 - DNA, 25 bp, E. coli
ggttctcgacgttattcacgacagg

SEQ ID NO: 22870 - DNA, 25 bp, E. coli
ggattttacttcagagaaacgggtg

SEQ ID NO: 22871 - DNA, 25 bp, E. coli
ggaccatttccaaagcactgcacca

SEQ ID NO: 22872 - DNA, 25 bp, E. coli
ggattttacttctgagaaacgggtg

SEQ ID NO: 22873 - DNA, 25 bp, E. coli
ggttctcgacgtaattcacgacagg

SEQ ID NO: 22874 - DNA, 25 bp, E. coli
ggaccatttccatagcactgcacca

SEQ ID NO: 22875 - DNA, 25 bp, E. coli
taagagtacctgttgcattgttccc

SEQ ID NO: 22876 - DNA, 25 bp, E. coli
taagagtacctgatgcattgttccc

SEQ ID NO: 22877 - DNA, 25 bp, E. coli
tcacaaacgcaagggatgggttctc

SEQ ID NO: 22878 - DNA, 25 bp, E. coli
tcacaaacgcaacggatgggttctc

SEQ ID NO: 22879 - DNA, 25 bp, E. coli
catcagccgctttggtatgcacgct

SEQ ID NO: 22880 - DNA, 25 bp, E. coli
catcagccgcttaggtatgcacgct

SEQ ID NO: 22881 - DNA, 25 bp, E. coli
tagacctgctggtcgacgaaggcat

SEQ ID NO: 22882 - DNA, 25 bp, E. coli
tagacctgctggacgacgaaggcat

SEQ ID NO: 22883 - DNA, 25 bp, E. coli
tatgcacgctgatgtggaatccgcc

SEQ ID NO: 22884 - DNA, 25 bp, E. coli
tatgcacgctgaagtggaatccgcc

SEQ ID NO: 22885 - DNA, 25 bp, E. coli
tattctggaaaggatggcgcaggta

SEQ ID NO: 22886 - DNA, 25 bp, E. coli
tattatcgaccgatacctggtggcc

SEQ ID NO: 22887 - DNA, 25 bp, E. coli
tattctggaaagcatggcgcaggta

SEQ ID NO: 22888 - DNA, 25 bp, E. coli
tattatcgaccgttacctggtggcc

SEQ ID NO: 22889 - DNA, 25 bp, E. coli
tgtgctcaacaacatagacctgctg

SEQ ID NO: 22890 - DNA, 25 bp, E. coli
tgtgctcaacaagatagacctgctg

SEQ ID NO: 22891 - DNA, 25 bp, E. coli
tgaccgggcgcatcagcatttttgc

SEQ ID NO: 22892 - DNA, 25 bp, E. coli
tgaccgggcgcaacagcatttttgc

SEQ ID NO: 22893 - DNA, 25 bp, E. coli
gcgaaaccttgctgattgagccgat

SEQ ID NO: 22894 - DNA, 25 bp, E. coli
gcgaaaccttgcagattgagccgat

SEQ ID NO: 22895 - DNA, 25 bp, E. coli
cgacaatctgtttggcgagcctgat

SEQ ID NO: 22896 - DNA, 25 bp, E. coli
cgacaatctgttaggcgagcctgat

SEQ ID NO: 22897 - DNA, 25 bp, E. coli
gattgcaaacaccataccgatccgg

SEQ ID NO: 22898 - DNA, 25 bp, E. coli
gattgcaaacacgataccgatccgg

SEQ ID NO: 22899 - DNA, 25 bp, E. coli
tggagccggaacaaatcactcaggg

SEQ ID NO: 22900 - DNA, 25 bp, E. coli
tggagccggaactaatcactcaggg

SEQ ID NO: 22901 - DNA, 25 bp, E. coli
caaaaccatcggcattgaagcgcgt

SEQ ID NO: 22902 - DNA, 25 bp, E. coli
caaaaccatcgggattgaagcgcgt

SEQ ID NO: 22903 - DNA, 25 bp, E. coli
tactgaaggcgcgtatcaggcgatc

SEQ ID NO: 22904 - DNA, 25 bp, E. coli
tactgaaggcgcctatcaggcgatc

SEQ ID NO: 22905 - DNA, 25 bp, E. coli
aaagcgccggtattcctcgcggtga

SEQ ID NO: 22906 - DNA, 25 bp, E. coli
aaagcgccggtaatcctcgcggtga

SEQ ID NO: 22907 - DNA, 25 bp, E. coli
tgaagcgcgtaatgacatgcaggaa

SEQ ID NO: 22908 - DNA, 25 bp, E. coli
tgaagcgcgtaaagacatgcaggaa

SEQ ID NO: 22909 - DNA, 25 bp, E. coli
tccgtgaccgtggagatcgaacgtt

SEQ ID NO: 22910 - DNA, 25 bp, E. coli
tccgtgaccgtgcagatcgaacgtt

SEQ ID NO: 22911 - DNA, 25 bp, E. coli
tctctgccgaaaccgggctgaatgt

SEQ ID NO: 22912 - DNA, 25 bp, E. coli
tctctgccgaaagcgggctgaatgt

SEQ ID NO: 22913 - DNA, 25 bp, E. coli
cctcgcggtgaagaaagtggacaac

SEQ ID NO: 22914 - DNA, 25 bp, E. coli
cctcgcggtgaacaaagtggacaac

SEQ ID NO: 22915 - DNA, 25 bp, E. coli
gcctgcatatggtagaaaaacgcgc

SEQ ID NO: 22916 - DNA, 25 bp, E. coli
gcctgcatatggaagaaaaacgcgc

SEQ ID NO: 22917 - DNA, 25 bp, E. coli
gaagatggtcattggcaacaaaggg

SEQ ID NO: 22918 - DNA, 25 bp, E. coli
gaagatggtcataggcaacaaaggg

SEQ ID NO: 22919 - DNA, 25 bp, E. coli
ggcaagccagatcaacttcctcgat

SEQ ID NO: 22920 - DNA, 25 bp, E. coli
ggcaagccagatgaacttcctcgat

SEQ ID NO: 22921 - DNA, 25 bp, E. coli
ggaagattacatgaccgatcgctca

SEQ ID NO: 22922 - DNA, 25 bp, E. coli
ggaagattacatcaccgatcgctca

SEQ ID NO: 22923 - DNA, 25 bp, E. coli
catcgatttcgagccatctgttagg

SEQ ID NO: 22924 - DNA, 25 bp, E. coli
catcgatttcgacccatctgttagg

SEQ ID NO: 22925 - DNA, 25 bp, E. coli
tataagacaatctttatgccagttg

SEQ ID NO: 22926 - DNA, 25 bp, E. coli
tataagacaatcattatgccagttg

SEQ ID NO: 22927 - DNA, 25 bp, E. coli
tgatgtatttgaaatggaattgagc

SEQ ID NO: 22928 - DNA, 25 bp, E. coli
tgatgtatttgatatggaattgagc

SEQ ID NO: 22929 - DNA, 25 bp, E. coli
cattatgccagttgatgtatttgaa

SEQ ID NO: 22930 - DNA, 25 bp, E. coli
cattatgccagtagatgtatttgaa

SEQ ID NO: 22931 - DNA, 25 bp, E. coli
gttattggttctcgcaacccatcga

SEQ ID NO: 22932 - DNA, 25 bp, E. coli
gttattggttctggcaacccatcga

SEQ ID NO: 22933 - DNA, 25 bp, E. coli
ggtagcgtgcgggatgaagtcaatg

SEQ ID NO: 22934 - DNA, 25 bp, E. coli
ggtagcgtgcggcatgaagtcaatg

SEQ ID NO: 22935 - DNA, 25 bp, E. coli
tgtagttattggttctcgcaaccca

SEQ ID NO: 22936 - DNA, 25 bp, E. coli
tggttctcgcaagccatcgatttcg

SEQ ID NO: 22937 - DNA, 25 bp, E. coli
tcgacccatctgataggttctaacg

SEQ ID NO: 22938 - DNA, 25 bp, E. coli
tcgacccatctgttaggttctaacg

SEQ ID NO: 22939 - DNA, 25 bp, E. coli
tgtagttattggatctcgcaaccca

SEQ ID NO: 22940 - DNA, 25 bp, E. coli
tggttctcgcaacccatcgatttcg

SEQ ID NO: 22941 - DNA, 25 bp, E. coli
gggctgatgttgtagttattggttc

SEQ ID NO: 22942 - DNA, 25 bp, E. coli
gatgttgtagtttttggttctcgca

SEQ ID NO: 22943 - DNA, 25 bp, E. coli
gatgttgtagttattggttctcgca

SEQ ID NO: 22944 - DNA, 25 bp, E. coli
gggctgatgttgaagttattggttc

SEQ ID NO: 22945 - DNA, 25 bp, E. coli
gagtttctaaggagtaccgttgtca

SEQ ID NO: 22946 - DNA, 25 bp, E. coli
gagtttctaaggtgtaccgttgtca

SEQ ID NO: 22947 - DNA, 25 bp, E. coli
taaagattacgccttctctgacggc

SEQ ID NO: 22948 - DNA, 25 bp, E. coli
taaagattacgcgttctctgacggc

SEQ ID NO: 22949 - DNA, 25 bp, E. coli
tatgcgttccgcaaacatttcggca

SEQ ID NO: 22950 - DNA, 25 bp, E. coli
tatgcgttccgctaacatttcggca

SEQ ID NO: 22951 - DNA, 25 bp, E. coli
tttgatacgcgttgaaggttcagtc

SEQ ID NO: 22952 - DNA, 25 bp, E. coli
tttgatacgcgtagaaggttcagtc

SEQ ID NO: 22953 - DNA, 25 bp, E. coli
tgtaccgactggtttgcttaatgaa

SEQ ID NO: 22954 - DNA, 25 bp, E. coli
tgtaccgactggattgcttaatgaa

SEQ ID NO: 22955 - DNA, 25 bp, E. coli
tcctgatggtagttaacgctgttcg

SEQ ID NO: 22956 - DNA, 25 bp, E. coli
tcctgatggtagataacgctgttcg

SEQ ID NO: 22957 - DNA, 25 bp, E. coli
gcattttgaaccttatgagcggcat

SEQ ID NO: 22958 - DNA, 25 bp, E. coli
gcattttgaaccatatgagcggcat

SEQ ID NO: 22959 - DNA, 25 bp, E. coli
gaaagatatttgtgactgcctgtac

SEQ ID NO: 22960 - DNA, 25 bp, E. coli
gaaatgattgctaatctcaactcgg

SEQ ID NO: 22961 - DNA, 25 bp, E. coli
gaaagatatttgagactgcctgtac

SEQ ID NO: 22962 - DNA, 25 bp, E. coli
gaaatgattgcttatctcaactcgg

SEQ ID NO: 22963 - DNA, 25 bp, E. coli
cgcacccatggatgctgaaagatat

SEQ ID NO: 22964 - DNA, 25 bp, E. coli
cgcacccatggaagctgaaagatat

SEQ ID NO: 22965 - DNA, 25 bp, E. coli
tcaactcggaagaacgcaatcatca

SEQ ID NO: 22966 - DNA, 25 bp, E. coli
tcaactcggaagtacgcaatcatca

SEQ ID NO: 22967 - DNA, 25 bp, E. coli
catcattacttttatttgtcgataa

SEQ ID NO: 22968 - DNA, 25 bp, E. coli
catcattactttaatttgtcgataa

SEQ ID NO: 22969 - DNA, 25 bp, E. coli
cgataaacccgaactttcgcagtta

SEQ ID NO: 22970 - DNA, 25 bp, E. coli
cgataaacccgatctttcgcagtta

SEQ ID NO: 22971 - DNA, 25 bp, E. coli
taaacccgatctatcgcagttacgg

SEQ ID NO: 22972 - DNA, 25 bp, E. coli
ataaacccgatctttcgcagttacg

SEQ ID NO: 22973 - DNA, 25 bp, E. coli
ataaacccgatcattcgcagttacg

SEQ ID NO: 22974 - DNA, 25 bp, E. coli
tttatttgtcgataaacccgatctt

SEQ ID NO: 22975 - DNA, 25 bp, E. coli
ttttatttgtcgataaacccgatct

SEQ ID NO: 22976 - DNA, 25 bp, E. coli
ttttatttgtcgttaaacccgatct

SEQ ID NO: 22977 - DNA, 25 bp, E. coli
tttatttgtcgaaaaacccgatctt

SEQ ID NO: 22978 - DNA, 25 bp, E. coli
tcgataaacccgttctttcgcagtt

SEQ ID NO: 22979 - DNA, 25 bp, E. coli
tcgataaacccgatctttcgcagtt

SEQ ID NO: 22980 - DNA, 25 bp, E. coli
tcattacttttaattgtcgataaac

SEQ ID NO: 22981 - DNA, 25 bp, E. coli
tcattacttttatttgtcgataaac

SEQ ID NO: 22982 - DNA, 25 bp, E. coli
ccatcattacttttatttgtcgata

SEQ ID NO: 22983 - DNA, 25 bp, E. coli
ccatcattacttatatttgtcgata

SEQ ID NO: 22984 - DNA, 25 bp, E. coli
gataaacccgatgtttcgcagttac

SEQ ID NO: 22985 - DNA, 25 bp, E. coli
gataaacccgatctttcgcagttac

SEQ ID NO: 22986 - DNA, 25 bp, E. coli
gtcgataaacccgatctttcgcagt

SEQ ID NO: 22987 - DNA, 25 bp, E. coli
gtcgataaaccccatctttcgcagt

SEQ ID NO: 22988 - DNA, 25 bp, E. coli
taaacccgatctttcgcagttacgg

SEQ ID NO: 22989 - DNA, 25 bp, E. coli
caatcgctgcgggtaacaacggtac

SEQ ID NO: 22990 - DNA, 25 bp, E. coli
caatcgctgcggctaacaacggtac

SEQ ID NO: 22991 - DNA, 25 bp, E. coli
caaaagcggcatcggtattgaccag

SEQ ID NO: 22992 - DNA, 25 bp, E. coli
caaaagcggcatgggtattgaccag

SEQ ID NO: 22993 - DNA, 25 bp, E. coli
atgggcgcgttcacctctacggcaa

SEQ ID NO: 22994 - DNA, 25 bp, E. coli
atgggcgcgttctcctctacggcaa

SEQ ID NO: 22995 - DNA, 25 bp, E. coli
tttaacaatgttagcctggcgatcg

SEQ ID NO: 22996 - DNA, 25 bp, E. coli
tttaacaatgtttgcctggcgatcg

SEQ ID NO: 22997 - DNA, 25 bp, E. coli
tctgggtacctcatacaaaagcggc

SEQ ID NO: 22998 - DNA, 25 bp, E. coli
tctgggtacctcttacaaaagcggc

SEQ ID NO: 22999 - DNA, 25 bp, E. coli
tcagtgtgttctttcgttccggacg

SEQ ID NO: 23000 - DNA, 25 bp, E. coli
tcagtgtgttctatcgttccggacg

SEQ ID NO: 23001 - DNA, 25 bp, E. coli
ccagatctgggttatttcgaagcaa

SEQ ID NO: 23002 - DNA, 25 bp, E. coli
ccagatctgggtaatttcgaagcaa

SEQ ID NO: 23003 - DNA, 25 bp, E. coli
gaaaatcgtgaaagatactgccact

SEQ ID NO: 23004 - DNA, 25 bp, E. coli
gaaaaatttccacattcgcctgcaa

SEQ ID NO: 23005 - DNA, 25 bp, E. coli
gaaaatcgtgaatgatactgccact

SEQ ID NO: 23006 - DNA, 25 bp, E. coli
gaaaaatttccagattcgcctgcaa

SEQ ID NO: 23007 - DNA, 25 bp, E. coli
ggtaccgtttcttctgcaaatagcg

SEQ ID NO: 23008 - DNA, 25 bp, E. coli
ggtaccgtttctactgcaaatagcg

SEQ ID NO: 23009 - DNA, 25 bp, E. coli
tggcgatcggtgtctctctgggtac

SEQ ID NO: 23010 - DNA, 25 bp, E. coli
tggcgatcggtgactctctgggtac

SEQ ID NO: 23011 - DNA, 25 bp, E. coli
caacgatgtctttccgacggcgatg

SEQ ID NO: 23012 - DNA, 25 bp, E. coli
caacgatgtcttaccgacggcgatg

SEQ ID NO: 23013 - DNA, 25 bp, E. coli
cagcggtgggtactggactaaatac

SEQ ID NO: 23014 - DNA, 25 bp, E. coli
cagcggtgggtagtggactaaatac

SEQ ID NO: 23015 - DNA, 25 bp, E. coli
tactggcaggactgcatgacgacga

SEQ ID NO: 23016 - DNA, 25 bp, E. coli
taaagttcacccaaacgacgacgtg

SEQ ID NO: 23017 - DNA, 25 bp, E. coli
taaagttcaccctaacgacgacgtg

SEQ ID NO: 23018 - DNA, 25 bp, E. coli
tactggcaggacagcatgacgacga

SEQ ID NO: 23019 - DNA, 25 bp, E. coli
tatgcgcgtcgcgtagcagatgaac

SEQ ID NO: 23020 - DNA, 25 bp, E. coli
tatgcgcgtcgcctagcagatgaac

SEQ ID NO: 23021 - DNA, 25 bp, E. coli
tgtctgaagagatagcgagcgccat

SEQ ID NO: 23022 - DNA, 25 bp, E. coli
tgtctgaagagaaagcgagcgccat

SEQ ID NO: 23023 - DNA, 25 bp, E. coli
tgatgtcccggctgataagctgtgg

SEQ ID NO: 23024 - DNA, 25 bp, E. coli
tgactgcgcttatcacccacattgg

SEQ ID NO: 23025 - DNA, 25 bp, E. coli
tgatgtcccggcagataagctgtgg

SEQ ID NO: 23026 - DNA, 25 bp, E. coli
tgactgcgcttaacacccacattgg

SEQ ID NO: 23027 - DNA, 25 bp, E. coli
cccgcgctgcggaattggtgaaatc

SEQ ID NO: 23028 - DNA, 25 bp, E. coli
cccgcgctgcggtattggtgaaatc

SEQ ID NO: 23029 - DNA, 25 bp, E. coli
ggctccggcacggaaagtaacatga

SEQ ID NO: 23030 - DNA, 25 bp, E. coli
ggctccggcacgcaaagtaacatga

SEQ ID NO: 23031 - DNA, 25 bp, E. coli
taaccgggccagtgaattactcggc

SEQ ID NO: 23032 - DNA, 25 bp, E. coli
taaccgggccagagaattactcggc

SEQ ID NO: 23033 - DNA, 25 bp, E. coli
attgcctatgcgttgtttgtgctgt

SEQ ID NO: 23034 - DNA, 25 bp, E. coli
attgcctatgcgatgtttgtgctgt

SEQ ID NO: 23035 - DNA, 25 bp, E. coli
tagtaggctgccacatttttgcagt

SEQ ID NO: 23036 - DNA, 25 bp, E. coli
tagtaggctgcctcatttttgcagt

SEQ ID NO: 23037 - DNA, 25 bp, E. coli
ttgtgctgttttccttttgggctgg

SEQ ID NO: 23038 - DNA, 25 bp, E. coli
ttgtgctgttttgcttttgggctgg

SEQ ID NO: 23039 - DNA, 25 bp, E. coli
tgagcgtttaatgcaggtccaggaa

SEQ ID NO: 23040 - DNA, 25 bp, E. coli
tgagcgtttaatccaggtccaggaa

SEQ ID NO: 23041 - DNA, 25 bp, E. coli
tccaggaaacagctcgcccacgggt

SEQ ID NO: 23042 - DNA, 25 bp, E. coli
tccaggaaacaggtcgcccacgggt

SEQ ID NO: 23043 - DNA, 25 bp, E. coli
gcgcccggcgtcaatgagcgtttaa

SEQ ID NO: 23044 - DNA, 25 bp, E. coli
gcgcccggcgtctatgagcgtttaa

SEQ ID NO: 23045 - DNA, 25 bp, E. coli
gcactggcgacaacgccgccagtaa

SEQ ID NO: 23046 - DNA, 25 bp, E. coli
gcactggcgacatcgccgccagtaa

SEQ ID NO: 23047 - DNA, 25 bp, E. coli
gaaattggtttacgtgtcggcacca

SEQ ID NO: 23048 - DNA, 25 bp, E. coli
gaaattggtttaggtgtcggcacca

SEQ ID NO: 23049 - DNA, 25 bp, E. coli
ggctgatcccgtttttagtaggctg

SEQ ID NO: 23050 - DNA, 25 bp, E. coli
ggctgatcccgtatttagtaggctg

SEQ ID NO: 23051 - DNA, 25 bp, E. coli
tggcgctatggctgcactggcgaca

SEQ ID NO: 23052 - DNA, 25 bp, E. coli
tggcgctatggcagcactggcgaca

SEQ ID NO: 23053 - DNA, 25 bp, E. coli
taatgcaggtcctggaaacaggtcg

SEQ ID NO: 23054 - DNA, 25 bp, E. coli
taatgcaggtccaggaaacaggtcg

SEQ ID NO: 23055 - DNA, 25 bp, E. coli
aattctgcagccgtgtactcactag

SEQ ID NO: 23056 - DNA, 25 bp, E. coli
aatagtggcgcagattgtagcggaa

SEQ ID NO: 23057 - DNA, 25 bp, E. coli
aatagtggcgcacattgtagcggaa

SEQ ID NO: 23058 - DNA, 25 bp, E. coli
aattctgcagccctgtactcactag

SEQ ID NO: 23059 - DNA, 25 bp, E. coli
catgggaagaattgtggcgcagatt

SEQ ID NO: 23060 - DNA, 25 bp, E. coli
catgggaagaatagtggcgcagatt

SEQ ID NO: 23061 - DNA, 25 bp, E. coli
cagattgtagcggaattctgcagcc

SEQ ID NO: 23062 - DNA, 25 bp, E. coli
cagattgtagcgcaattctgcagcc

SEQ ID NO: 23063 - DNA, 25 bp, E. coli
aaaaactcggcgcatatcgctagtc

SEQ ID NO: 23064 - DNA, 25 bp, E. coli
aaaaactcggcggatatcgctagtc

SEQ ID NO: 23065 - DNA, 25 bp, E. coli
tagcggaattctccagccgtgtact

SEQ ID NO: 23066 - DNA, 25 bp, E. coli
tagcggaattctgcagccgtgtact

SEQ ID NO: 23067 - DNA, 25 bp, E. coli
tcctgagcatggcaagaatagtggc

SEQ ID NO: 23068 - DNA, 25 bp, E. coli
tcctgagcatgggaagaatagtggc

SEQ ID NO: 23069 - DNA, 25 bp, E. coli
gccgtgtactcagtagcttaaaaaa

SEQ ID NO: 23070 - DNA, 25 bp, E. coli
gccgtgtactcactagcttaaaaaa

SEQ ID NO: 23071 - DNA, 25 bp, E. coli
gcgcatatcgctagtccggatgaaa

SEQ ID NO: 23072 - DNA, 25 bp, E. coli
gcagccgtgtactcactagcttaaa

SEQ ID NO: 23073 - DNA, 25 bp, E. coli
gcgcatatcgcttgtccggatgaaa

SEQ ID NO: 23074 - DNA, 25 bp, E. coli
gcagccgtgtacacactagcttaaa

SEQ ID NO: 23075 - DNA, 25 bp, E. coli
gatatctcctgaccatgggaagaat

SEQ ID NO: 23076 - DNA, 25 bp, E. coli
gatatctcctgagcatgggaagaat

SEQ ID NO: 23077 - DNA, 25 bp, E. coli
aactggatccgttccgatatcggcg

SEQ ID NO: 23078 - DNA, 25 bp, E. coli
agaaactgacgcgtctgcccctttc

SEQ ID NO: 23079 - DNA, 25 bp, E. coli
agaaactgacgcctctgcccctttc

SEQ ID NO: 23080 - DNA, 25 bp, E. coli
actggatccgtaccgatatcggcga

SEQ ID NO: 23081 - DNA, 25 bp, E. coli
aaagctgtcgattgtattgcgcaga

SEQ ID NO: 23082 - DNA, 25 bp, E. coli
aaagctgtcgatagtattgcgcaga

SEQ ID NO: 23083 - DNA, 25 bp, E. coli
aaaactggatccctaccgatatcgg

SEQ ID NO: 23084 - DNA, 25 bp, E. coli
aactggatccgtaccgatatcggcg

SEQ ID NO: 23085 - DNA, 25 bp, E. coli
actggatccgtagcgatatcggcga

SEQ ID NO: 23086 - DNA, 25 bp, E. coli
aaaactggatccgtaccgatatcgg

SEQ ID NO: 23087 - DNA, 25 bp, E. coli
gcggcgaaagctctcgattgtattg

SEQ ID NO: 23088 - DNA, 25 bp, E. coli
gcggcgaaagctgtcgattgtattg

SEQ ID NO: 23089 - DNA, 25 bp, E. coli
gaaaaaactggaaccgtaccgatat

SEQ ID NO: 23090 - DNA, 25 bp, E. coli
gaaaaaactggatccgtaccgatat

SEQ ID NO: 23091 - DNA, 25 bp, E. coli
cgaaagctgtcgattgtattgcgca

SEQ ID NO: 23092 - DNA, 25 bp, E. coli
cgaaagctgtcgtttgtattgcgca

SEQ ID NO: 23093 - DNA, 25 bp, E. coli
ctgtcgattgtaatgcgcagatgga

SEQ ID NO: 23094 - DNA, 25 bp, E. coli
ctgtcgattgtattgcgcagatgga

SEQ ID NO: 23095 - DNA, 25 bp, E. coli
tggatccgtaccgatatcggcgatt

SEQ ID NO: 23096 - DNA, 25 bp, E. coli
tggatccgtacccatatcggcgatt

SEQ ID NO: 23097 - DNA, 25 bp, E. coli
gatccgtaccgaaatcggcgattac

SEQ ID NO: 23098 - DNA, 25 bp, E. coli
gatccgtaccgatatcggcgattac

SEQ ID NO: 23099 - DNA, 25 bp, E. coli
cactggaagccagacgtaaggtcat

SEQ ID NO: 23100 - DNA, 25 bp, E. coli
cagacgtaaggtcatcaaagagaca

SEQ ID NO: 23101 - DNA, 25 bp, E. coli
cagacgtaaggtgatcaaagagaca

SEQ ID NO: 23102 - DNA, 25 bp, E. coli
cactggaagccacacgtaaggtcat

SEQ ID NO: 23103 - DNA, 25 bp, E. coli
catcagtatggtatcaccccaggca

SEQ ID NO: 23104 - DNA, 25 bp, E. coli
catcagtatggtttcaccccaggca

SEQ ID NO: 23105 - DNA, 25 bp, E. coli
agtatggtttcagcccaggcactgg

SEQ ID NO: 23106 - DNA, 25 bp, E. coli
agtatggtttcaccccaggcactgg

SEQ ID NO: 23107 - DNA, 25 bp, E. coli
tagctggcttttcgttgacccttca

SEQ ID NO: 23108 - DNA, 25 bp, E. coli
tagctggcttttggttgacccttca

SEQ ID NO: 23109 - DNA, 25 bp, E. coli
ttggttgacccttcatctaccgcgc

SEQ ID NO: 23110 - DNA, 25 bp, E. coli
ttggttgaccctacatctaccgcgc

SEQ ID NO: 23111 - DNA, 25 bp, E. coli
gaagccagacgtaaggtcatcaaag

SEQ ID NO: 23112 - DNA, 25 bp, E. coli
gaagccagacgttaggtcatcaaag

SEQ ID NO: 23113 - DNA, 25 bp, E. coli
tggtttcaccccaggcactggaagc

SEQ ID NO: 23114 - DNA, 25 bp, E. coli
tggtttcacccctggcactggaagc

SEQ ID NO: 23115 - DNA, 25 bp, E. coli
tggcctggtttaacacatcagtatg

SEQ ID NO: 23116 - DNA, 25 bp, E. coli
tggcctggtttatcacatcagtatg

SEQ ID NO: 23117 - DNA, 25 bp, E. coli
tcaaagagacaatccttagctggct

SEQ ID NO: 23118 - DNA, 25 bp, E. coli
tcaaagagacaaaccttagctggct

SEQ ID NO: 23119 - DNA, 25 bp, E. coli
gagacaatcctttgctggcttttgg

SEQ ID NO: 23120 - DNA, 25 bp, E. coli
gagacaatccttagctggcttttgg

SEQ ID NO: 23121 - DNA, 25 bp, E. coli
aatacggtgtttcaagagcgacgct

SEQ ID NO: 23122 - DNA, 25 bp, E. coli
aatgctcagcaaaatccgcgatggg

SEQ ID NO: 23123 - DNA, 25 bp, E. coli
aatgctcagcaatatccgcgatggg

SEQ ID NO: 23124 - DNA, 25 bp, E. coli
aatacggtgtttgaagagcgacgct

SEQ ID NO: 23125 - DNA, 25 bp, E. coli
tggtagttgcaatgctggaccgcct

SEQ ID NO: 23126 - DNA, 25 bp, E. coli
tgctaaaatcgctccggaagctcgt

SEQ ID NO: 23127 - DNA, 25 bp, E. coli
tgctaaaatcgcaccggaagctcgt

SEQ ID NO: 23128 - DNA, 25 bp, E. coli
gcgtgtttcgacatcccagcaggat

SEQ ID NO: 23129 - DNA, 25 bp, E. coli
gcgtgtttcgacttcccagcaggat

SEQ ID NO: 23130 - DNA, 25 bp, E. coli
ccgcctcgggcgtgatgcaattgac

SEQ ID NO: 23131 - DNA, 25 bp, E. coli
ccgcctcgggcgagatgcaattgac

SEQ ID NO: 23132 - DNA, 25 bp, E. coli
ctatggctatttttggctacgggcg

SEQ ID NO: 23133 - DNA, 25 bp, E. coli
ctatggctatttatggctacgggcg

SEQ ID NO: 23134 - DNA, 25 bp, E. coli
gatactgagaacgagcgcatggaac

SEQ ID NO: 23135 - DNA, 25 bp, E. coli
gatactgagaaccagcgcatggaac

SEQ ID NO: 23136 - DNA, 25 bp, E. coli
tggtagttgcaaagctggaccgcct

SEQ ID NO: 23137 - DNA, 25 bp, E. coli
taagctcctgttgtcgatgctagca

SEQ ID NO: 23138 - DNA, 25 bp, E. coli
taagctcctgttctcgatgctagca

SEQ ID NO: 23139 - DNA, 25 bp, E. coli
gacctgctgattcaacggactaatg

SEQ ID NO: 23140 - DNA, 25 bp, E. coli
ggaaaggttcctccggtgcaacgca

SEQ ID NO: 23141 - DNA, 25 bp, E. coli
ggaaaggttcctgcggtgcaacgca

SEQ ID NO: 23142 - DNA, 25 bp, E. coli
gacctgctgattgaacggactaatg

SEQ ID NO: 23143 - DNA, 25 bp, E. coli
caagatcagcgaaagtgacgacccg

SEQ ID NO: 23144 - DNA, 25 bp, E. coli
cagcgtaaagaagttctgatgacca

SEQ ID NO: 23145 - DNA, 25 bp, E. coli
caagatcagcgatagtgacgacccg

SEQ ID NO: 23146 - DNA, 25 bp, E. coli
cagcgtaaagaacttctgatgacca

SEQ ID NO: 23147 - DNA, 25 bp, E. coli
taaaactgagatgatccagcgactg

SEQ ID NO: 23148 - DNA, 25 bp, E. coli
taaaactgagatcatccagcgactg

SEQ ID NO: 23149 - DNA, 25 bp, E. coli
tatgcgcagtatcaatagtctggcc

SEQ ID NO: 23150 - DNA, 25 bp, E. coli
tatgcgcagtatgaatagtctggcc

SEQ ID NO: 23151 - DNA, 25 bp, E. coli
tattcaacgcgaagaagcgcaaatt

SEQ ID NO: 23152 - DNA, 25 bp, E. coli
tattcaacgcgatgaagcgcaaatt

SEQ ID NO: 23153 - DNA, 25 bp, E. coli
ttgatgatgatactgcgctgtttgg

SEQ ID NO: 23154 - DNA, 25 bp, E. coli
ttgatgatgatagtgcgctgtttgg

SEQ ID NO: 23155 - DNA, 25 bp, E. coli
tgacgacccgtcgtatatgcgcagt

SEQ ID NO: 23156 - DNA, 25 bp, E. coli
tgacgacccgtcctatatgcgcagt

SEQ ID NO: 23157 - DNA, 25 bp, E. coli
tctggccaccttggttattcaaaag

SEQ ID NO: 23158 - DNA, 25 bp, E. coli
tctggccaccttcgttattcaaaag

SEQ ID NO: 23159 - DNA, 25 bp, E. coli
tccgtcgatgcatcggaaattgtcg

SEQ ID NO: 23160 - DNA, 25 bp, E. coli
tccgtcgatgcaacggaaattgtcg

SEQ ID NO: 23161 - DNA, 25 bp, E. coli
gaaattgtcgttgtgctggataaag

SEQ ID NO: 23162 - DNA, 25 bp, E. coli
gaaattgtcgttctgctggataaag

SEQ ID NO: 23163 - DNA, 25 bp, E. coli
ggttttaaactgcactccgtcgatg

SEQ ID NO: 23164 - DNA, 25 bp, E. coli
ggttttaaactggactccgtcgatg

SEQ ID NO: 23165 - DNA, 25 bp, E. coli
caaatgctcaagtggcggtaaaaac

SEQ ID NO: 23166 - DNA, 25 bp, E. coli
caaatgctcaagaggcggtaaaaac

SEQ ID NO: 23167 - DNA, 25 bp, E. coli
catcgcctgggacaaccttacggtt

SEQ ID NO: 23168 - DNA, 25 bp, E. coli
catcgcctgggagaaccttacggtt

SEQ ID NO: 23169 - DNA, 25 bp, E. coli
aaagtttgtttgtctacgagcacga

SEQ ID NO: 23170 - DNA, 25 bp, E. coli
aaagtttgtttgactacgagcacga

SEQ ID NO: 23171 - DNA, 25 bp, E. coli
tattttcccggttctggcgctggta

SEQ ID NO: 23172 - DNA, 25 bp, E. coli
tatttccaatggctctgcctgcggc

SEQ ID NO: 23173 - DNA, 25 bp, E. coli
tatttccaatgggtctgcctgcggc

SEQ ID NO: 23174 - DNA, 25 bp, E. coli
tattttcccggtactggcgctggta

SEQ ID NO: 23175 - DNA, 25 bp, E. coli
ttctgtcgccggtaggtttaggtgc

SEQ ID NO: 23176 - DNA, 25 bp, E. coli
ttctgtcgccggaaggtttaggtgc

SEQ ID NO: 23177 - DNA, 25 bp, E. coli
cctttatgacggctaacgaattgca

SEQ ID NO: 23178 - DNA, 25 bp, E. coli
cctttatgacgggtaacgaattgca

SEQ ID NO: 23179 - DNA, 25 bp, E. coli
gaagcagccagagactaccagtggt

SEQ ID NO: 23180 - DNA, 25 bp, E. coli
gaagcagccagacactaccagtggt

SEQ ID NO: 23181 - DNA, 25 bp, E. coli
gcagtttgcactaggtgcgccagaa

SEQ ID NO: 23182 - DNA, 25 bp, E. coli
gcagtttgcacttggtgcgccagaa

SEQ ID NO: 23183 - DNA, 25 bp, E. coli
gatttcagcttttatggcaaccggc

SEQ ID NO: 23184 - DNA, 25 bp, E. coli
gatttcagctttaatggcaaccggc

SEQ ID NO: 23185 - DNA, 25 bp, E. coli
taagtagcgcctttagtgttgtccg

SEQ ID NO: 23186 - DNA, 25 bp, E. coli
taagtagcgcctatagtgttgtccg

SEQ ID NO: 23187 - DNA, 25 bp, E. coli
catttcttctgcagtcatccgcaca

SEQ ID NO: 23188 - DNA, 25 bp, E. coli
catttcttctgctgtcatccgcaca

SEQ ID NO: 23189 - DNA, 25 bp, E. coli
tacagctgtaagtaactccgctcag

SEQ ID NO: 23190 - DNA, 25 bp, E. coli
tacagctgtaagaaactccgctcag

SEQ ID NO: 23191 - DNA, 25 bp, E. coli
tatttcctctttactccagcctgtt

SEQ ID NO: 23192 - DNA, 25 bp, E. coli
tatttcctcttttctccagcctgtt

SEQ ID NO: 23193 - DNA, 25 bp, E. coli
tccgctcagtactgaagcaccagtc

SEQ ID NO: 23194 - DNA, 25 bp, E. coli
tcgcaatttgctgacatggattaaa

SEQ ID NO: 23195 - DNA, 25 bp, E. coli
tccagcctgttatattaagcatact

SEQ ID NO: 23196 - DNA, 25 bp, E. coli
tccgctcagtacagaagcaccagtc

SEQ ID NO: 23197 - DNA, 25 bp, E. coli
tccagcctgttaaattaagcatact

SEQ ID NO: 23198 - DNA, 25 bp, E. coli
tcgcaatttgctcacatggattaaa

SEQ ID NO: 23199 - DNA, 25 bp, E. coli
tcatccgcacaggagaagaattcct

SEQ ID NO: 23200 - DNA, 25 bp, E. coli
tcatccgcacagcagaagaattcct

SEQ ID NO: 23201 - DNA, 25 bp, E. coli
gcatactgattaacgatttttaacg

SEQ ID NO: 23202 - DNA, 25 bp, E. coli
gcatactgattatcgatttttaacg

SEQ ID NO: 23203 - DNA, 25 bp, E. coli
gaagcaccagtcgtatttcctcttt

SEQ ID NO: 23204 - DNA, 25 bp, E. coli
gcagaagaattcctcattgactatt

SEQ ID NO: 23205 - DNA, 25 bp, E. coli
gcagaagaattcgtcattgactatt

SEQ ID NO: 23206 - DNA, 25 bp, E. coli
gaagcaccagtcctatttcctcttt

SEQ ID NO: 23207 - DNA, 25 bp, E. coli
gatataaacttctgcctacagctgt

SEQ ID NO: 23208 - DNA, 25 bp, E. coli
gatataaacttcagcctacagctgt

SEQ ID NO: 23209 - DNA, 25 bp, E. coli
tagtaaccattctggaacgcaaccg

SEQ ID NO: 23210 - DNA, 25 bp, E. coli
tatgggcctgctaaggtgacgtctc

SEQ ID NO: 23211 - DNA, 25 bp, E. coli
tatgggcctgcttaggtgacgtctc

SEQ ID NO: 23212 - DNA, 25 bp, E. coli
tagtaaccattcaggaacgcaaccg

SEQ ID NO: 23213 - DNA, 25 bp, E. coli
tattagagcttatacaggcattcgg

SEQ ID NO: 23214 - DNA, 25 bp, E. coli
tattagagcttaaacaggcattcgg

SEQ ID NO: 23215 - DNA, 25 bp, E. coli
ccagcaggatgcctgtaagcgaatt

SEQ ID NO: 23216 - DNA, 25 bp, E. coli
ccagcaggatgcgtgtaagcgaatt

SEQ ID NO: 23217 - DNA, 25 bp, E. coli
gaaattcgatctccggcacatcagc

SEQ ID NO: 23218 - DNA, 25 bp, E. coli
gaaattcgatctgcggcacatcagc

SEQ ID NO: 23219 - DNA, 25 bp, E. coli
cgcgactggctctcgaatggaaagc

SEQ ID NO: 23220 - DNA, 25 bp, E. coli
cgttaagtggtcagacgaagcgcga

SEQ ID NO: 23221 - DNA, 25 bp, E. coli
cgcgactggctcacgaatggaaagc

SEQ ID NO: 23222 - DNA, 25 bp, E. coli
cgttaagtggtctgacgaagcgcga

SEQ ID NO: 23223 - DNA, 25 bp, E. coli
gtttaccgcagctttaaagcagcag

SEQ ID NO: 23224 - DNA, 25 bp, E. coli
gtttaccgcagcattaaagcagcag

SEQ ID NO: 23225 - DNA, 25 bp, E. coli
taataggccagtcaaccagcaggat

SEQ ID NO: 23226 - DNA, 25 bp, E. coli
taataggccagtgaaccagcaggat

SEQ ID NO: 23227 - DNA, 25 bp, E. coli
gaccaaaacaggtagctatgggcct

SEQ ID NO: 23228 - DNA, 25 bp, E. coli
gaccaaaacaggaagctatgggcct

SEQ ID NO: 23229 - DNA, 25 bp, E. coli
gatgttgttcctaaccttgccggga

SEQ ID NO: 23230 - DNA, 25 bp, E. coli
gatgttgttccttaccttgccggga

SEQ ID NO: 23231 - DNA, 25 bp, E. coli
tattgcgcgtcacgtggttgaacca

SEQ ID NO: 23232 - DNA, 25 bp, E. coli
tattgcgcgtcaggtggttgaacca

SEQ ID NO: 23233 - DNA, 25 bp, E. coli
ttcagcaagagaggcaacaccagat

SEQ ID NO: 23234 - DNA, 25 bp, E. coli
ttcagcaagagacgcaacaccagat

SEQ ID NO: 23235 - DNA, 25 bp, E. coli
tcattgataataacggcgcaccgga

SEQ ID NO: 23236 - DNA, 25 bp, E. coli
tcattgataatatcggcgcaccgga

SEQ ID NO: 23237 - DNA, 25 bp, E. coli
gccattgctggttgaaaactcactg

SEQ ID NO: 23238 - DNA, 25 bp, E. coli
gccattgctggtagaaaactcactg

SEQ ID NO: 23239 - DNA, 25 bp, E. coli
gccaatgcgtttgctgatctcggaa

SEQ ID NO: 23240 - DNA, 25 bp, E. coli
gccaatgcgtttcctgatctcggaa

SEQ ID NO: 23241 - DNA, 25 bp, E. coli
gcgtcgcagtttctctcacaggaaa

SEQ ID NO: 23242 - DNA, 25 bp, E. coli
gcgtcgcagtttgtctcacaggaaa

SEQ ID NO: 23243 - DNA, 25 bp, E. coli
gagaaaaactgggttaacgccctgc

SEQ ID NO: 23244 - DNA, 25 bp, E. coli
gagaaaaactggcttaacgccctgc

SEQ ID NO: 23245 - DNA, 25 bp, E. coli
cattggcagtggcaagagtaccgtt

SEQ ID NO: 23246 - DNA, 25 bp, E. coli
ctgatggaacattgcagcgccgggc

SEQ ID NO: 23247 - DNA, 25 bp, E. coli
ctgatggaacatagcagcgccgggc

SEQ ID NO: 23248 - DNA, 25 bp, E. coli
cattggcagtgggaagagtaccgtt

SEQ ID NO: 23249 - DNA, 25 bp, E. coli
ggatgtcagccctgaaacgcaactt

SEQ ID NO: 23250 - DNA, 25 bp, E. coli
ggatgtcagcccagaaacgcaactt

SEQ ID NO: 23251 - DNA, 25 bp, E. coli
gatgtaactcgccagcatgtcgaac

SEQ ID NO: 23252 - DNA, 25 bp, E. coli
gatgtaactcgcgagcatgtcgaac

SEQ ID NO: 23253 - DNA, 25 bp, E. coli
caaggattcagagatcgtgatgggc

SEQ ID NO: 23254 - DNA, 25 bp, E. coli
caaggattcagacatcgtgatgggc

SEQ ID NO: 23255 - DNA, 25 bp, E. coli
cacttcattgcggaacttgcggact

SEQ ID NO: 23256 - DNA, 25 bp, E. coli
cacttcattgcgcaacttgcggact

SEQ ID NO: 23257 - DNA, 25 bp, E. coli
tagccaattaagtgctgaacgcagc

SEQ ID NO: 23258 - DNA, 25 bp, E. coli
tagccaattaagagctgaacgcagc

SEQ ID NO: 23259 - DNA, 25 bp, E. coli
tattactggtatcgccgtgaacaag

SEQ ID NO: 23260 - DNA, 25 bp, E. coli
tattactggtatggccgtgaacaag

SEQ ID NO: 23261 - DNA, 25 bp, E. coli
tttactgaagcggaagccgaagcaa

SEQ ID NO: 23262 - DNA, 25 bp, E. coli
ttattattgcgggaacgctccggca

SEQ ID NO: 23263 - DNA, 25 bp, E. coli
tttactgaagcgcaagccgaagcaa

SEQ ID NO: 23264 - DNA, 25 bp, E. coli
ttattattgcggcaacgctccggca

SEQ ID NO: 23265 - DNA, 25 bp, E. coli
tgcggactatctggaactcgaaaac

SEQ ID NO: 23266 - DNA, 25 bp, E. coli
tgcggactatctcgaactcgaaaac

SEQ ID NO: 23267 - DNA, 25 bp, E. coli
tcgctggtggaagccgcatttagcc

SEQ ID NO: 23268 - DNA, 25 bp, E. coli
tcgctggtggaacccgcatttagcc

SEQ ID NO: 23269 - DNA, 25 bp, E. coli
ccgccgttgcgcctgaaattcagca

SEQ ID NO: 23270 - DNA, 25 bp, E. coli
ccgccgttgcgcgtgaaattcagca

SEQ ID NO: 23271 - DNA, 25 bp, E. coli
ctcgaaaaccatttgccgcgtgcgt

SEQ ID NO: 23272 - DNA, 25 bp, E. coli
ctcgaaaaccatatgccgcgtgcgt

SEQ ID NO: 23273 - DNA, 25 bp, E. coli
ggtttaatgctacgccaactcatgc

SEQ ID NO: 23274 - DNA, 25 bp, E. coli
ggtttaatgctaggccaactcatgc

SEQ ID NO: 23275 - DNA, 25 bp, E. coli
atttctttctgggtgggttggcgtt

SEQ ID NO: 23276 - DNA, 25 bp, E. coli
atttctttctggctgggttggcgtt

SEQ ID NO: 23277 - DNA, 25 bp, E. coli
aaacaaagcactacttgataaaact

SEQ ID NO: 23278 - DNA, 25 bp, E. coli
aaacaaagcacttcttgataaaact

SEQ ID NO: 23279 - DNA, 25 bp, E. coli
ttctttctggctcggttggcgtttt

SEQ ID NO: 23280 - DNA, 25 bp, E. coli
ttattggctgctagatgggcgactg

SEQ ID NO: 23281 - DNA, 25 bp, E. coli
ttattggctgcttgatgggcgactg

SEQ ID NO: 23282 - DNA, 25 bp, E. coli
ttctttctggctgggttggcgtttt

SEQ ID NO: 23283 - DNA, 25 bp, E. coli
tgcttgatgggccactggatttctt

SEQ ID NO: 23284 - DNA, 25 bp, E. coli
tgcttgatgggcgactggatttctt

SEQ ID NO: 23285 - DNA, 25 bp, E. coli
gaaaaacaaagctctacttgataaa

SEQ ID NO: 23286 - DNA, 25 bp, E. coli
gaaaaacaaagcactacttgataaa

SEQ ID NO: 23287 - DNA, 25 bp, E. coli
cgactggatttctttctggctgggt

SEQ ID NO: 23288 - DNA, 25 bp, E. coli
cgactggatttcattctggctgggt

SEQ ID NO: 23289 - DNA, 25 bp, E. coli
cttgatgggcgactggatttctttc

SEQ ID NO: 23290 - DNA, 25 bp, E. coli
cttgatgggcgagtggatttctttc

SEQ ID NO: 23291 - DNA, 25 bp, E. coli
tggatttctttctggctgggttggc

SEQ ID NO: 23292 - DNA, 25 bp, E. coli
tggcagggattaatggctgcttgat

SEQ ID NO: 23293 - DNA, 25 bp, E. coli
tggcagggattattggctgcttgat

SEQ ID NO: 23294 - DNA, 25 bp, E. coli
tggatttctttcaggctgggttggc

SEQ ID NO: 23295 - DNA, 25 bp, E. coli
gatgggcgactgcatttctttctgg

SEQ ID NO: 23296 - DNA, 25 bp, E. coli
gatgggcgactggatttctttctgg

SEQ ID NO: 23297 - DNA, 25 bp, E. coli
cactgcaattaacgtgacaccgaca

SEQ ID NO: 23298 - DNA, 25 bp, E. coli
cactgcaattaaggtgacaccgaca

SEQ ID NO: 23299 - DNA, 25 bp, E. coli
agcgaaattacggcggccactgcaa

SEQ ID NO: 23300 - DNA, 25 bp, E. coli
agcgaaattacgccggccactgcaa

SEQ ID NO: 23301 - DNA, 25 bp, E. coli
tacgccggccacagcaattaaggtg

SEQ ID NO: 23302 - DNA, 25 bp, E. coli
tacgccggccactgcaattaaggtg

SEQ ID NO: 23303 - DNA, 25 bp, E. coli
ttccgtggcggatgaacgcagcgaa

SEQ ID NO: 23304 - DNA, 25 bp, E. coli
ttccgtggcggaagaacgcagcgaa

SEQ ID NO: 23305 - DNA, 25 bp, E. coli
gccactgcaatttaggtgacaccga

SEQ ID NO: 23306 - DNA, 25 bp, E. coli
ccttccgtggcggaagaacgcagcg

SEQ ID NO: 23307 - DNA, 25 bp, E. coli
gccggccactgctattaaggtgaca

SEQ ID NO: 23308 - DNA, 25 bp, E. coli
gccactgcaattaaggtgacaccga

SEQ ID NO: 23309 - DNA, 25 bp, E. coli
ccttccgtggcgcaagaacgcagcg

SEQ ID NO: 23310 - DNA, 25 bp, E. coli
gccggccactgcaattaaggtgaca

SEQ ID NO: 23311 - DNA, 25 bp, E. coli
gcaaaccttccgtggcggaagaacg

SEQ ID NO: 23312 - DNA, 25 bp, E. coli
gcaaaccttccgaggcggaagaacg

SEQ ID NO: 23313 - DNA, 25 bp, E. coli
cgtggcggaagatcgcagcgaaatt

SEQ ID NO: 23314 - DNA, 25 bp, E. coli
cgtggcggaagaacgcagcgaaatt

SEQ ID NO: 23315 - DNA, 25 bp, E. coli
ctgcaattaaggagacaccgacatc

SEQ ID NO: 23316 - DNA, 25 bp, E. coli
ctgcaattaaggtgacaccgacatc

SEQ ID NO: 23317 - DNA, 25 bp, E. coli
taacgtgggcaaaccttccgtggcg

SEQ ID NO: 23318 - DNA, 25 bp, E. coli
taacgtgggcaatccttccgtggcg

SEQ ID NO: 23319 - DNA, 25 bp, E. coli
cagtgaactggaaatctggcatggt

SEQ ID NO: 23320 - DNA, 25 bp, E. coli
cagtgaactggatatctggcatggt

SEQ ID NO: 23321 - DNA, 25 bp, E. coli
tagcaggatgtaagttttgggaccc

SEQ ID NO: 23322 - DNA, 25 bp, E. coli
tagcaggatgtatgttttgggaccc

SEQ ID NO: 23323 - DNA, 25 bp, E. coli
ttttgcccattgcttgccgatattg

SEQ ID NO: 23324 - DNA, 25 bp, E. coli
ttttgcccattggttgccgatattg

SEQ ID NO: 23325 - DNA, 25 bp, E. coli
tgtatgcggtaatggacaagcgccc

SEQ ID NO: 23326 - DNA, 25 bp, E. coli
tgtatgcggtaaaggacaagcgccc

SEQ ID NO: 23327 - DNA, 25 bp, E. coli
gccgtctgtgctcgtgtgattcacg

SEQ ID NO: 23328 - DNA, 25 bp, E. coli
cctgcgggcgctttccttcgtgatg

SEQ ID NO: 23329 - DNA, 25 bp, E. coli
gccgcgaagaccagtgaactggaaa

SEQ ID NO: 23330 - DNA, 25 bp, E. coli
gccgtctgtgctggtgtgattcacg

SEQ ID NO: 23331 - DNA, 25 bp, E. coli
gccgcgaagacctgtgaactggaaa

SEQ ID NO: 23332 - DNA, 25 bp, E. coli
cctgcgggcgctatccttcgtgatg

SEQ ID NO: 23333 - DNA, 25 bp, E. coli
cattgtcgggctgattttcttcttc

SEQ ID NO: 23334 - DNA, 25 bp, E. coli
cgtgggctttcgaccgcagaaggtt

SEQ ID NO: 23335 - DNA, 25 bp, E. coli
cattgtcgggctcattttcttcttc

SEQ ID NO: 23336 - DNA, 25 bp, E. coli
cgtgggctttcgtccgcagaaggtt

SEQ ID NO: 23337 - DNA, 25 bp, E. coli
gatattgttctctttgtcgggctga

SEQ ID NO: 23338 - DNA, 25 bp, E. coli
gatattgttctcattgtcgggctga

SEQ ID NO: 23339 - DNA, 25 bp, E. coli
gattcacggcgtcggctttcgtccg

SEQ ID NO: 23340 - DNA, 25 bp, E. coli
gattcacggcgtgggctttcgtccg

SEQ ID NO: 23341 - DNA, 25 bp, E. coli
ttgcctctgttgaccgtacggccct

SEQ ID NO: 23342 - DNA, 25 bp, E. coli
ttgcctctgttgtccgtacggccct

SEQ ID NO: 23343 - DNA, 25 bp, E. coli
tgttgcctctgttgtccgtacggcc

SEQ ID NO: 23344 - DNA, 25 bp, E. coli
tgttgcctctgtagtccgtacggcc

SEQ ID NO: 23345 - DNA, 25 bp, E. coli
tgcctctgttgtgcgtacggccctg

SEQ ID NO: 23346 - DNA, 25 bp, E. coli
tgcctctgttgtccgtacggccctg

SEQ ID NO: 23347 - DNA, 25 bp, E. coli
tctgttgtccgttcggccctgcgcg

SEQ ID NO: 23348 - DNA, 25 bp, E. coli
tctgttgtccgtacggccctgcgcg

SEQ ID NO: 23349 - DNA, 25 bp, E. coli
gcctctgttgtcggtacggccctgc

SEQ ID NO: 23350 - DNA, 25 bp, E. coli
cctctgttgtccctacggccctgcg

SEQ ID NO: 23351 - DNA, 25 bp, E. coli
cctctgttgtccgtacggccctgcg

SEQ ID NO: 23352 - DNA, 25 bp, E. coli
gcctctgttgtccgtacggccctgc

SEQ ID NO: 23353 - DNA, 25 bp, E. coli
ctctgttgtccgaacggccctgcgc

SEQ ID NO: 23354 - DNA, 25 bp, E. coli
ctgttgtccgtacggccctgcgcgc

SEQ ID NO: 23355 - DNA, 25 bp, E. coli
ctgttgtccgtagggccctgcgcgc

SEQ ID NO: 23356 - DNA, 25 bp, E. coli
ctctgttgtccgtacggccctgcgc

SEQ ID NO: 23357 - DNA, 25 bp, E. coli
gttgcctctgttctccgtacggccc

SEQ ID NO: 23358 - DNA, 25 bp, E. coli
gttgcctctgttgtccgtacggccc

SEQ ID NO: 23359 - DNA, 25 bp, E. coli
gtgttgcctctgttgtccgtacggc

SEQ ID NO: 23360 - DNA, 25 bp, E. coli
gtgttgcctctgatgtccgtacggc

SEQ ID NO: 23361 - DNA, 25 bp, E. coli
tatcatcggcgagtatacccctggt

SEQ ID NO: 23362 - DNA, 25 bp, E. coli
tatcatcggcgactatacccctggt

SEQ ID NO: 23363 - DNA, 25 bp, E. coli
tgtaacctccaacgataaccgtcag

SEQ ID NO: 23364 - DNA, 25 bp, E. coli
tgtaacctccaaggataaccgtcag

SEQ ID NO: 23365 - DNA, 25 bp, E. coli
gacaggtctaatggtgggattcacg

SEQ ID NO: 23366 - DNA, 25 bp, E. coli
gacaggtctaatcgtgggattcacg

SEQ ID NO: 23367 - DNA, 25 bp, E. coli
cgagcgcggttaatctgttgcaaaa

SEQ ID NO: 23368 - DNA, 25 bp, E. coli
cgcggcggacgatacaggtgaaatt

SEQ ID NO: 23369 - DNA, 25 bp, E. coli
cgcggcggacgaaacaggtgaaatt

SEQ ID NO: 23370 - DNA, 25 bp, E. coli
cgagcgcggttattctgttgcaaaa

SEQ ID NO: 23371 - DNA, 25 bp, E. coli
tgtaccccagttgttacgggcggcg

SEQ ID NO: 23372 - DNA, 25 bp, E. coli
tgtaccccagttcttacgggcggcg

SEQ ID NO: 23373 - DNA, 25 bp, E. coli
gatcaaactggaaggtaacgtcact

SEQ ID NO: 23374 - DNA, 25 bp, E. coli
taacagtgcgctgaatccgaccggt

SEQ ID NO: 23375 - DNA, 25 bp, E. coli
taaccgtcagtcgaccattgtagcg

SEQ ID NO: 23376 - DNA, 25 bp, E. coli
taacagtgcgctcaatccgaccggt

SEQ ID NO: 23377 - DNA, 25 bp, E. coli
taataaactggttcaactgggccgc

SEQ ID NO: 23378 - DNA, 25 bp, E. coli
taataaactggtacaactgggccgc

SEQ ID NO: 23379 - DNA, 25 bp, E. coli
taatggcgcattgtgctcgctgaca

SEQ ID NO: 23380 - DNA, 25 bp, E. coli
taaccgtcagtccaccattgtagcg

SEQ ID NO: 23381 - DNA, 25 bp, E. coli
taatggcgcattctgctcgctgaca

SEQ ID NO: 23382 - DNA, 25 bp, E. coli
gatcaaactggatggtaacgtcact

SEQ ID NO: 23383 - DNA, 25 bp, E. coli
caatcggtactggtctgaacacgcc

SEQ ID NO: 23384 - DNA, 25 bp, E. coli
caatcggtactgctctgaacacgcc

SEQ ID NO: 23385 - DNA, 25 bp, E. coli
aacgtaccgctgtactgctgctgga

SEQ ID NO: 23386 - DNA, 25 bp, E. coli
cagaatctgatgcacccggcttaca

SEQ ID NO: 23387 - DNA, 25 bp, E. coli
cagaatctgatggacccggcttaca

SEQ ID NO: 23388 - DNA, 25 bp, E. coli
aacgtaccgctgaactgctgctgga

SEQ ID NO: 23389 - DNA, 25 bp, E. coli
tcctaaaagtgtagcgaatgccatc

SEQ ID NO: 23390 - DNA, 25 bp, E. coli
tcctaaaagtgttgcgaatgccatc

SEQ ID NO: 23391 - DNA, 25 bp, E. coli
tcatgccagctatagtaaacccggt

SEQ ID NO: 23392 - DNA, 25 bp, E. coli
tcatgccagctaaagtaaacccggt

SEQ ID NO: 23393 - DNA, 25 bp, E. coli
ccatggcagcagtagcaggtcagct

SEQ ID NO: 23394 - DNA, 25 bp, E. coli
ccatggcagcagaagcaggtcagct

SEQ ID NO: 23395 - DNA, 25 bp, E. coli
gctgaagacctgatcgaagcgacct

SEQ ID NO: 23396 - DNA, 25 bp, E. coli
gctgaagacctgttcgaagcgacct

SEQ ID NO: 23397 - DNA, 25 bp, E. coli
gaagtgctggcctatatcggtctgg

SEQ ID NO: 23398 - DNA, 25 bp, E. coli
gaagtgctggccaatatcggtctgg

SEQ ID NO: 23399 - DNA, 25 bp, E. coli
gaaacgcctggcagtgaagatgtcc

SEQ ID NO: 23400 - DNA, 25 bp, E. coli
gaaacgcctggctgtgaagatgtcc

SEQ ID NO: 23401 - DNA, 25 bp, E. coli
gaaagagtactcaccgctggcagtg

SEQ ID NO: 23402 - DNA, 25 bp, E. coli
gaaagagtactctccgctggcagtg

SEQ ID NO: 23403 - DNA, 25 bp, E. coli
cattgccgcatgagatgaagtcctg

SEQ ID NO: 23404 - DNA, 25 bp, E. coli
cattgccgcatgtgatgaagtcctg

SEQ ID NO: 23405 - DNA, 25 bp, E. coli
caaatggtcacattccccgtgtggg

SEQ ID NO: 23406 - DNA, 25 bp, E. coli
caaatggtcacaatccccgtgtggg

SEQ ID NO: 23407 - DNA, 25 bp, E. coli
cagcaggcgcttgatgttgagcacc

SEQ ID NO: 23408 - DNA, 25 bp, E. coli
cagcaggcgcttcatgttgagcacc

SEQ ID NO: 23409 - DNA, 25 bp, E. coli
tacgtgctaaagtactgctggtggc

SEQ ID NO: 23410 - DNA, 25 bp, E. coli
taaaaggcggtagagatttgcatgc

SEQ ID NO: 23411 - DNA, 25 bp, E. coli
tacgtgctaaagaactgctggtggc

SEQ ID NO: 23412 - DNA, 25 bp, E. coli
gccagtttctggctggtcgtcacac

SEQ ID NO: 23413 - DNA, 25 bp, E. coli
gccagtttctgggtggtcgtcacac

SEQ ID NO: 23414 - DNA, 25 bp, E. coli
gcgggaaacgtcaggccaatgttca

SEQ ID NO: 23415 - DNA, 25 bp, E. coli
gcgatcatgattccggccacggtaa

SEQ ID NO: 23416 - DNA, 25 bp, E. coli
gcgggaaacgtctggccaatgttca

SEQ ID NO: 23417 - DNA, 25 bp, E. coli
gcgatcatgattgcggccacggtaa

SEQ ID NO: 23418 - DNA, 25 bp, E. coli
gaactgcatgaacggctggaaaacc

SEQ ID NO: 23419 - DNA, 25 bp, E. coli
gaactgcatgaagggctggaaaacc

SEQ ID NO: 23420 - DNA, 25 bp, E. coli
cattgttaaagagcaaccggcgcac

SEQ ID NO: 23421 - DNA, 25 bp, E. coli
cattgttaaagaccaaccggcgcac

SEQ ID NO: 23422 - DNA, 25 bp, E. coli
ggtgaattcccggacgctgacgaaa

SEQ ID NO: 23423 - DNA, 25 bp, E. coli
ggtgaattcccgcacgctgacgaaa

SEQ ID NO: 23424 - DNA, 25 bp, E. coli
taaaaggcggtacagatttgcatgc

SEQ ID NO: 23425 - DNA, 25 bp, E. coli
gagcaccttgcccatgacgatgata

SEQ ID NO: 23426 - DNA, 25 bp, E. coli
gagcaccttgccgatgacgatgata

SEQ ID NO: 23427 - DNA, 25 bp, E. coli
caatctgaatccatgcatgacgtgt

SEQ ID NO: 23428 - DNA, 25 bp, E. coli
caagggctaaattcgggctgacacc

SEQ ID NO: 23429 - DNA, 25 bp, E. coli
caatctgaatccttgcatgacgtgt

SEQ ID NO: 23430 - DNA, 25 bp, E. coli
caagggctaaatacgggctgacacc

SEQ ID NO: 23431 - DNA, 25 bp, E. coli
catgtctggtgacaacggagtcgtc

SEQ ID NO: 23432 - DNA, 25 bp, E. coli
catgcagagaattcgccatgtctgg

SEQ ID NO: 23433 - DNA, 25 bp, E. coli
catgcagagaatacgccatgtctgg

SEQ ID NO: 23434 - DNA, 25 bp, E. coli
catgtctggtgagaacggagtcgtc

SEQ ID NO: 23435 - DNA, 25 bp, E. coli
catgacgtgtggtgcctgttgtgca

SEQ ID NO: 23436 - DNA, 25 bp, E. coli
catgacgtgtggagcctgttgtgca

SEQ ID NO: 23437 - DNA, 25 bp, E. coli
tactgggccgaagccgacgatgctg

SEQ ID NO: 23438 - DNA, 25 bp, E. coli
tactgggccgaacccgacgatgctg

SEQ ID NO: 23439 - DNA, 25 bp, E. coli
aaaatcgatcgtgcacatgcagaga

SEQ ID NO: 23440 - DNA, 25 bp, E. coli
aaaatcgatcgtccacatgcagaga

SEQ ID NO: 23441 - DNA, 25 bp, E. coli
tatccccttttctccgatgcatgag

SEQ ID NO: 23442 - DNA, 25 bp, E. coli
tatccccttttcaccgatgcatgag

SEQ ID NO: 23443 - DNA, 25 bp, E. coli
gaaccccgggcataaatgcctgctg

SEQ ID NO: 23444 - DNA, 25 bp, E. coli
gaaccccgggcaaaaatgcctgctg

SEQ ID NO: 23445 - DNA, 25 bp, E. coli
cgtcaatgaggcttgcaatcgtgca

SEQ ID NO: 23446 - DNA, 25 bp, E. coli
cgtcaatgaggcatgcaatcgtgca

SEQ ID NO: 23447 - DNA, 25 bp, E. coli
gatgtattgcccatgcaggaacccc

SEQ ID NO: 23448 - DNA, 25 bp, E. coli
gatgtattgcccttgcaggaacccc

SEQ ID NO: 23449 - DNA, 25 bp, E. coli
taaaaagttatcagtccgccctggc

SEQ ID NO: 23450 - DNA, 25 bp, E. coli
taaaaagttatctgtccgccctggc

SEQ ID NO: 23451 - DNA, 25 bp, E. coli
tcctgtgcgcctcaagaaataccgg

SEQ ID NO: 23452 - DNA, 25 bp, E. coli
tcctgtgcgcctgaagaaataccgg

SEQ ID NO: 23453 - DNA, 25 bp, E. coli
gaagaaatgtactatcgccgggact

SEQ ID NO: 23454 - DNA, 25 bp, E. coli
gaagaaatgtacaatcgccgggact

SEQ ID NO: 23455 - DNA, 25 bp, E. coli
gaaatatgggactcgctgcagaaaa

SEQ ID NO: 23456 - DNA, 25 bp, E. coli
gaaaactgatgctacagctcggcct

SEQ ID NO: 23457 - DNA, 25 bp, E. coli
gaaatatgggacacgctgcagaaaa

SEQ ID NO: 23458 - DNA, 25 bp, E. coli
gaaaactgatgcaacagctcggcct

SEQ ID NO: 23459 - DNA, 25 bp, E. coli
gatatcaccgaattcagggctggcg

SEQ ID NO: 23460 - DNA, 25 bp, E. coli
gatatcaccgaaatcagggctggcg

SEQ ID NO: 23461 - DNA, 25 bp, E. coli
ggcggatccattctgagcttcagaa

SEQ ID NO: 23462 - DNA, 25 bp, E. coli
ggcggatccattgtgagcttcagaa

SEQ ID NO: 23463 - DNA, 25 bp, E. coli
ggctggcggacaaaaactgtacctg

SEQ ID NO: 23464 - DNA, 25 bp, E. coli
ggctggcggacataaactgtacctg

SEQ ID NO: 23465 - DNA, 25 bp, E. coli
tcagcgacagttgaaagcggaagct

SEQ ID NO: 23466 - DNA, 25 bp, E. coli
tcagcgacagttcaaagcggaagct

SEQ ID NO: 23467 - DNA, 25 bp, E. coli
gagaaaccgctggtccacagtgatc

SEQ ID NO: 23468 - DNA, 25 bp, E. coli
gatgttatgggtaccggcggatcca

SEQ ID NO: 23469 - DNA, 25 bp, E. coli
gagaaaccgctgctccacagtgatc

SEQ ID NO: 23470 - DNA, 25 bp, E. coli
gatgttatgggttccggcggatcca

SEQ ID NO: 23471 - DNA, 25 bp, E. coli
cattatagggagttattccggcctg

SEQ ID NO: 23472 - DNA, 25 bp, E. coli
attatagggagttattccggcctga

SEQ ID NO: 23473 - DNA, 25 bp, E. coli
attatagggagtaattccggcctga

SEQ ID NO: 23474 - DNA, 25 bp, E. coli
tttgccgttgttgcgtgtcagtggt

SEQ ID NO: 23475 - DNA, 25 bp, E. coli
tttgccgttgttccgtgtcagtggt

SEQ ID NO: 23476 - DNA, 25 bp, E. coli
ttgttccgtgtctgtggtggcgcat

SEQ ID NO: 23477 - DNA, 25 bp, E. coli
ttgttccgtgtcagtggtggcgcat

SEQ ID NO: 23478 - DNA, 25 bp, E. coli
tgtttgccgttgatccgtgtcagtg

SEQ ID NO: 23479 - DNA, 25 bp, E. coli
tgttccgtgtcagtggtggcgcatt

SEQ ID NO: 23480 - DNA, 25 bp, E. coli
tgttccgtgtcactggtggcgcatt

SEQ ID NO: 23481 - DNA, 25 bp, E. coli
tgtttgccgttgttccgtgtcagtg

SEQ ID NO: 23482 - DNA, 25 bp, E. coli
tccgtgtcagtgctggcgcattata

SEQ ID NO: 23483 - DNA, 25 bp, E. coli
tccgtgtcagtggtggcgcattata

SEQ ID NO: 23484 - DNA, 25 bp, E. coli
ccgtgtcagtggtggcgcattatag

SEQ ID NO: 23485 - DNA, 25 bp, E. coli
ccgtgtcagtggaggcgcattatag

SEQ ID NO: 23486 - DNA, 25 bp, E. coli
gcattatagggacttattccggcct

SEQ ID NO: 23487 - DNA, 25 bp, E. coli
gcattatagggagttattccggcct

SEQ ID NO: 23488 - DNA, 25 bp, E. coli
cgcattatagggtgttattccggcc

SEQ ID NO: 23489 - DNA, 25 bp, E. coli
cgcattatagggagttattccggcc

SEQ ID NO: 23490 - DNA, 25 bp, E. coli
cattatagggagatattccggcctg

SEQ ID NO: 23491 - DNA, 25 bp, E. coli
gttccgtgtcagaggtggcgcatta

SEQ ID NO: 23492 - DNA, 25 bp, E. coli
gttccgtgtcagtggtggcgcatta

SEQ ID NO: 23493 - DNA, 25 bp, E. coli
caactttggattatgcatgctaata

SEQ ID NO: 23494 - DNA, 25 bp, E. coli
caactttggattttgcatgctaata

SEQ ID NO: 23495 - DNA, 25 bp, E. coli
catgctaataaacttgcgtatcgga

SEQ ID NO: 23496 - DNA, 25 bp, E. coli
catgctaataaagttgcgtatcgga

SEQ ID NO: 23497 - DNA, 25 bp, E. coli
tataccacgctgctggcaagagcgc

SEQ ID NO: 23498 - DNA, 25 bp, E. coli
tataccacgctggtggcaagagcgc

SEQ ID NO: 23499 - DNA, 25 bp, E. coli
tactccttaaactaggacattagtc

SEQ ID NO: 23500 - DNA, 25 bp, E. coli
tactccttaaacaaggacattagtc

SEQ ID NO: 23501 - DNA, 25 bp, E. coli
tcggattttatcaggtacagtgtga

SEQ ID NO: 23502 - DNA, 25 bp, E. coli
tcggattttatctggtacagtgtga

SEQ ID NO: 23503 - DNA, 25 bp, E. coli
ccaggcatggcttgcagacaaatat

SEQ ID NO: 23504 - DNA, 25 bp, E. coli
ccaggcatggctagcagacaaatat

SEQ ID NO: 23505 - DNA, 25 bp, E. coli
gcgtatcggattatatcaggtacag

SEQ ID NO: 23506 - DNA, 25 bp, E. coli
gcgtatcggattttatcaggtacag

SEQ ID NO: 23507 - DNA, 25 bp, E. coli
gcagacaaatataccacgctggtgg

SEQ ID NO: 23508 - DNA, 25 bp, E. coli
gcagacaaatattccacgctggtgg

SEQ ID NO: 23509 - DNA, 25 bp, E. coli
gacattagtctacgccaggcatggc

SEQ ID NO: 23510 - DNA, 25 bp, E. coli
gacattagtctaggccaggcatggc

SEQ ID NO: 23511 - DNA, 25 bp, E. coli
tggcaagagcgcgttactggcaact

SEQ ID NO: 23512 - DNA, 25 bp, E. coli
tggcaagagcgccttactggcaact

SEQ ID NO: 23513 - DNA, 25 bp, E. coli
gagcgccttactggcaactttggat

SEQ ID NO: 23514 - DNA, 25 bp, E. coli
gagcgccttactcgcaactttggat

SEQ ID NO: 23515 - DNA, 25 bp, E. coli
aatgattgaccccaccaaccgtatc

SEQ ID NO: 23516 - DNA, 25 bp, E. coli
aatgattgacccgaccaaccgtatc

SEQ ID NO: 23517 - DNA, 25 bp, E. coli
cagttggcccatgaaaaagggctgc

SEQ ID NO: 23518 - DNA, 25 bp, E. coli
cagttggcccatcaaaaagggctgc

SEQ ID NO: 23519 - DNA, 25 bp, E. coli
tacgctgtgtgacgaaaccctgttc

SEQ ID NO: 23520 - DNA, 25 bp, E. coli
tacgctgtgtgaggaaaccctgttc

SEQ ID NO: 23521 - DNA, 25 bp, E. coli
tatctatgaatttggtggcggcgtt

SEQ ID NO: 23522 - DNA, 25 bp, E. coli
tatctatgaattaggtggcggcgtt

SEQ ID NO: 23523 - DNA, 25 bp, E. coli
tgccgcaagccactggtggcctgct

SEQ ID NO: 23524 - DNA, 25 bp, E. coli
tgccgcaagccagtggtggcctgct

SEQ ID NO: 23525 - DNA, 25 bp, E. coli
tctggcaccggcagccaggaattga

SEQ ID NO: 23526 - DNA, 25 bp, E. coli
tctggcaccggctgccaggaattga

SEQ ID NO: 23527 - DNA, 25 bp, E. coli
gaactggcgctcaaacagttggccc

SEQ ID NO: 23528 - DNA, 25 bp, E. coli
gaactggcgctctaacagttggccc

SEQ ID NO: 23529 - DNA, 25 bp, E. coli
ctcgcggcagcatagaggcggcatt

SEQ ID NO: 23530 - DNA, 25 bp, E. coli
ctcgcggcagcaaagaggcggcatt

SEQ ID NO: 23531 - DNA, 25 bp, E. coli
gggcaccgatctcgatacgccatca

SEQ ID NO: 23532 - DNA, 25 bp, E. coli
gggcaccgatctggatacgccatca

SEQ ID NO: 23533 - DNA, 25 bp, E. coli
ggaattgagcgtgcgtatctatgaa

SEQ ID NO: 23534 - DNA, 25 bp, E. coli
tggcggcgtttctcaactgatcggc

SEQ ID NO: 23535 - DNA, 25 bp, E. coli
ggaattgagcgtccgtatctatgaa

SEQ ID NO: 23536 - DNA, 25 bp, E. coli
tggcggcgtttcacaactgatcggc

SEQ ID NO: 23537 - DNA, 25 bp, E. coli
catggtgctcgcacctaagaagaaa

SEQ ID NO: 23538 - DNA, 25 bp, E. coli
catggtgctcgctcctaagaagaaa

SEQ ID NO: 23539 - DNA, 25 bp, E. coli
aactggcagtggacgaatccttccc

SEQ ID NO: 23540 - DNA, 25 bp, E. coli
aactggcagtggtcgaatccttccc

SEQ ID NO: 23541 - DNA, 25 bp, E. coli
ttagtcgagatcagccctaacgccg

SEQ ID NO: 23542 - DNA, 25 bp, E. coli
tttccgcggtcgtgagatggcgcac

SEQ ID NO: 23543 - DNA, 25 bp, E. coli
ttagtcgagatctgccctaacgccg

SEQ ID NO: 23544 - DNA, 25 bp, E. coli
tttccgcggtcgagagatggcgcac

SEQ ID NO: 23545 - DNA, 25 bp, E. coli
tgataaagccaaaatcacgctgcgt

SEQ ID NO: 23546 - DNA, 25 bp, E. coli
tgataaagccaatatcacgctgcgt

SEQ ID NO: 23547 - DNA, 25 bp, E. coli
tcgaaggccgccagatgatcatggt

SEQ ID NO: 23548 - DNA, 25 bp, E. coli
tcgaaggccgcctgatgatcatggt

SEQ ID NO: 23549 - DNA, 25 bp, E. coli
cctggtacagatcaaggcgactatc

SEQ ID NO: 23550 - DNA, 25 bp, E. coli
cctggtacagatgaaggcgactatc

SEQ ID NO: 23551 - DNA, 25 bp, E. coli
gaagtgcttaatcgcgtgaaagacg

SEQ ID NO: 23552 - DNA, 25 bp, E. coli
gaagtgcttaatggcgtgaaagacg

SEQ ID NO: 23553 - DNA, 25 bp, E. coli
gactatcaggtataactccgcagcc

SEQ ID NO: 23554 - DNA, 25 bp, E. coli
gactatcaggtaaaactccgcagcc

SEQ ID NO: 23555 - DNA, 25 bp, E. coli
gatggcgcaccagcaaatcggtatg

SEQ ID NO: 23556 - DNA, 25 bp, E. coli
gatggcgcaccaccaaatcggtatg

SEQ ID NO: 23557 - DNA, 25 bp, E. coli
gagccgccggtttgtcgtataatgg

SEQ ID NO: 23558 - DNA, 25 bp, E. coli
gagccgccggttagtcgtataatgg

SEQ ID NO: 23559 - DNA, 25 bp, E. coli
catcagtaagtgaccgggatgagcg

SEQ ID NO: 23560 - DNA, 25 bp, E. coli
catcagtaagtgtccgggatgagcg

SEQ ID NO: 23561 - DNA, 25 bp, E. coli
accgggatgagcgagcgaagataac

SEQ ID NO: 23562 - DNA, 25 bp, E. coli
accgggatgagccagcgaagataac

SEQ ID NO: 23563 - DNA, 25 bp, E. coli
tgaagggggagagcccttatagacc

SEQ ID NO: 23564 - DNA, 25 bp, E. coli
tgaagggggagaccccttatagacc

SEQ ID NO: 23565 - DNA, 25 bp, E. coli
tgagcgagcgaacataacgcatctg

SEQ ID NO: 23566 - DNA, 25 bp, E. coli
tgagcgagcgaagataacgcatctg

SEQ ID NO: 23567 - DNA, 25 bp, E. coli
tcgagttgcagataggcggcaagct

SEQ ID NO: 23568 - DNA, 25 bp, E. coli
tcgagttgcagaaaggcggcaagct

SEQ ID NO: 23569 - DNA, 25 bp, E. coli
gcggcaagctcgtgaattcccggga

SEQ ID NO: 23570 - DNA, 25 bp, E. coli
gcggcaagctcgagaattcccggga

SEQ ID NO: 23571 - DNA, 25 bp, E. coli
gcttacatcagttagtgaccgggat

SEQ ID NO: 23572 - DNA, 25 bp, E. coli
gcttacatcagtaagtgaccgggat

SEQ ID NO: 23573 - DNA, 25 bp, E. coli
gataactcccccaaaatagttcgag

SEQ ID NO: 23574 - DNA, 25 bp, E. coli
gaagataacgcaactgcggcgcgaa

SEQ ID NO: 23575 - DNA, 25 bp, E. coli
gaattcccgggagcttacatcagta

SEQ ID NO: 23576 - DNA, 25 bp, E. coli
gataactccccctaaatagttcgag

SEQ ID NO: 23577 - DNA, 25 bp, E. coli
gaattcccgggaccttacatcagta

SEQ ID NO: 23578 - DNA, 25 bp, E. coli
gaagataacgcatctgcggcgcgaa

SEQ ID NO: 23579 - DNA, 25 bp, E. coli
gaaaggcggcaacctcgagaattcc

SEQ ID NO: 23580 - DNA, 25 bp, E. coli
gaaaggcggcaagctcgagaattcc

SEQ ID NO: 23581 - DNA, 25 bp, E. coli
cactcgttttgtacaggcccataaa

SEQ ID NO: 23582 - DNA, 25 bp, E. coli
cactcgttttgttcaggcccataaa

SEQ ID NO: 23583 - DNA, 25 bp, E. coli
tttgttcaggcccataaagaggcgc

SEQ ID NO: 23584 - DNA, 25 bp, E. coli
tttgttcaggccgataaagaggcgc

SEQ ID NO: 23585 - DNA, 25 bp, E. coli
tggggctgacccttttgtatctggc

SEQ ID NO: 23586 - DNA, 25 bp, E. coli
tgtttattggacagtgctgggcgat

SEQ ID NO: 23587 - DNA, 25 bp, E. coli
tggggctgacccatttgtatctggc

SEQ ID NO: 23588 - DNA, 25 bp, E. coli
tgtttattggactgtgctgggcgat

SEQ ID NO: 23589 - DNA, 25 bp, E. coli
tgaaatttatctatcgcgatatccc

SEQ ID NO: 23590 - DNA, 25 bp, E. coli
tgaaatttatctttcgcgatatccc

SEQ ID NO: 23591 - DNA, 25 bp, E. coli
gctgggcgatggtgaaatttatcta

SEQ ID NO: 23592 - DNA, 25 bp, E. coli
gctgggcgatggagaaatttatcta

SEQ ID NO: 23593 - DNA, 25 bp, E. coli
ccgctgctgttttttggactgtgct

SEQ ID NO: 23594 - DNA, 25 bp, E. coli
ccgctgctgtttattggactgtgct

SEQ ID NO: 23595 - DNA, 25 bp, E. coli
ctgtgctgggcgttggtgaaattta

SEQ ID NO: 23596 - DNA, 25 bp, E. coli
ctgtgctgggcgatggtgaaattta

SEQ ID NO: 23597 - DNA, 25 bp, E. coli
gttcaggcccattaagaggcgcgct

SEQ ID NO: 23598 - DNA, 25 bp, E. coli
gttcaggcccataaagaggcgcgct

SEQ ID NO: 23599 - DNA, 25 bp, E. coli
tggacactcgttatgttcaggccca

SEQ ID NO: 23600 - DNA, 25 bp, E. coli
tggacactcgttttgttcaggccca

SEQ ID NO: 23601 - DNA, 25 bp, E. coli
gacgccgctgctgtttattggactg

SEQ ID NO: 23602 - DNA, 25 bp, E. coli
gacgccgctgctctttattggactg

SEQ ID NO: 23603 - DNA, 25 bp, E. coli
cggcgttagggctgatctcgactaa

SEQ ID NO: 23604 - DNA, 25 bp, E. coli
cggcgttagggcagatctcgactaa

SEQ ID NO: 23605 - DNA, 25 bp, E. coli
cattatacgacaaaccggcggctcg

SEQ ID NO: 23606 - DNA, 25 bp, E. coli
tactgtttcttcttaggagcgagca

SEQ ID NO: 23607 - DNA, 25 bp, E. coli
tactgtttcttcataggagcgagca

SEQ ID NO: 23608 - DNA, 25 bp, E. coli
tgggaaggattccaccactgccagt

SEQ ID NO: 23609 - DNA, 25 bp, E. coli
tctggcggccttcgatcttcgttgg

SEQ ID NO: 23610 - DNA, 25 bp, E. coli
tctggcggccttggatcttcgttgg

SEQ ID NO: 23611 - DNA, 25 bp, E. coli
gctgcggagtttaacctgatagtcg

SEQ ID NO: 23612 - DNA, 25 bp, E. coli
gctgcggagttttacctgatagtcg

SEQ ID NO: 23613 - DNA, 25 bp, E. coli
cgatttgctggtccgccatctcacg

SEQ ID NO: 23614 - DNA, 25 bp, E. coli
cgatttgctggtgcgccatctcacg

SEQ ID NO: 23615 - DNA, 25 bp, E. coli
ctcttcgagaaaccgaatcaggctg

SEQ ID NO: 23616 - DNA, 25 bp, E. coli
ctcttcgagaaagcgaatcaggctg

SEQ ID NO: 23617 - DNA, 25 bp, E. coli
cattatacgacataccggcggctcg

SEQ ID NO: 23618 - DNA, 25 bp, E. coli
gatagtcgccttcatctgtaccagg

SEQ ID NO: 23619 - DNA, 25 bp, E. coli
gatagtcgccttgatctgtaccagg

SEQ ID NO: 23620 - DNA, 25 bp, E. coli
gattaagcacttgcataccgatttg

SEQ ID NO: 23621 - DNA, 25 bp, E. coli
gattaagcacttccataccgatttg

SEQ ID NO: 23622 - DNA, 25 bp, E. coli
tgggaaggattcgaccactgccagt

SEQ ID NO: 23623 - DNA, 25 bp, E. coli
gagcgagcaccaagatcatctggcg

SEQ ID NO: 23624 - DNA, 25 bp, E. coli
gagcgagcaccatgatcatctggcg

SEQ ID NO: 23625 - DNA, 25 bp, E. coli
caaaatttgtcgttccgccatcggc

SEQ ID NO: 23626 - DNA, 25 bp, E. coli
caaaatttgtcgatccgccatcggc

SEQ ID NO: 23627 - DNA, 25 bp, E. coli
caggtgaccaagtcgcagcgttagc

SEQ ID NO: 23628 - DNA, 25 bp, E. coli
caggtgaccaagacgcagcgttagc

SEQ ID NO: 23629 - DNA, 25 bp, E. coli
cgttaccactttttatcgggcctga

SEQ ID NO: 23630 - DNA, 25 bp, E. coli
cgttaccactttatatcgggcctga

SEQ ID NO: 23631 - DNA, 25 bp, E. coli
tatcccttaacttagctgccggcgg

SEQ ID NO: 23632 - DNA, 25 bp, E. coli
tatcccttaactaagctgccggcgg

SEQ ID NO: 23633 - DNA, 25 bp, E. coli
tatactggaaattctgccgcaccgt

SEQ ID NO: 23634 - DNA, 25 bp, E. coli
tatactggaaatactgccgcaccgt

SEQ ID NO: 23635 - DNA, 25 bp, E. coli
tccgccatcggctaatcgcattaag

SEQ ID NO: 23636 - DNA, 25 bp, E. coli
tccgccatcggcaaatcgcattaag

SEQ ID NO: 23637 - DNA, 25 bp, E. coli
tcgggcctgaaatcagactctacgc

SEQ ID NO: 23638 - DNA, 25 bp, E. coli
tcgggcctgaaaacagactctacgc

SEQ ID NO: 23639 - DNA, 25 bp, E. coli
gctataaaggtgatgcccgaactca

SEQ ID NO: 23640 - DNA, 25 bp, E. coli
gcgttagctgtatgtcacaactgaa

SEQ ID NO: 23641 - DNA, 25 bp, E. coli
gctataaaggtgttgcccgaactca

SEQ ID NO: 23642 - DNA, 25 bp, E. coli
gcgttagctgtaagtcacaactgaa

SEQ ID NO: 23643 - DNA, 25 bp, E. coli
gactctacgccagtttgctataaag

SEQ ID NO: 23644 - DNA, 25 bp, E. coli
gaaaaaaggcgggtattatactgga

SEQ ID NO: 23645 - DNA, 25 bp, E. coli
gactctacgccactttgctataaag

SEQ ID NO: 23646 - DNA, 25 bp, E. coli
gaaaaaaggcggctattatactgga

SEQ ID NO: 23647 - DNA, 25 bp, E. coli
caggtaaatcagattgccaaaaggc

SEQ ID NO: 23648 - DNA, 25 bp, E. coli
agtttgccaaaaggccggatccaga

SEQ ID NO: 23649 - DNA, 25 bp, E. coli
agtttgccaaaacgccggatccaga

SEQ ID NO: 23650 - DNA, 25 bp, E. coli
caggtaaatcagtttgccaaaaggc

SEQ ID NO: 23651 - DNA, 25 bp, E. coli
aaaggccggatccagacaccctgtt

SEQ ID NO: 23652 - DNA, 25 bp, E. coli
aaaggccggatcgagacaccctgtt

SEQ ID NO: 23653 - DNA, 25 bp, E. coli
tatagggcggcatcaggtaaatcag

SEQ ID NO: 23654 - DNA, 25 bp, E. coli
tatagggcggcaacaggtaaatcag

SEQ ID NO: 23655 - DNA, 25 bp, E. coli
tcagtttgccaaaaggccggatcca

SEQ ID NO: 23656 - DNA, 25 bp, E. coli
tcagtttgccaataggccggatcca

SEQ ID NO: 23657 - DNA, 25 bp, E. coli
cgcgcacatcggcaaccatttcggc

SEQ ID NO: 23658 - DNA, 25 bp, E. coli
cgcgcacatcgggaaccatttcggc

SEQ ID NO: 23659 - DNA, 25 bp, E. coli
cggatccagacagcctgttcgacaa

SEQ ID NO: 23660 - DNA, 25 bp, E. coli
cgggagaataatatagggcggcatc

SEQ ID NO: 23661 - DNA, 25 bp, E. coli
cggatccagacaccctgttcgacaa

SEQ ID NO: 23662 - DNA, 25 bp, E. coli
cgggagaataatttagggcggcatc

SEQ ID NO: 23663 - DNA, 25 bp, E. coli
gtaaatcagtttcccaaaaggccgg

SEQ ID NO: 23664 - DNA, 25 bp, E. coli
ggcggcatcaggaaaatcagtttgc

SEQ ID NO: 23665 - DNA, 25 bp, E. coli
ggcggcatcaggtaaatcagtttgc

SEQ ID NO: 23666 - DNA, 25 bp, E. coli
gagaataatatacggcggcatcagg

SEQ ID NO: 23667 - DNA, 25 bp, E. coli
gtaaatcagtttgccaaaaggccgg

SEQ ID NO: 23668 - DNA, 25 bp, E. coli
gagaataatatagggcggcatcagg

SEQ ID NO: 23669 - DNA, 25 bp, E. coli
caaaagcctgtgtgatgaaactgtc

SEQ ID NO: 23670 - DNA, 25 bp, E. coli
caaaagcctgtgagatgaaactgtc

SEQ ID NO: 23671 - DNA, 25 bp, E. coli
tacaggtaaacacgcagagaacaac

SEQ ID NO: 23672 - DNA, 25 bp, E. coli
tacaggtaaacaggcagagaacaac

SEQ ID NO: 23673 - DNA, 25 bp, E. coli
tatcagtctccaacagggcatgagc

SEQ ID NO: 23674 - DNA, 25 bp, E. coli
tatcagtctccatcagggcatgagc

SEQ ID NO: 23675 - DNA, 25 bp, E. coli
ttctgtcaacgtttatgaaaccggg

SEQ ID NO: 23676 - DNA, 25 bp, E. coli
ttctgtcaacgtatatgaaaccggg

SEQ ID NO: 23677 - DNA, 25 bp, E. coli
tgcagttgagcacaaacatcctgtt

SEQ ID NO: 23678 - DNA, 25 bp, E. coli
tgaaaccgggattctggtcgagaac

SEQ ID NO: 23679 - DNA, 25 bp, E. coli
tgaaaccgggatactggtcgagaac

SEQ ID NO: 23680 - DNA, 25 bp, E. coli
tgcagttgagcagaaacatcctgtt

SEQ ID NO: 23681 - DNA, 25 bp, E. coli
cctcgtcaggatcgaaaccggtcag

SEQ ID NO: 23682 - DNA, 25 bp, E. coli
cctcgtcaggatggaaaccggtcag

SEQ ID NO: 23683 - DNA, 25 bp, E. coli
gctatcatggaggttgactcggtca

SEQ ID NO: 23684 - DNA, 25 bp, E. coli
gctatcatggagcttgactcggtca

SEQ ID NO: 23685 - DNA, 25 bp, E. coli
gaagccagcgtccacggattatgtc

SEQ ID NO: 23686 - DNA, 25 bp, E. coli
gaagccagcgtcgacggattatgtc

SEQ ID NO: 23687 - DNA, 25 bp, E. coli
gaaactgtcgatgtggcaaccttaa

SEQ ID NO: 23688 - DNA, 25 bp, E. coli
gaaactgtcgatctggcaaccttaa

SEQ ID NO: 23689 - DNA, 25 bp, E. coli
gttctgtataaatcgtccccgctcg

SEQ ID NO: 23690 - DNA, 25 bp, E. coli
gttctgtataaaacgtccccgctcg

SEQ ID NO: 23691 - DNA, 25 bp, E. coli
caccgccgcctcttgcaatagaaga

SEQ ID NO: 23692 - DNA, 25 bp, E. coli
caccgccgcctcatgcaatagaaga

SEQ ID NO: 23693 - DNA, 25 bp, E. coli
tagaagatggctatcgcggaaccga

SEQ ID NO: 23694 - DNA, 25 bp, E. coli
tagaagatggctttcgcggaaccga

SEQ ID NO: 23695 - DNA, 25 bp, E. coli
tttgatggacgacaagttcagccgg

SEQ ID NO: 23696 - DNA, 25 bp, E. coli
tttgatggacgagaagttcagccgg

SEQ ID NO: 23697 - DNA, 25 bp, E. coli
ttatgcgttggcagatgaccagggc

SEQ ID NO: 23698 - DNA, 25 bp, E. coli
ttatgcgttggctgatgaccagggc

SEQ ID NO: 23699 - DNA, 25 bp, E. coli
tgatttcgcaaaaaccatgcacgat

SEQ ID NO: 23700 - DNA, 25 bp, E. coli
tgatttcgcaaataccatgcacgat

SEQ ID NO: 23701 - DNA, 25 bp, E. coli
tctcacaaaggagaggaccgttacg

SEQ ID NO: 23702 - DNA, 25 bp, E. coli
tctcacaaaggacaggaccgttacg

SEQ ID NO: 23703 - DNA, 25 bp, E. coli
gaaatttcaggcgattgtattagca

SEQ ID NO: 23704 - DNA, 25 bp, E. coli
gaaatttcaggccattgtattagca

SEQ ID NO: 23705 - DNA, 25 bp, E. coli
gttcagccggaccagatgatcaaca

SEQ ID NO: 23706 - DNA, 25 bp, E. coli
gttcagccggacgagatgatcaaca

SEQ ID NO: 23707 - DNA, 25 bp, E. coli
gtcgttcgggtcactcatttgcaga

SEQ ID NO: 23708 - DNA, 25 bp, E. coli
gtcgttcgggtctctcatttgcaga

SEQ ID NO: 23709 - DNA, 25 bp, E. coli
ggtttaaaacaggatgcagcgccac

SEQ ID NO: 23710 - DNA, 25 bp, E. coli
ggtttaaaacagcatgcagcgccac

SEQ ID NO: 23711 - DNA, 25 bp, E. coli
gatggcgcttcggtttcactacgcg

SEQ ID NO: 23712 - DNA, 25 bp, E. coli
gatggcgcttcgctttcactacgcg

SEQ ID NO: 23713 - DNA, 25 bp, E. coli
caactcatctgttgggttctaacgc

SEQ ID NO: 23714 - DNA, 25 bp, E. coli
caactcatctgtagggttctaacgc

SEQ ID NO: 23715 - DNA, 25 bp, E. coli
catgcaaaaacaaggagagaatgct

SEQ ID NO: 23716 - DNA, 25 bp, E. coli
catgcaaaaacatggagagaatgct

SEQ ID NO: 23717 - DNA, 25 bp, E. coli
tagtagtgattggttcgcgtaaccc

SEQ ID NO: 23718 - DNA, 25 bp, E. coli
tagtagtgattgcttcgcgtaaccc

SEQ ID NO: 23719 - DNA, 25 bp, E. coli
tgtgcgggatgatgttaacgagtta

SEQ ID NO: 23720 - DNA, 25 bp, E. coli
tgtatacatgcaaaaacaaggagag

SEQ ID NO: 23721 - DNA, 25 bp, E. coli
tgtacaaaacaatcatcatgccagt

SEQ ID NO: 23722 - DNA, 25 bp, E. coli
tgtacaaaacaaacatcatgccagt

SEQ ID NO: 23723 - DNA, 25 bp, E. coli
tgtatacatgcataaacaaggagag

SEQ ID NO: 23724 - DNA, 25 bp, E. coli
tgtgcgggatgaagttaacgagtta

SEQ ID NO: 23725 - DNA, 25 bp, E. coli
tcatgccagtggttgttttcgaaat

SEQ ID NO: 23726 - DNA, 25 bp, E. coli
tcatgccagtggatgttttcgaaat

SEQ ID NO: 23727 - DNA, 25 bp, E. coli
gcgtaacccatcaatttcaactcat

SEQ ID NO: 23728 - DNA, 25 bp, E. coli
gcgtaacccatctatttcaactcat

SEQ ID NO: 23729 - DNA, 25 bp, E. coli
gaacttgatgcagatgtagtagtga

SEQ ID NO: 23730 - DNA, 25 bp, E. coli
gaacttgatgcacatgtagtagtga

SEQ ID NO: 23731 - DNA, 25 bp, E. coli
cgagttagcgaaagaacttgatgca

SEQ ID NO: 23732 - DNA, 25 bp, E. coli
cgagttagcgaatgaacttgatgca

SEQ ID NO: 23733 - DNA, 25 bp, E. coli
ggagagaatgcttatgtacaaaaca

SEQ ID NO: 23734 - DNA, 25 bp, E. coli
ggagagaatgctaatgtacaaaaca

SEQ ID NO: 23735 - DNA, 25 bp, E. coli
caggtgtcgctggaatgattatcta

SEQ ID NO: 23736 - DNA, 25 bp, E. coli
caggtgtcgctgcaatgattatcta

SEQ ID NO: 23737 - DNA, 25 bp, E. coli
aaaacgcatagatgagctggaggct

SEQ ID NO: 23738 - DNA, 25 bp, E. coli
aaaacgcatagaagagctggaggct

SEQ ID NO: 23739 - DNA, 25 bp, E. coli
tatccgtcacagatgcaggacaggc

SEQ ID NO: 23740 - DNA, 25 bp, E. coli
tatccgtcacagttgcaggacaggc

SEQ ID NO: 23741 - DNA, 25 bp, E. coli
tgacccctacgcatttctggcagaa

SEQ ID NO: 23742 - DNA, 25 bp, E. coli
tgagaggttgaaacacgcaatggcc

SEQ ID NO: 23743 - DNA, 25 bp, E. coli
tgctctttgacggacatatgtgacg

SEQ ID NO: 23744 - DNA, 25 bp, E. coli
tgacccctacgcttttctggcagaa

SEQ ID NO: 23745 - DNA, 25 bp, E. coli
tgagaggttgaatcacgcaatggcc

SEQ ID NO: 23746 - DNA, 25 bp, E. coli
tgctctttgacgcacatatgtgacg

SEQ ID NO: 23747 - DNA, 25 bp, E. coli
gcttcgcaaaggaggcaacaagtga

SEQ ID NO: 23748 - DNA, 25 bp, E. coli
gcttcgcaaaggtggcaacaagtga

SEQ ID NO: 23749 - DNA, 25 bp, E. coli
cgagttagtcgctgagcttcgcaaa

SEQ ID NO: 23750 - DNA, 25 bp, E. coli
cgagttagtcgcagagcttcgcaaa

SEQ ID NO: 23751 - DNA, 25 bp, E. coli
tggccgtagcccttgagcatatatc

SEQ ID NO: 23752 - DNA, 25 bp, E. coli
tggccgtagcccatgagcatatatc

SEQ ID NO: 23753 - DNA, 25 bp, E. coli
gagatggtgcgccaacatccagcaa

SEQ ID NO: 23754 - DNA, 25 bp, E. coli
gagattaactatgaggagctgcgtg

SEQ ID NO: 23755 - DNA, 25 bp, E. coli
gagattaactatcaggagctgcgtg

SEQ ID NO: 23756 - DNA, 25 bp, E. coli
gagatggtgcgcgaacatccagcaa

SEQ ID NO: 23757 - DNA, 25 bp, E. coli
aagcagcatcactcggaagccttcg

SEQ ID NO: 23758 - DNA, 25 bp, E. coli
aagcagcatcacacggaagccttcg

SEQ ID NO: 23759 - DNA, 25 bp, E. coli
cagagcagaacttattgccgagcga

SEQ ID NO: 23760 - DNA, 25 bp, E. coli
cagagcagaactaattgccgagcga

SEQ ID NO: 23761 - DNA, 25 bp, E. coli
taaagctctctggttgcgtcagagc

SEQ ID NO: 23762 - DNA, 25 bp, E. coli
taaagctctctgcttgcgtcagagc

SEQ ID NO: 23763 - DNA, 25 bp, E. coli
aaaaagccgctagaaagctcgcaga

SEQ ID NO: 23764 - DNA, 25 bp, E. coli
aaaaagccgctacaaagctcgcaga

SEQ ID NO: 23765 - DNA, 25 bp, E. coli
tatttgcctgcctaacgtagccatt

SEQ ID NO: 23766 - DNA, 25 bp, E. coli
tatttgcctgccaaacgtagccatt

SEQ ID NO: 23767 - DNA, 25 bp, E. coli
tgaatgcagtggtagtatttgcctg

SEQ ID NO: 23768 - DNA, 25 bp, E. coli
tgaatgcagtggaagtatttgcctg

SEQ ID NO: 23769 - DNA, 25 bp, E. coli
tcgctgcaagaacgcagatgaatgc

SEQ ID NO: 23770 - DNA, 25 bp, E. coli
tcgctgcaagaaggcagatgaatgc

SEQ ID NO: 23771 - DNA, 25 bp, E. coli
tctggaaagaatgcaaaggtacggc

SEQ ID NO: 23772 - DNA, 25 bp, E. coli
tctggaaagaatccaaaggtacggc

SEQ ID NO: 23773 - DNA, 25 bp, E. coli
gccgagcgacgctgtaatgaagcac

SEQ ID NO: 23774 - DNA, 25 bp, E. coli
gccgagcgacgcagtaatgaagcac

SEQ ID NO: 23775 - DNA, 25 bp, E. coli
gcgtcagagcagtcaaagcagcatc

SEQ ID NO: 23776 - DNA, 25 bp, E. coli
gcgtcagagcagacaaagcagcatc

SEQ ID NO: 23777 - DNA, 25 bp, E. coli
gaaaaattgcgcaaaagctctctgg

SEQ ID NO: 23778 - DNA, 25 bp, E. coli
gaaaaattgcgctaaagctctctgg

SEQ ID NO: 23779 - DNA, 25 bp, E. coli
tacgcctccgttatgatctccgtgg

SEQ ID NO: 23780 - DNA, 25 bp, E. coli
atgcggcagcgaatgcggccacgct

SEQ ID NO: 23781 - DNA, 25 bp, E. coli
atgcggcagcgattgcggccacgct

SEQ ID NO: 23782 - DNA, 25 bp, E. coli
acttcttcggtcagagctttgcgca

SEQ ID NO: 23783 - DNA, 25 bp, E. coli
acttcttcggtctgagctttgcgca

SEQ ID NO: 23784 - DNA, 25 bp, E. coli
tatgatctccgtcgatgcggcagcg

SEQ ID NO: 23785 - DNA, 25 bp, E. coli
tatgatctccgtggatgcggcagcg

SEQ ID NO: 23786 - DNA, 25 bp, E. coli
tatgctgtatctcttctttcgcaga

SEQ ID NO: 23787 - DNA, 25 bp, E. coli
tacgcctccgttttgatctccgtgg

SEQ ID NO: 23788 - DNA, 25 bp, E. coli
tatgctgtatctgttctttcgcaga

SEQ ID NO: 23789 - DNA, 25 bp, E. coli
tcgtctcggcggacttcttcggtct

SEQ ID NO: 23790 - DNA, 25 bp, E. coli
tcgtctcggcggtcttcttcggtct

SEQ ID NO: 23791 - DNA, 25 bp, E. coli
tgagctttgcgcagtacgcctccgt

SEQ ID NO: 23792 - DNA, 25 bp, E. coli
tgagctttgcgctgtacgcctccgt

SEQ ID NO: 23793 - DNA, 25 bp, E. coli
tgcggccacgctgattatgctgtat

SEQ ID NO: 23794 - DNA, 25 bp, E. coli
tgcggccacgctcattatgctgtat

SEQ ID NO: 23795 - DNA, 25 bp, E. coli
tcttctttcgcagagttattccggc

SEQ ID NO: 23796 - DNA, 25 bp, E. coli
tcttctttcgcacagttattccggc

SEQ ID NO: 23797 - DNA, 25 bp, E. coli
cctggtgaatatggtctcggcggac

SEQ ID NO: 23798 - DNA, 25 bp, E. coli
cctggtgaatatcgtctcggcggac

SEQ ID NO: 23799 - DNA, 25 bp, E. coli
cgcagagttattccggcaacgtatt

SEQ ID NO: 23800 - DNA, 25 bp, E. coli
cgcagagttattgcggcaacgtatt

SEQ ID NO: 23801 - DNA, 25 bp, E. coli
caataaataacaactaacagggagt

SEQ ID NO: 23802 - DNA, 25 bp, E. coli
caataaataacatctaacagggagt

SEQ ID NO: 23803 - DNA, 25 bp, E. coli
atcttatccagcctacgggattgca

SEQ ID NO: 23804 - DNA, 25 bp, E. coli
atcttatccagcgtacgggattgca

SEQ ID NO: 23805 - DNA, 25 bp, E. coli
tccagcctacggcattgcacatgta

SEQ ID NO: 23806 - DNA, 25 bp, E. coli
tccagcctacgggattgcacatgta

SEQ ID NO: 23807 - DNA, 25 bp, E. coli
tcttatccagccaacgggattgcac

SEQ ID NO: 23808 - DNA, 25 bp, E. coli
tcttatccagcctacgggattgcac

SEQ ID NO: 23809 - DNA, 25 bp, E. coli
ccagcctacgggtttgcacatgtag

SEQ ID NO: 23810 - DNA, 25 bp, E. coli
ccagcctacgggattgcacatgtag

SEQ ID NO: 23811 - DNA, 25 bp, E. coli
gcatcttatccagcctacgggattg

SEQ ID NO: 23812 - DNA, 25 bp, E. coli
gcatcttatccaccctacgggattg

SEQ ID NO: 23813 - DNA, 25 bp, E. coli
gcgtcttatccagcctacgggattg

SEQ ID NO: 23814 - DNA, 25 bp, E. coli
gcgtcttatccaccctacgggattg

SEQ ID NO: 23815 - DNA, 25 bp, E. coli
gcatccgccaattaataacaactaa

SEQ ID NO: 23816 - DNA, 25 bp, E. coli
gcatccgccaataaataacaactaa

SEQ ID NO: 23817 - DNA, 25 bp, E. coli
ccgcatccgccaataaataacaact

SEQ ID NO: 23818 - DNA, 25 bp, E. coli
cgccaataaataacaactaacaggg

SEQ ID NO: 23819 - DNA, 25 bp, E. coli
ccgcatccgccattaaataacaact

SEQ ID NO: 23820 - DNA, 25 bp, E. coli
cgccaataaatatcaactaacaggg

SEQ ID NO: 23821 - DNA, 25 bp, E. coli
taacaactaacacggagtaaaggcg

SEQ ID NO: 23822 - DNA, 25 bp, E. coli
taacaactaacagggagtaaaggcg

SEQ ID NO: 23823 - DNA, 25 bp, E. coli
cagcaggaattcaggctcgcgcatt

SEQ ID NO: 23824 - DNA, 25 bp, E. coli
cagcaggaattctggctcgcgcatt

SEQ ID NO: 23825 - DNA, 25 bp, E. coli
caggttatcatgcatggcagcagga

SEQ ID NO: 23826 - DNA, 25 bp, E. coli
caggttatcatggatggcagcagga

SEQ ID NO: 23827 - DNA, 25 bp, E. coli
aaaccgtagagtccgattgctgtga

SEQ ID NO: 23828 - DNA, 25 bp, E. coli
aaaccgtagagtgcgattgctgtga

SEQ ID NO: 23829 - DNA, 25 bp, E. coli
tgaagttgaacatctctgtccgtgg

SEQ ID NO: 23830 - DNA, 25 bp, E. coli
tgaaagagttggttgaacgcacgcc

SEQ ID NO: 23831 - DNA, 25 bp, E. coli
tgaagttgaacaactctgtccgtgg

SEQ ID NO: 23832 - DNA, 25 bp, E. coli
tgaaagagttggatgaacgcacgcc

SEQ ID NO: 23833 - DNA, 25 bp, E. coli
tgcggacggttctgctgctgaaaag

SEQ ID NO: 23834 - DNA, 25 bp, E. coli
tccactgcggcaagctgagactgtg

SEQ ID NO: 23835 - DNA, 25 bp, E. coli
tccactgcggcatgctgagactgtg

SEQ ID NO: 23836 - DNA, 25 bp, E. coli
tgcggacggttcagctgctgaaaag

SEQ ID NO: 23837 - DNA, 25 bp, E. coli
gccactggaaactggcgcatttgaa

SEQ ID NO: 23838 - DNA, 25 bp, E. coli
gccactggaaacaggcgcatttgaa

SEQ ID NO: 23839 - DNA, 25 bp, E. coli
gctaaatgcctggaaaagggtggtc

SEQ ID NO: 23840 - DNA, 25 bp, E. coli
gctaaatgcctgcaaaagggtggtc

SEQ ID NO: 23841 - DNA, 25 bp, E. coli
gactcaaaatatgaggccgttaccc

SEQ ID NO: 23842 - DNA, 25 bp, E. coli
gactcaaaatatcaggccgttaccc

SEQ ID NO: 23843 - DNA, 25 bp, E. coli
gatcgcctcgatcaatttgccaacc

SEQ ID NO: 23844 - DNA, 25 bp, E. coli
gatcgcctcgatgaatttgccaacc

SEQ ID NO: 23845 - DNA, 25 bp, E. coli
caatctgattcgaaatctgctgaaa

SEQ ID NO: 23846 - DNA, 25 bp, E. coli
caatgtttgaatatcgtttcggcgg

SEQ ID NO: 23847 - DNA, 25 bp, E. coli
caatctgattcgtaatctgctgaaa

SEQ ID NO: 23848 - DNA, 25 bp, E. coli
caatgtttgaatttcgtttcggcgg

SEQ ID NO: 23849 - DNA, 25 bp, E. coli
tttgaatatcgtttcggcggtaatg

SEQ ID NO: 23850 - DNA, 25 bp, E. coli
tttgaatatcgtatcggcggtaatg

SEQ ID NO: 23851 - DNA, 25 bp, E. coli
tctgctgaaagtggacgcacatttg

SEQ ID NO: 23852 - DNA, 25 bp, E. coli
tctgctgaaagtcgacgcacatttg

SEQ ID NO: 23853 - DNA, 25 bp, E. coli
gcgtgcgacctcttgaagcgatcaa

SEQ ID NO: 23854 - DNA, 25 bp, E. coli
gctgataactgatcccagcgtcgct

SEQ ID NO: 23855 - DNA, 25 bp, E. coli
gcgtgcgacctcatgaagcgatcaa

SEQ ID NO: 23856 - DNA, 25 bp, E. coli
gctgataactgaacccagcgtcgct

SEQ ID NO: 23857 - DNA, 25 bp, E. coli
gaagcgatcaatctgattcgaaatc

SEQ ID NO: 23858 - DNA, 25 bp, E. coli
gcacatttgattgcgatgtcggagc

SEQ ID NO: 23859 - DNA, 25 bp, E. coli
gaagcgatcaatgtgattcgaaatc

SEQ ID NO: 23860 - DNA, 25 bp, E. coli
gcacatttgattccgatgtcggagc

SEQ ID NO: 23861 - DNA, 25 bp, E. coli
gaaagtggacgcacatttgattccg

SEQ ID NO: 23862 - DNA, 25 bp, E. coli
gaaagtggacgctcatttgattccg

SEQ ID NO: 23863 - DNA, 25 bp, E. coli
cgacctcttgaaccgatcaatctga

SEQ ID NO: 23864 - DNA, 25 bp, E. coli
cttagcgtgcgacctcttgaagcga

SEQ ID NO: 23865 - DNA, 25 bp, E. coli
cgacctcttgaagcgatcaatctga

SEQ ID NO: 23866 - DNA, 25 bp, E. coli
cttagcgtgcgagctcttgaagcga

SEQ ID NO: 23867 - DNA, 25 bp, E. coli
catgtatgacgcttactggaacggt

SEQ ID NO: 23868 - DNA, 25 bp, E. coli
catgtatgacgcatactggaacggt

SEQ ID NO: 23869 - DNA, 25 bp, E. coli
tatacgggcactcttactcaaggca

SEQ ID NO: 23870 - DNA, 25 bp, E. coli
tacggtacatggcttcctattgggc

SEQ ID NO: 23871 - DNA, 25 bp, E. coli
tacggtacatgggttcctattgggc

SEQ ID NO: 23872 - DNA, 25 bp, E. coli
tatacgggcactgttactcaaggca

SEQ ID NO: 23873 - DNA, 25 bp, E. coli
tatccgcctggtactgagcaaaacc

SEQ ID NO: 23874 - DNA, 25 bp, E. coli
tatccgcctggttctgagcaaaacc

SEQ ID NO: 23875 - DNA, 25 bp, E. coli
tgtgaatatcaaggccaatcgtctg

SEQ ID NO: 23876 - DNA, 25 bp, E. coli
tgtgaatatcaacgccaatcgtctg

SEQ ID NO: 23877 - DNA, 25 bp, E. coli
tcccaaatggctcaagtcggtgacg

SEQ ID NO: 23878 - DNA, 25 bp, E. coli
tcccaaatggctgaagtcggtgacg

SEQ ID NO: 23879 - DNA, 25 bp, E. coli
gacgtttccggccttgctaatggta

SEQ ID NO: 23880 - DNA, 25 bp, E. coli
gacgtttccggcgttgctaatggta

SEQ ID NO: 23881 - DNA, 25 bp, E. coli
gggtggcggtactaaacctcctgag

SEQ ID NO: 23882 - DNA, 25 bp, E. coli
gggtggcggtacaaaacctcctgag

SEQ ID NO: 23883 - DNA, 25 bp, E. coli
ggaacggtaaatacagagactgcgc

SEQ ID NO: 23884 - DNA, 25 bp, E. coli
ggaacggtaaattcagagactgcgc

SEQ ID NO: 23885 - DNA, 25 bp, E. coli
tcaacctcctgtcaatgctggcggc

SEQ ID NO: 23886 - DNA, 25 bp, E. coli
tcaacctcctgtgaatgctggcggc

SEQ ID NO: 23887 - DNA, 25 bp, E. coli
gatgaaaacgcggtacagtctgacg

SEQ ID NO: 23888 - DNA, 25 bp, E. coli
gatgaaaacgcgctacagtctgacg

SEQ ID NO: 23889 - DNA, 25 bp, E. coli
cagagcctgctcagcggtgcggatc

SEQ ID NO: 23890 - DNA, 25 bp, E. coli
cagagcctgctctgcggtgcggatc

SEQ ID NO: 23891 - DNA, 25 bp, E. coli
accagagcctgctcagcggtgcgga

SEQ ID NO: 23892 - DNA, 25 bp, E. coli
accagagcctgcacagcggtgcgga

SEQ ID NO: 23893 - DNA, 25 bp, E. coli
atctctctgacctgagcctgctcag

SEQ ID NO: 23894 - DNA, 25 bp, E. coli
atctctctgaccagagcctgctcag

SEQ ID NO: 23895 - DNA, 25 bp, E. coli
tgaccagagcctcctcagcggtgcg

SEQ ID NO: 23896 - DNA, 25 bp, E. coli
tgaccagagcctgctcagcggtgcg

SEQ ID NO: 23897 - DNA, 25 bp, E. coli
tctgaccagagcctgctcagcggtg

SEQ ID NO: 23898 - DNA, 25 bp, E. coli
tctgaccagagcgtgctcagcggtg

SEQ ID NO: 23899 - DNA, 25 bp, E. coli
gcgagctatctcactgaccagagcc

SEQ ID NO: 23900 - DNA, 25 bp, E. coli
gctatctctctgaccagagcctgct

SEQ ID NO: 23901 - DNA, 25 bp, E. coli
gcgagctatctctctgaccagagcc

SEQ ID NO: 23902 - DNA, 25 bp, E. coli
gctatctctctgtccagagcctgct

SEQ ID NO: 23903 - DNA, 25 bp, E. coli
ctcagcggtgcggatcgcagctacg

SEQ ID NO: 23904 - DNA, 25 bp, E. coli
ctgctcagcggtccggatcgcagct

SEQ ID NO: 23905 - DNA, 25 bp, E. coli
ctcagcggtgcgcatcgcagctacg

SEQ ID NO: 23906 - DNA, 25 bp, E. coli
ctgctcagcggtgcggatcgcagct

SEQ ID NO: 23907 - DNA, 25 bp, E. coli
ggcgagctatctgtctgaccagagc

SEQ ID NO: 23908 - DNA, 25 bp, E. coli
ggcgagctatctctctgaccagagc

SEQ ID NO: 23909 - DNA, 25 bp, E. coli
gagctatctctcagaccagagcctg

SEQ ID NO: 23910 - DNA, 25 bp, E. coli
gagctatctctctgaccagagcctg

SEQ ID NO: 23911 - DNA, 25 bp, E. coli
caaaaccgtttgttgatgaacgcca

SEQ ID NO: 23912 - DNA, 25 bp, E. coli
caaaaccgtttgatgatgaacgcca

SEQ ID NO: 23913 - DNA, 25 bp, E. coli
tacctataaattgcagacgccgctg

SEQ ID NO: 23914 - DNA, 25 bp, E. coli
tacctataaattccagacgccgctg

SEQ ID NO: 23915 - DNA, 25 bp, E. coli
tgcgaggtgcgcctatgacacgcaa

SEQ ID NO: 23916 - DNA, 25 bp, E. coli
tgccatgcgtctcttagtgccacca

SEQ ID NO: 23917 - DNA, 25 bp, E. coli
tgcgaggtgcgcgtatgacacgcaa

SEQ ID NO: 23918 - DNA, 25 bp, E. coli
tgccatgcgtctgttagtgccacca

SEQ ID NO: 23919 - DNA, 25 bp, E. coli
tcggtgatccgcgtactgggtgaaa

SEQ ID NO: 23920 - DNA, 25 bp, E. coli
tcggtgatccgcctactgggtgaaa

SEQ ID NO: 23921 - DNA, 25 bp, E. coli
gcagtttgctcacgtaaccaacccg

SEQ ID NO: 23922 - DNA, 25 bp, E. coli
gcagtttgctcaggtaaccaacccg

SEQ ID NO: 23923 - DNA, 25 bp, E. coli
cttgctgaaatacgtgcacggtggc

SEQ ID NO: 23924 - DNA, 25 bp, E. coli
cgtgatgtccgaaggccgtttcgcc

SEQ ID NO: 23925 - DNA, 25 bp, E. coli
cttgctgaaataggtgcacggtggc

SEQ ID NO: 23926 - DNA, 25 bp, E. coli
cgtgatgtccgatggccgtttcgcc

SEQ ID NO: 23927 - DNA, 25 bp, E. coli
cattggccgcgatatgaacgtcttc

SEQ ID NO: 23928 - DNA, 25 bp, E. coli
cattggccgcgaaatgaacgtcttc

SEQ ID NO: 23929 - DNA, 25 bp, E. coli
tggaaactgccgtgccacatgcagg

SEQ ID NO: 23930 - DNA, 25 bp, E. coli
tggaaactgccgagccacatgcagg

SEQ ID NO: 23931 - DNA, 25 bp, E. coli
gtaactcaaactgcggcgaaggcgg

SEQ ID NO: 23932 - DNA, 25 bp, E. coli
gtaactcaaactccggcgaaggcgg

SEQ ID NO: 23933 - DNA, 25 bp, E. coli
caagaagctcctaaacgaagcgaag

SEQ ID NO: 23934 - DNA, 25 bp, E. coli
caagaagctccttaacgaagcgaag

SEQ ID NO: 23935 - DNA, 25 bp, E. coli
catatgcggccaagggatcgctgga

SEQ ID NO: 23936 - DNA, 25 bp, E. coli
catatgcggccatgggatcgctgga

SEQ ID NO: 23937 - DNA, 25 bp, E. coli
tacccgatccatatttatggcgcgg

SEQ ID NO: 23938 - DNA, 25 bp, E. coli
tacccgatccatttttatggcgcgg

SEQ ID NO: 23939 - DNA, 25 bp, E. coli
tgtattggttaatgggctgcatgaa

SEQ ID NO: 23940 - DNA, 25 bp, E. coli
tgtattggttaaagggctgcatgaa

SEQ ID NO: 23941 - DNA, 25 bp, E. coli
tgcacgcgatgtcgcagtcgagttc

SEQ ID NO: 23942 - DNA, 25 bp, E. coli
tgcacgcgatgtggcagtcgagttc

SEQ ID NO: 23943 - DNA, 25 bp, E. coli
tcttcgaaaaagtagtggcgctggc

SEQ ID NO: 23944 - DNA, 25 bp, E. coli
tcttcgaaaaagaagtggcgctggc

SEQ ID NO: 23945 - DNA, 25 bp, E. coli
gcgtggaactggtgttcttcgaaaa

SEQ ID NO: 23946 - DNA, 25 bp, E. coli
gcgtggaactggagttcttcgaaaa

SEQ ID NO: 23947 - DNA, 25 bp, E. coli
gaatttgccaagtagctccttaacg

SEQ ID NO: 23948 - DNA, 25 bp, E. coli
gaatttgccaagaagctccttaacg

SEQ ID NO: 23949 - DNA, 25 bp, E. coli
cgatgtggcagtggagttctttacg

SEQ ID NO: 23950 - DNA, 25 bp, E. coli
cgaaaaagtagtcgcgctggcgaaa

SEQ ID NO: 23951 - DNA, 25 bp, E. coli
cccggaaccataagcggccatggga

SEQ ID NO: 23952 - DNA, 25 bp, E. coli
cgaaaaagtagtggcgctggcgaaa

SEQ ID NO: 23953 - DNA, 25 bp, E. coli
cgatgtggcagtcgagttctttacg

SEQ ID NO: 23954 - DNA, 25 bp, E. coli
cccggaaccatatgcggccatggga

SEQ ID NO: 23955 - DNA, 25 bp, E. coli
atctcggcgcggcaactgggtttac

SEQ ID NO: 23956 - DNA, 25 bp, E. coli
atctcggcgcgggaactgggtttac

SEQ ID NO: 23957 - DNA, 25 bp, E. coli
tatgttagcacttggcgagatctcg

SEQ ID NO: 23958 - DNA, 25 bp, E. coli
tagactggcggctaagctggctgat

SEQ ID NO: 23959 - DNA, 25 bp, E. coli
tagactggcggcaaagctggctgat

SEQ ID NO: 23960 - DNA, 25 bp, E. coli
tacccctgtggttctggcgcaatgt

SEQ ID NO: 23961 - DNA, 25 bp, E. coli
tatgttagcactaggcgagatctcg

SEQ ID NO: 23962 - DNA, 25 bp, E. coli
tacccctgtggtactggcgcaatgt

SEQ ID NO: 23963 - DNA, 25 bp, E. coli
tatatccggcgctgtaatgcaggcg

SEQ ID NO: 23964 - DNA, 25 bp, E. coli
tatatccggcgcagtaatgcaggcg

SEQ ID NO: 23965 - DNA, 25 bp, E. coli
tgctggccgatattgtagcgcgcct

SEQ ID NO: 23966 - DNA, 25 bp, E. coli
tgctggccgataatgtagcgcgcct

SEQ ID NO: 23967 - DNA, 25 bp, E. coli
tacttggcgtctctaacggcgcagg

SEQ ID NO: 23968 - DNA, 25 bp, E. coli
tacttggcgtctgtaacggcgcagg

SEQ ID NO: 23969 - DNA, 25 bp, E. coli
tctgtagcgcactaatgacgtgggc

SEQ ID NO: 23970 - DNA, 25 bp, E. coli
tctgttgtcagtgcaggccgatgaa

SEQ ID NO: 23971 - DNA, 25 bp, E. coli
tctgtagcgcacaaatgacgtgggc

SEQ ID NO: 23972 - DNA, 25 bp, E. coli
tctgttgtcagtccaggccgatgaa

SEQ ID NO: 23973 - DNA, 25 bp, E. coli
cgttgtttgaaaatcctctggcaga

SEQ ID NO: 23974 - DNA, 25 bp, E. coli
cgttgtttgaaattcctctggcaga

SEQ ID NO: 23975 - DNA, 25 bp, E. coli
tggcagaacctgcactacttggcgt

SEQ ID NO: 23976 - DNA, 25 bp, E. coli
tggcagaacctggactacttggcgt

SEQ ID NO: 23977 - DNA, 25 bp, E. coli
cacggtgcgcgtaacccttcctata

SEQ ID NO: 23978 - DNA, 25 bp, E. coli
cacggtgcgcgttacccttcctata

SEQ ID NO: 23979 - DNA, 25 bp, E. coli
agtgtgaactgcgtgacggtgacct

SEQ ID NO: 23980 - DNA, 25 bp, E. coli
agtgtgaactgcctgacggtgacct

SEQ ID NO: 23981 - DNA, 25 bp, E. coli
aaacgagtgtgatctgcgtgacggt

SEQ ID NO: 23982 - DNA, 25 bp, E. coli
aaacgagtgtgaactgcgtgacggt

SEQ ID NO: 23983 - DNA, 25 bp, E. coli
tgaaatcgtgaacagcgcgcttgag

SEQ ID NO: 23984 - DNA, 25 bp, E. coli
tgaaatcgtgaagagcgcgcttgag

SEQ ID NO: 23985 - DNA, 25 bp, E. coli
tgaacagcgcgcttgagaaactgcg

SEQ ID NO: 23986 - DNA, 25 bp, E. coli
tgaacagcgcgcatgagaaactgcg

SEQ ID NO: 23987 - DNA, 25 bp, E. coli
tcgccgcgcgggagaaatcaccgca

SEQ ID NO: 23988 - DNA, 25 bp, E. coli
tcgccgcgcgggtgaaatcaccgca

SEQ ID NO: 23989 - DNA, 25 bp, E. coli
tcaggctcagcgagaaatctatgac

SEQ ID NO: 23990 - DNA, 25 bp, E. coli
tcaggctcagcgtgaaatctatgac

SEQ ID NO: 23991 - DNA, 25 bp, E. coli
cgcactggcgcaaacacgggcgatg

SEQ ID NO: 23992 - DNA, 25 bp, E. coli
cgcgcttgagaatctgcgtaaaggt

SEQ ID NO: 23993 - DNA, 25 bp, E. coli
cgcactggcgcatacacgggcgatg

SEQ ID NO: 23994 - DNA, 25 bp, E. coli
cgcgcttgagaaactgcgtaaaggt

SEQ ID NO: 23995 - DNA, 25 bp, E. coli
cgggtgaaatcagcgcactggcgca

SEQ ID NO: 23996 - DNA, 25 bp, E. coli
cgggtgaaatcaccgcactggcgca

SEQ ID NO: 23997 - DNA, 25 bp, E. coli
ggtatggttctgaccgtagaaccag

SEQ ID NO: 23998 - DNA, 25 bp, E. coli
ggtatggttctgtccgtagaaccag

SEQ ID NO: 23999 - DNA, 25 bp, E. coli
catcaatagtcacgaactggctggg

SEQ ID NO: 24000 - DNA, 25 bp, E. coli
catcaatagtcaggaactggctggg

SEQ ID NO: 24001 - DNA, 25 bp, E. coli
taacagatgaagtgttgtgccgggc

SEQ ID NO: 24002 - DNA, 25 bp, E. coli
taacagatgaagagttgtgccgggc

SEQ ID NO: 24003 - DNA, 25 bp, E. coli
taaaaagcgcctacaccaaaatcgt

SEQ ID NO: 24004 - DNA, 25 bp, E. coli
taaagctgatgcacttggcggtggc

SEQ ID NO: 24005 - DNA, 25 bp, E. coli
taaaaagcgccttcaccaaaatcgt

SEQ ID NO: 24006 - DNA, 25 bp, E. coli
taaagctgatgctcttggcggtggc

SEQ ID NO: 24007 - DNA, 25 bp, E. coli
aaagcattatgccttcctgacgaaa

SEQ ID NO: 24008 - DNA, 25 bp, E. coli
aaagcattatgcgttcctgacgaaa

SEQ ID NO: 24009 - DNA, 25 bp, E. coli
tgtgccgggccattttagaaacaga

SEQ ID NO: 24010 - DNA, 25 bp, E. coli
tgtgccgggccaatttagaaacaga

SEQ ID NO: 24011 - DNA, 25 bp, E. coli
gccaggtctcatgcaataacagatg

SEQ ID NO: 24012 - DNA, 25 bp, E. coli
gccaggtctcatccaataacagatg

SEQ ID NO: 24013 - DNA, 25 bp, E. coli
gacagagatctggtatgactgcaaa

SEQ ID NO: 24014 - DNA, 25 bp, E. coli
gacagagatctgctatgactgcaaa

SEQ ID NO: 24015 - DNA, 25 bp, E. coli
cgtgagcgtgcaattattctggcga

SEQ ID NO: 24016 - DNA, 25 bp, E. coli
cgtgagcgtgcatttattctggcga

SEQ ID NO: 24017 - DNA, 25 bp, E. coli
gattaacactaaagaactgacagag

SEQ ID NO: 24018 - DNA, 25 bp, E. coli
gattaacactaatgaactgacagag

SEQ ID NO: 24019 - DNA, 25 bp, E. coli
ggtttgcaagggaagccaggtctca

SEQ ID NO: 24020 - DNA, 25 bp, E. coli
ggtttgcaagggtagccaggtctca

SEQ ID NO: 24021 - DNA, 25 bp, E. coli
aagttagtttcgcagagatagccca

SEQ ID NO: 24022 - DNA, 25 bp, E. coli
catgtcattaaagaacgtgtaggcg

SEQ ID NO: 24023 - DNA, 25 bp, E. coli
cattaaagaacgtgtaggcggcggt

SEQ ID NO: 24024 - DNA, 25 bp, E. coli
catgtcattaaacaacgtgtaggcg

SEQ ID NO: 24025 - DNA, 25 bp, E. coli
taggcggcggttttggctctaaaca

SEQ ID NO: 24026 - DNA, 25 bp, E. coli
atcgacgacgcggtctcaggtctgt

SEQ ID NO: 24027 - DNA, 25 bp, E. coli
atcgacgacgcgctctcaggtctgt

SEQ ID NO: 24028 - DNA, 25 bp, E. coli
cttgggcaacttgcgtaaccgggcg

SEQ ID NO: 24029 - DNA, 25 bp, E. coli
cttgggcaacttccgtaaccgggcg

SEQ ID NO: 24030 - DNA, 25 bp, E. coli
aagttagtttcggagagatagccca

SEQ ID NO: 24031 - DNA, 25 bp, E. coli
taggcggcggttatggctctaaaca

SEQ ID NO: 24032 - DNA, 25 bp, E. coli
ttcggagagataccccataaaggcg

SEQ ID NO: 24033 - DNA, 25 bp, E. coli
ttcggagagatagcccataaaggcg

SEQ ID NO: 24034 - DNA, 25 bp, E. coli
tctcaggtctgtatagccgcgatgc

SEQ ID NO: 24035 - DNA, 25 bp, E. coli
tctcaggtctgtttagccgcgatgc

SEQ ID NO: 24036 - DNA, 25 bp, E. coli
cgcgttgctgcgctagtagccgaaa

SEQ ID NO: 24037 - DNA, 25 bp, E. coli
cgcgttgctgcggtagtagccgaaa

SEQ ID NO: 24038 - DNA, 25 bp, E. coli
cattaaagaacgagtaggcggcggt

SEQ ID NO: 24039 - DNA, 25 bp, E. coli
ctgtttagccgccatgcaggctggc

SEQ ID NO: 24040 - DNA, 25 bp, E. coli
ctgtttagccgcgatgcaggctggc

SEQ ID NO: 24041 - DNA, 25 bp, E. coli
gtagccgaaagtgaagacattgcgc

SEQ ID NO: 24042 - DNA, 25 bp, E. coli
gtagccgaaagtcaagacattgcgc

SEQ ID NO: 24043 - DNA, 25 bp, E. coli
cagacgggcgccaaaacaaggtgtc

SEQ ID NO: 24044 - DNA, 25 bp, E. coli
cagacgggcgcctaaacaaggtgtc

SEQ ID NO: 24045 - DNA, 25 bp, E. coli
tactttccgtttcggtcgcaggata

SEQ ID NO: 24046 - DNA, 25 bp, E. coli
tactttccgtttgggtcgcaggata

SEQ ID NO: 24047 - DNA, 25 bp, E. coli
aaacaaggtgtcacggcgcagggca

SEQ ID NO: 24048 - DNA, 25 bp, E. coli
aaacaaggtgtctcggcgcagggca

SEQ ID NO: 24049 - DNA, 25 bp, E. coli
tttcggtcgcaggataaacagccag

SEQ ID NO: 24050 - DNA, 25 bp, E. coli
ttgttccggggagtgtgtccgacat

SEQ ID NO: 24051 - DNA, 25 bp, E. coli
tttcggtcgcagcataaacagccag

SEQ ID NO: 24052 - DNA, 25 bp, E. coli
ttcggtcgcaggataaacagccaga

SEQ ID NO: 24053 - DNA, 25 bp, E. coli
ttgttccggggactgtgtccgacat

SEQ ID NO: 24054 - DNA, 25 bp, E. coli
ttcggtcgcaggttaaacagccaga

SEQ ID NO: 24055 - DNA, 25 bp, E. coli
ccaaaacaaggtctcacggcgcagg

SEQ ID NO: 24056 - DNA, 25 bp, E. coli
ccaaaacaaggtgtcacggcgcagg

SEQ ID NO: 24057 - DNA, 25 bp, E. coli
cgcattgctgaagcggcccctgata

SEQ ID NO: 24058 - DNA, 25 bp, E. coli
cgcattgctgaaccggcccctgata

SEQ ID NO: 24059 - DNA, 25 bp, E. coli
gggcgccaaaacaaggtgtcacggc

SEQ ID NO: 24060 - DNA, 25 bp, E. coli
gggcgccaaaactaggtgtcacggc

SEQ ID NO: 24061 - DNA, 25 bp, E. coli
tgttgtcgtcggcaagcgttgttcc

SEQ ID NO: 24062 - DNA, 25 bp, E. coli
tgttgtcgtcgggaagcgttgttcc

SEQ ID NO: 24063 - DNA, 25 bp, E. coli
gacgggcgccaaaacaaggtgtcac

SEQ ID NO: 24064 - DNA, 25 bp, E. coli
gacgggcgccaatacaaggtgtcac

SEQ ID NO: 24065 - DNA, 25 bp, E. coli
tacgtttatcatgttaattcatcat

SEQ ID NO: 24066 - DNA, 25 bp, E. coli
aggcatcccaccagacttcgaatga

SEQ ID NO: 24067 - DNA, 25 bp, E. coli
aggcatcccacctgacttcgaatga

SEQ ID NO: 24068 - DNA, 25 bp, E. coli
tagagagcattgtttctaagtgtca

SEQ ID NO: 24069 - DNA, 25 bp, E. coli
tacgtttatcatcttaattcatcat

SEQ ID NO: 24070 - DNA, 25 bp, E. coli
tagagagcattgattctaagtgtca

SEQ ID NO: 24071 - DNA, 25 bp, E. coli
tatatatcaaactaaataaccctga

SEQ ID NO: 24072 - DNA, 25 bp, E. coli
tatatatcaaacaaaataaccctga

SEQ ID NO: 24073 - DNA, 25 bp, E. coli
tgattattcatctctatagagagca

SEQ ID NO: 24074 - DNA, 25 bp, E. coli
tgattattcatcactatagagagca

SEQ ID NO: 24075 - DNA, 25 bp, E. coli
tctaagtgtcatttgaaagtaccaa

SEQ ID NO: 24076 - DNA, 25 bp, E. coli
tctaagtgtcatatgaaagtaccaa

SEQ ID NO: 24077 - DNA, 25 bp, E. coli
gaaagtaccaatagatatatatcaa

SEQ ID NO: 24078 - DNA, 25 bp, E. coli
gaaagtaccaattgatatatatcaa

SEQ ID NO: 24079 - DNA, 25 bp, E. coli
ccccacatcctgaaggaggtgtatt

SEQ ID NO: 24080 - DNA, 25 bp, E. coli
cccacctgacttggaatgatgatta

SEQ ID NO: 24081 - DNA, 25 bp, E. coli
ccccacatcctgtaggaggtgtatt

SEQ ID NO: 24082 - DNA, 25 bp, E. coli
cccacctgacttcgaatgatgatta

SEQ ID NO: 24083 - DNA, 25 bp, E. coli
taaccctgattaatgaattattacg

SEQ ID NO: 24084 - DNA, 25 bp, E. coli
taaccctgattattgaattattacg

SEQ ID NO: 24085 - DNA, 25 bp, E. coli
gaggtgtattcagacaggcatccca

SEQ ID NO: 24086 - DNA, 25 bp, E. coli
gaggtgtattcacacaggcatccca

SEQ ID NO: 24087 - DNA, 25 bp, E. coli
cactattggtgtatacgactgggaa

SEQ ID NO: 24088 - DNA, 25 bp, E. coli
cactattggtgtttacgactgggaa

SEQ ID NO: 24089 - DNA, 25 bp, E. coli
cagaaacggtggacagccacgtcga

SEQ ID NO: 24090 - DNA, 25 bp, E. coli
cagaaacggtggtcagccacgtcga

SEQ ID NO: 24091 - DNA, 25 bp, E. coli
aactcgccgtgggtgcgtatcaaac

SEQ ID NO: 24092 - DNA, 25 bp, E. coli
aactcgccgtggctgcgtatcaaac

SEQ ID NO: 24093 - DNA, 25 bp, E. coli
tagagcaactttcggtaatcaccac

SEQ ID NO: 24094 - DNA, 25 bp, E. coli
tacgctgacattgcagaaacggtgg

SEQ ID NO: 24095 - DNA, 25 bp, E. coli
tacgctgacattccagaaacggtgg

SEQ ID NO: 24096 - DNA, 25 bp, E. coli
tagagcaactttgggtaatcaccac

SEQ ID NO: 24097 - DNA, 25 bp, E. coli
tttacgactgggtacagaccatcga

SEQ ID NO: 24098 - DNA, 25 bp, E. coli
tttacgactgggaacagaccatcga

SEQ ID NO: 24099 - DNA, 25 bp, E. coli
tgttagcacgctacaactcgccgtg

SEQ ID NO: 24100 - DNA, 25 bp, E. coli
tgttagcacgcttcaactcgccgtg

SEQ ID NO: 24101 - DNA, 25 bp, E. coli
tgagcgtggcaataatctgaaagaa

SEQ ID NO: 24102 - DNA, 25 bp, E. coli
tgagcgtggcaaaaatctgaaagaa

SEQ ID NO: 24103 - DNA, 25 bp, E. coli
tcgaaatggcgtgggataaccgtaa

SEQ ID NO: 24104 - DNA, 25 bp, E. coli
tcgaaatggcgtcggataaccgtaa

SEQ ID NO: 24105 - DNA, 25 bp, E. coli
gtatcaaactcaccaagccaggcgc

SEQ ID NO: 24106 - DNA, 25 bp, E. coli
gttggcgtaatcattgagcgtggca

SEQ ID NO: 24107 - DNA, 25 bp, E. coli
gttggcgtaatctttgagcgtggca

SEQ ID NO: 24108 - DNA, 25 bp, E. coli
gtatcaaactcagcaagccaggcgc

SEQ ID NO: 24109 - DNA, 25 bp, E. coli
catcacgtcgtaaacttggcggtcg

SEQ ID NO: 24110 - DNA, 25 bp, E. coli
catcacgtcgtatacttggcggtcg

SEQ ID NO: 24111 - DNA, 25 bp, E. coli
aacttggcggtccttccgttggctg

SEQ ID NO: 24112 - DNA, 25 bp, E. coli
aacttggcggtcgttccgttggctg

SEQ ID NO: 24113 - DNA, 25 bp, E. coli
tagccgtacgtgtcgctaccgcctg

SEQ ID NO: 24114 - DNA, 25 bp, E. coli
tagccgtacgtgacgctaccgcctg

SEQ ID NO: 24115 - DNA, 25 bp, E. coli
ttctggcctggatggatagctgcaa

SEQ ID NO: 24116 - DNA, 25 bp, E. coli
ttctggcctggaaggatagctgcaa

SEQ ID NO: 24117 - DNA, 25 bp, E. coli
tgtcgctaccgcgtggaaaaggccg

SEQ ID NO: 24118 - DNA, 25 bp, E. coli
tgtcgctaccgcctggaaaaggccg

SEQ ID NO: 24119 - DNA, 25 bp, E. coli
tccgttggctggtctttatccgagg

SEQ ID NO: 24120 - DNA, 25 bp, E. coli
tccgttggctggactttatccgagg

SEQ ID NO: 24121 - DNA, 25 bp, E. coli
tctttatccgaggttctggcctgga

SEQ ID NO: 24122 - DNA, 25 bp, E. coli
tctttatccgagcttctggcctgga

SEQ ID NO: 24123 - DNA, 25 bp, E. coli
cctggaaggatagctgcaaggcagt

SEQ ID NO: 24124 - DNA, 25 bp, E. coli
cctggaaggatacctgcaaggcagt

SEQ ID NO: 24125 - DNA, 25 bp, E. coli
ggatagctgcaacgcagttcattaa

SEQ ID NO: 24126 - DNA, 25 bp, E. coli
ggatagctgcaaggcagttcattaa

SEQ ID NO: 24127 - DNA, 25 bp, E. coli
tggaaaaggccgcacaattcccatc

SEQ ID NO: 24128 - DNA, 25 bp, E. coli
tggaaaaggccggacaattcccatc

SEQ ID NO: 24129 - DNA, 25 bp, E. coli
ggccggacaattcccatcacgtcgt

SEQ ID NO: 24130 - DNA, 25 bp, E. coli
ggccggacaattgccatcacgtcgt

SEQ ID NO: 24131 - DNA, 25 bp, E. coli
tactgaaacccagacctatgttgat

SEQ ID NO: 24132 - DNA, 25 bp, E. coli
taaattacaggctggtgaacgggat

SEQ ID NO: 24133 - DNA, 25 bp, E. coli
taaattacaggcaggtgaacgggat

SEQ ID NO: 24134 - DNA, 25 bp, E. coli
tactgaaacccacacctatgttgat

SEQ ID NO: 24135 - DNA, 25 bp, E. coli
agatatcgcttggttcggtgaaaaa

SEQ ID NO: 24136 - DNA, 25 bp, E. coli
agatatcgcttgcttcggtgaaaaa

SEQ ID NO: 24137 - DNA, 25 bp, E. coli
acctggtccagccagatatcgcttg

SEQ ID NO: 24138 - DNA, 25 bp, E. coli
aacagcaaacgtgcagtgattctgg

SEQ ID NO: 24139 - DNA, 25 bp, E. coli
aacagcaaacgtccagtgattctgg

SEQ ID NO: 24140 - DNA, 25 bp, E. coli
aacccacacctaagttgatgttccc

SEQ ID NO: 24141 - DNA, 25 bp, E. coli
aacccacacctatgttgatgttccc

SEQ ID NO: 24142 - DNA, 25 bp, E. coli
acctggtccagcgagatatcgcttg

SEQ ID NO: 24143 - DNA, 25 bp, E. coli
tgatgttcccggactttccaccatg

SEQ ID NO: 24144 - DNA, 25 bp, E. coli
tgatgttcccggtctttccaccatg

SEQ ID NO: 24145 - DNA, 25 bp, E. coli
gccagatatcgcttgcttcggtgaa

SEQ ID NO: 24146 - DNA, 25 bp, E. coli
gccagatatcgcatgcttcggtgaa

SEQ ID NO: 24147 - DNA, 25 bp, E. coli
cggtctttccaccatgctggaaggt

SEQ ID NO: 24148 - DNA, 25 bp, E. coli
cggtctttccacgatgctggaaggt

SEQ ID NO: 24149 - DNA, 25 bp, E. coli
gattgccgataatttacaggctggt

SEQ ID NO: 24150 - DNA, 25 bp, E. coli
gttcccggtcttaccaccatgctgg

SEQ ID NO: 24151 - DNA, 25 bp, E. coli
gttcccggtctttccaccatgctgg

SEQ ID NO: 24152 - DNA, 25 bp, E. coli
gattgccgataaattacaggctggt

SEQ ID NO: 24153 - DNA, 25 bp, E. coli
aactgattatcgttcatgacgggca

SEQ ID NO: 24154 - DNA, 25 bp, E. coli
catgacgggcaagaatatctgctcc

SEQ ID NO: 24155 - DNA, 25 bp, E. coli
catgacgggcaacaatatctgctcc

SEQ ID NO: 24156 - DNA, 25 bp, E. coli
taaaactcaggcaggcaagctgctg

SEQ ID NO: 24157 - DNA, 25 bp, E. coli
tacggatagcagaaaactcacgcct

SEQ ID NO: 24158 - DNA, 25 bp, E. coli
aactgattatcgatcatgacgggca

SEQ ID NO: 24159 - DNA, 25 bp, E. coli
aaactcacgcctgaaacggatgcca

SEQ ID NO: 24160 - DNA, 25 bp, E. coli
aaactcacgcctcaaacggatgcca

SEQ ID NO: 24161 - DNA, 25 bp, E. coli
tacggatagcagtaaactcacgcct

SEQ ID NO: 24162 - DNA, 25 bp, E. coli
tatctgctccgttaaactcaggctg

SEQ ID NO: 24163 - DNA, 25 bp, E. coli
tatctgctccgtaaaactcaggctg

SEQ ID NO: 24164 - DNA, 25 bp, E. coli
tgcgttatacggatagcagaaaact

SEQ ID NO: 24165 - DNA, 25 bp, E. coli
tgcgttatacggttagcagaaaact

SEQ ID NO: 24166 - DNA, 25 bp, E. coli
gacactgttaggtccggatggcaaa

SEQ ID NO: 24167 - DNA, 25 bp, E. coli
gacactgttaggaccggatggcaaa

SEQ ID NO: 24168 - DNA, 25 bp, E. coli
ccagccagacacagttaggtccgga

SEQ ID NO: 24169 - DNA, 25 bp, E. coli
ccagccagacactgttaggtccgga

SEQ ID NO: 24170 - DNA, 25 bp, E. coli
ggtccggatggcaaactgattatcg

SEQ ID NO: 24171 - DNA, 25 bp, E. coli
ggtccggatggctaactgattatcg

SEQ ID NO: 24172 - DNA, 25 bp, E. coli
tggcaagctgctcttgaccaagtag

SEQ ID NO: 24173 - DNA, 25 bp, E. coli
tggcaagctgctgttgaccaagtag

SEQ ID NO: 24174 - DNA, 25 bp, E. coli
taaaactcaggctggcaagctgctg

SEQ ID NO: 24175 - DNA, 25 bp, E. coli
taaagaaatgtttgccacggtaggg

SEQ ID NO: 24176 - DNA, 25 bp, E. coli
tacaccatgaatagagaaaaaacgg

SEQ ID NO: 24177 - DNA, 25 bp, E. coli
taaagaaatgttagccacggtaggg

SEQ ID NO: 24178 - DNA, 25 bp, E. coli
tacaccatgaattgagaaaaaacgg

SEQ ID NO: 24179 - DNA, 25 bp, E. coli
agcaggcaagctttttaccgatatg

SEQ ID NO: 24180 - DNA, 25 bp, E. coli
agcaggcaagctatttaccgatatg

SEQ ID NO: 24181 - DNA, 25 bp, E. coli
aaagacattccagcaaacgtcgtgg

SEQ ID NO: 24182 - DNA, 25 bp, E. coli
aaagacattccaccaaacgtcgtgg

SEQ ID NO: 24183 - DNA, 25 bp, E. coli
tattcgcgaaataaacgaccgggat

SEQ ID NO: 24184 - DNA, 25 bp, E. coli
tattcgcgaaattaacgaccgggat

SEQ ID NO: 24185 - DNA, 25 bp, E. coli
tgtggttattaaaccaggcgtcacc

SEQ ID NO: 24186 - DNA, 25 bp, E. coli
ttaccgatatgtccgaaggcttacc

SEQ ID NO: 24187 - DNA, 25 bp, E. coli
ttaccgatatgtgcgaaggcttacc

SEQ ID NO: 24188 - DNA, 25 bp, E. coli
tgtggttattaatccaggcgtcacc

SEQ ID NO: 24189 - DNA, 25 bp, E. coli
gataattctgtttttggcgcgggta

SEQ ID NO: 24190 - DNA, 25 bp, E. coli
gattggcaataaggtctggatcgga

SEQ ID NO: 24191 - DNA, 25 bp, E. coli
gataattctgttattggcgcgggta

SEQ ID NO: 24192 - DNA, 25 bp, E. coli
gattggcaataacgtctggatcgga

SEQ ID NO: 24193 - DNA, 25 bp, E. coli
ggttccaacatcgatataggccgca

SEQ ID NO: 24194 - DNA, 25 bp, E. coli
ggttccaacatccatataggccgca

SEQ ID NO: 24195 - DNA, 25 bp, E. coli
gagatgtactctattccgataacga

SEQ ID NO: 24196 - DNA, 25 bp, E. coli
gagatgtactcttttccgataacga

SEQ ID NO: 24197 - DNA, 25 bp, E. coli
acggtctgtttcgtacgcgatcatg

SEQ ID NO: 24198 - DNA, 25 bp, E. coli
acggtctgtttcctacgcgatcatg

SEQ ID NO: 24199 - DNA, 25 bp, E. coli
tttcgtacgcgaacatgatcggcat

SEQ ID NO: 24200 - DNA, 25 bp, E. coli
tttcgtacgcgatcatgatcggcat

SEQ ID NO: 24201 - DNA, 25 bp, E. coli
ttcgtacgcgatcatgatcggcatc

SEQ ID NO: 24202 - DNA, 25 bp, E. coli
ttcgtacgcgatgatgatcggcatc

SEQ ID NO: 24203 - DNA, 25 bp, E. coli
tgtttcgtacgcgatcatgatcggc

SEQ ID NO: 24204 - DNA, 25 bp, E. coli
tgtttcgtacgccatcatgatcggc

SEQ ID NO: 24205 - DNA, 25 bp, E. coli
tcgtacgcgatcatgatcggcatct

SEQ ID NO: 24206 - DNA, 25 bp, E. coli
tcgtacgcgatcttgatcggcatct

SEQ ID NO: 24207 - DNA, 25 bp, E. coli
tctgtttcgtacgcgatcatgatcg

SEQ ID NO: 24208 - DNA, 25 bp, E. coli
tctgtttcgtacccgatcatgatcg

SEQ ID NO: 24209 - DNA, 25 bp, E. coli
cggtctgtttcgtacgcgatcatga

SEQ ID NO: 24210 - DNA, 25 bp, E. coli
cgtacgcgatcaagatcggcatctg

SEQ ID NO: 24211 - DNA, 25 bp, E. coli
cgtacgcgatcatgatcggcatctg

SEQ ID NO: 24212 - DNA, 25 bp, E. coli
cggtctgtttcgaacgcgatcatga

SEQ ID NO: 24213 - DNA, 25 bp, E. coli
gtttcgtacgcgatcatgatcggca

SEQ ID NO: 24214 - DNA, 25 bp, E. coli
gtttcgtacgcgttcatgatcggca

SEQ ID NO: 24215 - DNA, 25 bp, E. coli
ggtctgtttcgtacgcgatcatgat

SEQ ID NO: 24216 - DNA, 25 bp, E. coli
gtctgtttcgtaggcgatcatgatc

SEQ ID NO: 24217 - DNA, 25 bp, E. coli
ggtctgtttcgttcgcgatcatgat

SEQ ID NO: 24218 - DNA, 25 bp, E. coli
gtctgtttcgtacgcgatcatgatc

SEQ ID NO: 24219 - DNA, 25 bp, E. coli
agccgtggcctgtccgcattgttga

SEQ ID NO: 24220 - DNA, 25 bp, E. coli
agccgtggcctgaccgcattgttga

SEQ ID NO: 24221 - DNA, 25 bp, E. coli
aaattaccgctatctctgcggcggg

SEQ ID NO: 24222 - DNA, 25 bp, E. coli
aaattaccgctaactctgcggcggg

SEQ ID NO: 24223 - DNA, 25 bp, E. coli
tagggcagatgtttaccgactcgga

SEQ ID NO: 24224 - DNA, 25 bp, E. coli
tagggcagatgtataccgactcgga

SEQ ID NO: 24225 - DNA, 25 bp, E. coli
ttatcaactggaccagcagtcgcag

SEQ ID NO: 24226 - DNA, 25 bp, E. coli
ttatcaactggagcagcagtcgcag

SEQ ID NO: 24227 - DNA, 25 bp, E. coli
tggttgaacacttcatcatgcgtgg

SEQ ID NO: 24228 - DNA, 25 bp, E. coli
tgtggttgacccatcacccgagaaa

SEQ ID NO: 24229 - DNA, 25 bp, E. coli
tgtggttgacccttcacccgagaaa

SEQ ID NO: 24230 - DNA, 25 bp, E. coli
gaatgatcctttcgcagacggttga

SEQ ID NO: 24231 - DNA, 25 bp, E. coli
gaatgatcctttggcagacggttga

SEQ ID NO: 24232 - DNA, 25 bp, E. coli
gaccgaagcggcaaatgggacatta

SEQ ID NO: 24233 - DNA, 25 bp, E. coli
gaaaccgaccgttatgttgcacaac

SEQ ID NO: 24234 - DNA, 25 bp, E. coli
gaaaccgaccgtaatgttgcacaac

SEQ ID NO: 24235 - DNA, 25 bp, E. coli
tggatcaaagccctaacgtcaaacg

SEQ ID NO: 24236 - DNA, 25 bp, E. coli
tggatcaaagccgtaacgtcaaacg

SEQ ID NO: 24237 - DNA, 25 bp, E. coli
tggttgaacactacatcatgcgtgg

SEQ ID NO: 24238 - DNA, 25 bp, E. coli
tatggtcgtccgagggcttatgcgc

SEQ ID NO: 24239 - DNA, 25 bp, E. coli
tatggtcgtccgtgggcttatgcgc

SEQ ID NO: 24240 - DNA, 25 bp, E. coli
gaccgaagcggctaatgggacatta

SEQ ID NO: 24241 - DNA, 25 bp, E. coli
aagtggctgattgttaccgtctgcg

SEQ ID NO: 24242 - DNA, 25 bp, E. coli
aagtggctgattcttaccgtctgcg

SEQ ID NO: 24243 - DNA, 25 bp, E. coli
caaaagtttgctgcacctggatgct

SEQ ID NO: 24244 - DNA, 25 bp, E. coli
caaaagtttgctccacctggatgct

SEQ ID NO: 24245 - DNA, 25 bp, E. coli
tacgtgaagtcagtgcatgggctca

SEQ ID NO: 24246 - DNA, 25 bp, E. coli
tacgtgaagtcactgcatgggctca

SEQ ID NO: 24247 - DNA, 25 bp, E. coli
aaaggaacctgatctcgcgaaagcg

SEQ ID NO: 24248 - DNA, 25 bp, E. coli
aaaggaacctgaactcgcgaaagcg

SEQ ID NO: 24249 - DNA, 25 bp, E. coli
tatctgacgtggctctcctgaagcg

SEQ ID NO: 24250 - DNA, 25 bp, E. coli
tatctgacgtgggtctcctgaagcg

SEQ ID NO: 24251 - DNA, 25 bp, E. coli
tgaatattcagcagagcaagtggct

SEQ ID NO: 24252 - DNA, 25 bp, E. coli
tgaatattcagctgagcaagtggct

SEQ ID NO: 24253 - DNA, 25 bp, E. coli
tcgatggaacaggaatcagtgcgcc

SEQ ID NO: 24254 - DNA, 25 bp, E. coli
tcgatggaacagcaatcagtgcgcc

SEQ ID NO: 24255 - DNA, 25 bp, E. coli
tctgcgatggcatattgaactggct

SEQ ID NO: 24256 - DNA, 25 bp, E. coli
tctgcgatggcaaattgaactggct

SEQ ID NO: 24257 - DNA, 25 bp, E. coli
gcagcgggccatctgctattgctaa

SEQ ID NO: 24258 - DNA, 25 bp, E. coli
gcagcgggccatgtgctattgctaa

SEQ ID NO: 24259 - DNA, 25 bp, E. coli
gataactggtcagcaattctggccc

SEQ ID NO: 24260 - DNA, 25 bp, E. coli
gataactggtcaccaattctggccc

SEQ ID NO: 24261 - DNA, 25 bp, E. coli
tgggctcagctcgatgacgttgcaa

SEQ ID NO: 24262 - DNA, 25 bp, E. coli
tgggctcagctccatgacgttgcaa

SEQ ID NO: 24263 - DNA, 25 bp, E. coli
agcgttacgctgctgtgcgctgctt

SEQ ID NO: 24264 - DNA, 25 bp, E. coli
aggatatgatccacgccgccattcc

SEQ ID NO: 24265 - DNA, 25 bp, E. coli
agcgttacgctggtgtgcgctgctt

SEQ ID NO: 24266 - DNA, 25 bp, E. coli
aggatatgatcctcgccgccattcc

SEQ ID NO: 24267 - DNA, 25 bp, E. coli
tagcgttggcgctggatatgatcct

SEQ ID NO: 24268 - DNA, 25 bp, E. coli
tagcgttggcgcaggatatgatcct

SEQ ID NO: 24269 - DNA, 25 bp, E. coli
tgcgataggtcaaggttcccgaatg

SEQ ID NO: 24270 - DNA, 25 bp, E. coli
tgcgataggtcatggttcccgaatg

SEQ ID NO: 24271 - DNA, 25 bp, E. coli
tcccgaatgatcttaatgaccagcg

SEQ ID NO: 24272 - DNA, 25 bp, E. coli
tgcgctgcttggtgcgataggtcat

SEQ ID NO: 24273 - DNA, 25 bp, E. coli
tcgaatttctgtaagcgttggcgca

SEQ ID NO: 24274 - DNA, 25 bp, E. coli
tcgaatttctgttagcgttggcgca

SEQ ID NO: 24275 - DNA, 25 bp, E. coli
tcccgaatgatcataatgaccagcg

SEQ ID NO: 24276 - DNA, 25 bp, E. coli
tgcgctgcttggagcgataggtcat

SEQ ID NO: 24277 - DNA, 25 bp, E. coli
gccattcctgcgctcggctttgcga

SEQ ID NO: 24278 - DNA, 25 bp, E. coli
gccattcctgcggtcggctttgcga

SEQ ID NO: 24279 - DNA, 25 bp, E. coli
gctttgcgatggagttcaacgttcc

SEQ ID NO: 24280 - DNA, 25 bp, E. coli
gctttgcgatggtgttcaacgttcc

SEQ ID NO: 24281 - DNA, 25 bp, E. coli
cgcggatgggtgtgatcgaatttct

SEQ ID NO: 24282 - DNA, 25 bp, E. coli
cgcggatgggtgagatcgaatttct

SEQ ID NO: 24283 - DNA, 25 bp, E. coli
tcaacgttcccgttcgagcgttacg

SEQ ID NO: 24284 - DNA, 25 bp, E. coli
tcaacgttcccgatcgagcgttacg

SEQ ID NO: 24285 - DNA, 25 bp, E. coli
cagcgtgttattattcgccacttca

SEQ ID NO: 24286 - DNA, 25 bp, E. coli
cagcgtgttatttttcgccacttca

SEQ ID NO: 24287 - DNA, 25 bp, E. coli
acttcctgctctttcttcatcacgg

SEQ ID NO: 24288 - DNA, 25 bp, E. coli
aaaatcatcatcagtcagcgtgtta

SEQ ID NO: 24289 - DNA, 25 bp, E. coli
aaaatcatcatctgtcagcgtgtta

SEQ ID NO: 24290 - DNA, 25 bp, E. coli
acttcctgctctatcttcatcacgg

SEQ ID NO: 24291 - DNA, 25 bp, E. coli
tttcccgcagaaaaatcatcatcag

SEQ ID NO: 24292 - DNA, 25 bp, E. coli
ttccgcccgggctatggcatcggca

SEQ ID NO: 24293 - DNA, 25 bp, E. coli
ttccgcccgggcaatggcatcggca

SEQ ID NO: 24294 - DNA, 25 bp, E. coli
tttcccgcagaataatcatcatcag

SEQ ID NO: 24295 - DNA, 25 bp, E. coli
tcatcacggcctcattcattgacgg

SEQ ID NO: 24296 - DNA, 25 bp, E. coli
tcatcacggcctgattcattgacgg

SEQ ID NO: 24297 - DNA, 25 bp, E. coli
gccgtttcaggacggcaagatgctc

SEQ ID NO: 24298 - DNA, 25 bp, E. coli
gccacttcagtattatcagtatccg

SEQ ID NO: 24299 - DNA, 25 bp, E. coli
gccgtttcaggagggcaagatgctc

SEQ ID NO: 24300 - DNA, 25 bp, E. coli
gccacttcagtaatatcagtatccg

SEQ ID NO: 24301 - DNA, 25 bp, E. coli
gcctcattcattgacggtgactgcg

SEQ ID NO: 24302 - DNA, 25 bp, E. coli
gcctcattcattcacggtgactgcg

SEQ ID NO: 24303 - DNA, 25 bp, E. coli
taatatcagtatccggacgaacagc

SEQ ID NO: 24304 - DNA, 25 bp, E. coli
taatatcagtatgcggacgaacagc

SEQ ID NO: 24305 - DNA, 25 bp, E. coli
gacggtgactgccttttctgtggat

SEQ ID NO: 24306 - DNA, 25 bp, E. coli
gacggtgactgcgttttctgtggat

SEQ ID NO: 24307 - DNA, 25 bp, E. coli
cacaatttgatatagcgcgcgaaac

SEQ ID NO: 24308 - DNA, 25 bp, E. coli
cacaatttgataaagcgcgcgaaac

SEQ ID NO: 24309 - DNA, 25 bp, E. coli
taccggtcgcggataaagacgaaca

SEQ ID NO: 24310 - DNA, 25 bp, E. coli
taccggtcgcggttaaagacgaaca

SEQ ID NO: 24311 - DNA, 25 bp, E. coli
tgatttcgacaaagtaccgccggat

SEQ ID NO: 24312 - DNA, 25 bp, E. coli
tgatttcgacaatgtaccgccggat

SEQ ID NO: 24313 - DNA, 25 bp, E. coli
tgaatacctgcataatctggtgccg

SEQ ID NO: 24314 - DNA, 25 bp, E. coli
tgaaattgctcgatactcgcccggc

SEQ ID NO: 24315 - DNA, 25 bp, E. coli
tgaaattgctcgttactcgcccggc

SEQ ID NO: 24316 - DNA, 25 bp, E. coli
tgaatacctgcaaaatctggtgccg

SEQ ID NO: 24317 - DNA, 25 bp, E. coli
gcgcgcggaccgttaaagactattt

SEQ ID NO: 24318 - DNA, 25 bp, E. coli
gcgcgcggaccgataaagactattt

SEQ ID NO: 24319 - DNA, 25 bp, E. coli
gaaagtattaccattgacgggcgtg

SEQ ID NO: 24320 - DNA, 25 bp, E. coli
gaaagtattacctttgacgggcgtg

SEQ ID NO: 24321 - DNA, 25 bp, E. coli
gaacgttaccgctttgggcatgtga

SEQ ID NO: 24322 - DNA, 25 bp, E. coli
gaacgttaccgcattgggcatgtga

SEQ ID NO: 24323 - DNA, 25 bp, E. coli
gtattgatcgccaaagtcacgccag

SEQ ID NO: 24324 - DNA, 25 bp, E. coli
gatttctccgttatccaggcgcaga

SEQ ID NO: 24325 - DNA, 25 bp, E. coli
gatttctccgttttccaggcgcaga

SEQ ID NO: 24326 - DNA, 25 bp, E. coli
gtattgatcgcctaagtcacgccag

SEQ ID NO: 24327 - DNA, 25 bp, E. coli
ggaataccagtacaacgtgaccgga

SEQ ID NO: 24328 - DNA, 25 bp, E. coli
ggaataccagtagaacgtgaccgga

SEQ ID NO: 24329 - DNA, 25 bp, E. coli
aagttcagccgtgagtggatccgca

SEQ ID NO: 24330 - DNA, 25 bp, E. coli
aagttcagccgtcagtggatccgca

SEQ ID NO: 24331 - DNA, 25 bp, E. coli
taaagacagtatagatgccgacagc

SEQ ID NO: 24332 - DNA, 25 bp, E. coli
taaagacagtattgatgccgacagc

SEQ ID NO: 24333 - DNA, 25 bp, E. coli
atattatcgaaacgctgcatcccgg

SEQ ID NO: 24334 - DNA, 25 bp, E. coli
atattatcgaaaggctgcatcccgg

SEQ ID NO: 24335 - DNA, 25 bp, E. coli
tatggattcgctggactggtacaac

SEQ ID NO: 24336 - DNA, 25 bp, E. coli
tatgacctgcgtaccaatatgccga

SEQ ID NO: 24337 - DNA, 25 bp, E. coli
tatggattcgctcgactggtacaac

SEQ ID NO: 24338 - DNA, 25 bp, E. coli
tatgacctgcgttccaatatgccga

SEQ ID NO: 24339 - DNA, 25 bp, E. coli
tgtatggcgaagacccgcacggttt

SEQ ID NO: 24340 - DNA, 25 bp, E. coli
tgtatggcgaagtcccgcacggttt

SEQ ID NO: 24341 - DNA, 25 bp, E. coli
tctgggcaacacactgggtagcgac

SEQ ID NO: 24342 - DNA, 25 bp, E. coli
tctgggcaacactctgggtagcgac

SEQ ID NO: 24343 - DNA, 25 bp, E. coli
cgtttaccgacgagcatttgcagcc

SEQ ID NO: 24344 - DNA, 25 bp, E. coli
cgtttaccgacgtgcatttgcagcc

SEQ ID NO: 24345 - DNA, 25 bp, E. coli
gatctggacgaccttgatggcgaca

SEQ ID NO: 24346 - DNA, 25 bp, E. coli
gatctggacgacgttgatggcgaca

SEQ ID NO: 24347 - DNA, 25 bp, E. coli
taagcccgcgcagtgaaggtgaatg

SEQ ID NO: 24348 - DNA, 25 bp, E. coli
taatgttagtaccaccatcaccgag

SEQ ID NO: 24349 - DNA, 25 bp, E. coli
taagcccgcgcactgaaggtgaatg

SEQ ID NO: 24350 - DNA, 25 bp, E. coli
taatgttagtacgaccatcaccgag

SEQ ID NO: 24351 - DNA, 25 bp, E. coli
aatcaaaggtatacgcgtgacgcgc

SEQ ID NO: 24352 - DNA, 25 bp, E. coli
aatacgctgtacaggattggcccgc

SEQ ID NO: 24353 - DNA, 25 bp, E. coli
aatacgctgtactggattggcccgc

SEQ ID NO: 24354 - DNA, 25 bp, E. coli
aatcaaaggtattcgcgtgacgcgc

SEQ ID NO: 24355 - DNA, 25 bp, E. coli
cataaacattaccacactgccgcgg

SEQ ID NO: 24356 - DNA, 25 bp, E. coli
cataaacattacgacactgccgcgg

SEQ ID NO: 24357 - DNA, 25 bp, E. coli
agatcaggtgatgccgcagcaagat

SEQ ID NO: 24358 - DNA, 25 bp, E. coli
agatcaggtgatcccgcagcaagat

SEQ ID NO: 24359 - DNA, 25 bp, E. coli
tagcgcgcaagaagtggtttcagac

SEQ ID NO: 24360 - DNA, 25 bp, E. coli
tagcgcgcaagatgtggtttcagac

SEQ ID NO: 24361 - DNA, 25 bp, E. coli
tattgctgtgcaaatgggaaccccg

SEQ ID NO: 24362 - DNA, 25 bp, E. coli
tttgcgcgcactgtgtaaagagccg

SEQ ID NO: 24363 - DNA, 25 bp, E. coli
tattgctgtgcatatgggaaccccg

SEQ ID NO: 24364 - DNA, 25 bp, E. coli
tttgcgcgcactctgtaaagagccg

SEQ ID NO: 24365 - DNA, 25 bp, E. coli
tgtggatttaacagcgcatagcgcg

SEQ ID NO: 24366 - DNA, 25 bp, E. coli
tgtggatttaactgcgcatagcgcg

SEQ ID NO: 24367 - DNA, 25 bp, E. coli
tgcacccggtattcaaacgctggcg

SEQ ID NO: 24368 - DNA, 25 bp, E. coli
tgcacccggtatacaaacgctggcg

SEQ ID NO: 24369 - DNA, 25 bp, E. coli
tgcggtacacgagatccggcagatc

SEQ ID NO: 24370 - DNA, 25 bp, E. coli
tgcggtacacgacatccggcagatc

SEQ ID NO: 24371 - DNA, 25 bp, E. coli
gccgcgatggaaggccgtcatttag

SEQ ID NO: 24372 - DNA, 25 bp, E. coli
gccgcgatggaacgccgtcatttag

SEQ ID NO: 24373 - DNA, 25 bp, E. coli
caattatcattggtggcgtacgcat

SEQ ID NO: 24374 - DNA, 25 bp, E. coli
caattatcattgctggcgtacgcat

SEQ ID NO: 24375 - DNA, 25 bp, E. coli
cacaaatgcgcgtgtttattgccga

SEQ ID NO: 24376 - DNA, 25 bp, E. coli
cacaaatgcgcgagtttattgccga

SEQ ID NO: 24377 - DNA, 25 bp, E. coli
caggcaccgaagatgttgccgcaca

SEQ ID NO: 24378 - DNA, 25 bp, E. coli
caggcaccgaagttgttgccgcaca

SEQ ID NO: 24379 - DNA, 25 bp, E. coli
taccgatccggcatttaaaggtgcc

SEQ ID NO: 24380 - DNA, 25 bp, E. coli
attctgatggcgacgtggcgctcca

SEQ ID NO: 24381 - DNA, 25 bp, E. coli
attctgatggcgtcgtggcgctcca

SEQ ID NO: 24382 - DNA, 25 bp, E. coli
taccgatccggcttttaaaggtgcc

SEQ ID NO: 24383 - DNA, 25 bp, E. coli
tgtcactatcatcgctcaggcaccg

SEQ ID NO: 24384 - DNA, 25 bp, E. coli
tgtcactatcatggctcaggcaccg

SEQ ID NO: 24385 - DNA, 25 bp, E. coli
cctttggcggtgtaggcccaattat

SEQ ID NO: 24386 - DNA, 25 bp, E. coli
cctttggcggtgaaggcccaattat

SEQ ID NO: 24387 - DNA, 25 bp, E. coli
gcggtggcgctagtcattaaggcaa

SEQ ID NO: 24388 - DNA, 25 bp, E. coli
gcggtggcgctactcattaaggcaa

SEQ ID NO: 24389 - DNA, 25 bp, E. coli
gaattggacacggttttgacgtaca

SEQ ID NO: 24390 - DNA, 25 bp, E. coli
gaagatctcggctgccatatggatg

SEQ ID NO: 24391 - DNA, 25 bp, E. coli
gaattggacacgcttttgacgtaca

SEQ ID NO: 24392 - DNA, 25 bp, E. coli
gaagatctcggcagccatatggatg

SEQ ID NO: 24393 - DNA, 25 bp, E. coli
ggatgatgttaacgtgaaagccact

SEQ ID NO: 24394 - DNA, 25 bp, E. coli
ggatgatgttaaggtgaaagccact

SEQ ID NO: 24395 - DNA, 25 bp, E. coli
cattttctgaaaatacgtgagcgta

SEQ ID NO: 24396 - DNA, 25 bp, E. coli
tacgatgttcgatgacccagactgg

SEQ ID NO: 24397 - DNA, 25 bp, E. coli
tatgcatccggtaacttgttggtgg

SEQ ID NO: 24398 - DNA, 25 bp, E. coli
tatgcatccggttacttgttggtgg

SEQ ID NO: 24399 - DNA, 25 bp, E. coli
tacgatgttcgaagacccagactgg

SEQ ID NO: 24400 - DNA, 25 bp, E. coli
tggtcagaagatacggagcatggat

SEQ ID NO: 24401 - DNA, 25 bp, E. coli
tggtcagaagattcggagcatggat

SEQ ID NO: 24402 - DNA, 25 bp, E. coli
tgaagtccctgtcggtatgcatccg

SEQ ID NO: 24403 - DNA, 25 bp, E. coli
tgcttcaccagaagaagttcagagc

SEQ ID NO: 24404 - DNA, 25 bp, E. coli
tgaagtccctgtgggtatgcatccg

SEQ ID NO: 24405 - DNA, 25 bp, E. coli
tgcttcaccagatgaagttcagagc

SEQ ID NO: 24406 - DNA, 25 bp, E. coli
gctggtttgtagaagaaattgcccc

SEQ ID NO: 24407 - DNA, 25 bp, E. coli
gctggtttgtagtagaaattgcccc

SEQ ID NO: 24408 - DNA, 25 bp, E. coli
gaaattgcccctcatgagtgctggg

SEQ ID NO: 24409 - DNA, 25 bp, E. coli
gacacctttagaacgcattacccaa

SEQ ID NO: 24410 - DNA, 25 bp, E. coli
gaaattgcccctgatgagtgctggg

SEQ ID NO: 24411 - DNA, 25 bp, E. coli
gacacctttagatcgcattacccaa

SEQ ID NO: 24412 - DNA, 25 bp, E. coli
cccagactggccctttagtgaaagt

SEQ ID NO: 24413 - DNA, 25 bp, E. coli
cccagactggccgtttagtgaaagt

SEQ ID NO: 24414 - DNA, 25 bp, E. coli
cattttctgaaattacgtgagcgta

SEQ ID NO: 24415 - DNA, 25 bp, E. coli
gtgattccagaagaatctccgcaag

SEQ ID NO: 24416 - DNA, 25 bp, E. coli
gtgattccagaacaatctccgcaag

SEQ ID NO: 24417 - DNA, 25 bp, E. coli
caaccgacagatgtatgtaaggcca

SEQ ID NO: 24418 - DNA, 25 bp, E. coli
aagagcaagcgcatggagcgacaaa

SEQ ID NO: 24419 - DNA, 25 bp, E. coli
aagagcaagcgcttggagcgacaaa

SEQ ID NO: 24420 - DNA, 25 bp, E. coli
caaccgacagatctatgtaaggcca

SEQ ID NO: 24421 - DNA, 25 bp, E. coli
cattctggagggtaatacaaccgac

SEQ ID NO: 24422 - DNA, 25 bp, E. coli
cattctggagggaaatacaaccgac

SEQ ID NO: 24423 - DNA, 25 bp, E. coli
taacaaagtgcgctcctgctggcat

SEQ ID NO: 24424 - DNA, 25 bp, E. coli
tatgtaaggccatcgtgctcaaacc

SEQ ID NO: 24425 - DNA, 25 bp, E. coli
tatgtaaggccaacgtgctcaaacc

SEQ ID NO: 24426 - DNA, 25 bp, E. coli
tattggttgcgtaacaaagtgcggt

SEQ ID NO: 24427 - DNA, 25 bp, E. coli
tattggttgcgttacaaagtgcggt

SEQ ID NO: 24428 - DNA, 25 bp, E. coli
tttaaccgctagatgaagagcaagc

SEQ ID NO: 24429 - DNA, 25 bp, E. coli
tttaaccgctagttgaagagcaagc

SEQ ID NO: 24430 - DNA, 25 bp, E. coli
tctggtctgacctctttgtgttttg

SEQ ID NO: 24431 - DNA, 25 bp, E. coli
tctggtctgaccactttgtgttttg

SEQ ID NO: 24432 - DNA, 25 bp, E. coli
cctgctggcattgtggagggaaata

SEQ ID NO: 24433 - DNA, 25 bp, E. coli
cctgctggcattctggagggaaata

SEQ ID NO: 24434 - DNA, 25 bp, E. coli
cgtttttatcgcttcaatctggtct

SEQ ID NO: 24435 - DNA, 25 bp, E. coli
cgtttttatcgcatcaatctggtct

SEQ ID NO: 24436 - DNA, 25 bp, E. coli
cgtgctcaaaccatcatacagaaag

SEQ ID NO: 24437 - DNA, 25 bp, E. coli
cgtgctcaaaccttcatacagaaag

SEQ ID NO: 24438 - DNA, 25 bp, E. coli
taacaaagtgcggtcctgctggcat

SEQ ID NO: 24439 - DNA, 25 bp, E. coli
aacgcgtctgaggtatctgcgcgag

SEQ ID NO: 24440 - DNA, 25 bp, E. coli
aacgcgtctgagctatctgcgcgag

SEQ ID NO: 24441 - DNA, 25 bp, E. coli
caactgttaaaactgagccgtctgg

SEQ ID NO: 24442 - DNA, 25 bp, E. coli
cagcaactgttaaaagtgagccgtc

SEQ ID NO: 24443 - DNA, 25 bp, E. coli
caactgttaaaagtgagccgtctgg

SEQ ID NO: 24444 - DNA, 25 bp, E. coli
cagcaactgttataagtgagccgtc

SEQ ID NO: 24445 - DNA, 25 bp, E. coli
aactgttaaaagtgagccgtctggg

SEQ ID NO: 24446 - DNA, 25 bp, E. coli
aactgttaaaagagagccgtctggg

SEQ ID NO: 24447 - DNA, 25 bp, E. coli
tgttaaaagtgacccgtctggggcc

SEQ ID NO: 24448 - DNA, 25 bp, E. coli
tgttaaaagtgagccgtctggggcc

SEQ ID NO: 24449 - DNA, 25 bp, E. coli
tctgagctatctccgcgagctggaa

SEQ ID NO: 24450 - DNA, 25 bp, E. coli
tctgagctatctgcgcgagctggaa

SEQ ID NO: 24451 - DNA, 25 bp, E. coli
gcgtctgagctatctgcgcgagctg

SEQ ID NO: 24452 - DNA, 25 bp, E. coli
gcgtctgagctaactgcgcgagctg

SEQ ID NO: 24453 - DNA, 25 bp, E. coli
gcaactgttaaaagtgagccgtctg

SEQ ID NO: 24454 - DNA, 25 bp, E. coli
gcaactgttaaatgtgagccgtctg

SEQ ID NO: 24455 - DNA, 25 bp, E. coli
gaaacgcgtctgtgctatctgcgcg

SEQ ID NO: 24456 - DNA, 25 bp, E. coli
gaaacgcgtctgagctatctgcgcg

SEQ ID NO: 24457 - DNA, 25 bp, E. coli
ctggaaacgcgtgtgagctatctgc

SEQ ID NO: 24458 - DNA, 25 bp, E. coli
ctggaaacgcgtctgagctatctgc

SEQ ID NO: 24459 - DNA, 25 bp, E. coli
tggaaacgcgtctgagctatctgcg

SEQ ID NO: 24460 - DNA, 25 bp, E. coli
tggaaacgcgtcagagctatctgcg

SEQ ID NO: 24461 - DNA, 25 bp, E. coli
aacctggatcttaatatgtatggcc

SEQ ID NO: 24462 - DNA, 25 bp, E. coli
caatattgctatggtttctgagtac

SEQ ID NO: 24463 - DNA, 25 bp, E. coli
caatattgctatcgtttctgagtac

SEQ ID NO: 24464 - DNA, 25 bp, E. coli
aacctggatctttatatgtatggcc

SEQ ID NO: 24465 - DNA, 25 bp, E. coli
tacgttaaggcgaaagcccagccaa

SEQ ID NO: 24466 - DNA, 25 bp, E. coli
tacgttaaggcgtaagcccagccaa

SEQ ID NO: 24467 - DNA, 25 bp, E. coli
gttaaggcgtaaccccagccaaaag

SEQ ID NO: 24468 - DNA, 25 bp, E. coli
gttaaggcgtaagcccagccaaaag

SEQ ID NO: 24469 - DNA, 25 bp, E. coli
tatggtttctgactacgttaaggcg

SEQ ID NO: 24470 - DNA, 25 bp, E. coli
tatgctggcggaaattgagcgtggc

SEQ ID NO: 24471 - DNA, 25 bp, E. coli
tatgtatggccgtagcaatattgct

SEQ ID NO: 24472 - DNA, 25 bp, E. coli
tatgctggcggatattgagcgtggc

SEQ ID NO: 24473 - DNA, 25 bp, E. coli
tatgtatggccgaagcaatattgct

SEQ ID NO: 24474 - DNA, 25 bp, E. coli
tatggtttctgagtacgttaaggcg

SEQ ID NO: 24475 - DNA, 25 bp, E. coli
tgagcgtggcgcagatgccgtaggc

SEQ ID NO: 24476 - DNA, 25 bp, E. coli
tgagcgtggcgctgatgccgtaggc

SEQ ID NO: 24477 - DNA, 25 bp, E. coli
tctgagtacgttaaggcgtaagccc

SEQ ID NO: 24478 - DNA, 25 bp, E. coli
tctgagtacgtttaggcgtaagccc

SEQ ID NO: 24479 - DNA, 25 bp, E. coli
gatctttatatgtatggccgtagca

SEQ ID NO: 24480 - DNA, 25 bp, E. coli
gatctttatatgaatggccgtagca

SEQ ID NO: 24481 - DNA, 25 bp, E. coli
ggcgtaagcccagccaaaagaaagg

SEQ ID NO: 24482 - DNA, 25 bp, E. coli
ggcgtaagcccacccaaaagaaagg

SEQ ID NO: 24483 - DNA, 25 bp, E. coli
catcgctgatgtatatggttacccc

SEQ ID NO: 24484 - DNA, 25 bp, E. coli
catcgctgatgtttatggttacccc

SEQ ID NO: 24485 - DNA, 25 bp, E. coli
taaaaccgcgccatgtctgcatatg

SEQ ID NO: 24486 - DNA, 25 bp, E. coli
taaaaccgcgccttgtctgcatatg

SEQ ID NO: 24487 - DNA, 25 bp, E. coli
aaaacctacattagggctgttgcga

SEQ ID NO: 24488 - DNA, 25 bp, E. coli
aaaacctacatttgggctgttgcga

SEQ ID NO: 24489 - DNA, 25 bp, E. coli
tgttattgcatataaccgcgccatg

SEQ ID NO: 24490 - DNA, 25 bp, E. coli
tgttattgcataaaaccgcgccatg

SEQ ID NO: 24491 - DNA, 25 bp, E. coli
tgcatatggcgcagtttctcctacc

SEQ ID NO: 24492 - DNA, 25 bp, E. coli
tgcatatggcgctgtttctcctacc

SEQ ID NO: 24493 - DNA, 25 bp, E. coli
gcgtaactgtttttgagcgagcatc

SEQ ID NO: 24494 - DNA, 25 bp, E. coli
gcgtaactgtttatgagcgagcatc

SEQ ID NO: 24495 - DNA, 25 bp, E. coli
gctcaggaatcgacaggtaatcact

SEQ ID NO: 24496 - DNA, 25 bp, E. coli
gctcaggaatcgtcaggtaatcact

SEQ ID NO: 24497 - DNA, 25 bp, E. coli
ggttaccccttatgtgtgctcagga

SEQ ID NO: 24498 - DNA, 25 bp, E. coli
ggtaatcactcaaactgaacagcga

SEQ ID NO: 24499 - DNA, 25 bp, E. coli
ggtaatcactcatactgaacagcga

SEQ ID NO: 24500 - DNA, 25 bp, E. coli
ggttaccccttaagtgtgctcagga

SEQ ID NO: 24501 - DNA, 25 bp, E. coli
taatgcgcctttgctcatgaatgga

SEQ ID NO: 24502 - DNA, 25 bp, E. coli
taatgcgcctttcctcatgaatgga

SEQ ID NO: 24503 - DNA, 25 bp, E. coli
gatgttatacgtatggcatcgctga

SEQ ID NO: 24504 - DNA, 25 bp, E. coli
gatgttatacgtttggcatcgctga

SEQ ID NO: 24505 - DNA, 25 bp, E. coli
taacgtcttcaactatgtgcgcaaa

SEQ ID NO: 24506 - DNA, 25 bp, E. coli
actggaaacgccactggcaacgggc

SEQ ID NO: 24507 - DNA, 25 bp, E. coli
actggaaacgcctctggcaacgggc

SEQ ID NO: 24508 - DNA, 25 bp, E. coli
tgtcgctgacttttcgcataacgtc

SEQ ID NO: 24509 - DNA, 25 bp, E. coli
tgtcaaccctgttcgctggaaggca

SEQ ID NO: 24510 - DNA, 25 bp, E. coli
tgtcgctgacttatcgcataacgtc

SEQ ID NO: 24511 - DNA, 25 bp, E. coli
tgtgcgcaaaaatcatgtcaaaacc

SEQ ID NO: 24512 - DNA, 25 bp, E. coli
tgtcaaccctgtacgctggaaggca

SEQ ID NO: 24513 - DNA, 25 bp, E. coli
tgtgcgcaaaaaacatgtcaaaacc

SEQ ID NO: 24514 - DNA, 25 bp, E. coli
tcatgatgcgttttctgtcgctgac

SEQ ID NO: 24515 - DNA, 25 bp, E. coli
tcatgatgcgttatctgtcgctgac

SEQ ID NO: 24516 - DNA, 25 bp, E. coli
cctgggatacgctaacctgtcaacc

SEQ ID NO: 24517 - DNA, 25 bp, E. coli
cctgggatacgcaaacctgtcaacc

SEQ ID NO: 24518 - DNA, 25 bp, E. coli
gcggcacattcgatccctgggatac

SEQ ID NO: 24519 - DNA, 25 bp, E. coli
gcggatggcccaagagttcgtttat

SEQ ID NO: 24520 - DNA, 25 bp, E. coli
gcggatggcccatgagttcgtttat

SEQ ID NO: 24521 - DNA, 25 bp, E. coli
gcggcacattcgttccctgggatac

SEQ ID NO: 24522 - DNA, 25 bp, E. coli
gaaggcattgtctgccgaaatcatg

SEQ ID NO: 24523 - DNA, 25 bp, E. coli
gaaggcattgtcagccgaaatcatg

SEQ ID NO: 24524 - DNA, 25 bp, E. coli
tcaaaaccactgagcactggaaacg

SEQ ID NO: 24525 - DNA, 25 bp, E. coli
tcaaaaccactgtgcactggaaacg

SEQ ID NO: 24526 - DNA, 25 bp, E. coli
taacgtcttcaagtatgtgcgcaaa

SEQ ID NO: 24527 - DNA, 25 bp, E. coli
taggtctgagcgacacgttgcaacg

SEQ ID NO: 24528 - DNA, 25 bp, E. coli
taggtctgagcgtcacgttgcaacg

SEQ ID NO: 24529 - DNA, 25 bp, E. coli
ttggcaaccttatgcgcagcggcat

SEQ ID NO: 24530 - DNA, 25 bp, E. coli
ttggcaaccttaagcgcagcggcat

SEQ ID NO: 24531 - DNA, 25 bp, E. coli
ttaagtattttggaatccagcggcg

SEQ ID NO: 24532 - DNA, 25 bp, E. coli
ttaagtattttgcaatccagcggcg

SEQ ID NO: 24533 - DNA, 25 bp, E. coli
tgttaaatcaggaacgcagcgccat

SEQ ID NO: 24534 - DNA, 25 bp, E. coli
tgttaaatcaggtacgcagcgccat

SEQ ID NO: 24535 - DNA, 25 bp, E. coli
tgaactgacgcttttcacccggcag

SEQ ID NO: 24536 - DNA, 25 bp, E. coli
tgaactgacgctattcacccggcag

SEQ ID NO: 24537 - DNA, 25 bp, E. coli
tcagagccgcagataaccaggagac

SEQ ID NO: 24538 - DNA, 25 bp, E. coli
gcattacccctgcaagagagccttg

SEQ ID NO: 24539 - DNA, 25 bp, E. coli
gcattacccctggaagagagccttg

SEQ ID NO: 24540 - DNA, 25 bp, E. coli
gctctacatggtggcctctggcgaa

SEQ ID NO: 24541 - DNA, 25 bp, E. coli
gctctacatggtcgcctctggcgaa

SEQ ID NO: 24542 - DNA, 25 bp, E. coli
cgtaccggcccgtcattattagcga

SEQ ID NO: 24543 - DNA, 25 bp, E. coli
cgtaccggcccgacattattagcga

SEQ ID NO: 24544 - DNA, 25 bp, E. coli
tcagagccgcagttaaccaggagac

SEQ ID NO: 24545 - DNA, 25 bp, E. coli
taacgatgaacgacaggcacgactg

SEQ ID NO: 24546 - DNA, 25 bp, E. coli
taacgatgaacgtcaggcacgactg

SEQ ID NO: 24547 - DNA, 25 bp, E. coli
gagtaaaaacacctcgcccgaggat

SEQ ID NO: 24548 - DNA, 25 bp, E. coli
gagtaaaaacacgtcgcccgaggat

SEQ ID NO: 24549 - DNA, 25 bp, E. coli
aagcttttgaagtcagttcctgcca

SEQ ID NO: 24550 - DNA, 25 bp, E. coli
cagtttttgaatggcccggtacaca

SEQ ID NO: 24551 - DNA, 25 bp, E. coli
cagtttttgaatcgcccggtacaca

SEQ ID NO: 24552 - DNA, 25 bp, E. coli
aagcttttgaagacagttcctgcca

SEQ ID NO: 24553 - DNA, 25 bp, E. coli
tatttatttggtgaggcaagctggc

SEQ ID NO: 24554 - DNA, 25 bp, E. coli
tatttatttggtcaggcaagctggc

SEQ ID NO: 24555 - DNA, 25 bp, E. coli
ttcttcagaaaaatatgcggcgggc

SEQ ID NO: 24556 - DNA, 25 bp, E. coli
ttcttcagaaaattatgcggcgggc

SEQ ID NO: 24557 - DNA, 25 bp, E. coli
tgtttgcgtcacagaatgcagctgc

SEQ ID NO: 24558 - DNA, 25 bp, E. coli
tgtttgcgtcactgaatgcagctgc

SEQ ID NO: 24559 - DNA, 25 bp, E. coli
tctttggcgcggaagacacaacgct

SEQ ID NO: 24560 - DNA, 25 bp, E. coli
tctttggcgcggtagacacaacgct

SEQ ID NO: 24561 - DNA, 25 bp, E. coli
gctggctgacagaccgttataacgg

SEQ ID NO: 24562 - DNA, 25 bp, E. coli
gctggctgacagtccgttataacgg

SEQ ID NO: 24563 - DNA, 25 bp, E. coli
gaaaagctcctcacttacggctgac

SEQ ID NO: 24564 - DNA, 25 bp, E. coli
gaaaagctcctctcttacggctgac

SEQ ID NO: 24565 - DNA, 25 bp, E. coli
gacaaatataccgacaatgccagtg

SEQ ID NO: 24566 - DNA, 25 bp, E. coli
gacaaatatacccacaatgccagtg

SEQ ID NO: 24567 - DNA, 25 bp, E. coli
cattttggactgaaggtggcttaca

SEQ ID NO: 24568 - DNA, 25 bp, E. coli
cattttggactgtaggtggcttaca

SEQ ID NO: 24569 - DNA, 25 bp, E. coli
gttataacggctatcgagagcgcga

SEQ ID NO: 24570 - DNA, 25 bp, E. coli
gttataacggctttcgagagcgcga

SEQ ID NO: 24571 - DNA, 25 bp, E. coli
tacatgacatccgttatctgattgc

SEQ ID NO: 24572 - DNA, 25 bp, E. coli
tacatgacatcccttatctgattgc

SEQ ID NO: 24573 - DNA, 25 bp, E. coli
aactatttcgcgatgggagtgctga

SEQ ID NO: 24574 - DNA, 25 bp, E. coli
aactatttcgcgttgggagtgctga

SEQ ID NO: 24575 - DNA, 25 bp, E. coli
tgggcgacgctcaatcaaccggagc

SEQ ID NO: 24576 - DNA, 25 bp, E. coli
tgggcgacgctctatcaaccggagc

SEQ ID NO: 24577 - DNA, 25 bp, E. coli
ccttatctgattgccaaaaagcgca

SEQ ID NO: 24578 - DNA, 25 bp, E. coli
ccttatctgattcccaaaaagcgca

SEQ ID NO: 24579 - DNA, 25 bp, E. coli
gctgggtgagcctgtttactctgca

SEQ ID NO: 24580 - DNA, 25 bp, E. coli
gctgggtgagccagtttactctgca

SEQ ID NO: 24581 - DNA, 25 bp, E. coli
gagaaaaagactgactattccacgt

SEQ ID NO: 24582 - DNA, 25 bp, E. coli
gagaaaaagactcactattccacgt

SEQ ID NO: 24583 - DNA, 25 bp, E. coli
cgacgctattcaaacggcgggctgg

SEQ ID NO: 24584 - DNA, 25 bp, E. coli
cgacgctattcatacggcgggctgg

SEQ ID NO: 24585 - DNA, 25 bp, E. coli
cctgtttactctgcatgttatctgg

SEQ ID NO: 24586 - DNA, 25 bp, E. coli
cctgtttactctccatgttatctgg

SEQ ID NO: 24587 - DNA, 25 bp, E. coli
ctcgccgccgagtaaaagactgact

SEQ ID NO: 24588 - DNA, 25 bp, E. coli
ctcgccgccgagaaaaagactgact

SEQ ID NO: 24589 - DNA, 25 bp, E. coli
ggagtgctgatcttcgtctttctgg

SEQ ID NO: 24590 - DNA, 25 bp, E. coli
ggagtgctgatcatcgtctttctgg

SEQ ID NO: 24591 - DNA, 25 bp, E. coli
tggaatcatcgcgatacatgacatc

SEQ ID NO: 24592 - DNA, 25 bp, E. coli
tggaatcatcgccatacatgacatc

SEQ ID NO: 24593 - DNA, 25 bp, E. coli
caatctggttgttagtaatggcggc

SEQ ID NO: 24594 - DNA, 25 bp, E. coli
caatctggttgtaagtaatggcggc

SEQ ID NO: 24595 - DNA, 25 bp, E. coli
cataccctccttttatagggcaggg

SEQ ID NO: 24596 - DNA, 25 bp, E. coli
cataccctccttatatagggcaggg

SEQ ID NO: 24597 - DNA, 25 bp, E. coli
taaaggagcaaaagacgaatctatc

SEQ ID NO: 24598 - DNA, 25 bp, E. coli
taaaggagcaaatgacgaatctatc

SEQ ID NO: 24599 - DNA, 25 bp, E. coli
aactggcaagcaacttgcaatctgg

SEQ ID NO: 24600 - DNA, 25 bp, E. coli
aactggcaagcatcttgcaatctgg

SEQ ID NO: 24601 - DNA, 25 bp, E. coli
tgctgtcaatttgaacaaagtggtg

SEQ ID NO: 24602 - DNA, 25 bp, E. coli
tgctgtcaatttcaacaaagtggtg

SEQ ID NO: 24603 - DNA, 25 bp, E. coli
tcttattgggtaatgaaccatcgtg

SEQ ID NO: 24604 - DNA, 25 bp, E. coli
tcttattgggtattgaaccatcgtg

SEQ ID NO: 24605 - DNA, 25 bp, E. coli
gaaccatcgtggagcataccctcct

SEQ ID NO: 24606 - DNA, 25 bp, E. coli
gaaccatcgtggtgcataccctcct

SEQ ID NO: 24607 - DNA, 25 bp, E. coli
gacagttggttaccttgtacatcaa

SEQ ID NO: 24608 - DNA, 25 bp, E. coli
gaacgcgacagcagattaaaggagc

SEQ ID NO: 24609 - DNA, 25 bp, E. coli
gaacgcgacagctgattaaaggagc

SEQ ID NO: 24610 - DNA, 25 bp, E. coli
gacagttggttagcttgtacatcaa

SEQ ID NO: 24611 - DNA, 25 bp, E. coli
ggcgcatattaatggcagtgcatgg

SEQ ID NO: 24612 - DNA, 25 bp, E. coli
ggcgcatattaaaggcagtgcatgg

SEQ ID NO: 24613 - DNA, 25 bp, E. coli
taatggcggcacatgggccgattct

SEQ ID NO: 24614 - DNA, 25 bp, E. coli
taatggcggcacttgggccgattct

SEQ ID NO: 24615 - DNA, 25 bp, E. coli
caaactggaagagcaggacaagccg

SEQ ID NO: 24616 - DNA, 25 bp, E. coli
caaactggaagaccaggacaagccg

SEQ ID NO: 24617 - DNA, 25 bp, E. coli
catacgatggcacaaaccagggcga

SEQ ID NO: 24618 - DNA, 25 bp, E. coli
catacgatggcagaaaccagggcga

SEQ ID NO: 24619 - DNA, 25 bp, E. coli
catgaccatagagcaggaacgtccg

SEQ ID NO: 24620 - DNA, 25 bp, E. coli
catgaccatagaccaggaacgtccg

SEQ ID NO: 24621 - DNA, 25 bp, E. coli
tatcgatgttggtacggctaaaagc

SEQ ID NO: 24622 - DNA, 25 bp, E. coli
tatcgatgttggaacggctaaaagc

SEQ ID NO: 24623 - DNA, 25 bp, E. coli
tatcagccgctgatacgtgcaatgg

SEQ ID NO: 24624 - DNA, 25 bp, E. coli
tatcagctggcatggcatacgatgg

SEQ ID NO: 24625 - DNA, 25 bp, E. coli
tatcagctggcaaggcatacgatgg

SEQ ID NO: 24626 - DNA, 25 bp, E. coli
tatcagccgctgttacgtgcaatgg

SEQ ID NO: 24627 - DNA, 25 bp, E. coli
tttatggacatgcacagcccgcaag

SEQ ID NO: 24628 - DNA, 25 bp, E. coli
tttatggacatggacagcccgcaag

SEQ ID NO: 24629 - DNA, 25 bp, E. coli
gccggaacttactgcagcctttgaa

SEQ ID NO: 24630 - DNA, 25 bp, E. coli
gccggaacttacagcagcctttgaa

SEQ ID NO: 24631 - DNA, 25 bp, E. coli
gaaagcatcatgtcgctaccgctgg

SEQ ID NO: 24632 - DNA, 25 bp, E. coli
gaaagcatcatgacgctaccgctgg

SEQ ID NO: 24633 - DNA, 25 bp, E. coli
cgagtaaatttaaagccgaagcgcg

SEQ ID NO: 24634 - DNA, 25 bp, E. coli
cgagtaaatttatagccgaagcgcg

SEQ ID NO: 24635 - DNA, 25 bp, E. coli
gatgaatctggcgactatcagccgc

SEQ ID NO: 24636 - DNA, 25 bp, E. coli
gatgaatctggccactatcagccgc

SEQ ID NO: 24637 - DNA, 25 bp, E. coli
aattacgcgccttcgcgcagcaaca

SEQ ID NO: 24638 - DNA, 25 bp, E. coli
aattacgcgcctacgcgcagcaaca

SEQ ID NO: 24639 - DNA, 25 bp, E. coli
cacgccgcgtggtttgcaggttgta

SEQ ID NO: 24640 - DNA, 25 bp, E. coli
cacgccgcgtggattgcaggttgta

SEQ ID NO: 24641 - DNA, 25 bp, E. coli
tatgccggacaagaaaacactgccc

SEQ ID NO: 24642 - DNA, 25 bp, E. coli
tatgccggacaacaaaacactgccc

SEQ ID NO: 24643 - DNA, 25 bp, E. coli
tgacgtcgcctttcgctatgccgga

SEQ ID NO: 24644 - DNA, 25 bp, E. coli
tgacgtcgccttacgctatgccgga

SEQ ID NO: 24645 - DNA, 25 bp, E. coli
tcgaagtcatcggattgaacggcac

SEQ ID NO: 24646 - DNA, 25 bp, E. coli
tcgaagtcatcgcattgaacggcac

SEQ ID NO: 24647 - DNA, 25 bp, E. coli
gctaagcggtaagttcgaagtcatc

SEQ ID NO: 24648 - DNA, 25 bp, E. coli
gctaagcggtaacttcgaagtcatc

SEQ ID NO: 24649 - DNA, 25 bp, E. coli
gaagttctctccgaattacgcgcct

SEQ ID NO: 24650 - DNA, 25 bp, E. coli
gaagttctctcccaattacgcgcct

SEQ ID NO: 24651 - DNA, 25 bp, E. coli
gaaaacactgccgtgctaagcggta

SEQ ID NO: 24652 - DNA, 25 bp, E. coli
gaaaacactgccctgctaagcggta

SEQ ID NO: 24653 - DNA, 25 bp, E. coli
cgcacgtttttacgcgctgcgcctg

SEQ ID NO: 24654 - DNA, 25 bp, E. coli
cgcacgtttttaggcgctgcgcctg

SEQ ID NO: 24655 - DNA, 25 bp, E. coli
cattgaacggcacgctggaacagag

SEQ ID NO: 24656 - DNA, 25 bp, E. coli
cattgaacggcaggctggaacagag

SEQ ID NO: 24657 - DNA, 25 bp, E. coli
ggttgtaccggctgtctgactgacg

SEQ ID NO: 24658 - DNA, 25 bp, E. coli
ggttgtaccggcagtctgactgacg

SEQ ID NO: 24659 - DNA, 25 bp, E. coli
cagaatttgcatgccgtgacgcagg

SEQ ID NO: 24660 - DNA, 25 bp, E. coli
cagaatttgcatcccgtgacgcagg

SEQ ID NO: 24661 - DNA, 25 bp, E. coli
catttaattgccctaatcaggaacc

SEQ ID NO: 24662 - DNA, 25 bp, E. coli
catttaattgccgtaatcaggaacc

SEQ ID NO: 24663 - DNA, 25 bp, E. coli
taacagtcgcttttgcattagcgca

SEQ ID NO: 24664 - DNA, 25 bp, E. coli
gaccttaatccagaaaattgccgtt

SEQ ID NO: 24665 - DNA, 25 bp, E. coli
gaccttaatccacaaaattgccgtt

SEQ ID NO: 24666 - DNA, 25 bp, E. coli
aacattatttcacccttcttcaggg

SEQ ID NO: 24667 - DNA, 25 bp, E. coli
aacattatttcagccttcttcaggg

SEQ ID NO: 24668 - DNA, 25 bp, E. coli
tagcgcaacattccaacaggtggtg

SEQ ID NO: 24669 - DNA, 25 bp, E. coli
tagcgcaacattgcaacaggtggtg

SEQ ID NO: 24670 - DNA, 25 bp, E. coli
tcttcagggctgactgtttgcataa

SEQ ID NO: 24671 - DNA, 25 bp, E. coli
tctcaagaatgtctagtcacgcaag

SEQ ID NO: 24672 - DNA, 25 bp, E. coli
tctcaagaatgtgtagtcacgcaag

SEQ ID NO: 24673 - DNA, 25 bp, E. coli
tcttcagggctgtctgtttgcataa

SEQ ID NO: 24674 - DNA, 25 bp, E. coli
cgtttacaatgagcacatctcaaga

SEQ ID NO: 24675 - DNA, 25 bp, E. coli
cgtttacaatgaccacatctcaaga

SEQ ID NO: 24676 - DNA, 25 bp, E. coli
ggtgacaatataccctaccgttcag

SEQ ID NO: 24677 - DNA, 25 bp, E. coli
ggtgacaatatagcctaccgttcag

SEQ ID NO: 24678 - DNA, 25 bp, E. coli
taacagtcgcttatgcattagcgca

SEQ ID NO: 24679 - DNA, 25 bp, E. coli
gacgcaggcatgtttctcaataacg

SEQ ID NO: 24680 - DNA, 25 bp, E. coli
gacgcaggcatgattctcaataacg

SEQ ID NO: 24681 - DNA, 25 bp, E. coli
aatgcgctgactttccagaccgacg

SEQ ID NO: 24682 - DNA, 25 bp, E. coli
aataaagccgatctctatacccgcg

SEQ ID NO: 24683 - DNA, 25 bp, E. coli
aataaagccgatgtctatacccgcg

SEQ ID NO: 24684 - DNA, 25 bp, E. coli
aatgcgctgactatccagaccgacg

SEQ ID NO: 24685 - DNA, 25 bp, E. coli
tactgaaaactattatgcgcgccgg

SEQ ID NO: 24686 - DNA, 25 bp, E. coli
tactgaaaactaatatgcgcgccgg

SEQ ID NO: 24687 - DNA, 25 bp, E. coli
agaccgacgacctgcaaaattcgcg

SEQ ID NO: 24688 - DNA, 25 bp, E. coli
agaccgacgaccagcaaaattcgcg

SEQ ID NO: 24689 - DNA, 25 bp, E. coli
aaattcgcgcacctggcagctctat

SEQ ID NO: 24690 - DNA, 25 bp, E. coli
aaattcgcgcacgtggcagctctat

SEQ ID NO: 24691 - DNA, 25 bp, E. coli
tgaaatatccctacgcgccactgga

SEQ ID NO: 24692 - DNA, 25 bp, E. coli
tgaaatatcccttcgcgccactgga

SEQ ID NO: 24693 - DNA, 25 bp, E. coli
tgcgccacaaaagcgcgaaatgttg

SEQ ID NO: 24694 - DNA, 25 bp, E. coli
tgcgccacaaaaccgcgaaatgttg

SEQ ID NO: 24695 - DNA, 25 bp, E. coli
gcgcgacgctgatcaacgacgatac

SEQ ID NO: 24696 - DNA, 25 bp, E. coli
gcgcgacgctgaacaacgacgatac

SEQ ID NO: 24697 - DNA, 25 bp, E. coli
cgttgtgaagaagtgtgcccgacca

SEQ ID NO: 24698 - DNA, 25 bp, E. coli
cgttgtgaagaactgtgcccgacca

SEQ ID NO: 24699 - DNA, 25 bp, E. coli
gttccatctacaacgttgcagccgt

SEQ ID NO: 24700 - DNA, 25 bp, E. coli
gttccatctacatcgttgcagccgt

SEQ ID NO: 24701 - DNA, 25 bp, E. coli
gacctgatgcccagccaatgtattg

SEQ ID NO: 24702 - DNA, 25 bp, E. coli
gacctgatgccctgccaatgtattg

SEQ ID NO: 24703 - DNA, 25 bp, E. coli
caggtaactactatccgccaacggt

SEQ ID NO: 24704 - DNA, 25 bp, E. coli
cacaaggcgtatttggctggctgaa

SEQ ID NO: 24705 - DNA, 25 bp, E. coli
caggtaactactttccgccaacggt

SEQ ID NO: 24706 - DNA, 25 bp, E. coli
cacaaggcgtatatggctggctgaa

SEQ ID NO: 24707 - DNA, 25 bp, E. coli
taaacatgcgccgaatgtgatgggc

SEQ ID NO: 24708 - DNA, 25 bp, E. coli
taaacatgcgcccaatgtgatgggc

SEQ ID NO: 24709 - DNA, 25 bp, E. coli
taccgaacgttttgtggcagctgcg

SEQ ID NO: 24710 - DNA, 25 bp, E. coli
taccgaacgtttagtggcagctgcg

SEQ ID NO: 24711 - DNA, 25 bp, E. coli
tgattaaagactggcgcattgctgc

SEQ ID NO: 24712 - DNA, 25 bp, E. coli
tgattaaagactcgcgcattgctgc

SEQ ID NO: 24713 - DNA, 25 bp, E. coli
tgaaaaaatgcgaactggaactggg

SEQ ID NO: 24714 - DNA, 25 bp, E. coli
tgaaaaaatgcgtactggaactggg

SEQ ID NO: 24715 - DNA, 25 bp, E. coli
gaagaaatgtttcgccccgttgcgg

SEQ ID NO: 24716 - DNA, 25 bp, E. coli
gaagagaacgctctcggaccaatgg

SEQ ID NO: 24717 - DNA, 25 bp, E. coli
gaagagaacgctgtcggaccaatgg

SEQ ID NO: 24718 - DNA, 25 bp, E. coli
gaagaaatgtttggccccgttgcgg

SEQ ID NO: 24719 - DNA, 25 bp, E. coli
gactcataaaggtgataccccgatg

SEQ ID NO: 24720 - DNA, 25 bp, E. coli
gactcataaaggagataccccgatg

SEQ ID NO: 24721 - DNA, 25 bp, E. coli
cgtgatatcggtaaggctctgcgcg

SEQ ID NO: 24722 - DNA, 25 bp, E. coli
cggcggtagccggacgttatcagaa

SEQ ID NO: 24723 - DNA, 25 bp, E. coli
cgtgatatcggttaggctctgcgcg

SEQ ID NO: 24724 - DNA, 25 bp, E. coli
cggcggtagccgcacgttatcagaa

SEQ ID NO: 24725 - DNA, 25 bp, E. coli
accgcctgctctcccgatggtttat

SEQ ID NO: 24726 - DNA, 25 bp, E. coli
accgcctgctctgccgatggtttat

SEQ ID NO: 24727 - DNA, 25 bp, E. coli
acaaattacggctcggcgtcatcac

SEQ ID NO: 24728 - DNA, 25 bp, E. coli
acaaattacggcacggcgtcatcac

SEQ ID NO: 24729 - DNA, 25 bp, E. coli
tgacaccggacattatcctgcagcg

SEQ ID NO: 24730 - DNA, 25 bp, E. coli
tgacaccggacaatatcctgcagcg

SEQ ID NO: 24731 - DNA, 25 bp, E. coli
tcccgatggtttttgcagtgacggc

SEQ ID NO: 24732 - DNA, 25 bp, E. coli
tcccgatggtttatgcagtgacggc

SEQ ID NO: 24733 - DNA, 25 bp, E. coli
tcatctatcgcgtcgaaagtatgcg

SEQ ID NO: 24734 - DNA, 25 bp, E. coli
tttgcaccggtgtggctccggaagt

SEQ ID NO: 24735 - DNA, 25 bp, E. coli
tcatctatcgcgacgaaagtatgcg

SEQ ID NO: 24736 - DNA, 25 bp, E. coli
tttgcaccggtgaggctccggaagt

SEQ ID NO: 24737 - DNA, 25 bp, E. coli
gaatccccgatcttctatcgcgacg

SEQ ID NO: 24738 - DNA, 25 bp, E. coli
gaatccccgatcatctatcgcgacg

SEQ ID NO: 24739 - DNA, 25 bp, E. coli
gaaaacagtacgagaacgacgccag

SEQ ID NO: 24740 - DNA, 25 bp, E. coli
gaaaatgtcctagttccacaccctg

SEQ ID NO: 24741 - DNA, 25 bp, E. coli
gaaaacagtacgtgaacgacgccag

SEQ ID NO: 24742 - DNA, 25 bp, E. coli
gaaaatgtcctacttccacaccctg

SEQ ID NO: 24743 - DNA, 25 bp, E. coli
tggcctgacatgaaaatgtcctact

SEQ ID NO: 24744 - DNA, 25 bp, E. coli
tggcacaaattagggctcggcgtca

SEQ ID NO: 24745 - DNA, 25 bp, E. coli
tggcctgacatgtaaatgtcctact

SEQ ID NO: 24746 - DNA, 25 bp, E. coli
tggcacaaattacggctcggcgtca

SEQ ID NO: 24747 - DNA, 25 bp, E. coli
tagtgctttctcatactcttctggc

SEQ ID NO: 24748 - DNA, 25 bp, E. coli
tagtgctttctcttactcttctggc

SEQ ID NO: 24749 - DNA, 25 bp, E. coli
tatttctgacacctacagatggcaa

SEQ ID NO: 24750 - DNA, 25 bp, E. coli
tatttctgacacgtacagatggcaa

SEQ ID NO: 24751 - DNA, 25 bp, E. coli
ttttccggccatagtcgcagcactg

SEQ ID NO: 24752 - DNA, 25 bp, E. coli
ttttccggccattgtcgcagcactg

SEQ ID NO: 24753 - DNA, 25 bp, E. coli
tgcgcttataatatgacaaccatca

SEQ ID NO: 24754 - DNA, 25 bp, E. coli
tgcgcttataatttgacaaccatca

SEQ ID NO: 24755 - DNA, 25 bp, E. coli
tgccaggcgtcttttccggccattg

SEQ ID NO: 24756 - DNA, 25 bp, E. coli
tgccaggcgtctattccggccattg

SEQ ID NO: 24757 - DNA, 25 bp, E. coli
gacaaccatcactaaaatcaatctt

SEQ ID NO: 24758 - DNA, 25 bp, E. coli
gacacctacagatggcaagaaatag

SEQ ID NO: 24759 - DNA, 25 bp, E. coli
gacacctacagaaggcaagaaatag

SEQ ID NO: 24760 - DNA, 25 bp, E. coli
gacaaccatcacaaaaatcaatctt

SEQ ID NO: 24761 - DNA, 25 bp, E. coli
cattgtcgcagcactgtaacgcgta

SEQ ID NO: 24762 - DNA, 25 bp, E. coli
cattgtcgcagctctgtaacgcgta

SEQ ID NO: 24763 - DNA, 25 bp, E. coli
gtaacgcgtaaaatagtgctttctc

SEQ ID NO: 24764 - DNA, 25 bp, E. coli
gatacaaatcacttaaatacccctt

SEQ ID NO: 24765 - DNA, 25 bp, E. coli
gtaacgcgtaaattagtgctttctc

SEQ ID NO: 24766 - DNA, 25 bp, E. coli
gatacaaatcacataaatacccctt

SEQ ID NO: 24767 - DNA, 25 bp, E. coli
tggcaagaaatagcgcctgccaggc

SEQ ID NO: 24768 - DNA, 25 bp, E. coli
tggcaagaaataccgcctgccaggc

SEQ ID NO: 24769 - DNA, 25 bp, E. coli
ttggaacaggttaccagtactggta

SEQ ID NO: 24770 - DNA, 25 bp, E. coli
ttggaacaggtttccagtactggta

SEQ ID NO: 24771 - DNA, 25 bp, E. coli
tctggatgttggaacaggttaccag

SEQ ID NO: 24772 - DNA, 25 bp, E. coli
tctggatgttggtacaggttaccag

SEQ ID NO: 24773 - DNA, 25 bp, E. coli
gcgtctggatgttggaacaggttac

SEQ ID NO: 24774 - DNA, 25 bp, E. coli
gcgtctggatgtaggaacaggttac

SEQ ID NO: 24775 - DNA, 25 bp, E. coli
cgtctggatgttcgaacaggttacc

SEQ ID NO: 24776 - DNA, 25 bp, E. coli
cgtctggatgttggaacaggttacc

SEQ ID NO: 24777 - DNA, 25 bp, E. coli
gttggaacaggtaaccagtactggt

SEQ ID NO: 24778 - DNA, 25 bp, E. coli
gttggaacaggttaccagtactggt

SEQ ID NO: 24779 - DNA, 25 bp, E. coli
gtctggatgttgcaacaggttacca

SEQ ID NO: 24780 - DNA, 25 bp, E. coli
gtctggatgttggaacaggttacca

SEQ ID NO: 24781 - DNA, 25 bp, E. coli
ggatgttggaactggttaccagtac

SEQ ID NO: 24782 - DNA, 25 bp, E. coli
ggatgttggaacaggttaccagtac

SEQ ID NO: 24783 - DNA, 25 bp, E. coli
tgttggaacaggttaccagtactgg

SEQ ID NO: 24784 - DNA, 25 bp, E. coli
tggaacaggttaccagtactggtac

SEQ ID NO: 24785 - DNA, 25 bp, E. coli
tggaacaggttagcagtactggtac

SEQ ID NO: 24786 - DNA, 25 bp, E. coli
tggatgttggaagaggttaccagta

SEQ ID NO: 24787 - DNA, 25 bp, E. coli
tgttggaacaggataccagtactgg

SEQ ID NO: 24788 - DNA, 25 bp, E. coli
tggatgttggaacaggttaccagta

SEQ ID NO: 24789 - DNA, 25 bp, E. coli
gatgttggaacaggttaccagtact

SEQ ID NO: 24790 - DNA, 25 bp, E. coli
gatgttggaacacgttaccagtact

SEQ ID NO: 24791 - DNA, 25 bp, E. coli
aatctggctcgcgaatatggcatca

SEQ ID NO: 24792 - DNA, 25 bp, E. coli
aatctggctcgccaatatggcatca

SEQ ID NO: 24793 - DNA, 25 bp, E. coli
caggcgctttcgcttggcaagatgc

SEQ ID NO: 24794 - DNA, 25 bp, E. coli
catgttctgactcatagccgcaccg

SEQ ID NO: 24795 - DNA, 25 bp, E. coli
catgttctgactgatagccgcaccg

SEQ ID NO: 24796 - DNA, 25 bp, E. coli
caggcgctttcggttggcaagatgc

SEQ ID NO: 24797 - DNA, 25 bp, E. coli
tgatattgtcatggccggtggccag

SEQ ID NO: 24798 - DNA, 25 bp, E. coli
tgatattgtcatcgccggtggccag

SEQ ID NO: 24799 - DNA, 25 bp, E. coli
tgatgatgagcgaagccaaagcacg

SEQ ID NO: 24800 - DNA, 25 bp, E. coli
tgatgatgagcgtagccaaagcacg

SEQ ID NO: 24801 - DNA, 25 bp, E. coli
gcgttgaatttagccgtgctggccc

SEQ ID NO: 24802 - DNA, 25 bp, E. coli
gcgttgaatttacccgtgctggccc

SEQ ID NO: 24803 - DNA, 25 bp, E. coli
gacagcgggtaaagcatcatccata

SEQ ID NO: 24804 - DNA, 25 bp, E. coli
gaaatggtgaaacgtaatgcccgca

SEQ ID NO: 24805 - DNA, 25 bp, E. coli
gacagcgggtaatgcatcatccata

SEQ ID NO: 24806 - DNA, 25 bp, E. coli
gaaatggtgaaaggtaatgcccgca

SEQ ID NO: 24807 - DNA, 25 bp, E. coli
cattgatgggaattgcgccggtgta

SEQ ID NO: 24808 - DNA, 25 bp, E. coli
cattgatgggaaatgcgccggtgta

SEQ ID NO: 24809 - DNA, 25 bp, E. coli
gatttaaagatgagatcgtcccggt

SEQ ID NO: 24810 - DNA, 25 bp, E. coli
gatttaaagatgtgatcgtcccggt

SEQ ID NO: 24811 - DNA, 25 bp, E. coli
gattatcatattggtgtcaccgccg

SEQ ID NO: 24812 - DNA, 25 bp, E. coli
gattatcatattcgtgtcaccgccg

SEQ ID NO: 24813 - DNA, 25 bp, E. coli
caccaatcaagtatttacatgagaa

SEQ ID NO: 24814 - DNA, 25 bp, E. coli
caccaatcaagtttttacatgagaa

SEQ ID NO: 24815 - DNA, 25 bp, E. coli
cagttgcaggcatttttcgatgccg

SEQ ID NO: 24816 - DNA, 25 bp, E. coli
cagttgcaggcaattttcgatgccg

SEQ ID NO: 24817 - DNA, 25 bp, E. coli
tgaatattccctcaccaatcaagta

SEQ ID NO: 24818 - DNA, 25 bp, E. coli
tgaatattccctgaccaatcaagta

SEQ ID NO: 24819 - DNA, 25 bp, E. coli
tcgatgccgtggtcgaactaagcca

SEQ ID NO: 24820 - DNA, 25 bp, E. coli
tcgatgccgtggacgaactaagcca

SEQ ID NO: 24821 - DNA, 25 bp, E. coli
cctggcggcaagtacggtagcgaac

SEQ ID NO: 24822 - DNA, 25 bp, E. coli
cctggcggcaagaacggtagcgaac

SEQ ID NO: 24823 - DNA, 25 bp, E. coli
gacgaactaagccaggaaagccccg

SEQ ID NO: 24824 - DNA, 25 bp, E. coli
gacggggttgctttcccatatcggc

SEQ ID NO: 24825 - DNA, 25 bp, E. coli
gacgaactaagcgaggaaagccccg

SEQ ID NO: 24826 - DNA, 25 bp, E. coli
cgaccagttgcacgcaattttcgat

SEQ ID NO: 24827 - DNA, 25 bp, E. coli
cgaccagttgcaggcaattttcgat

SEQ ID NO: 24828 - DNA, 25 bp, E. coli
cgtggacgaacttagccaggaaagc

SEQ ID NO: 24829 - DNA, 25 bp, E. coli
cgtggacgaactaagccaggaaagc

SEQ ID NO: 24830 - DNA, 25 bp, E. coli
gtatttacatgacaagttaccaaac

SEQ ID NO: 24831 - DNA, 25 bp, E. coli
gtatttacatgagaagttaccaaac

SEQ ID NO: 24832 - DNA, 25 bp, E. coli
ggcaattttcgaagccgtggacgaa

SEQ ID NO: 24833 - DNA, 25 bp, E. coli
ggcaattttcgatgccgtggacgaa

SEQ ID NO: 24834 - DNA, 25 bp, E. coli
gacggggttgctatcccatatcggc

SEQ ID NO: 24835 - DNA, 25 bp, E. coli
aataatgtgcgcgacgttgtgggca

SEQ ID NO: 24836 - DNA, 25 bp, E. coli
aataatgtgcgccacgttgtgggca

SEQ ID NO: 24837 - DNA, 25 bp, E. coli
caaagtctgtagtctccggcagggt

SEQ ID NO: 24838 - DNA, 25 bp, E. coli
caaagtctgtagactccggcagggt

SEQ ID NO: 24839 - DNA, 25 bp, E. coli
catcaaaaaagcatagcagacaggc

SEQ ID NO: 24840 - DNA, 25 bp, E. coli
catcaaaaaagcttagcagacaggc

SEQ ID NO: 24841 - DNA, 25 bp, E. coli
actccggcagggaaataatgtgcgc

SEQ ID NO: 24842 - DNA, 25 bp, E. coli
actccggcagggtaataatgtgcgc

SEQ ID NO: 24843 - DNA, 25 bp, E. coli
tgtgaacgttacctgaaaggaacaa

SEQ ID NO: 24844 - DNA, 25 bp, E. coli
gctggattaagctggtaacatcagt

SEQ ID NO: 24845 - DNA, 25 bp, E. coli
gctggattaagcaggtaacatcagt

SEQ ID NO: 24846 - DNA, 25 bp, E. coli
gcagacaggcatggtattgctggat

SEQ ID NO: 24847 - DNA, 25 bp, E. coli
gcagacaggcatcgtattgctggat

SEQ ID NO: 24848 - DNA, 25 bp, E. coli
tgtgaacgttacgtgaaaggaacaa

SEQ ID NO: 24849 - DNA, 25 bp, E. coli
ggctgttgcccacacactttatttg

SEQ ID NO: 24850 - DNA, 25 bp, E. coli
ggctgttgcccagacactttatttg

SEQ ID NO: 24851 - DNA, 25 bp, E. coli
taatggtgagagattggacttgctc

SEQ ID NO: 24852 - DNA, 25 bp, E. coli
taatggtgagagtttggacttgctc

SEQ ID NO: 24853 - DNA, 25 bp, E. coli
gagaaatttcgctaaacgcatcaaa

SEQ ID NO: 24854 - DNA, 25 bp, E. coli
gagaaatttcgcaaaacgcatcaaa

SEQ ID NO: 24855 - DNA, 25 bp, E. coli
gatgagtgcgttaattcacacttct

SEQ ID NO: 24856 - DNA, 25 bp, E. coli
gatgagtgcgtttattcacacttct

SEQ ID NO: 24857 - DNA, 25 bp, E. coli
catgtatcagcaggatgaccgcgac

SEQ ID NO: 24858 - DNA, 25 bp, E. coli
catgtatcagcacgatgaccgcgac

SEQ ID NO: 24859 - DNA, 25 bp, E. coli
aaaaccaaatacacgctggagcgcg

SEQ ID NO: 24860 - DNA, 25 bp, E. coli
aaaaccaaatactcgctggagcgcg

SEQ ID NO: 24861 - DNA, 25 bp, E. coli
tataaagaaaacttcaccgagccgg

SEQ ID NO: 24862 - DNA, 25 bp, E. coli
tatcgtgatgcgagtaacaggctgc

SEQ ID NO: 24863 - DNA, 25 bp, E. coli
tataaagaaaacatcaccgagccgg

SEQ ID NO: 24864 - DNA, 25 bp, E. coli
tatcgtgatgcgtgtaacaggctgc

SEQ ID NO: 24865 - DNA, 25 bp, E. coli
tctgaaaaagaacgtcaaaccggtg

SEQ ID NO: 24866 - DNA, 25 bp, E. coli
tctgaaaaagaaggtcaaaccggtg

SEQ ID NO: 24867 - DNA, 25 bp, E. coli
gcattacggcgatccagaatctgat

SEQ ID NO: 24868 - DNA, 25 bp, E. coli
gctacaacctgcttcttggcggcaa

SEQ ID NO: 24869 - DNA, 25 bp, E. coli
gcattacggcgaaccagaatctgat

SEQ ID NO: 24870 - DNA, 25 bp, E. coli
gctacaacctgcatcttggcggcaa

SEQ ID NO: 24871 - DNA, 25 bp, E. coli
gaagccgtcgtgtcaactcagcgtg

SEQ ID NO: 24872 - DNA, 25 bp, E. coli
gaagccgtcgtgacaactcagcgtg

SEQ ID NO: 24873 - DNA, 25 bp, E. coli
ctgaaaaccggcgtgctggagatcg

SEQ ID NO: 24874 - DNA, 25 bp, E. coli
ctgaaaaccggcctgctggagatcg

SEQ ID NO: 24875 - DNA, 25 bp, E. coli
gggttaatgaatgccgtcacgccgc

SEQ ID NO: 24876 - DNA, 25 bp, E. coli
gggttaatgaatcccgtcacgccgc

SEQ ID NO: 24877 - DNA, 25 bp, E. coli
ggcacctgacgcagtttatcgaaaa

SEQ ID NO: 24878 - DNA, 25 bp, E. coli
ggcacctgacgctgtttatcgaaaa

SEQ ID NO: 24879 - DNA, 25 bp, E. coli
tacgatgtaccagcaggcgagttgc

SEQ ID NO: 24880 - DNA, 25 bp, E. coli
tacgatgtaccaccaggcgagttgc

SEQ ID NO: 24881 - DNA, 25 bp, E. coli
agctgcagccgcctctttgttaccg

SEQ ID NO: 24882 - DNA, 25 bp, E. coli
atgatattggaacccggaacggtca

SEQ ID NO: 24883 - DNA, 25 bp, E. coli
agctgcagccgcgtctttgttaccg

SEQ ID NO: 24884 - DNA, 25 bp, E. coli
atgatattggaagccggaacggtca

SEQ ID NO: 24885 - DNA, 25 bp, E. coli
tacctgtgcgtaaatgtgacgcggg

SEQ ID NO: 24886 - DNA, 25 bp, E. coli
tacctgtgcgtatatgtgacgcggg

SEQ ID NO: 24887 - DNA, 25 bp, E. coli
tttctacagtagaagcagctaccag

SEQ ID NO: 24888 - DNA, 25 bp, E. coli
tttctacagtagtagcagctaccag

SEQ ID NO: 24889 - DNA, 25 bp, E. coli
cctttttccagaccgcgttcagcga

SEQ ID NO: 24890 - DNA, 25 bp, E. coli
cctttttccagagcgcgttcagcga

SEQ ID NO: 24891 - DNA, 25 bp, E. coli
gcacgacggatacgagcagatttct

SEQ ID NO: 24892 - DNA, 25 bp, E. coli
gaaccgttcggtccaattacctgtg

SEQ ID NO: 24893 - DNA, 25 bp, E. coli
gcacgacggataggagcagatttct

SEQ ID NO: 24894 - DNA, 25 bp, E. coli
gaaccgttcggtgcaattacctgtg

SEQ ID NO: 24895 - DNA, 25 bp, E. coli
cccggaacggtctaaggatacatct

SEQ ID NO: 24896 - DNA, 25 bp, E. coli
cccggaacggtcaaaggatacatct

SEQ ID NO: 24897 - DNA, 25 bp, E. coli
gttcagcgacagctttacccacagc

SEQ ID NO: 24898 - DNA, 25 bp, E. coli
gttcagcgacaggtttacccacagc

SEQ ID NO: 24899 - DNA, 25 bp, E. coli
gagttgcgcccacctcctggagctt

SEQ ID NO: 24900 - DNA, 25 bp, E. coli
gagttgcgcccagctcctggagctt

SEQ ID NO: 24901 - DNA, 25 bp, E. coli
caaaatgcggcgttcgaagggatca

SEQ ID NO: 24902 - DNA, 25 bp, E. coli
caaaatgcggcgatcgaagggatca

SEQ ID NO: 24903 - DNA, 25 bp, E. coli
cagatgacgggcatactcaatggtc

SEQ ID NO: 24904 - DNA, 25 bp, E. coli
cagatgacgggcttactcaatggtc

SEQ ID NO: 24905 - DNA, 25 bp, E. coli
ttcaggatgcctcgcaaaatgcggc

SEQ ID NO: 24906 - DNA, 25 bp, E. coli
ttcaggatgcctggcaaaatgcggc

SEQ ID NO: 24907 - DNA, 25 bp, E. coli
tgtttgctgccagtaaagcggacca

SEQ ID NO: 24908 - DNA, 25 bp, E. coli
tgtttgctgccactaaagcggacca

SEQ ID NO: 24909 - DNA, 25 bp, E. coli
gactatttaagctggtcgcgccaga

SEQ ID NO: 24910 - DNA, 25 bp, E. coli
gactatttaagcaggtcgcgccaga

SEQ ID NO: 24911 - DNA, 25 bp, E. coli
ccgcaggtgatgcatgtcgacaaac

SEQ ID NO: 24912 - DNA, 25 bp, E. coli
cgaatggttgctcgacctgccgatg

SEQ ID NO: 24913 - DNA, 25 bp, E. coli
ccgatgctggcggaggactatttaa

SEQ ID NO: 24914 - DNA, 25 bp, E. coli
cgaatggttgctggacctgccgatg

SEQ ID NO: 24915 - DNA, 25 bp, E. coli
ccgatgctggcgcaggactatttaa

SEQ ID NO: 24916 - DNA, 25 bp, E. coli
ccgcaggtgatggatgtcgacaaac

SEQ ID NO: 24917 - DNA, 25 bp, E. coli
tgttaacggtgagaaaatcccggcg

SEQ ID NO: 24918 - DNA, 25 bp, E. coli
tgttaacggtgacaaaatcccggcg

SEQ ID NO: 24919 - DNA, 25 bp, E. coli
ggcgcaccgctctctgtttatcctg

SEQ ID NO: 24920 - DNA, 25 bp, E. coli
ggcgcaccgctcactgtttatcctg

SEQ ID NO: 24921 - DNA, 25 bp, E. coli
gaccatgtgaccttcgatcagcacg

SEQ ID NO: 24922 - DNA, 25 bp, E. coli
gaccatgtgaccatcgatcagcacg

SEQ ID NO: 24923 - DNA, 25 bp, E. coli
aagctgggaaaccaaacgccgtcag

SEQ ID NO: 24924 - DNA, 25 bp, E. coli
aagctgggaaacgaaacgccgtcag

SEQ ID NO: 24925 - DNA, 25 bp, E. coli
tacgcatcgaaaagggtgaagaaac

SEQ ID NO: 24926 - DNA, 25 bp, E. coli
tacgcatcgaaatgggtgaagaaac

SEQ ID NO: 24927 - DNA, 25 bp, E. coli
aaaattgctcctgcttttgcaagcg

SEQ ID NO: 24928 - DNA, 25 bp, E. coli
aaaattgctcctccttttgcaagcg

SEQ ID NO: 24929 - DNA, 25 bp, E. coli
tatgacctggtctaaagctgggaaa

SEQ ID NO: 24930 - DNA, 25 bp, E. coli
tatgacctggtcaaaagctgggaaa

SEQ ID NO: 24931 - DNA, 25 bp, E. coli
tatttgctgatcatcttgccagcgc

SEQ ID NO: 24932 - DNA, 25 bp, E. coli
tatttgctgatcttcttgccagcgc

SEQ ID NO: 24933 - DNA, 25 bp, E. coli
tgtaaaagcgatgcgtgaagcaacg

SEQ ID NO: 24934 - DNA, 25 bp, E. coli
tgtaaaagcgatccgtgaagcaacg

SEQ ID NO: 24935 - DNA, 25 bp, E. coli
tgaagaaacgcctgaaccagagcac

SEQ ID NO: 24936 - DNA, 25 bp, E. coli
tgaagaaacgccagaaccagagcac

SEQ ID NO: 24937 - DNA, 25 bp, E. coli
tgccagcgcagaagaaatggtacgc

SEQ ID NO: 24938 - DNA, 25 bp, E. coli
tgccagcgcagatgaaatggtacgc

SEQ ID NO: 24939 - DNA, 25 bp, E. coli
gaagcaacgggtttacgtcagcaag

SEQ ID NO: 24940 - DNA, 25 bp, E. coli
gaagcaacgggtatacgtcagcaag

SEQ ID NO: 24941 - DNA, 25 bp, E. coli
gcaagattttgctgtcgccgtaggg

SEQ ID NO: 24942 - DNA, 25 bp, E. coli
gcaagattttgcagtcgccgtaggg

SEQ ID NO: 24943 - DNA, 25 bp, E. coli
gagcacgtccattcttttagcgaaa

SEQ ID NO: 24944 - DNA, 25 bp, E. coli
gagcacgtccatacttttagcgaaa

SEQ ID NO: 24945 - DNA, 25 bp, E. coli
caaactgcagtttaaggccttcctg

SEQ ID NO: 24946 - DNA, 25 bp, E. coli
caaactgcagttaaaggccttcctg

SEQ ID NO: 24947 - DNA, 25 bp, E. coli
taacagaagaggcagaacctgtctg

SEQ ID NO: 24948 - DNA, 25 bp, E. coli
taacagaagagggagaacctgtctg

SEQ ID NO: 24949 - DNA, 25 bp, E. coli
actgggaggaggatgaagacctcca

SEQ ID NO: 24950 - DNA, 25 bp, E. coli
actgggaggaggttgaagacctcca

SEQ ID NO: 24951 - DNA, 25 bp, E. coli
tatgtcgtggagctggaaacaccgc

SEQ ID NO: 24952 - DNA, 25 bp, E. coli
tatgtcgtggaggtggaaacaccgc

SEQ ID NO: 24953 - DNA, 25 bp, E. coli
tggtttcacctagacagaaacaggg

SEQ ID NO: 24954 - DNA, 25 bp, E. coli
tctgtattctctgattatgtcgtgg

SEQ ID NO: 24955 - DNA, 25 bp, E. coli
tctgtattctctcattatgtcgtgg

SEQ ID NO: 24956 - DNA, 25 bp, E. coli
cctgtcatctcttgactgggaggag

SEQ ID NO: 24957 - DNA, 25 bp, E. coli
cctgtcatctctagactgggaggag

SEQ ID NO: 24958 - DNA, 25 bp, E. coli
gaagacctccagtataaactgttag

SEQ ID NO: 24959 - DNA, 25 bp, E. coli
gaacctgtctgtgtccggaatgacg

SEQ ID NO: 24960 - DNA, 25 bp, E. coli
gaagacctccagaataaactgttag

SEQ ID NO: 24961 - DNA, 25 bp, E. coli
gaacctgtctgtctccggaatgacg

SEQ ID NO: 24962 - DNA, 25 bp, E. coli
gacggttattttgtcaacattcgca

SEQ ID NO: 24963 - DNA, 25 bp, E. coli
gacggttattttctcaacattcgca

SEQ ID NO: 24964 - DNA, 25 bp, E. coli
tggaaacaccgcttcgggaatggag

SEQ ID NO: 24965 - DNA, 25 bp, E. coli
tggaaacaccgcatcgggaatggag

SEQ ID NO: 24966 - DNA, 25 bp, E. coli
tggtttcacctacacagaaacaggg

SEQ ID NO: 24967 - DNA, 25 bp, E. coli
cagcggaattttagcacgggattat

SEQ ID NO: 24968 - DNA, 25 bp, E. coli
cactattaccgatgtgaaccctgat

SEQ ID NO: 24969 - DNA, 25 bp, E. coli
cagcggaatttttgcacgggattat

SEQ ID NO: 24970 - DNA, 25 bp, E. coli
cactattaccgaagtgaaccctgat

SEQ ID NO: 24971 - DNA, 25 bp, E. coli
agaaacggtgattgtcggcgataac

SEQ ID NO: 24972 - DNA, 25 bp, E. coli
agaaacggtgatagtcggcgataac

SEQ ID NO: 24973 - DNA, 25 bp, E. coli
tgctgatgcacgttaacgtcgccgt

SEQ ID NO: 24974 - DNA, 25 bp, E. coli
tgctgatgcacgataacgtcgccgt

SEQ ID NO: 24975 - DNA, 25 bp, E. coli
tcgccgtaccggctgcagcggaatt

SEQ ID NO: 24976 - DNA, 25 bp, E. coli
tcgccgtaccgggtgcagcggaatt

SEQ ID NO: 24977 - DNA, 25 bp, E. coli
gccgctggtgttgctgaccaactat

SEQ ID NO: 24978 - DNA, 25 bp, E. coli
gccgctggtgttcctgaccaactat

SEQ ID NO: 24979 - DNA, 25 bp, E. coli
gaaacgcgttcctacaactgggaca

SEQ ID NO: 24980 - DNA, 25 bp, E. coli
gaaacgcgttccaacaactgggaca

SEQ ID NO: 24981 - DNA, 25 bp, E. coli
gattcatgaactgtacaaagccggt

SEQ ID NO: 24982 - DNA, 25 bp, E. coli
gattatggataatggcctgccgctg

SEQ ID NO: 24983 - DNA, 25 bp, E. coli
gattatggataaaggcctgccgctg

SEQ ID NO: 24984 - DNA, 25 bp, E. coli
gattcatgaactctacaaagccggt

SEQ ID NO: 24985 - DNA, 25 bp, E. coli
gggcgaaggcgcactgattcatgaa

SEQ ID NO: 24986 - DNA, 25 bp, E. coli
gggcgaaggcgctctgattcatgaa

SEQ ID NO: 24987 - DNA, 25 bp, E. coli
taatttgcgataacgacggcgtgct

SEQ ID NO: 24988 - DNA, 25 bp, E. coli
taatttgcgatatcgacggcgtgct

SEQ ID NO: 24989 - DNA, 25 bp, E. coli
caaaatggttgttttaggttcaggg

SEQ ID NO: 24990 - DNA, 25 bp, E. coli
caaaatggttgtattaggttcaggg

SEQ ID NO: 24991 - DNA, 25 bp, E. coli
cactgaagggcatgaattttggtca

SEQ ID NO: 24992 - DNA, 25 bp, E. coli
cactgaagggcaagaattttggtca

SEQ ID NO: 24993 - DNA, 25 bp, E. coli
agagaattggcaccgttactggatt

SEQ ID NO: 24994 - DNA, 25 bp, E. coli
agagaattggcagcgttactggatt

SEQ ID NO: 24995 - DNA, 25 bp, E. coli
ttttcaaaaggttctggcccgcgcg

SEQ ID NO: 24996 - DNA, 25 bp, E. coli
ttttcaaaaggtactggcccgcgcg

SEQ ID NO: 24997 - DNA, 25 bp, E. coli
tcgggactggcgcaattttcaaaag

SEQ ID NO: 24998 - DNA, 25 bp, E. coli
tcgggactggcggaattttcaaaag

SEQ ID NO: 24999 - DNA, 25 bp, E. coli
gcatctgaccatatcgttgaaacca

SEQ ID NO: 25000 - DNA, 25 bp, E. coli
gcatctgaccatttcgttgaaacca

SEQ ID NO: 25001 - DNA, 25 bp, E. coli
gaaatacggcataatggcactgaag

SEQ ID NO: 25002 - DNA, 25 bp, E. coli
gaaatacggcattatggcactgaag

SEQ ID NO: 25003 - DNA, 25 bp, E. coli
gttactggattaacgggactggcgc

SEQ ID NO: 25004 - DNA, 25 bp, E. coli
gttactggattatcgggactggcgc

SEQ ID NO: 25005 - DNA, 25 bp, E. coli
ggctcaacgagatcttgaagatgtt

SEQ ID NO: 25006 - DNA, 25 bp, E. coli
tcgttgaaaccagcaaaatggttgt

SEQ ID NO: 25007 - DNA, 25 bp, E. coli
ggctcaacgagaacttgaagatgtt

SEQ ID NO: 25008 - DNA, 25 bp, E. coli
tcgttgaaaccaccaaaatggttgt

SEQ ID NO: 25009 - DNA, 25 bp, E. coli
tcaagcgtgcgaagccagcaatcaa

SEQ ID NO: 25010 - DNA, 25 bp, E. coli
tcaagcgtgcgatgccagcaatcaa

SEQ ID NO: 25011 - DNA, 25 bp, E. coli
aggcgcagtgctgtgtcccatacct

SEQ ID NO: 25012 - DNA, 25 bp, E. coli
aggcgcagtgctctgtcccatacct

SEQ ID NO: 25013 - DNA, 25 bp, E. coli
actggagccgccagtctggctggat

SEQ ID NO: 25014 - DNA, 25 bp, E. coli
aaaacagcagcatttgctggcggct

SEQ ID NO: 25015 - DNA, 25 bp, E. coli
actggagccgcctgtctggctggat

SEQ ID NO: 25016 - DNA, 25 bp, E. coli
aaaacagcagcaattgctggcggct

SEQ ID NO: 25017 - DNA, 25 bp, E. coli
ttcgccacgacattgcatagcctcg

SEQ ID NO: 25018 - DNA, 25 bp, E. coli
ttcgccacgacaatgcatagcctcg

SEQ ID NO: 25019 - DNA, 25 bp, E. coli
tcttttcgccacgacattgcatagc

SEQ ID NO: 25020 - DNA, 25 bp, E. coli
tcttttcgccaccacattgcatagc

SEQ ID NO: 25021 - DNA, 25 bp, E. coli
gcccagttacgcccgtactttatat

SEQ ID NO: 25022 - DNA, 25 bp, E. coli
gcccagttacgcgcgtactttatat

SEQ ID NO: 25023 - DNA, 25 bp, E. coli
gctggcggctattactgattattat

SEQ ID NO: 25024 - DNA, 25 bp, E. coli
gctggcggctataactgattattat

SEQ ID NO: 25025 - DNA, 25 bp, E. coli
gctgtgtcccattccttttttacgc

SEQ ID NO: 25026 - DNA, 25 bp, E. coli
gctgtgtcccataccttttttacgc

SEQ ID NO: 25027 - DNA, 25 bp, E. coli
gcagcatttgctggcggctattact

SEQ ID NO: 25028 - DNA, 25 bp, E. coli
gcagcatttgctcgcggctattact

SEQ ID NO: 25029 - DNA, 25 bp, E. coli
tggcgcgatgtaacactggagccgc

SEQ ID NO: 25030 - DNA, 25 bp, E. coli
tggcgcgatgtatcactggagccgc

SEQ ID NO: 25031 - DNA, 25 bp, E. coli
gatgtatcactgcagccgcctgtct

SEQ ID NO: 25032 - DNA, 25 bp, E. coli
gatgtatcactggagccgcctgtct

SEQ ID NO: 25033 - DNA, 25 bp, E. coli
aatcggatgctttcttacctcctga

SEQ ID NO: 25034 - DNA, 25 bp, E. coli
aatcggatgcttacttacctcctga

SEQ ID NO: 25035 - DNA, 25 bp, E. coli
caggaatgccctacaaatacagata

SEQ ID NO: 25036 - DNA, 25 bp, E. coli
caggcatcatgcacaataacaaagt

SEQ ID NO: 25037 - DNA, 25 bp, E. coli
caggaatgcccttcaaatacagata

SEQ ID NO: 25038 - DNA, 25 bp, E. coli
caggcatcatgctcaataacaaagt

SEQ ID NO: 25039 - DNA, 25 bp, E. coli
taacaaagtgcttcctgtaaccatt

SEQ ID NO: 25040 - DNA, 25 bp, E. coli
tatatttacactgactcacacaggc

SEQ ID NO: 25041 - DNA, 25 bp, E. coli
tatatttacactcactcacacaggc

SEQ ID NO: 25042 - DNA, 25 bp, E. coli
taatcaaaaacagccaggaatgccc

SEQ ID NO: 25043 - DNA, 25 bp, E. coli
taatcaaaaacacccaggaatgccc

SEQ ID NO: 25044 - DNA, 25 bp, E. coli
ccatcatgcggattatctttttcag

SEQ ID NO: 25045 - DNA, 25 bp, E. coli
ccatcatgcggaatatctttttcag

SEQ ID NO: 25046 - DNA, 25 bp, E. coli
gctttaataacccttgcactctgca

SEQ ID NO: 25047 - DNA, 25 bp, E. coli
gctttaataaccgttgcactctgca

SEQ ID NO: 25048 - DNA, 25 bp, E. coli
gcactctgcaaatatgtccttatgg

SEQ ID NO: 25049 - DNA, 25 bp, E. coli
gcactctgcaaaaatgtccttatgg

SEQ ID NO: 25050 - DNA, 25 bp, E. coli
gatacagttatccagccatcatgcg

SEQ ID NO: 25051 - DNA, 25 bp, E. coli
gatacagttatcgagccatcatgcg

SEQ ID NO: 25052 - DNA, 25 bp, E. coli
taacaaagtgctacctgtaaccatt

SEQ ID NO: 25053 - DNA, 25 bp, E. coli
taataatctggtatcaatcggatgc

SEQ ID NO: 25054 - DNA, 25 bp, E. coli
taataatctggtttcaatcggatgc

SEQ ID NO: 25055 - DNA, 25 bp, E. coli
aacggcgctgctcaagaagaaatcc

SEQ ID NO: 25056 - DNA, 25 bp, E. coli
caggtaagcgcattggcggaccaga

SEQ ID NO: 25057 - DNA, 25 bp, E. coli
caggtaagcgcaatggcggaccaga

SEQ ID NO: 25058 - DNA, 25 bp, E. coli
aacggcgctgctgaagaagaaatcc

SEQ ID NO: 25059 - DNA, 25 bp, E. coli
tatggtgctgaccaaaagtgcgtcc

SEQ ID NO: 25060 - DNA, 25 bp, E. coli
tatggtgctgacgaaaagtgcgtcc

SEQ ID NO: 25061 - DNA, 25 bp, E. coli
tattaccgggcaaaccgatgcgatg

SEQ ID NO: 25062 - DNA, 25 bp, E. coli
tattaccgggcataccgatgcgatg

SEQ ID NO: 25063 - DNA, 25 bp, E. coli
tctacaacaactcgaacctttcggg

SEQ ID NO: 25064 - DNA, 25 bp, E. coli
tgcagccgctggtgcaaaagctgga

SEQ ID NO: 25065 - DNA, 25 bp, E. coli
tctacaacaactggaacctttcggg

SEQ ID NO: 25066 - DNA, 25 bp, E. coli
tgcagccgctggagcaaaagctgga

SEQ ID NO: 25067 - DNA, 25 bp, E. coli
cccgtgatgcgcatatggaagcgaa

SEQ ID NO: 25068 - DNA, 25 bp, E. coli
cgatgcgatggcgtacaaaaacaat

SEQ ID NO: 25069 - DNA, 25 bp, E. coli
cccgtgatgcgcttatggaagcgaa

SEQ ID NO: 25070 - DNA, 25 bp, E. coli
cgatgcgatggcctacaaaaacaat

SEQ ID NO: 25071 - DNA, 25 bp, E. coli
gtatcaatactttggtcagcatggg

SEQ ID NO: 25072 - DNA, 25 bp, E. coli
gggctgtcgccgataaataaaatca

SEQ ID NO: 25073 - DNA, 25 bp, E. coli
gggctgtcgccgttaaataaaatca

SEQ ID NO: 25074 - DNA, 25 bp, E. coli
gtatcaatacttaggtcagcatggg

SEQ ID NO: 25075 - DNA, 25 bp, E. coli
taagcagcaggtcctttcgcagcga

SEQ ID NO: 25076 - DNA, 25 bp, E. coli
taagcagcaggtgctttcgcagcga

SEQ ID NO: 25077 - DNA, 25 bp, E. coli
tacaggtaaccagtatcagcggaaa

SEQ ID NO: 25078 - DNA, 25 bp, E. coli
tacaggtaaccactatcagcggaaa

SEQ ID NO: 25079 - DNA, 25 bp, E. coli
aaatgaccattaacagcgaagcggg

SEQ ID NO: 25080 - DNA, 25 bp, E. coli
aaatgaccattatcagcgaagcggg

SEQ ID NO: 25081 - DNA, 25 bp, E. coli
aaaacctgccgaataaatctgcggg

SEQ ID NO: 25082 - DNA, 25 bp, E. coli
aaaacctgccgattaaatctgcggg

SEQ ID NO: 25083 - DNA, 25 bp, E. coli
taccacctgtggaatagtcaaagca

SEQ ID NO: 25084 - DNA, 25 bp, E. coli
taccacctgtggtatagtcaaagca

SEQ ID NO: 25085 - DNA, 25 bp, E. coli
tgacccgacggtcaaattaatgatc

SEQ ID NO: 25086 - DNA, 25 bp, E. coli
tgacccgacggtgaaattaatgatc

SEQ ID NO: 25087 - DNA, 25 bp, E. coli
tcgataaaacaaatgccagggaggg

SEQ ID NO: 25088 - DNA, 25 bp, E. coli
tcgataaaacaattgccagggaggg

SEQ ID NO: 25089 - DNA, 25 bp, E. coli
tcagcggaaactcgatcgtaccacc

SEQ ID NO: 25090 - DNA, 25 bp, E. coli
tcagcggaaactggatcgtaccacc

SEQ ID NO: 25091 - DNA, 25 bp, E. coli
gctgtgccagccataatgaaaatgc

SEQ ID NO: 25092 - DNA, 25 bp, E. coli
gctgtgccagccttaatgaaaatgc

SEQ ID NO: 25093 - DNA, 25 bp, E. coli
gcaaagtagcggcacaacggtaaaa

SEQ ID NO: 25094 - DNA, 25 bp, E. coli
gcaaagtagcgggacaacggtaaaa

SEQ ID NO: 25095 - DNA, 25 bp, E. coli
ggatataccttactgctggcgcaaa

SEQ ID NO: 25096 - DNA, 25 bp, E. coli
ggatataccttagtgctggcgcaaa

SEQ ID NO: 25097 - DNA, 25 bp, E. coli
tcaacgacaaatgtgcgctgacccg

SEQ ID NO: 25098 - DNA, 25 bp, E. coli
tcaacgacaaatctgcgctgacccg

SEQ ID NO: 25099 - DNA, 25 bp, E. coli
caagccagcaggttgaattgccgcc

SEQ ID NO: 25100 - DNA, 25 bp, E. coli
caagccagcaggatgaattgccgcc

SEQ ID NO: 25101 - DNA, 25 bp, E. coli
cattagcgagggtattaaacctggc

SEQ ID NO: 25102 - DNA, 25 bp, E. coli
cattagcgagggaattaaacctggc

SEQ ID NO: 25103 - DNA, 25 bp, E. coli
taaaaacggcgcagtgaacgtgctg

SEQ ID NO: 25104 - DNA, 25 bp, E. coli
taaaaacggcgctgtgaacgtgctg

SEQ ID NO: 25105 - DNA, 25 bp, E. coli
tattacaacgctatatggcgctggc

SEQ ID NO: 25106 - DNA, 25 bp, E. coli
tattacaacgctttatggcgctggc

SEQ ID NO: 25107 - DNA, 25 bp, E. coli
ttcaaacggcgtcctgcataaggcc

SEQ ID NO: 25108 - DNA, 25 bp, E. coli
ttcaaacggcgtgctgcataaggcc

SEQ ID NO: 25109 - DNA, 25 bp, E. coli
tgcctggcaaaatccggagctggtg

SEQ ID NO: 25110 - DNA, 25 bp, E. coli
tgcctggcaaaaaccggagctggtg

SEQ ID NO: 25111 - DNA, 25 bp, E. coli
tgccgatgaagctagtggtgccgcc

SEQ ID NO: 25112 - DNA, 25 bp, E. coli
tgccgatgaagcaagtggtgccgcc

SEQ ID NO: 25113 - DNA, 25 bp, E. coli
gcccgcattgttgaagcactggaaa

SEQ ID NO: 25114 - DNA, 25 bp, E. coli
gcccgcattgttcaagcactggaaa

SEQ ID NO: 25115 - DNA, 25 bp, E. coli
cattcgtgaggcatatggtccggca

SEQ ID NO: 25116 - DNA, 25 bp, E. coli
cattcgtgaggcttatggtccggca

SEQ ID NO: 25117 - DNA, 25 bp, E. coli
tggaaaactcctagcagagcgcggt

SEQ ID NO: 25118 - DNA, 25 bp, E. coli
tggaaaactccttgcagagcgcggt

SEQ ID NO: 25119 - DNA, 25 bp, E. coli
gaccaggttcactgcaatacgcggg

SEQ ID NO: 25120 - DNA, 25 bp, E. coli
gaccaggttcacagcaatacgcggg

SEQ ID NO: 25121 - DNA, 25 bp, E. coli
actattgtttattcctgggcgggca

SEQ ID NO: 25122 - DNA, 25 bp, E. coli
actattgtttatacctgggcgggca

SEQ ID NO: 25123 - DNA, 25 bp, E. coli
tttttatcgccaccgggcttggtca

SEQ ID NO: 25124 - DNA, 25 bp, E. coli
tttttatcgccagcgggcttggtca

SEQ ID NO: 25125 - DNA, 25 bp, E. coli
tttatcgccagagtgatgggccgcg

SEQ ID NO: 25126 - DNA, 25 bp, E. coli
tttatcgccagactgatgggccgcg

SEQ ID NO: 25127 - DNA, 25 bp, E. coli
tgcttcccggcgtccatgagtttat

SEQ ID NO: 25128 - DNA, 25 bp, E. coli
tgcttcccggcgaccatgagtttat

SEQ ID NO: 25129 - DNA, 25 bp, E. coli
gctttattcagtcttacggcgcact

SEQ ID NO: 25130 - DNA, 25 bp, E. coli
gctttattcagtgttacggcgcact

SEQ ID NO: 25131 - DNA, 25 bp, E. coli
gctatgctgccggtttgacttcaat

SEQ ID NO: 25132 - DNA, 25 bp, E. coli
gctatgctgccgctttgacttcaat

SEQ ID NO: 25133 - DNA, 25 bp, E. coli
gactgtttattcagtttgccctgac

SEQ ID NO: 25134 - DNA, 25 bp, E. coli
gactgtttattctgtttgccctgac

SEQ ID NO: 25135 - DNA, 25 bp, E. coli
cgggcagcatgtaaacaggcggtac

SEQ ID NO: 25136 - DNA, 25 bp, E. coli
cgggcagcatgttaacaggcggtac

SEQ ID NO: 25137 - DNA, 25 bp, E. coli
gatcacctttgcgaatgcgtcgctg

SEQ ID NO: 25138 - DNA, 25 bp, E. coli
gatcacctttgccaatgcgtcgctg

SEQ ID NO: 25139 - DNA, 25 bp, E. coli
tggaccaacagggtatagaacgctt

SEQ ID NO: 25140 - DNA, 25 bp, E. coli
tggaccaacaggctatagaacgctt

SEQ ID NO: 25141 - DNA, 25 bp, E. coli
gagtttatcaatcgcagcgttgcgg

SEQ ID NO: 25142 - DNA, 25 bp, E. coli
gagtttatcaatggcagcgttgcgg

SEQ ID NO: 25143 - DNA, 25 bp, E. coli
caatcaaatagctgtgggacaggcg

SEQ ID NO: 25144 - DNA, 25 bp, E. coli
caagttgtaaatttagccgcgccgg

SEQ ID NO: 25145 - DNA, 25 bp, E. coli
caatattccggtcgtcaaagaagcc

SEQ ID NO: 25146 - DNA, 25 bp, E. coli
caatcaaatagcagtgggacaggcg

SEQ ID NO: 25147 - DNA, 25 bp, E. coli
caatattccggtggtcaaagaagcc

SEQ ID NO: 25148 - DNA, 25 bp, E. coli
caagttgtaaatatagccgcgccgg

SEQ ID NO: 25149 - DNA, 25 bp, E. coli
caaagaaaccggcacattgctgggc

SEQ ID NO: 25150 - DNA, 25 bp, E. coli
caaagaaaccgggacattgctgggc

SEQ ID NO: 25151 - DNA, 25 bp, E. coli
tatacgctgctggaagagatggcca

SEQ ID NO: 25152 - DNA, 25 bp, E. coli
tatacgctgctgcaagagatggcca

SEQ ID NO: 25153 - DNA, 25 bp, E. coli
ttaaaacctggtatcacgctgcgcc

SEQ ID NO: 25154 - DNA, 25 bp, E. coli
ttaaaacctggtttcacgctgcgcc

SEQ ID NO: 25155 - DNA, 25 bp, E. coli
tgtgccgaagaataactgattgccg

SEQ ID NO: 25156 - DNA, 25 bp, E. coli
tgtgccgaagaaaaactgattgccg

SEQ ID NO: 25157 - DNA, 25 bp, E. coli
tgacagacccagaaatgaacgtgcg

SEQ ID NO: 25158 - DNA, 25 bp, E. coli
tgacagacccagtaatgaacgtgcg

SEQ ID NO: 25159 - DNA, 25 bp, E. coli
gcgaccggacaaacactggctttaa

SEQ ID NO: 25160 - DNA, 25 bp, E. coli
gcgaccggacaatcactggctttaa

SEQ ID NO: 25161 - DNA, 25 bp, E. coli
gattactttggcaggcgcaccatcg

SEQ ID NO: 25162 - DNA, 25 bp, E. coli
gattactttggctggcgcaccatcg

SEQ ID NO: 25163 - DNA, 25 bp, E. coli
tcaacaaaaactggcaactggcgtg

SEQ ID NO: 25164 - DNA, 25 bp, E. coli
tcaacaaaaactcgcaactggcgtg

SEQ ID NO: 25165 - DNA, 25 bp, E. coli
tactttcgtcacagaacattcctcc

SEQ ID NO: 25166 - DNA, 25 bp, E. coli
tactttcgtcactgaacattcctcc

SEQ ID NO: 25167 - DNA, 25 bp, E. coli
acagaacattcctccattcgcgtgg

SEQ ID NO: 25168 - DNA, 25 bp, E. coli
acagaacattccaccattcgcgtgg

SEQ ID NO: 25169 - DNA, 25 bp, E. coli
tgaattgtatataacctttttcgcg

SEQ ID NO: 25170 - DNA, 25 bp, E. coli
tgaattgtatattacctttttcgcg

SEQ ID NO: 25171 - DNA, 25 bp, E. coli
tctgacgcgacaagctgcgagtgac

SEQ ID NO: 25172 - DNA, 25 bp, E. coli
tctgacgcgacatgctgcgagtgac

SEQ ID NO: 25173 - DNA, 25 bp, E. coli
ccgacattctgaggcgacatgctgc

SEQ ID NO: 25174 - DNA, 25 bp, E. coli
ccgacattctgacgcgacatgctgc

SEQ ID NO: 25175 - DNA, 25 bp, E. coli
cggctattacaatagtccacagcac

SEQ ID NO: 25176 - DNA, 25 bp, E. coli
cggctattacaaaagtccacagcac

SEQ ID NO: 25177 - DNA, 25 bp, E. coli
cttccgcggctattacaaaagtcca

SEQ ID NO: 25178 - DNA, 25 bp, E. coli
cttccgcggctaatacaaaagtcca

SEQ ID NO: 25179 - DNA, 25 bp, E. coli
gatttcctcaattctttcgtcacag

SEQ ID NO: 25180 - DNA, 25 bp, E. coli
gatttcctcaatactttcgtcacag

SEQ ID NO: 25181 - DNA, 25 bp, E. coli
ggatgatttcctcaatactttcgtc

SEQ ID NO: 25182 - DNA, 25 bp, E. coli
ggatgatttcctgaatactttcgtc

SEQ ID NO: 25183 - DNA, 25 bp, E. coli
taacgtcgctgaattgtatattacc

SEQ ID NO: 25184 - DNA, 25 bp, E. coli
taacgtcgctgatttgtatattacc

SEQ ID NO: 25185 - DNA, 25 bp, E. coli
gacgcgacatgcagcgagtgacagc

SEQ ID NO: 25186 - DNA, 25 bp, E. coli
gacgcgacatgctgcgagtgacagc

SEQ ID NO: 25187 - DNA, 25 bp, E. coli
aaatgattgctttggatgccattca

SEQ ID NO: 25188 - DNA, 25 bp, E. coli
aaatgattgcttaggatgccattca

SEQ ID NO: 25189 - DNA, 25 bp, E. coli
tttccagtgaaattgcgcgtgtcat

SEQ ID NO: 25190 - DNA, 25 bp, E. coli
tttccagtgaaaatgcgcgtgtcat

SEQ ID NO: 25191 - DNA, 25 bp, E. coli
tgtttccagtgaaaatgcgcgtgtc

SEQ ID NO: 25192 - DNA, 25 bp, E. coli
tgtttccagtgataatgcgcgtgtc

SEQ ID NO: 25193 - DNA, 25 bp, E. coli
tccagtgaaaatgcgcgtgtcattt

SEQ ID NO: 25194 - DNA, 25 bp, E. coli
tccagtgaaaatccgcgtgtcattt

SEQ ID NO: 25195 - DNA, 25 bp, E. coli
gctttggatgccattcatttaggca

SEQ ID NO: 25196 - DNA, 25 bp, E. coli
gctttggatgcctttcatttaggca

SEQ ID NO: 25197 - DNA, 25 bp, E. coli
gaattgtttccagtgaaaatgcgcg

SEQ ID NO: 25198 - DNA, 25 bp, E. coli
gaattgtttccactgaaaatgcgcg

SEQ ID NO: 25199 - DNA, 25 bp, E. coli
gaaaaaatgattcctttggatgcca

SEQ ID NO: 25200 - DNA, 25 bp, E. coli
gaaaaaatgattgctttggatgcca

SEQ ID NO: 25201 - DNA, 25 bp, E. coli
gattgctttggaagccattcattta

SEQ ID NO: 25202 - DNA, 25 bp, E. coli
gtttccagtgaaaatgcgcgtgtca

SEQ ID NO: 25203 - DNA, 25 bp, E. coli
gattgctttggatgccattcattta

SEQ ID NO: 25204 - DNA, 25 bp, E. coli
gtttccagtgaatatgcgcgtgtca

SEQ ID NO: 25205 - DNA, 25 bp, E. coli
tggatgccattcatttaggcaaagt

SEQ ID NO: 25206 - DNA, 25 bp, E. coli
tggatgccattcttttaggcaaagt

SEQ ID NO: 25207 - DNA, 25 bp, E. coli
gagcgaattgttaccagtgaaaatg

SEQ ID NO: 25208 - DNA, 25 bp, E. coli
gagcgaattgtttccagtgaaaatg

SEQ ID NO: 25209 - DNA, 25 bp, E. coli
taagggcaagaatcgactgggctac

SEQ ID NO: 25210 - DNA, 25 bp, E. coli
taagggcaagaaacgactgggctac

SEQ ID NO: 25211 - DNA, 25 bp, E. coli
caaaggatccaacacgtcatgcaag

SEQ ID NO: 25212 - DNA, 25 bp, E. coli
caaaggatccaagacgtcatgcaag

SEQ ID NO: 25213 - DNA, 25 bp, E. coli
tgcccgttcgaggacaaaggatcca

SEQ ID NO: 25214 - DNA, 25 bp, E. coli
tgcccgttcgagcacaaaggatcca

SEQ ID NO: 25215 - DNA, 25 bp, E. coli
tctgcgtaaaaactgggagtcggtc

SEQ ID NO: 25216 - DNA, 25 bp, E. coli
tctacagcaccaccgatgactacgg

SEQ ID NO: 25217 - DNA, 25 bp, E. coli
tctgcgtaaaaagtgggagtcggtc

SEQ ID NO: 25218 - DNA, 25 bp, E. coli
tctacagcaccagcgatgactacgg

SEQ ID NO: 25219 - DNA, 25 bp, E. coli
gcgatcgttctatgcctctgcgtaa

SEQ ID NO: 25220 - DNA, 25 bp, E. coli
gcgatcgttctaagcctctgcgtaa

SEQ ID NO: 25221 - DNA, 25 bp, E. coli
gaaaaataccgcgaagagatccgtc

SEQ ID NO: 25222 - DNA, 25 bp, E. coli
gaaaaataccgccaagagatccgtc

SEQ ID NO: 25223 - DNA, 25 bp, E. coli
cctggcccatcatggttgacgggaa

SEQ ID NO: 25224 - DNA, 25 bp, E. coli
cctggcccatcaaggttgacgggaa

SEQ ID NO: 25225 - DNA, 25 bp, E. coli
gatttttctaactttgccgcctggc

SEQ ID NO: 25226 - DNA, 25 bp, E. coli
gatttttctaacattgccgcctggc

SEQ ID NO: 25227 - DNA, 25 bp, E. coli
ggaaaacctggcctacctcagaaca

SEQ ID NO: 25228 - DNA, 25 bp, E. coli
ggaaaacctggcgtacctcagaaca

SEQ ID NO: 25229 - DNA, 25 bp, E. coli
gagttgcgcgaagaattggctatag

SEQ ID NO: 25230 - DNA, 25 bp, E. coli
gagttgcgcgaacaattggctatag

SEQ ID NO: 25231 - DNA, 25 bp, E. coli
actggaggcgggtttactggtgact

SEQ ID NO: 25232 - DNA, 25 bp, E. coli
actggaggcgggattactggtgact

SEQ ID NO: 25233 - DNA, 25 bp, E. coli
tattgcggctgaagttctgaggctg

SEQ ID NO: 25234 - DNA, 25 bp, E. coli
tattgcggctgatgttctgaggctg

SEQ ID NO: 25235 - DNA, 25 bp, E. coli
ttctgaggctgagaaaggccggaat

SEQ ID NO: 25236 - DNA, 25 bp, E. coli
ttctgaggctgacaaaggccggaat

SEQ ID NO: 25237 - DNA, 25 bp, E. coli
tgagaaaggccggaatgccggtggt

SEQ ID NO: 25238 - DNA, 25 bp, E. coli
tgagaaaggccgcaatgccggtggt

SEQ ID NO: 25239 - DNA, 25 bp, E. coli
tactgttttacagaacggaacgaat

SEQ ID NO: 25240 - DNA, 25 bp, E. coli
tactgttttacacaacggaacgaat

SEQ ID NO: 25241 - DNA, 25 bp, E. coli
gctgcttacccgaacaccgcaattg

SEQ ID NO: 25242 - DNA, 25 bp, E. coli
gctgcttacccgtacaccgcaattg

SEQ ID NO: 25243 - DNA, 25 bp, E. coli
ccgtacaccgcatttgattgccgcg

SEQ ID NO: 25244 - DNA, 25 bp, E. coli
ccgtacaccgcaattgattgccgcg

SEQ ID NO: 25245 - DNA, 25 bp, E. coli
ctgatgttctgaggctgagaaaggc

SEQ ID NO: 25246 - DNA, 25 bp, E. coli
cttacccgtacaccgcaattgattg

SEQ ID NO: 25247 - DNA, 25 bp, E. coli
cttacccgtacagcgcaattgattg

SEQ ID NO: 25248 - DNA, 25 bp, E. coli
cggctgatgttctgaggctgagaaa

SEQ ID NO: 25249 - DNA, 25 bp, E. coli
cggctgatgttcagaggctgagaaa

SEQ ID NO: 25250 - DNA, 25 bp, E. coli
ctgatgttctgacgctgagaaaggc

SEQ ID NO: 25251 - DNA, 25 bp, E. coli
gataaatactgtattacagaacgga

SEQ ID NO: 25252 - DNA, 25 bp, E. coli
gataaatactgttttacagaacgga

SEQ ID NO: 25253 - DNA, 25 bp, E. coli
caaattcgctgtcgtggagctggac

SEQ ID NO: 25254 - DNA, 25 bp, E. coli
caaattcgctgtggtggagctggac

SEQ ID NO: 25255 - DNA, 25 bp, E. coli
cacatcatcgtttcacaggagagca

SEQ ID NO: 25256 - DNA, 25 bp, E. coli
cacatcatcgttacacaggagagca

SEQ ID NO: 25257 - DNA, 25 bp, E. coli
catcgtcaatggtcgagtccgcaaa

SEQ ID NO: 25258 - DNA, 25 bp, E. coli
catcgtcaatggacgagtccgcaaa

SEQ ID NO: 25259 - DNA, 25 bp, E. coli
actgacactcgagggtaaaacctgg

SEQ ID NO: 25260 - DNA, 25 bp, E. coli
actgacactcgacggtaaaacctgg

SEQ ID NO: 25261 - DNA, 25 bp, E. coli
tgatgacattactagacgccaccgg

SEQ ID NO: 25262 - DNA, 25 bp, E. coli
tgatgacattacaagacgccaccgg

SEQ ID NO: 25263 - DNA, 25 bp, E. coli
tctggtgccgcatggtacgctaatc

SEQ ID NO: 25264 - DNA, 25 bp, E. coli
tctggtgccgcaaggtacgctaatc

SEQ ID NO: 25265 - DNA, 25 bp, E. coli
gcaccgtcgtagaggaaggcaaaca

SEQ ID NO: 25266 - DNA, 25 bp, E. coli
gcaccgtcgtagtggaaggcaaaca

SEQ ID NO: 25267 - DNA, 25 bp, E. coli
cccgcctggttgtagcattactgga

SEQ ID NO: 25268 - DNA, 25 bp, E. coli
cccgcctggttgaagcattactgga

SEQ ID NO: 25269 - DNA, 25 bp, E. coli
ggtgccgttatcgaccacatcatcg

SEQ ID NO: 25270 - DNA, 25 bp, E. coli
ggtgccgttatccaccacatcatcg

SEQ ID NO: 25271 - DNA, 25 bp, E. coli
ggaatctggtgttcgcgacctgaca

SEQ ID NO: 25272 - DNA, 25 bp, E. coli
ggcgagctgcaacctgaccatattg

SEQ ID NO: 25273 - DNA, 25 bp, E. coli
ggcgagctgcaagctgaccatattg

SEQ ID NO: 25274 - DNA, 25 bp, E. coli
ggaatctggtgtacgcgacctgaca

SEQ ID NO: 25275 - DNA, 25 bp, E. coli
aacgttatcgcgttcatcacgatga

SEQ ID NO: 25276 - DNA, 25 bp, E. coli
acaggtgcgtctggtttggtatatc

SEQ ID NO: 25277 - DNA, 25 bp, E. coli
aacgttatcgcgatcatcacgatga

SEQ ID NO: 25278 - DNA, 25 bp, E. coli
acaggtgcgtctcgtttggtatatc

SEQ ID NO: 25279 - DNA, 25 bp, E. coli
tacgcgcgttgtaagtggtactgcg

SEQ ID NO: 25280 - DNA, 25 bp, E. coli
tacgcgcgttgttagtggtactgcg

SEQ ID NO: 25281 - DNA, 25 bp, E. coli
tatttctcatcactacgcgcgttgt

SEQ ID NO: 25282 - DNA, 25 bp, E. coli
tatttctcatcagtacgcgcgttgt

SEQ ID NO: 25283 - DNA, 25 bp, E. coli
tttgcattgttaacatggcgcgcta

SEQ ID NO: 25284 - DNA, 25 bp, E. coli
tttattcgccgctgtgagcgggtgc

SEQ ID NO: 25285 - DNA, 25 bp, E. coli
tttattcgccgcagtgagcgggtgc

SEQ ID NO: 25286 - DNA, 25 bp, E. coli
tttgcattgttatcatggcgcgcta

SEQ ID NO: 25287 - DNA, 25 bp, E. coli
gggcttttttacgtcacatggccaa

SEQ ID NO: 25288 - DNA, 25 bp, E. coli
tggccaacccaacaaacaggtgcgt

SEQ ID NO: 25289 - DNA, 25 bp, E. coli
tggccaacccaagaaacaggtgcgt

SEQ ID NO: 25290 - DNA, 25 bp, E. coli
ggtactgcgtaagtgcgatccattg

SEQ ID NO: 25291 - DNA, 25 bp, E. coli
ggtactgcgtaactgcgatccattg

SEQ ID NO: 25292 - DNA, 25 bp, E. coli
gggcttttttacctcacatggccaa

SEQ ID NO: 25293 - DNA, 25 bp, E. coli
ggcagtttattcagaccagcgcatt

SEQ ID NO: 25294 - DNA, 25 bp, E. coli
ggcagtttattctgaccagcgcatt

SEQ ID NO: 25295 - DNA, 25 bp, E. coli
taagcaccgtcggattattttgggc

SEQ ID NO: 25296 - DNA, 25 bp, E. coli
taagcaccgtcgcattattttgggc

SEQ ID NO: 25297 - DNA, 25 bp, E. coli
cacaaaggcattggcggtggagaca

SEQ ID NO: 25298 - DNA, 25 bp, E. coli
cacaaaggcattcgcggtggagaca

SEQ ID NO: 25299 - DNA, 25 bp, E. coli
tagtagttttgcgacagcgccagac

SEQ ID NO: 25300 - DNA, 25 bp, E. coli
taccgtacgctgattgacgggcgac

SEQ ID NO: 25301 - DNA, 25 bp, E. coli
taccgtacgctgtttgacgggcgac

SEQ ID NO: 25302 - DNA, 25 bp, E. coli
tagtagttttgccacagcgccagac

SEQ ID NO: 25303 - DNA, 25 bp, E. coli
tgtaagtggacaacacgccctgagc

SEQ ID NO: 25304 - DNA, 25 bp, E. coli
tgtaagtggacatcacgccctgagc

SEQ ID NO: 25305 - DNA, 25 bp, E. coli
tgaccacggaagaactggctgcggt

SEQ ID NO: 25306 - DNA, 25 bp, E. coli
tgaccacggaagtactggctgcggt

SEQ ID NO: 25307 - DNA, 25 bp, E. coli
tcgatgttcatgctgtccgggcgaa

SEQ ID NO: 25308 - DNA, 25 bp, E. coli
tcgatgttcatggtgtccgggcgaa

SEQ ID NO: 25309 - DNA, 25 bp, E. coli
gacaaaggtgtagctcggcatgatc

SEQ ID NO: 25310 - DNA, 25 bp, E. coli
gacaaaggtgtacctcggcatgatc

SEQ ID NO: 25311 - DNA, 25 bp, E. coli
gtatatttatcgtcctgaccacgga

SEQ ID NO: 25312 - DNA, 25 bp, E. coli
gatcggacatcatatagctggagcc

SEQ ID NO: 25313 - DNA, 25 bp, E. coli
gtatatttatcgacctgaccacgga

SEQ ID NO: 25314 - DNA, 25 bp, E. coli
gatcggacatcaaatagctggagcc

SEQ ID NO: 25315 - DNA, 25 bp, E. coli
tggtttcatggatgctaaagcagcc

SEQ ID NO: 25316 - DNA, 25 bp, E. coli
tggtttcatggaagctaaagcagcc

SEQ ID NO: 25317 - DNA, 25 bp, E. coli
taatggtgtccaattcgcaggccac

SEQ ID NO: 25318 - DNA, 25 bp, E. coli
taatggtgtccatttcgcaggccac

SEQ ID NO: 25319 - DNA, 25 bp, E. coli
aaccggctctgatacgactaacgtg

SEQ ID NO: 25320 - DNA, 25 bp, E. coli
caaacggcgcttattcaggcgttcg

SEQ ID NO: 25321 - DNA, 25 bp, E. coli
caaacggcgctttttcaggcgttcg

SEQ ID NO: 25322 - DNA, 25 bp, E. coli
attctcgacgctgcgctgaccgaag

SEQ ID NO: 25323 - DNA, 25 bp, E. coli
attctcgacgctccgctgaccgaag

SEQ ID NO: 25324 - DNA, 25 bp, E. coli
aaccggctctgaaacgactaacgtg

SEQ ID NO: 25325 - DNA, 25 bp, E. coli
tatcgatgcggtaagcgggcgcaaa

SEQ ID NO: 25326 - DNA, 25 bp, E. coli
tatcgatgcggttagcgggcgcaaa

SEQ ID NO: 25327 - DNA, 25 bp, E. coli
tgcaaagtgaattgcaaacggcgct

SEQ ID NO: 25328 - DNA, 25 bp, E. coli
tgcaaagtgaatagcaaacggcgct

SEQ ID NO: 25329 - DNA, 25 bp, E. coli
tctgaaacgactaacgtgacggtga

SEQ ID NO: 25330 - DNA, 25 bp, E. coli
tctgaaacgacttacgtgacggtga

SEQ ID NO: 25331 - DNA, 25 bp, E. coli
gccggatgtcgcgattctcgacgct

SEQ ID NO: 25332 - DNA, 25 bp, E. coli
gccggatgtcgccattctcgacgct

SEQ ID NO: 25333 - DNA, 25 bp, E. coli
ccagcgccgggcatgggttatgcca

SEQ ID NO: 25334 - DNA, 25 bp, E. coli
ccagcgccgggcttgggttatgcca

SEQ ID NO: 25335 - DNA, 25 bp, E. coli
cgcggtgagcagttgtgggcagcaa

SEQ ID NO: 25336 - DNA, 25 bp, E. coli
cgcggtgagcagatgtgggcagcaa

SEQ ID NO: 25337 - DNA, 25 bp, E. coli
ccgggcttgggtaatgccacgcgat

SEQ ID NO: 25338 - DNA, 25 bp, E. coli
ccgggcttgggttatgccacgcgat

SEQ ID NO: 25339 - DNA, 25 bp, E. coli
taacgtgacggtgattatcgatgcg

SEQ ID NO: 25340 - DNA, 25 bp, E. coli
taacgtgacggtcattatcgatgcg

SEQ ID NO: 25341 - DNA, 25 bp, E. coli
cagacccgctggagtttgagaaaaa

SEQ ID NO: 25342 - DNA, 25 bp, E. coli
cagacccgctggtgtttgagaaaaa

SEQ ID NO: 25343 - DNA, 25 bp, E. coli
acgctaccgttgagccgggagcacc

SEQ ID NO: 25344 - DNA, 25 bp, E. coli
acgctaccgttgtgccgggagcacc

SEQ ID NO: 25345 - DNA, 25 bp, E. coli
aaaaatattgcgctgccacttcacg

SEQ ID NO: 25346 - DNA, 25 bp, E. coli
aaaaatattgcggtgccacttcacg

SEQ ID NO: 25347 - DNA, 25 bp, E. coli
acaacgaacttcatgcagacccgct

SEQ ID NO: 25348 - DNA, 25 bp, E. coli
acaacgaacttcttgcagacccgct

SEQ ID NO: 25349 - DNA, 25 bp, E. coli
tataccgtgagagtgacatcgtacc

SEQ ID NO: 25350 - DNA, 25 bp, E. coli
tataccgtgagactgacatcgtacc

SEQ ID NO: 25351 - DNA, 25 bp, E. coli
tgtggtaagcctgctgacgatccgc

SEQ ID NO: 25352 - DNA, 25 bp, E. coli
tgtggtaagcctcctgacgatccgc

SEQ ID NO: 25353 - DNA, 25 bp, E. coli
tgaatcgttcatcaggcggcctaaa

SEQ ID NO: 25354 - DNA, 25 bp, E. coli
tgaatcgttcatgaggcggcctaaa

SEQ ID NO: 25355 - DNA, 25 bp, E. coli
ccatttttcagccacgaacgagtga

SEQ ID NO: 25356 - DNA, 25 bp, E. coli
ccatttttcagcgacgaacgagtga

SEQ ID NO: 25357 - DNA, 25 bp, E. coli
gaaaaagtacgggtctcagattgag

SEQ ID NO: 25358 - DNA, 25 bp, E. coli
gaaaaagtacggctctcagattgag

SEQ ID NO: 25359 - DNA, 25 bp, E. coli
cggttgtcagtaacgccgttgatcc

SEQ ID NO: 25360 - DNA, 25 bp, E. coli
cggttgtcagtatcgccgttgatcc

SEQ ID NO: 25361 - DNA, 25 bp, E. coli
gttactgcgccaagttaaatcctgc

SEQ ID NO: 25362 - DNA, 25 bp, E. coli
gttactgcgccatgttaaatcctgc

SEQ ID NO: 25363 - DNA, 25 bp, E. coli
catcagcacggtgcctgtgccggat

SEQ ID NO: 25364 - DNA, 25 bp, E. coli
catcagcacggtccctgtgccggat

SEQ ID NO: 25365 - DNA, 25 bp, E. coli
tatccggcctacatagtgcataaat

SEQ ID NO: 25366 - DNA, 25 bp, E. coli
tatccggcctacttagtgcataaat

SEQ ID NO: 25367 - DNA, 25 bp, E. coli
tattgcatataaattcacttgatgg

SEQ ID NO: 25368 - DNA, 25 bp, E. coli
tattgcatataatttcacttgatgg

SEQ ID NO: 25369 - DNA, 25 bp, E. coli
ttcacttgatgggattgttatccca

SEQ ID NO: 25370 - DNA, 25 bp, E. coli
ttcacttgatggcattgttatccca

SEQ ID NO: 25371 - DNA, 25 bp, E. coli
tgaagacggacaacccactaagttg

SEQ ID NO: 25372 - DNA, 25 bp, E. coli
tgaagacggacatcccactaagttg

SEQ ID NO: 25373 - DNA, 25 bp, E. coli
tcttataatgaagacggacaaccca

SEQ ID NO: 25374 - DNA, 25 bp, E. coli
tcttataatgaacacggacaaccca

SEQ ID NO: 25375 - DNA, 25 bp, E. coli
gcatcagacatcagcacggtgcctg

SEQ ID NO: 25376 - DNA, 25 bp, E. coli
gcattgttatcccatgccgcagaca

SEQ ID NO: 25377 - DNA, 25 bp, E. coli
gcattgttatccgatgccgcagaca

SEQ ID NO: 25378 - DNA, 25 bp, E. coli
gcatcagacatctgcacggtgcctg

SEQ ID NO: 25379 - DNA, 25 bp, E. coli
gacaacccactaagttgtccgtctt

SEQ ID NO: 25380 - DNA, 25 bp, E. coli
gacaacccactatgttgtccgtctt

SEQ ID NO: 25381 - DNA, 25 bp, E. coli
cgtcgcatcagagatcagcacggtg

SEQ ID NO: 25382 - DNA, 25 bp, E. coli
cgtcgcatcagacatcagcacggtg

SEQ ID NO: 25383 - DNA, 25 bp, E. coli
ggcctacatagtccataaattctta

SEQ ID NO: 25384 - DNA, 25 bp, E. coli
ggcctacatagtgcataaattctta

SEQ ID NO: 25385 - DNA, 25 bp, E. coli
caatctacaaatcgatggataacgg

SEQ ID NO: 25386 - DNA, 25 bp, E. coli
caatctacaaatggatggataacgg

SEQ ID NO: 25387 - DNA, 25 bp, E. coli
aaactactacgaaaaagctgatggg

SEQ ID NO: 25388 - DNA, 25 bp, E. coli
aaactactacgataaagctgatggg

SEQ ID NO: 25389 - DNA, 25 bp, E. coli
actgttcgcgtttctgttgtggccg

SEQ ID NO: 25390 - DNA, 25 bp, E. coli
aaaaaatcgctcttgcatcaaacgg

SEQ ID NO: 25391 - DNA, 25 bp, E. coli
aaaaaatcgctcatgcatcaaacgg

SEQ ID NO: 25392 - DNA, 25 bp, E. coli
actgttcgcgttactgttgtggccg

SEQ ID NO: 25393 - DNA, 25 bp, E. coli
ttgcctcgcacagaatataccggcg

SEQ ID NO: 25394 - DNA, 25 bp, E. coli
ttgcctcgcacacaatataccggcg

SEQ ID NO: 25395 - DNA, 25 bp, E. coli
tggtgtcagccaaagagcaatctac

SEQ ID NO: 25396 - DNA, 25 bp, E. coli
tggtgtcagccatagagcaatctac

SEQ ID NO: 25397 - DNA, 25 bp, E. coli
tgaaccagaaaacacttgaagatgt

SEQ ID NO: 25398 - DNA, 25 bp, E. coli
tgaaccagaaaagacttgaagatgt

SEQ ID NO: 25399 - DNA, 25 bp, E. coli
gaagatgtaatctaaactgttcgcg

SEQ ID NO: 25400 - DNA, 25 bp, E. coli
gaagatgtaatcaaaactgttcgcg

SEQ ID NO: 25401 - DNA, 25 bp, E. coli
gaatataccggcgaaacaaattacg

SEQ ID NO: 25402 - DNA, 25 bp, E. coli
gaatataccggccaaacaaattacg

SEQ ID NO: 25403 - DNA, 25 bp, E. coli
gataacggtaaaatgcctcgcacag

SEQ ID NO: 25404 - DNA, 25 bp, E. coli
gataacggtaaattgcctcgcacag

SEQ ID NO: 25405 - DNA, 25 bp, E. coli
ggccgacgtttgtggtgtcagccaa

SEQ ID NO: 25406 - DNA, 25 bp, E. coli
ggccgacgtttgaggtgtcagccaa

SEQ ID NO: 25407 - DNA, 25 bp, E. coli
tactgtcttactgcatcaactggtg

SEQ ID NO: 25408 - DNA, 25 bp, E. coli
tactgtcttactccatcaactggtg

SEQ ID NO: 25409 - DNA, 25 bp, E. coli
atctggcaagagttaggcgttccgc

SEQ ID NO: 25410 - DNA, 25 bp, E. coli
atctggcaagagataggcgttccgc

SEQ ID NO: 25411 - DNA, 25 bp, E. coli
tagcgcactgtcaaactccgcaggg

SEQ ID NO: 25412 - DNA, 25 bp, E. coli
tacccggcgaagagctggttacagc

SEQ ID NO: 25413 - DNA, 25 bp, E. coli
tagcgcactgtctaactccgcaggg

SEQ ID NO: 25414 - DNA, 25 bp, E. coli
tacccggcgaagtgctggttacagc

SEQ ID NO: 25415 - DNA, 25 bp, E. coli
tagcggcggcctagattctactgtc

SEQ ID NO: 25416 - DNA, 25 bp, E. coli
tagcggcggccttgattctactgtc

SEQ ID NO: 25417 - DNA, 25 bp, E. coli
tcgaacgtgtgcagcttgcgcaaga

SEQ ID NO: 25418 - DNA, 25 bp, E. coli
tcgaacgtgtgctgcttgcgcaaga

SEQ ID NO: 25419 - DNA, 25 bp, E. coli
ttgccgggcaaaccgaaaccattct

SEQ ID NO: 25420 - DNA, 25 bp, E. coli
tcaggatgatagctacgatcgtaac

SEQ ID NO: 25421 - DNA, 25 bp, E. coli
ttgccgggcaaagcgaaaccattct

SEQ ID NO: 25422 - DNA, 25 bp, E. coli
tcaggatgataggtacgatcgtaac

SEQ ID NO: 25423 - DNA, 25 bp, E. coli
cctgttagatgaactgctggcggat

SEQ ID NO: 25424 - DNA, 25 bp, E. coli
ccaatgctgatgcatgggtgaaaca

SEQ ID NO: 25425 - DNA, 25 bp, E. coli
cctgttagatgatctgctggcggat

SEQ ID NO: 25426 - DNA, 25 bp, E. coli
ccaatgctgatggatgggtgaaaca

SEQ ID NO: 25427 - DNA, 25 bp, E. coli
ggttacagcgcatcatcttgacgat

SEQ ID NO: 25428 - DNA, 25 bp, E. coli
ggttacagcgcaacatcttgacgat

SEQ ID NO: 25429 - DNA, 25 bp, E. coli
caatacgagcaggtcgggcgtttac

SEQ ID NO: 25430 - DNA, 25 bp, E. coli
caatacgagcagctcgggcgtttac

SEQ ID NO: 25431 - DNA, 25 bp, E. coli
cacataatgggtgcgctggcagaaa

SEQ ID NO: 25432 - DNA, 25 bp, E. coli
cacataatgggtccgctggcagaaa

SEQ ID NO: 25433 - DNA, 25 bp, E. coli
cactgatggtctcgaaactggacag

SEQ ID NO: 25434 - DNA, 25 bp, E. coli
cactgatggtctggaaactggacag

SEQ ID NO: 25435 - DNA, 25 bp, E. coli
taaaacccggtgacacactgatggt

SEQ ID NO: 25436 - DNA, 25 bp, E. coli
taaaacccggtgtcacactgatggt

SEQ ID NO: 25437 - DNA, 25 bp, E. coli
tattatcctgcgagcgtttcggaaa

SEQ ID NO: 25438 - DNA, 25 bp, E. coli
tattatcctgcgtgcgtttcggaaa

SEQ ID NO: 25439 - DNA, 25 bp, E. coli
ttaattgtcgaacggacacgggctg

SEQ ID NO: 25440 - DNA, 25 bp, E. coli
ttaattgtcgaagggacacgggctg

SEQ ID NO: 25441 - DNA, 25 bp, E. coli
tgagtggtaaaacgacacagcggcc

SEQ ID NO: 25442 - DNA, 25 bp, E. coli
tgagtggtaaaaggacacagcggcc

SEQ ID NO: 25443 - DNA, 25 bp, E. coli
tgacagatgaataacagcaacaggg

SEQ ID NO: 25444 - DNA, 25 bp, E. coli
tgacagatgaattacagcaacaggg

SEQ ID NO: 25445 - DNA, 25 bp, E. coli
tcgtctcacgcaggaacaatacgag

SEQ ID NO: 25446 - DNA, 25 bp, E. coli
tcgtctcacgcacgaacaatacgag

SEQ ID NO: 25447 - DNA, 25 bp, E. coli
tcagtcgaagacaggtggcacttat

SEQ ID NO: 25448 - DNA, 25 bp, E. coli
tcagtcgaagactggtggcacttat

SEQ ID NO: 25449 - DNA, 25 bp, E. coli
ctgaagcgggcagtgaagaaactaa

SEQ ID NO: 25450 - DNA, 25 bp, E. coli
ctgaagcgggcactgaagaaactaa

SEQ ID NO: 25451 - DNA, 25 bp, E. coli
aattgcgcaacagggtctgttttgc

SEQ ID NO: 25452 - DNA, 25 bp, E. coli
aattgcgcaacacggtctgttttgc

SEQ ID NO: 25453 - DNA, 25 bp, E. coli
tacgtttagaaagatgccgacaacc

SEQ ID NO: 25454 - DNA, 25 bp, E. coli
tacgtttagaaacatgccgacaacc

SEQ ID NO: 25455 - DNA, 25 bp, E. coli
tttgaactctccctataatgcgact

SEQ ID NO: 25456 - DNA, 25 bp, E. coli
tattgttttcgttgacaaattgcgc

SEQ ID NO: 25457 - DNA, 25 bp, E. coli
tattgttttcgtagacaaattgcgc

SEQ ID NO: 25458 - DNA, 25 bp, E. coli
tttgaactctccgtataatgcgact

SEQ ID NO: 25459 - DNA, 25 bp, E. coli
tagttcgggtttgtaccttacgcat

SEQ ID NO: 25460 - DNA, 25 bp, E. coli
tagttcgggtttctaccttacgcat

SEQ ID NO: 25461 - DNA, 25 bp, E. coli
tcctggaaaaataaagtgggcgata

SEQ ID NO: 25462 - DNA, 25 bp, E. coli
tcctggaaaaattaagtgggcgata

SEQ ID NO: 25463 - DNA, 25 bp, E. coli
tttctttagaaattgcgttgactca

SEQ ID NO: 25464 - DNA, 25 bp, E. coli
tttctttagaaaatgcgttgactca

SEQ ID NO: 25465 - DNA, 25 bp, E. coli
gccgacaaccggcaaatcctggaaa

SEQ ID NO: 25466 - DNA, 25 bp, E. coli
gcctgattcctcaatgtagttcggg

SEQ ID NO: 25467 - DNA, 25 bp, E. coli
gccgacaaccgggaaatcctggaaa

SEQ ID NO: 25468 - DNA, 25 bp, E. coli
gcctgattcctctatgtagttcggg

SEQ ID NO: 25469 - DNA, 25 bp, E. coli
gatcatcttgctaaaatttacgacg

SEQ ID NO: 25470 - DNA, 25 bp, E. coli
gatcatcttgcttaaatttacgacg

SEQ ID NO: 25471 - DNA, 25 bp, E. coli
gtgggcgatattctatcactcccgc

SEQ ID NO: 25472 - DNA, 25 bp, E. coli
gtgggcgatattgtatcactcccgc

SEQ ID NO: 25473 - DNA, 25 bp, E. coli
catggtcgatgatgatggcgctccc

SEQ ID NO: 25474 - DNA, 25 bp, E. coli
catggtcgatgaagatggcgctccc

SEQ ID NO: 25475 - DNA, 25 bp, E. coli
tactgataacgtcctggaagcctgc

SEQ ID NO: 25476 - DNA, 25 bp, E. coli
tactgataacgtgctggaagcctgc

SEQ ID NO: 25477 - DNA, 25 bp, E. coli
tatggcgaagccgtatgaagagcac

SEQ ID NO: 25478 - DNA, 25 bp, E. coli
tatggcgaagccctatgaagagcac

SEQ ID NO: 25479 - DNA, 25 bp, E. coli
tatttactggatcgccagcgcgacg

SEQ ID NO: 25480 - DNA, 25 bp, E. coli
tatttactggatggccagcgcgacg

SEQ ID NO: 25481 - DNA, 25 bp, E. coli
tttacgcaggaagtgaaacgctacc

SEQ ID NO: 25482 - DNA, 25 bp, E. coli
ttatcgagaatgttcacctgcgccg

SEQ ID NO: 25483 - DNA, 25 bp, E. coli
tttacgcaggaactgaaacgctacc

SEQ ID NO: 25484 - DNA, 25 bp, E. coli
ttacagctgattccggcagatggcg

SEQ ID NO: 25485 - DNA, 25 bp, E. coli
ttatcgagaatgatcacctgcgccg

SEQ ID NO: 25486 - DNA, 25 bp, E. coli
ttacagctgattgcggcagatggcg

SEQ ID NO: 25487 - DNA, 25 bp, E. coli
gctgctgaaaaacatgctcgccggg

SEQ ID NO: 25488 - DNA, 25 bp, E. coli
gctgctgaaaaagatgctcgccggg

SEQ ID NO: 25489 - DNA, 25 bp, E. coli
gaacgttcttaaccgcctgtggcag

SEQ ID NO: 25490 - DNA, 25 bp, E. coli
gaacgttcttaagcgcctgtggcag

SEQ ID NO: 25491 - DNA, 25 bp, E. coli
cctcgccgggtcagtttgaaatcaa

SEQ ID NO: 25492 - DNA, 25 bp, E. coli
cctcgccgggtctgtttgaaatcaa

SEQ ID NO: 25493 - DNA, 25 bp, E. coli
gatgaccgcaatacacaaagccagg

SEQ ID NO: 25494 - DNA, 25 bp, E. coli
gatgaccgcaattcacaaagccagg

SEQ ID NO: 25495 - DNA, 25 bp, E. coli
catcccgcagtgcataacgctggaa

SEQ ID NO: 25496 - DNA, 25 bp, E. coli
catcccgcagtggataacgctggaa

SEQ ID NO: 25497 - DNA, 25 bp, E. coli
tatggctcctgaagctgacggtgac

SEQ ID NO: 25498 - DNA, 25 bp, E. coli
tatggctcctgatgctgacggtgac

SEQ ID NO: 25499 - DNA, 25 bp, E. coli
tgattgaatatagccatcacgcctg

SEQ ID NO: 25500 - DNA, 25 bp, E. coli
tgattgaatatacccatcacgcctg

SEQ ID NO: 25501 - DNA, 25 bp, E. coli
tgagcgtaacgcaggtacccgatga

SEQ ID NO: 25502 - DNA, 25 bp, E. coli
tgaacagcatatccgcttctggccg

SEQ ID NO: 25503 - DNA, 25 bp, E. coli
tgagcgtaacgctggtacccgatga

SEQ ID NO: 25504 - DNA, 25 bp, E. coli
tgaacagcatatgcgcttctggccg

SEQ ID NO: 25505 - DNA, 25 bp, E. coli
tcagcaatggcggagcgtttatggc

SEQ ID NO: 25506 - DNA, 25 bp, E. coli
gaatgcgatgccttgacggagcact

SEQ ID NO: 25507 - DNA, 25 bp, E. coli
gaatgcgatgccatgacggagcact

SEQ ID NO: 25508 - DNA, 25 bp, E. coli
gaaccgcgcattttcgcctggatgg

SEQ ID NO: 25509 - DNA, 25 bp, E. coli
gaaccgcgcattatcgcctggatgg

SEQ ID NO: 25510 - DNA, 25 bp, E. coli
gataaatggcatatgctcaacggca

SEQ ID NO: 25511 - DNA, 25 bp, E. coli
gataaatggcatttgctcaacggca

SEQ ID NO: 25512 - DNA, 25 bp, E. coli
ggaccgcttctgtgatgagtactgc

SEQ ID NO: 25513 - DNA, 25 bp, E. coli
ggaccgcttctgagatgagtactgc

SEQ ID NO: 25514 - DNA, 25 bp, E. coli
tggtccttttactcgctcagcaatg

SEQ ID NO: 25515 - DNA, 25 bp, E. coli
tggtccttttacacgctcagcaatg

SEQ ID NO: 25516 - DNA, 25 bp, E. coli
tcagcaatggcgcagcgtttatggc

SEQ ID NO: 25517 - DNA, 25 bp, E. coli
aacgccttgccactgccaattaacg

SEQ ID NO: 25518 - DNA, 25 bp, E. coli
atgacgaacgccttgccagtgccaa

SEQ ID NO: 25519 - DNA, 25 bp, E. coli
atgacgaacgccatgccagtgccaa

SEQ ID NO: 25520 - DNA, 25 bp, E. coli
aacgccttgccagtgccaattaacg

SEQ ID NO: 25521 - DNA, 25 bp, E. coli
aacgaaaacgaagtgctggattggc

SEQ ID NO: 25522 - DNA, 25 bp, E. coli
aacgaaaacgaactgctggattggc

SEQ ID NO: 25523 - DNA, 25 bp, E. coli
ttagcgtgccaacttttgttgccac

SEQ ID NO: 25524 - DNA, 25 bp, E. coli
ttcagtgtgcctcgcgtttttgctg

SEQ ID NO: 25525 - DNA, 25 bp, E. coli
ttgccagtgccaattaacgaaaacg

SEQ ID NO: 25526 - DNA, 25 bp, E. coli
ttgccagtgccatttaacgaaaacg

SEQ ID NO: 25527 - DNA, 25 bp, E. coli
ttagcgtgccaagttttgttgccac

SEQ ID NO: 25528 - DNA, 25 bp, E. coli
ttcagtgtgcctggcgtttttgctg

SEQ ID NO: 25529 - DNA, 25 bp, E. coli
tgtttagcgtgcgaagttttgttgc

SEQ ID NO: 25530 - DNA, 25 bp, E. coli
tgttgccacgctcggtttatggagc

SEQ ID NO: 25531 - DNA, 25 bp, E. coli
tgtttagcgtgccaagttttgttgc

SEQ ID NO: 25532 - DNA, 25 bp, E. coli
tgttgccacgctgggtttatggagc

SEQ ID NO: 25533 - DNA, 25 bp, E. coli
gccaagttttgttgccacgctgggt

SEQ ID NO: 25534 - DNA, 25 bp, E. coli
ccacgctgggttaatggagcgccct

SEQ ID NO: 25535 - DNA, 25 bp, E. coli
gccaagttttgtagccacgctgggt

SEQ ID NO: 25536 - DNA, 25 bp, E. coli
ccacgctgggtttatggagcgccct

SEQ ID NO: 25537 - DNA, 25 bp, E. coli
ggcttttgtttcagtgtgcctggcg

SEQ ID NO: 25538 - DNA, 25 bp, E. coli
ggcttttgtttctgtgtgcctggcg

SEQ ID NO: 25539 - DNA, 25 bp, E. coli
catttttgcggtagccatcagtttc

SEQ ID NO: 25540 - DNA, 25 bp, E. coli
catttttgcggttgccatcagtttc

SEQ ID NO: 25541 - DNA, 25 bp, E. coli
cagattgttgagagcgctttattca

SEQ ID NO: 25542 - DNA, 25 bp, E. coli
cagattgttgagtgcgctttattca

SEQ ID NO: 25543 - DNA, 25 bp, E. coli
atcagtttcaaacccgcgtcagtga

SEQ ID NO: 25544 - DNA, 25 bp, E. coli
atcagtttcaaagccgcgtcagtga

SEQ ID NO: 25545 - DNA, 25 bp, E. coli
tatacccaaaagaaagcggcttatc

SEQ ID NO: 25546 - DNA, 25 bp, E. coli
tatacccaaaagtaagcggcttatc

SEQ ID NO: 25547 - DNA, 25 bp, E. coli
tgatgtacgtaaaaaaccgttccgg

SEQ ID NO: 25548 - DNA, 25 bp, E. coli
tgtccacgacactatacccaaaaga

SEQ ID NO: 25549 - DNA, 25 bp, E. coli
tgtccacgacacaatacccaaaaga

SEQ ID NO: 25550 - DNA, 25 bp, E. coli
tgatgtacgtaataaaccgttccgg

SEQ ID NO: 25551 - DNA, 25 bp, E. coli
tgactgtccacgacgctatacccaa

SEQ ID NO: 25552 - DNA, 25 bp, E. coli
tgactgtccacgtcgctatacccaa

SEQ ID NO: 25553 - DNA, 25 bp, E. coli
gctatacccaaaagaaagcggctta

SEQ ID NO: 25554 - DNA, 25 bp, E. coli
gctatacccaaatgaaagcggctta

SEQ ID NO: 25555 - DNA, 25 bp, E. coli
cgttccggcgggtttcagattgttg

SEQ ID NO: 25556 - DNA, 25 bp, E. coli
cgttccggcgggattcagattgttg

SEQ ID NO: 25557 - DNA, 25 bp, E. coli
ggtgcacagggttagatgaataaat

SEQ ID NO: 25558 - DNA, 25 bp, E. coli
ggtgcacagggtaagatgaataaat

SEQ ID NO: 25559 - DNA, 25 bp, E. coli
gagtttttgcttatggtgcacaggg

SEQ ID NO: 25560 - DNA, 25 bp, E. coli
gagtttttgcttttggtgcacaggg

SEQ ID NO: 25561 - DNA, 25 bp, E. coli
caggctcaatgcacggtttacggga

SEQ ID NO: 25562 - DNA, 25 bp, E. coli
caggctcaatgctcggtttacggga

SEQ ID NO: 25563 - DNA, 25 bp, E. coli
cagaacgcgcatcatgagtttttaa

SEQ ID NO: 25564 - DNA, 25 bp, E. coli
cagaacgcgcatgatgagtttttaa

SEQ ID NO: 25565 - DNA, 25 bp, E. coli
tactcagaatggaggacaggctcaa

SEQ ID NO: 25566 - DNA, 25 bp, E. coli
tactcagaatggtggacaggctcaa

SEQ ID NO: 25567 - DNA, 25 bp, E. coli
tgtaaatgatgctgagtaactgccc

SEQ ID NO: 25568 - DNA, 25 bp, E. coli
tgtaaatgatgcagagtaactgccc

SEQ ID NO: 25569 - DNA, 25 bp, E. coli
tctgtaggttttatcgcgttgaccc

SEQ ID NO: 25570 - DNA, 25 bp, E. coli
tctgtaggttttttcgcgttgaccc

SEQ ID NO: 25571 - DNA, 25 bp, E. coli
gccctggcggtcacttctttgagaa

SEQ ID NO: 25572 - DNA, 25 bp, E. coli
gccctggcggtctcttctttgagaa

SEQ ID NO: 25573 - DNA, 25 bp, E. coli
gaaagtatattttttcagaacgcgc

SEQ ID NO: 25574 - DNA, 25 bp, E. coli
gaaagtatatttattcagaacgcgc

SEQ ID NO: 25575 - DNA, 25 bp, E. coli
cgcgttgaccctccttaaggttgag

SEQ ID NO: 25576 - DNA, 25 bp, E. coli
cgcgttgaccctgcttaaggttgag

SEQ ID NO: 25577 - DNA, 25 bp, E. coli
taactgcccacgtttaaaggtggcc

SEQ ID NO: 25578 - DNA, 25 bp, E. coli
taactgcccacgattaaaggtggcc

SEQ ID NO: 25579 - DNA, 25 bp, E. coli
taaggttgagagctttacgacgagc

SEQ ID NO: 25580 - DNA, 25 bp, E. coli
taaggttgagaggtttacgacgagc

SEQ ID NO: 25581 - DNA, 25 bp, E. coli
gagtttttaactgaatgcgaggcta

SEQ ID NO: 25582 - DNA, 25 bp, E. coli
gagtttttaactcaatgcgaggcta

SEQ ID NO: 25583 - DNA, 25 bp, E. coli
caacctgtagcatcagcggtggtaa

SEQ ID NO: 25584 - DNA, 25 bp, E. coli
caacctgtagcaacagcggtggtaa

SEQ ID NO: 25585 - DNA, 25 bp, E. coli
caactatggtcgaaaagaggtgcca

SEQ ID NO: 25586 - DNA, 25 bp, E. coli
caactatggtcgtaaagaggtgcca

SEQ ID NO: 25587 - DNA, 25 bp, E. coli
agcaattgaaacagatgtacccggt

SEQ ID NO: 25588 - DNA, 25 bp, E. coli
agcaattgaaactgatgtacccggt

SEQ ID NO: 25589 - DNA, 25 bp, E. coli
ttcggcttacgcaacattacgggtg

SEQ ID NO: 25590 - DNA, 25 bp, E. coli
ttcggcttacgctacattacgggtg

SEQ ID NO: 25591 - DNA, 25 bp, E. coli
tcgacgacatcatcggcaactatgg

SEQ ID NO: 25592 - DNA, 25 bp, E. coli
tcgacgacatcaacggcaactatgg

SEQ ID NO: 25593 - DNA, 25 bp, E. coli
cgacgacccgtcttccagattggga

SEQ ID NO: 25594 - DNA, 25 bp, E. coli
ccggttttggtatcgagcttcagca

SEQ ID NO: 25595 - DNA, 25 bp, E. coli
cgacgacccgtcatccagattggga

SEQ ID NO: 25596 - DNA, 25 bp, E. coli
ccggttttggtaacgagcttcagca

SEQ ID NO: 25597 - DNA, 25 bp, E. coli
gattttacgcaaaagccgaagctgg

SEQ ID NO: 25598 - DNA, 25 bp, E. coli
gattttacgcaatagccgaagctgg

SEQ ID NO: 25599 - DNA, 25 bp, E. coli
gattgggagatgtccctcacctgga

SEQ ID NO: 25600 - DNA, 25 bp, E. coli
gattgggagatgaccctcacctgga

SEQ ID NO: 25601 - DNA, 25 bp, E. coli
ggccgtaccggttaaagcgagtgat

SEQ ID NO: 25602 - DNA, 25 bp, E. coli
ggccgtaccggtaaaagcgagtgat

SEQ ID NO: 25603 - DNA, 25 bp, E. coli
taaccctgctttgtgtcagtagcgc

SEQ ID NO: 25604 - DNA, 25 bp, E. coli
taaccctgctttctgtcagtagcgc

SEQ ID NO: 25605 - DNA, 25 bp, E. coli
aagacgttgctataccgcgctgaag

SEQ ID NO: 25606 - DNA, 25 bp, E. coli
aagacgttgctaaaccgcgctgaag

SEQ ID NO: 25607 - DNA, 25 bp, E. coli
caaaacatgcagcgcggaaattcgc

SEQ ID NO: 25608 - DNA, 25 bp, E. coli
caaaacatgcagggcggaaattcgc

SEQ ID NO: 25609 - DNA, 25 bp, E. coli
acatctcgacaactatttccgccac

SEQ ID NO: 25610 - DNA, 25 bp, E. coli
acatctcgacaagtatttccgccac

SEQ ID NO: 25611 - DNA, 25 bp, E. coli
tgtcgaagagattaccgattacgtg

SEQ ID NO: 25612 - DNA, 25 bp, E. coli
ttttcatccggtcttcgacgtcgat

SEQ ID NO: 25613 - DNA, 25 bp, E. coli
tgtcgaagagataaccgattacgtg

SEQ ID NO: 25614 - DNA, 25 bp, E. coli
ttttcatccggtgttcgacgtcgat

SEQ ID NO: 25615 - DNA, 25 bp, E. coli
tgttgaagacgttgctaaaccgcgc

SEQ ID NO: 25616 - DNA, 25 bp, E. coli
tgttgaagacgtagctaaaccgcgc

SEQ ID NO: 25617 - DNA, 25 bp, E. coli
gctacacaacgagggcacgtatgtc

SEQ ID NO: 25618 - DNA, 25 bp, E. coli
gctacacaacgacggcacgtatgtc

SEQ ID NO: 25619 - DNA, 25 bp, E. coli
cgacggcacgtaagtcgaagagata

SEQ ID NO: 25620 - DNA, 25 bp, E. coli
cgacggcacgtatgtcgaagagata

SEQ ID NO: 25621 - DNA, 25 bp, E. coli
gtttttcatccgctgttcgacgtcg

SEQ ID NO: 25622 - DNA, 25 bp, E. coli
gtttttcatccggtgttcgacgtcg

SEQ ID NO: 25623 - DNA, 25 bp, E. coli
ggagctacacaacgacggcacgtat

SEQ ID NO: 25624 - DNA, 25 bp, E. coli
ggcacgtatgtccaagagataaccg

SEQ ID NO: 25625 - DNA, 25 bp, E. coli
ggcacgtatgtcgaagagataaccg

SEQ ID NO: 25626 - DNA, 25 bp, E. coli
ggagctacacaaggacggcacgtat

SEQ ID NO: 25627 - DNA, 25 bp, E. coli
caaaaggtgccagaaccgtaggccg

SEQ ID NO: 25628 - DNA, 25 bp, E. coli
caaaaggtgccacaaccgtaggccg

SEQ ID NO: 25629 - DNA, 25 bp, E. coli
catccggcaataagtaatgagcacc

SEQ ID NO: 25630 - DNA, 25 bp, E. coli
catccggcaatatgtaatgagcacc

SEQ ID NO: 25631 - DNA, 25 bp, E. coli
atcaggcctacataaggtgccagaa

SEQ ID NO: 25632 - DNA, 25 bp, E. coli
atcaggcctacaaaaggtgccagaa

SEQ ID NO: 25633 - DNA, 25 bp, E. coli
aaatgtgccagaaccgcgtagggcg

SEQ ID NO: 25634 - DNA, 25 bp, E. coli
aaaacgtaggcaattggcgcatcat

SEQ ID NO: 25635 - DNA, 25 bp, E. coli
aaatgtgccagatccgcgtagggcg

SEQ ID NO: 25636 - DNA, 25 bp, E. coli
aaaacgtaggcatttggcgcatcat

SEQ ID NO: 25637 - DNA, 25 bp, E. coli
tatcaggcctgcaaaatgtgccaga

SEQ ID NO: 25638 - DNA, 25 bp, E. coli
tatcaggcctgctaaatgtgccaga

SEQ ID NO: 25639 - DNA, 25 bp, E. coli
tgcaaaatgtgccagaaccgcgtag

SEQ ID NO: 25640 - DNA, 25 bp, E. coli
tgcaaaatgtgcgagaaccgcgtag

SEQ ID NO: 25641 - DNA, 25 bp, E. coli
ccggcaataagtcctccgatgcctg

SEQ ID NO: 25642 - DNA, 25 bp, E. coli
gcatccggcaataagtgctccgatg

SEQ ID NO: 25643 - DNA, 25 bp, E. coli
gcatccggcaattagtgctccgatg

SEQ ID NO: 25644 - DNA, 25 bp, E. coli
ccggcaataagtgctccgatgcctg

SEQ ID NO: 25645 - DNA, 25 bp, E. coli
ggcaattggcgcttcatgcctgatg

SEQ ID NO: 25646 - DNA, 25 bp, E. coli
ggcaattggcgcatcatgcctgatg

SEQ ID NO: 25647 - DNA, 25 bp, E. coli
taagtaatgagcaccgagactataa

SEQ ID NO: 25648 - DNA, 25 bp, E. coli
taagtaatgagctccgagactataa

SEQ ID NO: 25649 - DNA, 25 bp, E. coli
aagatgtggtcgagacgctctctca

SEQ ID NO: 25650 - DNA, 25 bp, E. coli
aagatgtggtcgtgacgctctctca

SEQ ID NO: 25651 - DNA, 25 bp, E. coli
cagggcgtgatcgtcatccgtactg

SEQ ID NO: 25652 - DNA, 25 bp, E. coli
cagggcgtgatcctcatccgtactg

SEQ ID NO: 25653 - DNA, 25 bp, E. coli
tggtcgtgacgcactctcaccaggg

SEQ ID NO: 25654 - DNA, 25 bp, E. coli
tgaaatcaccgcgaacagcgcagac

SEQ ID NO: 25655 - DNA, 25 bp, E. coli
tgaaatcaccgccaacagcgcagac

SEQ ID NO: 25656 - DNA, 25 bp, E. coli
ccaggaagatgtggtcgtgacgctc

SEQ ID NO: 25657 - DNA, 25 bp, E. coli
ccaggaagatgtcgtcgtgacgctc

SEQ ID NO: 25658 - DNA, 25 bp, E. coli
gcgtgatcctcaaccgtactgcgga

SEQ ID NO: 25659 - DNA, 25 bp, E. coli
gcgtgatcctcatccgtactgcgga

SEQ ID NO: 25660 - DNA, 25 bp, E. coli
cgctctctcaccagggctacgttaa

SEQ ID NO: 25661 - DNA, 25 bp, E. coli
cgctctctcacctgggctacgttaa

SEQ ID NO: 25662 - DNA, 25 bp, E. coli
cgcgatgctcgatcgtgctggcgac

SEQ ID NO: 25663 - DNA, 25 bp, E. coli
cgcgatgctcgaacgtgctggcgac

SEQ ID NO: 25664 - DNA, 25 bp, E. coli
cgttgccgcgatcctcgaacgtgct

SEQ ID NO: 25665 - DNA, 25 bp, E. coli
cgttgccgcgatgctcgaacgtgct

SEQ ID NO: 25666 - DNA, 25 bp, E. coli
gatcctcatccgaactgcggaagat

SEQ ID NO: 25667 - DNA, 25 bp, E. coli
gtgacgctctctcaccagggctacg

SEQ ID NO: 25668 - DNA, 25 bp, E. coli
gtgacgctctctgaccagggctacg

SEQ ID NO: 25669 - DNA, 25 bp, E. coli
tggtcgtgacgctctctcaccaggg

SEQ ID NO: 25670 - DNA, 25 bp, E. coli
gatcctcatccgtactgcggaagat

SEQ ID NO: 25671 - DNA, 25 bp, E. coli
acaacgcagctcaggtctggaacca

SEQ ID NO: 25672 - DNA, 25 bp, E. coli
acaacgcagctctggtctggaacca

SEQ ID NO: 25673 - DNA, 25 bp, E. coli
tatcgtttcaacgtctaacgcgggt

SEQ ID NO: 25674 - DNA, 25 bp, E. coli
tatgctaaagatgctctggcaccgc

SEQ ID NO: 25675 - DNA, 25 bp, E. coli
tatcgtttcaacctctaacgcgggt

SEQ ID NO: 25676 - DNA, 25 bp, E. coli
tatgctaaagatcctctggcaccgc

SEQ ID NO: 25677 - DNA, 25 bp, E. coli
tttctactggaagtgcctggcaccg

SEQ ID NO: 25678 - DNA, 25 bp, E. coli
tttctactggaactgcctggcaccg

SEQ ID NO: 25679 - DNA, 25 bp, E. coli
tgaaggtggcgttttcaacaacgca

SEQ ID NO: 25680 - DNA, 25 bp, E. coli
tgaaggtggcgtattcaacaacgca

SEQ ID NO: 25681 - DNA, 25 bp, E. coli
tctggctggaccaggctggtgaaaa

SEQ ID NO: 25682 - DNA, 25 bp, E. coli
tctggctggacctggctggtgaaaa

SEQ ID NO: 25683 - DNA, 25 bp, E. coli
gactatcgcaatccacgtcctggct

SEQ ID NO: 25684 - DNA, 25 bp, E. coli
gaaaagtcgctgtagctatcgccgc

SEQ ID NO: 25685 - DNA, 25 bp, E. coli
gactatcgcaatgcacgtcctggct

SEQ ID NO: 25686 - DNA, 25 bp, E. coli
gaaaagtcgctgaagctatcgccgc

SEQ ID NO: 25687 - DNA, 25 bp, E. coli
gattattcgcagctctgaaggtggc

SEQ ID NO: 25688 - DNA, 25 bp, E. coli
gattattcgcaggtctgaaggtggc

SEQ ID NO: 25689 - DNA, 25 bp, E. coli
tggtgaaaaacaccgatggcaaact

SEQ ID NO: 25690 - DNA, 25 bp, E. coli
tggtgaaaaacagcgatggcaaact

SEQ ID NO: 25691 - DNA, 25 bp, E. coli
tcaaaaactttggttctggctggac

SEQ ID NO: 25692 - DNA, 25 bp, E. coli
tcaaaaactttgcttctggctggac

SEQ ID NO: 25693 - DNA, 25 bp, E. coli
tactggcattactacacgtttcatg

SEQ ID NO: 25694 - DNA, 25 bp, E. coli
tactggcattacaacacgtttcatg

SEQ ID NO: 25695 - DNA, 25 bp, E. coli
attttgcacattgccagcgtactgg

SEQ ID NO: 25696 - DNA, 25 bp, E. coli
attttgcacattcccagcgtactgg

SEQ ID NO: 25697 - DNA, 25 bp, E. coli
aacggagttttcagagctggcctgc

SEQ ID NO: 25698 - DNA, 25 bp, E. coli
aacggagttttctgagctggcctgc

SEQ ID NO: 25699 - DNA, 25 bp, E. coli
tggtcaacatggtcagaatgtcctc

SEQ ID NO: 25700 - DNA, 25 bp, E. coli
tggtcaacatggacagaatgtcctc

SEQ ID NO: 25701 - DNA, 25 bp, E. coli
tgaacggagttttcagagctggcct

SEQ ID NO: 25702 - DNA, 25 bp, E. coli
tgaacggagtttacagagctggcct

SEQ ID NO: 25703 - DNA, 25 bp, E. coli
tgcgggtgaatctactgaacggagt

SEQ ID NO: 25704 - DNA, 25 bp, E. coli
tgcgggtgaatcaactgaacggagt

SEQ ID NO: 25705 - DNA, 25 bp, E. coli
ccagcgtactgggattacaacacgt

SEQ ID NO: 25706 - DNA, 25 bp, E. coli
ccagcgtactggcattacaacacgt

SEQ ID NO: 25707 - DNA, 25 bp, E. coli
gatttatgaaggatgggcaaatgcg

SEQ ID NO: 25708 - DNA, 25 bp, E. coli
gatttatgaaggttgggcaaatgcg

SEQ ID NO: 25709 - DNA, 25 bp, E. coli
ggtgaatctactgaacggagttttc

SEQ ID NO: 25710 - DNA, 25 bp, E. coli
ggtgaatctactcaacggagttttc

SEQ ID NO: 25711 - DNA, 25 bp, E. coli
ggcaaatgcgggtgaatctactgaa

SEQ ID NO: 25712 - DNA, 25 bp, E. coli
tggcattttgcacattgccagcgta

SEQ ID NO: 25713 - DNA, 25 bp, E. coli
ggcaaatgcgggagaatctactgaa

SEQ ID NO: 25714 - DNA, 25 bp, E. coli
tggcattttgcagattgccagcgta

SEQ ID NO: 25715 - DNA, 25 bp, E. coli
aaggtttgccctagtgcagctcagg

SEQ ID NO: 25716 - DNA, 25 bp, E. coli
aaggtttgcccttgtgcagctcagg

SEQ ID NO: 25717 - DNA, 25 bp, E. coli
tacgcatttcaccagaacgcagacg

SEQ ID NO: 25718 - DNA, 25 bp, E. coli
tatgaacagtagtaccaaccgggat

SEQ ID NO: 25719 - DNA, 25 bp, E. coli
tacgcatttcacgagaacgcagacg

SEQ ID NO: 25720 - DNA, 25 bp, E. coli
tatgaacagtagaaccaaccgggat

SEQ ID NO: 25721 - DNA, 25 bp, E. coli
ttgtggccaccaccgatatgacgag

SEQ ID NO: 25722 - DNA, 25 bp, E. coli
ttgtggccaccagcgatatgacgag

SEQ ID NO: 25723 - DNA, 25 bp, E. coli
tgaagtcaacaatacggtaagcctg

SEQ ID NO: 25724 - DNA, 25 bp, E. coli
tgaagtcaacaaaacggtaagcctg

SEQ ID NO: 25725 - DNA, 25 bp, E. coli
tctgaacgtaagaaccagcggaacg

SEQ ID NO: 25726 - DNA, 25 bp, E. coli
tctttgtacagaaccagcgcgatgt

SEQ ID NO: 25727 - DNA, 25 bp, E. coli
tctgaacgtaagtaccagcggaacg

SEQ ID NO: 25728 - DNA, 25 bp, E. coli
tctttgtacagatccagcgcgatgt

SEQ ID NO: 25729 - DNA, 25 bp, E. coli
ccatgtgggtggtctaccgggttca

SEQ ID NO: 25730 - DNA, 25 bp, E. coli
ccatgtgggtggactaccgggttca

SEQ ID NO: 25731 - DNA, 25 bp, E. coli
gaacggttcggatcgtactcaagac

SEQ ID NO: 25732 - DNA, 25 bp, E. coli
gaacggttcggaacgtactcaagac

SEQ ID NO: 25733 - DNA, 25 bp, E. coli
ggccattgttgttacgaccaccgga

SEQ ID NO: 25734 - DNA, 25 bp, E. coli
ggccattgttgtaacgaccaccgga

SEQ ID NO: 25735 - DNA, 25 bp, E. coli
tcaagacgttcatcaactgccggga

SEQ ID NO: 25736 - DNA, 25 bp, E. coli
tcaagacgttcaacaactgccggga

SEQ ID NO: 25737 - DNA, 25 bp, E. coli
caaccgaaggtgaatgtggcctcga

SEQ ID NO: 25738 - DNA, 25 bp, E. coli
caaccgaaggtgtatgtggcctcga

SEQ ID NO: 25739 - DNA, 25 bp, E. coli
caaagccgttttgtggcgtccagag

SEQ ID NO: 25740 - DNA, 25 bp, E. coli
caaagccgttttctggcgtccagag

SEQ ID NO: 25741 - DNA, 25 bp, E. coli
aaatggcgactcactttgcccgagg

SEQ ID NO: 25742 - DNA, 25 bp, E. coli
aaatggcgactctctttgcccgagg

SEQ ID NO: 25743 - DNA, 25 bp, E. coli
taccagccggatgatgcgttttgcc

SEQ ID NO: 25744 - DNA, 25 bp, E. coli
taccagccggatcatgcgttttgcc

SEQ ID NO: 25745 - DNA, 25 bp, E. coli
ttgccggacgccagaaatgtgctca

SEQ ID NO: 25746 - DNA, 25 bp, E. coli
ttgccggacgcctgaaatgtgctca

SEQ ID NO: 25747 - DNA, 25 bp, E. coli
tcccagtgtcatgaagaagcccgaa

SEQ ID NO: 25748 - DNA, 25 bp, E. coli
tcccagtgtcatcaagaagcccgaa

SEQ ID NO: 25749 - DNA, 25 bp, E. coli
tcatgtagaagcgttatgcgacgcg

SEQ ID NO: 25750 - DNA, 25 bp, E. coli
tcatgtagaagccttatgcgacgcg

SEQ ID NO: 25751 - DNA, 25 bp, E. coli
gaagcgtgctaaaactaaccggtga

SEQ ID NO: 25752 - DNA, 25 bp, E. coli
gaagcgtgctaatactaaccggtga

SEQ ID NO: 25753 - DNA, 25 bp, E. coli
ggcggtcacgccgacgattgaaaag

SEQ ID NO: 25754 - DNA, 25 bp, E. coli
ggcggtcacgcccacgattgaaaag

SEQ ID NO: 25755 - DNA, 25 bp, E. coli
gatgttttgaatgacgatccgcgcg

SEQ ID NO: 25756 - DNA, 25 bp, E. coli
gatgttttgaatcacgatccgcgcg

SEQ ID NO: 25757 - DNA, 25 bp, E. coli
gagttagatggctaacacggctgga

SEQ ID NO: 25758 - DNA, 25 bp, E. coli
gagttagatggcaaacacggctgga

SEQ ID NO: 25759 - DNA, 25 bp, E. coli
aatcaccgtcctgattttgggtgtg

SEQ ID NO: 25760 - DNA, 25 bp, E. coli
aatcaccgtcctcattttgggtgtg

SEQ ID NO: 25761 - DNA, 25 bp, E. coli
acctgggtacagtttatcaaagctg

SEQ ID NO: 25762 - DNA, 25 bp, E. coli
acctgggtacagattatcaaagctg

SEQ ID NO: 25763 - DNA, 25 bp, E. coli
acagattatcaaagctgtgctgttg

SEQ ID NO: 25764 - DNA, 25 bp, E. coli
acagattatcaatgctgtgctgttg

SEQ ID NO: 25765 - DNA, 25 bp, E. coli
tgattttgggtgtgattgcgattat

SEQ ID NO: 25766 - DNA, 25 bp, E. coli
tgattttgggtgagattgcgattat

SEQ ID NO: 25767 - DNA, 25 bp, E. coli
cctgattttgggtgtgattgcgatt

SEQ ID NO: 25768 - DNA, 25 bp, E. coli
ccgtcctgatttagggtgtgattgc

SEQ ID NO: 25769 - DNA, 25 bp, E. coli
cctgattttgggagtgattgcgatt

SEQ ID NO: 25770 - DNA, 25 bp, E. coli
gcgcgtaaaagcgtgttctacgcta

SEQ ID NO: 25771 - DNA, 25 bp, E. coli
gcgcgtaaaagcctgttctacgcta

SEQ ID NO: 25772 - DNA, 25 bp, E. coli
ccgtcctgattttgggtgtgattgc

SEQ ID NO: 25773 - DNA, 25 bp, E. coli
gcgtaaaagcgtgttctacgctacc

SEQ ID NO: 25774 - DNA, 25 bp, E. coli
gcgtaaaagcgtcttctacgctacc

SEQ ID NO: 25775 - DNA, 25 bp, E. coli
cgaaaatcaccgtcctgattttggg

SEQ ID NO: 25776 - DNA, 25 bp, E. coli
cgaaaatcaccgacctgattttggg

SEQ ID NO: 25777 - DNA, 25 bp, E. coli
ggtacagattatcaaagctgtgctg

SEQ ID NO: 25778 - DNA, 25 bp, E. coli
ggtacagattatgaaagctgtgctg

SEQ ID NO: 25779 - DNA, 25 bp, E. coli
gatctccgcactctctctggggcta

SEQ ID NO: 25780 - DNA, 25 bp, E. coli
gatctccgcactgtctctggggcta

SEQ ID NO: 25781 - DNA, 25 bp, E. coli
aatatcgtggtagtgaccgctgcgc

SEQ ID NO: 25782 - DNA, 25 bp, E. coli
aatatcgtggtactgaccgctgcgc

SEQ ID NO: 25783 - DNA, 25 bp, E. coli
ttcggtctggcagaacaagggaacg

SEQ ID NO: 25784 - DNA, 25 bp, E. coli
ttcggtctggcacaacaagggaacg

SEQ ID NO: 25785 - DNA, 25 bp, E. coli
tatcgtggtactgaccgctgcgctc

SEQ ID NO: 25786 - DNA, 25 bp, E. coli
tatgaaattccgacgtgccaaacaa

SEQ ID NO: 25787 - DNA, 25 bp, E. coli
tatgaaattccgtcgtgccaaacaa

SEQ ID NO: 25788 - DNA, 25 bp, E. coli
tatcgtggtactcaccgctgcgctc

SEQ ID NO: 25789 - DNA, 25 bp, E. coli
tccgtcgtgccaaacaagaacaagg

SEQ ID NO: 25790 - DNA, 25 bp, E. coli
tgccaaacaagaacaaggcgtggta

SEQ ID NO: 25791 - DNA, 25 bp, E. coli
tcgtgccaaacaagaacaaggcgtg

SEQ ID NO: 25792 - DNA, 25 bp, E. coli
tccgtcgtgccatacaagaacaagg

SEQ ID NO: 25793 - DNA, 25 bp, E. coli
tgccaaacaagatcaaggcgtggta

SEQ ID NO: 25794 - DNA, 25 bp, E. coli
tcgtgccaaacatgaacaaggcgtg

SEQ ID NO: 25795 - DNA, 25 bp, E. coli
gctgttcggtctcgcacaacaaggg

SEQ ID NO: 25796 - DNA, 25 bp, E. coli
gctgaatatcgtggtactgaccgct

SEQ ID NO: 25797 - DNA, 25 bp, E. coli
gctgttcggtctggcacaacaaggg

SEQ ID NO: 25798 - DNA, 25 bp, E. coli
gctgaatatcgtcgtactgaccgct

SEQ ID NO: 25799 - DNA, 25 bp, E. coli
gaaattccgtcgtgccaaacaagaa

SEQ ID NO: 25800 - DNA, 25 bp, E. coli
gaaattccgtcgagccaaacaagaa

SEQ ID NO: 25801 - DNA, 25 bp, E. coli
cggtctggcacatcaagggaacgcg

SEQ ID NO: 25802 - DNA, 25 bp, E. coli
cggtctggcacaacaagggaacgcg

SEQ ID NO: 25803 - DNA, 25 bp, E. coli
caataaccattttcctgctaactaa

SEQ ID NO: 25804 - DNA, 25 bp, E. coli
caataaccatttacctgctaactaa

SEQ ID NO: 25805 - DNA, 25 bp, E. coli
cagaaatttatccttaagctcctca

SEQ ID NO: 25806 - DNA, 25 bp, E. coli
cagaaatttatcgttaagctcctca

SEQ ID NO: 25807 - DNA, 25 bp, E. coli
caaattatgcgaaaggccatcctga

SEQ ID NO: 25808 - DNA, 25 bp, E. coli
caaattatgcgataggccatcctga

SEQ ID NO: 25809 - DNA, 25 bp, E. coli
catcctgacggatggcctttttgca

SEQ ID NO: 25810 - DNA, 25 bp, E. coli
catcctgacggaaggcctttttgca

SEQ ID NO: 25811 - DNA, 25 bp, E. coli
catggttaaggtagcataatgatat

SEQ ID NO: 25812 - DNA, 25 bp, E. coli
catggttaaggttgcataatgatat

SEQ ID NO: 25813 - DNA, 25 bp, E. coli
tatgcgaaaggccatcctgacggat

SEQ ID NO: 25814 - DNA, 25 bp, E. coli
tatgcgaaaggcgatcctgacggat

SEQ ID NO: 25815 - DNA, 25 bp, E. coli
cctgctaactaaattcatggttaag

SEQ ID NO: 25816 - DNA, 25 bp, E. coli
cctgctaactaatttcatggttaag

SEQ ID NO: 25817 - DNA, 25 bp, E. coli
gctgcgcgtcttatactcccacata

SEQ ID NO: 25818 - DNA, 25 bp, E. coli
gctgcgcgtcttttactcccacata

SEQ ID NO: 25819 - DNA, 25 bp, E. coli
ccatacgtgtcctccttaccagaaa

SEQ ID NO: 25820 - DNA, 25 bp, E. coli
ccatacgtgtccaccttaccagaaa

SEQ ID NO: 25821 - DNA, 25 bp, E. coli
gtcttatactccgacatatgccaga

SEQ ID NO: 25822 - DNA, 25 bp, E. coli
gtcttatactcccacatatgccaga

SEQ ID NO: 25823 - DNA, 25 bp, E. coli
tggcctttttgctttggcgcagaaa

SEQ ID NO: 25824 - DNA, 25 bp, E. coli
tggcctttttgcattggcgcagaaa

SEQ ID NO: 25825 - DNA, 25 bp, E. coli
aattgttgcaggagaacgcttaccg

SEQ ID NO: 25826 - DNA, 25 bp, E. coli
aattgttgcaggtgaacgcttaccg

SEQ ID NO: 25827 - DNA, 25 bp, E. coli
cagtgattgaccattcgcagttgcc

SEQ ID NO: 25828 - DNA, 25 bp, E. coli
cagtgattgacctttcgcagttgcc

SEQ ID NO: 25829 - DNA, 25 bp, E. coli
tacgctggaacttgaatctgaaccc

SEQ ID NO: 25830 - DNA, 25 bp, E. coli
taccgtgagttggttctgcgccagc

SEQ ID NO: 25831 - DNA, 25 bp, E. coli
tacgctggaactagaatctgaaccc

SEQ ID NO: 25832 - DNA, 25 bp, E. coli
tatgaatttcatccccgaagcgccg

SEQ ID NO: 25833 - DNA, 25 bp, E. coli
tatgaatttcatgcccgaagcgccg

SEQ ID NO: 25834 - DNA, 25 bp, E. coli
taccgtgagttgcttctgcgccagc

SEQ ID NO: 25835 - DNA, 25 bp, E. coli
tgttcaacgtgtggagctggcttca

SEQ ID NO: 25836 - DNA, 25 bp, E. coli
tgttcaacgtgtcgagctggcttca

SEQ ID NO: 25837 - DNA, 25 bp, E. coli
gcgcagaaatcatcacgtaccgtgt

SEQ ID NO: 25838 - DNA, 25 bp, E. coli
gcgcagaaatcaacacgtaccgtgt

SEQ ID NO: 25839 - DNA, 25 bp, E. coli
gcaaaagtcagcgtgcagaggtaca

SEQ ID NO: 25840 - DNA, 25 bp, E. coli
gcaaaagtcagcctgcagaggtaca

SEQ ID NO: 25841 - DNA, 25 bp, E. coli
gatcgccgccaaatacaacgtgaaa

SEQ ID NO: 25842 - DNA, 25 bp, E. coli
gatgtgccggactttgagacgctgc

SEQ ID NO: 25843 - DNA, 25 bp, E. coli
gatgtgccggacattgagacgctgc

SEQ ID NO: 25844 - DNA, 25 bp, E. coli
gacggtgacaccagctgatgatgac

SEQ ID NO: 25845 - DNA, 25 bp, E. coli
gacggtgacacctgctgatgatgac

SEQ ID NO: 25846 - DNA, 25 bp, E. coli
gatcgccgccaattacaacgtgaaa

SEQ ID NO: 25847 - DNA, 25 bp, E. coli
caatgatgcaggattacgccgacgc

SEQ ID NO: 25848 - DNA, 25 bp, E. coli
caatgatgcaggtttacgccgacgc

SEQ ID NO: 25849 - DNA, 25 bp, E. coli
tacctgaagcaagggcgagcaatga

SEQ ID NO: 25850 - DNA, 25 bp, E. coli
tacctgaagcaacggcgagcaatga

SEQ ID NO: 25851 - DNA, 25 bp, E. coli
tattgcaggaccagttcacacgcag

SEQ ID NO: 25852 - DNA, 25 bp, E. coli
tattaacggcataaaggaccgcaga

SEQ ID NO: 25853 - DNA, 25 bp, E. coli
tattaacggcattaaggaccgcaga

SEQ ID NO: 25854 - DNA, 25 bp, E. coli
tattgcaggacctgttcacacgcag

SEQ ID NO: 25855 - DNA, 25 bp, E. coli
tcttgatacggcactgaaggcccgc

SEQ ID NO: 25856 - DNA, 25 bp, E. coli
tcttgatacggctctgaaggcccgc

SEQ ID NO: 25857 - DNA, 25 bp, E. coli
gctggtgcatccgaacggttcgaaa

SEQ ID NO: 25858 - DNA, 25 bp, E. coli
gctggtgcatcccaacggttcgaaa

SEQ ID NO: 25859 - DNA, 25 bp, E. coli
gcaaaacaggtctgatcggcactag

SEQ ID NO: 25860 - DNA, 25 bp, E. coli
gcaaaacaggtcagatcggcactag

SEQ ID NO: 25861 - DNA, 25 bp, E. coli
gaattaacccagtggaacaagcccg

SEQ ID NO: 25862 - DNA, 25 bp, E. coli
gaattaacccagaggaacaagcccg

SEQ ID NO: 25863 - DNA, 25 bp, E. coli
cgattgtcgatataaccgcccgtga

SEQ ID NO: 25864 - DNA, 25 bp, E. coli
cgattgtcgataaaaccgcccgtga

SEQ ID NO: 25865 - DNA, 25 bp, E. coli
cattgatgcgctcaacatggcggca

SEQ ID NO: 25866 - DNA, 25 bp, E. coli
cattgatgcgctgaacatggcggca

SEQ ID NO: 25867 - DNA, 25 bp, E. coli
taatcacactcaaagaagcacgcag

SEQ ID NO: 25868 - DNA, 25 bp, E. coli
taatcacactcatagaagcacgcag

SEQ ID NO: 25869 - DNA, 25 bp, E. coli
cagccagagattttccggagatacc

SEQ ID NO: 25870 - DNA, 25 bp, E. coli
cagccagagattatccggagatacc

SEQ ID NO: 25871 - DNA, 25 bp, E. coli
aactcatctgacagacgttccgctt

SEQ ID NO: 25872 - DNA, 25 bp, E. coli
aactcatctgactgacgttccgctt

SEQ ID NO: 25873 - DNA, 25 bp, E. coli
tcgatataaacctttccatagtaag

SEQ ID NO: 25874 - DNA, 25 bp, E. coli
tcgatataaaccattccatagtaag

SEQ ID NO: 25875 - DNA, 25 bp, E. coli
ccggagataccagggatatgtttct

SEQ ID NO: 25876 - DNA, 25 bp, E. coli
ccggagataccacggatatgtttct

SEQ ID NO: 25877 - DNA, 25 bp, E. coli
gcgttacgcctgcatatgagtgaga

SEQ ID NO: 25878 - DNA, 25 bp, E. coli
gcgttacgcctggatatgagtgaga

SEQ ID NO: 25879 - DNA, 25 bp, E. coli
gctttatctgtcactggaacccaac

SEQ ID NO: 25880 - DNA, 25 bp, E. coli
gcataagctgactagaactcatctg

SEQ ID NO: 25881 - DNA, 25 bp, E. coli
gcttggtgcgatagcgttacgcctg

SEQ ID NO: 25882 - DNA, 25 bp, E. coli
gcataagctgacaagaactcatctg

SEQ ID NO: 25883 - DNA, 25 bp, E. coli
gctttatctgtctctggaacccaac

SEQ ID NO: 25884 - DNA, 25 bp, E. coli
gcttggtgcgattgcgttacgcctg

SEQ ID NO: 25885 - DNA, 25 bp, E. coli
gtttgaatcagatgaacggatatta

SEQ ID NO: 25886 - DNA, 25 bp, E. coli
gtttgaatcagaagaacggatatta

SEQ ID NO: 25887 - DNA, 25 bp, E. coli
tggcatgcctgtcgctgtttgaatc

SEQ ID NO: 25888 - DNA, 25 bp, E. coli
tggcatgcctgtggctgtttgaatc

SEQ ID NO: 25889 - DNA, 25 bp, E. coli
gacgttccgcttaatctgtcactgg

SEQ ID NO: 25890 - DNA, 25 bp, E. coli
gacgttccgctttatctgtcactgg

SEQ ID NO: 25891 - DNA, 25 bp, E. coli
aatcacagaactcgagtgcgcatga

SEQ ID NO: 25892 - DNA, 25 bp, E. coli
aatcacagaactggagtgcgcatga

SEQ ID NO: 25893 - DNA, 25 bp, E. coli
taaaaatcacagaactggagtgcgc

SEQ ID NO: 25894 - DNA, 25 bp, E. coli
taaaaatcacagtactggagtgcgc

SEQ ID NO: 25895 - DNA, 25 bp, E. coli
aaaaatcacagatctggagtgcgca

SEQ ID NO: 25896 - DNA, 25 bp, E. coli
aaatcacagaacaggagtgcgcatg

SEQ ID NO: 25897 - DNA, 25 bp, E. coli
aaaaatcacagaactggagtgcgca

SEQ ID NO: 25898 - DNA, 25 bp, E. coli
aaatcacagaactggagtgcgcatg

SEQ ID NO: 25899 - DNA, 25 bp, E. coli
ttgtgcgcggtctgctcgttcctgg

SEQ ID NO: 25900 - DNA, 25 bp, E. coli
ttgtgcgcggtcagctcgttcctgg

SEQ ID NO: 25901 - DNA, 25 bp, E. coli
tgtgcgcggtcacctcgttcctggt

SEQ ID NO: 25902 - DNA, 25 bp, E. coli
tgtgcgcggtcagctcgttcctggt

SEQ ID NO: 25903 - DNA, 25 bp, E. coli
tgcgcggtcagctcgttcctggtga

SEQ ID NO: 25904 - DNA, 25 bp, E. coli
tgcgcggtcagcacgttcctggtga

SEQ ID NO: 25905 - DNA, 25 bp, E. coli
cgcggtcagctcgttcctggtgagc

SEQ ID NO: 25906 - DNA, 25 bp, E. coli
cgcggtcagctccttcctggtgagc

SEQ ID NO: 25907 - DNA, 25 bp, E. coli
gataaaaatcacagaactggagtgc

SEQ ID NO: 25908 - DNA, 25 bp, E. coli
gataaaaatcactgaactggagtgc

SEQ ID NO: 25909 - DNA, 25 bp, E. coli
gggataaaaatctcagaactggagt

SEQ ID NO: 25910 - DNA, 25 bp, E. coli
gggataaaaatcacagaactggagt

SEQ ID NO: 25911 - DNA, 25 bp, E. coli
tcagctcgttcctggtgagcggctg

SEQ ID NO: 25912 - DNA, 25 bp, E. coli
tcagctcgttccaggtgagcggctg

SEQ ID NO: 25913 - DNA, 25 bp, E. coli
catcaaaagtggaccgttccgcagc

SEQ ID NO: 25914 - DNA, 25 bp, E. coli
catcaaaagtggtccgttccgcagc

SEQ ID NO: 25915 - DNA, 25 bp, E. coli
tacgcaactaatgaaaccgacgtgc

SEQ ID NO: 25916 - DNA, 25 bp, E. coli
tacgcaactaatcaaaccgacgtgc

SEQ ID NO: 25917 - DNA, 25 bp, E. coli
tatgcacaccgtgtggtacagcgtc

SEQ ID NO: 25918 - DNA, 25 bp, E. coli
tatgcacaccgtctggtacagcgtc

SEQ ID NO: 25919 - DNA, 25 bp, E. coli
ttagttggcggcgaaatcaccacca

SEQ ID NO: 25920 - DNA, 25 bp, E. coli
ttagttggcggccaaatcaccacca

SEQ ID NO: 25921 - DNA, 25 bp, E. coli
tcgttgataccttcggcggcatggc

SEQ ID NO: 25922 - DNA, 25 bp, E. coli
tccgacatgggcattgacgctaact

SEQ ID NO: 25923 - DNA, 25 bp, E. coli
tcgttgatacctacggcggcatggc

SEQ ID NO: 25924 - DNA, 25 bp, E. coli
tccgacatgggctttgacgctaact

SEQ ID NO: 25925 - DNA, 25 bp, E. coli
gctggcctggcccatcgttgtgaaa

SEQ ID NO: 25926 - DNA, 25 bp, E. coli
gctggcctggccgatcgttgtgaaa

SEQ ID NO: 25927 - DNA, 25 bp, E. coli
gcgcctgggtagtcatcgaagagat

SEQ ID NO: 25928 - DNA, 25 bp, E. coli
gcgcctgggtagacatcgaagagat

SEQ ID NO: 25929 - DNA, 25 bp, E. coli
gaacaggatccgaaagcacgcgttg

SEQ ID NO: 25930 - DNA, 25 bp, E. coli
gaaattggctatgtgcattccgaca

SEQ ID NO: 25931 - DNA, 25 bp, E. coli
gaacaggatccgtaagcacgcgttg

SEQ ID NO: 25932 - DNA, 25 bp, E. coli
gaaattggctatctgcattccgaca

SEQ ID NO: 25933 - DNA, 25 bp, E. coli
gagtccgtctctgaagggcatcctg

SEQ ID NO: 25934 - DNA, 25 bp, E. coli
gagtccgtctctcaagggcatcctg

SEQ ID NO: 25935 - DNA, 25 bp, E. coli
aataacagcggttttgcgtcggcgc

SEQ ID NO: 25936 - DNA, 25 bp, E. coli
aataacagcggtattgcgtcggcgc

SEQ ID NO: 25937 - DNA, 25 bp, E. coli
taaaaccgttgacctgagcgaaagc

SEQ ID NO: 25938 - DNA, 25 bp, E. coli
taaaaccgttgagctgagcgaaagc

SEQ ID NO: 25939 - DNA, 25 bp, E. coli
tattcaataaccttgcaggcggcga

SEQ ID NO: 25940 - DNA, 25 bp, E. coli
tataccagcctgaacgtgggcacca

SEQ ID NO: 25941 - DNA, 25 bp, E. coli
tatcactggaaacaggacggcatca

SEQ ID NO: 25942 - DNA, 25 bp, E. coli
tatcactggaaagaggacggcatca

SEQ ID NO: 25943 - DNA, 25 bp, E. coli
tataccagcctgtacgtgggcacca

SEQ ID NO: 25944 - DNA, 25 bp, E. coli
tattcaataaccatgcaggcggcga

SEQ ID NO: 25945 - DNA, 25 bp, E. coli
tgaaaacaacaatgccgggacgctg

SEQ ID NO: 25946 - DNA, 25 bp, E. coli
tgaaaacaacaaagccgggacgctg

SEQ ID NO: 25947 - DNA, 25 bp, E. coli
gcaaaaacgccattcgcttccaggg

SEQ ID NO: 25948 - DNA, 25 bp, E. coli
gcaaaaacgccaatcgcttccaggg

SEQ ID NO: 25949 - DNA, 25 bp, E. coli
cgacaacgtggtggaaggcatcaac

SEQ ID NO: 25950 - DNA, 25 bp, E. coli
cgacaacgtggtcgaaggcatcaac

SEQ ID NO: 25951 - DNA, 25 bp, E. coli
ggcgttatcaatctcggtaccgaag

SEQ ID NO: 25952 - DNA, 25 bp, E. coli
ggcgttatcaatgtcggtaccgaag

SEQ ID NO: 25953 - DNA, 25 bp, E. coli
taacctgagcatgaacagcggcagc

SEQ ID NO: 25954 - DNA, 25 bp, E. coli
taagtcaacgttcaacaacagcggc

SEQ ID NO: 25955 - DNA, 25 bp, E. coli
taacctgagcatcaacagcggcagc

SEQ ID NO: 25956 - DNA, 25 bp, E. coli
taagtcaacgttgaacaacagcggc

SEQ ID NO: 25957 - DNA, 25 bp, E. coli
aatttattaaagttgcactggtagg

SEQ ID NO: 25958 - DNA, 25 bp, E. coli
aatttattaaagatgcactggtagg

SEQ ID NO: 25959 - DNA, 25 bp, E. coli
cagtactggctacgttaactgcatg

SEQ ID NO: 25960 - DNA, 25 bp, E. coli
cagtactggctaggttaactgcatg

SEQ ID NO: 25961 - DNA, 25 bp, E. coli
actgctcttacgactacctgctgca

SEQ ID NO: 25962 - DNA, 25 bp, E. coli
aactgcatgtactggtcatattgaa

SEQ ID NO: 25963 - DNA, 25 bp, E. coli
actgctcttacgtctacctgctgca

SEQ ID NO: 25964 - DNA, 25 bp, E. coli
aactgcatgtacaggtcatattgaa

SEQ ID NO: 25965 - DNA, 25 bp, E. coli
tattgaaaaccgagataagaactgc

SEQ ID NO: 25966 - DNA, 25 bp, E. coli
tattgaaaaccgtgataagaactgc

SEQ ID NO: 25967 - DNA, 25 bp, E. coli
tttctatttctaaaatcattggcgg

SEQ ID NO: 25968 - DNA, 25 bp, E. coli
tttctatttctataatcattggcgg

SEQ ID NO: 25969 - DNA, 25 bp, E. coli
tgaaaaccgtgaaaagaactgctct

SEQ ID NO: 25970 - DNA, 25 bp, E. coli
tgaaaaccgtgataagaactgctct

SEQ ID NO: 25971 - DNA, 25 bp, E. coli
gaactgctcttaggactacctgctg

SEQ ID NO: 25972 - DNA, 25 bp, E. coli
gaactgctcttacgactacctgctg

SEQ ID NO: 25973 - DNA, 25 bp, E. coli
cgttaactgcatgtactggtcatat

SEQ ID NO: 25974 - DNA, 25 bp, E. coli
cgttaactgcatctactggtcatat

SEQ ID NO: 25975 - DNA, 25 bp, E. coli
tggctacgttaactgcatgtactgg

SEQ ID NO: 25976 - DNA, 25 bp, E. coli
tggctacgttaagtgcatgtactgg

SEQ ID NO: 25977 - DNA, 25 bp, E. coli
tggtcatattgataaccgtgataag

SEQ ID NO: 25978 - DNA, 25 bp, E. coli
tggtcatattgaaaaccgtgataag

SEQ ID NO: 25979 - DNA, 25 bp, E. coli
aatcattaaccagggaaacagcact

SEQ ID NO: 25980 - DNA, 25 bp, E. coli
aatcattaaccacggaaacagcact

SEQ ID NO: 25981 - DNA, 25 bp, E. coli
tactcttcgtcatctgcagcttctg

SEQ ID NO: 25982 - DNA, 25 bp, E. coli
tactcttcgtcaactgcagcttctg

SEQ ID NO: 25983 - DNA, 25 bp, E. coli
actgcgaatcggcaattatctttga

SEQ ID NO: 25984 - DNA, 25 bp, E. coli
actgcgaatcgggaattatctttga

SEQ ID NO: 25985 - DNA, 25 bp, E. coli
aaatcattaacctcggaaacagcac

SEQ ID NO: 25986 - DNA, 25 bp, E. coli
aaatcattaaccacggaaacagcac

SEQ ID NO: 25987 - DNA, 25 bp, E. coli
tgtccgtactcttcgtcatctgcag

SEQ ID NO: 25988 - DNA, 25 bp, E. coli
tgtccgtactctacgtcatctgcag

SEQ ID NO: 25989 - DNA, 25 bp, E. coli
tgcgaatcgggatttatctttgaca

SEQ ID NO: 25990 - DNA, 25 bp, E. coli
tgcgaatcgggaattatctttgaca

SEQ ID NO: 25991 - DNA, 25 bp, E. coli
tgccctgtatcgaacgggcccggga

SEQ ID NO: 25992 - DNA, 25 bp, E. coli
tgccctgtatcgtacgggcccggga

SEQ ID NO: 25993 - DNA, 25 bp, E. coli
gaaatcattaacgacggaaacagca

SEQ ID NO: 25994 - DNA, 25 bp, E. coli
gaaatcattaaccacggaaacagca

SEQ ID NO: 25995 - DNA, 25 bp, E. coli
ccgggaggatgtccgtactcttcgt

SEQ ID NO: 25996 - DNA, 25 bp, E. coli
ccgggaggatgtgcgtactcttcgt

SEQ ID NO: 25997 - DNA, 25 bp, E. coli
ggcccgggaggaagtccgtactctt

SEQ ID NO: 25998 - DNA, 25 bp, E. coli
ggaggatgtccgtactcttcgtcat

SEQ ID NO: 25999 - DNA, 25 bp, E. coli
ggaggatgtccgaactcttcgtcat

SEQ ID NO: 26000 - DNA, 25 bp, E. coli
ggcccgggaggatgtccgtactctt

SEQ ID NO: 26001 - DNA, 25 bp, E. coli
aagtatcgccaagaacgggaggcga

SEQ ID NO: 26002 - DNA, 25 bp, E. coli
aagtatcgccaacaacgggaggcga

SEQ ID NO: 26003 - DNA, 25 bp, E. coli
ttggccgcgcagtcgcgtcaaagca

SEQ ID NO: 26004 - DNA, 25 bp, E. coli
ttggccgcgcagacgcgtcaaagca

SEQ ID NO: 26005 - DNA, 25 bp, E. coli
tgactcttttattgatgatgtggcg

SEQ ID NO: 26006 - DNA, 25 bp, E. coli
tgactcttttatagatgatgtggcg

SEQ ID NO: 26007 - DNA, 25 bp, E. coli
tgccacggcgctggcgaagtatcgc

SEQ ID NO: 26008 - DNA, 25 bp, E. coli
tgccacggcgctcgcgaagtatcgc

SEQ ID NO: 26009 - DNA, 25 bp, E. coli
ccggcgcgcgattttgactctttta

SEQ ID NO: 26010 - DNA, 25 bp, E. coli
ccggcgcgcgatattgactctttta

SEQ ID NO: 26011 - DNA, 25 bp, E. coli
gcgcagtcgcgtgaaagcacacttt

SEQ ID NO: 26012 - DNA, 25 bp, E. coli
gctttggccgcgcagtcgcgtcaaa

SEQ ID NO: 26013 - DNA, 25 bp, E. coli
gcgcagtcgcgtcaaagcacacttt

SEQ ID NO: 26014 - DNA, 25 bp, E. coli
gctttggccgcggagtcgcgtcaaa

SEQ ID NO: 26015 - DNA, 25 bp, E. coli
gcagcacgtttggagattgcgctga

SEQ ID NO: 26016 - DNA, 25 bp, E. coli
gcagcacgtttgcagattgcgctga

SEQ ID NO: 26017 - DNA, 25 bp, E. coli
cgcgcgatattgactcttttattga

SEQ ID NO: 26018 - DNA, 25 bp, E. coli
cgcgcgatattgtctcttttattga

SEQ ID NO: 26019 - DNA, 25 bp, E. coli
gtatcgccaacaacgggaggcgata

SEQ ID NO: 26020 - DNA, 25 bp, E. coli
gtatcgccaacatcgggaggcgata

SEQ ID NO: 26021 - DNA, 25 bp, E. coli
tggcagcacgttaggagattgcgct

SEQ ID NO: 26022 - DNA, 25 bp, E. coli
tggcagcacgtttggagattgcgct

SEQ ID NO: 26023 - DNA, 25 bp, E. coli
aatcaacgggcacgtcactgacttg

SEQ ID NO: 26024 - DNA, 25 bp, E. coli
aatcaacgggcaggtcactgacttg

SEQ ID NO: 26025 - DNA, 25 bp, E. coli
accgttgccgcgatgcgcattctac

SEQ ID NO: 26026 - DNA, 25 bp, E. coli
tttttatcccttgtccacaccgttg

SEQ ID NO: 26027 - DNA, 25 bp, E. coli
aaatcaaagtcacatcaatgcgttg

SEQ ID NO: 26028 - DNA, 25 bp, E. coli
ttccccttctctcaaaatcaacggg

SEQ ID NO: 26029 - DNA, 25 bp, E. coli
tttttatcccttctccacaccgttg

SEQ ID NO: 26030 - DNA, 25 bp, E. coli
ttccccttctctgaaaatcaacggg

SEQ ID NO: 26031 - DNA, 25 bp, E. coli
aaatcaaagtcagatcaatgcgttg

SEQ ID NO: 26032 - DNA, 25 bp, E. coli
accgttgccgcgttgcgcattctac

SEQ ID NO: 26033 - DNA, 25 bp, E. coli
tttaatggggatttacgatggcagg

SEQ ID NO: 26034 - DNA, 25 bp, E. coli
tttaatggggatatacgatggcagg

SEQ ID NO: 26035 - DNA, 25 bp, E. coli
tctactttgcgagtctgctccagaa

SEQ ID NO: 26036 - DNA, 25 bp, E. coli
tctctgaaaatctacgggcaggtca

SEQ ID NO: 26037 - DNA, 25 bp, E. coli
tctactttgcgactctgctccagaa

SEQ ID NO: 26038 - DNA, 25 bp, E. coli
tctctgaaaatcaacgggcaggtca

SEQ ID NO: 26039 - DNA, 25 bp, E. coli
gctccagaaaattaatcaaagtcag

SEQ ID NO: 26040 - DNA, 25 bp, E. coli
gcgagtctgctcgagaaaataaatc

SEQ ID NO: 26041 - DNA, 25 bp, E. coli
gcgagtctgctccagaaaataaatc

SEQ ID NO: 26042 - DNA, 25 bp, E. coli
gctccagaaaataaatcaaagtcag

SEQ ID NO: 26043 - DNA, 25 bp, E. coli
cgcgttgcgcattctactttgcgag

SEQ ID NO: 26044 - DNA, 25 bp, E. coli
cgcgttgcgcatactactttgcgag

SEQ ID NO: 26045 - DNA, 25 bp, E. coli
caaaatcacgcatagagacaactat

SEQ ID NO: 26046 - DNA, 25 bp, E. coli
caaaatcacgcaaagagacaactat

SEQ ID NO: 26047 - DNA, 25 bp, E. coli
cattttttcggcaattgatcagctg

SEQ ID NO: 26048 - DNA, 25 bp, E. coli
tacgttgatagccattttttcggca

SEQ ID NO: 26049 - DNA, 25 bp, E. coli
tacgttgatagcgattttttcggca

SEQ ID NO: 26050 - DNA, 25 bp, E. coli
tagccattttttgggcaattgatca

SEQ ID NO: 26051 - DNA, 25 bp, E. coli
tagccattttttcggcaattgatca

SEQ ID NO: 26052 - DNA, 25 bp, E. coli
tatttcagaaatcggtcgcattgca

SEQ ID NO: 26053 - DNA, 25 bp, E. coli
tatttcagaaatgggtcgcattgca

SEQ ID NO: 26054 - DNA, 25 bp, E. coli
tttcagaaatggctcgcattgcaag

SEQ ID NO: 26055 - DNA, 25 bp, E. coli
tttcagaaatgggtcgcattgcaag

SEQ ID NO: 26056 - DNA, 25 bp, E. coli
tgcatgcgaccacagtgaaaaacaa

SEQ ID NO: 26057 - DNA, 25 bp, E. coli
tgcatgcgaccagagtgaaaaacaa

SEQ ID NO: 26058 - DNA, 25 bp, E. coli
gcgaccacagtgtaaaacaaaatca

SEQ ID NO: 26059 - DNA, 25 bp, E. coli
gcgaccacagtgaaaaacaaaatca

SEQ ID NO: 26060 - DNA, 25 bp, E. coli
gaaaaacaaaatgacgcaaagagac

SEQ ID NO: 26061 - DNA, 25 bp, E. coli
gacaactataaacaaatcatgtctg

SEQ ID NO: 26062 - DNA, 25 bp, E. coli
gaaaaacaaaatcacgcaaagagac

SEQ ID NO: 26063 - DNA, 25 bp, E. coli
gacaactataaagaaatcatgtctg

SEQ ID NO: 26064 - DNA, 25 bp, E. coli
cattttttcggctattgatcagctg

SEQ ID NO: 26065 - DNA, 25 bp, E. coli
tcacgcaaagagtcaactataaaga

SEQ ID NO: 26066 - DNA, 25 bp, E. coli
tcacgcaaagagacaactataaaga

SEQ ID NO: 26067 - DNA, 25 bp, E. coli
aacctcatcgaacgtttactgaaag

SEQ ID NO: 26068 - DNA, 25 bp, E. coli
aacctcatcgaaggtttactgaaag

SEQ ID NO: 26069 - DNA, 25 bp, E. coli
ccggactggaacgtcatcgaacgtt

SEQ ID NO: 26070 - DNA, 25 bp, E. coli
cctcatcgaacgattactgaaagag

SEQ ID NO: 26071 - DNA, 25 bp, E. coli
gccggactggaacctcatcgaacgt

SEQ ID NO: 26072 - DNA, 25 bp, E. coli
ccggactggaacctcatcgaacgtt

SEQ ID NO: 26073 - DNA, 25 bp, E. coli
cctcatcgaacgtttactgaaagag

SEQ ID NO: 26074 - DNA, 25 bp, E. coli
gccggactggaagctcatcgaacgt

SEQ ID NO: 26075 - DNA, 25 bp, E. coli
gaacctcatcgatcgtttactgaaa

SEQ ID NO: 26076 - DNA, 25 bp, E. coli
gactggaacctcttcgaacgtttac

SEQ ID NO: 26077 - DNA, 25 bp, E. coli
gactggaacctcatcgaacgtttac

SEQ ID NO: 26078 - DNA, 25 bp, E. coli
gaacctcatcgaacgtttactgaaa

SEQ ID NO: 26079 - DNA, 25 bp, E. coli
cggactggaacctcatcgaacgttt

SEQ ID NO: 26080 - DNA, 25 bp, E. coli
cggactggaaccacatcgaacgttt

SEQ ID NO: 26081 - DNA, 25 bp, E. coli
ctggaacctcatggaacgtttactg

SEQ ID NO: 26082 - DNA, 25 bp, E. coli
ctggaacctcatcgaacgtttactg

SEQ ID NO: 26083 - DNA, 25 bp, E. coli
ggactggaacctcatcgaacgttta

SEQ ID NO: 26084 - DNA, 25 bp, E. coli
tggaacctcatccaacgtttactga

SEQ ID NO: 26085 - DNA, 25 bp, E. coli
ggaacctcatcgaacgtttactgaa

SEQ ID NO: 26086 - DNA, 25 bp, E. coli
ggactggaacctgatcgaacgttta

SEQ ID NO: 26087 - DNA, 25 bp, E. coli
tggaacctcatcgaacgtttactga

SEQ ID NO: 26088 - DNA, 25 bp, E. coli
ggaacctcatcgtacgtttactgaa

SEQ ID NO: 26089 - DNA, 25 bp, E. coli
caaacggtgatccatgcagagagcc

SEQ ID NO: 26090 - DNA, 25 bp, E. coli
caaacggtgatcgatgcagagagcc

SEQ ID NO: 26091 - DNA, 25 bp, E. coli
aaaaagttgtgtacctgccgcagtc

SEQ ID NO: 26092 - DNA, 25 bp, E. coli
aaaaagttgtgttcctgccgcagtc

SEQ ID NO: 26093 - DNA, 25 bp, E. coli
tgtcgatttctacgctgccgcgcgg

SEQ ID NO: 26094 - DNA, 25 bp, E. coli
tgtcgatttctaggctgccgcgcgg

SEQ ID NO: 26095 - DNA, 25 bp, E. coli
tgctggatgaaccactgagcgcgct

SEQ ID NO: 26096 - DNA, 25 bp, E. coli
tgaactacctcgttagcctgtccgg

SEQ ID NO: 26097 - DNA, 25 bp, E. coli
tgaactacctcgatagcctgtccgg

SEQ ID NO: 26098 - DNA, 25 bp, E. coli
tgctggatgaacgactgagcgcgct

SEQ ID NO: 26099 - DNA, 25 bp, E. coli
tgcggtaaatcaacgctactgcgcg

SEQ ID NO: 26100 - DNA, 25 bp, E. coli
tgcggtaaatcatcgctactgcgcg

SEQ ID NO: 26101 - DNA, 25 bp, E. coli
gccgtttgctcgtcgggctgaaaaa

SEQ ID NO: 26102 - DNA, 25 bp, E. coli
gccgtttgctcgacgggctgaaaaa

SEQ ID NO: 26103 - DNA, 25 bp, E. coli
gcttacgattaatgcgctgtgcgcc

SEQ ID NO: 26104 - DNA, 25 bp, E. coli
gcttacgattaaagcgctgtgcgcc

SEQ ID NO: 26105 - DNA, 25 bp, E. coli
gaagagctaggcttcgcacatctgg

SEQ ID NO: 26106 - DNA, 25 bp, E. coli
gaagagctaggcatcgcacatctgg

SEQ ID NO: 26107 - DNA, 25 bp, E. coli
cgggcaaaatcacgcgcaggctata

SEQ ID NO: 26108 - DNA, 25 bp, E. coli
cgggcaaaatcaggcgcaggctata

SEQ ID NO: 26109 - DNA, 25 bp, E. coli
gggaaacttatccacagcggcgacc

SEQ ID NO: 26110 - DNA, 25 bp, E. coli
gggaaacttatcgacagcggcgacc

SEQ ID NO: 26111 - DNA, 25 bp, E. coli
aagatgagtctggaaggcgttgccc

SEQ ID NO: 26112 - DNA, 25 bp, E. coli
aagatgagtctgcaaggcgttgccc

SEQ ID NO: 26113 - DNA, 25 bp, E. coli
caaacccagggcgattatgctatcg

SEQ ID NO: 26114 - DNA, 25 bp, E. coli
caaacccagggccattatgctatcg

SEQ ID NO: 26115 - DNA, 25 bp, E. coli
tattgcaaaacagcagcacgccgta

SEQ ID NO: 26116 - DNA, 25 bp, E. coli
tattgcaaaacaccagcacgccgta

SEQ ID NO: 26117 - DNA, 25 bp, E. coli
tattcctgtggcaatacgtcgctgg

SEQ ID NO: 26118 - DNA, 25 bp, E. coli
tattcctgtggctatacgtcgctgg

SEQ ID NO: 26119 - DNA, 25 bp, E. coli
ttaagccatttaacggcggcactgg

SEQ ID NO: 26120 - DNA, 25 bp, E. coli
ttaagccatttatcggcggcactgg

SEQ ID NO: 26121 - DNA, 25 bp, E. coli
tgacgaacctgcctacagatgctgg

SEQ ID NO: 26122 - DNA, 25 bp, E. coli
tgacgaacctgcgtacagatgctgg

SEQ ID NO: 26123 - DNA, 25 bp, E. coli
ccggaagaacacaggcgagaattga

SEQ ID NO: 26124 - DNA, 25 bp, E. coli
ccggaagaacactggcgagaattga

SEQ ID NO: 26125 - DNA, 25 bp, E. coli
gcggcactggattgacccaatatca

SEQ ID NO: 26126 - DNA, 25 bp, E. coli
gcggcactggatagacccaatatca

SEQ ID NO: 26127 - DNA, 25 bp, E. coli
gcacccgcgaactgtttgccaaaag

SEQ ID NO: 26128 - DNA, 25 bp, E. coli
gcacccgcgaacagtttgccaaaag

SEQ ID NO: 26129 - DNA, 25 bp, E. coli
ggttcgcacagattccttcctggca

SEQ ID NO: 26130 - DNA, 25 bp, E. coli
ggttcgcacagaatccttcctggca

SEQ ID NO: 26131 - DNA, 25 bp, E. coli
gatgataaacacaggccggaagaac

SEQ ID NO: 26132 - DNA, 25 bp, E. coli
gatgataaacactggccggaagaac

SEQ ID NO: 26133 - DNA, 25 bp, E. coli
tactgacggttttgagaatgcgcca

SEQ ID NO: 26134 - DNA, 25 bp, E. coli
tactgacggtttagagaatgcgcca

SEQ ID NO: 26135 - DNA, 25 bp, E. coli
agatgatgtcgcgacaccgggtgaa

SEQ ID NO: 26136 - DNA, 25 bp, E. coli
agatgatgtcgccacaccgggtgaa

SEQ ID NO: 26137 - DNA, 25 bp, E. coli
aaaaatgccgccttgctaccgaggt

SEQ ID NO: 26138 - DNA, 25 bp, E. coli
aaacttcggcaatgtggtgatccgc

SEQ ID NO: 26139 - DNA, 25 bp, E. coli
aaacttcggcaaagtggtgatccgc

SEQ ID NO: 26140 - DNA, 25 bp, E. coli
aaaaatgccgccatgctaccgaggt

SEQ ID NO: 26141 - DNA, 25 bp, E. coli
tatctattatgataacgtgggcggt

SEQ ID NO: 26142 - DNA, 25 bp, E. coli
tatctattatgaaaacgtgggcggt

SEQ ID NO: 26143 - DNA, 25 bp, E. coli
tatcgctcaggattatggtcaccgc

SEQ ID NO: 26144 - DNA, 25 bp, E. coli
tatcgctcaggaatatggtcaccgc

SEQ ID NO: 26145 - DNA, 25 bp, E. coli
gcaaaatccatcgtggtcgctgggt

SEQ ID NO: 26146 - DNA, 25 bp, E. coli
gcaaaatccatcctggtcgctgggt

SEQ ID NO: 26147 - DNA, 25 bp, E. coli
gaatgcgccacagacgtttatcggc

SEQ ID NO: 26148 - DNA, 25 bp, E. coli
gaatgcgccacacacgtttatcggc

SEQ ID NO: 26149 - DNA, 25 bp, E. coli
ggataaaatccagtaccgcgaagaa

SEQ ID NO: 26150 - DNA, 25 bp, E. coli
ggataaaatccactaccgcgaagaa

SEQ ID NO: 26151 - DNA, 25 bp, E. coli
tggatatcggtcagcctaaagaggg

SEQ ID NO: 26152 - DNA, 25 bp, E. coli
tggatatcggtctgcctaaagaggg

SEQ ID NO: 26153 - DNA, 25 bp, E. coli
gatgtttgtcttgatcaccacgcgg

SEQ ID NO: 26154 - DNA, 25 bp, E. coli
gatgtttgtcttcatcaccacgcgg

SEQ ID NO: 26155 - DNA, 25 bp, E. coli
caccgccggtgtgaaagtcgtcaca

SEQ ID NO: 26156 - DNA, 25 bp, E. coli
cagaaccgcatcaaatattattaac

SEQ ID NO: 26157 - DNA, 25 bp, E. coli
caccgccggtgtcaaagtcgtcaca

SEQ ID NO: 26158 - DNA, 25 bp, E. coli
cagaaccgcatctaatattattaac

SEQ ID NO: 26159 - DNA, 25 bp, E. coli
taacttcgattaataatatcaccgc

SEQ ID NO: 26160 - DNA, 25 bp, E. coli
aaagtcgtcacaatttctggaagaa

SEQ ID NO: 26161 - DNA, 25 bp, E. coli
aaagtcgtcacattttctggaagaa

SEQ ID NO: 26162 - DNA, 25 bp, E. coli
tatcaccgccggtgtgaaagtcgtc

SEQ ID NO: 26163 - DNA, 25 bp, E. coli
tatcaccgccggagtgaaagtcgtc

SEQ ID NO: 26164 - DNA, 25 bp, E. coli
tttatcatttatcagaaccgcatca

SEQ ID NO: 26165 - DNA, 25 bp, E. coli
tttatcatttatgagaaccgcatca

SEQ ID NO: 26166 - DNA, 25 bp, E. coli
tctggaagaaattaactgaatcatt

SEQ ID NO: 26167 - DNA, 25 bp, E. coli
tctggaagaaataaactgaatcatt

SEQ ID NO: 26168 - DNA, 25 bp, E. coli
gaaataaactgattcattgcatctg

SEQ ID NO: 26169 - DNA, 25 bp, E. coli
gaaataaactgaatcattgcatctg

SEQ ID NO: 26170 - DNA, 25 bp, E. coli
cgccggtgtgaaagtcgtcacattt

SEQ ID NO: 26171 - DNA, 25 bp, E. coli
cgccggtgtgaatgtcgtcacattt

SEQ ID NO: 26172 - DNA, 25 bp, E. coli
cattatcgtattatgtttctttatc

SEQ ID NO: 26173 - DNA, 25 bp, E. coli
cattatcgtattttgtttctttatc

SEQ ID NO: 26174 - DNA, 25 bp, E. coli
gattattaatatcaccgccggtgtg

SEQ ID NO: 26175 - DNA, 25 bp, E. coli
gattattaatatgaccgccggtgtg

SEQ ID NO: 26176 - DNA, 25 bp, E. coli
taacttcgattattaatatcaccgc

SEQ ID NO: 26177 - DNA, 25 bp, E. coli
cagcaagctgccgatcgtggtgtat

SEQ ID NO: 26178 - DNA, 25 bp, E. coli
cagcaagctgcccatcgtggtgtat

SEQ ID NO: 26179 - DNA, 25 bp, E. coli
acgatgatggcctgcccggatggca

SEQ ID NO: 26180 - DNA, 25 bp, E. coli
acgatgatggccagcccggatggca

SEQ ID NO: 26181 - DNA, 25 bp, E. coli
tcgtggtgtataggccagacaatgt

SEQ ID NO: 26182 - DNA, 25 bp, E. coli
tcgtggtgtatacgccagacaatgt

SEQ ID NO: 26183 - DNA, 25 bp, E. coli
gaagatgaatcttccctgaaagtag

SEQ ID NO: 26184 - DNA, 25 bp, E. coli
gaagatgaatctaccctgaaagtag

SEQ ID NO: 26185 - DNA, 25 bp, E. coli
gaagaaatttgtcaccgcgtatctg

SEQ ID NO: 26186 - DNA, 25 bp, E. coli
gcaatttgcatcgtctcggcgggaa

SEQ ID NO: 26187 - DNA, 25 bp, E. coli
gaagaccattctacctgcagtattg

SEQ ID NO: 26188 - DNA, 25 bp, E. coli
gaagaaatttgtgaccgcgtatctg

SEQ ID NO: 26189 - DNA, 25 bp, E. coli
gcaatttgcatcctctcggcgggaa

SEQ ID NO: 26190 - DNA, 25 bp, E. coli
gaagaccattcttcctgcagtattg

SEQ ID NO: 26191 - DNA, 25 bp, E. coli
cccggatggcaagaaagagaagaaa

SEQ ID NO: 26192 - DNA, 25 bp, E. coli
cccggatggcaacaaagagaagaaa

SEQ ID NO: 26193 - DNA, 25 bp, E. coli
ctggaaggcggatgagaaaattgac

SEQ ID NO: 26194 - DNA, 25 bp, E. coli
ctggaaggcggaagagaaaattgac

SEQ ID NO: 26195 - DNA, 25 bp, E. coli
ggaatgctgcgttacaacagcaagc

SEQ ID NO: 26196 - DNA, 25 bp, E. coli
ggaatgctgcgtaacaacagcaagc

SEQ ID NO: 26197 - DNA, 25 bp, E. coli
taatcggtcagaggctggaagtcga

SEQ ID NO: 26198 - DNA, 25 bp, E. coli
taatcggtcagacgctggaagtcga

SEQ ID NO: 26199 - DNA, 25 bp, E. coli
cagtcagactgtatcttggatttta

SEQ ID NO: 26200 - DNA, 25 bp, E. coli
cagtcagactgtttcttggatttta

SEQ ID NO: 26201 - DNA, 25 bp, E. coli
taaagaacctgatacagtcagactg

SEQ ID NO: 26202 - DNA, 25 bp, E. coli
taaagaacctgaaacagtcagactg

SEQ ID NO: 26203 - DNA, 25 bp, E. coli
agaccttacgcacctccgggagctt

SEQ ID NO: 26204 - DNA, 25 bp, E. coli
agaccttacgcagctccgggagctt

SEQ ID NO: 26205 - DNA, 25 bp, E. coli
tatcgcggattatagaacctgaaac

SEQ ID NO: 26206 - DNA, 25 bp, E. coli
tatcgcggattaaagaacctgaaac

SEQ ID NO: 26207 - DNA, 25 bp, E. coli
ttaagcccaaaaagaccttacgcag

SEQ ID NO: 26208 - DNA, 25 bp, E. coli
ttaagcccaaaatgaccttacgcag

SEQ ID NO: 26209 - DNA, 25 bp, E. coli
ccaaaaagacctaacgcagctccgg

SEQ ID NO: 26210 - DNA, 25 bp, E. coli
ccaaaaagaccttacgcagctccgg

SEQ ID NO: 26211 - DNA, 25 bp, E. coli
gctccgggagcttcgttatatcgcg

SEQ ID NO: 26212 - DNA, 25 bp, E. coli
gctccgggagctacgttatatcgcg

SEQ ID NO: 26213 - DNA, 25 bp, E. coli
gacctttgtcaaatattaagcccaa

SEQ ID NO: 26214 - DNA, 25 bp, E. coli
gaaaaattcttatgacctttgtcaa

SEQ ID NO: 26215 - DNA, 25 bp, E. coli
gaaaaattcttaagacctttgtcaa

SEQ ID NO: 26216 - DNA, 25 bp, E. coli
ggagcttcgttatatcgcggattaa

SEQ ID NO: 26217 - DNA, 25 bp, E. coli
ggagcttcgttaaatcgcggattaa

SEQ ID NO: 26218 - DNA, 25 bp, E. coli
tggattttacaaactcttattcggg

SEQ ID NO: 26219 - DNA, 25 bp, E. coli
tggattttacaatctcttattcggg

SEQ ID NO: 26220 - DNA, 25 bp, E. coli
gacctttgtcaattattaagcccaa

SEQ ID NO: 26221 - DNA, 25 bp, E. coli
caggtcagaaaatgaaacgtgatgc

SEQ ID NO: 26222 - DNA, 25 bp, E. coli
cagaaaaagaaacgtgatgcggagc

SEQ ID NO: 26223 - DNA, 25 bp, E. coli
caggtcagaaaaagaaacgtgatgc

SEQ ID NO: 26224 - DNA, 25 bp, E. coli
cagaaaaagaaaggtgatgcggagc

SEQ ID NO: 26225 - DNA, 25 bp, E. coli
aaacgtgatgcggagcatggcgaat

SEQ ID NO: 26226 - DNA, 25 bp, E. coli
aaaagaaacgtgatgcggagcatgg

SEQ ID NO: 26227 - DNA, 25 bp, E. coli
aaaagaaacgtgttgcggagcatgg

SEQ ID NO: 26228 - DNA, 25 bp, E. coli
aaacgtgatgcgcagcatggcgaat

SEQ ID NO: 26229 - DNA, 25 bp, E. coli
tatccgtgatgtggcacagccgtgt

SEQ ID NO: 26230 - DNA, 25 bp, E. coli
tatccgtgatgtcgcacagccgtgt

SEQ ID NO: 26231 - DNA, 25 bp, E. coli
tccggcaggtcacaaaaagaaacgt

SEQ ID NO: 26232 - DNA, 25 bp, E. coli
tccggcaggtcagaaaaagaaacgt

SEQ ID NO: 26233 - DNA, 25 bp, E. coli
ccgtgtgcggagctgctggttcgcc

SEQ ID NO: 26234 - DNA, 25 bp, E. coli
gcgacgtccggcaggtcagaaaaag

SEQ ID NO: 26235 - DNA, 25 bp, E. coli
gcgacgtccggctggtcagaaaaag

SEQ ID NO: 26236 - DNA, 25 bp, E. coli
ccgtgtgcggaggtgctggttcgcc

SEQ ID NO: 26237 - DNA, 25 bp, E. coli
cggagcatggcgaatgtggaacctt

SEQ ID NO: 26238 - DNA, 25 bp, E. coli
cggagcatggcgtatgtggaacctt

SEQ ID NO: 26239 - DNA, 25 bp, E. coli
gggatatccgtgatgtggcacagcc

SEQ ID NO: 26240 - DNA, 25 bp, E. coli
gggatatccgtgttgtggcacagcc

SEQ ID NO: 26241 - DNA, 25 bp, E. coli
gagcatggcgaatgtggaacctttt

SEQ ID NO: 26242 - DNA, 25 bp, E. coli
gagcatggcgaaagtggaacctttt

SEQ ID NO: 26243 - DNA, 25 bp, E. coli
agaaatcgctctcacccgcgaacag

SEQ ID NO: 26244 - DNA, 25 bp, E. coli
agaaatcgctctgacccgcgaacag

SEQ ID NO: 26245 - DNA, 25 bp, E. coli
tatgttggcctgaatggcgctatca

SEQ ID NO: 26246 - DNA, 25 bp, E. coli
tatgttggcctgtatggcgctatca

SEQ ID NO: 26247 - DNA, 25 bp, E. coli
tgatgcagaaatcgctctgacccgc

SEQ ID NO: 26248 - DNA, 25 bp, E. coli
tgaatggcgctaacatcggtatgac

SEQ ID NO: 26249 - DNA, 25 bp, E. coli
tgaatggcgctatcatcggtatgac

SEQ ID NO: 26250 - DNA, 25 bp, E. coli
tgatgcagaaatggctctgacccgc

SEQ ID NO: 26251 - DNA, 25 bp, E. coli
tgcgccgctgggagatgcagaaatc

SEQ ID NO: 26252 - DNA, 25 bp, E. coli
tgcgccgctgggtgatgcagaaatc

SEQ ID NO: 26253 - DNA, 25 bp, E. coli
gaatgagaagttagcggcttacgcg

SEQ ID NO: 26254 - DNA, 25 bp, E. coli
gaagtttgcggcatacgcgaaagct

SEQ ID NO: 26255 - DNA, 25 bp, E. coli
gaagtttgcggcttacgcgaaagct

SEQ ID NO: 26256 - DNA, 25 bp, E. coli
gaatgagaagtttgcggcttacgcg

SEQ ID NO: 26257 - DNA, 25 bp, E. coli
gaaagaatctgcatggaatgagaag

SEQ ID NO: 26258 - DNA, 25 bp, E. coli
gaaagaatctgcttggaatgagaag

SEQ ID NO: 26259 - DNA, 25 bp, E. coli
cgctgggtgatgcagaaatcgctct

SEQ ID NO: 26260 - DNA, 25 bp, E. coli
cgctgggtgatggagaaatcgctct

SEQ ID NO: 26261 - DNA, 25 bp, E. coli
ggtgagtcagctgcggcagagttgc

SEQ ID NO: 26262 - DNA, 25 bp, E. coli
ggtgagtcagctccggcagagttgc

SEQ ID NO: 26263 - DNA, 25 bp, E. coli
tggcgctatcatgggtatgaccacc

SEQ ID NO: 26264 - DNA, 25 bp, E. coli
tggcgctatcatcggtatgaccacc

SEQ ID NO: 26265 - DNA, 25 bp, E. coli
caatgtgccattccggggtgttttc

SEQ ID NO: 26266 - DNA, 25 bp, E. coli
caatgtgccattgcggggtgttttc

SEQ ID NO: 26267 - DNA, 25 bp, E. coli
cattgcggggtgttttcgttcagga

SEQ ID NO: 26268 - DNA, 25 bp, E. coli
cattgcggggtgatttcgttcagga

SEQ ID NO: 26269 - DNA, 25 bp, E. coli
cggaagtgcgaatccggattagcag

SEQ ID NO: 26270 - DNA, 25 bp, E. coli
cggaagtgcgaaaccggattagcag

SEQ ID NO: 26271 - DNA, 25 bp, E. coli
aggactacgactgccacacacaacc

SEQ ID NO: 26272 - DNA, 25 bp, E. coli
attagcagccaatgtgccattgcgg

SEQ ID NO: 26273 - DNA, 25 bp, E. coli
attagcagccaaagtgccattgcgg

SEQ ID NO: 26274 - DNA, 25 bp, E. coli
aggactacgactcccacacacaacc

SEQ ID NO: 26275 - DNA, 25 bp, E. coli
ttagcagccaatctgccattgcggg

SEQ ID NO: 26276 - DNA, 25 bp, E. coli
ttagcagccaatgtgccattgcggg

SEQ ID NO: 26277 - DNA, 25 bp, E. coli
ttcaggactacgtctcccacacaca

SEQ ID NO: 26278 - DNA, 25 bp, E. coli
ttcaggactacgactcccacacaca

SEQ ID NO: 26279 - DNA, 25 bp, E. coli
ccggaagtgcgaatccggattagca

SEQ ID NO: 26280 - DNA, 25 bp, E. coli
ccggaagtgcgattccggattagca

SEQ ID NO: 26281 - DNA, 25 bp, E. coli
gaagtgcgaatccggattagcagcc

SEQ ID NO: 26282 - DNA, 25 bp, E. coli
gaagtgcgaatcgggattagcagcc

SEQ ID NO: 26283 - DNA, 25 bp, E. coli
gactcccacacacaaccaaagctaa

SEQ ID NO: 26284 - DNA, 25 bp, E. coli
gactcccacacagaaccaaagctaa

SEQ ID NO: 26285 - DNA, 25 bp, E. coli
gattagcagccaatgtgccattgcg

SEQ ID NO: 26286 - DNA, 25 bp, E. coli
gattagcagccattgtgccattgcg

SEQ ID NO: 26287 - DNA, 25 bp, E. coli
aaagttactttaagcggcgtggcgc

SEQ ID NO: 26288 - DNA, 25 bp, E. coli
actgctggcgatgcggacatggcta

SEQ ID NO: 26289 - DNA, 25 bp, E. coli
aaagttactttatgcggcgtggcgc

SEQ ID NO: 26290 - DNA, 25 bp, E. coli
actgctggcgatccggacatggcta

SEQ ID NO: 26291 - DNA, 25 bp, E. coli
tttaggcttaaaagccggagccgct

SEQ ID NO: 26292 - DNA, 25 bp, E. coli
tttaggcttaaatgccggagccgct

SEQ ID NO: 26293 - DNA, 25 bp, E. coli
tgttgcaggctgtcattcgtaaccc

SEQ ID NO: 26294 - DNA, 25 bp, E. coli
tgttgcaggctgacattcgtaaccc

SEQ ID NO: 26295 - DNA, 25 bp, E. coli
tgctctgtggcgcagccgtatcgat

SEQ ID NO: 26296 - DNA, 25 bp, E. coli
tgctctgtggcggagccgtatcgat

SEQ ID NO: 26297 - DNA, 25 bp, E. coli
tcttgacgaacatacactgctggcg

SEQ ID NO: 26298 - DNA, 25 bp, E. coli
tcttgacgaacaaacactgctggcg

SEQ ID NO: 26299 - DNA, 25 bp, E. coli
ccacaaacggtgttgcaggcatttc

SEQ ID NO: 26300 - DNA, 25 bp, E. coli
ccacaaacggtgatgcaggcatttc

SEQ ID NO: 26301 - DNA, 25 bp, E. coli
ccccatgagttagcgaccggtgtca

SEQ ID NO: 26302 - DNA, 25 bp, E. coli
ccgtatcgattggtggccccattgg

SEQ ID NO: 26303 - DNA, 25 bp, E. coli
ccgtatcgattgctggccccattgg

SEQ ID NO: 26304 - DNA, 25 bp, E. coli
ccccatgagttaccgaccggtgtca

SEQ ID NO: 26305 - DNA, 25 bp, E. coli
gatattgctgctatcctccgcaggg

SEQ ID NO: 26306 - DNA, 25 bp, E. coli
gatattgctgctttcctccgcaggg

SEQ ID NO: 26307 - DNA, 25 bp, E. coli
taattgtaagactccgtttgccgcg

SEQ ID NO: 26308 - DNA, 25 bp, E. coli
taattgtaagacaccgtttgccgcg

SEQ ID NO: 26309 - DNA, 25 bp, E. coli
aatttgcgcatttatcgctgccgac

SEQ ID NO: 26310 - DNA, 25 bp, E. coli
aatttgcgcattaatcgctgccgac

SEQ ID NO: 26311 - DNA, 25 bp, E. coli
atttgcgcattaatcgctgccgaca

SEQ ID NO: 26312 - DNA, 25 bp, E. coli
attaatcgctgcggacaaaggcgca

SEQ ID NO: 26313 - DNA, 25 bp, E. coli
attaatcgctgccgacaaaggcgca

SEQ ID NO: 26314 - DNA, 25 bp, E. coli
atttgcgcattattcgctgccgaca

SEQ ID NO: 26315 - DNA, 25 bp, E. coli
tttgcgcattaatcgctgccgacaa

SEQ ID NO: 26316 - DNA, 25 bp, E. coli
ttgcgcattaatcgctgccgacaaa

SEQ ID NO: 26317 - DNA, 25 bp, E. coli
ttgcgcattaatggctgccgacaaa

SEQ ID NO: 26318 - DNA, 25 bp, E. coli
tttgcgcattaaacgctgccgacaa

SEQ ID NO: 26319 - DNA, 25 bp, E. coli
gcattaatcgctgccgacaaaggcg

SEQ ID NO: 26320 - DNA, 25 bp, E. coli
gcattaatcgctcccgacaaaggcg

SEQ ID NO: 26321 - DNA, 25 bp, E. coli
gcgcattaatcggtgccgacaaagg

SEQ ID NO: 26322 - DNA, 25 bp, E. coli
gcgcattaatcgctgccgacaaagg

SEQ ID NO: 26323 - DNA, 25 bp, E. coli
cgtaatttgcgctttaatcgctgcc

SEQ ID NO: 26324 - DNA, 25 bp, E. coli
cgtaatttgcgcattaatcgctgcc

SEQ ID NO: 26325 - DNA, 25 bp, E. coli
gtaatttgcgcattaatcgctgccg

SEQ ID NO: 26326 - DNA, 25 bp, E. coli
gtaatttgcgcaataatcgctgccg

SEQ ID NO: 26327 - DNA, 25 bp, E. coli
taatttgcgcattaatcgctgccga

SEQ ID NO: 26328 - DNA, 25 bp, E. coli
taatttgcgcataaatcgctgccga

SEQ ID NO: 26329 - DNA, 25 bp, E. coli
gatggttgctcccgttcgtctgatg

SEQ ID NO: 26330 - DNA, 25 bp, E. coli
gatggttgctccggttcgtctgatg

SEQ ID NO: 26331 - DNA, 25 bp, E. coli
actgcgtgtacggtccggtgactgc

SEQ ID NO: 26332 - DNA, 25 bp, E. coli
actgcgtgtacgctccggtgactgc

SEQ ID NO: 26333 - DNA, 25 bp, E. coli
tagcaactgttgattgcaattcccg

SEQ ID NO: 26334 - DNA, 25 bp, E. coli
tagcaactgttgtttgcaattcccg

SEQ ID NO: 26335 - DNA, 25 bp, E. coli
tcgtcatcctcacgtactgcgtgta

SEQ ID NO: 26336 - DNA, 25 bp, E. coli
tgccattttggcaccgggatgtgct

SEQ ID NO: 26337 - DNA, 25 bp, E. coli
tgccattttggctccgggatgtgct

SEQ ID NO: 26338 - DNA, 25 bp, E. coli
tcgtcatcctcaggtactgcgtgta

SEQ ID NO: 26339 - DNA, 25 bp, E. coli
tcggcctggcttgtttgccattttg

SEQ ID NO: 26340 - DNA, 25 bp, E. coli
tcggcctggcttctttgccattttg

SEQ ID NO: 26341 - DNA, 25 bp, E. coli
gcaattcccgcaaaaatgagtaaaa

SEQ ID NO: 26342 - DNA, 25 bp, E. coli
gcaattcccgcataaatgagtaaaa

SEQ ID NO: 26343 - DNA, 25 bp, E. coli
cgccgacggcctattacagcagagt

SEQ ID NO: 26344 - DNA, 25 bp, E. coli
cgccgacggccttttacagcagagt

SEQ ID NO: 26345 - DNA, 25 bp, E. coli
cggccttttacagcagagttagcaa

SEQ ID NO: 26346 - DNA, 25 bp, E. coli
cggccttttacaccagagttagcaa

SEQ ID NO: 26347 - DNA, 25 bp, E. coli
gggatgtgctcgacatcctcacgta

SEQ ID NO: 26348 - DNA, 25 bp, E. coli
gggatgtgctcgtcatcctcacgta

SEQ ID NO: 26349 - DNA, 25 bp, E. coli
ggcttttaatatgacaccggactcc

SEQ ID NO: 26350 - DNA, 25 bp, E. coli
ggcttttaatatcacaccggactcc

SEQ ID NO: 26351 - DNA, 25 bp, E. coli
tacagcagagtttgcaactgttgat

SEQ ID NO: 26352 - DNA, 25 bp, E. coli
tacagcagagttagcaactgttgat

SEQ ID NO: 26353 - DNA, 25 bp, E. coli
cagatttttgtttacgggcgagagg

SEQ ID NO: 26354 - DNA, 25 bp, E. coli
cagatttttgttaacgggcgagagg

SEQ ID NO: 26355 - DNA, 25 bp, E. coli
actgcggcggatgttgccgatccac

SEQ ID NO: 26356 - DNA, 25 bp, E. coli
actgcggcggatcttgccgatccac

SEQ ID NO: 26357 - DNA, 25 bp, E. coli
tatggcgttatcacaacgaattgct

SEQ ID NO: 26358 - DNA, 25 bp, E. coli
tatggcgttatctcaacgaattgct

SEQ ID NO: 26359 - DNA, 25 bp, E. coli
tgccgatccacatttgctgcgcgaa

SEQ ID NO: 26360 - DNA, 25 bp, E. coli
tgccgatccacaattgctgcgcgaa

SEQ ID NO: 26361 - DNA, 25 bp, E. coli
gaaggagccgcgtatcataatcgtc

SEQ ID NO: 26362 - DNA, 25 bp, E. coli
gaaggagccgcgaatcataatcgtc

SEQ ID NO: 26363 - DNA, 25 bp, E. coli
gaattgcttgctcctgacaacccga

SEQ ID NO: 26364 - DNA, 25 bp, E. coli
gaattgcttgctgctgacaacccga

SEQ ID NO: 26365 - DNA, 25 bp, E. coli
gaaaatgaaaaatcttgccggtgcg

SEQ ID NO: 26366 - DNA, 25 bp, E. coli
gaaaatgaaaaaacttgccggtgcg

SEQ ID NO: 26367 - DNA, 25 bp, E. coli
cggtgaaccgggaatgcagattttt

SEQ ID NO: 26368 - DNA, 25 bp, E. coli
ctttgctcggtgacgaaggagccgc

SEQ ID NO: 26369 - DNA, 25 bp, E. coli
cggtgaaccgggtatgcagattttt

SEQ ID NO: 26370 - DNA, 25 bp, E. coli
ctttgctcggtgtcgaaggagccgc

SEQ ID NO: 26371 - DNA, 25 bp, E. coli
gatcttggttcgctttatccattcc

SEQ ID NO: 26372 - DNA, 25 bp, E. coli
gggaagcgctggttacactgactca

SEQ ID NO: 26373 - DNA, 25 bp, E. coli
gggaagcgctggatacactgactca

SEQ ID NO: 26374 - DNA, 25 bp, E. coli
gatcttggttcggtttatccattcc

SEQ ID NO: 26375 - DNA, 25 bp, E. coli
aaacgttcgccgctgatgcagcact

SEQ ID NO: 26376 - DNA, 25 bp, E. coli
aaacgttcgccggtgatgcagcact

SEQ ID NO: 26377 - DNA, 25 bp, E. coli
tatctacggaacaacgtcagggccg

SEQ ID NO: 26378 - DNA, 25 bp, E. coli
tatctacggaactacgtcagggccg

SEQ ID NO: 26379 - DNA, 25 bp, E. coli
tgtcacaacagggagtagaccagga

SEQ ID NO: 26380 - DNA, 25 bp, E. coli
tgtcacaacaggcagtagaccagga

SEQ ID NO: 26381 - DNA, 25 bp, E. coli
tcgggcagtgggatcaaacgttcgc

SEQ ID NO: 26382 - DNA, 25 bp, E. coli
tccgtgcaggtaacaaagttcgctt

SEQ ID NO: 26383 - DNA, 25 bp, E. coli
tccgtgcaggtatcaaagttcgctt

SEQ ID NO: 26384 - DNA, 25 bp, E. coli
tcgggcagtgggttcaaacgttcgc

SEQ ID NO: 26385 - DNA, 25 bp, E. coli
gactcagacagatacgaaaagccgg

SEQ ID NO: 26386 - DNA, 25 bp, E. coli
gaaagccttataagcgcagcgcctg

SEQ ID NO: 26387 - DNA, 25 bp, E. coli
gactcagacagaaacgaaaagccgg

SEQ ID NO: 26388 - DNA, 25 bp, E. coli
gaaagccttatatgcgcagcgcctg

SEQ ID NO: 26389 - DNA, 25 bp, E. coli
cgatgtataccccaatggcagcctt

SEQ ID NO: 26390 - DNA, 25 bp, E. coli
cgcttcagcgtgcagtaatggcccc

SEQ ID NO: 26391 - DNA, 25 bp, E. coli
cgcttcagcgtggagtaatggcccc

SEQ ID NO: 26392 - DNA, 25 bp, E. coli
cgttacgaaaagtgcgcaatgatcc

SEQ ID NO: 26393 - DNA, 25 bp, E. coli
cgttacgaaaagagcgcaatgatcc

SEQ ID NO: 26394 - DNA, 25 bp, E. coli
cgatgtatacccgaatggcagcctt

SEQ ID NO: 26395 - DNA, 25 bp, E. coli
gtatgacttcactttcgccaccgga

SEQ ID NO: 26396 - DNA, 25 bp, E. coli
gtatgacttcacattcgccaccgga

SEQ ID NO: 26397 - DNA, 25 bp, E. coli
attagctgcggtcctgtttacctcc

SEQ ID NO: 26398 - DNA, 25 bp, E. coli
attagctgcggtgctgtttacctcc

SEQ ID NO: 26399 - DNA, 25 bp, E. coli
taccggacgcaataaagatattatt

SEQ ID NO: 26400 - DNA, 25 bp, E. coli
taccggacgcaaaaaagatattatt

SEQ ID NO: 26401 - DNA, 25 bp, E. coli
tgcatggcgtaagggcaccattctt

SEQ ID NO: 26402 - DNA, 25 bp, E. coli
tgcatggcgtaacggcaccattctt

SEQ ID NO: 26403 - DNA, 25 bp, E. coli
tctgcatggcgttacggcaccattc

SEQ ID NO: 26404 - DNA, 25 bp, E. coli
tctgcatggcgtaacggcaccattc

SEQ ID NO: 26405 - DNA, 25 bp, E. coli
ccattcttaattcgcgctcgcagcg

SEQ ID NO: 26406 - DNA, 25 bp, E. coli
ccattcttaattggcgctcgcagcg

SEQ ID NO: 26407 - DNA, 25 bp, E. coli
gaattagctgcgctgctgtttacct

SEQ ID NO: 26408 - DNA, 25 bp, E. coli
gaattagctgcggtgctgtttacct

SEQ ID NO: 26409 - DNA, 25 bp, E. coli
cgatgaattagctgcggtgctgttt

SEQ ID NO: 26410 - DNA, 25 bp, E. coli
cgatgaattagcagcggtgctgttt

SEQ ID NO: 26411 - DNA, 25 bp, E. coli
cttaattggcgcacgcagcgtgttg

SEQ ID NO: 26412 - DNA, 25 bp, E. coli
cttaattggcgctcgcagcgtgttg

SEQ ID NO: 26413 - DNA, 25 bp, E. coli
ggcgtaacggcagcattcttaattg

SEQ ID NO: 26414 - DNA, 25 bp, E. coli
ggcaccattctttattggcgctcgc

SEQ ID NO: 26415 - DNA, 25 bp, E. coli
ggcgtaacggcaccattcttaattg

SEQ ID NO: 26416 - DNA, 25 bp, E. coli
ggcaccattcttaattggcgctcgc

SEQ ID NO: 26417 - DNA, 25 bp, E. coli
taacggcaccattcttaattggcgc

SEQ ID NO: 26418 - DNA, 25 bp, E. coli
taacggcaccatacttaattggcgc

SEQ ID NO: 26419 - DNA, 25 bp, E. coli
aattgcgttcttcatgcactttcca

SEQ ID NO: 26420 - DNA, 25 bp, E. coli
aattgcgttcttgatgcactttcca

SEQ ID NO: 26421 - DNA, 25 bp, E. coli
catcattagcttggtcgtgggtact

SEQ ID NO: 26422 - DNA, 25 bp, E. coli
catcattagcttcgtcgtgggtact

SEQ ID NO: 26423 - DNA, 25 bp, E. coli
cagtgtcaaaaacggctgtcatcct

SEQ ID NO: 26424 - DNA, 25 bp, E. coli
cagtgtcaaaaagggctgtcatcct

SEQ ID NO: 26425 - DNA, 25 bp, E. coli
caaaaacggctgtcatcctaaccat

SEQ ID NO: 26426 - DNA, 25 bp, E. coli
caaaaacggctgacatcctaaccat

SEQ ID NO: 26427 - DNA, 25 bp, E. coli
tttccctcaggacccgacagtgtca

SEQ ID NO: 26428 - DNA, 25 bp, E. coli
tttccctcaggagccgacagtgtca

SEQ ID NO: 26429 - DNA, 25 bp, E. coli
tgactaaagtacctaattgcgttct

SEQ ID NO: 26430 - DNA, 25 bp, E. coli
tgactaaagtacgtaattgcgttct

SEQ ID NO: 26431 - DNA, 25 bp, E. coli
gcactttccatctacgtcaacaaca

SEQ ID NO: 26432 - DNA, 25 bp, E. coli
gcactttccatcaacgtcaacaaca

SEQ ID NO: 26433 - DNA, 25 bp, E. coli
gtcatcctaaccattttaacagcaa

SEQ ID NO: 26434 - DNA, 25 bp, E. coli
gtcaacaacatcattagcttggtcg

SEQ ID NO: 26435 - DNA, 25 bp, E. coli
gtcaacaacatctttagcttggtcg

SEQ ID NO: 26436 - DNA, 25 bp, E. coli
gtcatcctaacctttttaacagcaa

SEQ ID NO: 26437 - DNA, 25 bp, E. coli
tggtcgtgggtactttccctcagga

SEQ ID NO: 26438 - DNA, 25 bp, E. coli
tggtcgtgggtagtttccctcagga

SEQ ID NO: 26439 - DNA, 25 bp, E. coli
gacccgacagtgacaaaaacggctg

SEQ ID NO: 26440 - DNA, 25 bp, E. coli
gacccgacagtgtcaaaaacggctg

SEQ ID NO: 26441 - DNA, 25 bp, E. coli
caagtcgcaagttaatccagcaagt

SEQ ID NO: 26442 - DNA, 25 bp, E. coli
caagtcgcaagtaaatccagcaagt

SEQ ID NO: 26443 - DNA, 25 bp, E. coli
tacccacggtattgataccaatatg

SEQ ID NO: 26444 - DNA, 25 bp, E. coli
aaaagcgattgcgaatcagggctgt

SEQ ID NO: 26445 - DNA, 25 bp, E. coli
aaaagcgattgccaatcagggctgt

SEQ ID NO: 26446 - DNA, 25 bp, E. coli
taccaatatggctatcagctccggt

SEQ ID NO: 26447 - DNA, 25 bp, E. coli
taccaatatggcaatcagctccggt

SEQ ID NO: 26448 - DNA, 25 bp, E. coli
tacccacggtatagataccaatatg

SEQ ID NO: 26449 - DNA, 25 bp, E. coli
tcagctccggttaaaatgcctataa

SEQ ID NO: 26450 - DNA, 25 bp, E. coli
tcagctccggtttaaatgcctataa

SEQ ID NO: 26451 - DNA, 25 bp, E. coli
gccgatgcaaaagcgattgccaatc

SEQ ID NO: 26452 - DNA, 25 bp, E. coli
gccgatgcaaaaccgattgccaatc

SEQ ID NO: 26453 - DNA, 25 bp, E. coli
gcaatcaagtcggaagtaaatccag

SEQ ID NO: 26454 - DNA, 25 bp, E. coli
gcaatcaagtcgcaagtaaatccag

SEQ ID NO: 26455 - DNA, 25 bp, E. coli
gtttaaatgcctataaagcagcaac

SEQ ID NO: 26456 - DNA, 25 bp, E. coli
gtttaaatgcctttaaagcagcaac

SEQ ID NO: 26457 - DNA, 25 bp, E. coli
gggtgtcaaaattcccacggtattg

SEQ ID NO: 26458 - DNA, 25 bp, E. coli
gggtgtcaaaatacccacggtattg

SEQ ID NO: 26459 - DNA, 25 bp, E. coli
ggacagcggcaatcaagtcgcaagt

SEQ ID NO: 26460 - DNA, 25 bp, E. coli
ggacagcggcaaacaagtcgcaagt

SEQ ID NO: 26461 - DNA, 25 bp, E. coli
taatcaacggatgattcacatgaag

SEQ ID NO: 26462 - DNA, 25 bp, E. coli
taatcaacggatcattcacatgaag

SEQ ID NO: 26463 - DNA, 25 bp, E. coli
tatccctattgcagccggtgctgcg

SEQ ID NO: 26464 - DNA, 25 bp, E. coli
tatatgaacgcaacccgtttgcaag

SEQ ID NO: 26465 - DNA, 25 bp, E. coli
tatatgaacgcatcccgtttgcaag

SEQ ID NO: 26466 - DNA, 25 bp, E. coli
tatccctattgctgccggtgctgcg

SEQ ID NO: 26467 - DNA, 25 bp, E. coli
tgttgtttatatcaacgcatcccgt

SEQ ID NO: 26468 - DNA, 25 bp, E. coli
tgttgctgctccttgttgtttatat

SEQ ID NO: 26469 - DNA, 25 bp, E. coli
tgttgtttatatgaacgcatcccgt

SEQ ID NO: 26470 - DNA, 25 bp, E. coli
tgttgctgctccatgttgtttatat

SEQ ID NO: 26471 - DNA, 25 bp, E. coli
tgacgttgacggtagattgctgctc

SEQ ID NO: 26472 - DNA, 25 bp, E. coli
tgacgttgacggaagattgctgctc

SEQ ID NO: 26473 - DNA, 25 bp, E. coli
tgcgggcctcgaagagattcgctga

SEQ ID NO: 26474 - DNA, 25 bp, E. coli
tgcgggcctcgatgagattcgctga

SEQ ID NO: 26475 - DNA, 25 bp, E. coli
tctatatccctaatgcagccggtgc

SEQ ID NO: 26476 - DNA, 25 bp, E. coli
tctatatccctattgcagccggtgc

SEQ ID NO: 26477 - DNA, 25 bp, E. coli
gctgcgggcctccatgagattcgct

SEQ ID NO: 26478 - DNA, 25 bp, E. coli
gcatcccgtttggaaggcttccgtg

SEQ ID NO: 26479 - DNA, 25 bp, E. coli
gcatcccgtttgcaaggcttccgtg

SEQ ID NO: 26480 - DNA, 25 bp, E. coli
gctgcgggcctcgatgagattcgct

SEQ ID NO: 26481 - DNA, 25 bp, E. coli
ggtagattgctggtctatatcccta

SEQ ID NO: 26482 - DNA, 25 bp, E. coli
ggtagattgctgctctatatcccta

SEQ ID NO: 26483 - DNA, 25 bp, E. coli
ggcttccgtgttattgacgttgacg

SEQ ID NO: 26484 - DNA, 25 bp, E. coli
ggcttccgtgtttttgacgttgacg

SEQ ID NO: 26485 - DNA, 25 bp, E. coli
cacataaatctatgccgcgtccgga

SEQ ID NO: 26486 - DNA, 25 bp, E. coli
cacataaatctaagccgcgtccgga

SEQ ID NO: 26487 - DNA, 25 bp, E. coli
ttcattaaagatcatgccgcgcgtg

SEQ ID NO: 26488 - DNA, 25 bp, E. coli
ttggctgggcaagcactgcgcagtt

SEQ ID NO: 26489 - DNA, 25 bp, E. coli
ttggctgggcaaccactgcgcagtt

SEQ ID NO: 26490 - DNA, 25 bp, E. coli
ttgaagctgcacctaaagacccggt

SEQ ID NO: 26491 - DNA, 25 bp, E. coli
ttcattaaagatgatgccgcgcgtg

SEQ ID NO: 26492 - DNA, 25 bp, E. coli
ttgaagctgcacgtaaagacccggt

SEQ ID NO: 26493 - DNA, 25 bp, E. coli
tgatagagtccagccgcaatagcat

SEQ ID NO: 26494 - DNA, 25 bp, E. coli
tgatagagtccacccgcaatagcat

SEQ ID NO: 26495 - DNA, 25 bp, E. coli
tccgaaaagggaatcacacaagtgc

SEQ ID NO: 26496 - DNA, 25 bp, E. coli
tcgctacagcgtcggcaagtgcact

SEQ ID NO: 26497 - DNA, 25 bp, E. coli
tcgctacagcgtgggcaagtgcact

SEQ ID NO: 26498 - DNA, 25 bp, E. coli
tccgaaaagggattcacacaagtgc

SEQ ID NO: 26499 - DNA, 25 bp, E. coli
gcgcgtgccgcaactatccttgaag

SEQ ID NO: 26500 - DNA, 25 bp, E. coli
gcgcgtgccgcatctatccttgaag

SEQ ID NO: 26501 - DNA, 25 bp, E. coli
gatatcgcaaaaggctctaaagctg

SEQ ID NO: 26502 - DNA, 25 bp, E. coli
gatatcgcaaaacgctctaaagctg

SEQ ID NO: 26503 - DNA, 25 bp, E. coli
ggatgccactaaaaaagcgatgctg

SEQ ID NO: 26504 - DNA, 25 bp, E. coli
ggatgccactaataaagcgatgctg

SEQ ID NO: 26505 - DNA, 25 bp, E. coli
gacgctggaaaactgcctgatagag

SEQ ID NO: 26506 - DNA, 25 bp, E. coli
gacgctggaaaagtgcctgatagag

SEQ ID NO: 26507 - DNA, 25 bp, E. coli
aaccatctgacaacggtgaagaccg

SEQ ID NO: 26508 - DNA, 25 bp, E. coli
aaccatctgacatcggtgaagaccg

SEQ ID NO: 26509 - DNA, 25 bp, E. coli
aaatccgggagctgttgcggtaccg

SEQ ID NO: 26510 - DNA, 25 bp, E. coli
aaatccgggagcagttgcggtaccg

SEQ ID NO: 26511 - DNA, 25 bp, E. coli
aacagagcagctagccgttgagcag

SEQ ID NO: 26512 - DNA, 25 bp, E. coli
aacagagcagcttgccgttgagcag

SEQ ID NO: 26513 - DNA, 25 bp, E. coli
ttgcggtaccgggaagagaccctga

SEQ ID NO: 26514 - DNA, 25 bp, E. coli
ttgagcagtcccgtctggcacagat

SEQ ID NO: 26515 - DNA, 25 bp, E. coli
ttgagcagtcccctctggcacagat

SEQ ID NO: 26516 - DNA, 25 bp, E. coli
ttgcggtaccggcaagagaccctga

SEQ ID NO: 26517 - DNA, 25 bp, E. coli
tcagtatgttctcgcgaacccgggc

SEQ ID NO: 26518 - DNA, 25 bp, E. coli
tcagtatgttctggcgaacccgggc

SEQ ID NO: 26519 - DNA, 25 bp, E. coli
gctgcgcgtgcaacaaatgaatctg

SEQ ID NO: 26520 - DNA, 25 bp, E. coli
gctgcgcgtgcatcaaatgaatctg

SEQ ID NO: 26521 - DNA, 25 bp, E. coli
gaatgataatgtcgctgcgcgtgca

SEQ ID NO: 26522 - DNA, 25 bp, E. coli
gaatgataatgtggctgcgcgtgca

SEQ ID NO: 26523 - DNA, 25 bp, E. coli
gaccgtaacggatgggcttgctcag

SEQ ID NO: 26524 - DNA, 25 bp, E. coli
gaccgtaacggaagggcttgctcag

SEQ ID NO: 26525 - DNA, 25 bp, E. coli
ctggcacagatggaggaaaaagcgc

SEQ ID NO: 26526 - DNA, 25 bp, E. coli
ctggcacagatgcaggaaaaagcgc

SEQ ID NO: 26527 - DNA, 25 bp, E. coli
gaccggtgacggattcatgataaac

SEQ ID NO: 26528 - DNA, 25 bp, E. coli
gaccggtgacggtttcatgataaac

SEQ ID NO: 26529 - DNA, 25 bp, E. coli
aattagcgttcctgtcgcactgggc

SEQ ID NO: 26530 - DNA, 25 bp, E. coli
aattagcgttccagtcgcactgggc

SEQ ID NO: 26531 - DNA, 25 bp, E. coli
cagggcgcgctgcataattatttta

SEQ ID NO: 26532 - DNA, 25 bp, E. coli
cagggcgcgctggataattatttta

SEQ ID NO: 26533 - DNA, 25 bp, E. coli
taaaattaccgcacgtggcagtacc

SEQ ID NO: 26534 - DNA, 25 bp, E. coli
taaaattaccgctcgtggcagtacc

SEQ ID NO: 26535 - DNA, 25 bp, E. coli
ccgtaaccggtgagcgtacctggat

SEQ ID NO: 26536 - DNA, 25 bp, E. coli
ccgtaaccggtgtgcgtacctggat

SEQ ID NO: 26537 - DNA, 25 bp, E. coli
aaagcaggttttgctcccgcagctg

SEQ ID NO: 26538 - DNA, 25 bp, E. coli
aaagcaggttttcctcccgcagctg

SEQ ID NO: 26539 - DNA, 25 bp, E. coli
tcgctcacggtagaggtatcggtat

SEQ ID NO: 26540 - DNA, 25 bp, E. coli
tcgttccgggaaagctgggcaaagc

SEQ ID NO: 26541 - DNA, 25 bp, E. coli
tcgctcacggtacaggtatcggtat

SEQ ID NO: 26542 - DNA, 25 bp, E. coli
tcgttccgggaatgctgggcaaagc

SEQ ID NO: 26543 - DNA, 25 bp, E. coli
gaagtactggctggcttaacgacct

SEQ ID NO: 26544 - DNA, 25 bp, E. coli
gaagtactggctcgcttaacgacct

SEQ ID NO: 26545 - DNA, 25 bp, E. coli
cattcagtctggtactcgggcaaca

SEQ ID NO: 26546 - DNA, 25 bp, E. coli
cattcagtctggaactcgggcaaca

SEQ ID NO: 26547 - DNA, 25 bp, E. coli
ggagacatcctacaaacaccggacg

SEQ ID NO: 26548 - DNA, 25 bp, E. coli
ggagacatcctagaaacaccggacg

SEQ ID NO: 26549 - DNA, 25 bp, E. coli
tggcagtaccgtacgtcaggaagta

SEQ ID NO: 26550 - DNA, 25 bp, E. coli
tggcagtaccgttcgtcaggaagta

SEQ ID NO: 26551 - DNA, 25 bp, E. coli
caagactctgttcgtgtaggaagaa

SEQ ID NO: 26552 - DNA, 25 bp, E. coli
caagactctgttggtgtaggaagaa

SEQ ID NO: 26553 - DNA, 25 bp, E. coli
cagactatttcaacaggaggtacgt

SEQ ID NO: 26554 - DNA, 25 bp, E. coli
cagactatttcatcaggaggtacgt

SEQ ID NO: 26555 - DNA, 25 bp, E. coli
catgcatcgcgagttgccagaatgg

SEQ ID NO: 26556 - DNA, 25 bp, E. coli
catgcatcgcgacttgccagaatgg

SEQ ID NO: 26557 - DNA, 25 bp, E. coli
ttacagcgtgttccagggatcagtc

SEQ ID NO: 26558 - DNA, 25 bp, E. coli
ttacagcgtgttgcagggatcagtc

SEQ ID NO: 26559 - DNA, 25 bp, E. coli
ttaatgtcgcattgtggaacctcac

SEQ ID NO: 26560 - DNA, 25 bp, E. coli
ttaatgtcgcatagtggaacctcac

SEQ ID NO: 26561 - DNA, 25 bp, E. coli
gacttctcgactccaaagacgtatg

SEQ ID NO: 26562 - DNA, 25 bp, E. coli
gacttctcgactgcaaagacgtatg

SEQ ID NO: 26563 - DNA, 25 bp, E. coli
cattcgctctgctataggtactcca

SEQ ID NO: 26564 - DNA, 25 bp, E. coli
cattcgctctgcaataggtactcca

SEQ ID NO: 26565 - DNA, 25 bp, E. coli
ggaagagtccgtcggattacgcaca

SEQ ID NO: 26566 - DNA, 25 bp, E. coli
ggaagagtccgtgggattacgcaca

SEQ ID NO: 26567 - DNA, 25 bp, E. coli
tcactgacgcagactgtggcaagag

SEQ ID NO: 26568 - DNA, 25 bp, E. coli
taatgcaattctcggaagcgtggca

SEQ ID NO: 26569 - DNA, 25 bp, E. coli
taatgcaattctgggaagcgtggca

SEQ ID NO: 26570 - DNA, 25 bp, E. coli
tcactgacgcagtctgtggcaagag

SEQ ID NO: 26571 - DNA, 25 bp, E. coli
gagtttccttctatgtgtccggcag

SEQ ID NO: 26572 - DNA, 25 bp, E. coli
gagtttccttctttgtgtccggcag

SEQ ID NO: 26573 - DNA, 25 bp, E. coli
catattctgacggtggaagatcctg

SEQ ID NO: 26574 - DNA, 25 bp, E. coli
catattctgacgctggaagatcctg

SEQ ID NO: 26575 - DNA, 25 bp, E. coli
ataaacaggaaggacgcgtggcgct

SEQ ID NO: 26576 - DNA, 25 bp, E. coli
ataaacaggaagcacgcgtggcgct

SEQ ID NO: 26577 - DNA, 25 bp, E. coli
aaatctaccacgctggcggcgatgg

SEQ ID NO: 26578 - DNA, 25 bp, E. coli
aaatctaccacggtggcggcgatgg

SEQ ID NO: 26579 - DNA, 25 bp, E. coli
tgaatatggaagtaattgtggccct

SEQ ID NO: 26580 - DNA, 25 bp, E. coli
tgaatatggaagaaattgtggccct

SEQ ID NO: 26581 - DNA, 25 bp, E. coli
cctgatgtgattatgctcggagagc

SEQ ID NO: 26582 - DNA, 25 bp, E. coli
cctgatgtgattttgctcggagagc

SEQ ID NO: 26583 - DNA, 25 bp, E. coli
gcattgcgggaagatcctgatgtga

SEQ ID NO: 26584 - DNA, 25 bp, E. coli
gcattgcgggaacatcctgatgtga

SEQ ID NO: 26585 - DNA, 25 bp, E. coli
cccgtgcgtaatgaactggcaggta

SEQ ID NO: 26586 - DNA, 25 bp, E. coli
cccgtgcgtaatcaactggcaggta

SEQ ID NO: 26587 - DNA, 25 bp, E. coli
gggaaaacccacgagttaccgcatg

SEQ ID NO: 26588 - DNA, 25 bp, E. coli
gggaaaacccaccagttaccgcatg

SEQ ID NO: 26589 - DNA, 25 bp, E. coli
tgtggcccttagtgtaaagcataac

SEQ ID NO: 26590 - DNA, 25 bp, E. coli
tgtggcccttagagtaaagcataac

SEQ ID NO: 26591 - DNA, 25 bp, E. coli
taacgtttcagctgagttatcagca

SEQ ID NO: 26592 - DNA, 25 bp, E. coli
taacgtttcagcagagttatcagca

SEQ ID NO: 26593 - DNA, 25 bp, E. coli
taacgtctcggatctacacctgtgc

SEQ ID NO: 26594 - DNA, 25 bp, E. coli
taacgtctcggaactacacctgtgc

SEQ ID NO: 26595 - DNA, 25 bp, E. coli
caaggccctttagctcagtggttag

SEQ ID NO: 26596 - DNA, 25 bp, E. coli
caaggccctttacctcagtggttag

SEQ ID NO: 26597 - DNA, 25 bp, E. coli
cagtggttagagcaggcgactcata

SEQ ID NO: 26598 - DNA, 25 bp, E. coli
cagtggttagaggaggcgactcata

SEQ ID NO: 26599 - DNA, 25 bp, E. coli
tatgatcatcatctttattgcgtgg

SEQ ID NO: 26600 - DNA, 25 bp, E. coli
tatgatcatcatgtttattgcgtgg

SEQ ID NO: 26601 - DNA, 25 bp, E. coli
tattgcgtggtttataagtattgtt

SEQ ID NO: 26602 - DNA, 25 bp, E. coli
tattgttattgcacactcaaggccc

SEQ ID NO: 26603 - DNA, 25 bp, E. coli
tattgcacactcaaggccctttagc

SEQ ID NO: 26604 - DNA, 25 bp, E. coli
tattgttattgctcactcaaggccc

SEQ ID NO: 26605 - DNA, 25 bp, E. coli
tattgcacactctaggccctttagc

SEQ ID NO: 26606 - DNA, 25 bp, E. coli
tattgcgtggttaataagtattgtt

SEQ ID NO: 26607 - DNA, 25 bp, E. coli
gcgtgtaatcaccacccaaggtgaa

SEQ ID NO: 26608 - DNA, 25 bp, E. coli
gcgtgtaatcacgacccaaggtgaa

SEQ ID NO: 26609 - DNA, 25 bp, E. coli
gaatgggaacgcttaaaaatctgtt

SEQ ID NO: 26610 - DNA, 25 bp, E. coli
gaatgggaacgcataaaaatctgtt

SEQ ID NO: 26611 - DNA, 25 bp, E. coli
gacccaaggtgattgggaacgcata

SEQ ID NO: 26612 - DNA, 25 bp, E. coli
gacccaaggtgaatgggaacgcata

SEQ ID NO: 26613 - DNA, 25 bp, E. coli
ctgttatttacatcatatgatcatc

SEQ ID NO: 26614 - DNA, 25 bp, E. coli
cgggttttatgtggcgtgtaatcac

SEQ ID NO: 26615 - DNA, 25 bp, E. coli
ctgttatttacaacatatgatcatc

SEQ ID NO: 26616 - DNA, 25 bp, E. coli
cgggttttatgtcgcgtgtaatcac

SEQ ID NO: 26617 - DNA, 25 bp, E. coli
caccattactggcatatgaccggcg

SEQ ID NO: 26618 - DNA, 25 bp, E. coli
caccattactgggatatgaccggcg

SEQ ID NO: 26619 - DNA, 25 bp, E. coli
agtgcccgccgccatattaatcgtg

SEQ ID NO: 26620 - DNA, 25 bp, E. coli
agtgcccgccgcgatattaatcgtg

SEQ ID NO: 26621 - DNA, 25 bp, E. coli
tattaattgcccctatcgccgtggt

SEQ ID NO: 26622 - DNA, 25 bp, E. coli
tattgcggtagttatggaagtgccc

SEQ ID NO: 26623 - DNA, 25 bp, E. coli
tattgcggtagtaatggaagtgccc

SEQ ID NO: 26624 - DNA, 25 bp, E. coli
tattaattgcccgtatcgccgtggt

SEQ ID NO: 26625 - DNA, 25 bp, E. coli
ttaatcgtgcttggctttttcaccc

SEQ ID NO: 26626 - DNA, 25 bp, E. coli
ttattttctacaggctgggtacggc

SEQ ID NO: 26627 - DNA, 25 bp, E. coli
ttaatcgtgcttcgctttttcaccc

SEQ ID NO: 26628 - DNA, 25 bp, E. coli
ttattttctacacgctgggtacggc

SEQ ID NO: 26629 - DNA, 25 bp, E. coli
cggtacggtccaatatatggcctcg

SEQ ID NO: 26630 - DNA, 25 bp, E. coli
cggtacggtccattatatggcctcg

SEQ ID NO: 26631 - DNA, 25 bp, E. coli
gggccaaatatgtttaatttctgga

SEQ ID NO: 26632 - DNA, 25 bp, E. coli
ggttttcccaaattgatgggctttg

SEQ ID NO: 26633 - DNA, 25 bp, E. coli
gggccaaatatgattaatttctgga

SEQ ID NO: 26634 - DNA, 25 bp, E. coli
ggttttcccaaaatgatgggctttg

SEQ ID NO: 26635 - DNA, 25 bp, E. coli
ggaagaatgtcagtatcgctggcgc

SEQ ID NO: 26636 - DNA, 25 bp, E. coli
ggaagaatgtcactatcgctggcgc

SEQ ID NO: 26637 - DNA, 25 bp, E. coli
gatgctggcagccattattgcggta

SEQ ID NO: 26638 - DNA, 25 bp, E. coli
gatgctggcagcgattattgcggta

SEQ ID NO: 26639 - DNA, 25 bp, E. coli
cacgtgcaaatgtcgctgcctggca

SEQ ID NO: 26640 - DNA, 25 bp, E. coli
cacgtgcaaatgacgctgcctggca

SEQ ID NO: 26641 - DNA, 25 bp, E. coli
attaaacctgttcacatgcgccggg

SEQ ID NO: 26642 - DNA, 25 bp, E. coli
attaaacctgttgacatgcgccggg

SEQ ID NO: 26643 - DNA, 25 bp, E. coli
atgaacctgaacagcgccctgaaaa

SEQ ID NO: 26644 - DNA, 25 bp, E. coli
atgaacctgaactgcgccctgaaaa

SEQ ID NO: 26645 - DNA, 25 bp, E. coli
aagcccgttcgcgtatcaaagttct

SEQ ID NO: 26646 - DNA, 25 bp, E. coli
aagcccgttcgcctatcaaagttct

SEQ ID NO: 26647 - DNA, 25 bp, E. coli
tgtggttgtgtagccgccgtctgca

SEQ ID NO: 26648 - DNA, 25 bp, E. coli
tgtggttgtgtacccgccgtctgca

SEQ ID NO: 26649 - DNA, 25 bp, E. coli
tgactggcagcaggttaagggacat

SEQ ID NO: 26650 - DNA, 25 bp, E. coli
tgactggcagcacgttaagggacat

SEQ ID NO: 26651 - DNA, 25 bp, E. coli
gaactccggtcgacatggcatgagg

SEQ ID NO: 26652 - DNA, 25 bp, E. coli
gaactccggtcgtcatggcatgagg

SEQ ID NO: 26653 - DNA, 25 bp, E. coli
gacgagtttaactggctgattgccg

SEQ ID NO: 26654 - DNA, 25 bp, E. coli
gacgagtttaacaggctgattgccg

SEQ ID NO: 26655 - DNA, 25 bp, E. coli
ggagccgccttcgtctttgttaaca

SEQ ID NO: 26656 - DNA, 25 bp, E. coli
gggcatcgactcactgacgcagtat

SEQ ID NO: 26657 - DNA, 25 bp, E. coli
gggcatcgactctctgacgcagtat

SEQ ID NO: 26658 - DNA, 25 bp, E. coli
ggagccgccttcctctttgttaaca

SEQ ID NO: 26659 - DNA, 25 bp, E. coli
taagggacatgagctgacgaaatgg

SEQ ID NO: 26660 - DNA, 25 bp, E. coli
taagggacatgacctgacgaaatgg

SEQ ID NO: 26661 - DNA, 25 bp, E. coli
atccgtgctgaacgtcagccagacg

SEQ ID NO: 26662 - DNA, 25 bp, E. coli
atccgtgctgaaggtcagccagacg

SEQ ID NO: 26663 - DNA, 25 bp, E. coli
aaatgatgaattggtgaaagcgacc

SEQ ID NO: 26664 - DNA, 25 bp, E. coli
aaatgatgaattcgtgaaagcgacc

SEQ ID NO: 26665 - DNA, 25 bp, E. coli
tatccgtgctgaaggtcagccagac

SEQ ID NO: 26666 - DNA, 25 bp, E. coli
tatccgtgctgatggtcagccagac

SEQ ID NO: 26667 - DNA, 25 bp, E. coli
tgctcgcgacgataatgatgaattc

SEQ ID NO: 26668 - DNA, 25 bp, E. coli
tgctcgcgacgaaaatgatgaattc

SEQ ID NO: 26669 - DNA, 25 bp, E. coli
tccgtgctgaaggtcagccagacgc

SEQ ID NO: 26670 - DNA, 25 bp, E. coli
tccgtgctgaagctcagccagacgc

SEQ ID NO: 26671 - DNA, 25 bp, E. coli
ccgtgctgaaggtcagccagacgcg

SEQ ID NO: 26672 - DNA, 25 bp, E. coli
ccgtgctgaaggacagccagacgcg

SEQ ID NO: 26673 - DNA, 25 bp, E. coli
gctcgcgacgaatatgatgaattcg

SEQ ID NO: 26674 - DNA, 25 bp, E. coli
gctcgcgacgaaaatgatgaattcg

SEQ ID NO: 26675 - DNA, 25 bp, E. coli
gaaaatgatgaaatcgtgaaagcga

SEQ ID NO: 26676 - DNA, 25 bp, E. coli
gaaaatgatgaattcgtgaaagcga

SEQ ID NO: 26677 - DNA, 25 bp, E. coli
cgaaaatgatgatttcgtgaaagcg

SEQ ID NO: 26678 - DNA, 25 bp, E. coli
cgcgacgaaaatgatgaattcgtga

SEQ ID NO: 26679 - DNA, 25 bp, E. coli
cgcgacgaaaatcatgaattcgtga

SEQ ID NO: 26680 - DNA, 25 bp, E. coli
cgaaaatgatgaattcgtgaaagcg

SEQ ID NO: 26681 - DNA, 25 bp, E. coli
ctcgcgacgaaaatgatgaattcgt

SEQ ID NO: 26682 - DNA, 25 bp, E. coli
ctcgcgacgaaattgatgaattcgt

SEQ ID NO: 26683 - DNA, 25 bp, E. coli
aagcgaccggagagatcaacggcaa

SEQ ID NO: 26684 - DNA, 25 bp, E. coli
aagcgaccggagtgatcaacggcaa

SEQ ID NO: 26685 - DNA, 25 bp, E. coli
cactagaagcgaccggagagatcaa

SEQ ID NO: 26686 - DNA, 25 bp, E. coli
cactagaagcgagcggagagatcaa

SEQ ID NO: 26687 - DNA, 25 bp, E. coli
atttccatgctgagtttcacgaaac

SEQ ID NO: 26688 - DNA, 25 bp, E. coli
atttccatgctgtgtttcacgaaac

SEQ ID NO: 26689 - DNA, 25 bp, E. coli
acatttccatgcagagtttcacgaa

SEQ ID NO: 26690 - DNA, 25 bp, E. coli
acatttccatgctgagtttcacgaa

SEQ ID NO: 26691 - DNA, 25 bp, E. coli
tagaagcgaccggagagatcaacgg

SEQ ID NO: 26692 - DNA, 25 bp, E. coli
tagaagcgaccgcagagatcaacgg

SEQ ID NO: 26693 - DNA, 25 bp, E. coli
gccggaacatttgcatgctgagttt

SEQ ID NO: 26694 - DNA, 25 bp, E. coli
gccggaacatttccatgctgagttt

SEQ ID NO: 26695 - DNA, 25 bp, E. coli
gcactagaagcgaccggagagatca

SEQ ID NO: 26696 - DNA, 25 bp, E. coli
gcactagaagcgtccggagagatca

SEQ ID NO: 26697 - DNA, 25 bp, E. coli
gaacatttccatcctgagtttcacg

SEQ ID NO: 26698 - DNA, 25 bp, E. coli
gaacatttccatgctgagtttcacg

SEQ ID NO: 26699 - DNA, 25 bp, E. coli
cgaccggagagatcaacggcaaact

SEQ ID NO: 26700 - DNA, 25 bp, E. coli
cgaccggagagaacaacggcaaact

SEQ ID NO: 26701 - DNA, 25 bp, E. coli
gtgtcgccggaacatttccatgctg

SEQ ID NO: 26702 - DNA, 25 bp, E. coli
gtcgccggaacaattccatgctgag

SEQ ID NO: 26703 - DNA, 25 bp, E. coli
gtcgccggaacatttccatgctgag

SEQ ID NO: 26704 - DNA, 25 bp, E. coli
gtgtcgccggaagatttccatgctg

SEQ ID NO: 26705 - DNA, 25 bp, E. coli
aattgatggaaatatacaccggcat

SEQ ID NO: 26706 - DNA, 25 bp, E. coli
caattgatggaaaaatacaccggca

SEQ ID NO: 26707 - DNA, 25 bp, E. coli
caattgatggaataatacaccggca

SEQ ID NO: 26708 - DNA, 25 bp, E. coli
aatacaccggcaatcttatgacaag

SEQ ID NO: 26709 - DNA, 25 bp, E. coli
aatacaccggcattcttatgacaag

SEQ ID NO: 26710 - DNA, 25 bp, E. coli
aattgatggaaaaatacaccggcat

SEQ ID NO: 26711 - DNA, 25 bp, E. coli
tacaccggcattgttatgacaagag

SEQ ID NO: 26712 - DNA, 25 bp, E. coli
tacaccggcattcttatgacaagag

SEQ ID NO: 26713 - DNA, 25 bp, E. coli
atacaccggcattcttatgacaaga

SEQ ID NO: 26714 - DNA, 25 bp, E. coli
atacaccggcatacttatgacaaga

SEQ ID NO: 26715 - DNA, 25 bp, E. coli
aaaatacaccggcattcttatgaca

SEQ ID NO: 26716 - DNA, 25 bp, E. coli
aaatacaccggcattcttatgacaa

SEQ ID NO: 26717 - DNA, 25 bp, E. coli
aaatacaccggctttcttatgacaa

SEQ ID NO: 26718 - DNA, 25 bp, E. coli
aaaatacaccgggattcttatgaca

SEQ ID NO: 26719 - DNA, 25 bp, E. coli
acaccggcattcatatgacaagagt

SEQ ID NO: 26720 - DNA, 25 bp, E. coli
acaccggcattcttatgacaagagt

SEQ ID NO: 26721 - DNA, 25 bp, E. coli
tgtcctgcgaaaattcatgagagct

SEQ ID NO: 26722 - DNA, 25 bp, E. coli
tgtcctgcgaaatttcatgagagct

SEQ ID NO: 26723 - DNA, 25 bp, E. coli
tctgtcctgcgaaatttcatgagag

SEQ ID NO: 26724 - DNA, 25 bp, E. coli
tctgtcctgcgatatttcatgagag

SEQ ID NO: 26725 - DNA, 25 bp, E. coli
ctgtcctgcgaaatttcatgagagc

SEQ ID NO: 26726 - DNA, 25 bp, E. coli
ctgtcctgcgaattttcatgagagc

SEQ ID NO: 26727 - DNA, 25 bp, E. coli
catgcgctgcgatgtgaatattaac

SEQ ID NO: 26728 - DNA, 25 bp, E. coli
catgcgctgcgaagtgaatattaac

SEQ ID NO: 26729 - DNA, 25 bp, E. coli
tatggaacgcctcaacctggtgcag

SEQ ID NO: 26730 - DNA, 25 bp, E. coli
tatggaacgcctgaacctggtgcag

SEQ ID NO: 26731 - DNA, 25 bp, E. coli
ttaacaacgtgatgatccccgacgc

SEQ ID NO: 26732 - DNA, 25 bp, E. coli
ttaacaacgtgaagatccccgacgc

SEQ ID NO: 26733 - DNA, 25 bp, E. coli
tgaatgaacaggaacgctactcgtg

SEQ ID NO: 26734 - DNA, 25 bp, E. coli
tgaatgaacaggtacgctactcgtg

SEQ ID NO: 26735 - DNA, 25 bp, E. coli
gcggcgctgatgtacaccaaaatgg

SEQ ID NO: 26736 - DNA, 25 bp, E. coli
gcggcgctgatgaacaccaaaatgg

SEQ ID NO: 26737 - DNA, 25 bp, E. coli
gcttatcacaaaggcgatgctgcga

SEQ ID NO: 26738 - DNA, 25 bp, E. coli
gcttatcacaaacgcgatgctgcga

SEQ ID NO: 26739 - DNA, 25 bp, E. coli
gaagctctcgatttccagcgtgaaa

SEQ ID NO: 26740 - DNA, 25 bp, E. coli
gaagctctcgatatccagcgtgaaa

SEQ ID NO: 26741 - DNA, 25 bp, E. coli
gaaattgtcaaattccacgcggtct

SEQ ID NO: 26742 - DNA, 25 bp, E. coli
gaaaagtctgctcatgcctggcggc

SEQ ID NO: 26743 - DNA, 25 bp, E. coli
gaaaagtctgctgatgcctggcggc

SEQ ID NO: 26744 - DNA, 25 bp, E. coli
gaaattgtcaaaatccacgcggtct

SEQ ID NO: 26745 - DNA, 25 bp, E. coli
gggatcttccgctatggctactggg

SEQ ID NO: 26746 - DNA, 25 bp, E. coli
gggatcttccgcaatggctactggg

SEQ ID NO: 26747 - DNA, 25 bp, E. coli
taacggcgacttcaacaatgtgctg

SEQ ID NO: 26748 - DNA, 25 bp, E. coli
taacggcgacttgaacaatgtgctg

SEQ ID NO: 26749 - DNA, 25 bp, E. coli
cactgttacgtcgtttgtgcgaagc

SEQ ID NO: 26750 - DNA, 25 bp, E. coli
cactgttacgtcctttgtgcgaagc

SEQ ID NO: 26751 - DNA, 25 bp, E. coli
actgcttgaggccttgctggatcag

SEQ ID NO: 26752 - DNA, 25 bp, E. coli
actgcttgaggcgttgctggatcag

SEQ ID NO: 26753 - DNA, 25 bp, E. coli
tatcggtggtggttcttcttatcgg

SEQ ID NO: 26754 - DNA, 25 bp, E. coli
tatcggtggtggatcttcttatcgg

SEQ ID NO: 26755 - DNA, 25 bp, E. coli
tgagagtcaaaaatcggttgaagac

SEQ ID NO: 26756 - DNA, 25 bp, E. coli
tgagagtcaaaattcggttgaagac

SEQ ID NO: 26757 - DNA, 25 bp, E. coli
tcggttgaagacgaagatattattc

SEQ ID NO: 26758 - DNA, 25 bp, E. coli
tcggttgaagaccaagatattattc

SEQ ID NO: 26759 - DNA, 25 bp, E. coli
tcttatcgggctgatcttgtggttt

SEQ ID NO: 26760 - DNA, 25 bp, E. coli
tcttatcgggctcatcttgtggttt

SEQ ID NO: 26761 - DNA, 25 bp, E. coli
tcaggcgtgatgaacattgcgtctt

SEQ ID NO: 26762 - DNA, 25 bp, E. coli
tcaggcgtgatgtacattgcgtctt

SEQ ID NO: 26763 - DNA, 25 bp, E. coli
gctggatcagcataaacgtcaaaat

SEQ ID NO: 26764 - DNA, 25 bp, E. coli
gctggatcagcaaaaacgtcaaaat

SEQ ID NO: 26765 - DNA, 25 bp, E. coli
gaacgaagttgtaaattcaggcgtg

SEQ ID NO: 26766 - DNA, 25 bp, E. coli
gaacgaagttgttaattcaggcgtg

SEQ ID NO: 26767 - DNA, 25 bp, E. coli
cattgcgtctttcgttgtatcggtg

SEQ ID NO: 26768 - DNA, 25 bp, E. coli
cattgcgtctttggttgtatcggtg

SEQ ID NO: 26769 - DNA, 25 bp, E. coli
ggactaacgaactgattgaactgct

SEQ ID NO: 26770 - DNA, 25 bp, E. coli
ggactaacgaacagattgaactgct

SEQ ID NO: 26771 - DNA, 25 bp, E. coli
cagaagcaattctgaccgcacaggg

SEQ ID NO: 26772 - DNA, 25 bp, E. coli
cagaagcaattcagaccgcacaggg

SEQ ID NO: 26773 - DNA, 25 bp, E. coli
agaagcaattctcaccgcacagggc

SEQ ID NO: 26774 - DNA, 25 bp, E. coli
agcagaagcaattctgaccgcacag

SEQ ID NO: 26775 - DNA, 25 bp, E. coli
agcagaagcaatactgaccgcacag

SEQ ID NO: 26776 - DNA, 25 bp, E. coli
acggaaattcgctgttagtggcgga

SEQ ID NO: 26777 - DNA, 25 bp, E. coli
agaagcaattctgaccgcacagggc

SEQ ID NO: 26778 - DNA, 25 bp, E. coli
aaattcgctgttagtggcggaagaa

SEQ ID NO: 26779 - DNA, 25 bp, E. coli
acggaaattcgcagttagtggcgga

SEQ ID NO: 26780 - DNA, 25 bp, E. coli
aaattcgctgtttgtggcggaagaa

SEQ ID NO: 26781 - DNA, 25 bp, E. coli
tagtggcggaagtagcagaagcaat

SEQ ID NO: 26782 - DNA, 25 bp, E. coli
tagtggcggaagaagcagaagcaat

SEQ ID NO: 26783 - DNA, 25 bp, E. coli
ttagtggcggaacaagcagaagcaa

SEQ ID NO: 26784 - DNA, 25 bp, E. coli
ttcgctgttagtggcggaagaagca

SEQ ID NO: 26785 - DNA, 25 bp, E. coli
ttagtggcggaagaagcagaagcaa

SEQ ID NO: 26786 - DNA, 25 bp, E. coli
ttcgctgttagtcgcggaagaagca

SEQ ID NO: 26787 - DNA, 25 bp, E. coli
gaagcagaagcatttctgaccgcac

SEQ ID NO: 26788 - DNA, 25 bp, E. coli
gaagcagaagcaattctgaccgcac

SEQ ID NO: 26789 - DNA, 25 bp, E. coli
gaaattcgctgttagtggcggaaga

SEQ ID NO: 26790 - DNA, 25 bp, E. coli
gaaattcgctgtaagtggcggaaga

SEQ ID NO: 26791 - DNA, 25 bp, E. coli
cggaaattcgctgttagtggcggaa

SEQ ID NO: 26792 - DNA, 25 bp, E. coli
cggaaattcgctcttagtggcggaa

SEQ ID NO: 26793 - DNA, 25 bp, E. coli
ataaacgtcagggattactggcggg

SEQ ID NO: 26794 - DNA, 25 bp, E. coli
ataaacgtcaggcattactggcggg

SEQ ID NO: 26795 - DNA, 25 bp, E. coli
aaacagccgcgcataacggtgagca

SEQ ID NO: 26796 - DNA, 25 bp, E. coli
aaacagccgcgcttaacggtgagca

SEQ ID NO: 26797 - DNA, 25 bp, E. coli
tatgcattttcgatcctcgtcggag

SEQ ID NO: 26798 - DNA, 25 bp, E. coli
tatgcattttcgttcctcgtcggag

SEQ ID NO: 26799 - DNA, 25 bp, E. coli
tattattatggcgtggcgtcgtgac

SEQ ID NO: 26800 - DNA, 25 bp, E. coli
tattattatggcctggcgtcgtgac

SEQ ID NO: 26801 - DNA, 25 bp, E. coli
tgctggaagccggagataaactgac

SEQ ID NO: 26802 - DNA, 25 bp, E. coli
tgctggaagccgcagataaactgac

SEQ ID NO: 26803 - DNA, 25 bp, E. coli
ccaaattcaccaatgtcgggaggat

SEQ ID NO: 26804 - DNA, 25 bp, E. coli
ccaaattcaccattgtcgggaggat

SEQ ID NO: 26805 - DNA, 25 bp, E. coli
cgaaatcctggtgtctgcgggaaat

SEQ ID NO: 26806 - DNA, 25 bp, E. coli
cgcggttgggaaacgcatctcacca

SEQ ID NO: 26807 - DNA, 25 bp, E. coli
cgttaatcgacaaactggcggcaaa

SEQ ID NO: 26808 - DNA, 25 bp, E. coli
cgaaatcctggtctctgcgggaaat

SEQ ID NO: 26809 - DNA, 25 bp, E. coli
cgcggttgggaatcgcatctcacca

SEQ ID NO: 26810 - DNA, 25 bp, E. coli
cgttaatcgacatactggcggcaaa

SEQ ID NO: 26811 - DNA, 25 bp, E. coli
cattaacgctggtagcactacgggt

SEQ ID NO: 26812 - DNA, 25 bp, E. coli
cattaacgctggaagcactacgggt

SEQ ID NO: 26813 - DNA, 25 bp, E. coli
gattcatcaggagccggaaccgtta

SEQ ID NO: 26814 - DNA, 25 bp, E. coli
gattcatcaggacccggaaccgtta

SEQ ID NO: 26815 - DNA, 25 bp, E. coli
caacaaccgagggaatatcaccatt

SEQ ID NO: 26816 - DNA, 25 bp, E. coli
caccattaatctcgatgaccaccta

SEQ ID NO: 26817 - DNA, 25 bp, E. coli
caacaaccgaggcaatatcaccatt

SEQ ID NO: 26818 - DNA, 25 bp, E. coli
caccattaatctggatgaccaccta

SEQ ID NO: 26819 - DNA, 25 bp, E. coli
atgcaggcagatcgcttagctgacc

SEQ ID NO: 26820 - DNA, 25 bp, E. coli
atgcaggcagatggcttagctgacc

SEQ ID NO: 26821 - DNA, 25 bp, E. coli
ttgcatctgctctgcggtaaaccgc

SEQ ID NO: 26822 - DNA, 25 bp, E. coli
ttgcatctgctcagcggtaaaccgc

SEQ ID NO: 26823 - DNA, 25 bp, E. coli
tgaccacctacactccgttcagggt

SEQ ID NO: 26824 - DNA, 25 bp, E. coli
tgaccacctacagtccgttcagggt

SEQ ID NO: 26825 - DNA, 25 bp, E. coli
cgctccccaacaaccgagggaatat

SEQ ID NO: 26826 - DNA, 25 bp, E. coli
ccgagggaatatgaccattaatctg

SEQ ID NO: 26827 - DNA, 25 bp, E. coli
ccgagggaatatcaccattaatctg

SEQ ID NO: 26828 - DNA, 25 bp, E. coli
cgctccccaacatccgagggaatat

SEQ ID NO: 26829 - DNA, 25 bp, E. coli
cttagctgacctggaaagaatgttg

SEQ ID NO: 26830 - DNA, 25 bp, E. coli
cttagctgacctcgaaagaatgttg

SEQ ID NO: 26831 - DNA, 25 bp, E. coli
gatcgcttagctgacctggaaagaa

SEQ ID NO: 26832 - DNA, 25 bp, E. coli
gatcgcttagctcacctggaaagaa

SEQ ID NO: 26833 - DNA, 25 bp, E. coli
ggatgaccacctacagtccgttcag

SEQ ID NO: 26834 - DNA, 25 bp, E. coli
ggatgaccaccttcagtccgttcag

SEQ ID NO: 26835 - DNA, 25 bp, E. coli
taatctggatgaccacctacagtcc

SEQ ID NO: 26836 - DNA, 25 bp, E. coli
taatctggatgagcacctacagtcc

SEQ ID NO: 26837 - DNA, 25 bp, E. coli
caaggactccgcaaatgctctgcgt

SEQ ID NO: 26838 - DNA, 25 bp, E. coli
caaggactccgctaatgctctgcgt

SEQ ID NO: 26839 - DNA, 25 bp, E. coli
aggatgttcctcgtgatagccccgt

SEQ ID NO: 26840 - DNA, 25 bp, E. coli
aggatgttcctcctgatagccccgt

SEQ ID NO: 26841 - DNA, 25 bp, E. coli
acgttaatgggagcatccggctgcg

SEQ ID NO: 26842 - DNA, 25 bp, E. coli
acgttaatgggaccatccggctgcg

SEQ ID NO: 26843 - DNA, 25 bp, E. coli
tgtcacgttaatcggaccatccggc

SEQ ID NO: 26844 - DNA, 25 bp, E. coli
tgatagccccgtactggatatggcg

SEQ ID NO: 26845 - DNA, 25 bp, E. coli
tgtcacgttaatgggaccatccggc

SEQ ID NO: 26846 - DNA, 25 bp, E. coli
tgatagccccgttctggatatggcg

SEQ ID NO: 26847 - DNA, 25 bp, E. coli
tccggctgcgggtaatccactctgt

SEQ ID NO: 26848 - DNA, 25 bp, E. coli
tccggctgcgggaaatccactctgt

SEQ ID NO: 26849 - DNA, 25 bp, E. coli
gcaggtgacgcacgatcttcaggat

SEQ ID NO: 26850 - DNA, 25 bp, E. coli
gcaggtgacgcaggatcttcaggat

SEQ ID NO: 26851 - DNA, 25 bp, E. coli
gaaattcgcgccttggcgatccctg

SEQ ID NO: 26852 - DNA, 25 bp, E. coli
gactccgctaatcctctgcgtgaaa

SEQ ID NO: 26853 - DNA, 25 bp, E. coli
gactccgctaatgctctgcgtgaaa

SEQ ID NO: 26854 - DNA, 25 bp, E. coli
gaaattcgcgccatggcgatccctg

SEQ ID NO: 26855 - DNA, 25 bp, E. coli
taacttttcagttgataaaggtgac

SEQ ID NO: 26856 - DNA, 25 bp, E. coli
taacttttcagtagataaaggtgac

SEQ ID NO: 26857 - DNA, 25 bp, E. coli
gatccctgttgtccaggtgacgcac

SEQ ID NO: 26858 - DNA, 25 bp, E. coli
gatccctgttgtgcaggtgacgcac

SEQ ID NO: 26859 - DNA, 25 bp, E. coli
taaagaccgtctggcatctgcgcag

SEQ ID NO: 26860 - DNA, 25 bp, E. coli
taaagaccgtctcgcatctgcgcag

SEQ ID NO: 26861 - DNA, 25 bp, E. coli
ttctgcaagtttggccatgctgggc

SEQ ID NO: 26862 - DNA, 25 bp, E. coli
ttttataccgcgctgagctggaacg

SEQ ID NO: 26863 - DNA, 25 bp, E. coli
ttctgcaagtttcgccatgctgggc

SEQ ID NO: 26864 - DNA, 25 bp, E. coli
ttttataccgcggtgagctggaacg

SEQ ID NO: 26865 - DNA, 25 bp, E. coli
tgaaactggcgagcattctggcgaa

SEQ ID NO: 26866 - DNA, 25 bp, E. coli
tgaccatcacatccgtatgacagcg

SEQ ID NO: 26867 - DNA, 25 bp, E. coli
tgaccatcacatgcgtatgacagcg

SEQ ID NO: 26868 - DNA, 25 bp, E. coli
tgaaactggcgaccattctggcgaa

SEQ ID NO: 26869 - DNA, 25 bp, E. coli
gctgatgcagatggcgaaaacctct

SEQ ID NO: 26870 - DNA, 25 bp, E. coli
gcgtaatcgcctccatagcctgtta

SEQ ID NO: 26871 - DNA, 25 bp, E. coli
gcgtaatcgcctgcatagcctgtta

SEQ ID NO: 26872 - DNA, 25 bp, E. coli
gctgatgcagatcgcgaaaacctct

SEQ ID NO: 26873 - DNA, 25 bp, E. coli
gaagttgatgaaactgccagcgccg

SEQ ID NO: 26874 - DNA, 25 bp, E. coli
gaacgtaatcttcaggtctgtccga

SEQ ID NO: 26875 - DNA, 25 bp, E. coli
gaacgtaatcttgaggtctgtccga

SEQ ID NO: 26876 - DNA, 25 bp, E. coli
gaagttgatgaatctgccagcgccg

SEQ ID NO: 26877 - DNA, 25 bp, E. coli
ggcttgccgtacttctccgtgctga

SEQ ID NO: 26878 - DNA, 25 bp, E. coli
tggcgcacgtatgcaggaagcactg

SEQ ID NO: 26879 - DNA, 25 bp, E. coli
ggcttgccgtacatctccgtgctga

SEQ ID NO: 26880 - DNA, 25 bp, E. coli
tggcgcacgtatccaggaagcactg

SEQ ID NO: 26881 - DNA, 25 bp, E. coli
cacagtggtggatggaaaaaccgtt

SEQ ID NO: 26882 - DNA, 25 bp, E. coli
caaaaagcgggtatcgcgtcatttt

SEQ ID NO: 26883 - DNA, 25 bp, E. coli
caaaaagcgggtttcgcgtcatttt

SEQ ID NO: 26884 - DNA, 25 bp, E. coli
cacagtggtggaaggaaaaaccgtt

SEQ ID NO: 26885 - DNA, 25 bp, E. coli
ttggtgctggcgcatctgctcctca

SEQ ID NO: 26886 - DNA, 25 bp, E. coli
ttggtgctggcggatctgctcctca

SEQ ID NO: 26887 - DNA, 25 bp, E. coli
tgaatgctggtgatcgtaaaggtgc

SEQ ID NO: 26888 - DNA, 25 bp, E. coli
tgaatgctggtgttcgtaaaggtgc

SEQ ID NO: 26889 - DNA, 25 bp, E. coli
tgccacagtggtcgatggaaaaacc

SEQ ID NO: 26890 - DNA, 25 bp, E. coli
tgccacagtggtggatggaaaaacc

SEQ ID NO: 26891 - DNA, 25 bp, E. coli
tctgctcctcagatacttgaccagt

SEQ ID NO: 26892 - DNA, 25 bp, E. coli
tctgctcctcagttacttgaccagt

SEQ ID NO: 26893 - DNA, 25 bp, E. coli
gctgattggtgcaggcgcatctgct

SEQ ID NO: 26894 - DNA, 25 bp, E. coli
gctgattggtgctggcgcatctgct

SEQ ID NO: 26895 - DNA, 25 bp, E. coli
ctggtggattaaggatggcggacgc

SEQ ID NO: 26896 - DNA, 25 bp, E. coli
ctggtggattaacgatggcggacgc

SEQ ID NO: 26897 - DNA, 25 bp, E. coli
gtttttcccaatatgaaactgtcga

SEQ ID NO: 26898 - DNA, 25 bp, E. coli
gatacttgaccactttctggacgaa

SEQ ID NO: 26899 - DNA, 25 bp, E. coli
gtttttcccaatttgaaactgtcga

SEQ ID NO: 26900 - DNA, 25 bp, E. coli
gatacttgaccagtttctggacgaa

SEQ ID NO: 26901 - DNA, 25 bp, E. coli
tggcggacgcgattgccgcattcgt

SEQ ID NO: 26902 - DNA, 25 bp, E. coli
tggcggacgcgaatgccgcattcgt

SEQ ID NO: 26903 - DNA, 25 bp, E. coli
cattttttgcggttgcacctttcaa

SEQ ID NO: 26904 - DNA, 25 bp, E. coli
cattttttgcggatgcacctttcaa

SEQ ID NO: 26905 - DNA, 25 bp, E. coli
tagtgctcagcgacactatttttca

SEQ ID NO: 26906 - DNA, 25 bp, E. coli
tagtgctcagcgtcactatttttca

SEQ ID NO: 26907 - DNA, 25 bp, E. coli
tatttttcatcaggttgcactctct

SEQ ID NO: 26908 - DNA, 25 bp, E. coli
tatttttcatcacgttgcactctct

SEQ ID NO: 26909 - DNA, 25 bp, E. coli
ttaactgccgcagagaaaaagtctg

SEQ ID NO: 26910 - DNA, 25 bp, E. coli
ttaactgccgcacagaaaaagtctg

SEQ ID NO: 26911 - DNA, 25 bp, E. coli
tcatcaggttgctctctctcacatt

SEQ ID NO: 26912 - DNA, 25 bp, E. coli
tcatcaggttgcactctctcacatt

SEQ ID NO: 26913 - DNA, 25 bp, E. coli
gccgcagagaaaaagtctgagttat

SEQ ID NO: 26914 - DNA, 25 bp, E. coli
gccgcagagaaatagtctgagttat

SEQ ID NO: 26915 - DNA, 25 bp, E. coli
gcggttgcacctatcaaaaatgtta

SEQ ID NO: 26916 - DNA, 25 bp, E. coli
gcggttgcacctttcaaaaatgtta

SEQ ID NO: 26917 - DNA, 25 bp, E. coli
gacactatttttgatcaggttgcac

SEQ ID NO: 26918 - DNA, 25 bp, E. coli
gacactatttttcatcaggttgcac

SEQ ID NO: 26919 - DNA, 25 bp, E. coli
ctctcacattttttgcggttgcacc

SEQ ID NO: 26920 - DNA, 25 bp, E. coli
ctctcacattttatgcggttgcacc

SEQ ID NO: 26921 - DNA, 25 bp, E. coli
tcagcgacactaattttcatcaggt

SEQ ID NO: 26922 - DNA, 25 bp, E. coli
tcagcgacactatttttcatcaggt

SEQ ID NO: 26923 - DNA, 25 bp, E. coli
tcaaaaatgttatctgccgcagaga

SEQ ID NO: 26924 - DNA, 25 bp, E. coli
tcaaaaatgttaactgccgcagaga

SEQ ID NO: 26925 - DNA, 25 bp, E. coli
caaatgtaggttttgggctgcaata

SEQ ID NO: 26926 - DNA, 25 bp, E. coli
caaatgtaggttatgggctgcaata

SEQ ID NO: 26927 - DNA, 25 bp, E. coli
caggagataatctcgcaagaatgca

SEQ ID NO: 26928 - DNA, 25 bp, E. coli
caggagataatcacgcaagaatgca

SEQ ID NO: 26929 - DNA, 25 bp, E. coli
tatcaagaggtaggagaaacagcgc

SEQ ID NO: 26930 - DNA, 25 bp, E. coli
ttattgaacattcgcaacagcccaa

SEQ ID NO: 26931 - DNA, 25 bp, E. coli
ttattgaacattggcaacagcccaa

SEQ ID NO: 26932 - DNA, 25 bp, E. coli
tatcaagaggtacgagaaacagcgc

SEQ ID NO: 26933 - DNA, 25 bp, E. coli
gacatggcgcggttttatgcaataa

SEQ ID NO: 26934 - DNA, 25 bp, E. coli
gacatggcgcggatttatgcaataa

SEQ ID NO: 26935 - DNA, 25 bp, E. coli
gaaacagcgccatatgcagacatgg

SEQ ID NO: 26936 - DNA, 25 bp, E. coli
gaaacagcgccaaatgcagacatgg

SEQ ID NO: 26937 - DNA, 25 bp, E. coli
gattatctttacctctgatgctcgc

SEQ ID NO: 26938 - DNA, 25 bp, E. coli
gattatctttacgtctgatgctcgc

SEQ ID NO: 26939 - DNA, 25 bp, E. coli
gggtaaccataatcatcagcgatgc

SEQ ID NO: 26940 - DNA, 25 bp, E. coli
gggtaaccataaacatcagcgatgc

SEQ ID NO: 26941 - DNA, 25 bp, E. coli
tggcatccattcatgagcaaaggcg

SEQ ID NO: 26942 - DNA, 25 bp, E. coli
tggcatccattcttgagcaaaggcg

SEQ ID NO: 26943 - DNA, 25 bp, E. coli
gagtgattacctctcgattcctgag

SEQ ID NO: 26944 - DNA, 25 bp, E. coli
gatgctcgctcataaacagttacgc

SEQ ID NO: 26945 - DNA, 25 bp, E. coli
gagtgattacctgtcgattcctgag

SEQ ID NO: 26946 - DNA, 25 bp, E. coli
gatgctcgctcaaaaacagttacgc

SEQ ID NO: 26947 - DNA, 25 bp, E. coli
caaacatactttgctataattcaca

SEQ ID NO: 26948 - DNA, 25 bp, E. coli
caaacatactttcctataattcaca

SEQ ID NO: 26949 - DNA, 25 bp, E. coli
taaagaaagccgcatgcactaaccc

SEQ ID NO: 26950 - DNA, 25 bp, E. coli
taaagaaagccggatgcactaaccc

SEQ ID NO: 26951 - DNA, 25 bp, E. coli
agagcttaaacataactctgcttta

SEQ ID NO: 26952 - DNA, 25 bp, E. coli
agagcttaaacaaaactctgcttta

SEQ ID NO: 26953 - DNA, 25 bp, E. coli
cggatgcactaacccgaccaattag

SEQ ID NO: 26954 - DNA, 25 bp, E. coli
actctgctttataattaaagggaca

SEQ ID NO: 26955 - DNA, 25 bp, E. coli
cggatgcactaagccgaccaattag

SEQ ID NO: 26956 - DNA, 25 bp, E. coli
actctgctttattattaaagggaca

SEQ ID NO: 26957 - DNA, 25 bp, E. coli
gttatttaaaacatagaagacatcc

SEQ ID NO: 26958 - DNA, 25 bp, E. coli
gttatttaaaacttagaagacatcc

SEQ ID NO: 26959 - DNA, 25 bp, E. coli
tatatgatgaaaaaacggtatgaat

SEQ ID NO: 26960 - DNA, 25 bp, E. coli
tatatgatgaaataacggtatgaat

SEQ ID NO: 26961 - DNA, 25 bp, E. coli
tccttctggcgattataaagaaagc

SEQ ID NO: 26962 - DNA, 25 bp, E. coli
tccttctggcgaatataaagaaagc

SEQ ID NO: 26963 - DNA, 25 bp, E. coli
gaagacatccaaaattgccagtaga

SEQ ID NO: 26964 - DNA, 25 bp, E. coli
gaagacatccaatattgccagtaga

SEQ ID NO: 26965 - DNA, 25 bp, E. coli
ctcaaataaataaagcagagcttaa

SEQ ID NO: 26966 - DNA, 25 bp, E. coli
ctcaaataaatatagcagagcttaa

SEQ ID NO: 26967 - DNA, 25 bp, E. coli
taattcacaattataattcaggtga

SEQ ID NO: 26968 - DNA, 25 bp, E. coli
taattcacaattttaattcaggtga

SEQ ID NO: 26969 - DNA, 25 bp, E. coli
caaggctaacgttcctggtggcgca

SEQ ID NO: 26970 - DNA, 25 bp, E. coli
caaggctaacgtacctggtggcgca

SEQ ID NO: 26971 - DNA, 25 bp, E. coli
catcctttaaagtccacgacaccgg

SEQ ID NO: 26972 - DNA, 25 bp, E. coli
catcctttaaagaccacgacaccgg

SEQ ID NO: 26973 - DNA, 25 bp, E. coli
catcaacggcgcatacaaagctcag

SEQ ID NO: 26974 - DNA, 25 bp, E. coli
catcaacggcgcttacaaagctcag

SEQ ID NO: 26975 - DNA, 25 bp, E. coli
tataaccaggctgtgtccgagcgtc

SEQ ID NO: 26976 - DNA, 25 bp, E. coli
tataaccaggctctgtccgagcgtc

SEQ ID NO: 26977 - DNA, 25 bp, E. coli
tacctggtggcggatcctttaaaga

SEQ ID NO: 26978 - DNA, 25 bp, E. coli
tacctggtggcgcatcctttaaaga

SEQ ID NO: 26979 - DNA, 25 bp, E. coli
tattcctaacaaaggtccgacccac

SEQ ID NO: 26980 - DNA, 25 bp, E. coli
tattcctaacaatggtccgacccac

SEQ ID NO: 26981 - DNA, 25 bp, E. coli
ccatgacactggatttattcctaac

SEQ ID NO: 26982 - DNA, 25 bp, E. coli
ccatgacactggttttattcctaac

SEQ ID NO: 26983 - DNA, 25 bp, E. coli
gacccacgaaaaccaactgggtgca

SEQ ID NO: 26984 - DNA, 25 bp, E. coli
gacccacgaaaagcaactgggtgca

SEQ ID NO: 26985 - DNA, 25 bp, E. coli
cgaaaaccaactcggtgcaggtgct

SEQ ID NO: 26986 - DNA, 25 bp, E. coli
cgaaaaccaactgggtgcaggtgct

SEQ ID NO: 26987 - DNA, 25 bp, E. coli
gtacaaaggcgacaacatcaacggc

SEQ ID NO: 26988 - DNA, 25 bp, E. coli
gtacaaaggcgagaacatcaacggc

SEQ ID NO: 26989 - DNA, 25 bp, E. coli
tggcgtgcagacaccaaggctaacg

SEQ ID NO: 26990 - DNA, 25 bp, E. coli
tggcgtgcagactccaaggctaacg

SEQ ID NO: 26991 - DNA, 25 bp, E. coli
aaccgaacgataaatcagtatctgc

SEQ ID NO: 26992 - DNA, 25 bp, E. coli
cagtatctgcaaaagaatggcctga

SEQ ID NO: 26993 - DNA, 25 bp, E. coli
cagtatctgcaatagaatggcctga

SEQ ID NO: 26994 - DNA, 25 bp, E. coli
agtatctgcaaaagaatggcctgaa

SEQ ID NO: 26995 - DNA, 25 bp, E. coli
agtatctgcaaatgaatggcctgaa

SEQ ID NO: 26996 - DNA, 25 bp, E. coli
aaccgaacgatatatcagtatctgc

SEQ ID NO: 26997 - DNA, 25 bp, E. coli
tatcagtatctgcaaaagaatggcc

SEQ ID NO: 26998 - DNA, 25 bp, E. coli
tatcagtatctggaaaagaatggcc

SEQ ID NO: 26999 - DNA, 25 bp, E. coli
tcagtatctgcaaaagaatggcctg

SEQ ID NO: 27000 - DNA, 25 bp, E. coli
gaacgatatatcagtatctgcaaaa

SEQ ID NO: 27001 - DNA, 25 bp, E. coli
gaacgatatatctgtatctgcaaaa

SEQ ID NO: 27002 - DNA, 25 bp, E. coli
cgatatatcagtatctgcaaaagaa

SEQ ID NO: 27003 - DNA, 25 bp, E. coli
cgatatatcagtttctgcaaaagaa

SEQ ID NO: 27004 - DNA, 25 bp, E. coli
ccgaacgatatatcagtatctgcaa

SEQ ID NO: 27005 - DNA, 25 bp, E. coli
ccgaacgatataacagtatctgcaa

SEQ ID NO: 27006 - DNA, 25 bp, E. coli
gtatctgcaaaagaatggcctgaaa

SEQ ID NO: 27007 - DNA, 25 bp, E. coli
gataaccgaacgttatatcagtatc

SEQ ID NO: 27008 - DNA, 25 bp, E. coli
gtatctgcaaaacaatggcctgaaa

SEQ ID NO: 27009 - DNA, 25 bp, E. coli
taaccgaacgatttatcagtatctg

SEQ ID NO: 27010 - DNA, 25 bp, E. coli
tcagtatctgcataagaatggcctg

SEQ ID NO: 27011 - DNA, 25 bp, E. coli
taaccgaacgatatatcagtatctg

SEQ ID NO: 27012 - DNA, 25 bp, E. coli
gataaccgaacgatatatcagtatc

SEQ ID NO: 27013 - DNA, 25 bp, E. coli
aatgctgcatggctgtcattcgcgc

SEQ ID NO: 27014 - DNA, 25 bp, E. coli
aacgtgacttgccacacccggtgcg

SEQ ID NO: 27015 - DNA, 25 bp, E. coli
aatgctgcatgggtgtcattcgcgc

SEQ ID NO: 27016 - DNA, 25 bp, E. coli
aacgtgacttgcgacacccggtgcg

SEQ ID NO: 27017 - DNA, 25 bp, E. coli
tttgatgagatctatcaggccgttg

SEQ ID NO: 27018 - DNA, 25 bp, E. coli
tttgatgagatcaatcaggccgttg

SEQ ID NO: 27019 - DNA, 25 bp, E. coli
tttcacgcccgcattaaggagcaca

SEQ ID NO: 27020 - DNA, 25 bp, E. coli
tttcacgcccgctttaaggagcaca

SEQ ID NO: 27021 - DNA, 25 bp, E. coli
tgaccgcccatctgctttaccaaaa

SEQ ID NO: 27022 - DNA, 25 bp, E. coli
tgaccgcccatcagctttaccaaaa

SEQ ID NO: 27023 - DNA, 25 bp, E. coli
tgcgcaccctgctgccagatatgac

SEQ ID NO: 27024 - DNA, 25 bp, E. coli
tccgcacagggaaagggcttgtttt

SEQ ID NO: 27025 - DNA, 25 bp, E. coli
tccgcacagggatagggcttgtttt

SEQ ID NO: 27026 - DNA, 25 bp, E. coli
tgcgcaccctgcagccagatatgac

SEQ ID NO: 27027 - DNA, 25 bp, E. coli
cctgttgcaggcgatctatgaaggg

SEQ ID NO: 27028 - DNA, 25 bp, E. coli
cctgttgcaggccatctatgaaggg

SEQ ID NO: 27029 - DNA, 25 bp, E. coli
gaatgctattttctcctcggaccgc

SEQ ID NO: 27030 - DNA, 25 bp, E. coli
gaatgctattttgtcctcggaccgc

SEQ ID NO: 27031 - DNA, 25 bp, E. coli
gggtttatcacatcttcagcgaagc

SEQ ID NO: 27032 - DNA, 25 bp, E. coli
gggtttatcacaacttcagcgaagc

SEQ ID NO: 27033 - DNA, 25 bp, E. coli
tcaacgttatcagcatctcattgcc

SEQ ID NO: 27034 - DNA, 25 bp, E. coli
tcaacgttatcaccatctcattgcc

SEQ ID NO: 27035 - DNA, 25 bp, E. coli
cagcctggcgctgggttccattaca

SEQ ID NO: 27036 - DNA, 25 bp, E. coli
cagcctggcgctcggttccattaca

SEQ ID NO: 27037 - DNA, 25 bp, E. coli
catggcgcattaaggtaccgggcaa

SEQ ID NO: 27038 - DNA, 25 bp, E. coli
catggcgcattatggtaccgggcaa

SEQ ID NO: 27039 - DNA, 25 bp, E. coli
catttctctgattcagcatggcgca

SEQ ID NO: 27040 - DNA, 25 bp, E. coli
atgaatcagcaacgcgggtttaccc

SEQ ID NO: 27041 - DNA, 25 bp, E. coli
atgaatcagcaaggcgggtttaccc

SEQ ID NO: 27042 - DNA, 25 bp, E. coli
acttgaattagcgatcgaccgcgcc

SEQ ID NO: 27043 - DNA, 25 bp, E. coli
acttgaattagccatcgaccgcgcc

SEQ ID NO: 27044 - DNA, 25 bp, E. coli
taccgggcaaaagaccatcagcctg

SEQ ID NO: 27045 - DNA, 25 bp, E. coli
taccctgctggacatgatgctggtg

SEQ ID NO: 27046 - DNA, 25 bp, E. coli
taccgggcaaaacaccatcagcctg

SEQ ID NO: 27047 - DNA, 25 bp, E. coli
taccctgctggagatgatgctggtg

SEQ ID NO: 27048 - DNA, 25 bp, E. coli
gcggtttaccgcagcacttgaatta

SEQ ID NO: 27049 - DNA, 25 bp, E. coli
gcggtttaccgctgcacttgaatta

SEQ ID NO: 27050 - DNA, 25 bp, E. coli
cggtgagccgctcctgacgttagtc

SEQ ID NO: 27051 - DNA, 25 bp, E. coli
catttctctgatacagcatggcgca

SEQ ID NO: 27052 - DNA, 25 bp, E. coli
cattacaagaagttgccgcagacga

SEQ ID NO: 27053 - DNA, 25 bp, E. coli
cattacaagaagatgccgcagacga

SEQ ID NO: 27054 - DNA, 25 bp, E. coli
cggtgagccgctgctgacgttagtc

SEQ ID NO: 27055 - DNA, 25 bp, E. coli
gattctggccgacggacaaatcacg

SEQ ID NO: 27056 - DNA, 25 bp, E. coli
gattctggccgagggacaaatcacg

SEQ ID NO: 27057 - DNA, 25 bp, E. coli
caacgaggtgcagaattagtccggc

SEQ ID NO: 27058 - DNA, 25 bp, E. coli
caacgaggtgcacaattagtccggc

SEQ ID NO: 27059 - DNA, 25 bp, E. coli
caacaaagtatttcgcagcgcagag

SEQ ID NO: 27060 - DNA, 25 bp, E. coli
caacaaagtattacgcagcgcagag

SEQ ID NO: 27061 - DNA, 25 bp, E. coli
cagagagggctaaatcgccagcgct

SEQ ID NO: 27062 - DNA, 25 bp, E. coli
cagagagggctatatcgccagcgct

SEQ ID NO: 27063 - DNA, 25 bp, E. coli
catctggcgctgctaactgctttgc

SEQ ID NO: 27064 - DNA, 25 bp, E. coli
catctggcgctggtaactgctttgc

SEQ ID NO: 27065 - DNA, 25 bp, E. coli
taactcttgccgctgacagtgcggg

SEQ ID NO: 27066 - DNA, 25 bp, E. coli
taactcttgccggtgacagtgcggg

SEQ ID NO: 27067 - DNA, 25 bp, E. coli
tatcctatgcttgatgcgactgggc

SEQ ID NO: 27068 - DNA, 25 bp, E. coli
tatcctatgcttcatgcgactgggc

SEQ ID NO: 27069 - DNA, 25 bp, E. coli
tgtatcaccgcatgacagggcaagg

SEQ ID NO: 27070 - DNA, 25 bp, E. coli
tgtatcaccgcaagacagggcaagg

SEQ ID NO: 27071 - DNA, 25 bp, E. coli
tccttgcgggtgagacagaaacgcg

SEQ ID NO: 27072 - DNA, 25 bp, E. coli
tccttgcgggtgtgacagaaacgcg

SEQ ID NO: 27073 - DNA, 25 bp, E. coli
gcgacactttactgagcggctttga

SEQ ID NO: 27074 - DNA, 25 bp, E. coli
gcgacactttacagagcggctttga

SEQ ID NO: 27075 - DNA, 25 bp, E. coli
gaatacgacccagtttgcgatgaag

SEQ ID NO: 27076 - DNA, 25 bp, E. coli
gaatacgacccactttgcgatgaag

SEQ ID NO: 27077 - DNA, 25 bp, E. coli
gaccttacgaattgtgtcaccgctg

SEQ ID NO: 27078 - DNA, 25 bp, E. coli
gaccttacgaatagtgtcaccgctg

SEQ ID NO: 27079 - DNA, 25 bp, E. coli
tattccgcaaaaccagagtacctgg

SEQ ID NO: 27080 - DNA, 25 bp, E. coli
tatacttgaagaagcgtcacaagcg

SEQ ID NO: 27081 - DNA, 25 bp, E. coli
tttggccgggactagcaaatgcgca

SEQ ID NO: 27082 - DNA, 25 bp, E. coli
tatacttgaagatgcgtcacaagcg

SEQ ID NO: 27083 - DNA, 25 bp, E. coli
tattccgcaaaagcagagtacctgg

SEQ ID NO: 27084 - DNA, 25 bp, E. coli
tttggccgggacaagcaaatgcgca

SEQ ID NO: 27085 - DNA, 25 bp, E. coli
tgttggctccagcaatcgacaccgt

SEQ ID NO: 27086 - DNA, 25 bp, E. coli
tgttggctccaggaatcgacaccgt

SEQ ID NO: 27087 - DNA, 25 bp, E. coli
tcatgtattaaagcctttggccggg

SEQ ID NO: 27088 - DNA, 25 bp, E. coli
tcatgtattaaaccctttggccggg

SEQ ID NO: 27089 - DNA, 25 bp, E. coli
ccaacgggtgatgtgatgacgctta

SEQ ID NO: 27090 - DNA, 25 bp, E. coli
ccaacgggtgatctgatgacgctta

SEQ ID NO: 27091 - DNA, 25 bp, E. coli
gaatagtctggtgtacatccctgcc

SEQ ID NO: 27092 - DNA, 25 bp, E. coli
gaatagtctggtctacatccctgcc

SEQ ID NO: 27093 - DNA, 25 bp, E. coli
cattgccgggaacgaatgcaacctc

SEQ ID NO: 27094 - DNA, 25 bp, E. coli
cattgccgggaaggaatgcaacctc

SEQ ID NO: 27095 - DNA, 25 bp, E. coli
gtcacaagcgacacaaacagcggtt

SEQ ID NO: 27096 - DNA, 25 bp, E. coli
gtcacaagcgactcaaacagcggtt

SEQ ID NO: 27097 - DNA, 25 bp, E. coli
tggacattatccctataccgagaag

SEQ ID NO: 27098 - DNA, 25 bp, E. coli
tggacattatccgtataccgagaag

SEQ ID NO: 27099 - DNA, 25 bp, E. coli
tcagaaccaatttgcagatacgcgc

SEQ ID NO: 27100 - DNA, 25 bp, E. coli
tcagaaccaattagcagatacgcgc

SEQ ID NO: 27101 - DNA, 25 bp, E. coli
agttctctctcggatggcgatgcaa

SEQ ID NO: 27102 - DNA, 25 bp, E. coli
agttctctctcgcatggcgatgcaa

SEQ ID NO: 27103 - DNA, 25 bp, E. coli
acagcctggatatttcccgtcttca

SEQ ID NO: 27104 - DNA, 25 bp, E. coli
acagcctggataattcccgtcttca

SEQ ID NO: 27105 - DNA, 25 bp, E. coli
tataccgcccttattgctctctacg

SEQ ID NO: 27106 - DNA, 25 bp, E. coli
tataccgccctttttgctctctacg

SEQ ID NO: 27107 - DNA, 25 bp, E. coli
tgtcggaattatttataccgccctt

SEQ ID NO: 27108 - DNA, 25 bp, E. coli
tgtcggaattatatataccgccctt

SEQ ID NO: 27109 - DNA, 25 bp, E. coli
tgctctctacgcgatgctgttctgg

SEQ ID NO: 27110 - DNA, 25 bp, E. coli
tgctctctacgccatgctgttctgg

SEQ ID NO: 27111 - DNA, 25 bp, E. coli
tcccggtgatcggcgcttattatcc

SEQ ID NO: 27112 - DNA, 25 bp, E. coli
tcccggtgatcgccgcttattatcc

SEQ ID NO: 27113 - DNA, 25 bp, E. coli
ccaacagttctctctcgcatggcga

SEQ ID NO: 27114 - DNA, 25 bp, E. coli
gcctggataattgccgtcttcatgg

SEQ ID NO: 27115 - DNA, 25 bp, E. coli
ccaacagttctcactcgcatggcga

SEQ ID NO: 27116 - DNA, 25 bp, E. coli
gcctggataattcccgtcttcatgg

SEQ ID NO: 27117 - DNA, 25 bp, E. coli
cgccatgctgttctggctggcattt

SEQ ID NO: 27118 - DNA, 25 bp, E. coli
cgccatgctgttgtggctggcattt

SEQ ID NO: 27119 - DNA, 25 bp, E. coli
ctcgcatggcgaagcaactcaaaaa

SEQ ID NO: 27120 - DNA, 25 bp, E. coli
ctcgcatggcgatgcaactcaaaaa

SEQ ID NO: 27121 - DNA, 25 bp, E. coli
ggcatttgtcggtattatttatacc

SEQ ID NO: 27122 - DNA, 25 bp, E. coli
ggcatttgtcggaattatttatacc

SEQ ID NO: 27123 - DNA, 25 bp, E. coli
aatggccagcgctgaatgaagaccc

SEQ ID NO: 27124 - DNA, 25 bp, E. coli
aatggccagcgcagaatgaagaccc

SEQ ID NO: 27125 - DNA, 25 bp, E. coli
cactcatcattctttgggcgctggc

SEQ ID NO: 27126 - DNA, 25 bp, E. coli
cactcatcattcattgggcgctggc

SEQ ID NO: 27127 - DNA, 25 bp, E. coli
tacacggcgcgaattgctaaagttg

SEQ ID NO: 27128 - DNA, 25 bp, E. coli
tacagacaggtatagctaagcagct

SEQ ID NO: 27129 - DNA, 25 bp, E. coli
tacagacaggtaaagctaagcagct

SEQ ID NO: 27130 - DNA, 25 bp, E. coli
tacacggcgcgatttgctaaagttg

SEQ ID NO: 27131 - DNA, 25 bp, E. coli
taaagttggcttcttcgccggtatc

SEQ ID NO: 27132 - DNA, 25 bp, E. coli
taaagttggcttgttcgccggtatc

SEQ ID NO: 27133 - DNA, 25 bp, E. coli
taccggtggcggaaacaacatgtcc

SEQ ID NO: 27134 - DNA, 25 bp, E. coli
tatgttactgctcatggtggcggca

SEQ ID NO: 27135 - DNA, 25 bp, E. coli
taccggtggcggtaacaacatgtcc

SEQ ID NO: 27136 - DNA, 25 bp, E. coli
tatgttactgctgatggtggcggca

SEQ ID NO: 27137 - DNA, 25 bp, E. coli
tttggtggcacgtaatacacggcgc

SEQ ID NO: 27138 - DNA, 25 bp, E. coli
tattcccgtgggtctttgtgctgcg

SEQ ID NO: 27139 - DNA, 25 bp, E. coli
tattcccgtgggactttgtgctgcg

SEQ ID NO: 27140 - DNA, 25 bp, E. coli
tttggtggcacgaaatacacggcgc

SEQ ID NO: 27141 - DNA, 25 bp, E. coli
tggagccaatcaacagtcagaacgc

SEQ ID NO: 27142 - DNA, 25 bp, E. coli
tggagccaatcatcagtcagaacgc

SEQ ID NO: 27143 - DNA, 25 bp, E. coli
taatgaaatcaacctctccgcaggg

SEQ ID NO: 27144 - DNA, 25 bp, E. coli
taatgaaatcaagctctccgcaggg

SEQ ID NO: 27145 - DNA, 25 bp, E. coli
tactgatggctttctgacccgtgcg

SEQ ID NO: 27146 - DNA, 25 bp, E. coli
tactgatggcttactgacccgtgcg

SEQ ID NO: 27147 - DNA, 25 bp, E. coli
aaatcggtgcggtgattatgcctcc

SEQ ID NO: 27148 - DNA, 25 bp, E. coli
aaatcggtgcggagattatgcctcc

SEQ ID NO: 27149 - DNA, 25 bp, E. coli
tattacaggttcagcgcgatgtcac

SEQ ID NO: 27150 - DNA, 25 bp, E. coli
tattacaggttctgcgcgatgtcac

SEQ ID NO: 27151 - DNA, 25 bp, E. coli
tgcacttaggccatctgcgtttaat

SEQ ID NO: 27152 - DNA, 25 bp, E. coli
tgcacttaggccttctgcgtttaat

SEQ ID NO: 27153 - DNA, 25 bp, E. coli
tccggcattgtccatagctatactg

SEQ ID NO: 27154 - DNA, 25 bp, E. coli
tccggcattgtcgatagctatactg

SEQ ID NO: 27155 - DNA, 25 bp, E. coli
gccagaccttatccctcgaaacgga

SEQ ID NO: 27156 - DNA, 25 bp, E. coli
gccagaccttatgcctcgaaacgga

SEQ ID NO: 27157 - DNA, 25 bp, E. coli
gcgatgtcacagatatcgaaacgca

SEQ ID NO: 27158 - DNA, 25 bp, E. coli
gcgatgtcacagttatcgaaacgca

SEQ ID NO: 27159 - DNA, 25 bp, E. coli
ctgaagatctctttgcccgctggca

SEQ ID NO: 27160 - DNA, 25 bp, E. coli
ctgaagatctctatgcccgctggca

SEQ ID NO: 27161 - DNA, 25 bp, E. coli
gtgattatgcctcccgttccggcgt

SEQ ID NO: 27162 - DNA, 25 bp, E. coli
gggatggtgattataccctgttcaa

SEQ ID NO: 27163 - DNA, 25 bp, E. coli
gggatggtgattttaccctgttcaa

SEQ ID NO: 27164 - DNA, 25 bp, E. coli
gtgattatgcctgccgttccggcgt

SEQ ID NO: 27165 - DNA, 25 bp, E. coli
taatcgtgttctagaccagtttgcg

SEQ ID NO: 27166 - DNA, 25 bp, E. coli
taatcgtgttcttgaccagtttgcg

SEQ ID NO: 27167 - DNA, 25 bp, E. coli
aatctggtgcagagcaatgcgggtt

SEQ ID NO: 27168 - DNA, 25 bp, E. coli
aatctggtgcagtgcaatgcgggtt

SEQ ID NO: 27169 - DNA, 25 bp, E. coli
caaacaaggttgctgcgtaggcgaa

SEQ ID NO: 27170 - DNA, 25 bp, E. coli
caactggcttatgcgaaatctggtg

SEQ ID NO: 27171 - DNA, 25 bp, E. coli
caaacaaggttggtgcgtaggcgaa

SEQ ID NO: 27172 - DNA, 25 bp, E. coli
caactggcttatccgaaatctggtg

SEQ ID NO: 27173 - DNA, 25 bp, E. coli
tactccgagaactagggcttcttag

SEQ ID NO: 27174 - DNA, 25 bp, E. coli
tactccgagaacaagggcttcttag

SEQ ID NO: 27175 - DNA, 25 bp, E. coli
tagacagttgcttattccttgcgac

SEQ ID NO: 27176 - DNA, 25 bp, E. coli
tagacagttgctaattccttgcgac

SEQ ID NO: 27177 - DNA, 25 bp, E. coli
tattccttgcgagctgggctgaagg

SEQ ID NO: 27178 - DNA, 25 bp, E. coli
tattccttgcgacctgggctgaagg

SEQ ID NO: 27179 - DNA, 25 bp, E. coli
gaatgccgctttgggaactactccg

SEQ ID NO: 27180 - DNA, 25 bp, E. coli
gaatgccgctttcggaactactccg

SEQ ID NO: 27181 - DNA, 25 bp, E. coli
cgatgctggcaataccacgcgaaaa

SEQ ID NO: 27182 - DNA, 25 bp, E. coli
cgatgctggcaaaaccacgcgaaaa

SEQ ID NO: 27183 - DNA, 25 bp, E. coli
ggtaaactttctgatgtccaactgg

SEQ ID NO: 27184 - DNA, 25 bp, E. coli
ggaactactccgagaacaagggctt

SEQ ID NO: 27185 - DNA, 25 bp, E. coli
ggaactactccgtgaacaagggctt

SEQ ID NO: 27186 - DNA, 25 bp, E. coli
ggtaaactttctcatgtccaactgg

SEQ ID NO: 27187 - DNA, 25 bp, E. coli
ggcttcttagtgacaaacaaggttg

SEQ ID NO: 27188 - DNA, 25 bp, E. coli
ggcttcttagtgtcaaacaaggttg

SEQ ID NO: 27189 - DNA, 25 bp, E. coli
taaatttgattttgggcaacagcgg

SEQ ID NO: 27190 - DNA, 25 bp, E. coli
taaatttgatttagggcaacagcgg

SEQ ID NO: 27191 - DNA, 25 bp, E. coli
atatggtcgttttatagggtcgtcg

SEQ ID NO: 27192 - DNA, 25 bp, E. coli
aaacgaaggcgactcattcaccaga

SEQ ID NO: 27193 - DNA, 25 bp, E. coli
atatggtcgtttaatagggtcgtcg

SEQ ID NO: 27194 - DNA, 25 bp, E. coli
aaacgaaggcgagtcattcaccaga

SEQ ID NO: 27195 - DNA, 25 bp, E. coli
aaagtgacgacgcaaataatgcgcg

SEQ ID NO: 27196 - DNA, 25 bp, E. coli
aaagtgacgacggaaataatgcgcg

SEQ ID NO: 27197 - DNA, 25 bp, E. coli
tgccagcgtaaacgataagtcacat

SEQ ID NO: 27198 - DNA, 25 bp, E. coli
tgccagcgtaaaggataagtcacat

SEQ ID NO: 27199 - DNA, 25 bp, E. coli
tcacgtattagcaaggcctttcccg

SEQ ID NO: 27200 - DNA, 25 bp, E. coli
tcacgtattagctaggcctttcccg

SEQ ID NO: 27201 - DNA, 25 bp, E. coli
tctgattgacagtgtagtgcacgca

SEQ ID NO: 27202 - DNA, 25 bp, E. coli
tctgattgacagagtagtgcacgca

SEQ ID NO: 27203 - DNA, 25 bp, E. coli
gcctttcccgttttactgccagcgt

SEQ ID NO: 27204 - DNA, 25 bp, E. coli
gcctttcccgttatactgccagcgt

SEQ ID NO: 27205 - DNA, 25 bp, E. coli
gcaacagcgggtagccccatatagt

SEQ ID NO: 27206 - DNA, 25 bp, E. coli
gcaacagcgggttgccccatatagt

SEQ ID NO: 27207 - DNA, 25 bp, E. coli
gtagtgcacgcataagatttaatcc

SEQ ID NO: 27208 - DNA, 25 bp, E. coli
gtagtgcacgcaaaagatttaatcc

SEQ ID NO: 27209 - DNA, 25 bp, E. coli
taatgcgcggcttttttaaaaacga

SEQ ID NO: 27210 - DNA, 25 bp, E. coli
taatgcgcggctattttaaaaacga

SEQ ID NO: 27211 - DNA, 25 bp, E. coli
aatcccaaaaaccttctgctggccg

SEQ ID NO: 27212 - DNA, 25 bp, E. coli
aatcccaaaaacgttctgctggccg

SEQ ID NO: 27213 - DNA, 25 bp, E. coli
caaaagcggcatagcagaaaaatcc

SEQ ID NO: 27214 - DNA, 25 bp, E. coli
caaaagcggcattgcagaaaaatcc

SEQ ID NO: 27215 - DNA, 25 bp, E. coli
caggatctgattacccgcacaaaag

SEQ ID NO: 27216 - DNA, 25 bp, E. coli
caggatctgatttcccgcacaaaag

SEQ ID NO: 27217 - DNA, 25 bp, E. coli
tatatcaggatctgatttcccgcac

SEQ ID NO: 27218 - DNA, 25 bp, E. coli
tatatcaggatcagatttcccgcac

SEQ ID NO: 27219 - DNA, 25 bp, E. coli
ttcccgcacaaaagcggcattgcag

SEQ ID NO: 27220 - DNA, 25 bp, E. coli
ttcccgcacaaatgcggcattgcag

SEQ ID NO: 27221 - DNA, 25 bp, E. coli
tctgatttcccggacaaaagcggca

SEQ ID NO: 27222 - DNA, 25 bp, E. coli
tctgatttcccgcacaaaagcggca

SEQ ID NO: 27223 - DNA, 25 bp, E. coli
gcggcattgcagtaaaatcccaaaa

SEQ ID NO: 27224 - DNA, 25 bp, E. coli
gcggcattgcagaaaaatcccaaaa

SEQ ID NO: 27225 - DNA, 25 bp, E. coli
gaaaaatcccaataacgttctgctg

SEQ ID NO: 27226 - DNA, 25 bp, E. coli
gaaaaatcccaaaaacgttctgctg

SEQ ID NO: 27227 - DNA, 25 bp, E. coli
gatttcccgcacaaaagcggcattg

SEQ ID NO: 27228 - DNA, 25 bp, E. coli
gatttcccgcactaaagcggcattg

SEQ ID NO: 27229 - DNA, 25 bp, E. coli
ggtgggcaagcccttatatcaggat

SEQ ID NO: 27230 - DNA, 25 bp, E. coli
ggtgggcaagccgttatatcaggat

SEQ ID NO: 27231 - DNA, 25 bp, E. coli
ggcaagccgttaaatcaggatctga

SEQ ID NO: 27232 - DNA, 25 bp, E. coli
ggcaagccgttatatcaggatctga

SEQ ID NO: 27233 - DNA, 25 bp, E. coli
caccggcagctatcggtccttacgt

SEQ ID NO: 27234 - DNA, 25 bp, E. coli
caccggcagctaacggtccttacgt

SEQ ID NO: 27235 - DNA, 25 bp, E. coli
cagtcgctggattacgtaaaagcga

SEQ ID NO: 27236 - DNA, 25 bp, E. coli
catgagcaaaacaatcgcgacggaa

SEQ ID NO: 27237 - DNA, 25 bp, E. coli
cagtcgctggataacgtaaaagcga

SEQ ID NO: 27238 - DNA, 25 bp, E. coli
catgagcaaaactatcgcgacggaa

SEQ ID NO: 27239 - DNA, 25 bp, E. coli
taaaagcgatcgacgaagccgctgg

SEQ ID NO: 27240 - DNA, 25 bp, E. coli
taaaagcgatcgtcgaagccgctgg

SEQ ID NO: 27241 - DNA, 25 bp, E. coli
aaaatgcaccggcagctatcggtcc

SEQ ID NO: 27242 - DNA, 25 bp, E. coli
aaagatctgaacgacttcgcaaccg

SEQ ID NO: 27243 - DNA, 25 bp, E. coli
aaagatctgaaccacttcgcaaccg

SEQ ID NO: 27244 - DNA, 25 bp, E. coli
aaaatgcaccgggagctatcggtcc

SEQ ID NO: 27245 - DNA, 25 bp, E. coli
tatcgcgacggaaaatgcaccggca

SEQ ID NO: 27246 - DNA, 25 bp, E. coli
tatcgcgacggataatgcaccggca

SEQ ID NO: 27247 - DNA, 25 bp, E. coli
tgagccagacttattaccgctgtaa

SEQ ID NO: 27248 - DNA, 25 bp, E. coli
tgagccagactttttaccgctgtaa

SEQ ID NO: 27249 - DNA, 25 bp, E. coli
ccgctgtaataatggagaaatcatg

SEQ ID NO: 27250 - DNA, 25 bp, E. coli
ccgctgtaataaaggagaaatcatg

SEQ ID NO: 27251 - DNA, 25 bp, E. coli
cgacggaaaatggaccggcagctat

SEQ ID NO: 27252 - DNA, 25 bp, E. coli
cgacggaaaatgcaccggcagctat

SEQ ID NO: 27253 - DNA, 25 bp, E. coli
ggagaaatcatgagcaaaactatcg

SEQ ID NO: 27254 - DNA, 25 bp, E. coli
ggagaaatcatgtgcaaaactatcg

SEQ ID NO: 27255 - DNA, 25 bp, E. coli
catagagttgtgagatatgcccgat

SEQ ID NO: 27256 - DNA, 25 bp, E. coli
catagagttgtgtgatatgcccgat

SEQ ID NO: 27257 - DNA, 25 bp, E. coli
tatttattggctgaacggaaaacct

SEQ ID NO: 27258 - DNA, 25 bp, E. coli
tatttattggctcaacggaaaacct

SEQ ID NO: 27259 - DNA, 25 bp, E. coli
gcccgatattgaagatgcgctaaaa

SEQ ID NO: 27260 - DNA, 25 bp, E. coli
gcgcagcgtaaaccgaaagatcgta

SEQ ID NO: 27261 - DNA, 25 bp, E. coli
gcgcagcgtaaagcgaaagatcgta

SEQ ID NO: 27262 - DNA, 25 bp, E. coli
gcccgatattgatgatgcgctaaaa

SEQ ID NO: 27263 - DNA, 25 bp, E. coli
gaagggttaaatacactcaatgact

SEQ ID NO: 27264 - DNA, 25 bp, E. coli
gaattatcgatcactccggaaagcg

SEQ ID NO: 27265 - DNA, 25 bp, E. coli
gaagggttaaattcactcaatgact

SEQ ID NO: 27266 - DNA, 25 bp, E. coli
gaattatcgatctctccggaaagcg

SEQ ID NO: 27267 - DNA, 25 bp, E. coli
taaaaggtgatttttacgaacgcct

SEQ ID NO: 27268 - DNA, 25 bp, E. coli
gaaagcgtgcttgagcgcagcgtaa

SEQ ID NO: 27269 - DNA, 25 bp, E. coli
taaaaggtgattattacgaacgcct

SEQ ID NO: 27270 - DNA, 25 bp, E. coli
gaaagcgtgcttcagcgcagcgtaa

SEQ ID NO: 27271 - DNA, 25 bp, E. coli
cgtttgaaagggtaaccagcgcgct

SEQ ID NO: 27272 - DNA, 25 bp, E. coli
cgtttgaaagggaaaccagcgcgct

SEQ ID NO: 27273 - DNA, 25 bp, E. coli
tgagcaaacccataaagtacgaaat

SEQ ID NO: 27274 - DNA, 25 bp, E. coli
tgagcaaacccaaaaagtacgaaat

SEQ ID NO: 27275 - DNA, 25 bp, E. coli
tcaacatggcatcgtttctggcgac

SEQ ID NO: 27276 - DNA, 25 bp, E. coli
tcaacatggcatggtttctggcgac

SEQ ID NO: 27277 - DNA, 25 bp, E. coli
caataacgtacgagatgcgctggcg

SEQ ID NO: 27278 - DNA, 25 bp, E. coli
caataacgtacgtgatgcgctggcg

SEQ ID NO: 27279 - DNA, 25 bp, E. coli
aacgccgtcggatgcaggatattgc

SEQ ID NO: 27280 - DNA, 25 bp, E. coli
aacgccgtcggaagcaggatattgc

SEQ ID NO: 27281 - DNA, 25 bp, E. coli
tataaacggcaggaccgatgaacgc

SEQ ID NO: 27282 - DNA, 25 bp, E. coli
tataaacggcagcaccgatgaacgc

SEQ ID NO: 27283 - DNA, 25 bp, E. coli
tgtacaccatgaaagcgcccaatgg

SEQ ID NO: 27284 - DNA, 25 bp, E. coli
ttcgacccgacaacgcaaagtgctg

SEQ ID NO: 27285 - DNA, 25 bp, E. coli
tgtacaccatgatagcgcccaatgg

SEQ ID NO: 27286 - DNA, 25 bp, E. coli
ttcgacccgacatcgcaaagtgctg

SEQ ID NO: 27287 - DNA, 25 bp, E. coli
tctcggtgaagggacgctgattaca

SEQ ID NO: 27288 - DNA, 25 bp, E. coli
tctcggtgaaggcacgctgattaca

SEQ ID NO: 27289 - DNA, 25 bp, E. coli
gcaggaaaatttagctcgtcgtacc

SEQ ID NO: 27290 - DNA, 25 bp, E. coli
gcaggaaaattttgctcgtcgtacc

SEQ ID NO: 27291 - DNA, 25 bp, E. coli
gaaatcgacgccagtatagcacgga

SEQ ID NO: 27292 - DNA, 25 bp, E. coli
gaaatcgacgcctgtatagcacgga

SEQ ID NO: 27293 - DNA, 25 bp, E. coli
cgtttgccgtggatgagcgatgacc

SEQ ID NO: 27294 - DNA, 25 bp, E. coli
cgtttgccgtggttgagcgatgacc

SEQ ID NO: 27295 - DNA, 25 bp, E. coli
gtggattcctgggtctgctgcgcaa

SEQ ID NO: 27296 - DNA, 25 bp, E. coli
gtcgctatatgggaccgcaacgtga

SEQ ID NO: 27297 - DNA, 25 bp, E. coli
gtggattcctggctctgctgcgcaa

SEQ ID NO: 27298 - DNA, 25 bp, E. coli
gtcgctatatggcaccgcaacgtga

SEQ ID NO: 27299 - DNA, 25 bp, E. coli
taaatatgggctcttaaaagtgtag

SEQ ID NO: 27300 - DNA, 25 bp, E. coli
taaatatgggctgttaaaagtgtag

SEQ ID NO: 27301 - DNA, 25 bp, E. coli
attccccggtggtaaatatgggctg

SEQ ID NO: 27302 - DNA, 25 bp, E. coli
attccccggtggaaaatatgggctg

SEQ ID NO: 27303 - DNA, 25 bp, E. coli
ttccccggtggttaatatgggctgt

SEQ ID NO: 27304 - DNA, 25 bp, E. coli
ttccccggtggtaaatatgggctgt

SEQ ID NO: 27305 - DNA, 25 bp, E. coli
tgagcccattccgcggtggtaaata

SEQ ID NO: 27306 - DNA, 25 bp, E. coli
tgagcccattccccggtggtaaata

SEQ ID NO: 27307 - DNA, 25 bp, E. coli
tccccggtggtatatatgggctgtt

SEQ ID NO: 27308 - DNA, 25 bp, E. coli
tccccggtggtaaatatgggctgtt

SEQ ID NO: 27309 - DNA, 25 bp, E. coli
gcccattccccggtggtaaatatgg

SEQ ID NO: 27310 - DNA, 25 bp, E. coli
gcccattccccgctggtaaatatgg

SEQ ID NO: 27311 - DNA, 25 bp, E. coli
gtaaatatgggcagttaaaagtgta

SEQ ID NO: 27312 - DNA, 25 bp, E. coli
gtaaatatgggctgttaaaagtgta

SEQ ID NO: 27313 - DNA, 25 bp, E. coli
cattccccggtggtaaatatgggct

SEQ ID NO: 27314 - DNA, 25 bp, E. coli
cattccccggtgctaaatatgggct

SEQ ID NO: 27315 - DNA, 25 bp, E. coli
ggtggtaaatatgggctgttaaaag

SEQ ID NO: 27316 - DNA, 25 bp, E. coli
gtgagcccattcgccggtggtaaat

SEQ ID NO: 27317 - DNA, 25 bp, E. coli
gtgagcccattccccggtggtaaat

SEQ ID NO: 27318 - DNA, 25 bp, E. coli
ggtggtaaatatcggctgttaaaag

SEQ ID NO: 27319 - DNA, 25 bp, E. coli
gagcccattcccgggtggtaaatat

SEQ ID NO: 27320 - DNA, 25 bp, E. coli
gagcccattccccggtggtaaatat

SEQ ID NO: 27321 - DNA, 25 bp, E. coli
aaagctgcctttcacgatctattgc

SEQ ID NO: 27322 - DNA, 25 bp, E. coli
aaagctgcctttgacgatctattgc

SEQ ID NO: 27323 - DNA, 25 bp, E. coli
ttgctacattcaatcaaaccacctg

SEQ ID NO: 27324 - DNA, 25 bp, E. coli
ttgctacattcattcaaaccacctg

SEQ ID NO: 27325 - DNA, 25 bp, E. coli
tgatagttcatcctgtggcgtcgct

SEQ ID NO: 27326 - DNA, 25 bp, E. coli
tgatagttcatcgtgtggcgtcgct

SEQ ID NO: 27327 - DNA, 25 bp, E. coli
ccacctgtaacaaaaagctgccttt

SEQ ID NO: 27328 - DNA, 25 bp, E. coli
ccacctgtaacataaagctgccttt

SEQ ID NO: 27329 - DNA, 25 bp, E. coli
gaaattctgtatttcgttgctacat

SEQ ID NO: 27330 - DNA, 25 bp, E. coli
gaaattctgtatatcgttgctacat

SEQ ID NO: 27331 - DNA, 25 bp, E. coli
gttttgccgggagttacatgacctg

SEQ ID NO: 27332 - DNA, 25 bp, E. coli
gttttgccgggacttacatgacctg

SEQ ID NO: 27333 - DNA, 25 bp, E. coli
gattacatacctcccggttttgccg

SEQ ID NO: 27334 - DNA, 25 bp, E. coli
gattacatacctgccggttttgccg

SEQ ID NO: 27335 - DNA, 25 bp, E. coli
gggagttacatgtcctgaaattctg

SEQ ID NO: 27336 - DNA, 25 bp, E. coli
gggagttacatgacctgaaattctg

SEQ ID NO: 27337 - DNA, 25 bp, E. coli
tggcgtcgctcttaaacttatattg

SEQ ID NO: 27338 - DNA, 25 bp, E. coli
tggcgtcgctctaaaacttatattg

SEQ ID NO: 27339 - DNA, 25 bp, E. coli
taagttttgctattcatgatgagct

SEQ ID NO: 27340 - DNA, 25 bp, E. coli
taagttttgctaatcatgatgagct

SEQ ID NO: 27341 - DNA, 25 bp, E. coli
gacgatctattggtataaataagtg

SEQ ID NO: 27342 - DNA, 25 bp, E. coli
gacgatctattgctataaataagtg

SEQ ID NO: 27343 - DNA, 25 bp, E. coli
cactgaactgattaataaggccgct

SEQ ID NO: 27344 - DNA, 25 bp, E. coli
cactgaactgataaataaggccgct

SEQ ID NO: 27345 - DNA, 25 bp, E. coli
atgccagccctctccagttgctgta

SEQ ID NO: 27346 - DNA, 25 bp, E. coli
atcactgaactgtttaataaggccg

SEQ ID NO: 27347 - DNA, 25 bp, E. coli
atgccagccctcaccagttgctgta

SEQ ID NO: 27348 - DNA, 25 bp, E. coli
atcactgaactgattaataaggccg

SEQ ID NO: 27349 - DNA, 25 bp, E. coli
actgaactgattaataaggccgctg

SEQ ID NO: 27350 - DNA, 25 bp, E. coli
actgaactgatttataaggccgctg

SEQ ID NO: 27351 - DNA, 25 bp, E. coli
tatcactgaactcattaataaggcc

SEQ ID NO: 27352 - DNA, 25 bp, E. coli
tatgccagccctgaccagttgctgt

SEQ ID NO: 27353 - DNA, 25 bp, E. coli
tatcactgaactgattaataaggcc

SEQ ID NO: 27354 - DNA, 25 bp, E. coli
tatgccagccctcaccagttgctgt

SEQ ID NO: 27355 - DNA, 25 bp, E. coli
ttatgccagccctcaccagttgctg

SEQ ID NO: 27356 - DNA, 25 bp, E. coli
ttatgccagcccacaccagttgctg

SEQ ID NO: 27357 - DNA, 25 bp, E. coli
tgccagccctcaccagttgctgtaa

SEQ ID NO: 27358 - DNA, 25 bp, E. coli
tgccagccctcagcagttgctgtaa

SEQ ID NO: 27359 - DNA, 25 bp, E. coli
ctgaactgattattaaggccgctga

SEQ ID NO: 27360 - DNA, 25 bp, E. coli
ctgaactgattaataaggccgctga

SEQ ID NO: 27361 - DNA, 25 bp, E. coli
tggatatggggcacattgtcgttga

SEQ ID NO: 27362 - DNA, 25 bp, E. coli
tggatatggggctcattgtcgttga

SEQ ID NO: 27363 - DNA, 25 bp, E. coli
tcactgaactgattaataaggccgc

SEQ ID NO: 27364 - DNA, 25 bp, E. coli
tcactgaactgaataataaggccgc

SEQ ID NO: 27365 - DNA, 25 bp, E. coli
caccatataatgttgctccagctga

SEQ ID NO: 27366 - DNA, 25 bp, E. coli
caccatataatgatgctccagctga

SEQ ID NO: 27367 - DNA, 25 bp, E. coli
catttgatgggtagtcatggtccta

SEQ ID NO: 27368 - DNA, 25 bp, E. coli
aaatatccgttatcctgagacatgg

SEQ ID NO: 27369 - DNA, 25 bp, E. coli
aaagagttcaatacccgcaaagcgg

SEQ ID NO: 27370 - DNA, 25 bp, E. coli
aaagagttcaattcccgcaaagcgg

SEQ ID NO: 27371 - DNA, 25 bp, E. coli
aaatatccgttaacctgagacatgg

SEQ ID NO: 27372 - DNA, 25 bp, E. coli
tttacgggtatacttccatgtggac

SEQ ID NO: 27373 - DNA, 25 bp, E. coli
tttacgggtatagttccatgtggac

SEQ ID NO: 27374 - DNA, 25 bp, E. coli
tttactctggatagaaaatgacggg

SEQ ID NO: 27375 - DNA, 25 bp, E. coli
tttactctggattgaaaatgacggg

SEQ ID NO: 27376 - DNA, 25 bp, E. coli
tccagctgagcatacgcatgtgcct

SEQ ID NO: 27377 - DNA, 25 bp, E. coli
tcgtcagactggtacggatgcatcc

SEQ ID NO: 27378 - DNA, 25 bp, E. coli
tccagctgagcaaacgcatgtgcct

SEQ ID NO: 27379 - DNA, 25 bp, E. coli
tcgtcagactggaacggatgcatcc

SEQ ID NO: 27380 - DNA, 25 bp, E. coli
tctctgaccatgcagaatctctggg

SEQ ID NO: 27381 - DNA, 25 bp, E. coli
tctctgaccatggagaatctctggg

SEQ ID NO: 27382 - DNA, 25 bp, E. coli
cctttcataatgagcagtcgtgtgg

SEQ ID NO: 27383 - DNA, 25 bp, E. coli
cctttcataatgtgcagtcgtgtgg

SEQ ID NO: 27384 - DNA, 25 bp, E. coli
catttgatgggttgtcatggtccta

SEQ ID NO: 27385 - DNA, 25 bp, E. coli
ggatgcatcccgcacaataaatgaa

SEQ ID NO: 27386 - DNA, 25 bp, E. coli
ggatgcatcccggacaataaatgaa

SEQ ID NO: 27387 - DNA, 25 bp, E. coli
cacttctggcgagctggatatctat

SEQ ID NO: 27388 - DNA, 25 bp, E. coli
cacttctggcgacctggatatctat

SEQ ID NO: 27389 - DNA, 25 bp, E. coli
taaataaagtgcagctgggaacgac

SEQ ID NO: 27390 - DNA, 25 bp, E. coli
taaagtgcagctgggaacgactccc

SEQ ID NO: 27391 - DNA, 25 bp, E. coli
taaagtgcagctcggaacgactccc

SEQ ID NO: 27392 - DNA, 25 bp, E. coli
taaataaagtgctgctgggaacgac

SEQ ID NO: 27393 - DNA, 25 bp, E. coli
aaagatgaaaaccatacggtatgga

SEQ ID NO: 27394 - DNA, 25 bp, E. coli
aaagatgaaaacgatacggtatgga

SEQ ID NO: 27395 - DNA, 25 bp, E. coli
ttacggcaccgatggcccggttgcg

SEQ ID NO: 27396 - DNA, 25 bp, E. coli
ttacggcaccgaaggcccggttgcg

SEQ ID NO: 27397 - DNA, 25 bp, E. coli
tgctggaaagtctcggcgttcctac

SEQ ID NO: 27398 - DNA, 25 bp, E. coli
tgctggaaagtcacggcgttcctac

SEQ ID NO: 27399 - DNA, 25 bp, E. coli
cctacggtaaataaagtgcagctgg

SEQ ID NO: 27400 - DNA, 25 bp, E. coli
cctacggtaaattaagtgcagctgg

SEQ ID NO: 27401 - DNA, 25 bp, E. coli
gcgttcctacggaaaataaagtgca

SEQ ID NO: 27402 - DNA, 25 bp, E. coli
gctgggaacgacacccgtagtgcgc

SEQ ID NO: 27403 - DNA, 25 bp, E. coli
gcgttcctacggtaaataaagtgca

SEQ ID NO: 27404 - DNA, 25 bp, E. coli
gctgggaacgactcccgtagtgcgc

SEQ ID NO: 27405 - DNA, 25 bp, E. coli
cgatacggtatgcaaaaacgcgcag

SEQ ID NO: 27406 - DNA, 25 bp, E. coli
cgatacggtatggaaaaacgcgcag

SEQ ID NO: 27407 - DNA, 25 bp, E. coli
ggcgatcacttcaggcgagctggat

SEQ ID NO: 27408 - DNA, 25 bp, E. coli
ggcgatcacttctggcgagctggat

SEQ ID NO: 27409 - DNA, 25 bp, E. coli
taaaccgtaccttgatcagcaactg

SEQ ID NO: 27410 - DNA, 25 bp, E. coli
taaaccgtacctagatcagcaactg

SEQ ID NO: 27411 - DNA, 25 bp, E. coli
agatcgtggctacaaactggtcgca

SEQ ID NO: 27412 - DNA, 25 bp, E. coli
agatcgtggctagaaactggtcgca

SEQ ID NO: 27413 - DNA, 25 bp, E. coli
aaattgttgaacaggaagcaccgca

SEQ ID NO: 27414 - DNA, 25 bp, E. coli
aacagcaggttggagaagtcgcgca

SEQ ID NO: 27415 - DNA, 25 bp, E. coli
aacagcaggttgcagaagtcgcgca

SEQ ID NO: 27416 - DNA, 25 bp, E. coli
aaattgttgaactggaagcaccgca

SEQ ID NO: 27417 - DNA, 25 bp, E. coli
aaacctttgcggcagtgggagccct

SEQ ID NO: 27418 - DNA, 25 bp, E. coli
aaacctttgcgggagtgggagccct

SEQ ID NO: 27419 - DNA, 25 bp, E. coli
tgaaagatggcgatggcctgctgcc

SEQ ID NO: 27420 - DNA, 25 bp, E. coli
tgcgaaagacaaatatggcctggac

SEQ ID NO: 27421 - DNA, 25 bp, E. coli
tgcgaaagacaattatggcctggac

SEQ ID NO: 27422 - DNA, 25 bp, E. coli
tgaaagatggcgttggcctgctgcc

SEQ ID NO: 27423 - DNA, 25 bp, E. coli
tcactggcactggtaggctgcggtc

SEQ ID NO: 27424 - DNA, 25 bp, E. coli
gcattgagcaaaggcgatatcgacg

SEQ ID NO: 27425 - DNA, 25 bp, E. coli
gcattgagcaaacgcgatatcgacg

SEQ ID NO: 27426 - DNA, 25 bp, E. coli
taaccttggtcgatcactgctgctg

SEQ ID NO: 27427 - DNA, 25 bp, E. coli
tcactggcactgctaggctgcggtc

SEQ ID NO: 27428 - DNA, 25 bp, E. coli
taaccttggtcgttcactgctgctg

SEQ ID NO: 27429 - DNA, 25 bp, E. coli
gagctggtaaccttcaacgactatg

SEQ ID NO: 27430 - DNA, 25 bp, E. coli
gagctggtaaccatcaacgactatg

SEQ ID NO: 27431 - DNA, 25 bp, E. coli
caagaagccgccaacaatatggaag

SEQ ID NO: 27432 - DNA, 25 bp, E. coli
caagaagccgcctacaatatggaag

SEQ ID NO: 27433 - DNA, 25 bp, E. coli
taaacgcatcgctcaggatctggcg

SEQ ID NO: 27434 - DNA, 25 bp, E. coli
taaacgcatcgcacaggatctggcg

SEQ ID NO: 27435 - DNA, 25 bp, E. coli
aagtggtgacaatccctcgaaagag

SEQ ID NO: 27436 - DNA, 25 bp, E. coli
aagtggtgacaaaccctcgaaagag

SEQ ID NO: 27437 - DNA, 25 bp, E. coli
tttactggcgactccgacaggttca

SEQ ID NO: 27438 - DNA, 25 bp, E. coli
tttactggcgacaccgacaggttca

SEQ ID NO: 27439 - DNA, 25 bp, E. coli
tttacctgacggcaatttactggcg

SEQ ID NO: 27440 - DNA, 25 bp, E. coli
tttacctgacgggaatttactggcg

SEQ ID NO: 27441 - DNA, 25 bp, E. coli
gcccagtggtttccggtgaaagcct

SEQ ID NO: 27442 - DNA, 25 bp, E. coli
gcccagtggtttgcggtgaaagcct

SEQ ID NO: 27443 - DNA, 25 bp, E. coli
gctgtatcgcaagaatccgcgctgt

SEQ ID NO: 27444 - DNA, 25 bp, E. coli
gctgtatcgcaacaatccgcgctgt

SEQ ID NO: 27445 - DNA, 25 bp, E. coli
cgatttcgcaaatgtagagcagtct

SEQ ID NO: 27446 - DNA, 25 bp, E. coli
cgatttcgcaaaagtagagcagtct

SEQ ID NO: 27447 - DNA, 25 bp, E. coli
gatttttattctcggtgaccgcccg

SEQ ID NO: 27448 - DNA, 25 bp, E. coli
gatttttattctgggtgaccgcccg

SEQ ID NO: 27449 - DNA, 25 bp, E. coli
ggaactggcagcagacaatcaggct

SEQ ID NO: 27450 - DNA, 25 bp, E. coli
ggaactggcagctgacaatcaggct

SEQ ID NO: 27451 - DNA, 25 bp, E. coli
gatccgttatctgaccgcaggtgaa

SEQ ID NO: 27452 - DNA, 25 bp, E. coli
gatccgttatctcaccgcaggtgaa

SEQ ID NO: 27453 - DNA, 25 bp, E. coli
aatgggaacactacaaagcgggcgc

SEQ ID NO: 27454 - DNA, 25 bp, E. coli
aatgggaacacttcaaagcgggcgc

SEQ ID NO: 27455 - DNA, 25 bp, E. coli
caaactgcgtgggtttggcggcaaa

SEQ ID NO: 27456 - DNA, 25 bp, E. coli
caaaactgagttctgggatcacaac

SEQ ID NO: 27457 - DNA, 25 bp, E. coli
caaaactgagttgtgggatcacaac

SEQ ID NO: 27458 - DNA, 25 bp, E. coli
caaactgcgtggctttggcggcaaa

SEQ ID NO: 27459 - DNA, 25 bp, E. coli
tagtcggttcttacgccagtgtcgc

SEQ ID NO: 27460 - DNA, 25 bp, E. coli
tagtcggttctttcgccagtgtcgc

SEQ ID NO: 27461 - DNA, 25 bp, E. coli
tctggcctggcgatgactatttctc

SEQ ID NO: 27462 - DNA, 25 bp, E. coli
tctctggcgggcgttttggcgtcaa

SEQ ID NO: 27463 - DNA, 25 bp, E. coli
tctgtcgggaatggaaaccttcggc

SEQ ID NO: 27464 - DNA, 25 bp, E. coli
tctgtcgggaatcgaaaccttcggc

SEQ ID NO: 27465 - DNA, 25 bp, E. coli
tctctggcgggccttttggcgtcaa

SEQ ID NO: 27466 - DNA, 25 bp, E. coli
tctggcctggcgttgactatttctc

SEQ ID NO: 27467 - DNA, 25 bp, E. coli
gaacaaagtcagaaagatacccgct

SEQ ID NO: 27468 - DNA, 25 bp, E. coli
gaacaaagtcagtaagatacccgct

SEQ ID NO: 27469 - DNA, 25 bp, E. coli
cttcggcggtaatcatcaatatggg

SEQ ID NO: 27470 - DNA, 25 bp, E. coli
cttcggcggtaaacatcaatatggg

SEQ ID NO: 27471 - DNA, 25 bp, E. coli
ggcaacaacggctggctcatttcga

SEQ ID NO: 27472 - DNA, 25 bp, E. coli
ggcaacaacggcaggctcatttcga

SEQ ID NO: 27473 - DNA, 25 bp, E. coli
gagtgtccccatcaaagtgatctgc

SEQ ID NO: 27474 - DNA, 25 bp, E. coli
gagtgtccccatgaaagtgatctgc

SEQ ID NO: 27475 - DNA, 25 bp, E. coli
caagccttgcttacaatggaaacaa

SEQ ID NO: 27476 - DNA, 25 bp, E. coli
caagccttgctttcaatggaaacaa

SEQ ID NO: 27477 - DNA, 25 bp, E. coli
aattgccgtcggaattttgccagag

SEQ ID NO: 27478 - DNA, 25 bp, E. coli
aattgccgtcggtattttgccagag

SEQ ID NO: 27479 - DNA, 25 bp, E. coli
ctgctgagctggtggtccctgattt

SEQ ID NO: 27480 - DNA, 25 bp, E. coli
ctgctgagctggaggtccctgattt

SEQ ID NO: 27481 - DNA, 25 bp, E. coli
atgaggaataaaatgcaaggcatac

SEQ ID NO: 27482 - DNA, 25 bp, E. coli
atgaggaataaattgcaaggcatac

SEQ ID NO: 27483 - DNA, 25 bp, E. coli
accctgatcccgtgcctgtcagggt

SEQ ID NO: 27484 - DNA, 25 bp, E. coli
aaaatgcaaggcatacagtttcagg

SEQ ID NO: 27485 - DNA, 25 bp, E. coli
accctgatcccgagcctgtcagggt

SEQ ID NO: 27486 - DNA, 25 bp, E. coli
aaaatgcaaggcttacagtttcagg

SEQ ID NO: 27487 - DNA, 25 bp, E. coli
tatgcaagccttgcttacaatggaa

SEQ ID NO: 27488 - DNA, 25 bp, E. coli
tatgcaagccttccttacaatggaa

SEQ ID NO: 27489 - DNA, 25 bp, E. coli
tattttgccagacccggtagagttt

SEQ ID NO: 27490 - DNA, 25 bp, E. coli
tattttgccagagccggtagagttt

SEQ ID NO: 27491 - DNA, 25 bp, E. coli
ttgctgctgagcaggtggtccctga

SEQ ID NO: 27492 - DNA, 25 bp, E. coli
ttgctgctgagctggtggtccctga

SEQ ID NO: 27493 - DNA, 25 bp, E. coli
gcttacaatggaaacaacaaaaata

SEQ ID NO: 27494 - DNA, 25 bp, E. coli
gcttacaatggatacaacaaaaata

SEQ ID NO: 27495 - DNA, 25 bp, E. coli
cgtcggtattttcccagagccggta

SEQ ID NO: 27496 - DNA, 25 bp, E. coli
cgtcggtattttgccagagccggta

SEQ ID NO: 27497 - DNA, 25 bp, E. coli
caggtgttatagagctgaataagtg

SEQ ID NO: 27498 - DNA, 25 bp, E. coli
caggtgttatagtgctgaataagtg

SEQ ID NO: 27499 - DNA, 25 bp, E. coli
agttagtcgctttcattcagaacac

SEQ ID NO: 27500 - DNA, 25 bp, E. coli
agttagtcgcttacattcagaacac

SEQ ID NO: 27501 - DNA, 25 bp, E. coli
tatactcctgatcgcctattgctct

SEQ ID NO: 27502 - DNA, 25 bp, E. coli
tatactcctgatggcctattgctct

SEQ ID NO: 27503 - DNA, 25 bp, E. coli
tctgtcgagcatcactatactcctg

SEQ ID NO: 27504 - DNA, 25 bp, E. coli
tttcctcactccataagttagtcgc

SEQ ID NO: 27505 - DNA, 25 bp, E. coli
tttcctcactccttaagttagtcgc

SEQ ID NO: 27506 - DNA, 25 bp, E. coli
tctgtcgagcatgactatactcctg

SEQ ID NO: 27507 - DNA, 25 bp, E. coli
cctgtaaagagtctgaatattcaga

SEQ ID NO: 27508 - DNA, 25 bp, E. coli
cctgtaaagagtgtgaatattcaga

SEQ ID NO: 27509 - DNA, 25 bp, E. coli
gaacacttcttcagtcgagcatcac

SEQ ID NO: 27510 - DNA, 25 bp, E. coli
gaacacttcttctgtcgagcatcac

SEQ ID NO: 27511 - DNA, 25 bp, E. coli
ggcctattgctcaaaaaagttcctg

SEQ ID NO: 27512 - DNA, 25 bp, E. coli
tggaacttactgcaaccatcccgcg

SEQ ID NO: 27513 - DNA, 25 bp, E. coli
tggaacttactggaaccatcccgcg

SEQ ID NO: 27514 - DNA, 25 bp, E. coli
ggcctattgctctaaaaagttcctg

SEQ ID NO: 27515 - DNA, 25 bp, E. coli
tcagaatatatatagatgcacatcc

SEQ ID NO: 27516 - DNA, 25 bp, E. coli
tcagaatatataaagatgcacatcc

SEQ ID NO: 27517 - DNA, 25 bp, E. coli
gatgcacatccctatttttcaggtg

SEQ ID NO: 27518 - DNA, 25 bp, E. coli
gatgcacatcccaatttttcaggtg

SEQ ID NO: 27519 - DNA, 25 bp, E. coli
caaaccgtaacgttgggagatgaga

SEQ ID NO: 27520 - DNA, 25 bp, E. coli
caaaccgtaacgatgggagatgaga

SEQ ID NO: 27521 - DNA, 25 bp, E. coli
tatcaggtgatgagcgcgtgcaaac

SEQ ID NO: 27522 - DNA, 25 bp, E. coli
tatcaggtgatgtgcgcgtgcaaac

SEQ ID NO: 27523 - DNA, 25 bp, E. coli
ttgcaaagggcgtaaccaccaaagc

SEQ ID NO: 27524 - DNA, 25 bp, E. coli
ttgcaaagggcgaaaccaccaaagc

SEQ ID NO: 27525 - DNA, 25 bp, E. coli
tgtttaaggcaaaaacgacagtcgc

SEQ ID NO: 27526 - DNA, 25 bp, E. coli
tgtttaaggcaataacgacagtcgc

SEQ ID NO: 27527 - DNA, 25 bp, E. coli
ccaccagtgcaatggcgcaggatga

SEQ ID NO: 27528 - DNA, 25 bp, E. coli
ccaccagtgcaaaggcgcaggatga

SEQ ID NO: 27529 - DNA, 25 bp, E. coli
gcgtgcaaaccgcatgactgtggct

SEQ ID NO: 27530 - DNA, 25 bp, E. coli
gcgtgcaaaccggatgactgtggct

SEQ ID NO: 27531 - DNA, 25 bp, E. coli
gcagcctggaaatccatccggatgg

SEQ ID NO: 27532 - DNA, 25 bp, E. coli
gcagcctggaaaaccatccggatgg

SEQ ID NO: 27533 - DNA, 25 bp, E. coli
gactgtggctcggaacgtatcgctg

SEQ ID NO: 27534 - DNA, 25 bp, E. coli
gactgtggctcgcaacgtatcgctg

SEQ ID NO: 27535 - DNA, 25 bp, E. coli
cgtatcgctgtgatgtggtccgaga

SEQ ID NO: 27536 - DNA, 25 bp, E. coli
cgtatcgctgtgttgtggtccgaga

SEQ ID NO: 27537 - DNA, 25 bp, E. coli
taagctgcctgcgtgggtgatgaaa

SEQ ID NO: 27538 - DNA, 25 bp, E. coli
taaccattagcacccttgcaaaggg

SEQ ID NO: 27539 - DNA, 25 bp, E. coli
taagctgcctgcctgggtgatgaaa

SEQ ID NO: 27540 - DNA, 25 bp, E. coli
taaccattagcagccttgcaaaggg

SEQ ID NO: 27541 - DNA, 25 bp, E. coli
aactgcgcgctgcagctggaacgtc

SEQ ID NO: 27542 - DNA, 25 bp, E. coli
aactgcgcgctggagctggaacgtc

SEQ ID NO: 27543 - DNA, 25 bp, E. coli
tatcgaaatgaacccacgcgtgtcc

SEQ ID NO: 27544 - DNA, 25 bp, E. coli
tatcgaaatgaagccacgcgtgtcc

SEQ ID NO: 27545 - DNA, 25 bp, E. coli
ttcgagccggtatctctggaagatg

SEQ ID NO: 27546 - DNA, 25 bp, E. coli
ttcgagccggtaactctggaagatg

SEQ ID NO: 27547 - DNA, 25 bp, E. coli
tgagcctggatgtcccggaagcgtt

SEQ ID NO: 27548 - DNA, 25 bp, E. coli
tgagcctggatgacccggaagcgtt

SEQ ID NO: 27549 - DNA, 25 bp, E. coli
tcgcgaactgaaagacgcaggcgca

SEQ ID NO: 27550 - DNA, 25 bp, E. coli
tcgcgaactgaatgacgcaggcgca

SEQ ID NO: 27551 - DNA, 25 bp, E. coli
tcggtgcgactggattcgacccgaa

SEQ ID NO: 27552 - DNA, 25 bp, E. coli
tcggtgcgactgcattcgacccgaa

SEQ ID NO: 27553 - DNA, 25 bp, E. coli
gcctgtctgtggacggcgtcttcaa

SEQ ID NO: 27554 - DNA, 25 bp, E. coli
ccgatgcgcgctaggcaaaactggc

SEQ ID NO: 27555 - DNA, 25 bp, E. coli
gcctgtctgtggtcggcgtcttcaa

SEQ ID NO: 27556 - DNA, 25 bp, E. coli
gaagcgttaaccaaaatccgtcgcg

SEQ ID NO: 27557 - DNA, 25 bp, E. coli
gaagcgttaacctaaatccgtcgcg

SEQ ID NO: 27558 - DNA, 25 bp, E. coli
gaaagcgaccggtttcccgattgct

SEQ ID NO: 27559 - DNA, 25 bp, E. coli
gaaagcgaccggattcccgattgct

SEQ ID NO: 27560 - DNA, 25 bp, E. coli
ccgatgcgcgcttggcaaaactggc

SEQ ID NO: 27561 - DNA, 25 bp, E. coli
ggtgactccatcactgtcgcgccag

SEQ ID NO: 27562 - DNA, 25 bp, E. coli
ggtgactccatctctgtcgcgccag

SEQ ID NO: 27563 - DNA, 25 bp, E. coli
aatgtcacccagattgcttactgca

SEQ ID NO: 27564 - DNA, 25 bp, E. coli
aatgtcacccagtttgcttactgca

SEQ ID NO: 27565 - DNA, 25 bp, E. coli
cagcagatcgtccttagcggcttta

SEQ ID NO: 27566 - DNA, 25 bp, E. coli
cagcagatcgtcgttagcggcttta

SEQ ID NO: 27567 - DNA, 25 bp, E. coli
agagttcagcagttcgtcgttagcg

SEQ ID NO: 27568 - DNA, 25 bp, E. coli
agagttcagcagatcgtcgttagcg

SEQ ID NO: 27569 - DNA, 25 bp, E. coli
tagcggctttagaaatctggatacc

SEQ ID NO: 27570 - DNA, 25 bp, E. coli
tagcggctttagtaatctggatacc

SEQ ID NO: 27571 - DNA, 25 bp, E. coli
tagtaatctggaaacctgtaatcat

SEQ ID NO: 27572 - DNA, 25 bp, E. coli
tagtaatctggatacctgtaatcat

SEQ ID NO: 27573 - DNA, 25 bp, E. coli
ccagaaagagttgagcagatcgtcg

SEQ ID NO: 27574 - DNA, 25 bp, E. coli
ccagaaagagttcagcagatcgtcg

SEQ ID NO: 27575 - DNA, 25 bp, E. coli
ccagtttgcttactgcaaccacttc

SEQ ID NO: 27576 - DNA, 25 bp, E. coli
ccagtttgcttagtgcaaccacttc

SEQ ID NO: 27577 - DNA, 25 bp, E. coli
gcttcgcctttttcgctgtccagca

SEQ ID NO: 27578 - DNA, 25 bp, E. coli
gcttcgccttttacgctgtccagca

SEQ ID NO: 27579 - DNA, 25 bp, E. coli
gaacttctggttacacttctactgg

SEQ ID NO: 27580 - DNA, 25 bp, E. coli
gaacttctggtttcacttctactgg

SEQ ID NO: 27581 - DNA, 25 bp, E. coli
ctggtttcacttgtactggaacttc

SEQ ID NO: 27582 - DNA, 25 bp, E. coli
ctggtttcacttctactggaacttc

SEQ ID NO: 27583 - DNA, 25 bp, E. coli
gaccaccttcaaggcgaacttctgg

SEQ ID NO: 27584 - DNA, 25 bp, E. coli
gaccaccttcaacgcgaacttctgg

SEQ ID NO: 27585 - DNA, 25 bp, E. coli
cagtgtagaaaaaatactggctggc

SEQ ID NO: 27586 - DNA, 25 bp, E. coli
cagtgtagaaaatatactggctggc

SEQ ID NO: 27587 - DNA, 25 bp, E. coli
catattctctcctgagcatcctgaa

SEQ ID NO: 27588 - DNA, 25 bp, E. coli
catattctctccagagcatcctgaa

SEQ ID NO: 27589 - DNA, 25 bp, E. coli
aaatggcccggctcgtggcgttgac

SEQ ID NO: 27590 - DNA, 25 bp, E. coli
aaatggcccggcacgtggcgttgac

SEQ ID NO: 27591 - DNA, 25 bp, E. coli
tagaaaatatacaggctggcatgaa

SEQ ID NO: 27592 - DNA, 25 bp, E. coli
tagaaaatatactggctggcatgaa

SEQ ID NO: 27593 - DNA, 25 bp, E. coli
tatactggctgggatgaaaatggcc

SEQ ID NO: 27594 - DNA, 25 bp, E. coli
tatactggctggcatgaaaatggcc

SEQ ID NO: 27595 - DNA, 25 bp, E. coli
tcagactgcatctgtgtagaaaata

SEQ ID NO: 27596 - DNA, 25 bp, E. coli
tcagactgcatcagtgtagaaaata

SEQ ID NO: 27597 - DNA, 25 bp, E. coli
ccggctcgtggcgttgacatattct

SEQ ID NO: 27598 - DNA, 25 bp, E. coli
ccggctcgtggccttgacatattct

SEQ ID NO: 27599 - DNA, 25 bp, E. coli
gcgttgacatattctctcctgagca

SEQ ID NO: 27600 - DNA, 25 bp, E. coli
gctcgtggcgttcacatattctctc

SEQ ID NO: 27601 - DNA, 25 bp, E. coli
gctcgtggcgttgacatattctctc

SEQ ID NO: 27602 - DNA, 25 bp, E. coli
gcgttgacatatactctcctgagca

SEQ ID NO: 27603 - DNA, 25 bp, E. coli
tggctggcatgataatggcccggct

SEQ ID NO: 27604 - DNA, 25 bp, E. coli
tggcatgaaaatggcccggctcgtg

SEQ ID NO: 27605 - DNA, 25 bp, E. coli
tggcatgaaaatcgcccggctcgtg

SEQ ID NO: 27606 - DNA, 25 bp, E. coli
tggctggcatgaaaatggcccggct

SEQ ID NO: 27607 - DNA, 25 bp, E. coli
cccttaattctgatgggcgtgttag

SEQ ID NO: 27608 - DNA, 25 bp, E. coli
cagcagcctgaaagaatagtgtatc

SEQ ID NO: 27609 - DNA, 25 bp, E. coli
cccttaattctgttgggcgtgttag

SEQ ID NO: 27610 - DNA, 25 bp, E. coli
cagcagcctgaatgaatagtgtatc

SEQ ID NO: 27611 - DNA, 25 bp, E. coli
cataatgatgaggaatttcagcggt

SEQ ID NO: 27612 - DNA, 25 bp, E. coli
catcacagaccgcaggaaagggtca

SEQ ID NO: 27613 - DNA, 25 bp, E. coli
catcacagaccggaggaaagggtca

SEQ ID NO: 27614 - DNA, 25 bp, E. coli
cataatgatgagcaatttcagcggt

SEQ ID NO: 27615 - DNA, 25 bp, E. coli
tactattgtaaggtcctggagttca

SEQ ID NO: 27616 - DNA, 25 bp, E. coli
tactattgtaagctcctggagttca

SEQ ID NO: 27617 - DNA, 25 bp, E. coli
tcctgcaacacgtaatccatagagt

SEQ ID NO: 27618 - DNA, 25 bp, E. coli
tcgtcgacgcgaggtgaacacgcga

SEQ ID NO: 27619 - DNA, 25 bp, E. coli
tcgtcgacgcgacgtgaacacgcga

SEQ ID NO: 27620 - DNA, 25 bp, E. coli
tcctgcaacacgaaatccatagagt

SEQ ID NO: 27621 - DNA, 25 bp, E. coli
tcagcggttttttacaggccgattc

SEQ ID NO: 27622 - DNA, 25 bp, E. coli
tcagcggtttttaacaggccgattc

SEQ ID NO: 27623 - DNA, 25 bp, E. coli
gaacacgcgaaagtcacctgcataa

SEQ ID NO: 27624 - DNA, 25 bp, E. coli
gaacacgcgaaactcacctgcataa

SEQ ID NO: 27625 - DNA, 25 bp, E. coli
ctttcagtgcgctattgcagcagcc

SEQ ID NO: 27626 - DNA, 25 bp, E. coli
ctttcagtgcgcaattgcagcagcc

SEQ ID NO: 27627 - DNA, 25 bp, E. coli
tggtacaacaacacaggcaacacgc

SEQ ID NO: 27628 - DNA, 25 bp, E. coli
tggtacaacaactcaggcaacacgc

SEQ ID NO: 27629 - DNA, 25 bp, E. coli
aagccaactataaggcggtgcgccg

SEQ ID NO: 27630 - DNA, 25 bp, E. coli
caaagccaactatatggcggtgcgc

SEQ ID NO: 27631 - DNA, 25 bp, E. coli
caaagccaactaaatggcggtgcgc

SEQ ID NO: 27632 - DNA, 25 bp, E. coli
agccaactatatggcggtgcgccgg

SEQ ID NO: 27633 - DNA, 25 bp, E. coli
agccaactatatcgcggtgcgccgg

SEQ ID NO: 27634 - DNA, 25 bp, E. coli
aaagccaactatatggcggtgcgcc

SEQ ID NO: 27635 - DNA, 25 bp, E. coli
aaagccaactatttggcggtgcgcc

SEQ ID NO: 27636 - DNA, 25 bp, E. coli
aagccaactatatggcggtgcgccg

SEQ ID NO: 27637 - DNA, 25 bp, E. coli
tgccgatggcaaattgaatatcgtc

SEQ ID NO: 27638 - DNA, 25 bp, E. coli
tgccgatggcaatttgaatatcgtc

SEQ ID NO: 27639 - DNA, 25 bp, E. coli
tcaaagccaactatatggcggtgcg

SEQ ID NO: 27640 - DNA, 25 bp, E. coli
tcaaagccaactttatggcggtgcg

SEQ ID NO: 27641 - DNA, 25 bp, E. coli
gccaactatatggcggtgcgccggt

SEQ ID NO: 27642 - DNA, 25 bp, E. coli
gccgatggcaaattgaatatcgtcc

SEQ ID NO: 27643 - DNA, 25 bp, E. coli
gccaactatatgccggtgcgccggt

SEQ ID NO: 27644 - DNA, 25 bp, E. coli
gccgatggcaaaatgaatatcgtcc

SEQ ID NO: 27645 - DNA, 25 bp, E. coli
aacgggcagcaagtgacgctggaaa

SEQ ID NO: 27646 - DNA, 25 bp, E. coli
aatggccgtactcgagggaaagtct

SEQ ID NO: 27647 - DNA, 25 bp, E. coli
aatggccgtactggagggaaagtct

SEQ ID NO: 27648 - DNA, 25 bp, E. coli
aacgggcagcaactgacgctggaaa

SEQ ID NO: 27649 - DNA, 25 bp, E. coli
taccgtgaagcggaaatggccgtac

SEQ ID NO: 27650 - DNA, 25 bp, E. coli
taccgtgaagcgcaaatggccgtac

SEQ ID NO: 27651 - DNA, 25 bp, E. coli
tgatacagcggtaccgtgaagcgga

SEQ ID NO: 27652 - DNA, 25 bp, E. coli
tgatacagcggttccgtgaagcgga

SEQ ID NO: 27653 - DNA, 25 bp, E. coli
tgagcacagaagtagccagagaaat

SEQ ID NO: 27654 - DNA, 25 bp, E. coli
tgagcacagaagaagccagagaaat

SEQ ID NO: 27655 - DNA, 25 bp, E. coli
tcttcaacgggctgcaactgacgct

SEQ ID NO: 27656 - DNA, 25 bp, E. coli
tcttcaacgggcagcaactgacgct

SEQ ID NO: 27657 - DNA, 25 bp, E. coli
ccagagaaatgaaacagcggtaccg

SEQ ID NO: 27658 - DNA, 25 bp, E. coli
ccagagaaatgatacagcggtaccg

SEQ ID NO: 27659 - DNA, 25 bp, E. coli
gaaagtctgtcatcttcaacgggca

SEQ ID NO: 27660 - DNA, 25 bp, E. coli
gaaagtctgtcaacttcaacgggca

SEQ ID NO: 27661 - DNA, 25 bp, E. coli
ccgtactggagggaaagtctgtcat

SEQ ID NO: 27662 - DNA, 25 bp, E. coli
ccgtactggaggcaaagtctgtcat

SEQ ID NO: 27663 - DNA, 25 bp, E. coli
ggttgtgagcactgaagaagccaga

SEQ ID NO: 27664 - DNA, 25 bp, E. coli
ggttgtgagcacagaagaagccaga

SEQ ID NO: 27665 - DNA, 25 bp, E. coli
tggaaagcctttgtcagatccgcgc

SEQ ID NO: 27666 - DNA, 25 bp, E. coli
tggaaagcctttctcagatccgcgc

SEQ ID NO: 27667 - DNA, 25 bp, E. coli
aatctggtgctttgcgatgatcgcc

SEQ ID NO: 27668 - DNA, 25 bp, E. coli
aatctggtgcttagcgatgatcgcc

SEQ ID NO: 27669 - DNA, 25 bp, E. coli
atctggatcctgctcgaaacgaccc

SEQ ID NO: 27670 - DNA, 25 bp, E. coli
atctggatcctggtcgaaacgaccc

SEQ ID NO: 27671 - DNA, 25 bp, E. coli
tattctcattttctcccggagtggg

SEQ ID NO: 27672 - DNA, 25 bp, E. coli
tattctcattttgtcccggagtggg

SEQ ID NO: 27673 - DNA, 25 bp, E. coli
gcttccattggcgtgctggcagaat

SEQ ID NO: 27674 - DNA, 25 bp, E. coli
gcttccattggcctgctggcagaat

SEQ ID NO: 27675 - DNA, 25 bp, E. coli
gcagggatttgcttcacgttcggaa

SEQ ID NO: 27676 - DNA, 25 bp, E. coli
gcagggatttgcatcacgttcggaa

SEQ ID NO: 27677 - DNA, 25 bp, E. coli
cgattatgtaccgtcgcctgcgtaa

SEQ ID NO: 27678 - DNA, 25 bp, E. coli
cgattatgtaccctcgcctgcgtaa

SEQ ID NO: 27679 - DNA, 25 bp, E. coli
gcgtagaaatcgtggtggcagcccc

SEQ ID NO: 27680 - DNA, 25 bp, E. coli
gcgtagaaatcgaggtggcagcccc

SEQ ID NO: 27681 - DNA, 25 bp, E. coli
gatatcagcgtaaaaatccgtgcca

SEQ ID NO: 27682 - DNA, 25 bp, E. coli
gatatcagcgtataaatccgtgcca

SEQ ID NO: 27683 - DNA, 25 bp, E. coli
gggtcgccgctacaaagtctttatg

SEQ ID NO: 27684 - DNA, 25 bp, E. coli
gggtcgccgctagaaagtctttatg

SEQ ID NO: 27685 - DNA, 25 bp, E. coli
taaccttggtatcctgggtcgccgc

SEQ ID NO: 27686 - DNA, 25 bp, E. coli
tcaccatttgatgatgcgtgccggg

SEQ ID NO: 27687 - DNA, 25 bp, E. coli
tcaccatttgatcatgcgtgccggg

SEQ ID NO: 27688 - DNA, 25 bp, E. coli
taaccttggtatgctgggtcgccgc

SEQ ID NO: 27689 - DNA, 25 bp, E. coli
cacttactacatctgggcgcgactg

SEQ ID NO: 27690 - DNA, 25 bp, E. coli
cacttactacatgtgggcgcgactg

SEQ ID NO: 27691 - DNA, 25 bp, E. coli
cacaaatgacgttctggcgctggag

SEQ ID NO: 27692 - DNA, 25 bp, E. coli
cacaaatgacgtactggcgctggag

SEQ ID NO: 27693 - DNA, 25 bp, E. coli
taaaaacgagatcgcgctcctgctg

SEQ ID NO: 27694 - DNA, 25 bp, E. coli
taaaaacgagatggcgctcctgctg

SEQ ID NO: 27695 - DNA, 25 bp, E. coli
agaactggacggaactgctggagca

SEQ ID NO: 27696 - DNA, 25 bp, E. coli
agaactggacggtactgctggagca

SEQ ID NO: 27697 - DNA, 25 bp, E. coli
aaaccctgcgctcggatacggtgca

SEQ ID NO: 27698 - DNA, 25 bp, E. coli
aaaccctgcgctgggatacggtgca

SEQ ID NO: 27699 - DNA, 25 bp, E. coli
ttatctgaacgaacagccgcagggc

SEQ ID NO: 27700 - DNA, 25 bp, E. coli
ttatctgaacgatcagccgcagggc

SEQ ID NO: 27701 - DNA, 25 bp, E. coli
gcttgcccggaatatggacgctctg

SEQ ID NO: 27702 - DNA, 25 bp, E. coli
gcttgcccggaaaatggacgctctg

SEQ ID NO: 27703 - DNA, 25 bp, E. coli
gaactgttgcaaaagctgacccgta

SEQ ID NO: 27704 - DNA, 25 bp, E. coli
gaaaatctggcatggaacgacggca

SEQ ID NO: 27705 - DNA, 25 bp, E. coli
gaaaatctggcaaggaacgacggca

SEQ ID NO: 27706 - DNA, 25 bp, E. coli
gaactgttgcaatagctgacccgta

SEQ ID NO: 27707 - DNA, 25 bp, E. coli
gattttctgcgtttccgcgacgaga

SEQ ID NO: 27708 - DNA, 25 bp, E. coli
gattttctgcgtatccgcgacgaga

SEQ ID NO: 27709 - DNA, 25 bp, E. coli
gagatgaacaaactttccggcgcgg

SEQ ID NO: 27710 - DNA, 25 bp, E. coli
gagatgaacaaagtttccggcgcgg

SEQ ID NO: 27711 - DNA, 25 bp, E. coli
caagaacacaacttctgacgaggtt

SEQ ID NO: 27712 - DNA, 25 bp, E. coli
caagaacacaacatctgacgaggtt

SEQ ID NO: 27713 - DNA, 25 bp, E. coli
caaacaacctggcaggtgcaggcaa

SEQ ID NO: 27714 - DNA, 25 bp, E. coli
caaacaacctgggaggtgcaggcaa

SEQ ID NO: 27715 - DNA, 25 bp, E. coli
taaaccgcccactgagcgcggttgc

SEQ ID NO: 27716 - DNA, 25 bp, E. coli
taaaccgcccacagagcgcggttgc

SEQ ID NO: 27717 - DNA, 25 bp, E. coli
tgtatgaaaagctggcacacctgcc

SEQ ID NO: 27718 - DNA, 25 bp, E. coli
tgtatgaaaagcaggcacacctgcc

SEQ ID NO: 27719 - DNA, 25 bp, E. coli
tgacgttgtcacattatgcatgatg

SEQ ID NO: 27720 - DNA, 25 bp, E. coli
tgaatgaagggcaacggcgaatagt

SEQ ID NO: 27721 - DNA, 25 bp, E. coli
tgacgttgtcactttatgcatgatg

SEQ ID NO: 27722 - DNA, 25 bp, E. coli
tgaatgaagggctacggcgaatagt

SEQ ID NO: 27723 - DNA, 25 bp, E. coli
tcagggcatccactgtatgaaaagc

SEQ ID NO: 27724 - DNA, 25 bp, E. coli
tcagggcatccagtgtatgaaaagc

SEQ ID NO: 27725 - DNA, 25 bp, E. coli
gcaggcaatcccgtttgcatcagta

SEQ ID NO: 27726 - DNA, 25 bp, E. coli
gcaggcaatcccctttgcatcagta

SEQ ID NO: 27727 - DNA, 25 bp, E. coli
taatgtgaacctcactaaaccgccc

SEQ ID NO: 27728 - DNA, 25 bp, E. coli
taatgtgaacctgactaaaccgccc

SEQ ID NO: 27729 - DNA, 25 bp, E. coli
gatgtgtacatctattttcagggca

SEQ ID NO: 27730 - DNA, 25 bp, E. coli
gagcgcggttgcaaacaagaacaca

SEQ ID NO: 27731 - DNA, 25 bp, E. coli
gagcgcggttgctaacaagaacaca

SEQ ID NO: 27732 - DNA, 25 bp, E. coli
gatgtgtacatcaattttcagggca

SEQ ID NO: 27733 - DNA, 25 bp, E. coli
caaagcgagtatatcgtcgcgggtc

SEQ ID NO: 27734 - DNA, 25 bp, E. coli
caaagcgagtatttcgtcgcgggtc

SEQ ID NO: 27735 - DNA, 25 bp, E. coli
cagacgagtttgtcgccggccatgt

SEQ ID NO: 27736 - DNA, 25 bp, E. coli
cagacgagtttgacgccggccatgt

SEQ ID NO: 27737 - DNA, 25 bp, E. coli
tatgattgccgcgtgtgtatcgacg

SEQ ID NO: 27738 - DNA, 25 bp, E. coli
tatgattgccgcctgtgtatcgacg

SEQ ID NO: 27739 - DNA, 25 bp, E. coli
ttatcatttcgcagctcacgcgcgg

SEQ ID NO: 27740 - DNA, 25 bp, E. coli
ttatcatttcgctgctcacgcgcgg

SEQ ID NO: 27741 - DNA, 25 bp, E. coli
gcatcgtttcttgcggaaatggcgc

SEQ ID NO: 27742 - DNA, 25 bp, E. coli
gcatcgtttcttccggaaatggcgc

SEQ ID NO: 27743 - DNA, 25 bp, E. coli
gacggaacaccggtacaggcttatt

SEQ ID NO: 27744 - DNA, 25 bp, E. coli
gacggaacaccgctacaggcttatt

SEQ ID NO: 27745 - DNA, 25 bp, E. coli
gggttaaccgcaatctgtgcctgtc

SEQ ID NO: 27746 - DNA, 25 bp, E. coli
gggttaaccgcattctgtgcctgtc

SEQ ID NO: 27747 - DNA, 25 bp, E. coli
tggcagcgtcatgcggtcactttct

SEQ ID NO: 27748 - DNA, 25 bp, E. coli
tggcagcgtcatccggtcactttct

SEQ ID NO: 27749 - DNA, 25 bp, E. coli
tcacgcgcggcgttaatacgtttta

SEQ ID NO: 27750 - DNA, 25 bp, E. coli
tcaaaagtctggctactggcactgg

SEQ ID NO: 27751 - DNA, 25 bp, E. coli
tcacgcgcggcgataatacgtttta

SEQ ID NO: 27752 - DNA, 25 bp, E. coli
tcaaaagtctgggtactggcactgg

SEQ ID NO: 27753 - DNA, 25 bp, E. coli
gagacgtacctgatcgttagccaac

SEQ ID NO: 27754 - DNA, 25 bp, E. coli
gagacgtacctgttcgttagccaac

SEQ ID NO: 27755 - DNA, 25 bp, E. coli
cactcggtgcgcaggacgctttaac

SEQ ID NO: 27756 - DNA, 25 bp, E. coli
cactcggtgcgctggacgctttaac

SEQ ID NO: 27757 - DNA, 25 bp, E. coli
tgggcactctgatcaaccgattcga

SEQ ID NO: 27758 - DNA, 25 bp, E. coli
tgggcactctgaacaaccgattcga

SEQ ID NO: 27759 - DNA, 25 bp, E. coli
tgaacaaccgattcgacgtcatggt

SEQ ID NO: 27760 - DNA, 25 bp, E. coli
tgaacaaccgatacgacgtcatggt

SEQ ID NO: 27761 - DNA, 25 bp, E. coli
gcgtcaggctctggctgcggtagga

SEQ ID NO: 27762 - DNA, 25 bp, E. coli
gctgagattcaggatgatacgcgaa

SEQ ID NO: 27763 - DNA, 25 bp, E. coli
gctttggctgaagcacggttttacc

SEQ ID NO: 27764 - DNA, 25 bp, E. coli
gctttggctgaaccacggttttacc

SEQ ID NO: 27765 - DNA, 25 bp, E. coli
gctgagattcagcatgatacgcgaa

SEQ ID NO: 27766 - DNA, 25 bp, E. coli
gcgtcaggctctcgctgcggtagga

SEQ ID NO: 27767 - DNA, 25 bp, E. coli
ccgctggctgagtttcaggatgata

SEQ ID NO: 27768 - DNA, 25 bp, E. coli
ccgctggctgagattcaggatgata

SEQ ID NO: 27769 - DNA, 25 bp, E. coli
gatttgattgtgtcgctttggctga

SEQ ID NO: 27770 - DNA, 25 bp, E. coli
gatttgattgtgacgctttggctga

SEQ ID NO: 27771 - DNA, 25 bp, E. coli
ggtgatgcaacgtgggcactctgaa

SEQ ID NO: 27772 - DNA, 25 bp, E. coli
ggtgatgcaacgagggcactctgaa

SEQ ID NO: 27773 - DNA, 25 bp, E. coli
ggcaagggcgctgattcatcgacca

SEQ ID NO: 27774 - DNA, 25 bp, E. coli
ggcgctgattcaacgaccaggttta

SEQ ID NO: 27775 - DNA, 25 bp, E. coli
ggcgctgattcatcgaccaggttta

SEQ ID NO: 27776 - DNA, 25 bp, E. coli
ggcaagggcgctcattcatcgacca

SEQ ID NO: 27777 - DNA, 25 bp, E. coli
caagggattggttaacagctggttg

SEQ ID NO: 27778 - DNA, 25 bp, E. coli
caagggattggtaaacagctggttg

SEQ ID NO: 27779 - DNA, 25 bp, E. coli
cagctggttgcgaaagtcgtggaaa

SEQ ID NO: 27780 - DNA, 25 bp, E. coli
cagctggttgcgtaagtcgtggaaa

SEQ ID NO: 27781 - DNA, 25 bp, E. coli
cataccgatgtccatgaaagcctga

SEQ ID NO: 27782 - DNA, 25 bp, E. coli
cataccgatgtcgatgaaagcctga

SEQ ID NO: 27783 - DNA, 25 bp, E. coli
aaatcgctgaaaatgtctttgtgcc

SEQ ID NO: 27784 - DNA, 25 bp, E. coli
aaatcgctgaaattgtctttgtgcc

SEQ ID NO: 27785 - DNA, 25 bp, E. coli
tgtgccgaccggagagaatttagcg

SEQ ID NO: 27786 - DNA, 25 bp, E. coli
tgtgccgaccggtgagaatttagcg

SEQ ID NO: 27787 - DNA, 25 bp, E. coli
ccggagagaattaagcgattatcga

SEQ ID NO: 27788 - DNA, 25 bp, E. coli
ccggagagaatttagcgattatcga

SEQ ID NO: 27789 - DNA, 25 bp, E. coli
gcgattatcgaacataccgatgtcg

SEQ ID NO: 27790 - DNA, 25 bp, E. coli
gcgattatcgaagataccgatgtcg

SEQ ID NO: 27791 - DNA, 25 bp, E. coli
gaaattgtctttctgccgaccggag

SEQ ID NO: 27792 - DNA, 25 bp, E. coli
gaaagtcgtggaaaaaatgcgtcgg

SEQ ID NO: 27793 - DNA, 25 bp, E. coli
gaaattgtctttgtgccgaccggag

SEQ ID NO: 27794 - DNA, 25 bp, E. coli
gaaagtcgtggataaaatgcgtcgg

SEQ ID NO: 27795 - DNA, 25 bp, E. coli
ccgatgtcgatgaaagcctgaaagg

SEQ ID NO: 27796 - DNA, 25 bp, E. coli
ccgatgtcgatgtaagcctgaaagg

SEQ ID NO: 27797 - DNA, 25 bp, E. coli
cgggagtatgatcatattcgcagtt

SEQ ID NO: 27798 - DNA, 25 bp, E. coli
cgggagtatgatgatattcgcagtt

SEQ ID NO: 27799 - DNA, 25 bp, E. coli
caatattcttttgaggtcatgcaag

SEQ ID NO: 27800 - DNA, 25 bp, E. coli
caatattcttttcaggtcatgcaag

SEQ ID NO: 27801 - DNA, 25 bp, E. coli
caggtcatgcaagatcttacggata

SEQ ID NO: 27802 - DNA, 25 bp, E. coli
caggtcatgcaacatcttacggata

SEQ ID NO: 27803 - DNA, 25 bp, E. coli
tacggataaatatctctttctgcgc

SEQ ID NO: 27804 - DNA, 25 bp, E. coli
taaactttatgcgatgtacccaggg

SEQ ID NO: 27805 - DNA, 25 bp, E. coli
taaactttatgccatgtacccaggg

SEQ ID NO: 27806 - DNA, 25 bp, E. coli
tacggataaataactctttctgcgc

SEQ ID NO: 27807 - DNA, 25 bp, E. coli
tatgacatgcaaaattcctggaaac

SEQ ID NO: 27808 - DNA, 25 bp, E. coli
tatgacatgcaatattcctggaaac

SEQ ID NO: 27809 - DNA, 25 bp, E. coli
tgtacccagggataatcatcttcag

SEQ ID NO: 27810 - DNA, 25 bp, E. coli
tgtacccagggaaaatcatcttcag

SEQ ID NO: 27811 - DNA, 25 bp, E. coli
tcggagaacaattcgtacggtaacg

SEQ ID NO: 27812 - DNA, 25 bp, E. coli
tcggagaacaatacgtacggtaacg

SEQ ID NO: 27813 - DNA, 25 bp, E. coli
tctgcgctaactaaggaaaatcgcg

SEQ ID NO: 27814 - DNA, 25 bp, E. coli
tctgcgctaacttaggaaaatcgcg

SEQ ID NO: 27815 - DNA, 25 bp, E. coli
gaaaatcgcgatcaaaaacaaacta

SEQ ID NO: 27816 - DNA, 25 bp, E. coli
gaaaatcgcgatgaaaaacaaacta

SEQ ID NO: 27817 - DNA, 25 bp, E. coli
cgaaattatctttcagcaaggagct

SEQ ID NO: 27818 - DNA, 25 bp, E. coli
cgaaattatcttacagcaaggagct

SEQ ID NO: 27819 - DNA, 25 bp, E. coli
tagtaattatgtaaaccgtcggaga

SEQ ID NO: 27820 - DNA, 25 bp, E. coli
tagtaattatgttaaccgtcggaga

SEQ ID NO: 27821 - DNA, 25 bp, E. coli
caccgcttagcgaggtaaatcagga

SEQ ID NO: 27822 - DNA, 25 bp, E. coli
caaaagaccttatgctggatggcgt

SEQ ID NO: 27823 - DNA, 25 bp, E. coli
caccgcttagcgtggtaaatcagga

SEQ ID NO: 27824 - DNA, 25 bp, E. coli
caaaagaccttaagctggatggcgt

SEQ ID NO: 27825 - DNA, 25 bp, E. coli
tatgacaagctgatttccgcaatgg

SEQ ID NO: 27826 - DNA, 25 bp, E. coli
tacccgacagctcttgatgcagccg

SEQ ID NO: 27827 - DNA, 25 bp, E. coli
tacccgacagctgttgatgcagccg

SEQ ID NO: 27828 - DNA, 25 bp, E. coli
tatgacaagctgttttccgcaatgg

SEQ ID NO: 27829 - DNA, 25 bp, E. coli
ttaataccggtactcaaacagcaga

SEQ ID NO: 27830 - DNA, 25 bp, E. coli
ttaataccggtagtcaaacagcaga

SEQ ID NO: 27831 - DNA, 25 bp, E. coli
tccgcaatggatttctacccgacag

SEQ ID NO: 27832 - DNA, 25 bp, E. coli
tccgcaatggatatctacccgacag

SEQ ID NO: 27833 - DNA, 25 bp, E. coli
gccaatccgcagctcgttaaagaga

SEQ ID NO: 27834 - DNA, 25 bp, E. coli
gccaatccgcaggtcgttaaagaga

SEQ ID NO: 27835 - DNA, 25 bp, E. coli
gatcagggtgtaaaacgcattctcg

SEQ ID NO: 27836 - DNA, 25 bp, E. coli
gatcagggtgtataacgcattctcg

SEQ ID NO: 27837 - DNA, 25 bp, E. coli
gatactggcatcaggtatggctgca

SEQ ID NO: 27838 - DNA, 25 bp, E. coli
gttatcgatggtcctctgccgctga

SEQ ID NO: 27839 - DNA, 25 bp, E. coli
gttatcgatggtgctctgccgctga

SEQ ID NO: 27840 - DNA, 25 bp, E. coli
gatactggcatctggtatggctgca

SEQ ID NO: 27841 - DNA, 25 bp, E. coli
tcagcgatcagttaaccgatgaggc

SEQ ID NO: 27842 - DNA, 25 bp, E. coli
tcagcgatcagtaaaccgatgaggc

SEQ ID NO: 27843 - DNA, 25 bp, E. coli
aacgtaacttctcgcagcttcaggc

SEQ ID NO: 27844 - DNA, 25 bp, E. coli
tacgctggatgaactttcctgcccg

SEQ ID NO: 27845 - DNA, 25 bp, E. coli
accctgcaggcgctgcagaaacgta

SEQ ID NO: 27846 - DNA, 25 bp, E. coli
accctgcaggcggtgcagaaacgta

SEQ ID NO: 27847 - DNA, 25 bp, E. coli
aacgtaacttctggcagcttcaggc

SEQ ID NO: 27848 - DNA, 25 bp, E. coli
tacgctggatgatctttcctgcccg

SEQ ID NO: 27849 - DNA, 25 bp, E. coli
tgtatacgctggttgaactttcctg

SEQ ID NO: 27850 - DNA, 25 bp, E. coli
tgtatacgctggatgaactttcctg

SEQ ID NO: 27851 - DNA, 25 bp, E. coli
tgagcagcattaacaccatcacagt

SEQ ID NO: 27852 - DNA, 25 bp, E. coli
tgagcagcattatcaccatcacagt

SEQ ID NO: 27853 - DNA, 25 bp, E. coli
tgcagaaacgtatcttctggcagct

SEQ ID NO: 27854 - DNA, 25 bp, E. coli
tgcagaaacgtaacttctggcagct

SEQ ID NO: 27855 - DNA, 25 bp, E. coli
gcagcattatcagcatcacagtgta

SEQ ID NO: 27856 - DNA, 25 bp, E. coli
gcagcattatcaccatcacagtgta

SEQ ID NO: 27857 - DNA, 25 bp, E. coli
gaaacgtaacttctggcagcttcag

SEQ ID NO: 27858 - DNA, 25 bp, E. coli
gaaacgtaacttgtggcagcttcag

SEQ ID NO: 27859 - DNA, 25 bp, E. coli
ctggatgaacttacctgcccggcac

SEQ ID NO: 27860 - DNA, 25 bp, E. coli
ctggatgaactttcctgcccggcac

SEQ ID NO: 27861 - DNA, 25 bp, E. coli
tcaccatcacagagtatacgctgga

SEQ ID NO: 27862 - DNA, 25 bp, E. coli
tcacagtgtatacgctggatgaact

SEQ ID NO: 27863 - DNA, 25 bp, E. coli
tcaccatcacagtgtatacgctgga

SEQ ID NO: 27864 - DNA, 25 bp, E. coli
tcacagtgtataggctggatgaact

SEQ ID NO: 27865 - DNA, 25 bp, E. coli
aacgatccggtgcatatcctcatca

SEQ ID NO: 27866 - DNA, 25 bp, E. coli
caggcgattctgcatggcgttgaac

SEQ ID NO: 27867 - DNA, 25 bp, E. coli
caggcgattctggatggcgttgaac

SEQ ID NO: 27868 - DNA, 25 bp, E. coli
acctgtttgaagttgaagagaattt

SEQ ID NO: 27869 - DNA, 25 bp, E. coli
aaccggtttctctctggtaacgctg

SEQ ID NO: 27870 - DNA, 25 bp, E. coli
acctgtttgaagatgaagagaattt

SEQ ID NO: 27871 - DNA, 25 bp, E. coli
aaaagccgctggtgttcaaccacga

SEQ ID NO: 27872 - DNA, 25 bp, E. coli
aaaagccgctggagttcaaccacga

SEQ ID NO: 27873 - DNA, 25 bp, E. coli
aaccggtttctcactggtaacgctg

SEQ ID NO: 27874 - DNA, 25 bp, E. coli
aacgatccggtggatatcctcatca

SEQ ID NO: 27875 - DNA, 25 bp, E. coli
tagagccgcgtttctaccaggcgat

SEQ ID NO: 27876 - DNA, 25 bp, E. coli
tagagccgcgttactaccaggcgat

SEQ ID NO: 27877 - DNA, 25 bp, E. coli
gcagatgtggtagagccgcgttact

SEQ ID NO: 27878 - DNA, 25 bp, E. coli
gcagatgtggtacagccgcgttact

SEQ ID NO: 27879 - DNA, 25 bp, E. coli
ctctggtaacgctgaaaaagccgct

SEQ ID NO: 27880 - DNA, 25 bp, E. coli
ctgccgtaccgaccaggaagtactg

SEQ ID NO: 27881 - DNA, 25 bp, E. coli
ctctggtaacgcagaaaaagccgct

SEQ ID NO: 27882 - DNA, 25 bp, E. coli
ctgccgtaccgagcaggaagtactg

SEQ ID NO: 27883 - DNA, 25 bp, E. coli
ggatatcctcatcaccatggcggcg

SEQ ID NO: 27884 - DNA, 25 bp, E. coli
ggatatcctcatgaccatggcggcg

SEQ ID NO: 27885 - DNA, 25 bp, E. coli
tcaccaggaagtgggcatcatgcag

SEQ ID NO: 27886 - DNA, 25 bp, E. coli
tcaccaggaagtcggcatcatgcag

SEQ ID NO: 27887 - DNA, 25 bp, E. coli
catgaccatcggagagcaggcgaaa

SEQ ID NO: 27888 - DNA, 25 bp, E. coli
catgaccatcggtgagcaggcgaaa

SEQ ID NO: 27889 - DNA, 25 bp, E. coli
tacgcctcgaaaatccgtgctggga

SEQ ID NO: 27890 - DNA, 25 bp, E. coli
tacgcctcgaaattccgtgctggga

SEQ ID NO: 27891 - DNA, 25 bp, E. coli
tttattggcaaggacgcggtgacag

SEQ ID NO: 27892 - DNA, 25 bp, E. coli
tttattggcaagcacgcggtgacag

SEQ ID NO: 27893 - DNA, 25 bp, E. coli
tgaaaacgcgctcctggtggactat

SEQ ID NO: 27894 - DNA, 25 bp, E. coli
tgaataccgaggtggatctgctgct

SEQ ID NO: 27895 - DNA, 25 bp, E. coli
tgaataccgaggaggatctgctgct

SEQ ID NO: 27896 - DNA, 25 bp, E. coli
tgaaaacgcgctgctggtggactat

SEQ ID NO: 27897 - DNA, 25 bp, E. coli
gaatccggttcacttgcagatgcag

SEQ ID NO: 27898 - DNA, 25 bp, E. coli
gaatccggttcagttgcagatgcag

SEQ ID NO: 27899 - DNA, 25 bp, E. coli
gaaggcactcttatccccagcgttg

SEQ ID NO: 27900 - DNA, 25 bp, E. coli
gaaggcactcttttccccagcgttg

SEQ ID NO: 27901 - DNA, 25 bp, E. coli
ggtgacagagctatcccaggagtat

SEQ ID NO: 27902 - DNA, 25 bp, E. coli
ggtgacagagctttcccaggagtat

SEQ ID NO: 27903 - DNA, 25 bp, E. coli
taaccgttggcgagaaatacctgat

SEQ ID NO: 27904 - DNA, 25 bp, E. coli
taaccgttggcgtgaaatacctgat

SEQ ID NO: 27905 - DNA, 25 bp, E. coli
gagcacagttatttcgacgcgtcaa

SEQ ID NO: 27906 - DNA, 25 bp, E. coli
gagcacagttatatcgacgcgtcaa

SEQ ID NO: 27907 - DNA, 25 bp, E. coli
gaccggcggcctcgattatcaaaaa

SEQ ID NO: 27908 - DNA, 25 bp, E. coli
gaccggcggcctggattatcaaaaa

SEQ ID NO: 27909 - DNA, 25 bp, E. coli
aatacacccgccgtggggttgccag

SEQ ID NO: 27910 - DNA, 25 bp, E. coli
aatacacccgccctggggttgccag

SEQ ID NO: 27911 - DNA, 25 bp, E. coli
atttgttgacccagaatacacccgc

SEQ ID NO: 27912 - DNA, 25 bp, E. coli
atttgttgaccctgaatacacccgc

SEQ ID NO: 27913 - DNA, 25 bp, E. coli
ttgttgaccctgaatacacccgccg

SEQ ID NO: 27914 - DNA, 25 bp, E. coli
ttgttgaccctgtatacacccgccg

SEQ ID NO: 27915 - DNA, 25 bp, E. coli
tgaccgccagtcagcattattcacc

SEQ ID NO: 27916 - DNA, 25 bp, E. coli
tgaccgccagtctgcattattcacc

SEQ ID NO: 27917 - DNA, 25 bp, E. coli
tgaccctgaatacacccgccgtggg

SEQ ID NO: 27918 - DNA, 25 bp, E. coli
tgaccctgaatagacccgccgtggg

SEQ ID NO: 27919 - DNA, 25 bp, E. coli
tgcgctattttctttagagcggtta

SEQ ID NO: 27920 - DNA, 25 bp, E. coli
tgcgctattttcattagagcggtta

SEQ ID NO: 27921 - DNA, 25 bp, E. coli
ccgccagtcagctttattcaccaca

SEQ ID NO: 27922 - DNA, 25 bp, E. coli
ccgccagtcagcattattcaccaca

SEQ ID NO: 27923 - DNA, 25 bp, E. coli
cccgccgtggggttgccagcgcttt

SEQ ID NO: 27924 - DNA, 25 bp, E. coli
cccgccgtggggatgccagcgcttt

SEQ ID NO: 27925 - DNA, 25 bp, E. coli
ctatgcgctattttcattagagcgg

SEQ ID NO: 27926 - DNA, 25 bp, E. coli
ctatgcgctattatcattagagcgg

SEQ ID NO: 27927 - DNA, 25 bp, E. coli
gttgaccctgaatacacccgccgtg

SEQ ID NO: 27928 - DNA, 25 bp, E. coli
gttgaccctgaaaacacccgccgtg

SEQ ID NO: 27929 - DNA, 25 bp, E. coli
gatgaccgccagtcagcattattca

SEQ ID NO: 27930 - DNA, 25 bp, E. coli
gatgaccgccagacagcattattca

SEQ ID NO: 27931 - DNA, 25 bp, E. coli
caatacagtccaatgctggcgggtg

SEQ ID NO: 27932 - DNA, 25 bp, E. coli
caatacagtccattgctggcgggtg

SEQ ID NO: 27933 - DNA, 25 bp, E. coli
cagtttttaacacacgcgacgcacg

SEQ ID NO: 27934 - DNA, 25 bp, E. coli
cagtttttaacagacgcgacgcacg

SEQ ID NO: 27935 - DNA, 25 bp, E. coli
tttacgcattttaaacaagctggca

SEQ ID NO: 27936 - DNA, 25 bp, E. coli
tttacgcatttttaacaagctggca

SEQ ID NO: 27937 - DNA, 25 bp, E. coli
tgtggaactaaactctagcctggcg

SEQ ID NO: 27938 - DNA, 25 bp, E. coli
tgtggaactaaagtctagcctggcg

SEQ ID NO: 27939 - DNA, 25 bp, E. coli
tctagcctggcgcttcgactttagc

SEQ ID NO: 27940 - DNA, 25 bp, E. coli
tctagcctggcggttcgactttagc

SEQ ID NO: 27941 - DNA, 25 bp, E. coli
tgaagcaggccagaaaaaagcacct

SEQ ID NO: 27942 - DNA, 25 bp, E. coli
tgaagcaggccacaaaaaagcacct

SEQ ID NO: 27943 - DNA, 25 bp, E. coli
tccgacaggctgtatcaatgccagg

SEQ ID NO: 27944 - DNA, 25 bp, E. coli
tccgacaggctgaatcaatgccagg

SEQ ID NO: 27945 - DNA, 25 bp, E. coli
gactttagcctgtattgttagcgcc

SEQ ID NO: 27946 - DNA, 25 bp, E. coli
gactttagcctgaattgttagcgcc

SEQ ID NO: 27947 - DNA, 25 bp, E. coli
gacgcacgaagagcgcaatacagtc

SEQ ID NO: 27948 - DNA, 25 bp, E. coli
ggttaaataccacttccgacaggct

SEQ ID NO: 27949 - DNA, 25 bp, E. coli
ggttaaataccagttccgacaggct

SEQ ID NO: 27950 - DNA, 25 bp, E. coli
ggcgaaagtttgaagcaggccacaa

SEQ ID NO: 27951 - DNA, 25 bp, E. coli
ggcgaaagtttgtagcaggccacaa

SEQ ID NO: 27952 - DNA, 25 bp, E. coli
gacgcacgaagaccgcaatacagtc

SEQ ID NO: 27953 - DNA, 25 bp, E. coli
caagtcgctctgttatgtggctaca

SEQ ID NO: 27954 - DNA, 25 bp, E. coli
caagtcgctctgatatgtggctaca

SEQ ID NO: 27955 - DNA, 25 bp, E. coli
taaatggaaacacaaaccaagtcgc

SEQ ID NO: 27956 - DNA, 25 bp, E. coli
taaatggaaacagaaaccaagtcgc

SEQ ID NO: 27957 - DNA, 25 bp, E. coli
tatcataacaagagggttttcgcgg

SEQ ID NO: 27958 - DNA, 25 bp, E. coli
tatcataacaagtgggttttcgcgg

SEQ ID NO: 27959 - DNA, 25 bp, E. coli
tccccttggatgaggattgtatacc

SEQ ID NO: 27960 - DNA, 25 bp, E. coli
tccccttggatgtggattgtatacc

SEQ ID NO: 27961 - DNA, 25 bp, E. coli
ccaagatatcatatacggtgctcac

SEQ ID NO: 27962 - DNA, 25 bp, E. coli
ccaagatatcatttacggtgctcac

SEQ ID NO: 27963 - DNA, 25 bp, E. coli
gaatagttacaacgtcgatcatccg

SEQ ID NO: 27964 - DNA, 25 bp, E. coli
gaatagttacaaggtcgatcatccg

SEQ ID NO: 27965 - DNA, 25 bp, E. coli
gaaaccagatcaggattcagaacct

SEQ ID NO: 27966 - DNA, 25 bp, E. coli
gaaaccagatcacgattcagaacct

SEQ ID NO: 27967 - DNA, 25 bp, E. coli
cgaagatgacataaacccagatgac

SEQ ID NO: 27968 - DNA, 25 bp, E. coli
cgaagatgacattaacccagatgac

SEQ ID NO: 27969 - DNA, 25 bp, E. coli
ctttaccgcttgtagatgagtcggg

SEQ ID NO: 27970 - DNA, 25 bp, E. coli
ctttaccgcttgaagatgagtcggg

SEQ ID NO: 27971 - DNA, 25 bp, E. coli
gattatcagccatgccaagtagaag

SEQ ID NO: 27972 - DNA, 25 bp, E. coli
gattatcagccaagccaagtagaag

SEQ ID NO: 27973 - DNA, 25 bp, E. coli
tactctgggagattacctttaccgc

SEQ ID NO: 27974 - DNA, 25 bp, E. coli
tactctgggagaatacctttaccgc

SEQ ID NO: 27975 - DNA, 25 bp, E. coli
caacatgtcagctgttcatatagcc

SEQ ID NO: 27976 - DNA, 25 bp, E. coli
cagctgttcatatagccattcatca

SEQ ID NO: 27977 - DNA, 25 bp, E. coli
caacatgtcagcagttcatatagcc

SEQ ID NO: 27978 - DNA, 25 bp, E. coli
cagctgttcataaagccattcatca

SEQ ID NO: 27979 - DNA, 25 bp, E. coli
catgtcagctgtacatatagccatt

SEQ ID NO: 27980 - DNA, 25 bp, E. coli
catgtcagctgttcatatagccatt

SEQ ID NO: 27981 - DNA, 25 bp, E. coli
aaaaatcatgacaacatgtcagctg

SEQ ID NO: 27982 - DNA, 25 bp, E. coli
aaactgtagaaacatattatgctgc

SEQ ID NO: 27983 - DNA, 25 bp, E. coli
aaactgtagaaagatattatgctgc

SEQ ID NO: 27984 - DNA, 25 bp, E. coli
aaaaatcatgactacatgtcagctg

SEQ ID NO: 27985 - DNA, 25 bp, E. coli
tgtcagctgttcttatagccattca

SEQ ID NO: 27986 - DNA, 25 bp, E. coli
tgtcagctgttcatatagccattca

SEQ ID NO: 27987 - DNA, 25 bp, E. coli
tcatgacaacatgtcagctgttcat

SEQ ID NO: 27988 - DNA, 25 bp, E. coli
tcatgacaacatctcagctgttcat

SEQ ID NO: 27989 - DNA, 25 bp, E. coli
gctgttcatatagccattcatcata

SEQ ID NO: 27990 - DNA, 25 bp, E. coli
gctgttcatatacccattcatcata

SEQ ID NO: 27991 - DNA, 25 bp, E. coli
gctaaaaatcatcacaacatgtcag

SEQ ID NO: 27992 - DNA, 25 bp, E. coli
gctaaaaatcatgacaacatgtcag

SEQ ID NO: 27993 - DNA, 25 bp, E. coli
gacaacatgtcagctgttcatatag

SEQ ID NO: 27994 - DNA, 25 bp, E. coli
gacaacatgtcacctgttcatatag

SEQ ID NO: 27995 - DNA, 25 bp, E. coli
ctgtagaaacattttatgctgctat

SEQ ID NO: 27996 - DNA, 25 bp, E. coli
ctgtagaaacatattatgctgctat

SEQ ID NO: 27997 - DNA, 25 bp, E. coli
ctgcaaaaacggtggatgtgtcgcg

SEQ ID NO: 27998 - DNA, 25 bp, E. coli
ctgcaaaaacggaggatgtgtcgcg

SEQ ID NO: 27999 - DNA, 25 bp, E. coli
cagaggctgcaaaaacggtggatgt

SEQ ID NO: 28000 - DNA, 25 bp, E. coli
cagaggctgcaataacggtggatgt

SEQ ID NO: 28001 - DNA, 25 bp, E. coli
agaggctgcaaaaacggtggatgtg

SEQ ID NO: 28002 - DNA, 25 bp, E. coli
agaggctgcaaatacggtggatgtg

SEQ ID NO: 28003 - DNA, 25 bp, E. coli
tgcaaaaacggtggatgtgtcgcga

SEQ ID NO: 28004 - DNA, 25 bp, E. coli
tgcaaaaacggtcgatgtgtcgcga

SEQ ID NO: 28005 - DNA, 25 bp, E. coli
tctggcagaggcagcaaaaacggtg

SEQ ID NO: 28006 - DNA, 25 bp, E. coli
tctggcagaggctgcaaaaacggtg

SEQ ID NO: 28007 - DNA, 25 bp, E. coli
gctgcaaaaacggtggatgtgtcgc

SEQ ID NO: 28008 - DNA, 25 bp, E. coli
gctgcaaaaacgctggatgtgtcgc

SEQ ID NO: 28009 - DNA, 25 bp, E. coli
ctggcagaggctccaaaaacggtgg

SEQ ID NO: 28010 - DNA, 25 bp, E. coli
ctggcagaggctgcaaaaacggtgg

SEQ ID NO: 28011 - DNA, 25 bp, E. coli
tggcagaggctggaaaaacggtgga

SEQ ID NO: 28012 - DNA, 25 bp, E. coli
ggcagaggctgcaaaaacggtggat

SEQ ID NO: 28013 - DNA, 25 bp, E. coli
tggcagaggctgcaaaaacggtgga

SEQ ID NO: 28014 - DNA, 25 bp, E. coli
ggcagaggctgctaaaacggtggat

SEQ ID NO: 28015 - DNA, 25 bp, E. coli
gagtctggcagaggctgcaaaaacg

SEQ ID NO: 28016 - DNA, 25 bp, E. coli
gagtctggcagacgctgcaaaaacg

SEQ ID NO: 28017 - DNA, 25 bp, E. coli
gaggctgcaaaatcggtggatgtgt

SEQ ID NO: 28018 - DNA, 25 bp, E. coli
gaggctgcaaaaacggtggatgtgt

SEQ ID NO: 28019 - DNA, 25 bp, E. coli
aaccggtgcgtaaccgcgtgatgat

SEQ ID NO: 28020 - DNA, 25 bp, E. coli
aaccgcgtgatgtttttagagcgca

SEQ ID NO: 28021 - DNA, 25 bp, E. coli
aaccggtgcgtatccgcgtgatgat

SEQ ID NO: 28022 - DNA, 25 bp, E. coli
aaccgcgtgatgattttagagcgca

SEQ ID NO: 28023 - DNA, 25 bp, E. coli
accgcgtgatgattttagagcgcag

SEQ ID NO: 28024 - DNA, 25 bp, E. coli
accgcgtgatgaatttagagcgcag

SEQ ID NO: 28025 - DNA, 25 bp, E. coli
accggtgcgtaaccgcgtgatgatt

SEQ ID NO: 28026 - DNA, 25 bp, E. coli
accggtgcgtaagcgcgtgatgatt

SEQ ID NO: 28027 - DNA, 25 bp, E. coli
tgcgtaaccgcgtgatgattttaga

SEQ ID NO: 28028 - DNA, 25 bp, E. coli
tgcgtaaccgcgagatgattttaga

SEQ ID NO: 28029 - DNA, 25 bp, E. coli
gcgtaaccgcgtgatgattttagag

SEQ ID NO: 28030 - DNA, 25 bp, E. coli
gcgtaaccgcgtcatgattttagag

SEQ ID NO: 28031 - DNA, 25 bp, E. coli
gcagaaaaagcggctacatgagccg

SEQ ID NO: 28032 - DNA, 25 bp, E. coli
gaaccggtgcgtaaccgcgtgatga

SEQ ID NO: 28033 - DNA, 25 bp, E. coli
gcagaaaaagcgcctacatgagccg

SEQ ID NO: 28034 - DNA, 25 bp, E. coli
gaaccggtgcgttaccgcgtgatga

SEQ ID NO: 28035 - DNA, 25 bp, E. coli
cgtaaccgcgtgatgattttagagc

SEQ ID NO: 28036 - DNA, 25 bp, E. coli
cgtaaccgcgtgttgattttagagc

SEQ ID NO: 28037 - DNA, 25 bp, E. coli
gtgcgtaaccgcctgatgattttag

SEQ ID NO: 28038 - DNA, 25 bp, E. coli
gtgcgtaaccgcgtgatgattttag

SEQ ID NO: 28039 - DNA, 25 bp, E. coli
taaccgcgtgatgattttagagcgc

SEQ ID NO: 28040 - DNA, 25 bp, E. coli
taaccgcgtgatcattttagagcgc

SEQ ID NO: 28041 - DNA, 25 bp, E. coli
caacagtcctgtgggtaaatacccg

SEQ ID NO: 28042 - DNA, 25 bp, E. coli
caacagtcctgtcggtaaatacccg

SEQ ID NO: 28043 - DNA, 25 bp, E. coli
catcggattatcgtcgcaagcggca

SEQ ID NO: 28044 - DNA, 25 bp, E. coli
catcggattatcctcgcaagcggca

SEQ ID NO: 28045 - DNA, 25 bp, E. coli
taccaatggtactagtctcgccgcc

SEQ ID NO: 28046 - DNA, 25 bp, E. coli
aaaaccagctactgacgtgcttccg

SEQ ID NO: 28047 - DNA, 25 bp, E. coli
aaaaccagctacagacgtgcttccg

SEQ ID NO: 28048 - DNA, 25 bp, E. coli
taccaatggtacaagtctcgccgcc

SEQ ID NO: 28049 - DNA, 25 bp, E. coli
tgtttaccgcctggctgactgcggg

SEQ ID NO: 28050 - DNA, 25 bp, E. coli
tgtttaccgcctcgctgactgcggg

SEQ ID NO: 28051 - DNA, 25 bp, E. coli
tcgccgccctgggaaactcaaaata

SEQ ID NO: 28052 - DNA, 25 bp, E. coli
tcgccgccctggcaaactcaaaata

SEQ ID NO: 28053 - DNA, 25 bp, E. coli
gcaaggtactgcgagatagcgcact

SEQ ID NO: 28054 - DNA, 25 bp, E. coli
gcaaggtactgccagatagcgcact

SEQ ID NO: 28055 - DNA, 25 bp, E. coli
gataaacgcaaacatacattgctgg

SEQ ID NO: 28056 - DNA, 25 bp, E. coli
gatatctctgttcgcattcctcacg

SEQ ID NO: 28057 - DNA, 25 bp, E. coli
gataaacgcaaagatacattgctgg

SEQ ID NO: 28058 - DNA, 25 bp, E. coli
gatatctctgttggcattcctcacg

SEQ ID NO: 28059 - DNA, 25 bp, E. coli
ggactcgcccgaaactcaaaaatag

SEQ ID NO: 28060 - DNA, 25 bp, E. coli
tggttgaacatccactggtacgcca

SEQ ID NO: 28061 - DNA, 25 bp, E. coli
tggttgaacatcgactggtacgcca

SEQ ID NO: 28062 - DNA, 25 bp, E. coli
ggactcgcccgatactcaaaaatag

SEQ ID NO: 28063 - DNA, 25 bp, E. coli
cataactgtggacaatcgaattgac

SEQ ID NO: 28064 - DNA, 25 bp, E. coli
cataactgtggagaatcgaattgac

SEQ ID NO: 28065 - DNA, 25 bp, E. coli
ttgcggtgaaaaatgttaaggcggc

SEQ ID NO: 28066 - DNA, 25 bp, E. coli
ttgcggtgaaaattgttaaggcggc

SEQ ID NO: 28067 - DNA, 25 bp, E. coli
tacgaatgactatctatcagtagcg

SEQ ID NO: 28068 - DNA, 25 bp, E. coli
tacgaatgactaactatcagtagcg

SEQ ID NO: 28069 - DNA, 25 bp, E. coli
tagggcttactgtgaaacgatccgg

SEQ ID NO: 28070 - DNA, 25 bp, E. coli
tagggcttactgagaaacgatccgg

SEQ ID NO: 28071 - DNA, 25 bp, E. coli
tttttgagcgtgatatcggcagtgc

SEQ ID NO: 28072 - DNA, 25 bp, E. coli
tttttgagcgtgttatcggcagtgc

SEQ ID NO: 28073 - DNA, 25 bp, E. coli
tggtgacgggcgagaccataactgt

SEQ ID NO: 28074 - DNA, 25 bp, E. coli
tgtcacatttcatcgtagggcttac

SEQ ID NO: 28075 - DNA, 25 bp, E. coli
tggtgacgggcgtgaccataactgt

SEQ ID NO: 28076 - DNA, 25 bp, E. coli
tgtcacatttcaacgtagggcttac

SEQ ID NO: 28077 - DNA, 25 bp, E. coli
gaaacgatccggaaagccgttggtg

SEQ ID NO: 28078 - DNA, 25 bp, E. coli
gaaacgatccggtaagccgttggtg

SEQ ID NO: 28079 - DNA, 25 bp, E. coli
gtagcgttatccgtatttctggaga

SEQ ID NO: 28080 - DNA, 25 bp, E. coli
gtagcgttatccctatttctggaga

SEQ ID NO: 28081 - DNA, 25 bp, E. coli
taaggcggcggactataccataagc

SEQ ID NO: 28082 - DNA, 25 bp, E. coli
taaggcggcggagtataccataagc

SEQ ID NO: 28083 - DNA, 25 bp, E. coli
gagagaaaaatccaatacccaccat

SEQ ID NO: 28084 - DNA, 25 bp, E. coli
gagagaaaaatcgaatacccaccat

SEQ ID NO: 28085 - DNA, 25 bp, E. coli
aggtggtattccaggttaacgctgc

SEQ ID NO: 28086 - DNA, 25 bp, E. coli
agcgcctgaacgaggcggccagtaa

SEQ ID NO: 28087 - DNA, 25 bp, E. coli
aggtggtattcctggttaacgctgc

SEQ ID NO: 28088 - DNA, 25 bp, E. coli
agcgcctgaacgtggcggccagtaa

SEQ ID NO: 28089 - DNA, 25 bp, E. coli
tatcaggccaatcttgaagtgctca

SEQ ID NO: 28090 - DNA, 25 bp, E. coli
tatttttgatatcgccgggtcggcg

SEQ ID NO: 28091 - DNA, 25 bp, E. coli
tatcaggccaatgttgaagtgctca

SEQ ID NO: 28092 - DNA, 25 bp, E. coli
tatttttgatatggccgggtcggcg

SEQ ID NO: 28093 - DNA, 25 bp, E. coli
tttatgaaccgggtaatccgctggc

SEQ ID NO: 28094 - DNA, 25 bp, E. coli
tttatgaaccggctaatccgctggc

SEQ ID NO: 28095 - DNA, 25 bp, E. coli
tgatgctgaaaacccttacgctcgg

SEQ ID NO: 28096 - DNA, 25 bp, E. coli
tgatgctgaaaagccttacgctcgg

SEQ ID NO: 28097 - DNA, 25 bp, E. coli
ccatatcgggcataacaggtggtat

SEQ ID NO: 28098 - DNA, 25 bp, E. coli
ccatatcgggcaaaacaggtggtat

SEQ ID NO: 28099 - DNA, 25 bp, E. coli
cgaatgctgataccgtgaccggtcc

SEQ ID NO: 28100 - DNA, 25 bp, E. coli
cgaatgctgatagcgtgaccggtcc

SEQ ID NO: 28101 - DNA, 25 bp, E. coli
ggttgccgatgtaatagaaagtcag

SEQ ID NO: 28102 - DNA, 25 bp, E. coli
ggttgccgatgttatagaaagtcag

SEQ ID NO: 28103 - DNA, 25 bp, E. coli
tggttaacaccaagtcggcgtcacg

SEQ ID NO: 28104 - DNA, 25 bp, E. coli
tggttaacaccatgtcggcgtcacg

SEQ ID NO: 28105 - DNA, 25 bp, E. coli
tcaacacggtgaaaagcatgatgct

SEQ ID NO: 28106 - DNA, 25 bp, E. coli
tcaacacggtgataagcatgatgct

SEQ ID NO: 28107 - DNA, 25 bp, E. coli
tactggatgattcaccgaaattccc

SEQ ID NO: 28108 - DNA, 25 bp, E. coli
tactggatgattgaccgaaattccc

SEQ ID NO: 28109 - DNA, 25 bp, E. coli
atgatggccccagccgctataaaag

SEQ ID NO: 28110 - DNA, 25 bp, E. coli
atgatggccccacccgctataaaag

SEQ ID NO: 28111 - DNA, 25 bp, E. coli
aacggataatcgctgatggctgcta

SEQ ID NO: 28112 - DNA, 25 bp, E. coli
aacggataatcggtgatggctgcta

SEQ ID NO: 28113 - DNA, 25 bp, E. coli
tacgcgcaagggaaaatgatggccc

SEQ ID NO: 28114 - DNA, 25 bp, E. coli
tacgcgcaagggtaaatgatggccc

SEQ ID NO: 28115 - DNA, 25 bp, E. coli
tagcaccaagtgagcgagttctgaa

SEQ ID NO: 28116 - DNA, 25 bp, E. coli
tagcaccaagtgtgcgagttctgaa

SEQ ID NO: 28117 - DNA, 25 bp, E. coli
tttgtaggaacggttgcagaaccgc

SEQ ID NO: 28118 - DNA, 25 bp, E. coli
tttgtaggaacgcttgcagaaccgc

SEQ ID NO: 28119 - DNA, 25 bp, E. coli
gcagaaccgcaactcccaataaacg

SEQ ID NO: 28120 - DNA, 25 bp, E. coli
gctataaaagttcgtcgctactgga

SEQ ID NO: 28121 - DNA, 25 bp, E. coli
gcagaaccgcaagtcccaataaacg

SEQ ID NO: 28122 - DNA, 25 bp, E. coli
gctataaaagttggtcgctactgga

SEQ ID NO: 28123 - DNA, 25 bp, E. coli
gactaatcactttacgggactgggc

SEQ ID NO: 28124 - DNA, 25 bp, E. coli
gactaatcacttaacgggactgggc

SEQ ID NO: 28125 - DNA, 25 bp, E. coli
cgggactgggctaaagaagaatttg

SEQ ID NO: 28126 - DNA, 25 bp, E. coli
cgggactgggcttaagaagaatttg

SEQ ID NO: 28127 - DNA, 25 bp, E. coli
gagttctgaaaatatacgcgcaagg

SEQ ID NO: 28128 - DNA, 25 bp, E. coli
gagttctgaaaaaatacgcgcaagg

SEQ ID NO: 28129 - DNA, 25 bp, E. coli
catggcccgcgctcgtaatcatatt

SEQ ID NO: 28130 - DNA, 25 bp, E. coli
catggcccgcgcacgtaatcatatt

SEQ ID NO: 28131 - DNA, 25 bp, E. coli
agaacatggcgctgttgatggaaca

SEQ ID NO: 28132 - DNA, 25 bp, E. coli
accgtttcgttggtcgagtggcaca

SEQ ID NO: 28133 - DNA, 25 bp, E. coli
accgtttcgttgctcgagtggcaca

SEQ ID NO: 28134 - DNA, 25 bp, E. coli
agaacatggcgcagttgatggaaca

SEQ ID NO: 28135 - DNA, 25 bp, E. coli
acactcacggaggttgatgaccggg

SEQ ID NO: 28136 - DNA, 25 bp, E. coli
acactcacggagcttgatgaccggg

SEQ ID NO: 28137 - DNA, 25 bp, E. coli
tatgctgatgcggtttcaccgctgg

SEQ ID NO: 28138 - DNA, 25 bp, E. coli
tagaagcgatacgtgtgccgcatcc

SEQ ID NO: 28139 - DNA, 25 bp, E. coli
tagaagcgatacctgtgccgcatcc

SEQ ID NO: 28140 - DNA, 25 bp, E. coli
tatgctgatgcgctttcaccgctgg

SEQ ID NO: 28141 - DNA, 25 bp, E. coli
tcgatgctgggatgcgatgctgatt

SEQ ID NO: 28142 - DNA, 25 bp, E. coli
tcgatgctgggaagcgatgctgatt

SEQ ID NO: 28143 - DNA, 25 bp, E. coli
tcatctggcattaagccgtcagtct

SEQ ID NO: 28144 - DNA, 25 bp, E. coli
tcatctggcatttagccgtcagtct

SEQ ID NO: 28145 - DNA, 25 bp, E. coli
gaagaactgcaggaaacactcacgg

SEQ ID NO: 28146 - DNA, 25 bp, E. coli
gaagaactgcagcaaacactcacgg

SEQ ID NO: 28147 - DNA, 25 bp, E. coli
cgtcagtctttccaaccgctgcgta

SEQ ID NO: 28148 - DNA, 25 bp, E. coli
cgtcagtctttcgaaccgctgcgta

SEQ ID NO: 28149 - DNA, 25 bp, E. coli
gatgccagtcactatcaacaagggc

SEQ ID NO: 28150 - DNA, 25 bp, E. coli
gatgccagtcacaatcaacaagggc

SEQ ID NO: 28151 - DNA, 25 bp, E. coli
catgaaaggcgcttttcgggctgcc

SEQ ID NO: 28152 - DNA, 25 bp, E. coli
catgaaaggcgcatttcgggctgcc

SEQ ID NO: 28153 - DNA, 25 bp, E. coli
ttatgcggctgtttttttcaccgac

SEQ ID NO: 28154 - DNA, 25 bp, E. coli
ttatgcggctgtatttttcaccgac

SEQ ID NO: 28155 - DNA, 25 bp, E. coli
tttttctggcgaggcacatgaaagg

SEQ ID NO: 28156 - DNA, 25 bp, E. coli
ttggcgcaatgctggcggcaccctg

SEQ ID NO: 28157 - DNA, 25 bp, E. coli
ttggcgcaatgcaggcggcaccctg

SEQ ID NO: 28158 - DNA, 25 bp, E. coli
tttttctggcgacgcacatgaaagg

SEQ ID NO: 28159 - DNA, 25 bp, E. coli
tgtttaaaccacagcacagaaaaaa

SEQ ID NO: 28160 - DNA, 25 bp, E. coli
tgtttaaaccactgcacagaaaaaa

SEQ ID NO: 28161 - DNA, 25 bp, E. coli
tgaaacataaacaacgttgggcggg

SEQ ID NO: 28162 - DNA, 25 bp, E. coli
tgctgttttgtcgtcttcattgtgg

SEQ ID NO: 28163 - DNA, 25 bp, E. coli
tgaaacataaactacgttgggcggg

SEQ ID NO: 28164 - DNA, 25 bp, E. coli
tgctgttttgtcctcttcattgtgg

SEQ ID NO: 28165 - DNA, 25 bp, E. coli
gcttttcgggctcccgggcatcctg

SEQ ID NO: 28166 - DNA, 25 bp, E. coli
gcttttcgggctgccgggcatcctg

SEQ ID NO: 28167 - DNA, 25 bp, E. coli
cgctcattctgggaagagctggcat

SEQ ID NO: 28168 - DNA, 25 bp, E. coli
cgctcattctggcaagagctggcat

SEQ ID NO: 28169 - DNA, 25 bp, E. coli
cattctggcaagtgctggcatggtt

SEQ ID NO: 28170 - DNA, 25 bp, E. coli
cattctggcaagagctggcatggtt

SEQ ID NO: 28171 - DNA, 25 bp, E. coli
tggcgacgcacaagaaaggcgcttt

SEQ ID NO: 28172 - DNA, 25 bp, E. coli
tggcgacgcacatgaaaggcgcttt

SEQ ID NO: 28173 - DNA, 25 bp, E. coli
aagatagcctgtccctattacccag

SEQ ID NO: 28174 - DNA, 25 bp, E. coli
aagatagcctgtgcctattacccag

SEQ ID NO: 28175 - DNA, 25 bp, E. coli
cacggtggtgagttattgtgaccca

SEQ ID NO: 28176 - DNA, 25 bp, E. coli
cacggtggtgagatattgtgaccca

SEQ ID NO: 28177 - DNA, 25 bp, E. coli
catatcatgattccggcgagagcag

SEQ ID NO: 28178 - DNA, 25 bp, E. coli
catatcatgattgcggcgagagcag

SEQ ID NO: 28179 - DNA, 25 bp, E. coli
agaatgctgcaatcgtctctgcgag

SEQ ID NO: 28180 - DNA, 25 bp, E. coli
agaatgctgcaaacgtctctgcgag

SEQ ID NO: 28181 - DNA, 25 bp, E. coli
tacccagatcaggaatggcatatca

SEQ ID NO: 28182 - DNA, 25 bp, E. coli
tacccagatcagcaatggcatatca

SEQ ID NO: 28183 - DNA, 25 bp, E. coli
tctctgcgagactaagccatcataa

SEQ ID NO: 28184 - DNA, 25 bp, E. coli
tctctgcgagacaaagccatcataa

SEQ ID NO: 28185 - DNA, 25 bp, E. coli
tcataaaaaacacggagatacgctt

SEQ ID NO: 28186 - DNA, 25 bp, E. coli
tcataaaaaacagggagatacgctt

SEQ ID NO: 28187 - DNA, 25 bp, E. coli
gaaaagccgataattagcgacgaat

SEQ ID NO: 28188 - DNA, 25 bp, E. coli
gaaaagccgatatttagcgacgaat

SEQ ID NO: 28189 - DNA, 25 bp, E. coli
cgacgaatttcggaggttggatcct

SEQ ID NO: 28190 - DNA, 25 bp, E. coli
cgacgaatttcgcaggttggatcct

SEQ ID NO: 28191 - DNA, 25 bp, E. coli
ggttaataaacgagatccaccgcac

SEQ ID NO: 28192 - DNA, 25 bp, E. coli
ggttaataaacgtgatccaccgcac

SEQ ID NO: 28193 - DNA, 25 bp, E. coli
ggcggagcgaatcactacccttaaa

SEQ ID NO: 28194 - DNA, 25 bp, E. coli
ggcggagcgaatgactacccttaaa

SEQ ID NO: 28195 - DNA, 25 bp, E. coli
tcccgggataagatgaagagccgct

SEQ ID NO: 28196 - DNA, 25 bp, E. coli
tcccgggataagttgaagagccgct

SEQ ID NO: 28197 - DNA, 25 bp, E. coli
tcaggtcaacgggaacaggattatc

SEQ ID NO: 28198 - DNA, 25 bp, E. coli
tcaggtcaacggcaacaggattatc

SEQ ID NO: 28199 - DNA, 25 bp, E. coli
gaataatctgtcagttgtcgcaacc

SEQ ID NO: 28200 - DNA, 25 bp, E. coli
gaataatctgtctgttgtcgcaacc

SEQ ID NO: 28201 - DNA, 25 bp, E. coli
gaaagtgacacactatccggcagta

SEQ ID NO: 28202 - DNA, 25 bp, E. coli
gactgaaaccacaacagacagcggt

SEQ ID NO: 28203 - DNA, 25 bp, E. coli
gactgaaaccactacagacagcggt

SEQ ID NO: 28204 - DNA, 25 bp, E. coli
gaaagtgacacagtatccggcagta

SEQ ID NO: 28205 - DNA, 25 bp, E. coli
cgacagtaaacagaccagcgtggct

SEQ ID NO: 28206 - DNA, 25 bp, E. coli
cgacagtaaacacaccagcgtggct

SEQ ID NO: 28207 - DNA, 25 bp, E. coli
gattatcgccgaagtgggccacgac

SEQ ID NO: 28208 - DNA, 25 bp, E. coli
gattatcgccgatgtgggccacgac

SEQ ID NO: 28209 - DNA, 25 bp, E. coli
gatattctgttgagtggcgccgcaa

SEQ ID NO: 28210 - DNA, 25 bp, E. coli
gatattctgttgtgtggcgccgcaa

SEQ ID NO: 28211 - DNA, 25 bp, E. coli
ggtggtaacacaagcctggatgccg

SEQ ID NO: 28212 - DNA, 25 bp, E. coli
ggtggtaacacatgcctggatgccg

SEQ ID NO: 28213 - DNA, 25 bp, E. coli
taatgtcagtataaccgcgggcaaa

SEQ ID NO: 28214 - DNA, 25 bp, E. coli
taatgtcagtattaccgcgggcaaa

SEQ ID NO: 28215 - DNA, 25 bp, E. coli
taatgcggttacgagtgcacaggag

SEQ ID NO: 28216 - DNA, 25 bp, E. coli
taatgcggttaccagtgcacaggag

SEQ ID NO: 28217 - DNA, 25 bp, E. coli
aaccatcaacaaatcaagaatagcc

SEQ ID NO: 28218 - DNA, 25 bp, E. coli
aatcttgaaccatcaacaattcaag

SEQ ID NO: 28219 - DNA, 25 bp, E. coli
ctaatcttgaacgatcaacaattca

SEQ ID NO: 28220 - DNA, 25 bp, E. coli
aaccatcaacaattcaagaatagcc

SEQ ID NO: 28221 - DNA, 25 bp, E. coli
ctaatcttgaaccatcaacaattca

SEQ ID NO: 28222 - DNA, 25 bp, E. coli
aatcttgaaccaacaacaattcaag

SEQ ID NO: 28223 - DNA, 25 bp, E. coli
atcttgaaccatcaacaattcaaga

SEQ ID NO: 28224 - DNA, 25 bp, E. coli
atcttgaaccatgaacaattcaaga

SEQ ID NO: 28225 - DNA, 25 bp, E. coli
ttgaaccatcaagaattcaagaata

SEQ ID NO: 28226 - DNA, 25 bp, E. coli
ttgaaccatcaacaattcaagaata

SEQ ID NO: 28227 - DNA, 25 bp, E. coli
tgaaccatcaacaattcaagaatag

SEQ ID NO: 28228 - DNA, 25 bp, E. coli
tgaaccatcaactattcaagaatag

SEQ ID NO: 28229 - DNA, 25 bp, E. coli
tcttgaaccatctacaattcaagaa

SEQ ID NO: 28230 - DNA, 25 bp, E. coli
tcttgaaccatcaacaattcaagaa

SEQ ID NO: 28231 - DNA, 25 bp, E. coli
gctaatcttgaaccatcaacaattc

SEQ ID NO: 28232 - DNA, 25 bp, E. coli
gctaatcttgaagcatcaacaattc

SEQ ID NO: 28233 - DNA, 25 bp, E. coli
gaaccatcaacaattcaagaatagc

SEQ ID NO: 28234 - DNA, 25 bp, E. coli
gaaccatcaacatttcaagaatagc

SEQ ID NO: 28235 - DNA, 25 bp, E. coli
cttgaaccatcatcaattcaagaat

SEQ ID NO: 28236 - DNA, 25 bp, E. coli
cttgaaccatcaacaattcaagaat

SEQ ID NO: 28237 - DNA, 25 bp, E. coli
taatcttgaaccatcaacaattcaa

SEQ ID NO: 28238 - DNA, 25 bp, E. coli
taatcttgaaccttcaacaattcaa

SEQ ID NO: 28239 - DNA, 25 bp, E. coli
aatgtgttgagccaattgcccggta

SEQ ID NO: 28240 - DNA, 25 bp, E. coli
aatgtgttgagcgaattgcccggta

SEQ ID NO: 28241 - DNA, 25 bp, E. coli
aataccgttgttattctgcggcgcg

SEQ ID NO: 28242 - DNA, 25 bp, E. coli
aataccgttgtttttctgcggcgcg

SEQ ID NO: 28243 - DNA, 25 bp, E. coli
taaagtgaaccagggcgattcgctg

SEQ ID NO: 28244 - DNA, 25 bp, E. coli
taaagtgaaccacggcgattcgctg

SEQ ID NO: 28245 - DNA, 25 bp, E. coli
tatgtcgatctctcgcagtcggtgc

SEQ ID NO: 28246 - DNA, 25 bp, E. coli
tatgtcgatctcacgcagtcggtgc

SEQ ID NO: 28247 - DNA, 25 bp, E. coli
ttacgggcgtcagcgggaaatcgtc

SEQ ID NO: 28248 - DNA, 25 bp, E. coli
ttacgggcgtcaccgggaaatcgtc

SEQ ID NO: 28249 - DNA, 25 bp, E. coli
tcgccagtgggctaatcaaacaggt

SEQ ID NO: 28250 - DNA, 25 bp, E. coli
tcgccagtgggcaaatcaaacaggt

SEQ ID NO: 28251 - DNA, 25 bp, E. coli
cgcgcgcacccagttgaatgaagca

SEQ ID NO: 28252 - DNA, 25 bp, E. coli
cgcgcgcacccacttgaatgaagca

SEQ ID NO: 28253 - DNA, 25 bp, E. coli
cattagtggatgaaggtagccgcca

SEQ ID NO: 28254 - DNA, 25 bp, E. coli
cattagtggatgtaggtagccgcca

SEQ ID NO: 28255 - DNA, 25 bp, E. coli
ggtttgcaacgcattcgtccgggta

SEQ ID NO: 28256 - DNA, 25 bp, E. coli
ggtttgcaacgctttcgtccgggta

SEQ ID NO: 28257 - DNA, 25 bp, E. coli
taaccgccaggcttcgttgctgaag

SEQ ID NO: 28258 - DNA, 25 bp, E. coli
tcaaacaggttcagggcagtacgcc

SEQ ID NO: 28259 - DNA, 25 bp, E. coli
tcaaacaggttctgggcagtacgcc

SEQ ID NO: 28260 - DNA, 25 bp, E. coli
taaccgccaggcatcgttgctgaag

SEQ ID NO: 28261 - DNA, 25 bp, E. coli
aataatatcgcaaccggcgcaatta

SEQ ID NO: 28262 - DNA, 25 bp, E. coli
aataatatcgcatccggcgcaatta

SEQ ID NO: 28263 - DNA, 25 bp, E. coli
cactggaatttaatgctaatggcac

SEQ ID NO: 28264 - DNA, 25 bp, E. coli
cactggaatttattgctaatggcac

SEQ ID NO: 28265 - DNA, 25 bp, E. coli
agtgatccgcttgctactgttacgc

SEQ ID NO: 28266 - DNA, 25 bp, E. coli
agtgatccgcttcctactgttacgc

SEQ ID NO: 28267 - DNA, 25 bp, E. coli
tagcagtgatcctaacagcattgcg

SEQ ID NO: 28268 - DNA, 25 bp, E. coli
tagcagtgatccaaacagcattgcg

SEQ ID NO: 28269 - DNA, 25 bp, E. coli
tgaattccagtgatccgcttcctac

SEQ ID NO: 28270 - DNA, 25 bp, E. coli
tgaattccagtgttccgcttcctac

SEQ ID NO: 28271 - DNA, 25 bp, E. coli
tccaaacagcatagcgaagacagcg

SEQ ID NO: 28272 - DNA, 25 bp, E. coli
tgcgaagacagccacaacactggaa

SEQ ID NO: 28273 - DNA, 25 bp, E. coli
tccaaacagcattgcgaagacagcg

SEQ ID NO: 28274 - DNA, 25 bp, E. coli
tgcgaagacagcgacaacactggaa

SEQ ID NO: 28275 - DNA, 25 bp, E. coli
gcttcctactgttacgccattcagc

SEQ ID NO: 28276 - DNA, 25 bp, E. coli
gcgacaacactggaatttaatgcta

SEQ ID NO: 28277 - DNA, 25 bp, E. coli
gcttcctactgtaacgccattcagc

SEQ ID NO: 28278 - DNA, 25 bp, E. coli
gcgacaacactgcaatttaatgcta

SEQ ID NO: 28279 - DNA, 25 bp, E. coli
ggatggtgcgatggcgaataatatc

SEQ ID NO: 28280 - DNA, 25 bp, E. coli
ggatggtgcgatcgcgaataatatc

SEQ ID NO: 28281 - DNA, 25 bp, E. coli
taatggcacattagtggatggtgcg

SEQ ID NO: 28282 - DNA, 25 bp, E. coli
taatggcacatttgtggatggtgcg

SEQ ID NO: 28283 - DNA, 25 bp, E. coli
atgctgcgcttagaaaaagcggtgg

SEQ ID NO: 28284 - DNA, 25 bp, E. coli
atgctgcgcttacaaaaagcggtgg

SEQ ID NO: 28285 - DNA, 25 bp, E. coli
aactggacgcgatgaccgcccgcat

SEQ ID NO: 28286 - DNA, 25 bp, E. coli
aactggacgcgaagaccgcccgcat

SEQ ID NO: 28287 - DNA, 25 bp, E. coli
tgctgcgcttactaaaagcggtgga

SEQ ID NO: 28288 - DNA, 25 bp, E. coli
tgcgcttacaaaaagcggtggaaga

SEQ ID NO: 28289 - DNA, 25 bp, E. coli
tgctgcgcttacaaaaagcggtgga

SEQ ID NO: 28290 - DNA, 25 bp, E. coli
tgcgcttacaaatagcggtggaaga

SEQ ID NO: 28291 - DNA, 25 bp, E. coli
gcgcttacaaaaagcggtggaagaa

SEQ ID NO: 28292 - DNA, 25 bp, E. coli
gctgcgcttacaaaaagcggtggaa

SEQ ID NO: 28293 - DNA, 25 bp, E. coli
gcttacaaaaagcggtggaagaacg

SEQ ID NO: 28294 - DNA, 25 bp, E. coli
gcgcttacaaaatgcggtggaagaa

SEQ ID NO: 28295 - DNA, 25 bp, E. coli
gctgcgcttacataaagcggtggaa

SEQ ID NO: 28296 - DNA, 25 bp, E. coli
gcttacaaaaaggggtggaagaacg

SEQ ID NO: 28297 - DNA, 25 bp, E. coli
ctgcgcttacaataagcggtggaag

SEQ ID NO: 28298 - DNA, 25 bp, E. coli
ctgcgcttacaaaaagcggtggaag

SEQ ID NO: 28299 - DNA, 25 bp, E. coli
ggacgcgatgaccgcccgcattcgt

SEQ ID NO: 28300 - DNA, 25 bp, E. coli
tggacgcgatgagcgcccgcattcg

SEQ ID NO: 28301 - DNA, 25 bp, E. coli
ggacgcgatgacggcccgcattcgt

SEQ ID NO: 28302 - DNA, 25 bp, E. coli
tggacgcgatgaccgcccgcattcg

SEQ ID NO: 28303 - DNA, 25 bp, E. coli
gatgctgcgctttcaaaaagcggtg

SEQ ID NO: 28304 - DNA, 25 bp, E. coli
gatgctgcgcttacaaaaagcggtg

SEQ ID NO: 28305 - DNA, 25 bp, E. coli
attgatgatccgtgaagggtccgca

SEQ ID NO: 28306 - DNA, 25 bp, E. coli
ataacgaactgatcacgcactcccg

SEQ ID NO: 28307 - DNA, 25 bp, E. coli
attgatgatccgagaagggtccgca

SEQ ID NO: 28308 - DNA, 25 bp, E. coli
ataacgaactgaacacgcactcccg

SEQ ID NO: 28309 - DNA, 25 bp, E. coli
acaacgactggcaccggcctgtggt

SEQ ID NO: 28310 - DNA, 25 bp, E. coli
acaacgactggctccggcctgtggt

SEQ ID NO: 28311 - DNA, 25 bp, E. coli
taccgttgcccattgccgggctaat

SEQ ID NO: 28312 - DNA, 25 bp, E. coli
taccgttgcccaatgccgggctaat

SEQ ID NO: 28313 - DNA, 25 bp, E. coli
tgaggtaatccaaaacgaactgatc

SEQ ID NO: 28314 - DNA, 25 bp, E. coli
tggtgatcggtcgtagcgcagaaga

SEQ ID NO: 28315 - DNA, 25 bp, E. coli
tgaggtaatccataacgaactgatc

SEQ ID NO: 28316 - DNA, 25 bp, E. coli
tggtgatcggtcctagcgcagaaga

SEQ ID NO: 28317 - DNA, 25 bp, E. coli
tcttgagcgttacggacaacgactg

SEQ ID NO: 28318 - DNA, 25 bp, E. coli
tcttgagcgttagggacaacgactg

SEQ ID NO: 28319 - DNA, 25 bp, E. coli
gctatcgcgttattgaggtaatcca

SEQ ID NO: 28320 - DNA, 25 bp, E. coli
gctatcgcgttaatgaggtaatcca

SEQ ID NO: 28321 - DNA, 25 bp, E. coli
gcaataccattgatcgccagccagt

SEQ ID NO: 28322 - DNA, 25 bp, E. coli
gcaataccattgttcgccagccagt

SEQ ID NO: 28323 - DNA, 25 bp, E. coli
cccgccatatggcaataccattgat

SEQ ID NO: 28324 - DNA, 25 bp, E. coli
cccgccatatgggaataccattgat

SEQ ID NO: 28325 - DNA, 25 bp, E. coli
cggaaaacgctaacgcgttattgag

SEQ ID NO: 28326 - DNA, 25 bp, E. coli
cggaaaacgctatcgcgttattgag

SEQ ID NO: 28327 - DNA, 25 bp, E. coli
cagaagacagtagttgggtcgcagc

SEQ ID NO: 28328 - DNA, 25 bp, E. coli
cagaagacagtacttgggtcgcagc

SEQ ID NO: 28329 - DNA, 25 bp, E. coli
tacgctgccagaatcagttagagtc

SEQ ID NO: 28330 - DNA, 25 bp, E. coli
tatgggtacaccaagaaaatcggcc

SEQ ID NO: 28331 - DNA, 25 bp, E. coli
tacgctgccagattcagttagagtc

SEQ ID NO: 28332 - DNA, 25 bp, E. coli
tatgggtacacctagaaaatcggcc

SEQ ID NO: 28333 - DNA, 25 bp, E. coli
tattctctgacctaaatggagcagg

SEQ ID NO: 28334 - DNA, 25 bp, E. coli
tattctctgaccaaaatggagcagg

SEQ ID NO: 28335 - DNA, 25 bp, E. coli
ttcaaggccatctaaacacagttgc

SEQ ID NO: 28336 - DNA, 25 bp, E. coli
ttcaaggccatcaaaacacagttgc

SEQ ID NO: 28337 - DNA, 25 bp, E. coli
tgtcggctctcttctagataaagga

SEQ ID NO: 28338 - DNA, 25 bp, E. coli
tgtcggctctctactagataaagga

SEQ ID NO: 28339 - DNA, 25 bp, E. coli
tccagaaaatacacctccaatgttg

SEQ ID NO: 28340 - DNA, 25 bp, E. coli
tccagaaaatactcctccaatgttg

SEQ ID NO: 28341 - DNA, 25 bp, E. coli
tctgagactgggagaaccattcatc

SEQ ID NO: 28342 - DNA, 25 bp, E. coli
tctgagactgggtgaaccattcatc

SEQ ID NO: 28343 - DNA, 25 bp, E. coli
tcggccgatatagcaaaagaagagc

SEQ ID NO: 28344 - DNA, 25 bp, E. coli
tcggccgatataccaaaagaagagc

SEQ ID NO: 28345 - DNA, 25 bp, E. coli
gaaccattcatctttacgctgccag

SEQ ID NO: 28346 - DNA, 25 bp, E. coli
gaaccattcatcattacgctgccag

SEQ ID NO: 28347 - DNA, 25 bp, E. coli
gatacatcatgcactctgagactgg

SEQ ID NO: 28348 - DNA, 25 bp, E. coli
gatacatcatgctctctgagactgg

SEQ ID NO: 28349 - DNA, 25 bp, E. coli
aatttgcaactatatcccggcaggt

SEQ ID NO: 28350 - DNA, 25 bp, E. coli
aatttgcaactaaatcccggcaggt

SEQ ID NO: 28351 - DNA, 25 bp, E. coli
catgagcattttctgcaaatcgcgg

SEQ ID NO: 28352 - DNA, 25 bp, E. coli
catgagcattttgtgcaaatcgcgg

SEQ ID NO: 28353 - DNA, 25 bp, E. coli
taccacgatttttcgttattttgag

SEQ ID NO: 28354 - DNA, 25 bp, E. coli
tactcataaccacgcagactgcgcg

SEQ ID NO: 28355 - DNA, 25 bp, E. coli
tactcataaccaggcagactgcgcg

SEQ ID NO: 28356 - DNA, 25 bp, E. coli
taccacgattttacgttattttgag

SEQ ID NO: 28357 - DNA, 25 bp, E. coli
tgaaaaatttgcaactaaatcccgg

SEQ ID NO: 28358 - DNA, 25 bp, E. coli
tgaaaaatttgctactaaatcccgg

SEQ ID NO: 28359 - DNA, 25 bp, E. coli
tcccggcaggtcttaccacgatttt

SEQ ID NO: 28360 - DNA, 25 bp, E. coli
tcccggcaggtcataccacgatttt

SEQ ID NO: 28361 - DNA, 25 bp, E. coli
gcactaattatttctcataaccacg

SEQ ID NO: 28362 - DNA, 25 bp, E. coli
gcactaattattactcataaccacg

SEQ ID NO: 28363 - DNA, 25 bp, E. coli
gcagactgcgcggaacatgagcatt

SEQ ID NO: 28364 - DNA, 25 bp, E. coli
gcagactgcgcgcaacatgagcatt

SEQ ID NO: 28365 - DNA, 25 bp, E. coli
cccaataacgcatatcattttgcac

SEQ ID NO: 28366 - DNA, 25 bp, E. coli
cccaataacgcaaatcattttgcac

SEQ ID NO: 28367 - DNA, 25 bp, E. coli
cgtagtgtataaaatgttgaaaaat

SEQ ID NO: 28368 - DNA, 25 bp, E. coli
cgtagtgtataatatgttgaaaaat

SEQ ID NO: 28369 - DNA, 25 bp, E. coli
ggcaggtcttacgacgattttacgt

SEQ ID NO: 28370 - DNA, 25 bp, E. coli
ggcaggtcttaccacgattttacgt

SEQ ID NO: 28371 - DNA, 25 bp, E. coli
caaccgtcaggagaaggtgattcac

SEQ ID NO: 28372 - DNA, 25 bp, E. coli
caaccgtcaggacaaggtgattcac

SEQ ID NO: 28373 - DNA, 25 bp, E. coli
caacaaaaccctgctcggtgcggta

SEQ ID NO: 28374 - DNA, 25 bp, E. coli
caacaaaaccctcctcggtgcggta

SEQ ID NO: 28375 - DNA, 25 bp, E. coli
catctggaagaacagatggcgcgcc

SEQ ID NO: 28376 - DNA, 25 bp, E. coli
catctggaagaagagatggcgcgcc

SEQ ID NO: 28377 - DNA, 25 bp, E. coli
aaaaccatgcgttttgccgacggca

SEQ ID NO: 28378 - DNA, 25 bp, E. coli
aaaaccatgcgtattgccgacggca

SEQ ID NO: 28379 - DNA, 25 bp, E. coli
tttctgtgaagaaccgcgcatcgct

SEQ ID NO: 28380 - DNA, 25 bp, E. coli
tatctacgccatgggtgaatgcgca

SEQ ID NO: 28381 - DNA, 25 bp, E. coli
tatctacgccatcggtgaatgcgca

SEQ ID NO: 28382 - DNA, 25 bp, E. coli
tttctgtgaagatccgcgcatcgct

SEQ ID NO: 28383 - DNA, 25 bp, E. coli
tgttgataaactcccggacagcgcg

SEQ ID NO: 28384 - DNA, 25 bp, E. coli
tgttgataaactgccggacagcgcg

SEQ ID NO: 28385 - DNA, 25 bp, E. coli
tgcgcaagctggaacaaccgtgtat

SEQ ID NO: 28386 - DNA, 25 bp, E. coli
tgcgcaagctggtacaaccgtgtat

SEQ ID NO: 28387 - DNA, 25 bp, E. coli
gaaagcactgcgaatggcgaaaacc

SEQ ID NO: 28388 - DNA, 25 bp, E. coli
gaaagcactgcgtatggcgaaaacc

SEQ ID NO: 28389 - DNA, 25 bp, E. coli
tcaaagttctggacggcgaacgcgc

SEQ ID NO: 28390 - DNA, 25 bp, E. coli
taactctggtggaggacaacgcatg

SEQ ID NO: 28391 - DNA, 25 bp, E. coli
taactctggtggtggacaacgcatg

SEQ ID NO: 28392 - DNA, 25 bp, E. coli
tcaaagttctggtcggcgaacgcgc

SEQ ID NO: 28393 - DNA, 25 bp, E. coli
aagcgtttactgtggatgccattaa

SEQ ID NO: 28394 - DNA, 25 bp, E. coli
taaagcgtttacagaggatgccatt

SEQ ID NO: 28395 - DNA, 25 bp, E. coli
taaagcgtttactgaggatgccatt

SEQ ID NO: 28396 - DNA, 25 bp, E. coli
tactgaggatgcgattaatatgcgg

SEQ ID NO: 28397 - DNA, 25 bp, E. coli
tactgaggatgccattaatatgcgg

SEQ ID NO: 28398 - DNA, 25 bp, E. coli
aagcgtttactgaggatgccattaa

SEQ ID NO: 28399 - DNA, 25 bp, E. coli
tgttctgctcagtaataaagcgttt

SEQ ID NO: 28400 - DNA, 25 bp, E. coli
tgttctgctcagaaataaagcgttt

SEQ ID NO: 28401 - DNA, 25 bp, E. coli
tgaggatgccataaatatgcggaaa

SEQ ID NO: 28402 - DNA, 25 bp, E. coli
tgaggatgccattaatatgcggaaa

SEQ ID NO: 28403 - DNA, 25 bp, E. coli
tcccgaattgccgttattaaacttg

SEQ ID NO: 28404 - DNA, 25 bp, E. coli
tcccgaattgcccttattaaacttg

SEQ ID NO: 28405 - DNA, 25 bp, E. coli
tctgctcagtaataaagcgtttact

SEQ ID NO: 28406 - DNA, 25 bp, E. coli
tctgctcagtaaaaaagcgtttact

SEQ ID NO: 28407 - DNA, 25 bp, E. coli
gcgtttactgagcatgccattaata

SEQ ID NO: 28408 - DNA, 25 bp, E. coli
gcgtttactgaggatgccattaata

SEQ ID NO: 28409 - DNA, 25 bp, E. coli
gaattgcccttattaaacttggtat

SEQ ID NO: 28410 - DNA, 25 bp, E. coli
gaattgcccttaataaacttggtat

SEQ ID NO: 28411 - DNA, 25 bp, E. coli
ggatgccattaatatgcggaaatat

SEQ ID NO: 28412 - DNA, 25 bp, E. coli
ggatgccattaaaatgcggaaatat

SEQ ID NO: 28413 - DNA, 25 bp, E. coli
taataaagcgtttactgaggatgcc

SEQ ID NO: 28414 - DNA, 25 bp, E. coli
taataaagcgttaactgaggatgcc

SEQ ID NO: 28415 - DNA, 25 bp, E. coli
aaggctgcgttaaacacagggaaag

SEQ ID NO: 28416 - DNA, 25 bp, E. coli
aaggctgcgttatacacagggaaag

SEQ ID NO: 28417 - DNA, 25 bp, E. coli
aagaaggctgcgataaacacaggga

SEQ ID NO: 28418 - DNA, 25 bp, E. coli
aagaaggctgcgttaaacacaggga

SEQ ID NO: 28419 - DNA, 25 bp, E. coli
ctgcgttaaacacagggaaagatca

SEQ ID NO: 28420 - DNA, 25 bp, E. coli
ctgcgttaaacagagggaaagatca

SEQ ID NO: 28421 - DNA, 25 bp, E. coli
aggctgcgttaatcacagggaaaga

SEQ ID NO: 28422 - DNA, 25 bp, E. coli
aggctgcgttaaacacagggaaaga

SEQ ID NO: 28423 - DNA, 25 bp, E. coli
agaaggctgcgttaaacacagggaa

SEQ ID NO: 28424 - DNA, 25 bp, E. coli
agaaggctgcgtaaaacacagggaa

SEQ ID NO: 28425 - DNA, 25 bp, E. coli
gctgcgttaaactcagggaaagatc

SEQ ID NO: 28426 - DNA, 25 bp, E. coli
gctgcgttaaacacagggaaagatc

SEQ ID NO: 28427 - DNA, 25 bp, E. coli
gaaggctgcgttaaacacagggaaa

SEQ ID NO: 28428 - DNA, 25 bp, E. coli
gaaggctgcgtttaacacagggaaa

SEQ ID NO: 28429 - DNA, 25 bp, E. coli
ggctgcgttaaacacagggaaagat

SEQ ID NO: 28430 - DNA, 25 bp, E. coli
ggctgcgttaaagacagggaaagat

SEQ ID NO: 28431 - DNA, 25 bp, E. coli
gagcgacgtaacctggtactacgtt

SEQ ID NO: 28432 - DNA, 25 bp, E. coli
gagcgacgtaacgtggtactacgtt

SEQ ID NO: 28433 - DNA, 25 bp, E. coli
actgggtgtgccgaaagatcaactg

SEQ ID NO: 28434 - DNA, 25 bp, E. coli
actgggtgtgcccaaagatcaactg

SEQ ID NO: 28435 - DNA, 25 bp, E. coli
ttgtggttgttgaccgctttagcgg

SEQ ID NO: 28436 - DNA, 25 bp, E. coli
ttgtggttgttgtccgctttagcgg

SEQ ID NO: 28437 - DNA, 25 bp, E. coli
tgccgaaagatctactgaatccagt

SEQ ID NO: 28438 - DNA, 25 bp, E. coli
tgccgaaagatcaactgaatccagt

SEQ ID NO: 28439 - DNA, 25 bp, E. coli
tcagtcatcgcacaagacggcaagg

SEQ ID NO: 28440 - DNA, 25 bp, E. coli
tcagtcatcgcagaagacggcaagg

SEQ ID NO: 28441 - DNA, 25 bp, E. coli
gctttccgcgcttcgttcagtcatc

SEQ ID NO: 28442 - DNA, 25 bp, E. coli
gctttccgcgctacgttcagtcatc

SEQ ID NO: 28443 - DNA, 25 bp, E. coli
gaatccagttccagcaatgttgttg

SEQ ID NO: 28444 - DNA, 25 bp, E. coli
gaatccagttcctgcaatgttgttg

SEQ ID NO: 28445 - DNA, 25 bp, E. coli
gacggcaaggtgttgtatcagagct

SEQ ID NO: 28446 - DNA, 25 bp, E. coli
gaaaccgcgattctggttgttgacc

SEQ ID NO: 28447 - DNA, 25 bp, E. coli
gaaaccgcgattgtggttgttgacc

SEQ ID NO: 28448 - DNA, 25 bp, E. coli
gacggcaaggtgatgtatcagagct

SEQ ID NO: 28449 - DNA, 25 bp, E. coli
cctggtactacgtttgctgcaacag

SEQ ID NO: 28450 - DNA, 25 bp, E. coli
cctggtactacgattgctgcaacag

SEQ ID NO: 28451 - DNA, 25 bp, E. coli
ggtggtaatcgtcctccgctttccg

SEQ ID NO: 28452 - DNA, 25 bp, E. coli
ggtggtaatcgtgctccgctttccg

SEQ ID NO: 28453 - DNA, 25 bp, E. coli
taaatgttcgtcagcccagggatgt

SEQ ID NO: 28454 - DNA, 25 bp, E. coli
taaatgttcgtctgcccagggatgt

SEQ ID NO: 28455 - DNA, 25 bp, E. coli
ttaacagtatcgacgacggcagcgg

SEQ ID NO: 28456 - DNA, 25 bp, E. coli
ttaacagtatcgtcgacggcagcgg

SEQ ID NO: 28457 - DNA, 25 bp, E. coli
tgaacaggtggcacaaggcattcgc

SEQ ID NO: 28458 - DNA, 25 bp, E. coli
tgacatgacgttacccgatctggcg

SEQ ID NO: 28459 - DNA, 25 bp, E. coli
tgacatgacgtttcccgatctggcg

SEQ ID NO: 28460 - DNA, 25 bp, E. coli
tgacggcgttagaacaggcagtgct

SEQ ID NO: 28461 - DNA, 25 bp, E. coli
tgaacaggtggctcaaggcattcgc

SEQ ID NO: 28462 - DNA, 25 bp, E. coli
tgacggcgttagtacaggcagtgct

SEQ ID NO: 28463 - DNA, 25 bp, E. coli
ccaatgttaattcgcatgggtgccg

SEQ ID NO: 28464 - DNA, 25 bp, E. coli
ccattccggtgaatggcgcgaagct

SEQ ID NO: 28465 - DNA, 25 bp, E. coli
ccagggatgtcggacaaattctgct

SEQ ID NO: 28466 - DNA, 25 bp, E. coli
ccaatgttaattggcatgggtgccg

SEQ ID NO: 28467 - DNA, 25 bp, E. coli
ccattccggtgattggcgcgaagct

SEQ ID NO: 28468 - DNA, 25 bp, E. coli
ccagggatgtcgcacaaattctgct

SEQ ID NO: 28469 - DNA, 25 bp, E. coli
gcagcggcccgcaaattaaagccat

SEQ ID NO: 28470 - DNA, 25 bp, E. coli
gcagcggcccgctaattaaagccat

SEQ ID NO: 28471 - DNA, 25 bp, E. coli
gccgtatccggcgtaccttatgcaa

SEQ ID NO: 28472 - DNA, 25 bp, E. coli
gccgtatccggcctaccttatgcaa

SEQ ID NO: 28473 - DNA, 25 bp, E. coli
gattatctggctctactggactggc

SEQ ID NO: 28474 - DNA, 25 bp, E. coli
gattatctggctgtactggactggc

SEQ ID NO: 28475 - DNA, 25 bp, E. coli
caaggattgccaacgaaaacagccc

SEQ ID NO: 28476 - DNA, 25 bp, E. coli
caaggattgccatcgaaaacagccc

SEQ ID NO: 28477 - DNA, 25 bp, E. coli
catggccaggccttaaaattgcagt

SEQ ID NO: 28478 - DNA, 25 bp, E. coli
catggccaggccataaaattgcagt

SEQ ID NO: 28479 - DNA, 25 bp, E. coli
tactcccgccgatgtcgaaggatgg

SEQ ID NO: 28480 - DNA, 25 bp, E. coli
tactcccgccgaagtcgaaggatgg

SEQ ID NO: 28481 - DNA, 25 bp, E. coli
aaacaggagcctttacgccagcaaa

SEQ ID NO: 28482 - DNA, 25 bp, E. coli
aaacaggagcctatacgccagcaaa

SEQ ID NO: 28483 - DNA, 25 bp, E. coli
tatgatgcggctttcgtagatggcg

SEQ ID NO: 28484 - DNA, 25 bp, E. coli
tatgatgcggctatcgtagatggcg

SEQ ID NO: 28485 - DNA, 25 bp, E. coli
tatatattcgggaccattcagggcg

SEQ ID NO: 28486 - DNA, 25 bp, E. coli
tattcgttacccaagcagagatggc

SEQ ID NO: 28487 - DNA, 25 bp, E. coli
tattcgttaccctagcagagatggc

SEQ ID NO: 28488 - DNA, 25 bp, E. coli
tatatattcgggtccattcagggcg

SEQ ID NO: 28489 - DNA, 25 bp, E. coli
gcttatctcttaacatggccgccag

SEQ ID NO: 28490 - DNA, 25 bp, E. coli
gcttatctcttatcatggccgccag

SEQ ID NO: 28491 - DNA, 25 bp, E. coli
gcagaactcttgttgaaatgcgcca

SEQ ID NO: 28492 - DNA, 25 bp, E. coli
gcaaccgtagaacctgcatggccag

SEQ ID NO: 28493 - DNA, 25 bp, E. coli
gcaaccgtagaagctgcatggccag

SEQ ID NO: 28494 - DNA, 25 bp, E. coli
gcagaactcttgatgaaatgcgcca

SEQ ID NO: 28495 - DNA, 25 bp, E. coli
gatcttgaccctcgtagcgggctta

SEQ ID NO: 28496 - DNA, 25 bp, E. coli
gatcttgaccctggtagcgggctta

SEQ ID NO: 28497 - DNA, 25 bp, E. coli
ttcaggccaaaaacccaaccgaggt

SEQ ID NO: 28498 - DNA, 25 bp, E. coli
tatgagttcaaaaataccgcgcctg

SEQ ID NO: 28499 - DNA, 25 bp, E. coli
ttcaggccaaaatcccaaccgaggt

SEQ ID NO: 28500 - DNA, 25 bp, E. coli
tatgagttcaaatataccgcgcctg

SEQ ID NO: 28501 - DNA, 25 bp, E. coli
ttatggatgtagtaggcgaacccgg

SEQ ID NO: 28502 - DNA, 25 bp, E. coli
ttatggatgtagaaggcgaacccgg

SEQ ID NO: 28503 - DNA, 25 bp, E. coli
tgatcaaatcatcgcacagacccgt

SEQ ID NO: 28504 - DNA, 25 bp, E. coli
tgatcaaatcatggcacagacccgt

SEQ ID NO: 28505 - DNA, 25 bp, E. coli
tgaactcgtggagcgaactgcctaa

SEQ ID NO: 28506 - DNA, 25 bp, E. coli
tgaactcgtggaccgaactgcctaa

SEQ ID NO: 28507 - DNA, 25 bp, E. coli
tctgccggtgcaactgttcgaaacg

SEQ ID NO: 28508 - DNA, 25 bp, E. coli
tctgcgcgctgccaaagttgaggtt

SEQ ID NO: 28509 - DNA, 25 bp, E. coli
tctgccggtgcatctgttcgaaacg

SEQ ID NO: 28510 - DNA, 25 bp, E. coli
tctgcgcgctgcgaaagttgaggtt

SEQ ID NO: 28511 - DNA, 25 bp, E. coli
gctatttagggcttacggcaccccg

SEQ ID NO: 28512 - DNA, 25 bp, E. coli
gctatttagggcatacggcaccccg

SEQ ID NO: 28513 - DNA, 25 bp, E. coli
gaactcgtttcctgtcatgccgggc

SEQ ID NO: 28514 - DNA, 25 bp, E. coli
gaactcgtttccagtcatgccgggc

SEQ ID NO: 28515 - DNA, 25 bp, E. coli
taatacggcctggatgctggcatgc

SEQ ID NO: 28516 - DNA, 25 bp, E. coli
taatacggcctgcatgctggcatgc

SEQ ID NO: 28517 - DNA, 25 bp, E. coli
gatgtcagccagtaccacgaagatt

SEQ ID NO: 28518 - DNA, 25 bp, E. coli
gatgtcagccagaaccacgaagatt

SEQ ID NO: 28519 - DNA, 25 bp, E. coli
cacggtggcgatcgtcagtatgaaa

SEQ ID NO: 28520 - DNA, 25 bp, E. coli
cacggtggcgatggtcagtatgaaa

SEQ ID NO: 28521 - DNA, 25 bp, E. coli
acaaggcgcgaaagtacagatggtc

SEQ ID NO: 28522 - DNA, 25 bp, E. coli
aacaggactgcggacgccggaatat

SEQ ID NO: 28523 - DNA, 25 bp, E. coli
aacaggactgcgcacgccggaatat

SEQ ID NO: 28524 - DNA, 25 bp, E. coli
acaaggcgcgaatgtacagatggtc

SEQ ID NO: 28525 - DNA, 25 bp, E. coli
tattgtcaccggaggcgcatccggc

SEQ ID NO: 28526 - DNA, 25 bp, E. coli
tattgtcaccggtggcgcatccggc

SEQ ID NO: 28527 - DNA, 25 bp, E. coli
gcgcgaatgtactgatggtcgatat

SEQ ID NO: 28528 - DNA, 25 bp, E. coli
ccataaaggttaacagttctggccg

SEQ ID NO: 28529 - DNA, 25 bp, E. coli
gcgcgaatgtacagatggtcgatat

SEQ ID NO: 28530 - DNA, 25 bp, E. coli
ccataaaggttatcagttctggccg

SEQ ID NO: 28531 - DNA, 25 bp, E. coli
gaatgtacagatcgtcgatattcac

SEQ ID NO: 28532 - DNA, 25 bp, E. coli
gaatgtacagatggtcgatattcac

SEQ ID NO: 28533 - DNA, 25 bp, E. coli
gattctggaaaaaacaggactgcgc

SEQ ID NO: 28534 - DNA, 25 bp, E. coli
gattctggaaaatacaggactgcgc

SEQ ID NO: 28535 - DNA, 25 bp, E. coli
ggtcagtatgaaagccataaaggtt

SEQ ID NO: 28536 - DNA, 25 bp, E. coli
ggtcagtatgaatgccataaaggtt

SEQ ID NO: 28537 - DNA, 25 bp, E. coli
tggaaaaaacaggactgcgcacgcc

SEQ ID NO: 28538 - DNA, 25 bp, E. coli
ggcgatggtcagaatgaaagccata

SEQ ID NO: 28539 - DNA, 25 bp, E. coli
tggaaaaaacagcactgcgcacgcc

SEQ ID NO: 28540 - DNA, 25 bp, E. coli
ggcgatggtcagtatgaaagccata

SEQ ID NO: 28541 - DNA, 25 bp, E. coli
caatcggaatcctctgtgtcaggtc

SEQ ID NO: 28542 - DNA, 25 bp, E. coli
caatcggaatccactgtgtcaggtc

SEQ ID NO: 28543 - DNA, 25 bp, E. coli
caggctgtcgttattgtcatggaaa

SEQ ID NO: 28544 - DNA, 25 bp, E. coli
caggctgtcgtttttgtcatggaaa

SEQ ID NO: 28545 - DNA, 25 bp, E. coli
aaaaaagatcgcattaagttcgccg

SEQ ID NO: 28546 - DNA, 25 bp, E. coli
aaaaaagatcgctttaagttcgccg

SEQ ID NO: 28547 - DNA, 25 bp, E. coli
ttggcgcaaaatactatctactgac

SEQ ID NO: 28548 - DNA, 25 bp, E. coli
ttggcgcaaaattctatctactgac

SEQ ID NO: 28549 - DNA, 25 bp, E. coli
tttacgcccgtctaattgcccgttg

SEQ ID NO: 28550 - DNA, 25 bp, E. coli
tttacgcccgtcaaattgcccgttg

SEQ ID NO: 28551 - DNA, 25 bp, E. coli
tcgccgttcatcgtcacttatgtga

SEQ ID NO: 28552 - DNA, 25 bp, E. coli
tcgccgttcatcctcacttatgtga

SEQ ID NO: 28553 - DNA, 25 bp, E. coli
gcatcagtgtcggtacgcaaagcat

SEQ ID NO: 28554 - DNA, 25 bp, E. coli
gcatcagtgtcgctacgcaaagcat

SEQ ID NO: 28555 - DNA, 25 bp, E. coli
gcaaagcattcgacatcaatcggaa

SEQ ID NO: 28556 - DNA, 25 bp, E. coli
gcaaagcattcgtcatcaatcggaa

SEQ ID NO: 28557 - DNA, 25 bp, E. coli
cccgttgcatggcaatttggcgcaa

SEQ ID NO: 28558 - DNA, 25 bp, E. coli
cccgttgcatgggaatttggcgcaa

SEQ ID NO: 28559 - DNA, 25 bp, E. coli
gtgacataaccgataagtaaaggcc

SEQ ID NO: 28560 - DNA, 25 bp, E. coli
gtgacataaccgttaagtaaaggcc

SEQ ID NO: 28561 - DNA, 25 bp, E. coli
gtgtcaggtcttgccactgcttcaa

SEQ ID NO: 28562 - DNA, 25 bp, E. coli
gtgtcaggtcttcccactgcttcaa

SEQ ID NO: 28563 - DNA, 25 bp, E. coli
taaaaatgttaacgcagcgcgagct

SEQ ID NO: 28564 - DNA, 25 bp, E. coli
taaaaatgttaaggcagcgcgagct

SEQ ID NO: 28565 - DNA, 25 bp, E. coli
agctgaagctgtaccaatggatggc

SEQ ID NO: 28566 - DNA, 25 bp, E. coli
agctgaagctgttccaatggatggc

SEQ ID NO: 28567 - DNA, 25 bp, E. coli
tatctatctgctttcctgctggcgg

SEQ ID NO: 28568 - DNA, 25 bp, E. coli
tatctatctgctatcctgctggcgg

SEQ ID NO: 28569 - DNA, 25 bp, E. coli
tttatctcgggcaatcgtccgggcg

SEQ ID NO: 28570 - DNA, 25 bp, E. coli
tttatctcgggctatcgtccgggcg

SEQ ID NO: 28571 - DNA, 25 bp, E. coli
tccttgaactggttgggcgacaccc

SEQ ID NO: 28572 - DNA, 25 bp, E. coli
tccttgaactggatgggcgacaccc

SEQ ID NO: 28573 - DNA, 25 bp, E. coli
tcaggtaaatcgtccctcacggcaa

SEQ ID NO: 28574 - DNA, 25 bp, E. coli
tcaggtaaatcgaccctcacggcaa

SEQ ID NO: 28575 - DNA, 25 bp, E. coli
tcttggcattgaagaacaaaccgcg

SEQ ID NO: 28576 - DNA, 25 bp, E. coli
tcttggcattgatgaacaaaccgcg

SEQ ID NO: 28577 - DNA, 25 bp, E. coli
gctggcgggcgtacaagtttcgcaa

SEQ ID NO: 28578 - DNA, 25 bp, E. coli
gctggcgggcgttcaagtttcgcaa

SEQ ID NO: 28579 - DNA, 25 bp, E. coli
gcacatgtgcaccaaaagccctcaa

SEQ ID NO: 28580 - DNA, 25 bp, E. coli
gcacatgtgcacgaaaagccctcaa

SEQ ID NO: 28581 - DNA, 25 bp, E. coli
gaaattctgcaagcgtcactacgcg

SEQ ID NO: 28582 - DNA, 25 bp, E. coli
gaaattctgcaaccgtcactacgcg

SEQ ID NO: 28583 - DNA, 25 bp, E. coli
gttatctgcgaagtaaagcggcaca

SEQ ID NO: 28584 - DNA, 25 bp, E. coli
gttatctgcgaactaaagcggcaca

SEQ ID NO: 28585 - DNA, 25 bp, E. coli
caatttgcatatcaaatggttaatt

SEQ ID NO: 28586 - DNA, 25 bp, E. coli
caatttgcatatgaaatggttaatt

SEQ ID NO: 28587 - DNA, 25 bp, E. coli
caaatggttaatttttgcacaggac

SEQ ID NO: 28588 - DNA, 25 bp, E. coli
cacaggactggtcggttcggaacgg

SEQ ID NO: 28589 - DNA, 25 bp, E. coli
caaatggttaatatttgcacaggac

SEQ ID NO: 28590 - DNA, 25 bp, E. coli
cacaggactggtgggttcggaacgg

SEQ ID NO: 28591 - DNA, 25 bp, E. coli
tacttctgctaaaaattttctctga

SEQ ID NO: 28592 - DNA, 25 bp, E. coli
tacttctgctaataattttctctga

SEQ ID NO: 28593 - DNA, 25 bp, E. coli
tttttgcacaggtctggtgggttcg

SEQ ID NO: 28594 - DNA, 25 bp, E. coli
tttttgcacaggactggtgggttcg

SEQ ID NO: 28595 - DNA, 25 bp, E. coli
tcggaacggactttcccttctgaat

SEQ ID NO: 28596 - DNA, 25 bp, E. coli
tcggaacggactatcccttctgaat

SEQ ID NO: 28597 - DNA, 25 bp, E. coli
tcgtggttatacttctgctaataat

SEQ ID NO: 28598 - DNA, 25 bp, E. coli
tcgtggttatacatctgctaataat

SEQ ID NO: 28599 - DNA, 25 bp, E. coli
taatttttgcactggactggtgggt

SEQ ID NO: 28600 - DNA, 25 bp, E. coli
taatttttgcacaggactggtgggt

SEQ ID NO: 28601 - DNA, 25 bp, E. coli
cccttctgaataaaggtcttcgtgg

SEQ ID NO: 28602 - DNA, 25 bp, E. coli
cccttctgaatataggtcttcgtgg

SEQ ID NO: 28603 - DNA, 25 bp, E. coli
ggtcttcgtggtaatacttctgcta

SEQ ID NO: 28604 - DNA, 25 bp, E. coli
ggtcttcgtggttatacttctgcta

SEQ ID NO: 28605 - DNA, 25 bp, E. coli
tggttaatttttccacaggactggt

SEQ ID NO: 28606 - DNA, 25 bp, E. coli
tggttaatttttgcacaggactggt

SEQ ID NO: 28607 - DNA, 25 bp, E. coli
caagcactcatatgcgtttaagccg

SEQ ID NO: 28608 - DNA, 25 bp, E. coli
caagcactcataagcgtttaagccg

SEQ ID NO: 28609 - DNA, 25 bp, E. coli
aatgatgggaacataaatgctgata

SEQ ID NO: 28610 - DNA, 25 bp, E. coli
aatgctgataaaaggtatgaattcc

SEQ ID NO: 28611 - DNA, 25 bp, E. coli
aatgatgggaacttaaatgctgata

SEQ ID NO: 28612 - DNA, 25 bp, E. coli
aatgctgataaatggtatgaattcc

SEQ ID NO: 28613 - DNA, 25 bp, E. coli
cactgtatgatataaatgatgggaa

SEQ ID NO: 28614 - DNA, 25 bp, E. coli
cactgtatgataaaaatgatgggaa

SEQ ID NO: 28615 - DNA, 25 bp, E. coli
cgtttaagccgtgtgataattatcc

SEQ ID NO: 28616 - DNA, 25 bp, E. coli
cgtttaagccgtctgataattatcc

SEQ ID NO: 28617 - DNA, 25 bp, E. coli
aaaacatggctactgcaagcactca

SEQ ID NO: 28618 - DNA, 25 bp, E. coli
aaaacatggctagtgcaagcactca

SEQ ID NO: 28619 - DNA, 25 bp, E. coli
tgcagtacttgtttcaaaacatggc

SEQ ID NO: 28620 - DNA, 25 bp, E. coli
tgcagtacttgtatcaaaacatggc

SEQ ID NO: 28621 - DNA, 25 bp, E. coli
gactcacttagtagtggtgcagtac

SEQ ID NO: 28622 - DNA, 25 bp, E. coli
gactcacttagttgtggtgcagtac

SEQ ID NO: 28623 - DNA, 25 bp, E. coli
gaactctggttttgataacgaaacg

SEQ ID NO: 28624 - DNA, 25 bp, E. coli
gaactctggtttagataacgaaacg

SEQ ID NO: 28625 - DNA, 25 bp, E. coli
cgaaacgatttctaatatccacgat

SEQ ID NO: 28626 - DNA, 25 bp, E. coli
cgaaacgatttcaaatatccacgat

SEQ ID NO: 28627 - DNA, 25 bp, E. coli
taattatccaataaagaactctggt

SEQ ID NO: 28628 - DNA, 25 bp, E. coli
taattatccaattaagaactctggt

SEQ ID NO: 28629 - DNA, 25 bp, E. coli
aagatacggcgttcagtgaggacga

SEQ ID NO: 28630 - DNA, 25 bp, E. coli
tacggcgtacagagaggacgatcag

SEQ ID NO: 28631 - DNA, 25 bp, E. coli
tacggcgtacagtgaggacgatcag

SEQ ID NO: 28632 - DNA, 25 bp, E. coli
atcagccgattcagccaaacgtcga

SEQ ID NO: 28633 - DNA, 25 bp, E. coli
atcagccgattctgccaaacgtcga

SEQ ID NO: 28634 - DNA, 25 bp, E. coli
aacgtcgactctcccggtgtattcg

SEQ ID NO: 28635 - DNA, 25 bp, E. coli
aacgccggaattcgcagagctgaag

SEQ ID NO: 28636 - DNA, 25 bp, E. coli
aagatacggcgtacagtgaggacga

SEQ ID NO: 28637 - DNA, 25 bp, E. coli
aacgccggaattggcagagctgaag

SEQ ID NO: 28638 - DNA, 25 bp, E. coli
aacgtcgactctgccggtgtattcg

SEQ ID NO: 28639 - DNA, 25 bp, E. coli
gccgattcagcctaacgtcgactct

SEQ ID NO: 28640 - DNA, 25 bp, E. coli
gccgattcagccaaacgtcgactct

SEQ ID NO: 28641 - DNA, 25 bp, E. coli
ccaaacgtcgacactcccggtgtat

SEQ ID NO: 28642 - DNA, 25 bp, E. coli
gactctcccggtgtattcggttgcc

SEQ ID NO: 28643 - DNA, 25 bp, E. coli
gactctcccggtctattcggttgcc

SEQ ID NO: 28644 - DNA, 25 bp, E. coli
ccgcaaggtggtaggctgtgcccag

SEQ ID NO: 28645 - DNA, 25 bp, E. coli
cgacaacgccggaattggcagagct

SEQ ID NO: 28646 - DNA, 25 bp, E. coli
cgacaacgccggtattggcagagct

SEQ ID NO: 28647 - DNA, 25 bp, E. coli
ccgcaaggtggttggctgtgcccag

SEQ ID NO: 28648 - DNA, 25 bp, E. coli
ccaaacgtcgactctcccggtgtat

SEQ ID NO: 28649 - DNA, 25 bp, E. coli
gttggctgtgccgagcagaactgac

SEQ ID NO: 28650 - DNA, 25 bp, E. coli
gttggctgtgcccagcagaactgac

SEQ ID NO: 28651 - DNA, 25 bp, E. coli
cacatctgaaatgctggcggcaacg

SEQ ID NO: 28652 - DNA, 25 bp, E. coli
cacatctgaaatcctggcggcaacg

SEQ ID NO: 28653 - DNA, 25 bp, E. coli
cagtggtcacaatatgggtcagtac

SEQ ID NO: 28654 - DNA, 25 bp, E. coli
cagtggtcacaaaatgggtcagtac

SEQ ID NO: 28655 - DNA, 25 bp, E. coli
tacataaggtagtgtctgcggccag

SEQ ID NO: 28656 - DNA, 25 bp, E. coli
tacataaggtagagtctgcggccag

SEQ ID NO: 28657 - DNA, 25 bp, E. coli
tatgagctggctaacgggaaataca

SEQ ID NO: 28658 - DNA, 25 bp, E. coli
tatgagctggcttacgggaaataca

SEQ ID NO: 28659 - DNA, 25 bp, E. coli
tataccagtaatcccagcgtgacga

SEQ ID NO: 28660 - DNA, 25 bp, E. coli
tataccagtaatgccagcgtgacga

SEQ ID NO: 28661 - DNA, 25 bp, E. coli
tttatggcagcggacatcgacaggg

SEQ ID NO: 28662 - DNA, 25 bp, E. coli
tttatggcagcgcacatcgacaggg

SEQ ID NO: 28663 - DNA, 25 bp, E. coli
tgaatacaagtgctgcaggagcgca

SEQ ID NO: 28664 - DNA, 25 bp, E. coli
tgaatacaagtggtgcaggagcgca

SEQ ID NO: 28665 - DNA, 25 bp, E. coli
tccagctcagtactgcaaccaacag

SEQ ID NO: 28666 - DNA, 25 bp, E. coli
tccagctcagtagtgcaaccaacag

SEQ ID NO: 28667 - DNA, 25 bp, E. coli
tcatagtgtcacaggcgcatcagca

SEQ ID NO: 28668 - DNA, 25 bp, E. coli
tcatagtgtcactggcgcatcagca

SEQ ID NO: 28669 - DNA, 25 bp, E. coli
gcctatgaccttcctaacgggaaat

SEQ ID NO: 28670 - DNA, 25 bp, E. coli
gcctatgaccttgctaacgggaaat

SEQ ID NO: 28671 - DNA, 25 bp, E. coli
gaaatatactgcacaggacgctacg

SEQ ID NO: 28672 - DNA, 25 bp, E. coli
gaaatatactgctcaggacgctacg

SEQ ID NO: 28673 - DNA, 25 bp, E. coli
ccggaccgccctaacttgtttgctg

SEQ ID NO: 28674 - DNA, 25 bp, E. coli
ccggaccgcccttacttgtttgctg

SEQ ID NO: 28675 - DNA, 25 bp, E. coli
acttgtttgctgctgtttgtgccga

SEQ ID NO: 28676 - DNA, 25 bp, E. coli
aaatcgttccttgagcttatcgcgc

SEQ ID NO: 28677 - DNA, 25 bp, E. coli
acttgtttgctggtgtttgtgccga

SEQ ID NO: 28678 - DNA, 25 bp, E. coli
aaatcgttccttcagcttatcgcgc

SEQ ID NO: 28679 - DNA, 25 bp, E. coli
ttatcgcgctcgaccagccaggact

SEQ ID NO: 28680 - DNA, 25 bp, E. coli
ttatcgcgctcgtccagccaggact

SEQ ID NO: 28681 - DNA, 25 bp, E. coli
tgtttgtgccgagttagatagacgc

SEQ ID NO: 28682 - DNA, 25 bp, E. coli
tgtttgtgccgacttagatagacgc

SEQ ID NO: 28683 - DNA, 25 bp, E. coli
gcgctatttcttgaactgcaaaaac

SEQ ID NO: 28684 - DNA, 25 bp, E. coli
ccagccaggactcctggcgagagtc

SEQ ID NO: 28685 - DNA, 25 bp, E. coli
ccagccaggactgctggcgagagtc

SEQ ID NO: 28686 - DNA, 25 bp, E. coli
gcgctatttcttcaactgcaaaaac

SEQ ID NO: 28687 - DNA, 25 bp, E. coli
gacgcaacttaagcgttcacgacgc

SEQ ID NO: 28688 - DNA, 25 bp, E. coli
gacgcaacttaaccgttcacgacgc

SEQ ID NO: 28689 - DNA, 25 bp, E. coli
gtcgtcaaccggctaaactacgtca

SEQ ID NO: 28690 - DNA, 25 bp, E. coli
gtcgtcaaccgggtaaactacgtca

SEQ ID NO: 28691 - DNA, 25 bp, E. coli
ggcgatgttgcgctatttcttgaac

SEQ ID NO: 28692 - DNA, 25 bp, E. coli
ggcgatgttgcggtatttcttgaac

SEQ ID NO: 28693 - DNA, 25 bp, E. coli
taaactacgtcactttactgttgaa

SEQ ID NO: 28694 - DNA, 25 bp, E. coli
taaactacgtcagtttactgttgaa

SEQ ID NO: 28695 - DNA, 25 bp, E. coli
aatatcacggtgattaccaacagtc

SEQ ID NO: 28696 - DNA, 25 bp, E. coli
aatatcacggtgtttaccaacagtc

SEQ ID NO: 28697 - DNA, 25 bp, E. coli
aaataaagacattactctggtcgtc

SEQ ID NO: 28698 - DNA, 25 bp, E. coli
aaataaagacataactctggtcgtc

SEQ ID NO: 28699 - DNA, 25 bp, E. coli
tatcgccgaaggtttaatgaccgcc

SEQ ID NO: 28700 - DNA, 25 bp, E. coli
tatcgccgaaggattaatgaccgcc

SEQ ID NO: 28701 - DNA, 25 bp, E. coli
ttgacattattaataccgatgatgc

SEQ ID NO: 28702 - DNA, 25 bp, E. coli
ttaatgaccgcctaaaatatcacgg

SEQ ID NO: 28703 - DNA, 25 bp, E. coli
ttaatgaccgccaaaaatatcacgg

SEQ ID NO: 28704 - DNA, 25 bp, E. coli
ttgacattattattaccgatgatgc

SEQ ID NO: 28705 - DNA, 25 bp, E. coli
tgattgccgttcacgattcatcgaa

SEQ ID NO: 28706 - DNA, 25 bp, E. coli
tgattgccgttctcgattcatcgaa

SEQ ID NO: 28707 - DNA, 25 bp, E. coli
ttgccctttccgtaaataaagacat

SEQ ID NO: 28708 - DNA, 25 bp, E. coli
ttgccctttccgaaaataaagacat

SEQ ID NO: 28709 - DNA, 25 bp, E. coli
cggtgattaccaacagtctcccggc

SEQ ID NO: 28710 - DNA, 25 bp, E. coli
cggtgattaccatcagtctcccggc

SEQ ID NO: 28711 - DNA, 25 bp, E. coli
gtgctgatggtattgatgcggttaa

SEQ ID NO: 28712 - DNA, 25 bp, E. coli
gtgctgatggtaatgatgcggttaa

SEQ ID NO: 28713 - DNA, 25 bp, E. coli
tggataaactggcattgcagaagac

SEQ ID NO: 28714 - DNA, 25 bp, E. coli
tggataaactgggattgcagaagac

SEQ ID NO: 28715 - DNA, 25 bp, E. coli
gatgcggttaatggtattacgacct

SEQ ID NO: 28716 - DNA, 25 bp, E. coli
gatgcggttaatcgtattacgacct

SEQ ID NO: 28717 - DNA, 25 bp, E. coli
tactgagactgtataacctagggaa

SEQ ID NO: 28718 - DNA, 25 bp, E. coli
tactgagactgtttaacctagggaa

SEQ ID NO: 28719 - DNA, 25 bp, E. coli
tatgaattaccactccttacacccg

SEQ ID NO: 28720 - DNA, 25 bp, E. coli
tatgaattaccagtccttacacccg

SEQ ID NO: 28721 - DNA, 25 bp, E. coli
tgattaagacatccccaaagttagt

SEQ ID NO: 28722 - DNA, 25 bp, E. coli
tgattaagacatgcccaaagttagt

SEQ ID NO: 28723 - DNA, 25 bp, E. coli
gccaacaggcatagggtgcaatcac

SEQ ID NO: 28724 - DNA, 25 bp, E. coli
ccttagcgttcaggtacatgcggaa

SEQ ID NO: 28725 - DNA, 25 bp, E. coli
ccttagcgttcacgtacatgcggaa

SEQ ID NO: 28726 - DNA, 25 bp, E. coli
gccaacaggcattgggtgcaatcac

SEQ ID NO: 28727 - DNA, 25 bp, E. coli
gctttttattattgctggcggacgc

SEQ ID NO: 28728 - DNA, 25 bp, E. coli
gcggccccttcacatacatctttag

SEQ ID NO: 28729 - DNA, 25 bp, E. coli
gcggccccttcagatacatctttag

SEQ ID NO: 28730 - DNA, 25 bp, E. coli
gctttttattatagctggcggacgc

SEQ ID NO: 28731 - DNA, 25 bp, E. coli
ggccggtcaggtcgtagttctacta

SEQ ID NO: 28732 - DNA, 25 bp, E. coli
ggccggtcaggtggtagttctacta

SEQ ID NO: 28733 - DNA, 25 bp, E. coli
gttttgtatcaagtactcacccggg

SEQ ID NO: 28734 - DNA, 25 bp, E. coli
gttttgtatcaactactcacccggg

SEQ ID NO: 28735 - DNA, 25 bp, E. coli
ggaatgtaaaaaaggccgcgagcgc

SEQ ID NO: 28736 - DNA, 25 bp, E. coli
tggcggacgctccttaatatttaag

SEQ ID NO: 28737 - DNA, 25 bp, E. coli
tggcggacgctcgttaatatttaag

SEQ ID NO: 28738 - DNA, 25 bp, E. coli
ggaatgtaaaaatggccgcgagcgc

SEQ ID NO: 28739 - DNA, 25 bp, E. coli
aatcattagcggaaccgggtctgcc

SEQ ID NO: 28740 - DNA, 25 bp, E. coli
aatcattagcggtaccgggtctgcc

SEQ ID NO: 28741 - DNA, 25 bp, E. coli
caaagcaacatgcactctgatcggc

SEQ ID NO: 28742 - DNA, 25 bp, E. coli
caaagcaacatggactctgatcggc

SEQ ID NO: 28743 - DNA, 25 bp, E. coli
taaatatagtgctgccactggcgga

SEQ ID NO: 28744 - DNA, 25 bp, E. coli
taaatatagtgcagccactggcgga

SEQ ID NO: 28745 - DNA, 25 bp, E. coli
aaatattcggagtcagcggctctgg

SEQ ID NO: 28746 - DNA, 25 bp, E. coli
aaatattcggagacagcggctctgg

SEQ ID NO: 28747 - DNA, 25 bp, E. coli
tagaattgccgcgactgacgatgga

SEQ ID NO: 28748 - DNA, 25 bp, E. coli
taggccccggtagtctgaatgttca

SEQ ID NO: 28749 - DNA, 25 bp, E. coli
taggccccggtactctgaatgttca

SEQ ID NO: 28750 - DNA, 25 bp, E. coli
tagaattgccgccactgacgatgga

SEQ ID NO: 28751 - DNA, 25 bp, E. coli
ttaatccgctgaatgggcgtaccgg

SEQ ID NO: 28752 - DNA, 25 bp, E. coli
ttaatccgctgattgggcgtaccgg

SEQ ID NO: 28753 - DNA, 25 bp, E. coli
tgatcagcctgagtggaaaaccggg

SEQ ID NO: 28754 - DNA, 25 bp, E. coli
tgatcagcctgactggaaaaccggg

SEQ ID NO: 28755 - DNA, 25 bp, E. coli
tgaatatcgatcaggtcagcgcacc

SEQ ID NO: 28756 - DNA, 25 bp, E. coli
tgaatatcgatctggtcagcgcacc

SEQ ID NO: 28757 - DNA, 25 bp, E. coli
gctataaatctgtggccaacgccga

SEQ ID NO: 28758 - DNA, 25 bp, E. coli
gctataaatctgaggccaacgccga

SEQ ID NO: 28759 - DNA, 25 bp, E. coli
taaggactggaaagtcacagcccgc

SEQ ID NO: 28760 - DNA, 25 bp, E. coli
taaggactggaatgtcacagcccgc

SEQ ID NO: 28761 - DNA, 25 bp, E. coli
cacaggaagattttattgccgcgct

SEQ ID NO: 28762 - DNA, 25 bp, E. coli
cacaggaagattatattgccgcgct

SEQ ID NO: 28763 - DNA, 25 bp, E. coli
taaatcttattcgtcatggcggcaa

SEQ ID NO: 28764 - DNA, 25 bp, E. coli
taaatcttattcctcatggcggcaa

SEQ ID NO: 28765 - DNA, 25 bp, E. coli
acattaatttgtgagcagcctggcg

SEQ ID NO: 28766 - DNA, 25 bp, E. coli
acattaatttgtcagcagcctggcg

SEQ ID NO: 28767 - DNA, 25 bp, E. coli
taccttgcggtacgtgaagacaacc

SEQ ID NO: 28768 - DNA, 25 bp, E. coli
taccttgcggtaggtgaagacaacc

SEQ ID NO: 28769 - DNA, 25 bp, E. coli
tattgactgtcatcgtcgccagcac

SEQ ID NO: 28770 - DNA, 25 bp, E. coli
tattgactgtcaacgtcgccagcac

SEQ ID NO: 28771 - DNA, 25 bp, E. coli
tgatattcacgcttttgccggcaga

SEQ ID NO: 28772 - DNA, 25 bp, E. coli
tgatattcacgcatttgccggcaga

SEQ ID NO: 28773 - DNA, 25 bp, E. coli
gccgcaatgccacacgggaagattt

SEQ ID NO: 28774 - DNA, 25 bp, E. coli
gccgcaatgccagacgggaagattt

SEQ ID NO: 28775 - DNA, 25 bp, E. coli
cctttggaggcgtactggcttgcgt

SEQ ID NO: 28776 - DNA, 25 bp, E. coli
cctttggaggcgaactggcttgcgt

SEQ ID NO: 28777 - DNA, 25 bp, E. coli
gaacttgttattgacgatccgacct

SEQ ID NO: 28778 - DNA, 25 bp, E. coli
gaacttgttattcacgatccgacct

SEQ ID NO: 28779 - DNA, 25 bp, E. coli
gaaaaggatattgccacaccagcag

SEQ ID NO: 28780 - DNA, 25 bp, E. coli
gaaaaggatattcccacaccagcag

SEQ ID NO: 28781 - DNA, 25 bp, E. coli
cgttcgtcgggctgagatcaaggct

SEQ ID NO: 28782 - DNA, 25 bp, E. coli
cgttcgtcgggcagagatcaaggct

SEQ ID NO: 28783 - DNA, 25 bp, E. coli
aatgttacgggcgtgctgactccag

SEQ ID NO: 28784 - DNA, 25 bp, E. coli
aatgttacgggcctgctgactccag

SEQ ID NO: 28785 - DNA, 25 bp, E. coli
tacagcggagtctggctcaaagacg

SEQ ID NO: 28786 - DNA, 25 bp, E. coli
tacagcggagtcaggctcaaagacg

SEQ ID NO: 28787 - DNA, 25 bp, E. coli
acggtgacgtggtcgaatcttgagc

SEQ ID NO: 28788 - DNA, 25 bp, E. coli
acggtgacgtggacgaatcttgagc

SEQ ID NO: 28789 - DNA, 25 bp, E. coli
aaacccgacgggtaatcattgcagg

SEQ ID NO: 28790 - DNA, 25 bp, E. coli
aaacccgacgggaaatcattgcagg

SEQ ID NO: 28791 - DNA, 25 bp, E. coli
tttcctggacagatttacagcggag

SEQ ID NO: 28792 - DNA, 25 bp, E. coli
tttcctggacagttttacagcggag

SEQ ID NO: 28793 - DNA, 25 bp, E. coli
tgtatttgcggaacggaaagtaccg

SEQ ID NO: 28794 - DNA, 25 bp, E. coli
tgtatttgcggatcggaaagtaccg

SEQ ID NO: 28795 - DNA, 25 bp, E. coli
tcaaagacgtacactaataaacccg

SEQ ID NO: 28796 - DNA, 25 bp, E. coli
tcaaagacgtactctaataaacccg

SEQ ID NO: 28797 - DNA, 25 bp, E. coli
tcttgagcagggaatgggatcttat

SEQ ID NO: 28798 - DNA, 25 bp, E. coli
tcttgagcagggtatgggatcttat

SEQ ID NO: 28799 - DNA, 25 bp, E. coli
gctgtatgttgtatatttccctgga

SEQ ID NO: 28800 - DNA, 25 bp, E. coli
gctgtatgttgtttatttccctgga

SEQ ID NO: 28801 - DNA, 25 bp, E. coli
gaaagtaccgaagataaccattaat

SEQ ID NO: 28802 - DNA, 25 bp, E. coli
gaaagtaccgaacataaccattaat

SEQ ID NO: 28803 - DNA, 25 bp, E. coli
cattaatgacaatacggtgacgtgg

SEQ ID NO: 28804 - DNA, 25 bp, E. coli
cattaatgacaaaacggtgacgtgg

SEQ ID NO: 28805 - DNA, 25 bp, E. coli
aatgatgttattctgcgggcggttt

SEQ ID NO: 28806 - DNA, 25 bp, E. coli
aatgatgttattgtgcgggcggttt

SEQ ID NO: 28807 - DNA, 25 bp, E. coli
cagcgcgaggctggcctttgaacgc

SEQ ID NO: 28808 - DNA, 25 bp, E. coli
cagcgcgaggctcgcctttgaacgc

SEQ ID NO: 28809 - DNA, 25 bp, E. coli
taaacgctgttatctgcaattaaga

SEQ ID NO: 28810 - DNA, 25 bp, E. coli
tacgacgtaaaatgatgtgaagcaa

SEQ ID NO: 28811 - DNA, 25 bp, E. coli
taaacgctgttaactgcaattaaga

SEQ ID NO: 28812 - DNA, 25 bp, E. coli
tacgacgtaaaaagatgtgaagcaa

SEQ ID NO: 28813 - DNA, 25 bp, E. coli
tatatcatcatagattaaacgctgt

SEQ ID NO: 28814 - DNA, 25 bp, E. coli
tatatcatcatacattaaacgctgt

SEQ ID NO: 28815 - DNA, 25 bp, E. coli
tgaattaagataggtgagtacgacg

SEQ ID NO: 28816 - DNA, 25 bp, E. coli
tgaattaagatacgtgagtacgacg

SEQ ID NO: 28817 - DNA, 25 bp, E. coli
gcctttgaacgcaggtgaagaaaga

SEQ ID NO: 28818 - DNA, 25 bp, E. coli
gcctttgaacgctggtgaagaaaga

SEQ ID NO: 28819 - DNA, 25 bp, E. coli
gcgtgaacgcctttccaaaagaaaa

SEQ ID NO: 28820 - DNA, 25 bp, E. coli
gcgtgaacgcctatccaaaagaaaa

SEQ ID NO: 28821 - DNA, 25 bp, E. coli
gaagcaaatcacatcagtgtaatcg

SEQ ID NO: 28822 - DNA, 25 bp, E. coli
gaagcaaatcacttcagtgtaatcg

SEQ ID NO: 28823 - DNA, 25 bp, E. coli
gaaatgtaacaagtgtgaaaaccga

SEQ ID NO: 28824 - DNA, 25 bp, E. coli
gaaatgtaacaactgtgaaaaccga

SEQ ID NO: 28825 - DNA, 25 bp, E. coli
taatctgcggtgtaacgtgatcagg

SEQ ID NO: 28826 - DNA, 25 bp, E. coli
taatctgcggtgaaacgtgatcagg

SEQ ID NO: 28827 - DNA, 25 bp, E. coli
aattaccccttgttgcagatgtgtg

SEQ ID NO: 28828 - DNA, 25 bp, E. coli
aattaccccttgatgcagatgtgtg

SEQ ID NO: 28829 - DNA, 25 bp, E. coli
caacgggaaggcttgatgacgcact

SEQ ID NO: 28830 - DNA, 25 bp, E. coli
caacgggaaggcatgatgacgcact

SEQ ID NO: 28831 - DNA, 25 bp, E. coli
tacctatagtgtccgaaacgtacca

SEQ ID NO: 28832 - DNA, 25 bp, E. coli
tacctatagtgtgcgaaacgtacca

SEQ ID NO: 28833 - DNA, 25 bp, E. coli
ttttgcgcagagaaaaccgcttcag

SEQ ID NO: 28834 - DNA, 25 bp, E. coli
ttttaatatcgatgaatggcgggca

SEQ ID NO: 28835 - DNA, 25 bp, E. coli
ttttaatatcgaagaatggcgggca

SEQ ID NO: 28836 - DNA, 25 bp, E. coli
ttttgcgcagagtaaaccgcttcag

SEQ ID NO: 28837 - DNA, 25 bp, E. coli
gaaacgactgcatttcaggaacgct

SEQ ID NO: 28838 - DNA, 25 bp, E. coli
gaaacgactgcaattcaggaacgct

SEQ ID NO: 28839 - DNA, 25 bp, E. coli
gatttaccgtacatacagatgcagc

SEQ ID NO: 28840 - DNA, 25 bp, E. coli
gatttaccgtacttacagatgcagc

SEQ ID NO: 28841 - DNA, 25 bp, E. coli
tggcaatccagtatcgccgatgtaa

SEQ ID NO: 28842 - DNA, 25 bp, E. coli
tggcaatccagtttcgccgatgtaa

SEQ ID NO: 28843 - DNA, 25 bp, E. coli
ggccgcagatgtcccgaatttccag

SEQ ID NO: 28844 - DNA, 25 bp, E. coli
ggccgcagatgtgccgaatttccag

SEQ ID NO: 28845 - DNA, 25 bp, E. coli
gatgcagcatatcgtaacggagact

SEQ ID NO: 28846 - DNA, 25 bp, E. coli
gatgcagcatatggtaacggagact

SEQ ID NO: 28847 - DNA, 25 bp, E. coli
gacgcactgccactgttacagcgag

SEQ ID NO: 28848 - DNA, 25 bp, E. coli
gacgcactgccagtgttacagcgag

SEQ ID NO: 28849 - DNA, 25 bp, E. coli
tactgctgcaaaatgctcttggtgg

SEQ ID NO: 28850 - DNA, 25 bp, E. coli
tactgctgcaaattgctcttggtgg

SEQ ID NO: 28851 - DNA, 25 bp, E. coli
tatcttcgtcactgcgctcattagt

SEQ ID NO: 28852 - DNA, 25 bp, E. coli
tatcttcgtcacagcgctcattagt

SEQ ID NO: 28853 - DNA, 25 bp, E. coli
tttgcgtacggtagcagccgcacta

SEQ ID NO: 28854 - DNA, 25 bp, E. coli
tattttccgccgggaaagtgggctg

SEQ ID NO: 28855 - DNA, 25 bp, E. coli
tttgcgtacggttgcagccgcacta

SEQ ID NO: 28856 - DNA, 25 bp, E. coli
tattttccgccgcgaaagtgggctg

SEQ ID NO: 28857 - DNA, 25 bp, E. coli
tcttagtccagctaccgagctttcg

SEQ ID NO: 28858 - DNA, 25 bp, E. coli
tcttagtccagcaaccgagctttcg

SEQ ID NO: 28859 - DNA, 25 bp, E. coli
gcgtacggttgctgccgcactactg

SEQ ID NO: 28860 - DNA, 25 bp, E. coli
gcgtacggttgcagccgcactactg

SEQ ID NO: 28861 - DNA, 25 bp, E. coli
gcagccgcactagtgctgcaaattg

SEQ ID NO: 28862 - DNA, 25 bp, E. coli
gcagccgcactactgctgcaaattg

SEQ ID NO: 28863 - DNA, 25 bp, E. coli
gcactactgctggaaattgctcttg

SEQ ID NO: 28864 - DNA, 25 bp, E. coli
gcactactgctgcaaattgctcttg

SEQ ID NO: 28865 - DNA, 25 bp, E. coli
cgccgggaaagtgggctgtagaaca

SEQ ID NO: 28866 - DNA, 25 bp, E. coli
cgccgggaaagtcggctgtagaaca

SEQ ID NO: 28867 - DNA, 25 bp, E. coli
gtattcttagtcgagcaaccgagct

SEQ ID NO: 28868 - DNA, 25 bp, E. coli
gtattcttagtccagcaaccgagct

SEQ ID NO: 28869 - DNA, 25 bp, E. coli
gtccagcaaccgagctttcgcaggt

SEQ ID NO: 28870 - DNA, 25 bp, E. coli
gtccagcaaccgtgctttcgcaggt

SEQ ID NO: 28871 - DNA, 25 bp, E. coli
catggctgcgaatccactactggtg

SEQ ID NO: 28872 - DNA, 25 bp, E. coli
catggctgcgaaaccactactggtg

SEQ ID NO: 28873 - DNA, 25 bp, E. coli
attttttatacaccgcatggctgcg

SEQ ID NO: 28874 - DNA, 25 bp, E. coli
attttttatacagcgcatggctgcg

SEQ ID NO: 28875 - DNA, 25 bp, E. coli
tgccagttggcaaacagatatacag

SEQ ID NO: 28876 - DNA, 25 bp, E. coli
tgccagttggcatacagatatacag

SEQ ID NO: 28877 - DNA, 25 bp, E. coli
tctgtcaggcttcagtgcgatgcgt

SEQ ID NO: 28878 - DNA, 25 bp, E. coli
tctgtcaggcttgagtgcgatgcgt

SEQ ID NO: 28879 - DNA, 25 bp, E. coli
gcattgcgattctctctcaggtgga

SEQ ID NO: 28880 - DNA, 25 bp, E. coli
gcattgcgattcactctcaggtgga

SEQ ID NO: 28881 - DNA, 25 bp, E. coli
gaataacaacttgcaggtggaaccc

SEQ ID NO: 28882 - DNA, 25 bp, E. coli
gaataacaacttccaggtggaaccc

SEQ ID NO: 28883 - DNA, 25 bp, E. coli
gaaaagaccccagacaaacatgatg

SEQ ID NO: 28884 - DNA, 25 bp, E. coli
gaaaagaccccacacaaacatgatg

SEQ ID NO: 28885 - DNA, 25 bp, E. coli
cggtttttgatatgagccttacagc

SEQ ID NO: 28886 - DNA, 25 bp, E. coli
cggtttttgataagagccttacagc

SEQ ID NO: 28887 - DNA, 25 bp, E. coli
ggttgtcgtctggtcttcctgatga

SEQ ID NO: 28888 - DNA, 25 bp, E. coli
ggttgtcgtctgctcttcctgatga

SEQ ID NO: 28889 - DNA, 25 bp, E. coli
taagcgaagtgtggccgatcacaac

SEQ ID NO: 28890 - DNA, 25 bp, E. coli
taagcgaagtgtcgccgatcacaac

SEQ ID NO: 28891 - DNA, 25 bp, E. coli
gatgcgtaagattcagaaaagaccc

SEQ ID NO: 28892 - DNA, 25 bp, E. coli
gatgcgtaagatacagaaaagaccc

SEQ ID NO: 28893 - DNA, 25 bp, E. coli
aatcgaagagatttctggtggcaaa

SEQ ID NO: 28894 - DNA, 25 bp, E. coli
aatcgaagagatatctggtggcaaa

SEQ ID NO: 28895 - DNA, 25 bp, E. coli
catccctgaagttgcgaaggcttgt

SEQ ID NO: 28896 - DNA, 25 bp, E. coli
catccctgaagtagcgaaggcttgt

SEQ ID NO: 28897 - DNA, 25 bp, E. coli
taaatacgcatcaaaaatcgaagag

SEQ ID NO: 28898 - DNA, 25 bp, E. coli
taaatacgcatctaaaatcgaagag

SEQ ID NO: 28899 - DNA, 25 bp, E. coli
aaacggcttcctgcctaagactgag

SEQ ID NO: 28900 - DNA, 25 bp, E. coli
aaacggcttcctccctaagactgag

SEQ ID NO: 28901 - DNA, 25 bp, E. coli
tataagtggctcaaaaacggcttcc

SEQ ID NO: 28902 - DNA, 25 bp, E. coli
tataagtggctctaaaacggcttcc

SEQ ID NO: 28903 - DNA, 25 bp, E. coli
ttttgggaaaactaaatacgcatca

SEQ ID NO: 28904 - DNA, 25 bp, E. coli
ttttgggaaaacaaaatacgcatca

SEQ ID NO: 28905 - DNA, 25 bp, E. coli
tctggtggcaaaaatcaagcaagcg

SEQ ID NO: 28906 - DNA, 25 bp, E. coli
tcttgatgagcccattaaaggtgtc

SEQ ID NO: 28907 - DNA, 25 bp, E. coli
tctggtggcaaatatcaagcaagcg

SEQ ID NO: 28908 - DNA, 25 bp, E. coli
tcttgatgagccgattaaaggtgtc

SEQ ID NO: 28909 - DNA, 25 bp, E. coli
cgaaagggctgtgtataagtggctc

SEQ ID NO: 28910 - DNA, 25 bp, E. coli
cgaaagggctgtctataagtggctc

SEQ ID NO: 28911 - DNA, 25 bp, E. coli
gattaaaggtgtgggcatccctgaa

SEQ ID NO: 28912 - DNA, 25 bp, E. coli
gattaaaggtgtcggcatccctgaa

SEQ ID NO: 28913 - DNA, 25 bp, E. coli
taagcaaaaagatccttctggctgc

SEQ ID NO: 28914 - DNA, 25 bp, E. coli
taagcaaaaagaaccttctggctgc

SEQ ID NO: 28915 - DNA, 25 bp, E. coli
aaacagaagtcgtgctgcggatgcc

SEQ ID NO: 28916 - DNA, 25 bp, E. coli
aaacgccgtcgaagcactgaaagcc

SEQ ID NO: 28917 - DNA, 25 bp, E. coli
aaacgccgtcgatgcactgaaagcc

SEQ ID NO: 28918 - DNA, 25 bp, E. coli
aaacagaagtcgagctgcggatgcc

SEQ ID NO: 28919 - DNA, 25 bp, E. coli
tatggagttgctcgaaaacgccgtc

SEQ ID NO: 28920 - DNA, 25 bp, E. coli
tatggagttgctggaaaacgccgtc

SEQ ID NO: 28921 - DNA, 25 bp, E. coli
tgcttggcgaagtacaaagcggctc

SEQ ID NO: 28922 - DNA, 25 bp, E. coli
tgcttggcgaagaacaaagcggctc

SEQ ID NO: 28923 - DNA, 25 bp, E. coli
tcggacgttcgcttcatcaggcata

SEQ ID NO: 28924 - DNA, 25 bp, E. coli
tcggacgttcgcatcatcaggcata

SEQ ID NO: 28925 - DNA, 25 bp, E. coli
gcattaccgcctagatggtccgacg

SEQ ID NO: 28926 - DNA, 25 bp, E. coli
gcattaccgccttgatggtccgacg

SEQ ID NO: 28927 - DNA, 25 bp, E. coli
gaagaatcacgtaaatccggcctgg

SEQ ID NO: 28928 - DNA, 25 bp, E. coli
gaagaatcacgttaatccggcctgg

SEQ ID NO: 28929 - DNA, 25 bp, E. coli
cgctggcaacgctcgatctggagat

SEQ ID NO: 28930 - DNA, 25 bp, E. coli
cgctggcaacgcacgatctggagat

SEQ ID NO: 28931 - DNA, 25 bp, E. coli
gatctcaccagcgagcaaacagaag

SEQ ID NO: 28932 - DNA, 25 bp, E. coli
gatctcaccagccagcaaacagaag

SEQ ID NO: 28933 - DNA, 25 bp, E. coli
ggtccgacgcgcctgaaatttattc

SEQ ID NO: 28934 - DNA, 25 bp, E. coli
ggtccgacgcgcgtgaaatttattc

SEQ ID NO: 28935 - DNA, 25 bp, E. coli
gagccgtcgctggaagatctcacca

SEQ ID NO: 28936 - DNA, 25 bp, E. coli
gagccgtcgctgcaagatctcacca

SEQ ID NO: 28937 - DNA, 25 bp, E. coli
caaaacgatgtggtggaaaacggct

SEQ ID NO: 28938 - DNA, 25 bp, E. coli
caaaacgatgtgctggaaaacggct

SEQ ID NO: 28939 - DNA, 25 bp, E. coli
cattgtgcctttaaaccggtatgcg

SEQ ID NO: 28940 - DNA, 25 bp, E. coli
cattgtgccttttaaccggtatgcg

SEQ ID NO: 28941 - DNA, 25 bp, E. coli
catcggtgtaataaaagacgggcaa

SEQ ID NO: 28942 - DNA, 25 bp, E. coli
catcggtgtaattaaagacgggcaa

SEQ ID NO: 28943 - DNA, 25 bp, E. coli
aaagaaatggcgacgggtgcagcaa

SEQ ID NO: 28944 - DNA, 25 bp, E. coli
aaagaaatggcgtcgggtgcagcaa

SEQ ID NO: 28945 - DNA, 25 bp, E. coli
acgctggttgttggcaggtattgca

SEQ ID NO: 28946 - DNA, 25 bp, E. coli
acgctggttgttcgcaggtattgca

SEQ ID NO: 28947 - DNA, 25 bp, E. coli
tatgcgtgacccttttaaaccgccg

SEQ ID NO: 28948 - DNA, 25 bp, E. coli
tatgccggattagcgaacttagcca

SEQ ID NO: 28949 - DNA, 25 bp, E. coli
tatgccggattaccgaacttagcca

SEQ ID NO: 28950 - DNA, 25 bp, E. coli
tatgcgtgacccatttaaaccgccg

SEQ ID NO: 28951 - DNA, 25 bp, E. coli
ttaaaccgccggaagatctatgccg

SEQ ID NO: 28952 - DNA, 25 bp, E. coli
ttaaaccgccggtagatctatgccg

SEQ ID NO: 28953 - DNA, 25 bp, E. coli
gaacttagccagaggcgctatcagg

SEQ ID NO: 28954 - DNA, 25 bp, E. coli
gaacttagccagtggcgctatcagg

SEQ ID NO: 28955 - DNA, 25 bp, E. coli
cgaggcgagcgcttcatcggtgtaa

SEQ ID NO: 28956 - DNA, 25 bp, E. coli
cgaggcgagcgcatcatcggtgtaa

SEQ ID NO: 28957 - DNA, 25 bp, E. coli
tggcaacggcaaggagatacaaatg

SEQ ID NO: 28958 - DNA, 25 bp, E. coli
tggcaacggcaacgagatacaaatg

SEQ ID NO: 28959 - DNA, 25 bp, E. coli
tacatcaaattaatacacagtaagc

SEQ ID NO: 28960 - DNA, 25 bp, E. coli
tacacagtaagcaaactattattat

SEQ ID NO: 28961 - DNA, 25 bp, E. coli
tacacagtaagctaactattattat

SEQ ID NO: 28962 - DNA, 25 bp, E. coli
tacatcaaattattacacagtaagc

SEQ ID NO: 28963 - DNA, 25 bp, E. coli
taagccctgtccagttaattacctt

SEQ ID NO: 28964 - DNA, 25 bp, E. coli
taagccctgtcctgttaattacctt

SEQ ID NO: 28965 - DNA, 25 bp, E. coli
aaactgattataaagttaatgtccg

SEQ ID NO: 28966 - DNA, 25 bp, E. coli
aaactgattatatagttaatgtccg

SEQ ID NO: 28967 - DNA, 25 bp, E. coli
tacctttggcaaactgattataaag

SEQ ID NO: 28968 - DNA, 25 bp, E. coli
tacctttggcaatctgattataaag

SEQ ID NO: 28969 - DNA, 25 bp, E. coli
tataagccctgtcctgttaattacc

SEQ ID NO: 28970 - DNA, 25 bp, E. coli
tataagccctgtgctgttaattacc

SEQ ID NO: 28971 - DNA, 25 bp, E. coli
tgcattacatcaaattaatacacag

SEQ ID NO: 28972 - DNA, 25 bp, E. coli
ttattataagccctgtcctgttaat

SEQ ID NO: 28973 - DNA, 25 bp, E. coli
ttattataagccgtgtcctgttaat

SEQ ID NO: 28974 - DNA, 25 bp, E. coli
tgcattacatcatattaatacacag

SEQ ID NO: 28975 - DNA, 25 bp, E. coli
cctttggcaaactgattataaagtt

SEQ ID NO: 28976 - DNA, 25 bp, E. coli
cctttggcaaacagattataaagtt

SEQ ID NO: 28977 - DNA, 25 bp, E. coli
tgttaattacctttggcaaactgat

SEQ ID NO: 28978 - DNA, 25 bp, E. coli
tgttaattacctatggcaaactgat

SEQ ID NO: 28979 - DNA, 25 bp, E. coli
tcaaattaatacacagtaagctaac

SEQ ID NO: 28980 - DNA, 25 bp, E. coli
tcaaattaatactcagtaagctaac

SEQ ID NO: 28981 - DNA, 25 bp, E. coli
caaccatcgggccaaacgtcgagtt

SEQ ID NO: 28982 - DNA, 25 bp, E. coli
caaccatcgggcgaaacgtcgagtt

SEQ ID NO: 28983 - DNA, 25 bp, E. coli
tacgaatgacgcacaacaaggtgcc

SEQ ID NO: 28984 - DNA, 25 bp, E. coli
ccttcgggacgtcctacataaaata

SEQ ID NO: 28985 - DNA, 25 bp, E. coli
ccttcgggacgtgctacataaaata

SEQ ID NO: 28986 - DNA, 25 bp, E. coli
aacttctgatatgagcgtagctata

SEQ ID NO: 28987 - DNA, 25 bp, E. coli
aacttctgatatcagcgtagctata

SEQ ID NO: 28988 - DNA, 25 bp, E. coli
tacgaatgacgctcaacaaggtgcc

SEQ ID NO: 28989 - DNA, 25 bp, E. coli
ttatgtcagccccttcgggacgtgc

SEQ ID NO: 28990 - DNA, 25 bp, E. coli
ttatgtcagcccgttcgggacgtgc

SEQ ID NO: 28991 - DNA, 25 bp, E. coli
tgacgcacaacaaggtgcctgccgt

SEQ ID NO: 28992 - DNA, 25 bp, E. coli
tgacgcacaacatggtgcctgccgt

SEQ ID NO: 28993 - DNA, 25 bp, E. coli
gaaacgtcgagtaaggcaccgcctt

SEQ ID NO: 28994 - DNA, 25 bp, E. coli
gaaacgtcgagttaggcaccgcctt

SEQ ID NO: 28995 - DNA, 25 bp, E. coli
cgtagctatatcaaccatcgggcga

SEQ ID NO: 28996 - DNA, 25 bp, E. coli
cgtagctatatctaccatcgggcga

SEQ ID NO: 28997 - DNA, 25 bp, E. coli
gtgctacataaattacgaatgacgc

SEQ ID NO: 28998 - DNA, 25 bp, E. coli
ggtgcctgccgtgcaacttctgata

SEQ ID NO: 28999 - DNA, 25 bp, E. coli
gtggctcattcaccgacttatgtca

SEQ ID NO: 29000 - DNA, 25 bp, E. coli
gtgctacataaaatacgaatgacgc

SEQ ID NO: 29001 - DNA, 25 bp, E. coli
ggtgcctgccgtccaacttctgata

SEQ ID NO: 29002 - DNA, 25 bp, E. coli
gtggctcattcagcgacttatgtca

SEQ ID NO: 29003 - DNA, 25 bp, E. coli
cagtgagcagagacgcagcgattat

SEQ ID NO: 29004 - DNA, 25 bp, E. coli
cagtgagcagagtcgcagcgattat

SEQ ID NO: 29005 - DNA, 25 bp, E. coli
tactctggttatgtgcaccatcgtc

SEQ ID NO: 29006 - DNA, 25 bp, E. coli
tactctggttatctgcaccatcgtc

SEQ ID NO: 29007 - DNA, 25 bp, E. coli
ataatggtggcacggtgctcgtcaa

SEQ ID NO: 29008 - DNA, 25 bp, E. coli
atagatcagtgaccagagtcgcagc

SEQ ID NO: 29009 - DNA, 25 bp, E. coli
ataatggtggcagggtgctcgtcaa

SEQ ID NO: 29010 - DNA, 25 bp, E. coli
atagatcagtgagcagagtcgcagc

SEQ ID NO: 29011 - DNA, 25 bp, E. coli
tatactctggttttctgcaccatcg

SEQ ID NO: 29012 - DNA, 25 bp, E. coli
tatactctggttatctgcaccatcg

SEQ ID NO: 29013 - DNA, 25 bp, E. coli
gaaaatgatgctcttctgcggaagc

SEQ ID NO: 29014 - DNA, 25 bp, E. coli
gaaaatgatgctgttctgcggaagc

SEQ ID NO: 29015 - DNA, 25 bp, E. coli
gtcgcagcgattatttatactctgg

SEQ ID NO: 29016 - DNA, 25 bp, E. coli
gatcagtgagcacagtcgcagcgat

SEQ ID NO: 29017 - DNA, 25 bp, E. coli
gatcagtgagcagagtcgcagcgat

SEQ ID NO: 29018 - DNA, 25 bp, E. coli
ggatagatcagtcagcagagtcgca

SEQ ID NO: 29019 - DNA, 25 bp, E. coli
ggatagatcagtgagcagagtcgca

SEQ ID NO: 29020 - DNA, 25 bp, E. coli
gtcgcagcgattttttatactctgg

SEQ ID NO: 29021 - DNA, 25 bp, E. coli
ggcagggtgctcgtcaaaggaaaat

SEQ ID NO: 29022 - DNA, 25 bp, E. coli
ggcagggtgctcctcaaaggaaaat

SEQ ID NO: 29023 - DNA, 25 bp, E. coli
gagcagagtcgctgcgattatttat

SEQ ID NO: 29024 - DNA, 25 bp, E. coli
gagcagagtcgcagcgattatttat

SEQ ID NO: 29025 - DNA, 25 bp, E. coli
caaccgggaggtccgacaaaaatgt

SEQ ID NO: 29026 - DNA, 25 bp, E. coli
caaccgggaggtgcgacaaaaatgt

SEQ ID NO: 29027 - DNA, 25 bp, E. coli
catgcacagaaatcgctggcctggg

SEQ ID NO: 29028 - DNA, 25 bp, E. coli
catggactgaccgaacgcgatgttt

SEQ ID NO: 29029 - DNA, 25 bp, E. coli
catgcacagaaaacgctggcctggg

SEQ ID NO: 29030 - DNA, 25 bp, E. coli
catggactgacccaacgcgatgttt

SEQ ID NO: 29031 - DNA, 25 bp, E. coli
tacgatccgattggcgcattgaatg

SEQ ID NO: 29032 - DNA, 25 bp, E. coli
tacgatccgattcgcgcattgaatg

SEQ ID NO: 29033 - DNA, 25 bp, E. coli
tatgacaaaccggaagcagttcagg

SEQ ID NO: 29034 - DNA, 25 bp, E. coli
tatgacaaaccgcaagcagttcagg

SEQ ID NO: 29035 - DNA, 25 bp, E. coli
tgaaaaagtcggagccttcggtgct

SEQ ID NO: 29036 - DNA, 25 bp, E. coli
tgaaaaagtcggtgccttcggtgct

SEQ ID NO: 29037 - DNA, 25 bp, E. coli
gcgtcgcaacgaaccaaagaggctc

SEQ ID NO: 29038 - DNA, 25 bp, E. coli
gcgtcgcaacgatccaaagaggctc

SEQ ID NO: 29039 - DNA, 25 bp, E. coli
gaagtgttactgtctcagccggtga

SEQ ID NO: 29040 - DNA, 25 bp, E. coli
gaaggtttcagctattacgatccga

SEQ ID NO: 29041 - DNA, 25 bp, E. coli
gaagtgttactgactcagccggtga

SEQ ID NO: 29042 - DNA, 25 bp, E. coli
gaaggtttcagcaattacgatccga

SEQ ID NO: 29043 - DNA, 25 bp, E. coli
gactactataaatcaccacgcgggc

SEQ ID NO: 29044 - DNA, 25 bp, E. coli
gactactataaaacaccacgcgggc

SEQ ID NO: 29045 - DNA, 25 bp, E. coli
gatgcagcaaaaccccatggactga

SEQ ID NO: 29046 - DNA, 25 bp, E. coli
gatgcagcaaaagcccatggactga

SEQ ID NO: 29047 - DNA, 25 bp, E. coli
cactgtggaatgtaaaacgcgatac

SEQ ID NO: 29048 - DNA, 25 bp, E. coli
cactgtggaatgaaaaacgcgatac

SEQ ID NO: 29049 - DNA, 25 bp, E. coli
cagaaaactacgttgtgcgcgccaa

SEQ ID NO: 29050 - DNA, 25 bp, E. coli
cagaaaactacgatgtgcgcgccaa

SEQ ID NO: 29051 - DNA, 25 bp, E. coli
tatgaaacgctgatgaacgccgtga

SEQ ID NO: 29052 - DNA, 25 bp, E. coli
tatgaaacgctgttgaacgccgtga

SEQ ID NO: 29053 - DNA, 25 bp, E. coli
tgatctcccgtataaccacaggcga

SEQ ID NO: 29054 - DNA, 25 bp, E. coli
tgatctcccgtaaaaccacaggcga

SEQ ID NO: 29055 - DNA, 25 bp, E. coli
tcaggaccgtttcgcagaaggcatt

SEQ ID NO: 29056 - DNA, 25 bp, E. coli
tcaggaccgtttggcagaaggcatt

SEQ ID NO: 29057 - DNA, 25 bp, E. coli
gaacgcgtctggaacatcactgaag

SEQ ID NO: 29058 - DNA, 25 bp, E. coli
gaacaaattcctcacgatgctcgcg

SEQ ID NO: 29059 - DNA, 25 bp, E. coli
gaacaaattcctgacgatgctcgcg

SEQ ID NO: 29060 - DNA, 25 bp, E. coli
gaacgcgtctggtacatcactgaag

SEQ ID NO: 29061 - DNA, 25 bp, E. coli
gattaaaagcgccatcccgatgggc

SEQ ID NO: 29062 - DNA, 25 bp, E. coli
gattaaaagcgcgatcccgatgggc

SEQ ID NO: 29063 - DNA, 25 bp, E. coli
ggacgcctttgtacacaccgtggaa

SEQ ID NO: 29064 - DNA, 25 bp, E. coli
ggacgcctttgttcacaccgtggaa

SEQ ID NO: 29065 - DNA, 25 bp, E. coli
tcaagttctggatgccctgaaaggc

SEQ ID NO: 29066 - DNA, 25 bp, E. coli
tcaagttctggaagccctgaaaggc

SEQ ID NO: 29067 - DNA, 25 bp, E. coli
gatggtccgaaagccctgaaagagc

SEQ ID NO: 29068 - DNA, 25 bp, E. coli
gatggtccgaaacccctgaaagagc

SEQ ID NO: 29069 - DNA, 25 bp, E. coli
caaggcccgcaattggtcatgttac

SEQ ID NO: 29070 - DNA, 25 bp, E. coli
aaggacatccttaatgcttgcagcc

SEQ ID NO: 29071 - DNA, 25 bp, E. coli
caaggcccgcaaatggtcatgttac

SEQ ID NO: 29072 - DNA, 25 bp, E. coli
aaggacatcctttatgcttgcagcc

SEQ ID NO: 29073 - DNA, 25 bp, E. coli
tacatgtattttaacaaggcccgca

SEQ ID NO: 29074 - DNA, 25 bp, E. coli
tacatgtatttttacaaggcccgca

SEQ ID NO: 29075 - DNA, 25 bp, E. coli
tattgaggctctcgactatgaacca

SEQ ID NO: 29076 - DNA, 25 bp, E. coli
tattgaggctctggactatgaacca

SEQ ID NO: 29077 - DNA, 25 bp, E. coli
tttacaagagaaaggaaatactgcc

SEQ ID NO: 29078 - DNA, 25 bp, E. coli
tttacaagagaatggaaatactgcc

SEQ ID NO: 29079 - DNA, 25 bp, E. coli
ttctcacgaaacctcatggatgcga

SEQ ID NO: 29080 - DNA, 25 bp, E. coli
ttctcacgaaacgtcatggatgcga

SEQ ID NO: 29081 - DNA, 25 bp, E. coli
tccatggtgcaggtagaaatatcgt

SEQ ID NO: 29082 - DNA, 25 bp, E. coli
tccatggtgcagctagaaatatcgt

SEQ ID NO: 29083 - DNA, 25 bp, E. coli
tcattagcagaggacaaaatagcct

SEQ ID NO: 29084 - DNA, 25 bp, E. coli
tcattagcagagcacaaaatagcct

SEQ ID NO: 29085 - DNA, 25 bp, E. coli
gacttgaattagagtggcaccccaa

SEQ ID NO: 29086 - DNA, 25 bp, E. coli
gacttgaattagtgtggcaccccaa

SEQ ID NO: 29087 - DNA, 25 bp, E. coli
gttcaataccaacagcaaatgctag

SEQ ID NO: 29088 - DNA, 25 bp, E. coli
gttcaataccaagagcaaatgctag

SEQ ID NO: 29089 - DNA, 25 bp, E. coli
gagtaaatgagacaatccagacccc

SEQ ID NO: 29090 - DNA, 25 bp, E. coli
gagtaaatgagagaatccagacccc

SEQ ID NO: 29091 - DNA, 25 bp, E. coli
caccgagctgcaaaaaggtttcaca

SEQ ID NO: 29092 - DNA, 25 bp, E. coli
caccgagctgcataaaggtttcaca

SEQ ID NO: 29093 - DNA, 25 bp, E. coli
catacgcggtgaaactgaatctgga

SEQ ID NO: 29094 - DNA, 25 bp, E. coli
catacgcggtgatactgaatctgga

SEQ ID NO: 29095 - DNA, 25 bp, E. coli
tatgcagtatcttgccgacagcgtc

SEQ ID NO: 29096 - DNA, 25 bp, E. coli
tatgcagtatctagccgacagcgtc

SEQ ID NO: 29097 - DNA, 25 bp, E. coli
tatgcaacgtatggctgaacgtccg

SEQ ID NO: 29098 - DNA, 25 bp, E. coli
tatgcaacgtatcgctgaacgtccg

SEQ ID NO: 29099 - DNA, 25 bp, E. coli
tatcaccctgcgtgagagcggaaag

SEQ ID NO: 29100 - DNA, 25 bp, E. coli
tatcaccctgcgagagagcggaaag

SEQ ID NO: 29101 - DNA, 25 bp, E. coli
tgtttcgccctgatacaccggaaga

SEQ ID NO: 29102 - DNA, 25 bp, E. coli
tgtttcgccctgttacaccggaaga

SEQ ID NO: 29103 - DNA, 25 bp, E. coli
tcccgctataaatccatcgaatggc

SEQ ID NO: 29104 - DNA, 25 bp, E. coli
tccggaagtacaagacgcgctgtca

SEQ ID NO: 29105 - DNA, 25 bp, E. coli
tccggaagtacatgacgcgctgtca

SEQ ID NO: 29106 - DNA, 25 bp, E. coli
tcccgctataaaaccatcgaatggc

SEQ ID NO: 29107 - DNA, 25 bp, E. coli
gctgaattacatcgccaccgagctg

SEQ ID NO: 29108 - DNA, 25 bp, E. coli
gctgaattacatggccaccgagctg

SEQ ID NO: 29109 - DNA, 25 bp, E. coli
gaacgaggcactgaaggatgagcac

SEQ ID NO: 29110 - DNA, 25 bp, E. coli
gaacgaggcactcaaggatgagcac

SEQ ID NO: 29111 - DNA, 25 bp, E. coli
cgctgtcagcggtaggcttaaagta

SEQ ID NO: 29112 - DNA, 25 bp, E. coli
cgctgtcagcggaaggcttaaagta

SEQ ID NO: 29113 - DNA, 25 bp, E. coli
ttggtccgatcatgcaaatcgaagc

SEQ ID NO: 29114 - DNA, 25 bp, E. coli
ttggtccgatcaagcaaatcgaagc

SEQ ID NO: 29115 - DNA, 25 bp, E. coli
tgttgttggtcccatcaagcaaatc

SEQ ID NO: 29116 - DNA, 25 bp, E. coli
tgttggtccgatgaagcaaatcgaa

SEQ ID NO: 29117 - DNA, 25 bp, E. coli
tgttggtccgatcaagcaaatcgaa

SEQ ID NO: 29118 - DNA, 25 bp, E. coli
tggtccgatcaaccaaatcgaagct

SEQ ID NO: 29119 - DNA, 25 bp, E. coli
tggtccgatcaagcaaatcgaagct

SEQ ID NO: 29120 - DNA, 25 bp, E. coli
tgttgttggtccgatcaagcaaatc

SEQ ID NO: 29121 - DNA, 25 bp, E. coli
tccgatcaagcaaatcgaagctctg

SEQ ID NO: 29122 - DNA, 25 bp, E. coli
tccgatcaagcatatcgaagctctg

SEQ ID NO: 29123 - DNA, 25 bp, E. coli
cgatcaagcaaaacgaagctctgca

SEQ ID NO: 29124 - DNA, 25 bp, E. coli
cgatcaagcaaatcgaagctctgca

SEQ ID NO: 29125 - DNA, 25 bp, E. coli
gatcaagcaaatggaagctctgcaa

SEQ ID NO: 29126 - DNA, 25 bp, E. coli
gttggtccgatctagcaaatcgaag

SEQ ID NO: 29127 - DNA, 25 bp, E. coli
gttggtccgatcaagcaaatcgaag

SEQ ID NO: 29128 - DNA, 25 bp, E. coli
gatcaagcaaatcgaagctctgcaa

SEQ ID NO: 29129 - DNA, 25 bp, E. coli
ggtgttgttggtccgatcaagcaaa

SEQ ID NO: 29130 - DNA, 25 bp, E. coli
ggtgttgttggtgcgatcaagcaaa

SEQ ID NO: 29131 - DNA, 25 bp, E. coli
ggtccgatcaagcaaatcgaagctc

SEQ ID NO: 29132 - DNA, 25 bp, E. coli
ggtccgatcaaggaaatcgaagctc

SEQ ID NO: 29133 - DNA, 25 bp, E. coli
tcaagcaaatcgaagctctgcaaca

SEQ ID NO: 29134 - DNA, 25 bp, E. coli
tcaagcaaatcgtagctctgcaaca

SEQ ID NO: 29135 - DNA, 25 bp, E. coli
taaatcctttggactggaagcggcg

SEQ ID NO: 29136 - DNA, 25 bp, E. coli
taaatcctttggtctggaagcggcg

SEQ ID NO: 29137 - DNA, 25 bp, E. coli
tatacgtggatcatccagccacagg

SEQ ID NO: 29138 - DNA, 25 bp, E. coli
tatagcgcgaaacgtgcaaccgtct

SEQ ID NO: 29139 - DNA, 25 bp, E. coli
tatacgtggatcttccagccacagg

SEQ ID NO: 29140 - DNA, 25 bp, E. coli
tatcgttcgaaacggagtgtcagag

SEQ ID NO: 29141 - DNA, 25 bp, E. coli
tatagcgcgaaaggtgcaaccgtct

SEQ ID NO: 29142 - DNA, 25 bp, E. coli
tatcgttcgaaagggagtgtcagag

SEQ ID NO: 29143 - DNA, 25 bp, E. coli
ttatgcgtctgaacgaccgtgcggg

SEQ ID NO: 29144 - DNA, 25 bp, E. coli
ttatgcgtctgatcgaccgtgcggg

SEQ ID NO: 29145 - DNA, 25 bp, E. coli
tgcgccccgaaggtggaagttacgt

SEQ ID NO: 29146 - DNA, 25 bp, E. coli
tgcgccccgaagctggaagttacgt

SEQ ID NO: 29147 - DNA, 25 bp, E. coli
tgagaacgacctcgcatcgctacgt

SEQ ID NO: 29148 - DNA, 25 bp, E. coli
tgagaacgacctggcatcgctacgt

SEQ ID NO: 29149 - DNA, 25 bp, E. coli
gccacctggtttgccgatgacatca

SEQ ID NO: 29150 - DNA, 25 bp, E. coli
gccacctggtttcccgatgacatca

SEQ ID NO: 29151 - DNA, 25 bp, E. coli
gaagttacgtcgctaacctggcagc

SEQ ID NO: 29152 - DNA, 25 bp, E. coli
gaagttacgtcggtaacctggcagc

SEQ ID NO: 29153 - DNA, 25 bp, E. coli
gactcctgggcggaatatagctggt

SEQ ID NO: 29154 - DNA, 25 bp, E. coli
gactcctgggcgcaatatagctggt

SEQ ID NO: 29155 - DNA, 25 bp, E. coli
ggttatgcccgccactacaacttaa

SEQ ID NO: 29156 - DNA, 25 bp, E. coli
ggttatgcccgcgactacaacttaa

SEQ ID NO: 29157 - DNA, 25 bp, E. coli
cagcgtaattgccacccatgtgaat

SEQ ID NO: 29158 - DNA, 25 bp, E. coli
cagcgtaattgcgacccatgtgaat

SEQ ID NO: 29159 - DNA, 25 bp, E. coli
tacgtcaggtgaattccgacggcaa

SEQ ID NO: 29160 - DNA, 25 bp, E. coli
tacgatgacagaaaccagcgagcaa

SEQ ID NO: 29161 - DNA, 25 bp, E. coli
taactatgacgaaattactcagctg

SEQ ID NO: 29162 - DNA, 25 bp, E. coli
tacgtcaggtgatttccgacggcaa

SEQ ID NO: 29163 - DNA, 25 bp, E. coli
tactcagctgcataaccgtttgtcg

SEQ ID NO: 29164 - DNA, 25 bp, E. coli
tactcagctgcaaaaccgtttgtcg

SEQ ID NO: 29165 - DNA, 25 bp, E. coli
tacgatgacagataccagcgagcaa

SEQ ID NO: 29166 - DNA, 25 bp, E. coli
tcgaaacgctaagccgtacgatgac

SEQ ID NO: 29167 - DNA, 25 bp, E. coli
tcgaaacgctaacccgtacgatgac

SEQ ID NO: 29168 - DNA, 25 bp, E. coli
tctctacaccgcgactggaattatg

SEQ ID NO: 29169 - DNA, 25 bp, E. coli
tctctacaccgccactggaattatg

SEQ ID NO: 29170 - DNA, 25 bp, E. coli
ccgtttgtcgtccatggcaccgcga

SEQ ID NO: 29171 - DNA, 25 bp, E. coli
gcttgatagcgtcccagtggatccg

SEQ ID NO: 29172 - DNA, 25 bp, E. coli
gcttgatagcgtgccagtggatccg

SEQ ID NO: 29173 - DNA, 25 bp, E. coli
gcaacaggccggcaaagtgatgctt

SEQ ID NO: 29174 - DNA, 25 bp, E. coli
gcaacaggccgggaaagtgatgctt

SEQ ID NO: 29175 - DNA, 25 bp, E. coli
gaatgccgcattacccgttcctgat

SEQ ID NO: 29176 - DNA, 25 bp, E. coli
gaatgccgcatttcccgttcctgat

SEQ ID NO: 29177 - DNA, 25 bp, E. coli
ccgtttgtcgtcgatggcaccgcga

SEQ ID NO: 29178 - DNA, 25 bp, E. coli
taactatgacgatattactcagctg

SEQ ID NO: 29179 - DNA, 25 bp, E. coli
tactggcacgccttcgggaacagtg

SEQ ID NO: 29180 - DNA, 25 bp, E. coli
tactggcacgccatcgggaacagtg

SEQ ID NO: 29181 - DNA, 25 bp, E. coli
aaaatgacggatgaagatgactggc

SEQ ID NO: 29182 - DNA, 25 bp, E. coli
aaaatgacggatcaagatgactggc

SEQ ID NO: 29183 - DNA, 25 bp, E. coli
tttcccggccctcaatgatgtatcg

SEQ ID NO: 29184 - DNA, 25 bp, E. coli
tatcggcactttccggactcatcga

SEQ ID NO: 29185 - DNA, 25 bp, E. coli
tttcccggccctgaatgatgtatcg

SEQ ID NO: 29186 - DNA, 25 bp, E. coli
tattgctgtcttgatccgggcacag

SEQ ID NO: 29187 - DNA, 25 bp, E. coli
tttgttgatgcggaggaactgcctg

SEQ ID NO: 29188 - DNA, 25 bp, E. coli
tttgttgatgcgcaggaactgcctg

SEQ ID NO: 29189 - DNA, 25 bp, E. coli
tattgctgtcttcatccgggcacag

SEQ ID NO: 29190 - DNA, 25 bp, E. coli
tatcggcactttgcggactcatcga

SEQ ID NO: 29191 - DNA, 25 bp, E. coli
tgggcgatggcggaaatcacgtacc

SEQ ID NO: 29192 - DNA, 25 bp, E. coli
tgataatgagatggccacctgggcg

SEQ ID NO: 29193 - DNA, 25 bp, E. coli
tgggcgatggcgcaaatcacgtacc

SEQ ID NO: 29194 - DNA, 25 bp, E. coli
tgataatgagatcgccacctgggcg

SEQ ID NO: 29195 - DNA, 25 bp, E. coli
gacatacacaaatccgccaggtcgt

SEQ ID NO: 29196 - DNA, 25 bp, E. coli
gacatacacaaaaccgccaggtcgt

SEQ ID NO: 29197 - DNA, 25 bp, E. coli
ggagacagcgcctcgttttttgacg

SEQ ID NO: 29198 - DNA, 25 bp, E. coli
ggagacagcgccacgttttttgacg

SEQ ID NO: 29199 - DNA, 25 bp, E. coli
gatggagagcacgattttcccggcc

SEQ ID NO: 29200 - DNA, 25 bp, E. coli
gatggagagcaccattttcccggcc

SEQ ID NO: 29201 - DNA, 25 bp, E. coli
aacctgccagtcataacgcctccgc

SEQ ID NO: 29202 - DNA, 25 bp, E. coli
cgtgaccgaactccgggccggaatt

SEQ ID NO: 29203 - DNA, 25 bp, E. coli
cgtgaccgaactgcgggccggaatt

SEQ ID NO: 29204 - DNA, 25 bp, E. coli
atgtacccgtgaccgaactgcgggc

SEQ ID NO: 29205 - DNA, 25 bp, E. coli
agtcggatcatctgcgtgctcgtca

SEQ ID NO: 29206 - DNA, 25 bp, E. coli
atgtacccgtgagcgaactgcgggc

SEQ ID NO: 29207 - DNA, 25 bp, E. coli
agtcggatcatcagcgtgctcgtca

SEQ ID NO: 29208 - DNA, 25 bp, E. coli
aactgcgggccgcaattatcgttgg

SEQ ID NO: 29209 - DNA, 25 bp, E. coli
aactgcgggccggaattatcgttgg

SEQ ID NO: 29210 - DNA, 25 bp, E. coli
aacctgccagtcttaacgcctccgc

SEQ ID NO: 29211 - DNA, 25 bp, E. coli
ttatcgttggcggaggttccgcggc

SEQ ID NO: 29212 - DNA, 25 bp, E. coli
ttatcgttggcgcaggttccgcggc

SEQ ID NO: 29213 - DNA, 25 bp, E. coli
gaatgtacccgtgaccgaactgcgg

SEQ ID NO: 29214 - DNA, 25 bp, E. coli
gaatgtacccgtcaccgaactgcgg

SEQ ID NO: 29215 - DNA, 25 bp, E. coli
ctccgcgctgggttcgttcacgcac

SEQ ID NO: 29216 - DNA, 25 bp, E. coli
ctccgcgctgggatcgttcacgcac

SEQ ID NO: 29217 - DNA, 25 bp, E. coli
gatcatctgcgtcctcgtcaggcta

SEQ ID NO: 29218 - DNA, 25 bp, E. coli
gatcatctgcgtgctcgtcaggcta

SEQ ID NO: 29219 - DNA, 25 bp, E. coli
ggaattatcgttggcgcaggttccg

SEQ ID NO: 29220 - DNA, 25 bp, E. coli
ggaattatcgttcgcgcaggttccg

SEQ ID NO: 29221 - DNA, 25 bp, E. coli
gagcagtcggatcatctgcgtgctc

SEQ ID NO: 29222 - DNA, 25 bp, E. coli
gagcagtcggatgatctgcgtgctc

SEQ ID NO: 29223 - DNA, 25 bp, E. coli
taacggtgttcgacgataacgcgcc

SEQ ID NO: 29224 - DNA, 25 bp, E. coli
tatgttgatgcgaattttatggcgc

SEQ ID NO: 29225 - DNA, 25 bp, E. coli
tatgttgatgcgtattttatggcgc

SEQ ID NO: 29226 - DNA, 25 bp, E. coli
ttgatgcgtattttatggcgcgggt

SEQ ID NO: 29227 - DNA, 25 bp, E. coli
ttgatgcgtattatatggcgcgggt

SEQ ID NO: 29228 - DNA, 25 bp, E. coli
tgagctaacggtgttcgtcgataac

SEQ ID NO: 29229 - DNA, 25 bp, E. coli
tgagctaacggtcttcgtcgataac

SEQ ID NO: 29230 - DNA, 25 bp, E. coli
tcgacgcccgctggaagaatcgcgg

SEQ ID NO: 29231 - DNA, 25 bp, E. coli
tcgacgcccgctcgaagaatcgcgg

SEQ ID NO: 29232 - DNA, 25 bp, E. coli
gcgggtagatcgaattgagctaacg

SEQ ID NO: 29233 - DNA, 25 bp, E. coli
gcgggtagatcgtattgagctaacg

SEQ ID NO: 29234 - DNA, 25 bp, E. coli
cccgctggaagaatcgcggcgtcgc

SEQ ID NO: 29235 - DNA, 25 bp, E. coli
cccgctggaagattcgcggcgtcgc

SEQ ID NO: 29236 - DNA, 25 bp, E. coli
gttcgtcgataacgcgccagcaatt

SEQ ID NO: 29237 - DNA, 25 bp, E. coli
gttcgtcgataaggcgccagcaatt

SEQ ID NO: 29238 - DNA, 25 bp, E. coli
ggtatctgtgtcgacgcccgctgga

SEQ ID NO: 29239 - DNA, 25 bp, E. coli
ggtatctgtgtccacgcccgctgga

SEQ ID NO: 29240 - DNA, 25 bp, E. coli
ggtgttcgtcgaaaacgcgccagca

SEQ ID NO: 29241 - DNA, 25 bp, E. coli
ggtgttcgtcgataacgcgccagca

SEQ ID NO: 29242 - DNA, 25 bp, E. coli
taacggtgttcgtcgataacgcgcc

SEQ ID NO: 29243 - DNA, 25 bp, E. coli
gatcgtattgagctaacggtgttcg

SEQ ID NO: 29244 - DNA, 25 bp, E. coli
gatcgtattgaggtaacggtgttcg

SEQ ID NO: 29245 - DNA, 25 bp, E. coli
aatgaatgcactaccgacgacctgg

SEQ ID NO: 29246 - DNA, 25 bp, E. coli
aatgaatgcacttccgacgacctgg

SEQ ID NO: 29247 - DNA, 25 bp, E. coli
caagattgatgttacgccagatggc

SEQ ID NO: 29248 - DNA, 25 bp, E. coli
caagattgatgtaacgccagatggc

SEQ ID NO: 29249 - DNA, 25 bp, E. coli
tagctattcgatggcgctggcagca

SEQ ID NO: 29250 - DNA, 25 bp, E. coli
tagctattcgatcgcgctggcagca

SEQ ID NO: 29251 - DNA, 25 bp, E. coli
tttgaattctacagtggcggcggca

SEQ ID NO: 29252 - DNA, 25 bp, E. coli
tttgaattctactgtggcggcggca

SEQ ID NO: 29253 - DNA, 25 bp, E. coli
tgaagcgcgcttactgcaaaccgga

SEQ ID NO: 29254 - DNA, 25 bp, E. coli
tgaagcgcgctttctgcaaaccgga

SEQ ID NO: 29255 - DNA, 25 bp, E. coli
gcgatcgcgatagcaaaggcactaa

SEQ ID NO: 29256 - DNA, 25 bp, E. coli
gcgatcgcgataccaaaggcactaa

SEQ ID NO: 29257 - DNA, 25 bp, E. coli
gcaaagtgttcgaacaggtccgcga

SEQ ID NO: 29258 - DNA, 25 bp, E. coli
gcaaagtgttcgtacaggtccgcga

SEQ ID NO: 29259 - DNA, 25 bp, E. coli
gaattaattgagatcgcccctggcg

SEQ ID NO: 29260 - DNA, 25 bp, E. coli
gaattaattgagttcgcccctggcg

SEQ ID NO: 29261 - DNA, 25 bp, E. coli
gaaagtagcctgattacgccgatgg

SEQ ID NO: 29262 - DNA, 25 bp, E. coli
gaaagtagcctgtttacgccgatgg

SEQ ID NO: 29263 - DNA, 25 bp, E. coli
gatatcaccttcgtcggcatgggag

SEQ ID NO: 29264 - DNA, 25 bp, E. coli
gatatcaccttcctcggcatgggag

SEQ ID NO: 29265 - DNA, 25 bp, E. coli
taatggcaatctcattggccccggc

SEQ ID NO: 29266 - DNA, 25 bp, E. coli
taatggcaatctgattggccccggc

SEQ ID NO: 29267 - DNA, 25 bp, E. coli
tagccctgacgatctgattgctgcg

SEQ ID NO: 29268 - DNA, 25 bp, E. coli
tagccctgacgaactgattgctgcg

SEQ ID NO: 29269 - DNA, 25 bp, E. coli
ttctctccaagccttgtagccctga

SEQ ID NO: 29270 - DNA, 25 bp, E. coli
ttctctccaagcgttgtagccctga

SEQ ID NO: 29271 - DNA, 25 bp, E. coli
tgtagccctgaccaactgattgctg

SEQ ID NO: 29272 - DNA, 25 bp, E. coli
tgtagccctgacgaactgattgctg

SEQ ID NO: 29273 - DNA, 25 bp, E. coli
tgacgaactgatagctgcggtgcat

SEQ ID NO: 29274 - DNA, 25 bp, E. coli
tgacgaactgattgctgcggtgcat

SEQ ID NO: 29275 - DNA, 25 bp, E. coli
tctccaagcgttctagccctgacga

SEQ ID NO: 29276 - DNA, 25 bp, E. coli
tctccaagcgttgtagccctgacga

SEQ ID NO: 29277 - DNA, 25 bp, E. coli
ccaagcgttgtagccctgacgaact

SEQ ID NO: 29278 - DNA, 25 bp, E. coli
cctgacgaactgtttgctgcggtgc

SEQ ID NO: 29279 - DNA, 25 bp, E. coli
cctgacgaactgattgctgcggtgc

SEQ ID NO: 29280 - DNA, 25 bp, E. coli
ccaagcgttgtacccctgacgaact

SEQ ID NO: 29281 - DNA, 25 bp, E. coli
cgtggctttctctccaagcgttgta

SEQ ID NO: 29282 - DNA, 25 bp, E. coli
cgtggctttctcaccaagcgttgta

SEQ ID NO: 29283 - DNA, 25 bp, E. coli
gttgtagccctgtcgaactgattgc

SEQ ID NO: 29284 - DNA, 25 bp, E. coli
gttgtagccctgacgaactgattgc

SEQ ID NO: 29285 - DNA, 25 bp, E. coli
tggctttctctccaagcgttgtagc

SEQ ID NO: 29286 - DNA, 25 bp, E. coli
ggcgcgtggcttactctccaagcgt

SEQ ID NO: 29287 - DNA, 25 bp, E. coli
ggcgcgtggctttctctccaagcgt

SEQ ID NO: 29288 - DNA, 25 bp, E. coli
tggctttctctcgaagcgttgtagc

SEQ ID NO: 29289 - DNA, 25 bp, E. coli
caaaatggtcttaacgctggataac

SEQ ID NO: 29290 - DNA, 25 bp, E. coli
caacgagtttttcctctggctgggc

SEQ ID NO: 29291 - DNA, 25 bp, E. coli
caaaatggtctttacgctggataac

SEQ ID NO: 29292 - DNA, 25 bp, E. coli
caacgagtttttgctctggctgggc

SEQ ID NO: 29293 - DNA, 25 bp, E. coli
tacgctgactatcgtaatgggcctg

SEQ ID NO: 29294 - DNA, 25 bp, E. coli
tacgctgactatggtaatgggcctg

SEQ ID NO: 29295 - DNA, 25 bp, E. coli
tattgcactcgcagaatatggcgct

SEQ ID NO: 29296 - DNA, 25 bp, E. coli
tattgcactcgctgaatatggcgct

SEQ ID NO: 29297 - DNA, 25 bp, E. coli
tgatgttgctggtttactggcgcgc

SEQ ID NO: 29298 - DNA, 25 bp, E. coli
tgggcggtgcgataaacctgctgat

SEQ ID NO: 29299 - DNA, 25 bp, E. coli
tgggcggtgcgaaaaacctgctgat

SEQ ID NO: 29300 - DNA, 25 bp, E. coli
tgatgttgctggattactggcgcgc

SEQ ID NO: 29301 - DNA, 25 bp, E. coli
tcgaaaaactggttaagccgttgct

SEQ ID NO: 29302 - DNA, 25 bp, E. coli
tcgaaaaactggataagccgttgct

SEQ ID NO: 29303 - DNA, 25 bp, E. coli
ccggatgtctgcaggtgatgctgcc

SEQ ID NO: 29304 - DNA, 25 bp, E. coli
gcaccaaaggctatctcaacgagtt

SEQ ID NO: 29305 - DNA, 25 bp, E. coli
gcaccaaaggctttctcaacgagtt

SEQ ID NO: 29306 - DNA, 25 bp, E. coli
ccggatgtctgctggtgatgctgcc

SEQ ID NO: 29307 - DNA, 25 bp, E. coli
gatgctgccagcgatgggcctgttc

SEQ ID NO: 29308 - DNA, 25 bp, E. coli
gatgccgctgtagtccagtatcgaa

SEQ ID NO: 29309 - DNA, 25 bp, E. coli
gatgctgccagccatgggcctgttc

SEQ ID NO: 29310 - DNA, 25 bp, E. coli
gatgccgctgtactccagtatcgaa

SEQ ID NO: 29311 - DNA, 25 bp, E. coli
aagcgtcccacaacgattaaccatg

SEQ ID NO: 29312 - DNA, 25 bp, E. coli
aagcgtcccacatcgattaaccatg

SEQ ID NO: 29313 - DNA, 25 bp, E. coli
ataattcctaaccatgaagcaaggg

SEQ ID NO: 29314 - DNA, 25 bp, E. coli
ataattcctaacgatgaagcaaggg

SEQ ID NO: 29315 - DNA, 25 bp, E. coli
tattggtgtaaattcacccgccagc

SEQ ID NO: 29316 - DNA, 25 bp, E. coli
tttatcagcacttttttaccgcgac

SEQ ID NO: 29317 - DNA, 25 bp, E. coli
tttatcagcactattttaccgcgac

SEQ ID NO: 29318 - DNA, 25 bp, E. coli
tattggtgtaaaatcacccgccagc

SEQ ID NO: 29319 - DNA, 25 bp, E. coli
ttaaccatgcttcaaggactgatgc

SEQ ID NO: 29320 - DNA, 25 bp, E. coli
ttaaccatgcttgaaggactgatgc

SEQ ID NO: 29321 - DNA, 25 bp, E. coli
gacttgcctgcatcatgtgtgactg

SEQ ID NO: 29322 - DNA, 25 bp, E. coli
gactgatgcagtgggatgaccgcaa

SEQ ID NO: 29323 - DNA, 25 bp, E. coli
gactgatgcagtcggatgaccgcaa

SEQ ID NO: 29324 - DNA, 25 bp, E. coli
gacttgcctgcaacatgtgtgactg

SEQ ID NO: 29325 - DNA, 25 bp, E. coli
gggaactcctgtccaaaagacagca

SEQ ID NO: 29326 - DNA, 25 bp, E. coli
ggttgcgttggttaagcgtcccaca

SEQ ID NO: 29327 - DNA, 25 bp, E. coli
gggaactcctgtgcaaaagacagca

SEQ ID NO: 29328 - DNA, 25 bp, E. coli
ggtgccccatgcctcagttttatca

SEQ ID NO: 29329 - DNA, 25 bp, E. coli
ggttgcgttggtaaagcgtcccaca

SEQ ID NO: 29330 - DNA, 25 bp, E. coli
ggtgccccatgcgtcagttttatca

SEQ ID NO: 29331 - DNA, 25 bp, E. coli
gatgaccgcaatactgaaagttgac

SEQ ID NO: 29332 - DNA, 25 bp, E. coli
gatgaccgcaattctgaaagttgac

SEQ ID NO: 29333 - DNA, 25 bp, E. coli
caatttttgctgttcggcagacccg

SEQ ID NO: 29334 - DNA, 25 bp, E. coli
caatttttgctgatcggcagacccg

SEQ ID NO: 29335 - DNA, 25 bp, E. coli
aaaatgctcacctgaatcaccgccg

SEQ ID NO: 29336 - DNA, 25 bp, E. coli
aaggccgcatggatcgttaccgacg

SEQ ID NO: 29337 - DNA, 25 bp, E. coli
aaattgcctgttctggtcgttcgcg

SEQ ID NO: 29338 - DNA, 25 bp, E. coli
aaattgcctgttgtggtcgttcgcg

SEQ ID NO: 29339 - DNA, 25 bp, E. coli
aaaatgctcaccagaatcaccgccg

SEQ ID NO: 29340 - DNA, 25 bp, E. coli
aaggccgcatggttcgttaccgacg

SEQ ID NO: 29341 - DNA, 25 bp, E. coli
tcttctgttgtgcaaaatgtcgccg

SEQ ID NO: 29342 - DNA, 25 bp, E. coli
tcttctgttgtggaaaatgtcgccg

SEQ ID NO: 29343 - DNA, 25 bp, E. coli
gaagagattctcaggctggaaacga

SEQ ID NO: 29344 - DNA, 25 bp, E. coli
gaagagattctctggctggaaacga

SEQ ID NO: 29345 - DNA, 25 bp, E. coli
gaaaaacctggctggcgcagcaact

SEQ ID NO: 29346 - DNA, 25 bp, E. coli
gaaaaacctggcaggcgcagcaact

SEQ ID NO: 29347 - DNA, 25 bp, E. coli
cgttagtacatctctggcaggtggc

SEQ ID NO: 29348 - DNA, 25 bp, E. coli
cgttagtacatcactggcaggtggc

SEQ ID NO: 29349 - DNA, 25 bp, E. coli
gttcctgcgtgggtgatacccgtaa

SEQ ID NO: 29350 - DNA, 25 bp, E. coli
gttcctgcgtggctgatacccgtaa

SEQ ID NO: 29351 - DNA, 25 bp, E. coli
taagcctcgttgattcctggcaagg

SEQ ID NO: 29352 - DNA, 25 bp, E. coli
taaggcaagcatccttgaaggtcag

SEQ ID NO: 29353 - DNA, 25 bp, E. coli
taagcctcgttgtttcctggcaagg

SEQ ID NO: 29354 - DNA, 25 bp, E. coli
taaggcaagcatgcttgaaggtcag

SEQ ID NO: 29355 - DNA, 25 bp, E. coli
acgtaatgacgatggcaccgaggct

SEQ ID NO: 29356 - DNA, 25 bp, E. coli
acgtaatgacgaaggcaccgaggct

SEQ ID NO: 29357 - DNA, 25 bp, E. coli
tgatgttggattgtgccaaaggacg

SEQ ID NO: 29358 - DNA, 25 bp, E. coli
tgatgttggattctgccaaaggacg

SEQ ID NO: 29359 - DNA, 25 bp, E. coli
tgcatgcccggcgtgcaatgaagct

SEQ ID NO: 29360 - DNA, 25 bp, E. coli
tgcagggttttgacgctgaagtgct

SEQ ID NO: 29361 - DNA, 25 bp, E. coli
tgcatgcccggcctgcaatgaagct

SEQ ID NO: 29362 - DNA, 25 bp, E. coli
tgcagggttttgtcgctgaagtgct

SEQ ID NO: 29363 - DNA, 25 bp, E. coli
tccacaggaagaggaagcactggcc

SEQ ID NO: 29364 - DNA, 25 bp, E. coli
tccacaggaagacgaagcactggcc

SEQ ID NO: 29365 - DNA, 25 bp, E. coli
ccaaaggacggcagattgaagttga

SEQ ID NO: 29366 - DNA, 25 bp, E. coli
ccaaaggacggctgattgaagttga

SEQ ID NO: 29367 - DNA, 25 bp, E. coli
gcgttattgcgcagctgatgttgga

SEQ ID NO: 29368 - DNA, 25 bp, E. coli
gcgttattgcgctgctgatgttgga

SEQ ID NO: 29369 - DNA, 25 bp, E. coli
cgaggctgaagccaacagcgttatt

SEQ ID NO: 29370 - DNA, 25 bp, E. coli
cgaggctgaagcgaacagcgttatt

SEQ ID NO: 29371 - DNA, 25 bp, E. coli
gattgaagttgatgcgaccggtcca

SEQ ID NO: 29372 - DNA, 25 bp, E. coli
gattgaagttgaagcgaccggtcca

SEQ ID NO: 29373 - DNA, 25 bp, E. coli
tggccgccgttaacgccctctttaa

SEQ ID NO: 29374 - DNA, 25 bp, E. coli
tggccgccgttatcgccctctttaa

SEQ ID NO: 29375 - DNA, 25 bp, E. coli
tcacaaacaagctgggcatgcatgc

SEQ ID NO: 29376 - DNA, 25 bp, E. coli
tcacaaacaagcagggcatgcatgc

SEQ ID NO: 29377 - DNA, 25 bp, E. coli
aaccgtgagcgggagtgaacaagtc

SEQ ID NO: 29378 - DNA, 25 bp, E. coli
aaccgtgagcggcagtgaacaagtc

SEQ ID NO: 29379 - DNA, 25 bp, E. coli
cacctgcggtttttcagtgcattca

SEQ ID NO: 29380 - DNA, 25 bp, E. coli
cacctgcggtttatcagtgcattca

SEQ ID NO: 29381 - DNA, 25 bp, E. coli
cactagcggcgttattcttaagctg

SEQ ID NO: 29382 - DNA, 25 bp, E. coli
cactagcggcgtaattcttaagctg

SEQ ID NO: 29383 - DNA, 25 bp, E. coli
catcagcgagattgaacgagtcagc

SEQ ID NO: 29384 - DNA, 25 bp, E. coli
catcagcgagatagaacgagtcagc

SEQ ID NO: 29385 - DNA, 25 bp, E. coli
gcatgagagttagccctatgtttta

SEQ ID NO: 29386 - DNA, 25 bp, E. coli
gcatgagagttacccctatgtttta

SEQ ID NO: 29387 - DNA, 25 bp, E. coli
gaatttgctggcgaggttgtcacta

SEQ ID NO: 29388 - DNA, 25 bp, E. coli
gaatttgctggccaggttgtcacta

SEQ ID NO: 29389 - DNA, 25 bp, E. coli
cgaggttgtcacaatgaagcatgag

SEQ ID NO: 29390 - DNA, 25 bp, E. coli
cgaggttgtcactatgaagcatgag

SEQ ID NO: 29391 - DNA, 25 bp, E. coli
cattcatagtacgttcatcagcgag

SEQ ID NO: 29392 - DNA, 25 bp, E. coli
cattcatagtaccttcatcagcgag

SEQ ID NO: 29393 - DNA, 25 bp, E. coli
gattctgtccccttacctggaacgg

SEQ ID NO: 29394 - DNA, 25 bp, E. coli
gattctgtccccatacctggaacgg

SEQ ID NO: 29395 - DNA, 25 bp, E. coli
taagctgagtgggatttcacctgcg

SEQ ID NO: 29396 - DNA, 25 bp, E. coli
tcaccatagccaggaacactagcgg

SEQ ID NO: 29397 - DNA, 25 bp, E. coli
tcaccatagccacgaacactagcgg

SEQ ID NO: 29398 - DNA, 25 bp, E. coli
taagctgagtggcatttcacctgcg

SEQ ID NO: 29399 - DNA, 25 bp, E. coli
cataatttacttttctgtcgatgca

SEQ ID NO: 29400 - DNA, 25 bp, E. coli
cataatttacttatctgtcgatgca

SEQ ID NO: 29401 - DNA, 25 bp, E. coli
aaagaaatgggcctcattgtccgga

SEQ ID NO: 29402 - DNA, 25 bp, E. coli
aaagaaatgggcgtcattgtccgga

SEQ ID NO: 29403 - DNA, 25 bp, E. coli
ttttccatggatatgcaacgcgtcc

SEQ ID NO: 29404 - DNA, 25 bp, E. coli
ttttccatggatttgcaacgcgtcc

SEQ ID NO: 29405 - DNA, 25 bp, E. coli
tccggagttttccatggatttgcaa

SEQ ID NO: 29406 - DNA, 25 bp, E. coli
tccggagttttcgatggatttgcaa

SEQ ID NO: 29407 - DNA, 25 bp, E. coli
tcgatgcaaagaaatgggcgtcatt

SEQ ID NO: 29408 - DNA, 25 bp, E. coli
tccattaaggataaggagagcagca

SEQ ID NO: 29409 - DNA, 25 bp, E. coli
tcgatgcaaagatatgggcgtcatt

SEQ ID NO: 29410 - DNA, 25 bp, E. coli
tccattaaggattaggagagcagca

SEQ ID NO: 29411 - DNA, 25 bp, E. coli
tctgtcgatgcaaagaaatgggcgt

SEQ ID NO: 29412 - DNA, 25 bp, E. coli
tctgtcgatgcatagaaatgggcgt

SEQ ID NO: 29413 - DNA, 25 bp, E. coli
gcaacgcgtccaataaggataagga

SEQ ID NO: 29414 - DNA, 25 bp, E. coli
gcaacgcgtccattaaggataagga

SEQ ID NO: 29415 - DNA, 25 bp, E. coli
gtcattgtccggtgttttccatgga

SEQ ID NO: 29416 - DNA, 25 bp, E. coli
gatttgcaacgcgtccattaaggat

SEQ ID NO: 29417 - DNA, 25 bp, E. coli
gatttgcaacgcctccattaaggat

SEQ ID NO: 29418 - DNA, 25 bp, E. coli
gtcattgtccggagttttccatgga

SEQ ID NO: 29419 - DNA, 25 bp, E. coli
gggcgtcattgtgcggagttttcca

SEQ ID NO: 29420 - DNA, 25 bp, E. coli
gggcgtcattgtccggagttttcca

SEQ ID NO: 29421 - DNA, 25 bp, E. coli
aagttgcccgctttcttcagacaga

SEQ ID NO: 29422 - DNA, 25 bp, E. coli
aagttgcccgctatcttcagacaga

SEQ ID NO: 29423 - DNA, 25 bp, E. coli
taaaatatacagacacaggcggaga

SEQ ID NO: 29424 - DNA, 25 bp, E. coli
taaaatatacagtcacaggcggaga

SEQ ID NO: 29425 - DNA, 25 bp, E. coli
tgagcaattaacaccagaagagcga

SEQ ID NO: 29426 - DNA, 25 bp, E. coli
tgagcaattaactccagaagagcga

SEQ ID NO: 29427 - DNA, 25 bp, E. coli
tcgatatcgatgacctggaggacaa

SEQ ID NO: 29428 - DNA, 25 bp, E. coli
tcgatatcgatgtcctggaggacaa

SEQ ID NO: 29429 - DNA, 25 bp, E. coli
gaaaattccgaatagaggctcttgc

SEQ ID NO: 29430 - DNA, 25 bp, E. coli
gaaaattccgaaaagaggctcttgc

SEQ ID NO: 29431 - DNA, 25 bp, E. coli
gaaactgcgctctgtgctccgatag

SEQ ID NO: 29432 - DNA, 25 bp, E. coli
gaaactgcgctcagtgctccgatag

SEQ ID NO: 29433 - DNA, 25 bp, E. coli
gataaacaactgacagccgtggcgt

SEQ ID NO: 29434 - DNA, 25 bp, E. coli
gatttgatcctccaggcgtcgggca

SEQ ID NO: 29435 - DNA, 25 bp, E. coli
gataaacaactgtcagccgtggcgt

SEQ ID NO: 29436 - DNA, 25 bp, E. coli
gatttgatcctcgaggcgtcgggca

SEQ ID NO: 29437 - DNA, 25 bp, E. coli
ggtgtgcgcgtagaaaaagttgccc

SEQ ID NO: 29438 - DNA, 25 bp, E. coli
gggcatacattagctctcaccggag

SEQ ID NO: 29439 - DNA, 25 bp, E. coli
ggtgtgcgcgtacaaaaagttgccc

SEQ ID NO: 29440 - DNA, 25 bp, E. coli
gggcatacattacctctcaccggag

SEQ ID NO: 29441 - DNA, 25 bp, E. coli
tggaggacaactacacatggcaact

SEQ ID NO: 29442 - DNA, 25 bp, E. coli
tggaggacaacttcacatggcaact

SEQ ID NO: 29443 - DNA, 25 bp, E. coli
caacgcgttacttgatgatgccgtg

SEQ ID NO: 29444 - DNA, 25 bp, E. coli
aagagtctgacccacaataacggcc

SEQ ID NO: 29445 - DNA, 25 bp, E. coli
aagagtctgaccgacaataacggcc

SEQ ID NO: 29446 - DNA, 25 bp, E. coli
caacgcgttactagatgatgccgtg

SEQ ID NO: 29447 - DNA, 25 bp, E. coli
aaatgcaacgcgatacttgatgatg

SEQ ID NO: 29448 - DNA, 25 bp, E. coli
aaatgcaacgcgttacttgatgatg

SEQ ID NO: 29449 - DNA, 25 bp, E. coli
ttgatgatgccgtggcactgatgcc

SEQ ID NO: 29450 - DNA, 25 bp, E. coli
ttgatgatgccgaggcactgatgcc

SEQ ID NO: 29451 - DNA, 25 bp, E. coli
tgcaacgcgttagttgatgatgccg

SEQ ID NO: 29452 - DNA, 25 bp, E. coli
tgcaacgcgttacttgatgatgccg

SEQ ID NO: 29453 - DNA, 25 bp, E. coli
tctgaccgacaaaaacggcccgtat

SEQ ID NO: 29454 - DNA, 25 bp, E. coli
tctgaccgacaataacggcccgtat

SEQ ID NO: 29455 - DNA, 25 bp, E. coli
gcgtgggataagtgtctgaccgaca

SEQ ID NO: 29456 - DNA, 25 bp, E. coli
gcgtgggataagagtctgaccgaca

SEQ ID NO: 29457 - DNA, 25 bp, E. coli
cgcgttacttgatgatgccgtggca

SEQ ID NO: 29458 - DNA, 25 bp, E. coli
cgttacttgatgatgccgtggcact

SEQ ID NO: 29459 - DNA, 25 bp, E. coli
cgttacttgatgttgccgtggcact

SEQ ID NO: 29460 - DNA, 25 bp, E. coli
cgcgttacttgaagatgccgtggca

SEQ ID NO: 29461 - DNA, 25 bp, E. coli
gataagagtctgtccgacaataacg

SEQ ID NO: 29462 - DNA, 25 bp, E. coli
gataagagtctgaccgacaataacg

SEQ ID NO: 29463 - DNA, 25 bp, E. coli
gagtctgaccgagaataacggcccg

SEQ ID NO: 29464 - DNA, 25 bp, E. coli
gagtctgaccgacaataacggcccg

SEQ ID NO: 29465 - DNA, 25 bp, E. coli
agcggcccttttatattgcatatta

SEQ ID NO: 29466 - DNA, 25 bp, E. coli
agcggcccttttttattgcatatta

SEQ ID NO: 29467 - DNA, 25 bp, E. coli
tataaacaaaggctcgcgaaagcgg

SEQ ID NO: 29468 - DNA, 25 bp, E. coli
tataaacaaagggtcgcgaaagcgg

SEQ ID NO: 29469 - DNA, 25 bp, E. coli
tattaaatcgtaatagtcacccgcc

SEQ ID NO: 29470 - DNA, 25 bp, E. coli
tattaaatcgtattagtcacccgcc

SEQ ID NO: 29471 - DNA, 25 bp, E. coli
ttttcttcacacctatacactaagg

SEQ ID NO: 29472 - DNA, 25 bp, E. coli
ttttcttcacacgtatacactaagg

SEQ ID NO: 29473 - DNA, 25 bp, E. coli
tcgtattagtcacccgccaggtgtg

SEQ ID NO: 29474 - DNA, 25 bp, E. coli
tcgtattagtcagccgccaggtgtg

SEQ ID NO: 29475 - DNA, 25 bp, E. coli
tctgtcaggtttatataaacaaagg

SEQ ID NO: 29476 - DNA, 25 bp, E. coli
tctgtcaggtttttataaacaaagg

SEQ ID NO: 29477 - DNA, 25 bp, E. coli
cctatacactaaggctataaatgat

SEQ ID NO: 29478 - DNA, 25 bp, E. coli
cctatacactaacgctataaatgat

SEQ ID NO: 29479 - DNA, 25 bp, E. coli
gaaaaaacgatgttctgatggcgtc

SEQ ID NO: 29480 - DNA, 25 bp, E. coli
gaaaaaacgatgatctgatggcgtc

SEQ ID NO: 29481 - DNA, 25 bp, E. coli
ccgccaggtgtgtcgaaaaaacgat

SEQ ID NO: 29482 - DNA, 25 bp, E. coli
ccgccaggtgtgacgaaaaaacgat

SEQ ID NO: 29483 - DNA, 25 bp, E. coli
gatatagtggttatagttagcacct

SEQ ID NO: 29484 - DNA, 25 bp, E. coli
gatatagtggttttagttagcacct

SEQ ID NO: 29485 - DNA, 25 bp, E. coli
gatggcgtctaagtggatggtttaa

SEQ ID NO: 29486 - DNA, 25 bp, E. coli
gatggcgtctaactggatggtttaa

SEQ ID NO: 29487 - DNA, 25 bp, E. coli
taaacgcctcatccgcccttgagga

SEQ ID NO: 29488 - DNA, 25 bp, E. coli
taaacgcctcatgcgcccttgagga

SEQ ID NO: 29489 - DNA, 25 bp, E. coli
agcgcgatcggctgccgcgttgtat

SEQ ID NO: 29490 - DNA, 25 bp, E. coli
agcgcgatcggcagccgcgttgtat

SEQ ID NO: 29491 - DNA, 25 bp, E. coli
tgtatcaggcatcctttcagactcc

SEQ ID NO: 29492 - DNA, 25 bp, E. coli
tgtatcaggcatgctttcagactcc

SEQ ID NO: 29493 - DNA, 25 bp, E. coli
tcagactcctcccaatccttaagta

SEQ ID NO: 29494 - DNA, 25 bp, E. coli
tcagactcctccgaatccttaagta

SEQ ID NO: 29495 - DNA, 25 bp, E. coli
tcgacgtacactcgcggatgtggca

SEQ ID NO: 29496 - DNA, 25 bp, E. coli
tctccttcgcttccatgattggcat

SEQ ID NO: 29497 - DNA, 25 bp, E. coli
tctccttcgcttgcatgattggcat

SEQ ID NO: 29498 - DNA, 25 bp, E. coli
tcgacgtacactggcggatgtggca

SEQ ID NO: 29499 - DNA, 25 bp, E. coli
gcggatgtggcaaaaacgcctcatc

SEQ ID NO: 29500 - DNA, 25 bp, E. coli
gcggatgtggcataaacgcctcatc

SEQ ID NO: 29501 - DNA, 25 bp, E. coli
cgcccttgaggaacagcgcgatcgg

SEQ ID NO: 29502 - DNA, 25 bp, E. coli
cgcgcttttcatcttctgtctgata

SEQ ID NO: 29503 - DNA, 25 bp, E. coli
cgcgcttttcatgttctgtctgata

SEQ ID NO: 29504 - DNA, 25 bp, E. coli
cgcccttgaggatcagcgcgatcgg

SEQ ID NO: 29505 - DNA, 25 bp, E. coli
gatagctgctttactccttcgcttg

SEQ ID NO: 29506 - DNA, 25 bp, E. coli
gatagctgcttttctccttcgcttg

SEQ ID NO: 29507 - DNA, 25 bp, E. coli
ttaagtatttccagccattcccgcg

SEQ ID NO: 29508 - DNA, 25 bp, E. coli
ttaagtatttcctgccattcccgcg

SEQ ID NO: 29509 - DNA, 25 bp, E. coli
aagaacatggctaaacgcgcggggc

SEQ ID NO: 29510 - DNA, 25 bp, E. coli
aagaacatggcttaacgcgcggggc

SEQ ID NO: 29511 - DNA, 25 bp, E. coli
catcgactgaaagaacatggcttaa

SEQ ID NO: 29512 - DNA, 25 bp, E. coli
catgagttacatggactgaaagaac

SEQ ID NO: 29513 - DNA, 25 bp, E. coli
catcgactgaaacaacatggcttaa

SEQ ID NO: 29514 - DNA, 25 bp, E. coli
catgagttacatcgactgaaagaac

SEQ ID NO: 29515 - DNA, 25 bp, E. coli
tacatcgactgatagaacatggctt

SEQ ID NO: 29516 - DNA, 25 bp, E. coli
tacatcgactgaaagaacatggctt

SEQ ID NO: 29517 - DNA, 25 bp, E. coli
ttcagggttattttcgcccgcatat

SEQ ID NO: 29518 - DNA, 25 bp, E. coli
ttcagggttattatcgcccgcatat

SEQ ID NO: 29519 - DNA, 25 bp, E. coli
tcgactgaaagaacatggcttaacg

SEQ ID NO: 29520 - DNA, 25 bp, E. coli
tcgactgaaagatcatggcttaacg

SEQ ID NO: 29521 - DNA, 25 bp, E. coli
gcacgttcagggatattttcgcccg

SEQ ID NO: 29522 - DNA, 25 bp, E. coli
gcacgttcagggttattttcgcccg

SEQ ID NO: 29523 - DNA, 25 bp, E. coli
gactgaaagaacttggcttaacgcg

SEQ ID NO: 29524 - DNA, 25 bp, E. coli
gactgaaagaacatggcttaacgcg

SEQ ID NO: 29525 - DNA, 25 bp, E. coli
ctgaaagaacatggcttaacgcgcg

SEQ ID NO: 29526 - DNA, 25 bp, E. coli
cgttcagggttattttcgcccgcat

SEQ ID NO: 29527 - DNA, 25 bp, E. coli
cgttcagggttaatttcgcccgcat

SEQ ID NO: 29528 - DNA, 25 bp, E. coli
ctgaaagaacatcgcttaacgcgcg

SEQ ID NO: 29529 - DNA, 25 bp, E. coli
gttacatcgactcaaagaacatggc

SEQ ID NO: 29530 - DNA, 25 bp, E. coli
gttacatcgactgaaagaacatggc

SEQ ID NO: 29531 - DNA, 25 bp, E. coli
cacagaggcggaataacgggttcat

SEQ ID NO: 29532 - DNA, 25 bp, E. coli
cacagaggcggattaacgggttcat

SEQ ID NO: 29533 - DNA, 25 bp, E. coli
tacttaaccttgtggatcatctcgg

SEQ ID NO: 29534 - DNA, 25 bp, E. coli
tacttaaccttgaggatcatctcgg

SEQ ID NO: 29535 - DNA, 25 bp, E. coli
taggtcagttaaatcacgtcgcaaa

SEQ ID NO: 29536 - DNA, 25 bp, E. coli
taggtcagttaattcacgtcgcaaa

SEQ ID NO: 29537 - DNA, 25 bp, E. coli
tgtcaaaacaccttcgaccggcagt

SEQ ID NO: 29538 - DNA, 25 bp, E. coli
tgtcaaaacaccatcgaccggcagt

SEQ ID NO: 29539 - DNA, 25 bp, E. coli
tgtaatgggctttccccatcgcgga

SEQ ID NO: 29540 - DNA, 25 bp, E. coli
tgtaatgggcttaccccatcgcgga

SEQ ID NO: 29541 - DNA, 25 bp, E. coli
tgacgttttcaagccacagaggcgg

SEQ ID NO: 29542 - DNA, 25 bp, E. coli
tgcacggcctgtgagatcacgtagg

SEQ ID NO: 29543 - DNA, 25 bp, E. coli
tgcacggcctgtcagatcacgtagg

SEQ ID NO: 29544 - DNA, 25 bp, E. coli
tgacgttttcaacccacagaggcgg

SEQ ID NO: 29545 - DNA, 25 bp, E. coli
tcaggcatactgtggaggctgcccg

SEQ ID NO: 29546 - DNA, 25 bp, E. coli
tcaggcatactgaggaggctgcccg

SEQ ID NO: 29547 - DNA, 25 bp, E. coli
ccatcgcggactactacggaagctc

SEQ ID NO: 29548 - DNA, 25 bp, E. coli
ccatcgcggacttctacggaagctc

SEQ ID NO: 29549 - DNA, 25 bp, E. coli
gctgccccggtgtttcgcatacatg

SEQ ID NO: 29550 - DNA, 25 bp, E. coli
gctgccccggtgattcgcatacatg

SEQ ID NO: 29551 - DNA, 25 bp, E. coli
tggcagaagtcagcaacgcaagcgt

SEQ ID NO: 29552 - DNA, 25 bp, E. coli
tggcagaagtcaccaacgcaagcgt

SEQ ID NO: 29553 - DNA, 25 bp, E. coli
aaggtcgaaggctatgtcagtgaag

SEQ ID NO: 29554 - DNA, 25 bp, E. coli
aaggtcgaaggcaatgtcagtgaag

SEQ ID NO: 29555 - DNA, 25 bp, E. coli
cactgtggagccctgcagtctttgc

SEQ ID NO: 29556 - DNA, 25 bp, E. coli
cactgtggagccgtgcagtctttgc

SEQ ID NO: 29557 - DNA, 25 bp, E. coli
actgtggagccgtgcagtctttgcg

SEQ ID NO: 29558 - DNA, 25 bp, E. coli
actgtggagccgagcagtctttgcg

SEQ ID NO: 29559 - DNA, 25 bp, E. coli
tgccactgtggagccgtgcagtctt

SEQ ID NO: 29560 - DNA, 25 bp, E. coli
tcgaaggcaatgtcagtgaagtgct

SEQ ID NO: 29561 - DNA, 25 bp, E. coli
tcgaaggcaatgacagtgaagtgct

SEQ ID NO: 29562 - DNA, 25 bp, E. coli
tgccactgtggacccgtgcagtctt

SEQ ID NO: 29563 - DNA, 25 bp, E. coli
tcagtctaccttaggcgagaaaact

SEQ ID NO: 29564 - DNA, 25 bp, E. coli
tcagtctacctttggcgagaaaact

SEQ ID NO: 29565 - DNA, 25 bp, E. coli
cgttaaggtcgatggcaatgtcagt

SEQ ID NO: 29566 - DNA, 25 bp, E. coli
cttgccactgtgcagccgtgcagtc

SEQ ID NO: 29567 - DNA, 25 bp, E. coli
cgttaaggtcgaaggcaatgtcagt

SEQ ID NO: 29568 - DNA, 25 bp, E. coli
cttgccactgtggagccgtgcagtc

SEQ ID NO: 29569 - DNA, 25 bp, E. coli
gttaaggtcgaaggcaatgtcagtg

SEQ ID NO: 29570 - DNA, 25 bp, E. coli
gttaaggtcgaacgcaatgtcagtg

SEQ ID NO: 29571 - DNA, 25 bp, E. coli
gtcgaaggcaatctcagtgaagtgc

SEQ ID NO: 29572 - DNA, 25 bp, E. coli
gtcgaaggcaatgtcagtgaagtgc

SEQ ID NO: 29573 - DNA, 25 bp, E. coli
taaggtcgaagggaatgtcagtgaa

SEQ ID NO: 29574 - DNA, 25 bp, E. coli
taaggtcgaaggcaatgtcagtgaa

SEQ ID NO: 29575 - DNA, 25 bp, E. coli
caggaaaagctgagcaaccgggagc

SEQ ID NO: 29576 - DNA, 25 bp, E. coli
caggaaaagctgtgcaaccgggagc

SEQ ID NO: 29577 - DNA, 25 bp, E. coli
aaaagctgagcaaccgggagcgcga

SEQ ID NO: 29578 - DNA, 25 bp, E. coli
aaaagctgagcatccgggagcgcga

SEQ ID NO: 29579 - DNA, 25 bp, E. coli
tgatccacgccctgcaggaaaagct

SEQ ID NO: 29580 - DNA, 25 bp, E. coli
tgatccacgcccagcaggaaaagct

SEQ ID NO: 29581 - DNA, 25 bp, E. coli
tgcaggcgcagcaggataaactccg

SEQ ID NO: 29582 - DNA, 25 bp, E. coli
tgcaggcgcagctggataaactccg

SEQ ID NO: 29583 - DNA, 25 bp, E. coli
tctgcaggcgcacctggataaactc

SEQ ID NO: 29584 - DNA, 25 bp, E. coli
tctgcaggcgcagctggataaactc

SEQ ID NO: 29585 - DNA, 25 bp, E. coli
gcctggccgaacaggaagcgctgat

SEQ ID NO: 29586 - DNA, 25 bp, E. coli
gcctggccgaactggaagcgctgat

SEQ ID NO: 29587 - DNA, 25 bp, E. coli
gcgcagctggattaactccgccgga

SEQ ID NO: 29588 - DNA, 25 bp, E. coli
gcgcagctggataaactccgccgga

SEQ ID NO: 29589 - DNA, 25 bp, E. coli
gaacaggaagcgctgatccacgccc

SEQ ID NO: 29590 - DNA, 25 bp, E. coli
gaacaggaagcggtgatccacgccc

SEQ ID NO: 29591 - DNA, 25 bp, E. coli
ctgaaacagcgcgtggccgaacagg

SEQ ID NO: 29592 - DNA, 25 bp, E. coli
ctgaaacagcgcctggccgaacagg

SEQ ID NO: 29593 - DNA, 25 bp, E. coli
tggccgaacaggaagcgctgatcca

SEQ ID NO: 29594 - DNA, 25 bp, E. coli
tggccgaacaggtagcgctgatcca

SEQ ID NO: 29595 - DNA, 25 bp, E. coli
gagcaaccgggaccgcgaaatagac

SEQ ID NO: 29596 - DNA, 25 bp, E. coli
gagcaaccgggagcgcgaaatagac

SEQ ID NO: 29597 - DNA, 25 bp, E. coli
aaggatcttctttactgggcagcga

SEQ ID NO: 29598 - DNA, 25 bp, E. coli
aaggatcttcttaactgggcagcga

SEQ ID NO: 29599 - DNA, 25 bp, E. coli
taaagatctgaatgattgcgcggtc

SEQ ID NO: 29600 - DNA, 25 bp, E. coli
taaagatctgaaagattgcgcggtc

SEQ ID NO: 29601 - DNA, 25 bp, E. coli
acataaagttgatgcgccgtcaggc

SEQ ID NO: 29602 - DNA, 25 bp, E. coli
acataaagttgaagcgccgtcaggc

SEQ ID NO: 29603 - DNA, 25 bp, E. coli
taccgcgatgtttgccgatattggc

SEQ ID NO: 29604 - DNA, 25 bp, E. coli
taccgcgatgttagccgatattggc

SEQ ID NO: 29605 - DNA, 25 bp, E. coli
tattggcgagcgtctggagatcacc

SEQ ID NO: 29606 - DNA, 25 bp, E. coli
tattggcgagcgactggagatcacc

SEQ ID NO: 29607 - DNA, 25 bp, E. coli
ttttgccaccgtgcgtgcaggtgac

SEQ ID NO: 29608 - DNA, 25 bp, E. coli
ttttgccaccgtccgtgcaggtgac

SEQ ID NO: 29609 - DNA, 25 bp, E. coli
tgcatgatgcaaacatccgcgttgc

SEQ ID NO: 29610 - DNA, 25 bp, E. coli
tgcatgatgcaatcatccgcgttgc

SEQ ID NO: 29611 - DNA, 25 bp, E. coli
tgcgcggtctactgtcgtgaaggcc

SEQ ID NO: 29612 - DNA, 25 bp, E. coli
tgcgcggtctacagtcgtgaaggcc

SEQ ID NO: 29613 - DNA, 25 bp, E. coli
tctcgctttttgacgccagcatggc

SEQ ID NO: 29614 - DNA, 25 bp, E. coli
tctcgctttttgtcgccagcatggc

SEQ ID NO: 29615 - DNA, 25 bp, E. coli
ccagcatggcaaagggatggtgatc

SEQ ID NO: 29616 - DNA, 25 bp, E. coli
ccagcatggcaatgggatggtgatc

SEQ ID NO: 29617 - DNA, 25 bp, E. coli
ccgtccggaaggaacgctgaaccat

SEQ ID NO: 29618 - DNA, 25 bp, E. coli
ccgtccggaaggtacgctgaaccat

SEQ ID NO: 29619 - DNA, 25 bp, E. coli
cagtcgtgcatgatgattagcgtcc

SEQ ID NO: 29620 - DNA, 25 bp, E. coli
cagtcgtgcatgttgattagcgtcc

SEQ ID NO: 29621 - DNA, 25 bp, E. coli
tgaaaggcggtgaagtgattcgcgc

SEQ ID NO: 29622 - DNA, 25 bp, E. coli
tgaaaggcggtgtagtgattcgcgc

SEQ ID NO: 29623 - DNA, 25 bp, E. coli
tctgggttacgttacaccgcttgcc

SEQ ID NO: 29624 - DNA, 25 bp, E. coli
tctgggttacgtaacaccgcttgcc

SEQ ID NO: 29625 - DNA, 25 bp, E. coli
gcatgttgattaccgtccagtgcga

SEQ ID NO: 29626 - DNA, 25 bp, E. coli
gcatgttgattagcgtccagtgcga

SEQ ID NO: 29627 - DNA, 25 bp, E. coli
cgtttgtcgctgatagccaaccgga

SEQ ID NO: 29628 - DNA, 25 bp, E. coli
cgtttgtcgctgttagccaaccgga

SEQ ID NO: 29629 - DNA, 25 bp, E. coli
cggtaacggtgatcgagcacgcaga

SEQ ID NO: 29630 - DNA, 25 bp, E. coli
cggtaacggtgaacgagcacgcaga

SEQ ID NO: 29631 - DNA, 25 bp, E. coli
gattagcgtccagtgcgagaacgat

SEQ ID NO: 29632 - DNA, 25 bp, E. coli
gttacaccgcttgccgctggtgcgt

SEQ ID NO: 29633 - DNA, 25 bp, E. coli
gttacaccgcttcccgctggtgcgt

SEQ ID NO: 29634 - DNA, 25 bp, E. coli
gattagcgtccactgcgagaacgat

SEQ ID NO: 29635 - DNA, 25 bp, E. coli
gtcgctgatagcgaaccggacgtgc

SEQ ID NO: 29636 - DNA, 25 bp, E. coli
ggttacgttacaccgcttgccgctg

SEQ ID NO: 29637 - DNA, 25 bp, E. coli
gtcgctgatagccaaccggacgtgc

SEQ ID NO: 29638 - DNA, 25 bp, E. coli
ggttacgttacagcgcttgccgctg

SEQ ID NO: 29639 - DNA, 25 bp, E. coli
taacggtgatcgagcacgcagaacc

SEQ ID NO: 29640 - DNA, 25 bp, E. coli
taacggtgatcgtgcacgcagaacc

SEQ ID NO: 29641 - DNA, 25 bp, E. coli
aaattgatcaacatcctgctgcgcc

SEQ ID NO: 29642 - DNA, 25 bp, E. coli
aaattgatcaacttcctgctgcgcc

SEQ ID NO: 29643 - DNA, 25 bp, E. coli
tatcagaagctgaaagcaggacgtt

SEQ ID NO: 29644 - DNA, 25 bp, E. coli
tatcagaagctgtaagcaggacgtt

SEQ ID NO: 29645 - DNA, 25 bp, E. coli
tatttctacaactggaccgagtacg

SEQ ID NO: 29646 - DNA, 25 bp, E. coli
tatttctacaacaggaccgagtacg

SEQ ID NO: 29647 - DNA, 25 bp, E. coli
ttaacctcggcaagatctggaacgg

SEQ ID NO: 29648 - DNA, 25 bp, E. coli
ttaacctcggcatgatctggaacgg

SEQ ID NO: 29649 - DNA, 25 bp, E. coli
tgaaaaaatggtcacgccacctgct

SEQ ID NO: 29650 - DNA, 25 bp, E. coli
tgaaaaaatggtgacgccacctgct

SEQ ID NO: 29651 - DNA, 25 bp, E. coli
tgcgcccggatgaggcaaaacaggt

SEQ ID NO: 29652 - DNA, 25 bp, E. coli
tgccaaaaacaatgaaggcgcgctg

SEQ ID NO: 29653 - DNA, 25 bp, E. coli
tgccaaaaacaaagaaggcgcgctg

SEQ ID NO: 29654 - DNA, 25 bp, E. coli
tgcgcccggatgtggcaaaacaggt

SEQ ID NO: 29655 - DNA, 25 bp, E. coli
ccgatccgaaagagattgaagctgc

SEQ ID NO: 29656 - DNA, 25 bp, E. coli
ccgatccgaaagtgattgaagctgc

SEQ ID NO: 29657 - DNA, 25 bp, E. coli
cgtaagctgggctactccggtaaca

SEQ ID NO: 29658 - DNA, 25 bp, E. coli
cgtaagctgggcaactccggtaaca

SEQ ID NO: 29659 - DNA, 25 bp, E. coli
gatccgaaatctgtcaccagctggg

SEQ ID NO: 29660 - DNA, 25 bp, E. coli
gatccgaaatctctcaccagctggg

SEQ ID NO: 29661 - DNA, 25 bp, E. coli
gacgatgcccgtgaagtgttccaga

SEQ ID NO: 29662 - DNA, 25 bp, E. coli
gacgatgcccgtcaagtgttccaga

SEQ ID NO: 29663 - DNA, 25 bp, E. coli
caaagcggtagacggcaagttatga

SEQ ID NO: 29664 - DNA, 25 bp, E. coli
caaagcggtagagggcaagttatga

SEQ ID NO: 29665 - DNA, 25 bp, E. coli
cagataaacgctggtgagccgctgt

SEQ ID NO: 29666 - DNA, 25 bp, E. coli
cagataaacgctcgtgagccgctgt

SEQ ID NO: 29667 - DNA, 25 bp, E. coli
taaacgtcagtctgcgcaagttgcc

SEQ ID NO: 29668 - DNA, 25 bp, E. coli
acgcccatcacaattctgctggtgg

SEQ ID NO: 29669 - DNA, 25 bp, E. coli
acgcccatcacatttctgctggtgg

SEQ ID NO: 29670 - DNA, 25 bp, E. coli
aaatctttgtgaagttcggtctgca

SEQ ID NO: 29671 - DNA, 25 bp, E. coli
aaatctttgtgatgttcggtctgca

SEQ ID NO: 29672 - DNA, 25 bp, E. coli
tgcttgattcacctcaggccgtttt

SEQ ID NO: 29673 - DNA, 25 bp, E. coli
tgcttgattcacgtcaggccgtttt

SEQ ID NO: 29674 - DNA, 25 bp, E. coli
gcaagttgcccagcaagagaaaaca

SEQ ID NO: 29675 - DNA, 25 bp, E. coli
gcaagttgcccaccaagagaaaaca

SEQ ID NO: 29676 - DNA, 25 bp, E. coli
cgcagggaaacggttcagcggcaat

SEQ ID NO: 29677 - DNA, 25 bp, E. coli
cgcagggaaacgcttcagcggcaat

SEQ ID NO: 29678 - DNA, 25 bp, E. coli
ctgaaaggtatgatggctctggcac

SEQ ID NO: 29679 - DNA, 25 bp, E. coli
ctgaaaggtatgttggctctggcac

SEQ ID NO: 29680 - DNA, 25 bp, E. coli
cttcgttatcgcgtgcataagtggg

SEQ ID NO: 29681 - DNA, 25 bp, E. coli
cttcgttatcgcctgcataagtggg

SEQ ID NO: 29682 - DNA, 25 bp, E. coli
tcagcggcgttgtcaggtttgtttg

SEQ ID NO: 29683 - DNA, 25 bp, E. coli
taaacgtcagtcagcgcaagttgcc

SEQ ID NO: 29684 - DNA, 25 bp, E. coli
tcagcggcgttgacaggtttgtttg

SEQ ID NO: 29685 - DNA, 25 bp, E. coli
caggaacctggtattctgtggaagg

SEQ ID NO: 29686 - DNA, 25 bp, E. coli
catttggcgacggaatggctgagca

SEQ ID NO: 29687 - DNA, 25 bp, E. coli
caggaacctggttttctgtggaagg

SEQ ID NO: 29688 - DNA, 25 bp, E. coli
catttggcgacgcaatggctgagca

SEQ ID NO: 29689 - DNA, 25 bp, E. coli
agtgaaaagaaccacgaagccggtg

SEQ ID NO: 29690 - DNA, 25 bp, E. coli
cacgaagccggtgggatctaccttt

SEQ ID NO: 29691 - DNA, 25 bp, E. coli
gagtcgattaatcaggaacctggtt

SEQ ID NO: 29692 - DNA, 25 bp, E. coli
acttcattttgcttttaatggccca

SEQ ID NO: 29693 - DNA, 25 bp, E. coli
cacgaagccggtcggatctaccttt

SEQ ID NO: 29694 - DNA, 25 bp, E. coli
agtgaaaagaacgacgaagccggtg

SEQ ID NO: 29695 - DNA, 25 bp, E. coli
gagtcgattaatgaggaacctggtt

SEQ ID NO: 29696 - DNA, 25 bp, E. coli
acgcaatggctgtgcagcttaaacc

SEQ ID NO: 29697 - DNA, 25 bp, E. coli
acgcaatggctgagcagcttaaacc

SEQ ID NO: 29698 - DNA, 25 bp, E. coli
acttcattttgcatttaatggccca

SEQ ID NO: 29699 - DNA, 25 bp, E. coli
ggaagttgtcgccaaagttttcgat

SEQ ID NO: 29700 - DNA, 25 bp, E. coli
ggaagttgtcgcgaaagttttcgat

SEQ ID NO: 29701 - DNA, 25 bp, E. coli
tggacagaaagtgaaaagaaccacg

SEQ ID NO: 29702 - DNA, 25 bp, E. coli
tggacagaaagtcaaaagaaccacg

SEQ ID NO: 29703 - DNA, 25 bp, E. coli
taatggcccatttggcgacgcaatg

SEQ ID NO: 29704 - DNA, 25 bp, E. coli
taatggcccattaggcgacgcaatg

SEQ ID NO: 29705 - DNA, 25 bp, E. coli
gtcgccaaagttttcgatgtcaatg

SEQ ID NO: 29706 - DNA, 25 bp, E. coli
gtcgccaaagttatcgatgtcaatg

SEQ ID NO: 29707 - DNA, 25 bp, E. coli
caatggatggtgattaagccttccg

SEQ ID NO: 29708 - DNA, 25 bp, E. coli
cttcgaagagcgagggttgaacccg

SEQ ID NO: 29709 - DNA, 25 bp, E. coli
caatggatggtgtttaagccttccg

SEQ ID NO: 29710 - DNA, 25 bp, E. coli
cttcgaagagcgtgggttgaacccg

SEQ ID NO: 29711 - DNA, 25 bp, E. coli
catctggtcgcacgccggacttgat

SEQ ID NO: 29712 - DNA, 25 bp, E. coli
catctggtcgcaggccggacttgat

SEQ ID NO: 29713 - DNA, 25 bp, E. coli
agattggcggcaaagtgcataccca

SEQ ID NO: 29714 - DNA, 25 bp, E. coli
agattggcggcatagtgcataccca

SEQ ID NO: 29715 - DNA, 25 bp, E. coli
taccgtcgctttgcggagattggcg

SEQ ID NO: 29716 - DNA, 25 bp, E. coli
taccgtcgctttccggagattggcg

SEQ ID NO: 29717 - DNA, 25 bp, E. coli
tgatgaccgcagaagagatcaacgg

SEQ ID NO: 29718 - DNA, 25 bp, E. coli
tgatgaccgcagtagagatcaacgg

SEQ ID NO: 29719 - DNA, 25 bp, E. coli
gccttccggcgttgagtatgaggta

SEQ ID NO: 29720 - DNA, 25 bp, E. coli
gccttccggcgtagagtatgaggta

SEQ ID NO: 29721 - DNA, 25 bp, E. coli
gaaagctgacgtgctggcggcaaac

SEQ ID NO: 29722 - DNA, 25 bp, E. coli
gaaagctgacgtcctggcggcaaac

SEQ ID NO: 29723 - DNA, 25 bp, E. coli
gatcaacggcgactatgaataccag

SEQ ID NO: 29724 - DNA, 25 bp, E. coli
gtatgaggtaatgaccgccgacgat

SEQ ID NO: 29725 - DNA, 25 bp, E. coli
gatcaacggcgagtatgaataccag

SEQ ID NO: 29726 - DNA, 25 bp, E. coli
gtatgaggtaatcaccgccgacgat

SEQ ID NO: 29727 - DNA, 25 bp, E. coli
taacgccgtggttctggaagagtgc

SEQ ID NO: 29728 - DNA, 25 bp, E. coli
taacgccgtggtactggaagagtgc

SEQ ID NO: 29729 - DNA, 25 bp, E. coli
caaccgctgtttgaagatcgtcgac

SEQ ID NO: 29730 - DNA, 25 bp, E. coli
caaccgctgtttcaagatcgtcgac

SEQ ID NO: 29731 - DNA, 25 bp, E. coli
tttggtaacgctggtgccgatgtcg

SEQ ID NO: 29732 - DNA, 25 bp, E. coli
tttggtaacgctcgtgccgatgtcg

SEQ ID NO: 29733 - DNA, 25 bp, E. coli
ttggtgctttcagtaaccggctgcg

SEQ ID NO: 29734 - DNA, 25 bp, E. coli
ttggtgctttcactaaccggctgcg

SEQ ID NO: 29735 - DNA, 25 bp, E. coli
tggtcaacggcatcctgcatgtggt

SEQ ID NO: 29736 - DNA, 25 bp, E. coli
tggtcaacggcaacctgcatgtggt

SEQ ID NO: 29737 - DNA, 25 bp, E. coli
gatgtcgaagcctccggtggtaaca

SEQ ID NO: 29738 - DNA, 25 bp, E. coli
gatgtcgaagccaccggtggtaaca

SEQ ID NO: 29739 - DNA, 25 bp, E. coli
gcaaaagctcctctgcgaatgccag

SEQ ID NO: 29740 - DNA, 25 bp, E. coli
gcaaaagctcctgtgcgaatgccag

SEQ ID NO: 29741 - DNA, 25 bp, E. coli
gattaactatggctatcaaccgctg

SEQ ID NO: 29742 - DNA, 25 bp, E. coli
gatcgtcgaccaggcaatattggcg

SEQ ID NO: 29743 - DNA, 25 bp, E. coli
gatacgctgaccttcgtgttgcagg

SEQ ID NO: 29744 - DNA, 25 bp, E. coli
gattaactatgggtatcaaccgctg

SEQ ID NO: 29745 - DNA, 25 bp, E. coli
gatacgctgaccatcgtgttgcagg

SEQ ID NO: 29746 - DNA, 25 bp, E. coli
ggatgcgcgcattgaatacgtaggc

SEQ ID NO: 29747 - DNA, 25 bp, E. coli
ggatgcgcgcatagaatacgtaggc

SEQ ID NO: 29748 - DNA, 25 bp, E. coli
taatccacgcacaatcagcggcagc

SEQ ID NO: 29749 - DNA, 25 bp, E. coli
taatccacgcactatcagcggcagc

SEQ ID NO: 29750 - DNA, 25 bp, E. coli
gatcgtcgaccacgcaatattggcg

SEQ ID NO: 29751 - DNA, 25 bp, E. coli
caacgtgattccactggcaccgggt

SEQ ID NO: 29752 - DNA, 25 bp, E. coli
caacgtgattcctctggcaccgggt

SEQ ID NO: 29753 - DNA, 25 bp, E. coli
tacgggttacctgctgttatgagca

SEQ ID NO: 29754 - DNA, 25 bp, E. coli
tacgggttacctcctgttatgagca

SEQ ID NO: 29755 - DNA, 25 bp, E. coli
tatctgccgctttgccggtcatctt

SEQ ID NO: 29756 - DNA, 25 bp, E. coli
tatctgccgcttagccggtcatctt

SEQ ID NO: 29757 - DNA, 25 bp, E. coli
tttatcggagtttcgcaaatgcgca

SEQ ID NO: 29758 - DNA, 25 bp, E. coli
tttatcggagttacgcaaatgcgca

SEQ ID NO: 29759 - DNA, 25 bp, E. coli
ttctcacttctagagtgtcgcccaa

SEQ ID NO: 29760 - DNA, 25 bp, E. coli
ttctcacttctacagtgtcgcccaa

SEQ ID NO: 29761 - DNA, 25 bp, E. coli
tcctgttatgagcacgccagtgaaa

SEQ ID NO: 29762 - DNA, 25 bp, E. coli
tcctgttatgaggacgccagtgaaa

SEQ ID NO: 29763 - DNA, 25 bp, E. coli
tcatgcctacggcatgtttatggaa

SEQ ID NO: 29764 - DNA, 25 bp, E. coli
tcatgcctacgggatgtttatggaa

SEQ ID NO: 29765 - DNA, 25 bp, E. coli
gccggtcatcttactcacttctaca

SEQ ID NO: 29766 - DNA, 25 bp, E. coli
gccggtcatctttctcacttctaca

SEQ ID NO: 29767 - DNA, 25 bp, E. coli
tggcaccgggtcatgcctacgggat

SEQ ID NO: 29768 - DNA, 25 bp, E. coli
tggcaccgggtcttgcctacgggat

SEQ ID NO: 29769 - DNA, 25 bp, E. coli
tatggaacgttttaacgatttatcg

SEQ ID NO: 29770 - DNA, 25 bp, E. coli
tatggaacgtttaaacgatttatcg

SEQ ID NO: 29771 - DNA, 25 bp, E. coli
gagatgttcaacctgattccactgg

SEQ ID NO: 29772 - DNA, 25 bp, E. coli
gagatgttcaacgtgattccactgg

SEQ ID NO: 29773 - DNA, 25 bp, E. coli
caccgtacgggcagttttcagcaat

SEQ ID NO: 29774 - DNA, 25 bp, E. coli
cacggtacatcggtgcatttcgtca

SEQ ID NO: 29775 - DNA, 25 bp, E. coli
cacggtacatcgctgcatttcgtca

SEQ ID NO: 29776 - DNA, 25 bp, E. coli
caccgtacgggctgttttcagcaat

SEQ ID NO: 29777 - DNA, 25 bp, E. coli
cactggtgattacctggtttgccga

SEQ ID NO: 29778 - DNA, 25 bp, E. coli
cactggtgattagctggtttgccga

SEQ ID NO: 29779 - DNA, 25 bp, E. coli
tacaggcgaaagtcccggtatttgc

SEQ ID NO: 29780 - DNA, 25 bp, E. coli
tacaggcgaaagacccggtatttgc

SEQ ID NO: 29781 - DNA, 25 bp, E. coli
aaaacgccgcgtcgctggatggtca

SEQ ID NO: 29782 - DNA, 25 bp, E. coli
aaaacgccgcgtggctggatggtca

SEQ ID NO: 29783 - DNA, 25 bp, E. coli
tatgccgggcgtatgctgaacattc

SEQ ID NO: 29784 - DNA, 25 bp, E. coli
tatgccgggcgtttgctgaacattc

SEQ ID NO: 29785 - DNA, 25 bp, E. coli
ttttcagcaataaggccgacgcgtt

SEQ ID NO: 29786 - DNA, 25 bp, E. coli
ttttcagcaatatggccgacgcgtt

SEQ ID NO: 29787 - DNA, 25 bp, E. coli
tgtggtgcttatatccggcaacgga

SEQ ID NO: 29788 - DNA, 25 bp, E. coli
tgtggtgcttatttccggcaacgga

SEQ ID NO: 29789 - DNA, 25 bp, E. coli
gaaatcgacatgtacgcacccgatg

SEQ ID NO: 29790 - DNA, 25 bp, E. coli
gaaatcgacatgaacgcacccgatg

SEQ ID NO: 29791 - DNA, 25 bp, E. coli
cgtttgacagtcgtgaagcctatga

SEQ ID NO: 29792 - DNA, 25 bp, E. coli
cgtttgacagtcctgaagcctatga

SEQ ID NO: 29793 - DNA, 25 bp, E. coli
gttttatgcgcattctcagcccggc

SEQ ID NO: 29794 - DNA, 25 bp, E. coli
gttttatgcgcaatctcagcccggc

SEQ ID NO: 29795 - DNA, 25 bp, E. coli
acatcggctgggaacgcgtgagatt

SEQ ID NO: 29796 - DNA, 25 bp, E. coli
acatcggctgggtacgcgtgagatt

SEQ ID NO: 29797 - DNA, 25 bp, E. coli
ttacatgacgaactgaatgcggtgg

SEQ ID NO: 29798 - DNA, 25 bp, E. coli
ttacatgacgaagtgaatgcggtgg

SEQ ID NO: 29799 - DNA, 25 bp, E. coli
tccgccagttacttgacgaagtgaa

SEQ ID NO: 29800 - DNA, 25 bp, E. coli
tccgccagttacatgacgaagtgaa

SEQ ID NO: 29801 - DNA, 25 bp, E. coli
ccattgccgccacgctgtattcaaa

SEQ ID NO: 29802 - DNA, 25 bp, E. coli
ccaggctgtattgaaaccatctggg

SEQ ID NO: 29803 - DNA, 25 bp, E. coli
ccaggctgtattcaaaccatctggg

SEQ ID NO: 29804 - DNA, 25 bp, E. coli
ccattgccgccaggctgtattcaaa

SEQ ID NO: 29805 - DNA, 25 bp, E. coli
gcatcagccgcgacacgttttactg

SEQ ID NO: 29806 - DNA, 25 bp, E. coli
gcgtcacgttttactggtggatcgc

SEQ ID NO: 29807 - DNA, 25 bp, E. coli
gcgtcacgtttttctggtggatcgc

SEQ ID NO: 29808 - DNA, 25 bp, E. coli
gcatcagccgcgtcacgttttactg

SEQ ID NO: 29809 - DNA, 25 bp, E. coli
cttcgcacagcgtggcaacgcgaat

SEQ ID NO: 29810 - DNA, 25 bp, E. coli
cttcgcacagcgaggcaacgcgaat

SEQ ID NO: 29811 - DNA, 25 bp, E. coli
gataagtcaggctcagcatcagccg

SEQ ID NO: 29812 - DNA, 25 bp, E. coli
gatttgcttcgctcagcgtggcaac

SEQ ID NO: 29813 - DNA, 25 bp, E. coli
gatttgcttcgcacagcgtggcaac

SEQ ID NO: 29814 - DNA, 25 bp, E. coli
gataagtcaggcacagcatcagccg

SEQ ID NO: 29815 - DNA, 25 bp, E. coli
tttaccttccgccagttacatgacg

SEQ ID NO: 29816 - DNA, 25 bp, E. coli
tttaccttccgcgagttacatgacg

SEQ ID NO: 29817 - DNA, 25 bp, E. coli
aaggtgcccttttgatctgccctca

SEQ ID NO: 29818 - DNA, 25 bp, E. coli
aaggtgccctttagatctgccctca

SEQ ID NO: 29819 - DNA, 25 bp, E. coli
tatacggccatttatacaggaaaag

SEQ ID NO: 29820 - DNA, 25 bp, E. coli
tatacggccattaatacaggaaaag

SEQ ID NO: 29821 - DNA, 25 bp, E. coli
tatctcgttaaatgttcctgcccaa

SEQ ID NO: 29822 - DNA, 25 bp, E. coli
tatctcgttaaaagttcctgcccaa

SEQ ID NO: 29823 - DNA, 25 bp, E. coli
tttcaagagtactaaaaggtgccct

SEQ ID NO: 29824 - DNA, 25 bp, E. coli
tttcaagagtacaaaaaggtgccct

SEQ ID NO: 29825 - DNA, 25 bp, E. coli
tgcacccaagagtcagaacacagtt

SEQ ID NO: 29826 - DNA, 25 bp, E. coli
tgcacccaagagacagaacacagtt

SEQ ID NO: 29827 - DNA, 25 bp, E. coli
gcaaacctgcacatcaccacaatgg

SEQ ID NO: 29828 - DNA, 25 bp, E. coli
gcactttgttttgccatgccagcag

SEQ ID NO: 29829 - DNA, 25 bp, E. coli
gcaaacctgcacttcaccacaatgg

SEQ ID NO: 29830 - DNA, 25 bp, E. coli
gcactttgttttcccatgccagcag

SEQ ID NO: 29831 - DNA, 25 bp, E. coli
gacaaatcttaatgctgtagcctga

SEQ ID NO: 29832 - DNA, 25 bp, E. coli
gacaaatcttaaagctgtagcctga

SEQ ID NO: 29833 - DNA, 25 bp, E. coli
gggagtcatccacttacgcactttg

SEQ ID NO: 29834 - DNA, 25 bp, E. coli
ggaaaagcctatgtcagaacgtaaa

SEQ ID NO: 29835 - DNA, 25 bp, E. coli
ggaaaagcctatctcagaacgtaaa

SEQ ID NO: 29836 - DNA, 25 bp, E. coli
gggagtcatccagttacgcactttg

SEQ ID NO: 29837 - DNA, 25 bp, E. coli
ggcatcagccttgttcgttatcgta

SEQ ID NO: 29838 - DNA, 25 bp, E. coli
ggcatcagccttcttcgttatcgta

SEQ ID NO: 29839 - DNA, 25 bp, E. coli
aataacgcccgcgtggtatgtgcgc

SEQ ID NO: 29840 - DNA, 25 bp, E. coli
aataacgcccgcctggtatgtgcgc

SEQ ID NO: 29841 - DNA, 25 bp, E. coli
ttttcttgccctcgattcgtctgcc

SEQ ID NO: 29842 - DNA, 25 bp, E. coli
ttttcttgccctggattcgtctgcc

SEQ ID NO: 29843 - DNA, 25 bp, E. coli
tctttgcagacctttccaggattaa

SEQ ID NO: 29844 - DNA, 25 bp, E. coli
tctttgcagaccattccaggattaa

SEQ ID NO: 29845 - DNA, 25 bp, E. coli
tgcaatgaaaataacgcccgcctgg

SEQ ID NO: 29846 - DNA, 25 bp, E. coli
tgaacgaacgcagtcgcagtacatg

SEQ ID NO: 29847 - DNA, 25 bp, E. coli
tgaacgaacgcactcgcagtacatg

SEQ ID NO: 29848 - DNA, 25 bp, E. coli
tgcaatgaaaattacgcccgcctgg

SEQ ID NO: 29849 - DNA, 25 bp, E. coli
tccagcttgcaatgaaaataacgcc

SEQ ID NO: 29850 - DNA, 25 bp, E. coli
tccagcttgcaaagaaaataacgcc

SEQ ID NO: 29851 - DNA, 25 bp, E. coli
tctgattccacaaactgcaaggagg

SEQ ID NO: 29852 - DNA, 25 bp, E. coli
tctgattccacatactgcaaggagg

SEQ ID NO: 29853 - DNA, 25 bp, E. coli
cctttatcaatgtctctttgcagac

SEQ ID NO: 29854 - DNA, 25 bp, E. coli
cctttatcaatgactctttgcagac

SEQ ID NO: 29855 - DNA, 25 bp, E. coli
gcaaggaggtaaatcatgacaaatc

SEQ ID NO: 29856 - DNA, 25 bp, E. coli
gcaaggaggtaattcatgacaaatc

SEQ ID NO: 29857 - DNA, 25 bp, E. coli
gattcgtctgccatttcctgatttt

SEQ ID NO: 29858 - DNA, 25 bp, E. coli
gattcgtctgccttttcctgatttt

SEQ ID NO: 29859 - DNA, 25 bp, E. coli
ggtatgtgcgcgatttctgattcca

SEQ ID NO: 29860 - DNA, 25 bp, E. coli
ggtatgtgcgcgttttctgattcca

SEQ ID NO: 29861 - DNA, 25 bp, E. coli
ctgactatctactgcggaggtgatg

SEQ ID NO: 29862 - DNA, 25 bp, E. coli
ctgactatctacagcggaggtgatg

SEQ ID NO: 29863 - DNA, 25 bp, E. coli
atctacagcggacgtgatgatgaaa

SEQ ID NO: 29864 - DNA, 25 bp, E. coli
atctacagcggaggtgatgatgaaa

SEQ ID NO: 29865 - DNA, 25 bp, E. coli
tatctgcctgacaatctacagcgga

SEQ ID NO: 29866 - DNA, 25 bp, E. coli
tatctgcctgactatctacagcgga

SEQ ID NO: 29867 - DNA, 25 bp, E. coli
tatatctgcctgtctatctacagcg

SEQ ID NO: 29868 - DNA, 25 bp, E. coli
tatatctgcctgactatctacagcg

SEQ ID NO: 29869 - DNA, 25 bp, E. coli
ttgcctgtgattgactgcaataaag

SEQ ID NO: 29870 - DNA, 25 bp, E. coli
ttgcctgtgattcactgcaataaag

SEQ ID NO: 29871 - DNA, 25 bp, E. coli
tgactatctacagcggaggtgatga

SEQ ID NO: 29872 - DNA, 25 bp, E. coli
tgactatctacaccggaggtgatga

SEQ ID NO: 29873 - DNA, 25 bp, E. coli
tcaccaagttgtatatctgcctgac

SEQ ID NO: 29874 - DNA, 25 bp, E. coli
tctgcctgactaactacagcggagg

SEQ ID NO: 29875 - DNA, 25 bp, E. coli
tctgcctgactatctacagcggagg

SEQ ID NO: 29876 - DNA, 25 bp, E. coli
tcaccaagttgtttatctgcctgac

SEQ ID NO: 29877 - DNA, 25 bp, E. coli
cctgtgattcacagcaataaagacg

SEQ ID NO: 29878 - DNA, 25 bp, E. coli
cctgtgattcactgcaataaagacg

SEQ ID NO: 29879 - DNA, 25 bp, E. coli
ctgcctgactatgtacagcggaggt

SEQ ID NO: 29880 - DNA, 25 bp, E. coli
ctatctacagcggaggtgatgatga

SEQ ID NO: 29881 - DNA, 25 bp, E. coli
ctgcctgactatctacagcggaggt

SEQ ID NO: 29882 - DNA, 25 bp, E. coli
ctatctacagcgcaggtgatgatga

SEQ ID NO: 29883 - DNA, 25 bp, E. coli
accgcgtaccggttttgattgcagc

SEQ ID NO: 29884 - DNA, 25 bp, E. coli
accgcgtaccggatttgattgcagc

SEQ ID NO: 29885 - DNA, 25 bp, E. coli
taccaaacgtaacggctataaatcg

SEQ ID NO: 29886 - DNA, 25 bp, E. coli
taccaaacgtaagggctataaatcg

SEQ ID NO: 29887 - DNA, 25 bp, E. coli
ttcaaagcaagccagggagagttct

SEQ ID NO: 29888 - DNA, 25 bp, E. coli
ttcaaagcaagcgagggagagttct

SEQ ID NO: 29889 - DNA, 25 bp, E. coli
tcagtgaagacttctggcagcgcca

SEQ ID NO: 29890 - DNA, 25 bp, E. coli
tcatgtcggcgtctatgtcggcaac

SEQ ID NO: 29891 - DNA, 25 bp, E. coli
tcatgtcggcgtgtatgtcggcaac

SEQ ID NO: 29892 - DNA, 25 bp, E. coli
tcagtgaagactactggcagcgcca

SEQ ID NO: 29893 - DNA, 25 bp, E. coli
gtagtgaactgaaaaacggcgacct

SEQ ID NO: 29894 - DNA, 25 bp, E. coli
gaaaattcgtataccgcgtacggcg

SEQ ID NO: 29895 - DNA, 25 bp, E. coli
gaaaattcgtattccgcgtacggcg

SEQ ID NO: 29896 - DNA, 25 bp, E. coli
gtagtgaactgataaacggcgacct

SEQ ID NO: 29897 - DNA, 25 bp, E. coli
cgtacggcgaatcaaatgtatcacc

SEQ ID NO: 29898 - DNA, 25 bp, E. coli
cgtacggcgaatgaaatgtatcacc

SEQ ID NO: 29899 - DNA, 25 bp, E. coli
gtaatgaccccaaaaacacttcgct

SEQ ID NO: 29900 - DNA, 25 bp, E. coli
gtaatgaccccataaacacttcgct

SEQ ID NO: 29901 - DNA, 25 bp, E. coli
ggcaaatttattgagtcaccgcgca

SEQ ID NO: 29902 - DNA, 25 bp, E. coli
ggcaaatttattcagtcaccgcgca

SEQ ID NO: 29903 - DNA, 25 bp, E. coli
gatgcagcgccattcgaacgtagtg

SEQ ID NO: 29904 - DNA, 25 bp, E. coli
gatgcagcgccaatcgaacgtagtg

SEQ ID NO: 29905 - DNA, 25 bp, E. coli
cacggcattcgctttaacgctatcg

SEQ ID NO: 29906 - DNA, 25 bp, E. coli
cacggcattcgcattaacgctatcg

SEQ ID NO: 29907 - DNA, 25 bp, E. coli
taacagaatgtaatgccatgactgc

SEQ ID NO: 29908 - DNA, 25 bp, E. coli
taacagaatgtattgccatgactgc

SEQ ID NO: 29909 - DNA, 25 bp, E. coli
tatcgacaacgataaagtcaggttg

SEQ ID NO: 29910 - DNA, 25 bp, E. coli
tatcgacaacgaaaaagtcaggttg

SEQ ID NO: 29911 - DNA, 25 bp, E. coli
tcaggttgaagttgtgtatatcggc

SEQ ID NO: 29912 - DNA, 25 bp, E. coli
tcaggttgaagtagtgtatatcggc

SEQ ID NO: 29913 - DNA, 25 bp, E. coli
gccatgactgcttagatgtaatgtg

SEQ ID NO: 29914 - DNA, 25 bp, E. coli
gccatgactgctaagatgtaatgtg

SEQ ID NO: 29915 - DNA, 25 bp, E. coli
gactcttttaatctttcaaggagca

SEQ ID NO: 29916 - DNA, 25 bp, E. coli
gactcttttaatgtttcaaggagca

SEQ ID NO: 29917 - DNA, 25 bp, E. coli
cgttatatgatggataatgccggga

SEQ ID NO: 29918 - DNA, 25 bp, E. coli
cgttatatgatgcataatgccggga

SEQ ID NO: 29919 - DNA, 25 bp, E. coli
gatacagagagagccgactctttta

SEQ ID NO: 29920 - DNA, 25 bp, E. coli
gataatgccgggttacagagagacc

SEQ ID NO: 29921 - DNA, 25 bp, E. coli
gtggactcgcttcacggcattcgca

SEQ ID NO: 29922 - DNA, 25 bp, E. coli
gtggactcgcttgacggcattcgca

SEQ ID NO: 29923 - DNA, 25 bp, E. coli
taagcgtcaggcaatgccgtggact

SEQ ID NO: 29924 - DNA, 25 bp, E. coli
taagcgtcaggctatgccgtggact

SEQ ID NO: 29925 - DNA, 25 bp, E. coli
gataatgccgggatacagagagacc

SEQ ID NO: 29926 - DNA, 25 bp, E. coli
gatacagagagacccgactctttta

SEQ ID NO: 29927 - DNA, 25 bp, E. coli
taaaagtgcttaagcagctgccgga

SEQ ID NO: 29928 - DNA, 25 bp, E. coli
taaaagtgcttatgcagctgccgga

SEQ ID NO: 29929 - DNA, 25 bp, E. coli
aaaaagtcgcccttgagacaccgga

SEQ ID NO: 29930 - DNA, 25 bp, E. coli
aaaaagtcgcccatgagacaccgga

SEQ ID NO: 29931 - DNA, 25 bp, E. coli
tattgcttgcccgagtaaaggcgcg

SEQ ID NO: 29932 - DNA, 25 bp, E. coli
tattgcttgccccagtaaaggcgcg

SEQ ID NO: 29933 - DNA, 25 bp, E. coli
tctcgctggacggaaatatcggctg

SEQ ID NO: 29934 - DNA, 25 bp, E. coli
tcacgtttattgtcagcccggaagg

SEQ ID NO: 29935 - DNA, 25 bp, E. coli
tctgcaactggaacacgggctattt

SEQ ID NO: 29936 - DNA, 25 bp, E. coli
tctcgctggacgcaaatatcggctg

SEQ ID NO: 29937 - DNA, 25 bp, E. coli
tctgcaactggatcacgggctattt

SEQ ID NO: 29938 - DNA, 25 bp, E. coli
tcacgtttattgacagcccggaagg

SEQ ID NO: 29939 - DNA, 25 bp, E. coli
gaactccaggtgctacgtgatgaaa

SEQ ID NO: 29940 - DNA, 25 bp, E. coli
gaactccaggtggtacgtgatgaaa

SEQ ID NO: 29941 - DNA, 25 bp, E. coli
gaaaacatctatccggtacgccagg

SEQ ID NO: 29942 - DNA, 25 bp, E. coli
gaaaacatctatgcggtacgccagg

SEQ ID NO: 29943 - DNA, 25 bp, E. coli
taaccctctggtcttgcgggaaacg

SEQ ID NO: 29944 - DNA, 25 bp, E. coli
taaccctctggtgttgcgggaaacg

SEQ ID NO: 29945 - DNA, 25 bp, E. coli
ggtgacttatcagaccgggccagaa

SEQ ID NO: 29946 - DNA, 25 bp, E. coli
ggtgacttatcacaccgggccagaa

SEQ ID NO: 29947 - DNA, 25 bp, E. coli
gatgccgtgtcctaaagagatagcc

SEQ ID NO: 29948 - DNA, 25 bp, E. coli
gatgccgtgtccaaaagagatagcc

SEQ ID NO: 29949 - DNA, 25 bp, E. coli
caagtaccgaaaacaggcgtgcagc

SEQ ID NO: 29950 - DNA, 25 bp, E. coli
caagtaccgaaatcaggcgtgcagc

SEQ ID NO: 29951 - DNA, 25 bp, E. coli
cacgcaagtcctgagcaattagaaa

SEQ ID NO: 29952 - DNA, 25 bp, E. coli
cacgcaagtcctcagcaattagaaa

SEQ ID NO: 29953 - DNA, 25 bp, E. coli
caaactgtgcatgcacgtagtgccg

SEQ ID NO: 29954 - DNA, 25 bp, E. coli
caaactgtgcatccacgtagtgccg

SEQ ID NO: 29955 - DNA, 25 bp, E. coli
tacatcagcaagaaccgaaaacagg

SEQ ID NO: 29956 - DNA, 25 bp, E. coli
tacatcagcaagtaccgaaaacagg

SEQ ID NO: 29957 - DNA, 25 bp, E. coli
aaacaggcgtgcagctggtcgccta

SEQ ID NO: 29958 - DNA, 25 bp, E. coli
aaacaggcgtgctgctggtcgccta

SEQ ID NO: 29959 - DNA, 25 bp, E. coli
ttatgactctgcgagcagttatgaa

SEQ ID NO: 29960 - DNA, 25 bp, E. coli
ttatgactctgccagcagttatgaa

SEQ ID NO: 29961 - DNA, 25 bp, E. coli
tggtgcgcattatgactctgccagc

SEQ ID NO: 29962 - DNA, 25 bp, E. coli
tggtgcgcattaagactctgccagc

SEQ ID NO: 29963 - DNA, 25 bp, E. coli
gttcgttatctttcacaaactgtgc

SEQ ID NO: 29964 - DNA, 25 bp, E. coli
gttcgttatcttacacaaactgtgc

SEQ ID NO: 29965 - DNA, 25 bp, E. coli
ggcacgtttgtttcatcagcaagta

SEQ ID NO: 29966 - DNA, 25 bp, E. coli
tgtgtttttactgcctatgattatt

SEQ ID NO: 29967 - DNA, 25 bp, E. coli
tgtgtttttactccctatgattatt

SEQ ID NO: 29968 - DNA, 25 bp, E. coli
ggcacgtttgttacatcagcaagta

SEQ ID NO: 29969 - DNA, 25 bp, E. coli
gagcaattagaataaacagttcgtt

SEQ ID NO: 29970 - DNA, 25 bp, E. coli
gagcaattagaaaaaacagttcgtt

SEQ ID NO: 29971 - DNA, 25 bp, E. coli
aacccctggcgcagctaatgcggat

SEQ ID NO: 29972 - DNA, 25 bp, E. coli
aacccctggcgctgctaatgcggat

SEQ ID NO: 29973 - DNA, 25 bp, E. coli
tactggctctgcaaagttctgctgc

SEQ ID NO: 29974 - DNA, 25 bp, E. coli
tactggctctgctaagttctgctgc

SEQ ID NO: 29975 - DNA, 25 bp, E. coli
aacagggactgccttggctttggat

SEQ ID NO: 29976 - DNA, 25 bp, E. coli
aacagggactgcgttggctttggat

SEQ ID NO: 29977 - DNA, 25 bp, E. coli
tattatgccattggtgccgcaaccc

SEQ ID NO: 29978 - DNA, 25 bp, E. coli
tattatgccattcgtgccgcaaccc

SEQ ID NO: 29979 - DNA, 25 bp, E. coli
tgtacagaacgactgcccatgtcga

SEQ ID NO: 29980 - DNA, 25 bp, E. coli
tgtacagaacgagtgcccatgtcga

SEQ ID NO: 29981 - DNA, 25 bp, E. coli
tgcagatcctggttaaaacagggac

SEQ ID NO: 29982 - DNA, 25 bp, E. coli
tgcagatcctggataaaacagggac

SEQ ID NO: 29983 - DNA, 25 bp, E. coli
gccttcttaggttcaacaattgaca

SEQ ID NO: 29984 - DNA, 25 bp, E. coli
gccttcttaggtacaacaattgaca

SEQ ID NO: 29985 - DNA, 25 bp, E. coli
gacacgaatcattccaacgtactgg

SEQ ID NO: 29986 - DNA, 25 bp, E. coli
gacacgaatcataccaacgtactgg

SEQ ID NO: 29987 - DNA, 25 bp, E. coli
ccgatgttgcaactaaagctgctgt

SEQ ID NO: 29988 - DNA, 25 bp, E. coli
ccgatgttgcaagtaaagctgctgt

SEQ ID NO: 29989 - DNA, 25 bp, E. coli
gtgcacaaaccaccctgaataacgg

SEQ ID NO: 29990 - DNA, 25 bp, E. coli
gtgcacaaaccagcctgaataacgg

SEQ ID NO: 29991 - DNA, 25 bp, E. coli
ggaccaggatggagcgaccagctct

SEQ ID NO: 29992 - DNA, 25 bp, E. coli
ggaccaggatggtgcgaccagctct

SEQ ID NO: 29993 - DNA, 25 bp, E. coli
aatatcgaattgtccgttgccagcc

SEQ ID NO: 29994 - DNA, 25 bp, E. coli
aatatcgaattgaccgttgccagcc

SEQ ID NO: 29995 - DNA, 25 bp, E. coli
cagagcacaaccacatcacaacaaa

SEQ ID NO: 29996 - DNA, 25 bp, E. coli
cagagcacaacctcatcacaacaaa

SEQ ID NO: 29997 - DNA, 25 bp, E. coli
taaataaactggaggacgtcgcaca

SEQ ID NO: 29998 - DNA, 25 bp, E. coli
taaataaactggtggacgtcgcaca

SEQ ID NO: 29999 - DNA, 25 bp, E. coli
tagaacgtgtttaacgcgtggtgcg

SEQ ID NO: 30000 - DNA, 25 bp, E. coli
tagaacgtgttttacgcgtggtgcg

SEQ ID NO: 30001 - DNA, 25 bp, E. coli
tctgctcaatgaatatggccgccgc

SEQ ID NO: 30002 - DNA, 25 bp, E. coli
tctgctcaatgattatggccgccgc

SEQ ID NO: 30003 - DNA, 25 bp, E. coli
gcccacggtcggacgacttactgtt

SEQ ID NO: 30004 - DNA, 25 bp, E. coli
gccgccagcgatccacaaaatataa

SEQ ID NO: 30005 - DNA, 25 bp, E. coli
gccgccagcgatgcacaaaatataa

SEQ ID NO: 30006 - DNA, 25 bp, E. coli
gcccacggtcggtcgacttactgtt

SEQ ID NO: 30007 - DNA, 25 bp, E. coli
gcgtggtgcgtcttcgtggtttcca

SEQ ID NO: 30008 - DNA, 25 bp, E. coli
gcgtggtgcgtcatcgtggtttcca

SEQ ID NO: 30009 - DNA, 25 bp, E. coli
cgtggtttccacctctgctcaatga

SEQ ID NO: 30010 - DNA, 25 bp, E. coli
cgtggtttccacgtctgctcaatga

SEQ ID NO: 30011 - DNA, 25 bp, E. coli
tcaatgtatcggctcgcttcaatcc

SEQ ID NO: 30012 - DNA, 25 bp, E. coli
tcaatgtatcgggtcgcttcaatcc

SEQ ID NO: 30013 - DNA, 25 bp, E. coli
gatgcaacatcaggtcaatgtatcg

SEQ ID NO: 30014 - DNA, 25 bp, E. coli
gatgcaacatcacgtcaatgtatcg

SEQ ID NO: 30015 - DNA, 25 bp, E. coli
catttccccggcagcgagtttctta

SEQ ID NO: 30016 - DNA, 25 bp, E. coli
catttccccggctgcgagtttctta

SEQ ID NO: 30017 - DNA, 25 bp, E. coli
tattgcgtggtcaggtgtttgcgcc

SEQ ID NO: 30018 - DNA, 25 bp, E. coli
tattgcgtggtctggtgtttgcgcc

SEQ ID NO: 30019 - DNA, 25 bp, E. coli
tgttatcaaccgtattcgcgccacg

SEQ ID NO: 30020 - DNA, 25 bp, E. coli
tgttatcaaccgaattcgcgccacg

SEQ ID NO: 30021 - DNA, 25 bp, E. coli
tgaatgcggcgcgaatgtctcgaca

SEQ ID NO: 30022 - DNA, 25 bp, E. coli
tgaatgcggcgccaatgtctcgaca

SEQ ID NO: 30023 - DNA, 25 bp, E. coli
tgatgcatttcaggcacaggctgcg

SEQ ID NO: 30024 - DNA, 25 bp, E. coli
tgatgcatttcacgcacaggctgcg

SEQ ID NO: 30025 - DNA, 25 bp, E. coli
ccaggactgaatgaaccgcgcgtta

SEQ ID NO: 30026 - DNA, 25 bp, E. coli
ccaggactgaatcaaccgcgcgtta

SEQ ID NO: 30027 - DNA, 25 bp, E. coli
cgcaaaagcgcggtgccttgcctta

SEQ ID NO: 30028 - DNA, 25 bp, E. coli
cgcaaaagcgcgctgccttgcctta

SEQ ID NO: 30029 - DNA, 25 bp, E. coli
ctcgaatcggctgtgaatgcggcgc

SEQ ID NO: 30030 - DNA, 25 bp, E. coli
cggtgattgctaatgcgcagtcgaa

SEQ ID NO: 30031 - DNA, 25 bp, E. coli
cggtgattgctattgcgcagtcgaa

SEQ ID NO: 30032 - DNA, 25 bp, E. coli
ctcgaatcggctctgaatgcggcgc

SEQ ID NO: 30033 - DNA, 25 bp, E. coli
gatagcatttgtcgccatttccccg

SEQ ID NO: 30034 - DNA, 25 bp, E. coli
gatagcatttgtggccatttccccg

SEQ ID NO: 30035 - DNA, 25 bp, E. coli
gatttaggcttaacgccaggactga

SEQ ID NO: 30036 - DNA, 25 bp, E. coli
gatttaggcttatcgccaggactga

SEQ ID NO: 30037 - DNA, 25 bp, E. coli
taaaagccgctcactggaaaagcgt

SEQ ID NO: 30038 - DNA, 25 bp, E. coli
taaaagccgctctctggaaaagcgt

SEQ ID NO: 30039 - DNA, 25 bp, E. coli
tacgctgccggatgacgacttaacg

SEQ ID NO: 30040 - DNA, 25 bp, E. coli
catgaataaacaacggtttcaaggg

SEQ ID NO: 30041 - DNA, 25 bp, E. coli
catgaataaacatcggtttcaaggg

SEQ ID NO: 30042 - DNA, 25 bp, E. coli
tacgctgccggaagacgacttaacg

SEQ ID NO: 30043 - DNA, 25 bp, E. coli
ttaacgtttcatccggcgttccttg

SEQ ID NO: 30044 - DNA, 25 bp, E. coli
ttaacgtttcatgcggcgttccttg

SEQ ID NO: 30045 - DNA, 25 bp, E. coli
tgacgacttaacgtttcatccggcg

SEQ ID NO: 30046 - DNA, 25 bp, E. coli
tgacgacttaacctttcatccggcg

SEQ ID NO: 30047 - DNA, 25 bp, E. coli
tcgcaacgcatgaataaacaacggt

SEQ ID NO: 30048 - DNA, 25 bp, E. coli
tcgcaacgcatgtataaacaacggt

SEQ ID NO: 30049 - DNA, 25 bp, E. coli
tcaggttagggcattgttaaaagcc

SEQ ID NO: 30050 - DNA, 25 bp, E. coli
tcaggttagggctttgttaaaagcc

SEQ ID NO: 30051 - DNA, 25 bp, E. coli
gcattgttaaaagccgctctctgga

SEQ ID NO: 30052 - DNA, 25 bp, E. coli
gctctctggaaatgcgtattgttaa

SEQ ID NO: 30053 - DNA, 25 bp, E. coli
gcattgttaaaacccgctctctgga

SEQ ID NO: 30054 - DNA, 25 bp, E. coli
gctctctggaaaagcgtattgttaa

SEQ ID NO: 30055 - DNA, 25 bp, E. coli
cgtattgttaatggcaacgcatgaa

SEQ ID NO: 30056 - DNA, 25 bp, E. coli
cgtattgttaatcgcaacgcatgaa

SEQ ID NO: 30057 - DNA, 25 bp, E. coli
ggttgaatacgcagccggatgacga

SEQ ID NO: 30058 - DNA, 25 bp, E. coli
ggttgaatacgctgccggatgacga

SEQ ID NO: 30059 - DNA, 25 bp, E. coli
caggtggcgaagtacgtaaagatcc

SEQ ID NO: 30060 - DNA, 25 bp, E. coli
caggtggcgaagaacgtaaagatcc

SEQ ID NO: 30061 - DNA, 25 bp, E. coli
cagtgatgtccgaagttaaccgtca

SEQ ID NO: 30062 - DNA, 25 bp, E. coli
cagtgatgtccgtagttaaccgtca

SEQ ID NO: 30063 - DNA, 25 bp, E. coli
acgtaaagatcctgttccgtggacg

SEQ ID NO: 30064 - DNA, 25 bp, E. coli
acgtaaagatccagttccgtggacg

SEQ ID NO: 30065 - DNA, 25 bp, E. coli
tatacatcaaggacgttggcgcttt

SEQ ID NO: 30066 - DNA, 25 bp, E. coli
tatacatcaaggtcgttggcgcttt

SEQ ID NO: 30067 - DNA, 25 bp, E. coli
gcgtctgcaaacagagatggcttaa

SEQ ID NO: 30068 - DNA, 25 bp, E. coli
gcgtctgcaaactgagatggcttaa

SEQ ID NO: 30069 - DNA, 25 bp, E. coli
cccaaaagtgaacgataagctgcat

SEQ ID NO: 30070 - DNA, 25 bp, E. coli
cccaaaagtgaaggataagctgcat

SEQ ID NO: 30071 - DNA, 25 bp, E. coli
ggtaagattcttttcccaaaagtga

SEQ ID NO: 30072 - DNA, 25 bp, E. coli
ggtacaacccacatcaggtggcgaa

SEQ ID NO: 30073 - DNA, 25 bp, E. coli
ggtaagattcttatcccaaaagtga

SEQ ID NO: 30074 - DNA, 25 bp, E. coli
ggtacaacccacttcaggtggcgaa

SEQ ID NO: 30075 - DNA, 25 bp, E. coli
ggcgtaatactctgcaggagataac

SEQ ID NO: 30076 - DNA, 25 bp, E. coli
ggcgtaatactcagcaggagataac

SEQ ID NO: 30077 - DNA, 25 bp, E. coli
taaccgtcaggttatgcgtctgcaa

SEQ ID NO: 30078 - DNA, 25 bp, E. coli
taagctgcatttctcagtgatgtcc

SEQ ID NO: 30079 - DNA, 25 bp, E. coli
taaccgtcaggtaatgcgtctgcaa

SEQ ID NO: 30080 - DNA, 25 bp, E. coli
taagctgcatttgtcagtgatgtcc

SEQ ID NO: 30081 - DNA, 25 bp, E. coli
caaagtgctggctaaagtgctggcg

SEQ ID NO: 30082 - DNA, 25 bp, E. coli
caaagtgctggcaaaagtgctggcg

SEQ ID NO: 30083 - DNA, 25 bp, E. coli
catgccggtcaggaggtgttactca

SEQ ID NO: 30084 - DNA, 25 bp, E. coli
catgccggtcagcaggtgttactca

SEQ ID NO: 30085 - DNA, 25 bp, E. coli
tacttttagaactgcaggacggcaa

SEQ ID NO: 30086 - DNA, 25 bp, E. coli
tacttttagaacagcaggacggcaa

SEQ ID NO: 30087 - DNA, 25 bp, E. coli
agtgctggcgcaaatgaattacggc

SEQ ID NO: 30088 - DNA, 25 bp, E. coli
agtgctggcgcatatgaattacggc

SEQ ID NO: 30089 - DNA, 25 bp, E. coli
tccggtcgcgaaagtacccatgaat

SEQ ID NO: 30090 - DNA, 25 bp, E. coli
tccggtcgcgaatgtacccatgaat

SEQ ID NO: 30091 - DNA, 25 bp, E. coli
gaagatccgcgtattcatgccggtc

SEQ ID NO: 30092 - DNA, 25 bp, E. coli
gaagatccgcgttttcatgccggtc

SEQ ID NO: 30093 - DNA, 25 bp, E. coli
cgtcctctggaaaaacaagtctggg

SEQ ID NO: 30094 - DNA, 25 bp, E. coli
cgtcctctggaataacaagtctggg

SEQ ID NO: 30095 - DNA, 25 bp, E. coli
gattttgccggatctgtacgcacca

SEQ ID NO: 30096 - DNA, 25 bp, E. coli
gattttgccggaactgtacgcacca

SEQ ID NO: 30097 - DNA, 25 bp, E. coli
ggaatcattctaaacccaggcggca

SEQ ID NO: 30098 - DNA, 25 bp, E. coli
ggaatcattctatacccaggcggca

SEQ ID NO: 30099 - DNA, 25 bp, E. coli
taataaccagatgcagggtcgcacg

SEQ ID NO: 30100 - DNA, 25 bp, E. coli
taataaccagatccagggtcgcacg

SEQ ID NO: 30101 - DNA, 25 bp, E. coli
gagtttgccgaatcccgtcctctgg

SEQ ID NO: 30102 - DNA, 25 bp, E. coli
gagtttgccgaaacccgtcctctgg

SEQ ID NO: 30103 - DNA, 25 bp, E. coli
cagctcgttgctgcaatacacaatg

SEQ ID NO: 30104 - DNA, 25 bp, E. coli
gttcggctggttgagtgcggtcagc

SEQ ID NO: 30105 - DNA, 25 bp, E. coli
cagctcgttgctccaatacacaatg

SEQ ID NO: 30106 - DNA, 25 bp, E. coli
gttcggctggttcagtgcggtcagc

SEQ ID NO: 30107 - DNA, 25 bp, E. coli
acgctgggatcgatcctcgccattg

SEQ ID NO: 30108 - DNA, 25 bp, E. coli
acgctgggatcgttcctcgccattg

SEQ ID NO: 30109 - DNA, 25 bp, E. coli
ttattgatgctgctctccacgctgg

SEQ ID NO: 30110 - DNA, 25 bp, E. coli
ttgagtgcggtctgctcgttgctgc

SEQ ID NO: 30111 - DNA, 25 bp, E. coli
ttgatgctgctctccacgctgggat

SEQ ID NO: 30112 - DNA, 25 bp, E. coli
ttgagtgcggtcagctcgttgctgc

SEQ ID NO: 30113 - DNA, 25 bp, E. coli
ttattgatgctggtctccacgctgg

SEQ ID NO: 30114 - DNA, 25 bp, E. coli
ttgatgctgctcaccacgctgggat

SEQ ID NO: 30115 - DNA, 25 bp, E. coli
tgctgctctccacgctgggatcgtt

SEQ ID NO: 30116 - DNA, 25 bp, E. coli
tgctctccacgctgggatcgttcct

SEQ ID NO: 30117 - DNA, 25 bp, E. coli
tgctgctctccaggctgggatcgtt

SEQ ID NO: 30118 - DNA, 25 bp, E. coli
tgctctccacgcagggatcgttcct

SEQ ID NO: 30119 - DNA, 25 bp, E. coli
gcgcgaccagggatattgatgctgc

SEQ ID NO: 30120 - DNA, 25 bp, E. coli
ccagggttattgatgctgctctcca

SEQ ID NO: 30121 - DNA, 25 bp, E. coli
ccagggttattgttgctgctctcca

SEQ ID NO: 30122 - DNA, 25 bp, E. coli
gcgcgaccagggttattgatgctgc

SEQ ID NO: 30123 - DNA, 25 bp, E. coli
gcggtcagctcgatgctgcaataca

SEQ ID NO: 30124 - DNA, 25 bp, E. coli
gcggtcagctcgttgctgcaataca

SEQ ID NO: 30125 - DNA, 25 bp, E. coli
cagtgacgataccatggtggcgaca

SEQ ID NO: 30126 - DNA, 25 bp, E. coli
cagtgacgatacgatggtggcgaca

SEQ ID NO: 30127 - DNA, 25 bp, E. coli
aaatatattatagcgcagaccctgc

SEQ ID NO: 30128 - DNA, 25 bp, E. coli
aaatatattataccgcagaccctgc

SEQ ID NO: 30129 - DNA, 25 bp, E. coli
taccgtgcgggtttgcggcaaatga

SEQ ID NO: 30130 - DNA, 25 bp, E. coli
taccgtgcgggtatgcggcaaatga

SEQ ID NO: 30131 - DNA, 25 bp, E. coli
ttggcgtgagccagaaaactggagc

SEQ ID NO: 30132 - DNA, 25 bp, E. coli
ttggcgtgagcctgaaaactggagc

SEQ ID NO: 30133 - DNA, 25 bp, E. coli
tcagggaaacaaaactacagcggtt

SEQ ID NO: 30134 - DNA, 25 bp, E. coli
tcagggaaacaatactacagcggtt

SEQ ID NO: 30135 - DNA, 25 bp, E. coli
gctaccgcgaccttaaccattgaat

SEQ ID NO: 30136 - DNA, 25 bp, E. coli
gctgaagttagcgtcaacaacggca

SEQ ID NO: 30137 - DNA, 25 bp, E. coli
gctaccgcgaccataaccattgaat

SEQ ID NO: 30138 - DNA, 25 bp, E. coli
gctgaagttagcctcaacaacggca

SEQ ID NO: 30139 - DNA, 25 bp, E. coli
gaattttcatcttccgccgggcaag

SEQ ID NO: 30140 - DNA, 25 bp, E. coli
gcaagttacccgcagacatgggcaa

SEQ ID NO: 30141 - DNA, 25 bp, E. coli
gaattttcatctaccgccgggcaag

SEQ ID NO: 30142 - DNA, 25 bp, E. coli
gcaagttacccggagacatgggcaa

SEQ ID NO: 30143 - DNA, 25 bp, E. coli
tggtttatagcagcaccgcaagtgg

SEQ ID NO: 30144 - DNA, 25 bp, E. coli
tggtttatagcaccaccgcaagtgg

SEQ ID NO: 30145 - DNA, 25 bp, E. coli
gacccgtggtgaggcgattgcaaaa

SEQ ID NO: 30146 - DNA, 25 bp, E. coli
gacccgtggtgacgcgattgcaaaa

SEQ ID NO: 30147 - DNA, 25 bp, E. coli
catagcattattgccgaagcgacgc

SEQ ID NO: 30148 - DNA, 25 bp, E. coli
catagcattattcccgaagcgacgc

SEQ ID NO: 30149 - DNA, 25 bp, E. coli
taaatttgaagacctggatcaccga

SEQ ID NO: 30150 - DNA, 25 bp, E. coli
taaatttgaagagctggatcaccga

SEQ ID NO: 30151 - DNA, 25 bp, E. coli
aacaagctgctgtattatggcgggc

SEQ ID NO: 30152 - DNA, 25 bp, E. coli
aacaagctgctgaattatggcgggc

SEQ ID NO: 30153 - DNA, 25 bp, E. coli
tattaccggtttagctgccagccag

SEQ ID NO: 30154 - DNA, 25 bp, E. coli
tattaccggttttgctgccagccag

SEQ ID NO: 30155 - DNA, 25 bp, E. coli
ttacaggaaaaacccatcgctgcgg

SEQ ID NO: 30156 - DNA, 25 bp, E. coli
ttacaggaaaaagccatcgctgcgg

SEQ ID NO: 30157 - DNA, 25 bp, E. coli
tcgggtactcatgaaacaagctgct

SEQ ID NO: 30158 - DNA, 25 bp, E. coli
tcgggtactcatcaaacaagctgct

SEQ ID NO: 30159 - DNA, 25 bp, E. coli
gaaagattcagacctcgccagggaa

SEQ ID NO: 30160 - DNA, 25 bp, E. coli
gaaagattcagagctcgccagggaa

SEQ ID NO: 30161 - DNA, 25 bp, E. coli
ggccggagaacggttaccttcagaa

SEQ ID NO: 30162 - DNA, 25 bp, E. coli
ggccggagaacgcttaccttcagaa

SEQ ID NO: 30163 - DNA, 25 bp, E. coli
tggcgggcagttggtacagaaaacc

SEQ ID NO: 30164 - DNA, 25 bp, E. coli
ggaacaggttataacaaagcgccgc

SEQ ID NO: 30165 - DNA, 25 bp, E. coli
tggctggaagatgaccgggctattt

SEQ ID NO: 30166 - DNA, 25 bp, E. coli
tggcgggcagttcgtacagaaaacc

SEQ ID NO: 30167 - DNA, 25 bp, E. coli
ggaacaggttattacaaagcgccgc

SEQ ID NO: 30168 - DNA, 25 bp, E. coli
tggctggaagatcaccgggctattt

SEQ ID NO: 30169 - DNA, 25 bp, E. coli
cactggttaacgtcaaggtgctgcg

SEQ ID NO: 30170 - DNA, 25 bp, E. coli
caaaactttctggtgatacgctgga

SEQ ID NO: 30171 - DNA, 25 bp, E. coli
caaaactttctgctgatacgctgga

SEQ ID NO: 30172 - DNA, 25 bp, E. coli
cactggttaacgacaaggtgctgcg

SEQ ID NO: 30173 - DNA, 25 bp, E. coli
tacaaactggttcgtccgctgatcg

SEQ ID NO: 30174 - DNA, 25 bp, E. coli
tacaaactggttggtccgctgatcg

SEQ ID NO: 30175 - DNA, 25 bp, E. coli
aacatcatggatctcgaagcggcga

SEQ ID NO: 30176 - DNA, 25 bp, E. coli
aaaaccgtggttatgtactgcgtcg

SEQ ID NO: 30177 - DNA, 25 bp, E. coli
aaaaccgtggttttgtactgcgtcg

SEQ ID NO: 30178 - DNA, 25 bp, E. coli
aacatcatggatgtcgaagcggcga

SEQ ID NO: 30179 - DNA, 25 bp, E. coli
tgctcggcgcgaaagaaaccttctt

SEQ ID NO: 30180 - DNA, 25 bp, E. coli
tgctcggcgcgatagaaaccttctt

SEQ ID NO: 30181 - DNA, 25 bp, E. coli
tctgcgggtgaagacctgaaacgcc

SEQ ID NO: 30182 - DNA, 25 bp, E. coli
tctatgaaagcgtcgacgaagccta

SEQ ID NO: 30183 - DNA, 25 bp, E. coli
tctgcgggtgaacacctgaaacgcc

SEQ ID NO: 30184 - DNA, 25 bp, E. coli
tctatgaaagcgacgacgaagccta

SEQ ID NO: 30185 - DNA, 25 bp, E. coli
tcacatcggtaatcttgctgcgggt

SEQ ID NO: 30186 - DNA, 25 bp, E. coli
tcacatcggtaaacttgctgcgggt

SEQ ID NO: 30187 - DNA, 25 bp, E. coli
taatgccgtccattgaaaaccgtgg

SEQ ID NO: 30188 - DNA, 25 bp, E. coli
taatgccgtccaatgaaaaccgtgg

SEQ ID NO: 30189 - DNA, 25 bp, E. coli
gaccatctggaactgaacggcaaag

SEQ ID NO: 30190 - DNA, 25 bp, E. coli
gaccatctggaagtgaacggcaaag

SEQ ID NO: 30191 - DNA, 25 bp, E. coli
catcggcagctatgtaccggcacaa

SEQ ID NO: 30192 - DNA, 25 bp, E. coli
catcggcagctaagtaccggcacaa

SEQ ID NO: 30193 - DNA, 25 bp, E. coli
agatgacctggcgtccgggcgctca

SEQ ID NO: 30194 - DNA, 25 bp, E. coli
agatgacctggcctccgggcgctca

SEQ ID NO: 30195 - DNA, 25 bp, E. coli
tatcgatcgcatctttacccgcgta

SEQ ID NO: 30196 - DNA, 25 bp, E. coli
tatcgatcgcatgtttacccgcgta

SEQ ID NO: 30197 - DNA, 25 bp, E. coli
tttacccgcgtaggcgcggcagatg

SEQ ID NO: 30198 - DNA, 25 bp, E. coli
tttacccgcgtacgcgcggcagatg

SEQ ID NO: 30199 - DNA, 25 bp, E. coli
cctgcggtcgaacctctggaaaatc

SEQ ID NO: 30200 - DNA, 25 bp, E. coli
cctgcggtcgaagctctggaaaatc

SEQ ID NO: 30201 - DNA, 25 bp, E. coli
gaagctctggaatatcttgatccgg

SEQ ID NO: 30202 - DNA, 25 bp, E. coli
gaagctctggaaaatcttgatccgg

SEQ ID NO: 30203 - DNA, 25 bp, E. coli
cgtattctggcacgtctggctttac

SEQ ID NO: 30204 - DNA, 25 bp, E. coli
ccgcagcgccgcatgttgatcatca

SEQ ID NO: 30205 - DNA, 25 bp, E. coli
ccgcagcgccgcttgttgatcatca

SEQ ID NO: 30206 - DNA, 25 bp, E. coli
cgagattggacctatcgatcgcatc

SEQ ID NO: 30207 - DNA, 25 bp, E. coli
cgtattctggcaggtctggctttac

SEQ ID NO: 30208 - DNA, 25 bp, E. coli
cgagattggaccaatcgatcgcatc

SEQ ID NO: 30209 - DNA, 25 bp, E. coli
cgtctggctttaggaactgctcgcc

SEQ ID NO: 30210 - DNA, 25 bp, E. coli
cgtctggctttacgaactgctcgcc

SEQ ID NO: 30211 - DNA, 25 bp, E. coli
ggcattgacgttttttgctacccac

SEQ ID NO: 30212 - DNA, 25 bp, E. coli
ggcattgacgttatttgctacccac

SEQ ID NO: 30213 - DNA, 25 bp, E. coli
aagctcaacaagaaaacagcacgag

SEQ ID NO: 30214 - DNA, 25 bp, E. coli
aagctcaacaagtaaacagcacgag

SEQ ID NO: 30215 - DNA, 25 bp, E. coli
caagaaaacagcacgagacaatctc

SEQ ID NO: 30216 - DNA, 25 bp, E. coli
caagaaaacagctcgagacaatctc

SEQ ID NO: 30217 - DNA, 25 bp, E. coli
caacaagaaaacagcacgagacaat

SEQ ID NO: 30218 - DNA, 25 bp, E. coli
caacaagaaaactgcacgagacaat

SEQ ID NO: 30219 - DNA, 25 bp, E. coli
tataaaaccttatcaacacataacg

SEQ ID NO: 30220 - DNA, 25 bp, E. coli
tataaaaaacgaatcaatatcatga

SEQ ID NO: 30221 - DNA, 25 bp, E. coli
tataaaaccttaacaacacataacg

SEQ ID NO: 30222 - DNA, 25 bp, E. coli
tataaaaaacgattcaatatcatga

SEQ ID NO: 30223 - DNA, 25 bp, E. coli
tatcatgaaaaacctcaacaagaaa

SEQ ID NO: 30224 - DNA, 25 bp, E. coli
tatcatgaaaaagctcaacaagaaa

SEQ ID NO: 30225 - DNA, 25 bp, E. coli
ttatcaacacattacgaaaaacacc

SEQ ID NO: 30226 - DNA, 25 bp, E. coli
ttatcaacacataacgaaaaacacc

SEQ ID NO: 30227 - DNA, 25 bp, E. coli
tgaaaaagctcatcaagaaaacagc

SEQ ID NO: 30228 - DNA, 25 bp, E. coli
tgaaaaagctcaacaagaaaacagc

SEQ ID NO: 30229 - DNA, 25 bp, E. coli
tctcaacaaaaaacaaattctcctt

SEQ ID NO: 30230 - DNA, 25 bp, E. coli
tctcaacaaaaatcaaattctcctt

SEQ ID NO: 30231 - DNA, 25 bp, E. coli
gaaaacagcacgagacaatctcaac

SEQ ID NO: 30232 - DNA, 25 bp, E. coli
gaaaacagcacgtgacaatctcaac

SEQ ID NO: 30233 - DNA, 25 bp, E. coli
gagacaatctcaacaaaaaacaaat

SEQ ID NO: 30234 - DNA, 25 bp, E. coli
gagacaatctcatcaaaaaacaaat

SEQ ID NO: 30235 - DNA, 25 bp, E. coli
caaaattgaaaacgatcagggcggc

SEQ ID NO: 30236 - DNA, 25 bp, E. coli
caaatcaggcgttagtggcgaagac

SEQ ID NO: 30237 - DNA, 25 bp, E. coli
caaaattgaaaaggatcagggcggc

SEQ ID NO: 30238 - DNA, 25 bp, E. coli
caaatcaggcgtaagtggcgaagac

SEQ ID NO: 30239 - DNA, 25 bp, E. coli
taaagtgaccgaagttctgcaaacg

SEQ ID NO: 30240 - DNA, 25 bp, E. coli
taaagtgaccgatgttctgcaaacg

SEQ ID NO: 30241 - DNA, 25 bp, E. coli
tatttcatcgaacgtacgcagccga

SEQ ID NO: 30242 - DNA, 25 bp, E. coli
tatttcatcgaaggtacgcagccga

SEQ ID NO: 30243 - DNA, 25 bp, E. coli
tgcagatttacagcgccgatggcga

SEQ ID NO: 30244 - DNA, 25 bp, E. coli
tgcagatttacaccgccgatggcga

SEQ ID NO: 30245 - DNA, 25 bp, E. coli
gaagcgaaaccgtaagtagcctgcc

SEQ ID NO: 30246 - DNA, 25 bp, E. coli
gaatgtttctgttccaatgccgcag

SEQ ID NO: 30247 - DNA, 25 bp, E. coli
gaagcgaaaccgaaagtagcctgcc

SEQ ID NO: 30248 - DNA, 25 bp, E. coli
gaatgtttctgtaccaatgccgcag

SEQ ID NO: 30249 - DNA, 25 bp, E. coli
gtgaatatcgatcgcagcaccgggc

SEQ ID NO: 30250 - DNA, 25 bp, E. coli
gtgaatatcgatggcagcaccgggc

SEQ ID NO: 30251 - DNA, 25 bp, E. coli
tcaatcagagcatgtttaaccgcgc

SEQ ID NO: 30252 - DNA, 25 bp, E. coli
taacgctaactaacacgcgccggag

SEQ ID NO: 30253 - DNA, 25 bp, E. coli
ttacgaaggcggtgccaagagtgcc

SEQ ID NO: 30254 - DNA, 25 bp, E. coli
ttacgaaggcggagccaagagtgcc

SEQ ID NO: 30255 - DNA, 25 bp, E. coli
taacgctaactatcacgcgccggag

SEQ ID NO: 30256 - DNA, 25 bp, E. coli
tcaatcagagcaagtttaaccgcgc

SEQ ID NO: 30257 - DNA, 25 bp, E. coli
caggttttacctctcaacgtgcggg

SEQ ID NO: 30258 - DNA, 25 bp, E. coli
caggttttacctgtcaacgtgcggg

SEQ ID NO: 30259 - DNA, 25 bp, E. coli
agattagccccccttttgttgtcag

SEQ ID NO: 30260 - DNA, 25 bp, E. coli
agattagcccccgttttgttgtcag

SEQ ID NO: 30261 - DNA, 25 bp, E. coli
tttgttgtcaggatttacctctcaa

SEQ ID NO: 30262 - DNA, 25 bp, E. coli
tttgttgtcaggttttacctctcaa

SEQ ID NO: 30263 - DNA, 25 bp, E. coli
ttgttgtcaggtattacctctcaac

SEQ ID NO: 30264 - DNA, 25 bp, E. coli
ttgtcaggttttacctctcaacgtg

SEQ ID NO: 30265 - DNA, 25 bp, E. coli
ttgttgtcaggttttacctctcaac

SEQ ID NO: 30266 - DNA, 25 bp, E. coli
ttttgttgtcaggttttacctctca

SEQ ID NO: 30267 - DNA, 25 bp, E. coli
ttgtcaggtttttcctctcaacgtg

SEQ ID NO: 30268 - DNA, 25 bp, E. coli
ttttgttgtcagcttttacctctca

SEQ ID NO: 30269 - DNA, 25 bp, E. coli
tgttgtcaggttttacctctcaacg

SEQ ID NO: 30270 - DNA, 25 bp, E. coli
tgttgtcaggttatacctctcaacg

SEQ ID NO: 30271 - DNA, 25 bp, E. coli
tgtcaggttttagctctcaacgtgc

SEQ ID NO: 30272 - DNA, 25 bp, E. coli
tgtcaggttttacctctcaacgtgc

SEQ ID NO: 30273 - DNA, 25 bp, E. coli
tcaggttttaccactcaacgtgcgg

SEQ ID NO: 30274 - DNA, 25 bp, E. coli
tcaggttttacctctcaacgtgcgg

SEQ ID NO: 30275 - DNA, 25 bp, E. coli
gtctggtttcaagattagcccccgt

SEQ ID NO: 30276 - DNA, 25 bp, E. coli
gtcaggttttacctctcaacgtgcg

SEQ ID NO: 30277 - DNA, 25 bp, E. coli
gtcaggttttacgtctcaacgtgcg

SEQ ID NO: 30278 - DNA, 25 bp, E. coli
gtctggtttcaacattagcccccgt

SEQ ID NO: 30279 - DNA, 25 bp, E. coli
aattgaacggctgaaacaggaatac

SEQ ID NO: 30280 - DNA, 25 bp, E. coli
aattgaacggctcaaacaggaatac

SEQ ID NO: 30281 - DNA, 25 bp, E. coli
ctcgaaatgcgtaccagagggattg

SEQ ID NO: 30282 - DNA, 25 bp, E. coli
ctcgaaatgcgttccagagggattg

SEQ ID NO: 30283 - DNA, 25 bp, E. coli
acgccggaaggctgctggttttatt

SEQ ID NO: 30284 - DNA, 25 bp, E. coli
acgccggaaggcagctggttttatt

SEQ ID NO: 30285 - DNA, 25 bp, E. coli
atgcgtaccagacggattgagcgcc

SEQ ID NO: 30286 - DNA, 25 bp, E. coli
atgcgtaccagagggattgagcgcc

SEQ ID NO: 30287 - DNA, 25 bp, E. coli
aacagcaaatccgtctggtgtgccg

SEQ ID NO: 30288 - DNA, 25 bp, E. coli
aacagcaaatccctctggtgtgccg

SEQ ID NO: 30289 - DNA, 25 bp, E. coli
taccacatctgcctcgaaatgcgta

SEQ ID NO: 30290 - DNA, 25 bp, E. coli
taccacatctgcgtcgaaatgcgta

SEQ ID NO: 30291 - DNA, 25 bp, E. coli
tttgttgcgctgatttcggagagtg

SEQ ID NO: 30292 - DNA, 25 bp, E. coli
tttgttgcgctgttttcggagagtg

SEQ ID NO: 30293 - DNA, 25 bp, E. coli
tgagtgttccgcgagtgcgacgaca

SEQ ID NO: 30294 - DNA, 25 bp, E. coli
tgagtgttccgccagtgcgacgaca

SEQ ID NO: 30295 - DNA, 25 bp, E. coli
tccgtctggtgtcccgtcagtgcat

SEQ ID NO: 30296 - DNA, 25 bp, E. coli
tccgtctggtgtgccgtcagtgcat

SEQ ID NO: 30297 - DNA, 25 bp, E. coli
cgccagtgcgacgacaactggaagg

SEQ ID NO: 30298 - DNA, 25 bp, E. coli
cgccagtgcgaccacaactggaagg

SEQ ID NO: 30299 - DNA, 25 bp, E. coli
taacgggatgagagttccgccagtg

SEQ ID NO: 30300 - DNA, 25 bp, E. coli
taacgggatgagtgttccgccagtg

SEQ ID NO: 30301 - DNA, 25 bp, E. coli
atctgccgtggacccacccgggggg

SEQ ID NO: 30302 - DNA, 25 bp, E. coli
atctgccgtggagccacccgggggg

SEQ ID NO: 30303 - DNA, 25 bp, E. coli
aaacatcagagtcccgctgaccgaa

SEQ ID NO: 30304 - DNA, 25 bp, E. coli
aaacatcagagtgccgctgaccgaa

SEQ ID NO: 30305 - DNA, 25 bp, E. coli
tgaacgcaaaaatcagatacggcct

SEQ ID NO: 30306 - DNA, 25 bp, E. coli
tgcaggggcgtctgcgcctgaaatc

SEQ ID NO: 30307 - DNA, 25 bp, E. coli
tgaacgcaaaaaacagatacggcct

SEQ ID NO: 30308 - DNA, 25 bp, E. coli
tgcaggggcgtcagcgcctgaaatc

SEQ ID NO: 30309 - DNA, 25 bp, E. coli
gcaaaaatcagatacggcctgtcgg

SEQ ID NO: 30310 - DNA, 25 bp, E. coli
gcaaaaatcagaaacggcctgtcgg

SEQ ID NO: 30311 - DNA, 25 bp, E. coli
cgctgattggtggaggggcgtctgc

SEQ ID NO: 30312 - DNA, 25 bp, E. coli
cgctgattggtgcaggggcgtctgc

SEQ ID NO: 30313 - DNA, 25 bp, E. coli
gccacccggggggatggtaagcctg

SEQ ID NO: 30314 - DNA, 25 bp, E. coli
gccacccgggggcatggtaagcctg

SEQ ID NO: 30315 - DNA, 25 bp, E. coli
gatcgcgtcattgttgtccgtacaa

SEQ ID NO: 30316 - DNA, 25 bp, E. coli
gggatcgcgtcattcttgtccgtac

SEQ ID NO: 30317 - DNA, 25 bp, E. coli
gggatcgcgtcaatcttgtccgtac

SEQ ID NO: 30318 - DNA, 25 bp, E. coli
ggatcgcgtcattcttgtccgtaca

SEQ ID NO: 30319 - DNA, 25 bp, E. coli
ggatcgcgtcatacttgtccgtaca

SEQ ID NO: 30320 - DNA, 25 bp, E. coli
tggagaaaaacaacagagtgccgct

SEQ ID NO: 30321 - DNA, 25 bp, E. coli
tggagaaaaacatcagagtgccgct

SEQ ID NO: 30322 - DNA, 25 bp, E. coli
gatcgcgtcattcttgtccgtacaa

SEQ ID NO: 30323 - DNA, 25 bp, E. coli
cacgacgtgctggttcgatctgacg

SEQ ID NO: 30324 - DNA, 25 bp, E. coli
cacgacgtgctgcttcgatctgacg

SEQ ID NO: 30325 - DNA, 25 bp, E. coli
cagcttgaatgcatcacgggccagc

SEQ ID NO: 30326 - DNA, 25 bp, E. coli
cagcttgaatgcttcacgggccagc

SEQ ID NO: 30327 - DNA, 25 bp, E. coli
cagtgatcggttagtccgggaacac

SEQ ID NO: 30328 - DNA, 25 bp, E. coli
cagtgatcggtttgtccgggaacac

SEQ ID NO: 30329 - DNA, 25 bp, E. coli
tacatcaccgtcttagttacaaagg

SEQ ID NO: 30330 - DNA, 25 bp, E. coli
tacatcaccgtcatagttacaaagg

SEQ ID NO: 30331 - DNA, 25 bp, E. coli
taactgcacgggacatagcacgacg

SEQ ID NO: 30332 - DNA, 25 bp, E. coli
taactgcacgggtcatagcacgacg

SEQ ID NO: 30333 - DNA, 25 bp, E. coli
ttaccttgacgcataactgcacggg

SEQ ID NO: 30334 - DNA, 25 bp, E. coli
ttaccttgacgcttaactgcacggg

SEQ ID NO: 30335 - DNA, 25 bp, E. coli
tcatacaggactttacccggctgaa

SEQ ID NO: 30336 - DNA, 25 bp, E. coli
tcatacaggactatacccggctgaa

SEQ ID NO: 30337 - DNA, 25 bp, E. coli
ccggctgaatcatggcaacccaata

SEQ ID NO: 30338 - DNA, 25 bp, E. coli
ccggctgaatcaaggcaacccaata

SEQ ID NO: 30339 - DNA, 25 bp, E. coli
gaagctgccgaacctaacatccgta

SEQ ID NO: 30340 - DNA, 25 bp, E. coli
gaagctgccgaagctaacatccgta

SEQ ID NO: 30341 - DNA, 25 bp, E. coli
cgggaacacacgcatccagatctta

SEQ ID NO: 30342 - DNA, 25 bp, E. coli
cgggaacacacggatccagatctta

SEQ ID NO: 30343 - DNA, 25 bp, E. coli
ggaacaccgtccttttcatacagga

SEQ ID NO: 30344 - DNA, 25 bp, E. coli
ggaacaccgtccatttcatacagga

SEQ ID NO: 30345 - DNA, 25 bp, E. coli
caaacgctgatgtggcgctggtcct

SEQ ID NO: 30346 - DNA, 25 bp, E. coli
caaacgctgatgaggcgctggtcct

SEQ ID NO: 30347 - DNA, 25 bp, E. coli
aacaagagatgataacgctggcagc

SEQ ID NO: 30348 - DNA, 25 bp, E. coli
aacaagagatgaaaacgctggcagc

SEQ ID NO: 30349 - DNA, 25 bp, E. coli
ttatacgccgcgtctggatcaggca

SEQ ID NO: 30350 - DNA, 25 bp, E. coli
ttatacgccgcgactggatcaggca

SEQ ID NO: 30351 - DNA, 25 bp, E. coli
tgttatcggcgcatatccagcgact

SEQ ID NO: 30352 - DNA, 25 bp, E. coli
tgtcgaagtgcaagcctctctggaa

SEQ ID NO: 30353 - DNA, 25 bp, E. coli
tgttatcggcgcttatccagcgact

SEQ ID NO: 30354 - DNA, 25 bp, E. coli
tgtcgaagtgcatgcctctctggaa

SEQ ID NO: 30355 - DNA, 25 bp, E. coli
tgaaagtcgtgaacagtcgcggtag

SEQ ID NO: 30356 - DNA, 25 bp, E. coli
tgaaagtcgtgatcagtcgcggtag

SEQ ID NO: 30357 - DNA, 25 bp, E. coli
tctcatcttgagcagacaaacgctg

SEQ ID NO: 30358 - DNA, 25 bp, E. coli
tctcatcttgaggagacaaacgctg

SEQ ID NO: 30359 - DNA, 25 bp, E. coli
gacttctggcctgagcttgaacaag

SEQ ID NO: 30360 - DNA, 25 bp, E. coli
gacttctggcctcagcttgaacaag

SEQ ID NO: 30361 - DNA, 25 bp, E. coli
gctaatttgttcaggcggaagggca

SEQ ID NO: 30362 - DNA, 25 bp, E. coli
gctaatttgttctggcggaagggca

SEQ ID NO: 30363 - DNA, 25 bp, E. coli
ggcgagggtacaccacattgaacag

SEQ ID NO: 30364 - DNA, 25 bp, E. coli
ggcgagggtacagcacattgaacag

SEQ ID NO: 30365 - DNA, 25 bp, E. coli
gatggttgtttttccaccgccagag

SEQ ID NO: 30366 - DNA, 25 bp, E. coli
gatggttgttttaccaccgccagag

SEQ ID NO: 30367 - DNA, 25 bp, E. coli
aattgcgctttaagttgccggatgc

SEQ ID NO: 30368 - DNA, 25 bp, E. coli
aattgcgctttatgttgccggatgc

SEQ ID NO: 30369 - DNA, 25 bp, E. coli
cagccctgcgttatatgagttatcg

SEQ ID NO: 30370 - DNA, 25 bp, E. coli
cagccctgcgttttatgagttatcg

SEQ ID NO: 30371 - DNA, 25 bp, E. coli
catgattatccgtttctgcagggtt

SEQ ID NO: 30372 - DNA, 25 bp, E. coli
catgattatccgattctgcagggtt

SEQ ID NO: 30373 - DNA, 25 bp, E. coli
taaattgcaattgaacttgtaggcc

SEQ ID NO: 30374 - DNA, 25 bp, E. coli
taaattgcaattcaacttgtaggcc

SEQ ID NO: 30375 - DNA, 25 bp, E. coli
tgagttatcggcatgattatccgtt

SEQ ID NO: 30376 - DNA, 25 bp, E. coli
tgagttatcggcttgattatccgtt

SEQ ID NO: 30377 - DNA, 25 bp, E. coli
tctgcagggtttataatcggacgat

SEQ ID NO: 30378 - DNA, 25 bp, E. coli
tctgcagggtttttaatcggacgat

SEQ ID NO: 30379 - DNA, 25 bp, E. coli
gaagcacgttgctgacaaattgcgc

SEQ ID NO: 30380 - DNA, 25 bp, E. coli
gaagcacgttgcagacaaattgcgc

SEQ ID NO: 30381 - DNA, 25 bp, E. coli
gggttacaggtatattccaggcaga

SEQ ID NO: 30382 - DNA, 25 bp, E. coli
gggttacaggtaaattccaggcaga

SEQ ID NO: 30383 - DNA, 25 bp, E. coli
tggcgttgccgtcagtctcagttaa

SEQ ID NO: 30384 - DNA, 25 bp, E. coli
tggcgttgccgtgagtctcagttaa

SEQ ID NO: 30385 - DNA, 25 bp, E. coli
taatcggacgattagtgggtgaaat

SEQ ID NO: 30386 - DNA, 25 bp, E. coli
taatcggacgataagtgggtgaaat

SEQ ID NO: 30387 - DNA, 25 bp, E. coli
gtctcagttaatgaggttacaacga

SEQ ID NO: 30388 - DNA, 25 bp, E. coli
gtctcagttaatcaggttacaacga

SEQ ID NO: 30389 - DNA, 25 bp, E. coli
aatgattactaacccgatgccgacg

SEQ ID NO: 30390 - DNA, 25 bp, E. coli
aatgattactaagccgatgccgacg

SEQ ID NO: 30391 - DNA, 25 bp, E. coli
catgaacgtacggtgaacctgactg

SEQ ID NO: 30392 - DNA, 25 bp, E. coli
catgaacgtacgctgaacctgactg

SEQ ID NO: 30393 - DNA, 25 bp, E. coli
taaaggtatcaacaaacttggcggc

SEQ ID NO: 30394 - DNA, 25 bp, E. coli
taaaggtatcaagaaacttggcggc

SEQ ID NO: 30395 - DNA, 25 bp, E. coli
aaacgccgttctggatggtactgac

SEQ ID NO: 30396 - DNA, 25 bp, E. coli
aaacgccgttctcgatggtactgac

SEQ ID NO: 30397 - DNA, 25 bp, E. coli
ttgaaaaagttaacgcggcgggtgc

SEQ ID NO: 30398 - DNA, 25 bp, E. coli
ttgaaaaagttatcgcggcgggtgc

SEQ ID NO: 30399 - DNA, 25 bp, E. coli
tcagaaagcgttcatccgtcgtgcg

SEQ ID NO: 30400 - DNA, 25 bp, E. coli
tcagaaagcgttgatccgtcgtgcg

SEQ ID NO: 30401 - DNA, 25 bp, E. coli
gcctgaagatcacaaaatgcgcgcg

SEQ ID NO: 30402 - DNA, 25 bp, E. coli
gcctgaagatcagaaaatgcgcgcg

SEQ ID NO: 30403 - DNA, 25 bp, E. coli
gaagtcatggacgtagcaaacgccg

SEQ ID NO: 30404 - DNA, 25 bp, E. coli
gaagtcatggacctagcaaacgccg

SEQ ID NO: 30405 - DNA, 25 bp, E. coli
gataaagttcgtgagattgccgcaa

SEQ ID NO: 30406 - DNA, 25 bp, E. coli
gataaagttcgtcagattgccgcaa

SEQ ID NO: 30407 - DNA, 25 bp, E. coli
gggataaattcctgctcgacgccaa

SEQ ID NO: 30408 - DNA, 25 bp, E. coli
gggataaattccagctcgacgccaa

SEQ ID NO: 30409 - DNA, 25 bp, E. coli
taaccacctgaatggcgttacggcg

SEQ ID NO: 30410 - DNA, 25 bp, E. coli
taaccacctgaaaggcgttacggcg

SEQ ID NO: 30411 - DNA, 25 bp, E. coli
caagactttgaattaacggagatgg

SEQ ID NO: 30412 - DNA, 25 bp, E. coli
caagactttgaaataacggagatgg

SEQ ID NO: 30413 - DNA, 25 bp, E. coli
catcaaggcgatttgcggtctacgt

SEQ ID NO: 30414 - DNA, 25 bp, E. coli
catcaaggcgatatgcggtctacgt

SEQ ID NO: 30415 - DNA, 25 bp, E. coli
ttttccgagccggatcaaggcgata

SEQ ID NO: 30416 - DNA, 25 bp, E. coli
ttttctactaaattaatcgcaggag

SEQ ID NO: 30417 - DNA, 25 bp, E. coli
ttttccgagccgcatcaaggcgata

SEQ ID NO: 30418 - DNA, 25 bp, E. coli
ttttctactaaaataatcgcaggag

SEQ ID NO: 30419 - DNA, 25 bp, E. coli
gcacatttgtgctcccaaggatgaa

SEQ ID NO: 30420 - DNA, 25 bp, E. coli
gaataaagaaatcatacgcgcgagg

SEQ ID NO: 30421 - DNA, 25 bp, E. coli
gcacatttgtgcacccaaggatgaa

SEQ ID NO: 30422 - DNA, 25 bp, E. coli
gaataaagaaatgatacgcgcgagg

SEQ ID NO: 30423 - DNA, 25 bp, E. coli
gcaatttccatattttctcgctcaa

SEQ ID NO: 30424 - DNA, 25 bp, E. coli
gcaatttccataatttctcgctcaa

SEQ ID NO: 30425 - DNA, 25 bp, E. coli
cgcgcgaggtcagagaaaatcttca

SEQ ID NO: 30426 - DNA, 25 bp, E. coli
cgcgcgaggtcacagaaaatcttca

SEQ ID NO: 30427 - DNA, 25 bp, E. coli
cccaaggatgaaagctgacagcaat

SEQ ID NO: 30428 - DNA, 25 bp, E. coli
cccaaggatgaatgctgacagcaat

SEQ ID NO: 30429 - DNA, 25 bp, E. coli
cggtctacgtttttgcaggcgagtt

SEQ ID NO: 30430 - DNA, 25 bp, E. coli
cattctctatttgcggcagatcaca

SEQ ID NO: 30431 - DNA, 25 bp, E. coli
cggtctacgtttatgcaggcgagtt

SEQ ID NO: 30432 - DNA, 25 bp, E. coli
cattctctatttccggcagatcaca

SEQ ID NO: 30433 - DNA, 25 bp, E. coli
caagctggacgaaggacatcctgag

SEQ ID NO: 30434 - DNA, 25 bp, E. coli
caagctggacgatggacatcctgag

SEQ ID NO: 30435 - DNA, 25 bp, E. coli
taaaccgctgggtgaggtgatagcc

SEQ ID NO: 30436 - DNA, 25 bp, E. coli
taaaccgctgggagaggtgatagcc

SEQ ID NO: 30437 - DNA, 25 bp, E. coli
ttactaccgcgaaagatgccctgca

SEQ ID NO: 30438 - DNA, 25 bp, E. coli
ttactaccgcgatagatgccctgca

SEQ ID NO: 30439 - DNA, 25 bp, E. coli
tgagtttggcgcagtgaaaccgctg

SEQ ID NO: 30440 - DNA, 25 bp, E. coli
tgagtttggcgctgtgaaaccgctg

SEQ ID NO: 30441 - DNA, 25 bp, E. coli
tgaaaacctgcgcaaccagcttggc

SEQ ID NO: 30442 - DNA, 25 bp, E. coli
tgaaaacctgcggaaccagcttggc

SEQ ID NO: 30443 - DNA, 25 bp, E. coli
tcgtgaacgctggtgaaagcctgca

SEQ ID NO: 30444 - DNA, 25 bp, E. coli
tcgtgaacgctgctgaaagcctgca

SEQ ID NO: 30445 - DNA, 25 bp, E. coli
gacgttcccgctcaaaaataccgat

SEQ ID NO: 30446 - DNA, 25 bp, E. coli
gacgttcccgctgaaaaataccgat

SEQ ID NO: 30447 - DNA, 25 bp, E. coli
gaaaccgctggaagacgagagtaca

SEQ ID NO: 30448 - DNA, 25 bp, E. coli
gaaaccgctggatgacgagagtaca

SEQ ID NO: 30449 - DNA, 25 bp, E. coli
cccgccgtcacgtgatgaaaggatt

SEQ ID NO: 30450 - DNA, 25 bp, E. coli
cccgccgtcacgagatgaaaggatt

SEQ ID NO: 30451 - DNA, 25 bp, E. coli
gattactgctgtagctcggcgctgg

SEQ ID NO: 30452 - DNA, 25 bp, E. coli
gattactgctgttgctcggcgctgg

SEQ ID NO: 30453 - DNA, 25 bp, E. coli
tcagcaactggaagatggctccctg

SEQ ID NO: 30454 - DNA, 25 bp, E. coli
tcagcaactggatgatggctccctg

SEQ ID NO: 30455 - DNA, 25 bp, E. coli
caatctggttggcattaagcctggc

SEQ ID NO: 30456 - DNA, 25 bp, E. coli
caatctggttgggattaagcctggc

SEQ ID NO: 30457 - DNA, 25 bp, E. coli
tacatgaggctatacgaaaaagccc

SEQ ID NO: 30458 - DNA, 25 bp, E. coli
tacatgtacgtatgcatctgctcgt

SEQ ID NO: 30459 - DNA, 25 bp, E. coli
tacatgaggctaaacgaaaaagccc

SEQ ID NO: 30460 - DNA, 25 bp, E. coli
tacatgtacgtaagcatctgctcgt

SEQ ID NO: 30461 - DNA, 25 bp, E. coli
aggttttatctgtcatcggcgaggc

SEQ ID NO: 30462 - DNA, 25 bp, E. coli
aggttttatctgacatcggcgaggc

SEQ ID NO: 30463 - DNA, 25 bp, E. coli
tgctcgtggcttactacaatctggt

SEQ ID NO: 30464 - DNA, 25 bp, E. coli
tgagcgcattcttcataagctggaa

SEQ ID NO: 30465 - DNA, 25 bp, E. coli
tgagcgcattctacataagctggaa

SEQ ID NO: 30466 - DNA, 25 bp, E. coli
tgctcgtggctttctacaatctggt

SEQ ID NO: 30467 - DNA, 25 bp, E. coli
gaagcgcgctttgtgctggaagata

SEQ ID NO: 30468 - DNA, 25 bp, E. coli
gaagcgcgctttctgctggaagata

SEQ ID NO: 30469 - DNA, 25 bp, E. coli
cggagcgcgtcacaggaagtaacaa

SEQ ID NO: 30470 - DNA, 25 bp, E. coli
cggagcgcgtcagaggaagtaacaa

SEQ ID NO: 30471 - DNA, 25 bp, E. coli
taaccagctcgataacctgacggag

SEQ ID NO: 30472 - DNA, 25 bp, E. coli
taagcctggcaaagaatcgtacatg

SEQ ID NO: 30473 - DNA, 25 bp, E. coli
taagcctggcaatgaatcgtacatg

SEQ ID NO: 30474 - DNA, 25 bp, E. coli
taaccagctcgaaaacctgacggag

SEQ ID NO: 30475 - DNA, 25 bp, E. coli
gagcctggtcgaatacttgtctgcc

SEQ ID NO: 30476 - DNA, 25 bp, E. coli
gagcctggtcgattacttgtctgcc

SEQ ID NO: 30477 - DNA, 25 bp, E. coli
caatacctcagtacttcagaacccg

SEQ ID NO: 30478 - DNA, 25 bp, E. coli
caatacctcagttcttcagaacccg

SEQ ID NO: 30479 - DNA, 25 bp, E. coli
taaatcaaccatcgtcagactgcga

SEQ ID NO: 30480 - DNA, 25 bp, E. coli
taaatcaaccatggtcagactgcga

SEQ ID NO: 30481 - DNA, 25 bp, E. coli
agttcttcagaacccgcctccgata

SEQ ID NO: 30482 - DNA, 25 bp, E. coli
agttcttcagaagccgcctccgata

SEQ ID NO: 30483 - DNA, 25 bp, E. coli
tcgtcagactgccatcattcgtatg

SEQ ID NO: 30484 - DNA, 25 bp, E. coli
tgagttcgccggaacaatacctcag

SEQ ID NO: 30485 - DNA, 25 bp, E. coli
tcgtcagactgcgatcattcgtatg

SEQ ID NO: 30486 - DNA, 25 bp, E. coli
tgagttcgccggtacaatacctcag

SEQ ID NO: 30487 - DNA, 25 bp, E. coli
tccgataccagcgtggcggtcgccc

SEQ ID NO: 30488 - DNA, 25 bp, E. coli
tcgccggaacaaaacctcagttctt

SEQ ID NO: 30489 - DNA, 25 bp, E. coli
tccgataccagcctggcggtcgccc

SEQ ID NO: 30490 - DNA, 25 bp, E. coli
tcgccggaacaatacctcagttctt

SEQ ID NO: 30491 - DNA, 25 bp, E. coli
tcagactgcgatcattcgtatgcat

SEQ ID NO: 30492 - DNA, 25 bp, E. coli
tcagactgcgatgattcgtatgcat

SEQ ID NO: 30493 - DNA, 25 bp, E. coli
gccccggcgcaagagaataaatcaa

SEQ ID NO: 30494 - DNA, 25 bp, E. coli
gccccggcgcaacagaataaatcaa

SEQ ID NO: 30495 - DNA, 25 bp, E. coli
gaataaatcaaccatcgtcagactg

SEQ ID NO: 30496 - DNA, 25 bp, E. coli
gaataaatcaacgatcgtcagactg

SEQ ID NO: 30497 - DNA, 25 bp, E. coli
gtcgccccggcgcaacagaataaat

SEQ ID NO: 30498 - DNA, 25 bp, E. coli
gtcgccccggcggaacagaataaat

SEQ ID NO: 30499 - DNA, 25 bp, E. coli
aaaaccgacgcacactggcgtcggc

SEQ ID NO: 30500 - DNA, 25 bp, E. coli
aaaaccgacgcagactggcgtcggc

SEQ ID NO: 30501 - DNA, 25 bp, E. coli
tatggagcgaggagaaaaaaagacg

SEQ ID NO: 30502 - DNA, 25 bp, E. coli
tacgccgttgcacgacgttgcaaaa

SEQ ID NO: 30503 - DNA, 25 bp, E. coli
tacgccgttgcaggacgttgcaaaa

SEQ ID NO: 30504 - DNA, 25 bp, E. coli
tatggagcgaggtgaaaaaaagacg

SEQ ID NO: 30505 - DNA, 25 bp, E. coli
ttccggactattaacgccgttgcag

SEQ ID NO: 30506 - DNA, 25 bp, E. coli
ttccggactatttacgccgttgcag

SEQ ID NO: 30507 - DNA, 25 bp, E. coli
tcggcgcatcttccggactatttac

SEQ ID NO: 30508 - DNA, 25 bp, E. coli
tcggcgcatcttgcggactatttac

SEQ ID NO: 30509 - DNA, 25 bp, E. coli
tcggctctggcaggatgtttcgtaa

SEQ ID NO: 30510 - DNA, 25 bp, E. coli
tcggctctggcacgatgtttcgtaa

SEQ ID NO: 30511 - DNA, 25 bp, E. coli
gccggcagtatggagcgaggagaaa

SEQ ID NO: 30512 - DNA, 25 bp, E. coli
ccagtttctattacttcggcgcatc

SEQ ID NO: 30513 - DNA, 25 bp, E. coli
ccagtttctatttcttcggcgcatc

SEQ ID NO: 30514 - DNA, 25 bp, E. coli
gccggcagtatgcagcgaggagaaa

SEQ ID NO: 30515 - DNA, 25 bp, E. coli
gcaggacgttgcaaaatttcgggaa

SEQ ID NO: 30516 - DNA, 25 bp, E. coli
gcaggacgttgctaaatttcgggaa

SEQ ID NO: 30517 - DNA, 25 bp, E. coli
gacgagggccagattctatttcttc

SEQ ID NO: 30518 - DNA, 25 bp, E. coli
gacgagggccagtttctatttcttc

SEQ ID NO: 30519 - DNA, 25 bp, E. coli
cgcacactggcgtcggctctggcag

SEQ ID NO: 30520 - DNA, 25 bp, E. coli
cgcacactggcgacggctctggcag

SEQ ID NO: 30521 - DNA, 25 bp, E. coli
aaccgttggctgtcgctaatgagcg

SEQ ID NO: 30522 - DNA, 25 bp, E. coli
caaatttccgcactggtggcaggcg

SEQ ID NO: 30523 - DNA, 25 bp, E. coli
caaatttccgcagtggtggcaggcg

SEQ ID NO: 30524 - DNA, 25 bp, E. coli
caacatgcgagataaggaagacaca

SEQ ID NO: 30525 - DNA, 25 bp, E. coli
caacatgcgagaaaaggaagacaca

SEQ ID NO: 30526 - DNA, 25 bp, E. coli
caggctgatcgccattgactcaagc

SEQ ID NO: 30527 - DNA, 25 bp, E. coli
caggctgatcgcgattgactcaagc

SEQ ID NO: 30528 - DNA, 25 bp, E. coli
tacaactttagccactacctgcaag

SEQ ID NO: 30529 - DNA, 25 bp, E. coli
tacaactttagcgactacctgcaag

SEQ ID NO: 30530 - DNA, 25 bp, E. coli
aaccgttggctgacgctaatgagcg

SEQ ID NO: 30531 - DNA, 25 bp, E. coli
tacgcctgaaacagatgctgctggg

SEQ ID NO: 30532 - DNA, 25 bp, E. coli
tacgcctgaaactgatgctgctggg

SEQ ID NO: 30533 - DNA, 25 bp, E. coli
tatttatcgattaagtaggcggcgc

SEQ ID NO: 30534 - DNA, 25 bp, E. coli
tatttatcgatttagtaggcggcgc

SEQ ID NO: 30535 - DNA, 25 bp, E. coli
ttacacgccgcggtaacgctgttgg

SEQ ID NO: 30536 - DNA, 25 bp, E. coli
ttacacgccgcgctaacgctgttgg

SEQ ID NO: 30537 - DNA, 25 bp, E. coli
tgagcaattcactgctacgcctgaa

SEQ ID NO: 30538 - DNA, 25 bp, E. coli
tgagcaattcacagctacgcctgaa

SEQ ID NO: 30539 - DNA, 25 bp, E. coli
gctggctggccccttcaatgcaaat

SEQ ID NO: 30540 - DNA, 25 bp, E. coli
gctggctggcccgttcaatgcaaat

SEQ ID NO: 30541 - DNA, 25 bp, E. coli
cgtattttatcttctctggcccaca

SEQ ID NO: 30542 - DNA, 25 bp, E. coli
cgtattttatctactctggcccaca

SEQ ID NO: 30543 - DNA, 25 bp, E. coli
ctttgctgatgatgggcttaacgtc

SEQ ID NO: 30544 - DNA, 25 bp, E. coli
ctttgctgatgaagggcttaacgtc

SEQ ID NO: 30545 - DNA, 25 bp, E. coli
tactgcagaagttcaaacaggaaaa

SEQ ID NO: 30546 - DNA, 25 bp, E. coli
tactgcagaagtacaaacaggaaaa

SEQ ID NO: 30547 - DNA, 25 bp, E. coli
accgcttatgactatagcttcgcca

SEQ ID NO: 30548 - DNA, 25 bp, E. coli
accgcttatgacaatagcttcgcca

SEQ ID NO: 30549 - DNA, 25 bp, E. coli
tatagcttcgccaaactctttgctg

SEQ ID NO: 30550 - DNA, 25 bp, E. coli
tatagcttcgcctaactctttgctg

SEQ ID NO: 30551 - DNA, 25 bp, E. coli
tgatgaagggctaaacgtcatgctg

SEQ ID NO: 30552 - DNA, 25 bp, E. coli
tgcacgacgcctttggtattaccgg

SEQ ID NO: 30553 - DNA, 25 bp, E. coli
tgatgaagggcttaacgtcatgctg

SEQ ID NO: 30554 - DNA, 25 bp, E. coli
tgcacgacgcctatggtattaccgg

SEQ ID NO: 30555 - DNA, 25 bp, E. coli
ccatctccttactgcagaagtacaa

SEQ ID NO: 30556 - DNA, 25 bp, E. coli
ccaaactctttggtgatgaagggct

SEQ ID NO: 30557 - DNA, 25 bp, E. coli
gccagttaccgtagccgatatcgcc

SEQ ID NO: 30558 - DNA, 25 bp, E. coli
gcctttggtatttccggcggtcaca

SEQ ID NO: 30559 - DNA, 25 bp, E. coli
gccagttaccgttgccgatatcgcc

SEQ ID NO: 30560 - DNA, 25 bp, E. coli
ccaaactctttgctgatgaagggct

SEQ ID NO: 30561 - DNA, 25 bp, E. coli
gcctttggtattaccggcggtcaca

SEQ ID NO: 30562 - DNA, 25 bp, E. coli
ccatctccttacagcagaagtacaa

SEQ ID NO: 30563 - DNA, 25 bp, E. coli
cgtgatgcacgacgcctttggtatt

SEQ ID NO: 30564 - DNA, 25 bp, E. coli
cgtgatgcacgaggcctttggtatt

SEQ ID NO: 30565 - DNA, 25 bp, E. coli
aagagagtttggattgtatgtgcgc

SEQ ID NO: 30566 - DNA, 25 bp, E. coli
aagtcaccggagttgttcaggctcc

SEQ ID NO: 30567 - DNA, 25 bp, E. coli
aagagagtttggtttgtatgtgcgc

SEQ ID NO: 30568 - DNA, 25 bp, E. coli
aagtcaccggagatgttcaggctcc

SEQ ID NO: 30569 - DNA, 25 bp, E. coli
catctgtgaagggagaagagagttt

SEQ ID NO: 30570 - DNA, 25 bp, E. coli
catctgtgaaggcagaagagagttt

SEQ ID NO: 30571 - DNA, 25 bp, E. coli
taattatgccgtcttgatttcccaa

SEQ ID NO: 30572 - DNA, 25 bp, E. coli
taattatgccgtgttgatttcccaa

SEQ ID NO: 30573 - DNA, 25 bp, E. coli
tcaggctccggtcacataattatgc

SEQ ID NO: 30574 - DNA, 25 bp, E. coli
tcaggctccggtgacataattatgc

SEQ ID NO: 30575 - DNA, 25 bp, E. coli
tcaaaatcgatagaattgctccttc

SEQ ID NO: 30576 - DNA, 25 bp, E. coli
tcaaaatcgatacaattgctccttc

SEQ ID NO: 30577 - DNA, 25 bp, E. coli
cctccgcagaggtcaaacgctagat

SEQ ID NO: 30578 - DNA, 25 bp, E. coli
cctccgcagaggacaaacgctagat

SEQ ID NO: 30579 - DNA, 25 bp, E. coli
gcaggtgcatttctgcatctgtgaa

SEQ ID NO: 30580 - DNA, 25 bp, E. coli
gcaggtgcatttgtgcatctgtgaa

SEQ ID NO: 30581 - DNA, 25 bp, E. coli
cgtttagcgcagaagtcaccggagt

SEQ ID NO: 30582 - DNA, 25 bp, E. coli
cgtttagcgcagtagtcaccggagt

SEQ ID NO: 30583 - DNA, 25 bp, E. coli
gtatgtgcgcataaacgtccccgtt

SEQ ID NO: 30584 - DNA, 25 bp, E. coli
gtatgtgcgcattaacgtccccgtt

SEQ ID NO: 30585 - DNA, 25 bp, E. coli
tcaaacgctagaagcaaagaattgc

SEQ ID NO: 30586 - DNA, 25 bp, E. coli
tcaaacgctagatgcaaagaattgc

SEQ ID NO: 30587 - DNA, 25 bp, E. coli
ctccgttaagaccaggcatggcaac

SEQ ID NO: 30588 - DNA, 25 bp, E. coli
cagcgctctccgttaagacgaggca

SEQ ID NO: 30589 - DNA, 25 bp, E. coli
ctccgttaagacgaggcatggcaac

SEQ ID NO: 30590 - DNA, 25 bp, E. coli
cagcgctctccgataagacgaggca

SEQ ID NO: 30591 - DNA, 25 bp, E. coli
agtcagccactttttatccttttgc

SEQ ID NO: 30592 - DNA, 25 bp, E. coli
agtcagccacttattatccttttgc

SEQ ID NO: 30593 - DNA, 25 bp, E. coli
aaataatgggttttctgagcagaca

SEQ ID NO: 30594 - DNA, 25 bp, E. coli
aaataatgggttatctgagcagaca

SEQ ID NO: 30595 - DNA, 25 bp, E. coli
tatccttttgctaatatagagagga

SEQ ID NO: 30596 - DNA, 25 bp, E. coli
tatccttttgcttatatagagagga

SEQ ID NO: 30597 - DNA, 25 bp, E. coli
tatagagaggatgatgatatgcaga

SEQ ID NO: 30598 - DNA, 25 bp, E. coli
tatagagaggatcatgatatgcaga

SEQ ID NO: 30599 - DNA, 25 bp, E. coli
ttttctgagcagacataatggaggg

SEQ ID NO: 30600 - DNA, 25 bp, E. coli
ttttctgagcagtcataatggaggg

SEQ ID NO: 30601 - DNA, 25 bp, E. coli
tgatatgcagaatgaaataatgggt

SEQ ID NO: 30602 - DNA, 25 bp, E. coli
tgtcaaaaacaactcagccacttat

SEQ ID NO: 30603 - DNA, 25 bp, E. coli
tgtcaaaaacaagtcagccacttat

SEQ ID NO: 30604 - DNA, 25 bp, E. coli
tgatatgcagaaagaaataatgggt

SEQ ID NO: 30605 - DNA, 25 bp, E. coli
gaattgtcaaaaacaagtcagccac

SEQ ID NO: 30606 - DNA, 25 bp, E. coli
gaattgtcaaaatcaagtcagccac

SEQ ID NO: 30607 - DNA, 25 bp, E. coli
gttcagcgctctccgttaagacgag

SEQ ID NO: 30608 - DNA, 25 bp, E. coli
gttcagcgctctgcgttaagacgag

SEQ ID NO: 30609 - DNA, 25 bp, E. coli
taactaaatcacttagaaaaccatc

SEQ ID NO: 30610 - DNA, 25 bp, E. coli
taactaaatcacatagaaaaccatc

SEQ ID NO: 30611 - DNA, 25 bp, E. coli
tagaaaaccatctattatagtatgt

SEQ ID NO: 30612 - DNA, 25 bp, E. coli
tagtatgtataaaataggcgacagc

SEQ ID NO: 30613 - DNA, 25 bp, E. coli
tagtatgtataatataggcgacagc

SEQ ID NO: 30614 - DNA, 25 bp, E. coli
tagaaaaccatcaattatagtatgt

SEQ ID NO: 30615 - DNA, 25 bp, E. coli
taggcgacagcatcccaattacaaa

SEQ ID NO: 30616 - DNA, 25 bp, E. coli
taggcgacagcaacccaattacaaa

SEQ ID NO: 30617 - DNA, 25 bp, E. coli
tataaaataggcgacagcaacccaa

SEQ ID NO: 30618 - DNA, 25 bp, E. coli
tataaaataggccacagcaacccaa

SEQ ID NO: 30619 - DNA, 25 bp, E. coli
tataattaacatgtagacaacttgt

SEQ ID NO: 30620 - DNA, 25 bp, E. coli
tataattaacatctagacaacttgt

SEQ ID NO: 30621 - DNA, 25 bp, E. coli
gccatttcaatgtaacaattaaccc

SEQ ID NO: 30622 - DNA, 25 bp, E. coli
ccaattacaaattaatggttccaga

SEQ ID NO: 30623 - DNA, 25 bp, E. coli
ccagaaggttataaactaaatcaca

SEQ ID NO: 30624 - DNA, 25 bp, E. coli
ccaattacaaataaatggttccaga

SEQ ID NO: 30625 - DNA, 25 bp, E. coli
gccatttcaatgaaacaattaaccc

SEQ ID NO: 30626 - DNA, 25 bp, E. coli
ccagaaggttattaactaaatcaca

SEQ ID NO: 30627 - DNA, 25 bp, E. coli
ggaataactagccatttcaatgtaa

SEQ ID NO: 30628 - DNA, 25 bp, E. coli
tggttccagaatttcacatcaaaaa

SEQ ID NO: 30629 - DNA, 25 bp, E. coli
ggaataactagcgatttcaatgtaa

SEQ ID NO: 30630 - DNA, 25 bp, E. coli
tggttccagaatatcacatcaaaaa

SEQ ID NO: 30631 - DNA, 25 bp, E. coli
caattcagcgaccaagattttgccg

SEQ ID NO: 30632 - DNA, 25 bp, E. coli
caattcagcgacgaagattttgccg

SEQ ID NO: 30633 - DNA, 25 bp, E. coli
cacttcatcgagttggtcatcagca

SEQ ID NO: 30634 - DNA, 25 bp, E. coli
cacttcatcgagatggtcatcagca

SEQ ID NO: 30635 - DNA, 25 bp, E. coli
catcaatttttagttttggcaggaa

SEQ ID NO: 30636 - DNA, 25 bp, E. coli
catcaatttttacttttggcaggaa

SEQ ID NO: 30637 - DNA, 25 bp, E. coli
tttcacttcggtcacggtcaggccc

SEQ ID NO: 30638 - DNA, 25 bp, E. coli
tttcacttcggtgacggtcaggccc

SEQ ID NO: 30639 - DNA, 25 bp, E. coli
tgacgcccgaaacctttcacttcgg

SEQ ID NO: 30640 - DNA, 25 bp, E. coli
tgacgatatcgatcacttcatcgag

SEQ ID NO: 30641 - DNA, 25 bp, E. coli
tgacgatatcgaacacttcatcgag

SEQ ID NO: 30642 - DNA, 25 bp, E. coli
tgacgcccgaaagctttcacttcgg

SEQ ID NO: 30643 - DNA, 25 bp, E. coli
tcgccaatttttccggtgtaagccg

SEQ ID NO: 30644 - DNA, 25 bp, E. coli
tcgccaatttttgcggtgtaagccg

SEQ ID NO: 30645 - DNA, 25 bp, E. coli
tcaggccctgaataccaatggaaga

SEQ ID NO: 30646 - DNA, 25 bp, E. coli
tcaggccctgaaaaccaatggaaga

SEQ ID NO: 30647 - DNA, 25 bp, E. coli
gacgaagattttgccgtcgccaatt

SEQ ID NO: 30648 - DNA, 25 bp, E. coli
gacgaagattttcccgtcgccaatt

SEQ ID NO: 30649 - DNA, 25 bp, E. coli
gtacagctcggcatgccctttctga

SEQ ID NO: 30650 - DNA, 25 bp, E. coli
ggtcatcagcaaacgccacatcaat

SEQ ID NO: 30651 - DNA, 25 bp, E. coli
gtacagctcggcttgccctttctga

SEQ ID NO: 30652 - DNA, 25 bp, E. coli
ggtcatcagcaatcgccacatcaat

SEQ ID NO: 30653 - DNA, 25 bp, E. coli
caattaaggcaacatcacgctttga

SEQ ID NO: 30654 - DNA, 25 bp, E. coli
caattaaggcaagatcacgctttga

SEQ ID NO: 30655 - DNA, 25 bp, E. coli
cagtattacactcacgcgcaaggag

SEQ ID NO: 30656 - DNA, 25 bp, E. coli
cagtattacactgacgcgcaaggag

SEQ ID NO: 30657 - DNA, 25 bp, E. coli
tactgcaagggattctgtcgatgac

SEQ ID NO: 30658 - DNA, 25 bp, E. coli
tactttggctacaggcctccagagc

SEQ ID NO: 30659 - DNA, 25 bp, E. coli
tactttggctactggcctccagagc

SEQ ID NO: 30660 - DNA, 25 bp, E. coli
tactgcaagggaatctgtcgatgac

SEQ ID NO: 30661 - DNA, 25 bp, E. coli
tattgaagataaacaaaggacccag

SEQ ID NO: 30662 - DNA, 25 bp, E. coli
tattgaagataatcaaaggacccag

SEQ ID NO: 30663 - DNA, 25 bp, E. coli
tcattttctgagatgctggcaaggg

SEQ ID NO: 30664 - DNA, 25 bp, E. coli
tcattttctgagttgctggcaaggg

SEQ ID NO: 30665 - DNA, 25 bp, E. coli
gctggcaagggtacgggcacaatta

SEQ ID NO: 30666 - DNA, 25 bp, E. coli
gctggcaagggttcgggcacaatta

SEQ ID NO: 30667 - DNA, 25 bp, E. coli
gcaggctccgcgcaaaagttgatga

SEQ ID NO: 30668 - DNA, 25 bp, E. coli
gcaggctccgcggaaaagttgatga

SEQ ID NO: 30669 - DNA, 25 bp, E. coli
cccagaacggtttttgcgagtgaaa

SEQ ID NO: 30670 - DNA, 25 bp, E. coli
cccagaacggttattgcgagtgaaa

SEQ ID NO: 30671 - DNA, 25 bp, E. coli
gggctttccgaaccgggttatgtca

SEQ ID NO: 30672 - DNA, 25 bp, E. coli
gggctttccgaagcgggttatgtca

SEQ ID NO: 30673 - DNA, 25 bp, E. coli
gatggctggcagatcttacaaacgt

SEQ ID NO: 30674 - DNA, 25 bp, E. coli
gatggctggcagttcttacaaacgt

SEQ ID NO: 30675 - DNA, 25 bp, E. coli
caaagaagcggtaaagcagcgtctc

SEQ ID NO: 30676 - DNA, 25 bp, E. coli
caaagaagcggttaagcagcgtctc

SEQ ID NO: 30677 - DNA, 25 bp, E. coli
caaacagtacggagtggtgctgcaa

SEQ ID NO: 30678 - DNA, 25 bp, E. coli
caaacagtacggtgtggtgctgcaa

SEQ ID NO: 30679 - DNA, 25 bp, E. coli
atttggtaaaacagaaggcggcgca

SEQ ID NO: 30680 - DNA, 25 bp, E. coli
atttggtaaaactgaaggcggcgca

SEQ ID NO: 30681 - DNA, 25 bp, E. coli
tatcgcggcgaagaactatgactgg

SEQ ID NO: 30682 - DNA, 25 bp, E. coli
tatcgcggcgaacaactatgactgg

SEQ ID NO: 30683 - DNA, 25 bp, E. coli
ttggatccgaagaaaaccagcccgt

SEQ ID NO: 30684 - DNA, 25 bp, E. coli
ttggatccgaagtaaaccagcccgt

SEQ ID NO: 30685 - DNA, 25 bp, E. coli
tgaagagatcaacgccctggaagaa

SEQ ID NO: 30686 - DNA, 25 bp, E. coli
tgaatgtgctgagcttcctgcgcga

SEQ ID NO: 30687 - DNA, 25 bp, E. coli
tgaatgtgctgaccttcctgcgcga

SEQ ID NO: 30688 - DNA, 25 bp, E. coli
tgaagagatcaaggccctggaagaa

SEQ ID NO: 30689 - DNA, 25 bp, E. coli
gaagcggacttccaacagctggcgc

SEQ ID NO: 30690 - DNA, 25 bp, E. coli
gaagcggacttcgaacagctggcgc

SEQ ID NO: 30691 - DNA, 25 bp, E. coli
gattctgaactggaaccttcccgtg

SEQ ID NO: 30692 - DNA, 25 bp, E. coli
gattggcgacccgagcttcaaagct

SEQ ID NO: 30693 - DNA, 25 bp, E. coli
gattctgaactgcaaccttcccgtg

SEQ ID NO: 30694 - DNA, 25 bp, E. coli
gattggcgaccccagcttcaaagct

SEQ ID NO: 30695 - DNA, 25 bp, E. coli
gagaaaactctgctatcgcggcgaa

SEQ ID NO: 30696 - DNA, 25 bp, E. coli
gagaaaactctggtatcgcggcgaa

SEQ ID NO: 30697 - DNA, 25 bp, E. coli
tggtggatctattgaaggcaacgcc

SEQ ID NO: 30698 - DNA, 25 bp, E. coli
tggtggatctatagaaggcaacgcc

SEQ ID NO: 30699 - DNA, 25 bp, E. coli
tgatgcaccattggctctgaagtgg

SEQ ID NO: 30700 - DNA, 25 bp, E. coli
tgatgcaccattcgctctgaagtgg

SEQ ID NO: 30701 - DNA, 25 bp, E. coli
tcccctggatatgacaatgattgcg

SEQ ID NO: 30702 - DNA, 25 bp, E. coli
tcccctggatatcacaatgattgcg

SEQ ID NO: 30703 - DNA, 25 bp, E. coli
tctgaagtggtcgtgggcaacatct

SEQ ID NO: 30704 - DNA, 25 bp, E. coli
tctgaaggcaaaccagcattacgcg

SEQ ID NO: 30705 - DNA, 25 bp, E. coli
tctgaagtggtcctgggcaacatct

SEQ ID NO: 30706 - DNA, 25 bp, E. coli
tctatcgcccggaaggattgagtgg

SEQ ID NO: 30707 - DNA, 25 bp, E. coli
tctatcgcccggtaggattgagtgg

SEQ ID NO: 30708 - DNA, 25 bp, E. coli
tctgaaggcaaagcagcattacgcg

SEQ ID NO: 30709 - DNA, 25 bp, E. coli
gacatcgtaattacaggtacacgcg

SEQ ID NO: 30710 - DNA, 25 bp, E. coli
gacatcgtaatttcaggtacacgcg

SEQ ID NO: 30711 - DNA, 25 bp, E. coli
gatttagaagcctacggcaaacgct

SEQ ID NO: 30712 - DNA, 25 bp, E. coli
gatttagaagccaacggcaaacgct

SEQ ID NO: 30713 - DNA, 25 bp, E. coli
taacgacgtcatcaaggtaaatggg

SEQ ID NO: 30714 - DNA, 25 bp, E. coli
taacgacgtcatgaaggtaaatggg

SEQ ID NO: 30715 - DNA, 25 bp, E. coli
gagatgataacgctgaaccaggcag

SEQ ID NO: 30716 - DNA, 25 bp, E. coli
gatgtacaccgcgagtagtgctctg

SEQ ID NO: 30717 - DNA, 25 bp, E. coli
gagatgataacggtgaaccaggcag

SEQ ID NO: 30718 - DNA, 25 bp, E. coli
gatgtacaccgccagtagtgctctg

SEQ ID NO: 30719 - DNA, 25 bp, E. coli
aactgttcgatagcaacggcgacgg

SEQ ID NO: 30720 - DNA, 25 bp, E. coli
catagcgtactttttgcgacagcgt

SEQ ID NO: 30721 - DNA, 25 bp, E. coli
catagcgtacttattgcgacagcgt

SEQ ID NO: 30722 - DNA, 25 bp, E. coli
aactgttcgataccaacggcgacgg

SEQ ID NO: 30723 - DNA, 25 bp, E. coli
tacctgatcgattagaaaaccgccg

SEQ ID NO: 30724 - DNA, 25 bp, E. coli
tacctgatcgataagaaaaccgccg

SEQ ID NO: 30725 - DNA, 25 bp, E. coli
cctggacgccgttctgggtgagtaa

SEQ ID NO: 30726 - DNA, 25 bp, E. coli
cctggacgccgtactgggtgagtaa

SEQ ID NO: 30727 - DNA, 25 bp, E. coli
gctgccggtggccataagaaatttt

SEQ ID NO: 30728 - DNA, 25 bp, E. coli
gctgccggtggcgataagaaatttt

SEQ ID NO: 30729 - DNA, 25 bp, E. coli
gacaacatgtacgaagctgccggtg

SEQ ID NO: 30730 - DNA, 25 bp, E. coli
gacaacatgtaccaagctgccggtg

SEQ ID NO: 30731 - DNA, 25 bp, E. coli
cattatgcatgacggcaaagcctca

SEQ ID NO: 30732 - DNA, 25 bp, E. coli
cattatgcatgagggcaaagcctca

SEQ ID NO: 30733 - DNA, 25 bp, E. coli
gattacaacgttggctacacctcgc

SEQ ID NO: 30734 - DNA, 25 bp, E. coli
gatattaacgccgagaacgccatta

SEQ ID NO: 30735 - DNA, 25 bp, E. coli
gattacaacgttcgctacacctcgc

SEQ ID NO: 30736 - DNA, 25 bp, E. coli
gatattaacgcccagaacgccatta

SEQ ID NO: 30737 - DNA, 25 bp, E. coli
ggtgcgatcaacgaccagcttgccg

SEQ ID NO: 30738 - DNA, 25 bp, E. coli
ggtgcgatcaaccaccagcttgccg

SEQ ID NO: 30739 - DNA, 25 bp, E. coli
tggacgccactggatgacaacatgt

SEQ ID NO: 30740 - DNA, 25 bp, E. coli
tggacgccactgcatgacaacatgt

SEQ ID NO: 30741 - DNA, 25 bp, E. coli
atttctctgtgtcggcagttatctg

SEQ ID NO: 30742 - DNA, 25 bp, E. coli
atttctctgtgtgggcagttatctg

SEQ ID NO: 30743 - DNA, 25 bp, E. coli
atggtatttctctgtgtcggcagtt

SEQ ID NO: 30744 - DNA, 25 bp, E. coli
atggtatttctcagtgtcggcagtt

SEQ ID NO: 30745 - DNA, 25 bp, E. coli
tttctctgtgtccgcagttatctgt

SEQ ID NO: 30746 - DNA, 25 bp, E. coli
tttctctgtgtcggcagttatctgt

SEQ ID NO: 30747 - DNA, 25 bp, E. coli
tatttctctgtgacggcagttatct

SEQ ID NO: 30748 - DNA, 25 bp, E. coli
tatttctctgtgtcggcagttatct

SEQ ID NO: 30749 - DNA, 25 bp, E. coli
ttgatggtatttctctgtgtcggca

SEQ ID NO: 30750 - DNA, 25 bp, E. coli
ttgatggtatttgtctgtgtcggca

SEQ ID NO: 30751 - DNA, 25 bp, E. coli
tgatggtatttctctgtgtcggcag

SEQ ID NO: 30752 - DNA, 25 bp, E. coli
tgatggtatttcactgtgtcggcag

SEQ ID NO: 30753 - DNA, 25 bp, E. coli
tctctgtgtcgggagttatctgtta

SEQ ID NO: 30754 - DNA, 25 bp, E. coli
tctctgtgtcggcagttatctgtta

SEQ ID NO: 30755 - DNA, 25 bp, E. coli
gtatttctctgtgtcggcagttatc

SEQ ID NO: 30756 - DNA, 25 bp, E. coli
ggtatttctctgagtcggcagttat

SEQ ID NO: 30757 - DNA, 25 bp, E. coli
ggtatttctctgtgtcggcagttat

SEQ ID NO: 30758 - DNA, 25 bp, E. coli
gtatttctctgtctcggcagttatc

SEQ ID NO: 30759 - DNA, 25 bp, E. coli
tggtatttctctgtgtcggcagtta

SEQ ID NO: 30760 - DNA, 25 bp, E. coli
tggtatttctctctgtcggcagtta

SEQ ID NO: 30761 - DNA, 25 bp, E. coli
gatggtatttctctgtgtcggcagt

SEQ ID NO: 30762 - DNA, 25 bp, E. coli
gatggtatttctgtgtgtcggcagt

SEQ ID NO: 30763 - DNA, 25 bp, E. coli
caatgggattttctcgccgcgatgg

SEQ ID NO: 30764 - DNA, 25 bp, E. coli
caatgggattttgtcgccgcgatgg

SEQ ID NO: 30765 - DNA, 25 bp, E. coli
cagcggagaagttgtttgtcaccca

SEQ ID NO: 30766 - DNA, 25 bp, E. coli
cagcggagaagtagtttgtcaccca

SEQ ID NO: 30767 - DNA, 25 bp, E. coli
tttcggcaactggaagctgagctta

SEQ ID NO: 30768 - DNA, 25 bp, E. coli
tttcggcaactgcaagctgagctta

SEQ ID NO: 30769 - DNA, 25 bp, E. coli
tattttgtcgaactcgtgcgccagc

SEQ ID NO: 30770 - DNA, 25 bp, E. coli
tattttgtcgaagtcgtgcgccagc

SEQ ID NO: 30771 - DNA, 25 bp, E. coli
ttaaaatggctagcgctggaaagcg

SEQ ID NO: 30772 - DNA, 25 bp, E. coli
ttaaaatggctaccgctggaaagcg

SEQ ID NO: 30773 - DNA, 25 bp, E. coli
tctgacggtacaacaagcggtgatg

SEQ ID NO: 30774 - DNA, 25 bp, E. coli
tctgacggtacatcaagcggtgatg

SEQ ID NO: 30775 - DNA, 25 bp, E. coli
cctgccagtagaagaaagcggcctg

SEQ ID NO: 30776 - DNA, 25 bp, E. coli
cctgccagtagatgaaagcggcctg

SEQ ID NO: 30777 - DNA, 25 bp, E. coli
gcttctcactgaaactggtcgcgtc

SEQ ID NO: 30778 - DNA, 25 bp, E. coli
gcttctcactgatactggtcgcgtc

SEQ ID NO: 30779 - DNA, 25 bp, E. coli
gaatgtgatgccgtctcaccggaga

SEQ ID NO: 30780 - DNA, 25 bp, E. coli
gaatagccatatagccggaacccat

SEQ ID NO: 30781 - DNA, 25 bp, E. coli
gaatgtgatgccctctcaccggaga

SEQ ID NO: 30782 - DNA, 25 bp, E. coli
gaatagccatattgccggaacccat

SEQ ID NO: 30783 - DNA, 25 bp, E. coli
cgagaattgcagttcgcagcgggca

SEQ ID NO: 30784 - DNA, 25 bp, E. coli
cgagaattgcagatcgcagcgggca

SEQ ID NO: 30785 - DNA, 25 bp, E. coli
aaaaaattaatgtagcgcgcagtcc

SEQ ID NO: 30786 - DNA, 25 bp, E. coli
aaaaaattaatgaagcgcgcagtcc

SEQ ID NO: 30787 - DNA, 25 bp, E. coli
tatcagggcggattggttaactcgc

SEQ ID NO: 30788 - DNA, 25 bp, E. coli
tatcagggcggaatggttaactcgc

SEQ ID NO: 30789 - DNA, 25 bp, E. coli
tttaacgtgggcgtggtagcgatca

SEQ ID NO: 30790 - DNA, 25 bp, E. coli
tttaacgtgggcctggtagcgatca

SEQ ID NO: 30791 - DNA, 25 bp, E. coli
tgtacaacgccatgcaagagctggc

SEQ ID NO: 30792 - DNA, 25 bp, E. coli
tgtacaacgccaagcaagagctggc

SEQ ID NO: 30793 - DNA, 25 bp, E. coli
tgacgatagcaaaatgggccagaac

SEQ ID NO: 30794 - DNA, 25 bp, E. coli
tgatgtgttggaagcgaccaccacg

SEQ ID NO: 30795 - DNA, 25 bp, E. coli
tgatgtgttggatgcgaccaccacg

SEQ ID NO: 30796 - DNA, 25 bp, E. coli
tgacgatagcaatatgggccagaac

SEQ ID NO: 30797 - DNA, 25 bp, E. coli
tgaacaatgcgcagagcaaaccggt

SEQ ID NO: 30798 - DNA, 25 bp, E. coli
tgaacaatgcgctgagcaaaccggt

SEQ ID NO: 30799 - DNA, 25 bp, E. coli
cttgataacgcggtagagcagctgc

SEQ ID NO: 30800 - DNA, 25 bp, E. coli
cttgataacgcgctagagcagctgc

SEQ ID NO: 30801 - DNA, 25 bp, E. coli
ggttcagttcgttgagccaggccga

SEQ ID NO: 30802 - DNA, 25 bp, E. coli
ggttcagttcgtagagccaggccga

SEQ ID NO: 30803 - DNA, 25 bp, E. coli
taacccggaattccgtaagtctgcc

SEQ ID NO: 30804 - DNA, 25 bp, E. coli
taacccggaattgcgtaagtctgcc

SEQ ID NO: 30805 - DNA, 25 bp, E. coli
gacgcgaacggcatcaactctaacg

SEQ ID NO: 30806 - DNA, 25 bp, E. coli
gacgcgaacggcttcaactctaacg

SEQ ID NO: 30807 - DNA, 25 bp, E. coli
aacgtgttgtgaacactcccggcga

SEQ ID NO: 30808 - DNA, 25 bp, E. coli
aagaacttcgcgtggcgctggcaac

SEQ ID NO: 30809 - DNA, 25 bp, E. coli
aagaacttcgcgaggcgctggcaac

SEQ ID NO: 30810 - DNA, 25 bp, E. coli
aaatttggtattgccgaaccgcgca

SEQ ID NO: 30811 - DNA, 25 bp, E. coli
aaatttggtattcccgaaccgcgca

SEQ ID NO: 30812 - DNA, 25 bp, E. coli
aacgtgttgtgatcactcccggcga

SEQ ID NO: 30813 - DNA, 25 bp, E. coli
tatgggtacggaagagatagacacc

SEQ ID NO: 30814 - DNA, 25 bp, E. coli
tatgggtacggatgagatagacacc

SEQ ID NO: 30815 - DNA, 25 bp, E. coli
tattcgcacatctgtggaccacggc

SEQ ID NO: 30816 - DNA, 25 bp, E. coli
tattcgcacatcagtggaccacggc

SEQ ID NO: 30817 - DNA, 25 bp, E. coli
tgatgctggcgagcgaagaacttcg

SEQ ID NO: 30818 - DNA, 25 bp, E. coli
tgatgctggcgaccgaagaacttcg

SEQ ID NO: 30819 - DNA, 25 bp, E. coli
tccagcttgcacagcgtgagtggcc

SEQ ID NO: 30820 - DNA, 25 bp, E. coli
tccagcttgcactgcgtgagtggcc

SEQ ID NO: 30821 - DNA, 25 bp, E. coli
gctaaaataccagggcttcgggcgc

SEQ ID NO: 30822 - DNA, 25 bp, E. coli
gctaaaataccacggcttcgggcgc

SEQ ID NO: 30823 - DNA, 25 bp, E. coli
cgaactggttgtttgtgccgatgcc

SEQ ID NO: 30824 - DNA, 25 bp, E. coli
cgatcagggtctacccgtgctaaaa

SEQ ID NO: 30825 - DNA, 25 bp, E. coli
cgatcagggtcttcccgtgctaaaa

SEQ ID NO: 30826 - DNA, 25 bp, E. coli
cgaactggttgtatgtgccgatgcc

SEQ ID NO: 30827 - DNA, 25 bp, E. coli
ggtgtgaacattacgctgggcctgc

SEQ ID NO: 30828 - DNA, 25 bp, E. coli
ggtgtgaacatttcgctgggcctgc

SEQ ID NO: 30829 - DNA, 25 bp, E. coli
aatacgaaactctcgcaagggctgg

SEQ ID NO: 30830 - DNA, 25 bp, E. coli
aatacgaaactcacgcaagggctgg

SEQ ID NO: 30831 - DNA, 25 bp, E. coli
cagaaactgagtgttggcggccaac

SEQ ID NO: 30832 - DNA, 25 bp, E. coli
cagaaactgagtcttggcggccaac

SEQ ID NO: 30833 - DNA, 25 bp, E. coli
aacaatacgacgtctggcgaaccag

SEQ ID NO: 30834 - DNA, 25 bp, E. coli
aacaatacgacgactggcgaaccag

SEQ ID NO: 30835 - DNA, 25 bp, E. coli
tatttgccccgcgtggcaaggctgg

SEQ ID NO: 30836 - DNA, 25 bp, E. coli
tatttgccccgcctggcaaggctgg

SEQ ID NO: 30837 - DNA, 25 bp, E. coli
tgatgaatgcacagcttgcacgggt

SEQ ID NO: 30838 - DNA, 25 bp, E. coli
tgatgaatgcactgcttgcacgggt

SEQ ID NO: 30839 - DNA, 25 bp, E. coli
tgcaccggcaagacagaaactgagt

SEQ ID NO: 30840 - DNA, 25 bp, E. coli
tgcaccggcaagtcagaaactgagt

SEQ ID NO: 30841 - DNA, 25 bp, E. coli
gaagccgaacaggatcgccagatga

SEQ ID NO: 30842 - DNA, 25 bp, E. coli
gaagccgaacagcatcgccagatga

SEQ ID NO: 30843 - DNA, 25 bp, E. coli
cgcgaaaaatggtatccgtgaagcc

SEQ ID NO: 30844 - DNA, 25 bp, E. coli
cgcgaaaaatggaatccgtgaagcc

SEQ ID NO: 30845 - DNA, 25 bp, E. coli
gataatcccgactgtaatacgctgg

SEQ ID NO: 30846 - DNA, 25 bp, E. coli
gataatcccgacagtaatacgctgg

SEQ ID NO: 30847 - DNA, 25 bp, E. coli
tggttattcaggtgcagaccgccca

SEQ ID NO: 30848 - DNA, 25 bp, E. coli
tggttattcaggagcagaccgccca

SEQ ID NO: 30849 - DNA, 25 bp, E. coli
taatgccctggcaattgctggcgcg

SEQ ID NO: 30850 - DNA, 25 bp, E. coli
taatgccctggctattgctggcgcg

SEQ ID NO: 30851 - DNA, 25 bp, E. coli
cacctttgaattgcctcgcggacga

SEQ ID NO: 30852 - DNA, 25 bp, E. coli
cacctttgaattccctcgcggacga

SEQ ID NO: 30853 - DNA, 25 bp, E. coli
catgatatcccctgtcaggtattcg

SEQ ID NO: 30854 - DNA, 25 bp, E. coli
catgatatccccagtcaggtattcg

SEQ ID NO: 30855 - DNA, 25 bp, E. coli
aacattacgcgaagagcaaggcagc

SEQ ID NO: 30856 - DNA, 25 bp, E. coli
aacattacgcgatgagcaaggcagc

SEQ ID NO: 30857 - DNA, 25 bp, E. coli
ttttatccgtccagaagtgagtggg

SEQ ID NO: 30858 - DNA, 25 bp, E. coli
ttttatccgtcctgaagtgagtggg

SEQ ID NO: 30859 - DNA, 25 bp, E. coli
tctctgctggcttctttggcgtcac

SEQ ID NO: 30860 - DNA, 25 bp, E. coli
tctctgctggctactttggcgtcac

SEQ ID NO: 30861 - DNA, 25 bp, E. coli
ccggcttattctcgcaacggtaatg

SEQ ID NO: 30862 - DNA, 25 bp, E. coli
ccggcttattctggcaacggtaatg

SEQ ID NO: 30863 - DNA, 25 bp, E. coli
gcttggcgcgataacaacagggaaa

SEQ ID NO: 30864 - DNA, 25 bp, E. coli
gcttggcgcgattacaacagggaaa

SEQ ID NO: 30865 - DNA, 25 bp, E. coli
gacatattccggcacagaatgcggt

SEQ ID NO: 30866 - DNA, 25 bp, E. coli
gacatattccgggacagaatgcggt

SEQ ID NO: 30867 - DNA, 25 bp, E. coli
cgaccgtcgttggaattatcagaaa

SEQ ID NO: 30868 - DNA, 25 bp, E. coli
cgaccgtcgttgcaattatcagaaa

SEQ ID NO: 30869 - DNA, 25 bp, E. coli
ggatggctattttcgcaacttgaac

SEQ ID NO: 30870 - DNA, 25 bp, E. coli
ggatggctatttacgcaacttgaac

SEQ ID NO: 30871 - DNA, 25 bp, E. coli
tggcgtcactttcgtcagcatctgg

SEQ ID NO: 30872 - DNA, 25 bp, E. coli
tggcgtcactttggtcagcatctgg

SEQ ID NO: 30873 - DNA, 25 bp, E. coli
tactaccgcaggacatgccgctgct

SEQ ID NO: 30874 - DNA, 25 bp, E. coli
tacggcgtactaccgcaggtcatgc

SEQ ID NO: 30875 - DNA, 25 bp, E. coli
tacggcgtactagcgcaggtcatgc

SEQ ID NO: 30876 - DNA, 25 bp, E. coli
taccaacctgtacgccgcctgatgg

SEQ ID NO: 30877 - DNA, 25 bp, E. coli
tactaccgcaggtcatgccgctgct

SEQ ID NO: 30878 - DNA, 25 bp, E. coli
taccaacctgtaggccgcctgatgg

SEQ ID NO: 30879 - DNA, 25 bp, E. coli
tggtgcgggcggaattggcgtcacg

SEQ ID NO: 30880 - DNA, 25 bp, E. coli
tgttatcgccgtcctggtcgtctcg

SEQ ID NO: 30881 - DNA, 25 bp, E. coli
tgttatcgccgtgctggtcgtctcg

SEQ ID NO: 30882 - DNA, 25 bp, E. coli
tggtgcgggcggtattggcgtcacg

SEQ ID NO: 30883 - DNA, 25 bp, E. coli
gctggaagagatgctttacggcgta

SEQ ID NO: 30884 - DNA, 25 bp, E. coli
gctggaagagatcctttacggcgta

SEQ ID NO: 30885 - DNA, 25 bp, E. coli
gaagagatcctttacggcgtactac

SEQ ID NO: 30886 - DNA, 25 bp, E. coli
ggtgggtctaccaacctgtacgccg

SEQ ID NO: 30887 - DNA, 25 bp, E. coli
gaagagatccttaacggcgtactac

SEQ ID NO: 30888 - DNA, 25 bp, E. coli
ggtgggtctacctacctgtacgccg

SEQ ID NO: 30889 - DNA, 25 bp, E. coli
cgtcgtcggtatcgttggtgcgggc

SEQ ID NO: 30890 - DNA, 25 bp, E. coli
cgtcgtcggtatggttggtgcgggc

SEQ ID NO: 30891 - DNA, 25 bp, E. coli
gtaccgtggtggctctaccaacctg

SEQ ID NO: 30892 - DNA, 25 bp, E. coli
gtaccgtggtgggtctaccaacctg

SEQ ID NO: 30893 - DNA, 25 bp, E. coli
tcctttacggcgaactaccgcaggt

SEQ ID NO: 30894 - DNA, 25 bp, E. coli
tcctttacggcgtactaccgcaggt

SEQ ID NO: 30895 - DNA, 25 bp, E. coli
caatatgccgatctgatggagcgcg

SEQ ID NO: 30896 - DNA, 25 bp, E. coli
caatatgccgatgtgatggagcgcg

SEQ ID NO: 30897 - DNA, 25 bp, E. coli
taaaagcacccgtagaacgctggag

SEQ ID NO: 30898 - DNA, 25 bp, E. coli
taaaagcacccgaagaacgctggag

SEQ ID NO: 30899 - DNA, 25 bp, E. coli
tatgaacagagctatccagagcagc

SEQ ID NO: 30900 - DNA, 25 bp, E. coli
tatgaagtgactcaagagccgcgct

SEQ ID NO: 30901 - DNA, 25 bp, E. coli
tatgaagtgactgaagagccgcgct

SEQ ID NO: 30902 - DNA, 25 bp, E. coli
tatgaacagagcaatccagagcagc

SEQ ID NO: 30903 - DNA, 25 bp, E. coli
tattttgtcgaacagcgtggtgcgc

SEQ ID NO: 30904 - DNA, 25 bp, E. coli
tattttgtcgaagagcgtggtgcgc

SEQ ID NO: 30905 - DNA, 25 bp, E. coli
tgtctatctgatgaccggcgtcgcg

SEQ ID NO: 30906 - DNA, 25 bp, E. coli
tgtctatctgatcaccggcgtcgcg

SEQ ID NO: 30907 - DNA, 25 bp, E. coli
tcatctgattgatgccggagtcgcc

SEQ ID NO: 30908 - DNA, 25 bp, E. coli
tcatctgattgaagccggagtcgcc

SEQ ID NO: 30909 - DNA, 25 bp, E. coli
gaatctgactttcccgatgccggta

SEQ ID NO: 30910 - DNA, 25 bp, E. coli
gaatctgactttgccgatgccggta

SEQ ID NO: 30911 - DNA, 25 bp, E. coli
gaaagttgtgcttccatcggcctga

SEQ ID NO: 30912 - DNA, 25 bp, E. coli
gaaagttgtgctaccatcggcctga

SEQ ID NO: 30913 - DNA, 25 bp, E. coli
tggagcgcgcactgtacaacactgt

SEQ ID NO: 30914 - DNA, 25 bp, E. coli
tggagcgcgcacagtacaacactgt

SEQ ID NO: 30915 - DNA, 25 bp, E. coli
taagatcttaatccaggcaccgggt

SEQ ID NO: 30916 - DNA, 25 bp, E. coli
taagatcttaatgcaggcaccgggt

SEQ ID NO: 30917 - DNA, 25 bp, E. coli
tatggatggcgttgttaatcgcagc

SEQ ID NO: 30918 - DNA, 25 bp, E. coli
tatggatggcgtagttaatcgcagc

SEQ ID NO: 30919 - DNA, 25 bp, E. coli
tctgctgaccgttattgccttctgg

SEQ ID NO: 30920 - DNA, 25 bp, E. coli
tcagatggcgcaacaggtagcagca

SEQ ID NO: 30921 - DNA, 25 bp, E. coli
tctttgctgaagtcaattacccgaa

SEQ ID NO: 30922 - DNA, 25 bp, E. coli
tctgctgaccgtaattgccttctgg

SEQ ID NO: 30923 - DNA, 25 bp, E. coli
tctttgctgaagacaattacccgaa

SEQ ID NO: 30924 - DNA, 25 bp, E. coli
cctgtttgctgacatgggcggtaat

SEQ ID NO: 30925 - DNA, 25 bp, E. coli
cctgtttgctgagatgggcggtaat

SEQ ID NO: 30926 - DNA, 25 bp, E. coli
ctctggcaggagataagggcatctt

SEQ ID NO: 30927 - DNA, 25 bp, E. coli
ctctggcaggagttaagggcatctt

SEQ ID NO: 30928 - DNA, 25 bp, E. coli
cggtaattccggtagcactggctgc

SEQ ID NO: 30929 - DNA, 25 bp, E. coli
cggtaattccggaagcactggctgc

SEQ ID NO: 30930 - DNA, 25 bp, E. coli
gattgtcgtaagtctcgcctggacg

SEQ ID NO: 30931 - DNA, 25 bp, E. coli
gattgtcgtaagactcgcctggacg

SEQ ID NO: 30932 - DNA, 25 bp, E. coli
tggatcacccgttatcagatggcgc

SEQ ID NO: 30933 - DNA, 25 bp, E. coli
tggatcacccgtaatcagatggcgc

SEQ ID NO: 30934 - DNA, 25 bp, E. coli
tcagatggcgcatcaggtagcagca

SEQ ID NO: 30935 - DNA, 25 bp, E. coli
taatcgcagcaatggtgtatccgca

SEQ ID NO: 30936 - DNA, 25 bp, E. coli
taattaagaataccccgctctggca

SEQ ID NO: 30937 - DNA, 25 bp, E. coli
taatcgcagcaaaggtgtatccgca

SEQ ID NO: 30938 - DNA, 25 bp, E. coli
taattaagaatagcccgctctggca

SEQ ID NO: 30939 - DNA, 25 bp, E. coli
cagtggccgttgatgtcgcttatga

SEQ ID NO: 30940 - DNA, 25 bp, E. coli
caggatatcttcatgccagtacgga

SEQ ID NO: 30941 - DNA, 25 bp, E. coli
caggatatcttcttgccagtacgga

SEQ ID NO: 30942 - DNA, 25 bp, E. coli
cagtggccgttgttgtcgcttatga

SEQ ID NO: 30943 - DNA, 25 bp, E. coli
tatcttcatgccagtacggacgctc

SEQ ID NO: 30944 - DNA, 25 bp, E. coli
tatcttcatgcctgtacggacgctc

SEQ ID NO: 30945 - DNA, 25 bp, E. coli
ttgtgcagcaattttgtccgcagcc

SEQ ID NO: 30946 - DNA, 25 bp, E. coli
ttgtgcagcaatattgtccgcagcc

SEQ ID NO: 30947 - DNA, 25 bp, E. coli
tgatgacgctcgctacagcaacaca

SEQ ID NO: 30948 - DNA, 25 bp, E. coli
tgatgacgctcggtacagcaacaca

SEQ ID NO: 30949 - DNA, 25 bp, E. coli
gctcgctacagcaacacatctctgg

SEQ ID NO: 30950 - DNA, 25 bp, E. coli
gctcgctacagctacacatctctgg

SEQ ID NO: 30951 - DNA, 25 bp, E. coli
gacgctcccggctgcgatgatctga

SEQ ID NO: 30952 - DNA, 25 bp, E. coli
gacgctcccggcagcgatgatctga

SEQ ID NO: 30953 - DNA, 25 bp, E. coli
ccgaccgaatcagtggccgttgatg

SEQ ID NO: 30954 - DNA, 25 bp, E. coli
ccgaccgaatcactggccgttgatg

SEQ ID NO: 30955 - DNA, 25 bp, E. coli
cttcagttatgcgaacgccgaagat

SEQ ID NO: 30956 - DNA, 25 bp, E. coli
cttcagttatgccaacgccgaagat

SEQ ID NO: 30957 - DNA, 25 bp, E. coli
tgcgtaaagtttctgcagcaatttt

SEQ ID NO: 30958 - DNA, 25 bp, E. coli
tgcgtaaagtttgtgcagcaatttt

SEQ ID NO: 30959 - DNA, 25 bp, E. coli
gatggcagggccctctgtgcgtgtg

SEQ ID NO: 30960 - DNA, 25 bp, E. coli
gatggcagggccgtctgtgcgtgtg

SEQ ID NO: 30961 - DNA, 25 bp, E. coli
caagagctgcttgaggagctgccct

SEQ ID NO: 30962 - DNA, 25 bp, E. coli
caagagctgcttcaggagctgccct

SEQ ID NO: 30963 - DNA, 25 bp, E. coli
aaccaataatattgcccgggcggca

SEQ ID NO: 30964 - DNA, 25 bp, E. coli
aaccaataatatagcccgggcggca

SEQ ID NO: 30965 - DNA, 25 bp, E. coli
ataatatcagcctcaataaagccgg

SEQ ID NO: 30966 - DNA, 25 bp, E. coli
ataatatcagccacaataaagccgg

SEQ ID NO: 30967 - DNA, 25 bp, E. coli
tgaccgcccagccagttgagttcag

SEQ ID NO: 30968 - DNA, 25 bp, E. coli
tgaccgcccagcgagttgagttcag

SEQ ID NO: 30969 - DNA, 25 bp, E. coli
tcgtttctcgccgttatgaagagcg

SEQ ID NO: 30970 - DNA, 25 bp, E. coli
tcgtttctcgcccttatgaagagcg

SEQ ID NO: 30971 - DNA, 25 bp, E. coli
gcatgtatctgcacgagttcaggaa

SEQ ID NO: 30972 - DNA, 25 bp, E. coli
gcatgtatctgctcgagttcaggaa

SEQ ID NO: 30973 - DNA, 25 bp, E. coli
gaactgtatcaaaaactgttcccgg

SEQ ID NO: 30974 - DNA, 25 bp, E. coli
gaactgtatcaataactgttcccgg

SEQ ID NO: 30975 - DNA, 25 bp, E. coli
gaaaaaatccatttgacggcttcgc

SEQ ID NO: 30976 - DNA, 25 bp, E. coli
gaaaaaatccatatgacggcttcgc

SEQ ID NO: 30977 - DNA, 25 bp, E. coli
gaactggaaaacgtgactatcagtg

SEQ ID NO: 30978 - DNA, 25 bp, E. coli
gaactggaaaacctgactatcagtg

SEQ ID NO: 30979 - DNA, 25 bp, E. coli
ccgcgctggaagtacaaattggcta

SEQ ID NO: 30980 - DNA, 25 bp, E. coli
ccgcgctggaagaacaaattggcta

SEQ ID NO: 30981 - DNA, 25 bp, E. coli
ggctatacgctaattacccgcaaag

SEQ ID NO: 30982 - DNA, 25 bp, E. coli
ggctatacgctatttacccgcaaag

SEQ ID NO: 30983 - DNA, 25 bp, E. coli
aagagatgacggtaatcagtggcgc

SEQ ID NO: 30984 - DNA, 25 bp, E. coli
aagagatgacggaaatcagtggcgc

SEQ ID NO: 30985 - DNA, 25 bp, E. coli
ttttccagcagcagcactggtcgcg

SEQ ID NO: 30986 - DNA, 25 bp, E. coli
ttttccagcagctgcactggtcgcg

SEQ ID NO: 30987 - DNA, 25 bp, E. coli
tcagtggcgcgctgaatgtgttact

SEQ ID NO: 30988 - DNA, 25 bp, E. coli
tcagtggcgcgcagaatgtgttact

SEQ ID NO: 30989 - DNA, 25 bp, E. coli
cctcttatctgtcccgctatctgta

SEQ ID NO: 30990 - DNA, 25 bp, E. coli
cctcttatctgtgccgctatctgta

SEQ ID NO: 30991 - DNA, 25 bp, E. coli
gaatgtgttactccctgacgcgacc

SEQ ID NO: 30992 - DNA, 25 bp, E. coli
gttgccgaaccctcctcttatctgt

SEQ ID NO: 30993 - DNA, 25 bp, E. coli
gaatgtgttactgcctgacgcgacc

SEQ ID NO: 30994 - DNA, 25 bp, E. coli
gaatacaccttcagcaccgctgagc

SEQ ID NO: 30995 - DNA, 25 bp, E. coli
gaatacaccttctgcaccgctgagc

SEQ ID NO: 30996 - DNA, 25 bp, E. coli
gttgccgaacccacctcttatctgt

SEQ ID NO: 30997 - DNA, 25 bp, E. coli
cggtgtttaatgttcccggtcacag

SEQ ID NO: 30998 - DNA, 25 bp, E. coli
cggtgtttaatgatcccggtcacag

SEQ ID NO: 30999 - DNA, 25 bp, E. coli
ttcaaagtaatgtgtacttttccgg

SEQ ID NO: 31000 - DNA, 25 bp, E. coli
tgtatgaagccggttcggtgtttaa

SEQ ID NO: 31001 - DNA, 25 bp, E. coli
tgtatgaagccgcttcggtgtttaa

SEQ ID NO: 31002 - DNA, 25 bp, E. coli
ttcaaagtaatgagtacttttccgg

SEQ ID NO: 31003 - DNA, 25 bp, E. coli
gagtttcatctggaagttgccgaac

SEQ ID NO: 31004 - DNA, 25 bp, E. coli
gagtttcatctgcaagttgccgaac

SEQ ID NO: 31005 - DNA, 25 bp, E. coli
agaaagcttatggagagtctgtgcg

SEQ ID NO: 31006 - DNA, 25 bp, E. coli
agaaagcttatgcagagtctgtgcg

SEQ ID NO: 31007 - DNA, 25 bp, E. coli
aaaacgggcagtcgcttacagcaca

SEQ ID NO: 31008 - DNA, 25 bp, E. coli
aaaacgggcagtggcttacagcaca

SEQ ID NO: 31009 - DNA, 25 bp, E. coli
aacgggcagtcggttacagcacaac

SEQ ID NO: 31010 - DNA, 25 bp, E. coli
aaagcttatgcagagtctgtgcggt

SEQ ID NO: 31011 - DNA, 25 bp, E. coli
aacgggcagtcgcttacagcacaac

SEQ ID NO: 31012 - DNA, 25 bp, E. coli
aaagcttatgcacagtctgtgcggt

SEQ ID NO: 31013 - DNA, 25 bp, E. coli
tgactgtgaaaaggggcagtcgctt

SEQ ID NO: 31014 - DNA, 25 bp, E. coli
tgaaaacgggcactcgcttacagca

SEQ ID NO: 31015 - DNA, 25 bp, E. coli
tgactgtgaaaacgggcagtcgctt

SEQ ID NO: 31016 - DNA, 25 bp, E. coli
tgaaaacgggcagtcgcttacagca

SEQ ID NO: 31017 - DNA, 25 bp, E. coli
gaaagcttatgctgagtctgtgcgg

SEQ ID NO: 31018 - DNA, 25 bp, E. coli
gactgtgaaaaccggcagtcgctta

SEQ ID NO: 31019 - DNA, 25 bp, E. coli
gactgtgaaaacgggcagtcgctta

SEQ ID NO: 31020 - DNA, 25 bp, E. coli
gaaagcttatgcagagtctgtgcgg

SEQ ID NO: 31021 - DNA, 25 bp, E. coli
cgggcagtcgcttacagcacaactg

SEQ ID NO: 31022 - DNA, 25 bp, E. coli
cgggcagtcgctaacagcacaactg

SEQ ID NO: 31023 - DNA, 25 bp, E. coli
gtgaaaacgggctgtcgcttacagc

SEQ ID NO: 31024 - DNA, 25 bp, E. coli
gtgaaaacgggcagtcgcttacagc

SEQ ID NO: 31025 - DNA, 25 bp, E. coli
gagaaagcttatccagagtctgtgc

SEQ ID NO: 31026 - DNA, 25 bp, E. coli
gagaaagcttatgcagagtctgtgc

SEQ ID NO: 31027 - DNA, 25 bp, E. coli
aaatggctgaaatgcgaactgggcg

SEQ ID NO: 31028 - DNA, 25 bp, E. coli
aaatggctgaaaagcgaactgggcg

SEQ ID NO: 31029 - DNA, 25 bp, E. coli
tatttcaggagcgttttgacacgcg

SEQ ID NO: 31030 - DNA, 25 bp, E. coli
tatttcaggagccttttgacacgcg

SEQ ID NO: 31031 - DNA, 25 bp, E. coli
ttttggcgtctctcaaggcaaggcg

SEQ ID NO: 31032 - DNA, 25 bp, E. coli
ttttggcgtctcacaaggcaaggcg

SEQ ID NO: 31033 - DNA, 25 bp, E. coli
tgtacacaatattacgtcagccgca

SEQ ID NO: 31034 - DNA, 25 bp, E. coli
tgtacacaatataacgtcagccgca

SEQ ID NO: 31035 - DNA, 25 bp, E. coli
tgatgtatctcgataaagagccgct

SEQ ID NO: 31036 - DNA, 25 bp, E. coli
tgatgtatctcgttaaagagccgct

SEQ ID NO: 31037 - DNA, 25 bp, E. coli
gcgccgcgccgtattgcgaaaagct

SEQ ID NO: 31038 - DNA, 25 bp, E. coli
gcgccgcgccgttttgcgaaaagct

SEQ ID NO: 31039 - DNA, 25 bp, E. coli
gacacgcgagtggtcagcgacaaaa

SEQ ID NO: 31040 - DNA, 25 bp, E. coli
gaaccgttgtttggcatcagcaaaa

SEQ ID NO: 31041 - DNA, 25 bp, E. coli
gacacgcgagtgctcagcgacaaaa

SEQ ID NO: 31042 - DNA, 25 bp, E. coli
gaaccgttgtttcgcatcagcaaaa

SEQ ID NO: 31043 - DNA, 25 bp, E. coli
gatttacgtcgaaggaagctccacc

SEQ ID NO: 31044 - DNA, 25 bp, E. coli
gatttacgtcgatggaagctccacc

SEQ ID NO: 31045 - DNA, 25 bp, E. coli
gatcagaatgacaaaccggtgcacg

SEQ ID NO: 31046 - DNA, 25 bp, E. coli
gatcagaatgactaaccggtgcacg

SEQ ID NO: 31047 - DNA, 25 bp, E. coli
tcagcgacttagaggcagacggcgt

SEQ ID NO: 31048 - DNA, 25 bp, E. coli
tcagcgacttagtggcagacggcgt

SEQ ID NO: 31049 - DNA, 25 bp, E. coli
caatgccggagagacaattgaagtt

SEQ ID NO: 31050 - DNA, 25 bp, E. coli
caatgccggagacacaattgaagtt

SEQ ID NO: 31051 - DNA, 25 bp, E. coli
tatcgcgcgaatgaatgtctatcca

SEQ ID NO: 31052 - DNA, 25 bp, E. coli
tatcgcgcgaatcaatgtctatcca

SEQ ID NO: 31053 - DNA, 25 bp, E. coli
tctatccagtcagcacgacaggtgt

SEQ ID NO: 31054 - DNA, 25 bp, E. coli
tctatccagtcaccacgacaggtgt

SEQ ID NO: 31055 - DNA, 25 bp, E. coli
gccacggcaacgctgagaataaatt

SEQ ID NO: 31056 - DNA, 25 bp, E. coli
cctggaggaagaagcaaatacggca

SEQ ID NO: 31057 - DNA, 25 bp, E. coli
gccacggcaacggtgagaataaatt

SEQ ID NO: 31058 - DNA, 25 bp, E. coli
cctggaggaagatgcaaatacggca

SEQ ID NO: 31059 - DNA, 25 bp, E. coli
gacaggtgtaccaccagaaaccggg

SEQ ID NO: 31060 - DNA, 25 bp, E. coli
gacaggtgtacctccagaaaccggg

SEQ ID NO: 31061 - DNA, 25 bp, E. coli
gaaaccgggcgatttgaagccacgg

SEQ ID NO: 31062 - DNA, 25 bp, E. coli
gaaaccgggcgaattgaagccacgg

SEQ ID NO: 31063 - DNA, 25 bp, E. coli
cgctgccaatttccgtgttgtaggg

SEQ ID NO: 31064 - DNA, 25 bp, E. coli
cgctgccaatttgcgtgttgtaggg

SEQ ID NO: 31065 - DNA, 25 bp, E. coli
gatttaggtgatctcttcgctgcca

SEQ ID NO: 31066 - DNA, 25 bp, E. coli
gatttaggtgatgtcttcgctgcca

SEQ ID NO: 31067 - DNA, 25 bp, E. coli
gggatacccgatggcatatttgcga

SEQ ID NO: 31068 - DNA, 25 bp, E. coli
gggatacccgatcgcatatttgcga

SEQ ID NO: 31069 - DNA, 25 bp, E. coli
gatggcatatttgcgaccctggcgg

SEQ ID NO: 31070 - DNA, 25 bp, E. coli
gatggcatatttccgaccctggcgg

SEQ ID NO: 31071 - DNA, 25 bp, E. coli
aattagtcggcgagcgtactgcgga

SEQ ID NO: 31072 - DNA, 25 bp, E. coli
aattagtcggcgtgcgtactgcgga

SEQ ID NO: 31073 - DNA, 25 bp, E. coli
aaataatatcgagagcaggagcgcc

SEQ ID NO: 31074 - DNA, 25 bp, E. coli
aaataatatcgacagcaggagcgcc

SEQ ID NO: 31075 - DNA, 25 bp, E. coli
tatgccttgattcaacgcctgtcgg

SEQ ID NO: 31076 - DNA, 25 bp, E. coli
tacctgaatcgtcaagtcgtcggag

SEQ ID NO: 31077 - DNA, 25 bp, E. coli
tatgccttgattgaacgcctgtcgg

SEQ ID NO: 31078 - DNA, 25 bp, E. coli
tacctgaatcgtgaagtcgtcggag

SEQ ID NO: 31079 - DNA, 25 bp, E. coli
tataagtactattgcacgcgtgccc

SEQ ID NO: 31080 - DNA, 25 bp, E. coli
tataagtactatagcacgcgtgccc

SEQ ID NO: 31081 - DNA, 25 bp, E. coli
tattgactcctgctgcatatgccgc

SEQ ID NO: 31082 - DNA, 25 bp, E. coli
tattgactcctggtgcatatgccgc

SEQ ID NO: 31083 - DNA, 25 bp, E. coli
ttaatggagcaatacagcgatggca

SEQ ID NO: 31084 - DNA, 25 bp, E. coli
ttaatggagcaaaacagcgatggca

SEQ ID NO: 31085 - DNA, 25 bp, E. coli
tgctaccacgatttgctgcgcgaaa

SEQ ID NO: 31086 - DNA, 25 bp, E. coli
tgctaccacgatatgctgcgcgaaa

SEQ ID NO: 31087 - DNA, 25 bp, E. coli
tgagccaagagacatcgatgaacgc

SEQ ID NO: 31088 - DNA, 25 bp, E. coli
tgcacaaaaaagaagagccgccgtt

SEQ ID NO: 31089 - DNA, 25 bp, E. coli
tgcacaaaaaagtagagccgccgtt

SEQ ID NO: 31090 - DNA, 25 bp, E. coli
tgagccaagagagatcgatgaacgc

SEQ ID NO: 31091 - DNA, 25 bp, E. coli
tcctggcatggctaaagtactatcg

SEQ ID NO: 31092 - DNA, 25 bp, E. coli
tcctggcatggcaaaagtactatcg

SEQ ID NO: 31093 - DNA, 25 bp, E. coli
aaccgtatcgactactatgaagtgg

SEQ ID NO: 31094 - DNA, 25 bp, E. coli
caggttgaagcttttaaacgcggca

SEQ ID NO: 31095 - DNA, 25 bp, E. coli
catatccccgcccagatcggtttta

SEQ ID NO: 31096 - DNA, 25 bp, E. coli
caggttgaagctattaaacgcggca

SEQ ID NO: 31097 - DNA, 25 bp, E. coli
catatccccgccgagatcggtttta

SEQ ID NO: 31098 - DNA, 25 bp, E. coli
aaacgcggcacgctaattgaccata

SEQ ID NO: 31099 - DNA, 25 bp, E. coli
aaccgtatcgacaactatgaagtgg

SEQ ID NO: 31100 - DNA, 25 bp, E. coli
aaacgcggcacggtaattgaccata

SEQ ID NO: 31101 - DNA, 25 bp, E. coli
tgacacacgatattaaattgcaggt

SEQ ID NO: 31102 - DNA, 25 bp, E. coli
tgacacacgataataaattgcaggt

SEQ ID NO: 31103 - DNA, 25 bp, E. coli
tcgacaatgtgcaggtctgcccgaa

SEQ ID NO: 31104 - DNA, 25 bp, E. coli
tcgacaatgtgctggtctgcccgaa

SEQ ID NO: 31105 - DNA, 25 bp, E. coli
tctgaacctgccatctggcgagatg

SEQ ID NO: 31106 - DNA, 25 bp, E. coli
tctgaacctgccttctggcgagatg

SEQ ID NO: 31107 - DNA, 25 bp, E. coli
gaacagcaactgaatcagccatgcc

SEQ ID NO: 31108 - DNA, 25 bp, E. coli
gaacagcaactgtatcagccatgcc

SEQ ID NO: 31109 - DNA, 25 bp, E. coli
cgcaagccacggttaaccgtatcga

SEQ ID NO: 31110 - DNA, 25 bp, E. coli
cgcaagccacggataaccgtatcga

SEQ ID NO: 31111 - DNA, 25 bp, E. coli
ctgtatcagccatgccgaaccggtt

SEQ ID NO: 31112 - DNA, 25 bp, E. coli
ctgtatcagccaagccgaaccggtt

SEQ ID NO: 31113 - DNA, 25 bp, E. coli
gatctgatcaaattcgaaaatacct

SEQ ID NO: 31114 - DNA, 25 bp, E. coli
gatctgatcaaaatcgaaaatacct

SEQ ID NO: 31115 - DNA, 25 bp, E. coli
cagtgttgacgcagaaacgcctgcg

SEQ ID NO: 31116 - DNA, 25 bp, E. coli
cagtgttgacgctgaaacgcctgcg

SEQ ID NO: 31117 - DNA, 25 bp, E. coli
tacgaatggcagagatggatggtat

SEQ ID NO: 31118 - DNA, 25 bp, E. coli
tacacacagtgtagacgctgaaacg

SEQ ID NO: 31119 - DNA, 25 bp, E. coli
tacacacagtgttgacgctgaaacg

SEQ ID NO: 31120 - DNA, 25 bp, E. coli
cattaaaccccgcgattccggtgct

SEQ ID NO: 31121 - DNA, 25 bp, E. coli
cattaaaccccgggattccggtgct

SEQ ID NO: 31122 - DNA, 25 bp, E. coli
tacgaatggcagtgatggatggtat

SEQ ID NO: 31123 - DNA, 25 bp, E. coli
tattcctctgctcgcaaaccatttt

SEQ ID NO: 31124 - DNA, 25 bp, E. coli
tattcctctgctggcaaaccatttt

SEQ ID NO: 31125 - DNA, 25 bp, E. coli
tcggcagcaacctgaccatctcggt

SEQ ID NO: 31126 - DNA, 25 bp, E. coli
tcggcagcaaccagaccatctcggt

SEQ ID NO: 31127 - DNA, 25 bp, E. coli
gcagcaaccagagcatctcggttga

SEQ ID NO: 31128 - DNA, 25 bp, E. coli
gcagcaaccagaccatctcggttga

SEQ ID NO: 31129 - DNA, 25 bp, E. coli
tggcagagatggttggtatcgccac

SEQ ID NO: 31130 - DNA, 25 bp, E. coli
tggcagagatggatggtatcgccac

SEQ ID NO: 31131 - DNA, 25 bp, E. coli
ggcgctcgcgcatacacacagtgtt

SEQ ID NO: 31132 - DNA, 25 bp, E. coli
ggcaaaccatttacttcagcgcttt

SEQ ID NO: 31133 - DNA, 25 bp, E. coli
ggcgctcgcgcaaacacacagtgtt

SEQ ID NO: 31134 - DNA, 25 bp, E. coli
ggcaaaccattttcttcagcgcttt

SEQ ID NO: 31135 - DNA, 25 bp, E. coli
gagatcaaaacattaaaccccgcga

SEQ ID NO: 31136 - DNA, 25 bp, E. coli
gagatcaaaacaataaaccccgcga

SEQ ID NO: 31137 - DNA, 25 bp, E. coli
tacctgggtaaatacgagcgtgaca

SEQ ID NO: 31138 - DNA, 25 bp, E. coli
tacctgggtaaaaacgagcgtgaca

SEQ ID NO: 31139 - DNA, 25 bp, E. coli
aactggtaacaaaacgcgtctggca

SEQ ID NO: 31140 - DNA, 25 bp, E. coli
aacagttacggtcgcaatggcgaca

SEQ ID NO: 31141 - DNA, 25 bp, E. coli
aacagttacggtggcaatggcgaca

SEQ ID NO: 31142 - DNA, 25 bp, E. coli
aactggtaacaatacgcgtctggca

SEQ ID NO: 31143 - DNA, 25 bp, E. coli
tacctggcagcgaactacggtgaaa

SEQ ID NO: 31144 - DNA, 25 bp, E. coli
tacctggcagcgtactacggtgaaa

SEQ ID NO: 31145 - DNA, 25 bp, E. coli
tttatgatgcactgggttacaccga

SEQ ID NO: 31146 - DNA, 25 bp, E. coli
tttatgatgcacagggttacaccga

SEQ ID NO: 31147 - DNA, 25 bp, E. coli
gaactactttgatgtgggcgcaacc

SEQ ID NO: 31148 - DNA, 25 bp, E. coli
gaactactttgaagtgggcgcaacc

SEQ ID NO: 31149 - DNA, 25 bp, E. coli
gattctgacaacaaactgggcgtag

SEQ ID NO: 31150 - DNA, 25 bp, E. coli
gattctgacaactaactgggcgtag

SEQ ID NO: 31151 - DNA, 25 bp, E. coli
ggcgctgacgctgaaactggtaaca

SEQ ID NO: 31152 - DNA, 25 bp, E. coli
tggcggcgttgctacctatcgtaac

SEQ ID NO: 31153 - DNA, 25 bp, E. coli
ggcttcgccaacaaaacgcaagacg

SEQ ID NO: 31154 - DNA, 25 bp, E. coli
tggcggcgttgcaacctatcgtaac

SEQ ID NO: 31155 - DNA, 25 bp, E. coli
ggcgctgacgctcaaactggtaaca

SEQ ID NO: 31156 - DNA, 25 bp, E. coli
ggcttcgccaactaaacgcaagacg

SEQ ID NO: 31157 - DNA, 25 bp, E. coli
gacgttctgttagttgcgcaatacc

SEQ ID NO: 31158 - DNA, 25 bp, E. coli
gacgttctgttacttgcgcaatacc

SEQ ID NO: 31159 - DNA, 25 bp, E. coli
taggatttatggatcagtcagcggg

SEQ ID NO: 31160 - DNA, 25 bp, E. coli
taggatttatggttcagtcagcggg

SEQ ID NO: 31161 - DNA, 25 bp, E. coli
tttatggacgcctcgctgtggcagc

SEQ ID NO: 31162 - DNA, 25 bp, E. coli
tttatggacgccacgctgtggcagc

SEQ ID NO: 31163 - DNA, 25 bp, E. coli
tgctgtggtttgacattttgcccgg

SEQ ID NO: 31164 - DNA, 25 bp, E. coli
tgctgtggtttgtcattttgcccgg

SEQ ID NO: 31165 - DNA, 25 bp, E. coli
tcttttagaactgggtctgcgcgcg

SEQ ID NO: 31166 - DNA, 25 bp, E. coli
tcttttagaactcggtctgcgcgcg

SEQ ID NO: 31167 - DNA, 25 bp, E. coli
gccgctctcgcgacaggtgacctta

SEQ ID NO: 31168 - DNA, 25 bp, E. coli
gccgctctcgcgtcaggtgacctta

SEQ ID NO: 31169 - DNA, 25 bp, E. coli
gctgccggaaatcctcaccggatta

SEQ ID NO: 31170 - DNA, 25 bp, E. coli
gctgccggaaatgctcaccggatta

SEQ ID NO: 31171 - DNA, 25 bp, E. coli
ggtgccgccgctggcttatttgccg

SEQ ID NO: 31172 - DNA, 25 bp, E. coli
ggtgccgccgctcgcttatttgccg

SEQ ID NO: 31173 - DNA, 25 bp, E. coli
ggcattctggatgcgataatcgagc

SEQ ID NO: 31174 - DNA, 25 bp, E. coli
ggcattctggatccgataatcgagc

SEQ ID NO: 31175 - DNA, 25 bp, E. coli
taatcgagctttttcgtccggtgcc

SEQ ID NO: 31176 - DNA, 25 bp, E. coli
taatcgagctttatcgtccggtgcc

SEQ ID NO: 31177 - DNA, 25 bp, E. coli
gaccttaagcataggcacgttagcg

SEQ ID NO: 31178 - DNA, 25 bp, E. coli
gacgccctggcatggagaagtacaa

SEQ ID NO: 31179 - DNA, 25 bp, E. coli
gacgccctggcaaggagaagtacaa

SEQ ID NO: 31180 - DNA, 25 bp, E. coli
gaccttaagcattggcacgttagcg

SEQ ID NO: 31181 - DNA, 25 bp, E. coli
taaatcccggcgaacttaatgggcg

SEQ ID NO: 31182 - DNA, 25 bp, E. coli
taaatcccggcgtacttaatgggcg

SEQ ID NO: 31183 - DNA, 25 bp, E. coli
aaatcacagcggaaaagagtacgac

SEQ ID NO: 31184 - DNA, 25 bp, E. coli
aaatcacagcggtaaagagtacgac

SEQ ID NO: 31185 - DNA, 25 bp, E. coli
tttgcccgctatgcgctgaagaaaa

SEQ ID NO: 31186 - DNA, 25 bp, E. coli
tttgcccgctatccgctgaagaaaa

SEQ ID NO: 31187 - DNA, 25 bp, E. coli
tgaagaaaatcagagcggaaaagag

SEQ ID NO: 31188 - DNA, 25 bp, E. coli
tgaagaaaatcacagcggaaaagag

SEQ ID NO: 31189 - DNA, 25 bp, E. coli
tcccggcgtactaaatgggcgctat

SEQ ID NO: 31190 - DNA, 25 bp, E. coli
tcccggcgtacttaatgggcgctat

SEQ ID NO: 31191 - DNA, 25 bp, E. coli
gcccgctatccgctgaagaaaatca

SEQ ID NO: 31192 - DNA, 25 bp, E. coli
gcccgctatccggtgaagaaaatca

SEQ ID NO: 31193 - DNA, 25 bp, E. coli
gctatccgctgaagaaaatcacagc

SEQ ID NO: 31194 - DNA, 25 bp, E. coli
gctatccgctgatgaaaatcacagc

SEQ ID NO: 31195 - DNA, 25 bp, E. coli
gacggcagtaaatcccggcgtactt

SEQ ID NO: 31196 - DNA, 25 bp, E. coli
gacggcagtaaaacccggcgtactt

SEQ ID NO: 31197 - DNA, 25 bp, E. coli
cggcgtacttaaagggcgctatcgt

SEQ ID NO: 31198 - DNA, 25 bp, E. coli
cggcgtacttaatgggcgctatcgt

SEQ ID NO: 31199 - DNA, 25 bp, E. coli
gtacgacggcagtaaatcccggcgt

SEQ ID NO: 31200 - DNA, 25 bp, E. coli
gtacgacggcagaaaatcccggcgt

SEQ ID NO: 31201 - DNA, 25 bp, E. coli
gaggtggagctgattgcccgctatc

SEQ ID NO: 31202 - DNA, 25 bp, E. coli
gaggtggagctgtttgcccgctatc

SEQ ID NO: 31203 - DNA, 25 bp, E. coli
cacaaatgatgagcttgctgcactt

SEQ ID NO: 31204 - DNA, 25 bp, E. coli
cacaaatgatgaccttgctgcactt

SEQ ID NO: 31205 - DNA, 25 bp, E. coli
cactttacatgcagaaggtacagaa

SEQ ID NO: 31206 - DNA, 25 bp, E. coli
cactttacatgctgaaggtacagaa

SEQ ID NO: 31207 - DNA, 25 bp, E. coli
cataccctatgttgccggtattgga

SEQ ID NO: 31208 - DNA, 25 bp, E. coli
cataccctatgtagccggtattgga

SEQ ID NO: 31209 - DNA, 25 bp, E. coli
gaggacggcaacaccacgccgttat

SEQ ID NO: 31210 - DNA, 25 bp, E. coli
gaggacggcaactccacgccgttat

SEQ ID NO: 31211 - DNA, 25 bp, E. coli
aaaaatggcataccctatgttgccg

SEQ ID NO: 31212 - DNA, 25 bp, E. coli
aaaaatggcatagcctatgttgccg

SEQ ID NO: 31213 - DNA, 25 bp, E. coli
tgattaacccggtggacggcaacac

SEQ ID NO: 31214 - DNA, 25 bp, E. coli
tgattaacccggaggacggcaacac

SEQ ID NO: 31215 - DNA, 25 bp, E. coli
gcaggctgaccggaagaaatgctga

SEQ ID NO: 31216 - DNA, 25 bp, E. coli
gcaggctgaccgcaagaaatgctga

SEQ ID NO: 31217 - DNA, 25 bp, E. coli
cgtattgcgatgtttaacccggagg

SEQ ID NO: 31218 - DNA, 25 bp, E. coli
cgtattgcgatgattaacccggagg

SEQ ID NO: 31219 - DNA, 25 bp, E. coli
ggtacagaaaactaaaaatggcata

SEQ ID NO: 31220 - DNA, 25 bp, E. coli
ggtacagaaaacaaaaaatggcata

SEQ ID NO: 31221 - DNA, 25 bp, E. coli
gaccttgctgcagtttacatgctga

SEQ ID NO: 31222 - DNA, 25 bp, E. coli
gaccgcaagaaatgctgatatcagc

SEQ ID NO: 31223 - DNA, 25 bp, E. coli
gaccgcaagaaaagctgatatcagc

SEQ ID NO: 31224 - DNA, 25 bp, E. coli
gaccttgctgcactttacatgctga

SEQ ID NO: 31225 - DNA, 25 bp, E. coli
caaagcttaggcctgatttatatca

SEQ ID NO: 31226 - DNA, 25 bp, E. coli
cacgccagcgcgcatatttatcgct

SEQ ID NO: 31227 - DNA, 25 bp, E. coli
cacgccagcgcggatatttatcgct

SEQ ID NO: 31228 - DNA, 25 bp, E. coli
caaagcttaggcgtgatttatatca

SEQ ID NO: 31229 - DNA, 25 bp, E. coli
catgggcagccaatgaaattaataa

SEQ ID NO: 31230 - DNA, 25 bp, E. coli
caggccagaaatatggacgatgtgc

SEQ ID NO: 31231 - DNA, 25 bp, E. coli
caggccagaaatttggacgatgtgc

SEQ ID NO: 31232 - DNA, 25 bp, E. coli
catgggcagccattgaaattaataa

SEQ ID NO: 31233 - DNA, 25 bp, E. coli
atgcgcaaggcgcaacgtactacca

SEQ ID NO: 31234 - DNA, 25 bp, E. coli
atgcgcaaggcggaacgtactacca

SEQ ID NO: 31235 - DNA, 25 bp, E. coli
tatggacgatgtccaaagcttaggc

SEQ ID NO: 31236 - DNA, 25 bp, E. coli
tatggacgatgtgcaaagcttaggc

SEQ ID NO: 31237 - DNA, 25 bp, E. coli
tgctaagtgcaattacatgggcagc

SEQ ID NO: 31238 - DNA, 25 bp, E. coli
tgaaattaataagcaccaggccaga

SEQ ID NO: 31239 - DNA, 25 bp, E. coli
tgaaattaataaccaccaggccaga

SEQ ID NO: 31240 - DNA, 25 bp, E. coli
tgctaagtgcaaatacatgggcagc

SEQ ID NO: 31241 - DNA, 25 bp, E. coli
gggagtaacggctatatgcacgcca

SEQ ID NO: 31242 - DNA, 25 bp, E. coli
gggagtaacggcaatatgcacgcca

SEQ ID NO: 31243 - DNA, 25 bp, E. coli
gtaacggcaatatgcacgccagcgc

SEQ ID NO: 31244 - DNA, 25 bp, E. coli
gtaacggcaataagcacgccagcgc

SEQ ID NO: 31245 - DNA, 25 bp, E. coli
taaccaccaggcgagaaatatggac

SEQ ID NO: 31246 - DNA, 25 bp, E. coli
taaccaccaggccagaaatatggac

SEQ ID NO: 31247 - DNA, 25 bp, E. coli
caggaagtgctcaatggtgatggag

SEQ ID NO: 31248 - DNA, 25 bp, E. coli
caggaagtgctctatggtgatggag

SEQ ID NO: 31249 - DNA, 25 bp, E. coli
agaggatgacgataccctgtcggtg

SEQ ID NO: 31250 - DNA, 25 bp, E. coli
acccgccgtaacctggaagcggatg

SEQ ID NO: 31251 - DNA, 25 bp, E. coli
acccgccgtaacgtggaagcggatg

SEQ ID NO: 31252 - DNA, 25 bp, E. coli
agaggatgacgaaaccctgtcggtg

SEQ ID NO: 31253 - DNA, 25 bp, E. coli
tgatggagaggatgacgataccctg

SEQ ID NO: 31254 - DNA, 25 bp, E. coli
tgatggagaggaagacgataccctg

SEQ ID NO: 31255 - DNA, 25 bp, E. coli
tcagcgtggtgcagcgggagccttc

SEQ ID NO: 31256 - DNA, 25 bp, E. coli
tcagcgtggtgctgcgggagccttc

SEQ ID NO: 31257 - DNA, 25 bp, E. coli
tctgtggcaggaagtgctcaatggt

SEQ ID NO: 31258 - DNA, 25 bp, E. coli
tctgtggcaggatgtgctcaatggt

SEQ ID NO: 31259 - DNA, 25 bp, E. coli
ccgtaacctggatgcggatgtgacg

SEQ ID NO: 31260 - DNA, 25 bp, E. coli
cctggaagcggatgtgacgctgttc

SEQ ID NO: 31261 - DNA, 25 bp, E. coli
cctggaagcggaagtgacgctgttc

SEQ ID NO: 31262 - DNA, 25 bp, E. coli
ccgtaacctggaagcggatgtgacg

SEQ ID NO: 31263 - DNA, 25 bp, E. coli
cctggtatctgtcgcaggaagtgct

SEQ ID NO: 31264 - DNA, 25 bp, E. coli
cctggtatctgtggcaggaagtgct

SEQ ID NO: 31265 - DNA, 25 bp, E. coli
gataccctgtcgctggtggcgaaaa

SEQ ID NO: 31266 - DNA, 25 bp, E. coli
gataccctgtcggtggtggcgaaaa

SEQ ID NO: 31267 - DNA, 25 bp, E. coli
gagccttcggcacaggcctggtatc

SEQ ID NO: 31268 - DNA, 25 bp, E. coli
gagccttcggcagaggcctggtatc

SEQ ID NO: 31269 - DNA, 25 bp, E. coli
actttgttgctgatctacgtgcgcc

SEQ ID NO: 31270 - DNA, 25 bp, E. coli
actttgttgctgttctacgtgcgcc

SEQ ID NO: 31271 - DNA, 25 bp, E. coli
tatgctcgaacgtctgcaaaagcgg

SEQ ID NO: 31272 - DNA, 25 bp, E. coli
tatgctcgaacgactgcaaaagcgg

SEQ ID NO: 31273 - DNA, 25 bp, E. coli
tatcgtcgaaagtatgcagccggcc

SEQ ID NO: 31274 - DNA, 25 bp, E. coli
tatcgtcgaaagaatgcagccggcc

SEQ ID NO: 31275 - DNA, 25 bp, E. coli
gcttaaagacgaaaccgcgcaggtg

SEQ ID NO: 31276 - DNA, 25 bp, E. coli
gcttaaagacgataccgcgcaggtg

SEQ ID NO: 31277 - DNA, 25 bp, E. coli
gaatcagcttaatcgcgcgggtcag

SEQ ID NO: 31278 - DNA, 25 bp, E. coli
gaatcagcttaaacgcgcgggtcag

SEQ ID NO: 31279 - DNA, 25 bp, E. coli
gattaacacggctactcgtccagca

SEQ ID NO: 31280 - DNA, 25 bp, E. coli
gattagtgaagtcagcgccgtaaca

SEQ ID NO: 31281 - DNA, 25 bp, E. coli
gattagtgaagtgagcgccgtaaca

SEQ ID NO: 31282 - DNA, 25 bp, E. coli
gattaacacggcaactcgtccagca

SEQ ID NO: 31283 - DNA, 25 bp, E. coli
gtccagcaaaatgcgcagtcgcgta

SEQ ID NO: 31284 - DNA, 25 bp, E. coli
ggactattatctcgccaatcgcacg

SEQ ID NO: 31285 - DNA, 25 bp, E. coli
gtgagacactgagcacacgactggg

SEQ ID NO: 31286 - DNA, 25 bp, E. coli
gtgagacactgaccacacgactggg

SEQ ID NO: 31287 - DNA, 25 bp, E. coli
gtccagcaaaatccgcagtcgcgta

SEQ ID NO: 31288 - DNA, 25 bp, E. coli
ggactattatctggccaatcgcacg

SEQ ID NO: 31289 - DNA, 25 bp, E. coli
taattttacacatccagcctccggt

SEQ ID NO: 31290 - DNA, 25 bp, E. coli
taattttacacaaccagcctccggt

SEQ ID NO: 31291 - DNA, 25 bp, E. coli
caataacgccgtgcataatcagcca

SEQ ID NO: 31292 - DNA, 25 bp, E. coli
caataacgccgtccataatcagcca

SEQ ID NO: 31293 - DNA, 25 bp, E. coli
cagtaagtcaattagacaaaggcgc

SEQ ID NO: 31294 - DNA, 25 bp, E. coli
cagtaagtcaataagacaaaggcgc

SEQ ID NO: 31295 - DNA, 25 bp, E. coli
tagcaaagcctagcagtaagtcaat

SEQ ID NO: 31296 - DNA, 25 bp, E. coli
tagcaaagcctaccagtaagtcaat

SEQ ID NO: 31297 - DNA, 25 bp, E. coli
tttttcgagtttcctgacccgggag

SEQ ID NO: 31298 - DNA, 25 bp, E. coli
tttttcgagtttgctgacccgggag

SEQ ID NO: 31299 - DNA, 25 bp, E. coli
ttgttccactttcccaataacgccg

SEQ ID NO: 31300 - DNA, 25 bp, E. coli
ttgttccactttgccaataacgccg

SEQ ID NO: 31301 - DNA, 25 bp, E. coli
tccataatcagccacgaggtgcgcg

SEQ ID NO: 31302 - DNA, 25 bp, E. coli
tccataatcagcgacgaggtgcgcg

SEQ ID NO: 31303 - DNA, 25 bp, E. coli
gacccgggagtgagtcttgttccac

SEQ ID NO: 31304 - DNA, 25 bp, E. coli
gacccgggagtgtgtcttgttccac

SEQ ID NO: 31305 - DNA, 25 bp, E. coli
gacaaaggcgctaaatagcaacaaa

SEQ ID NO: 31306 - DNA, 25 bp, E. coli
gacaaaggcgcttaatagcaacaaa

SEQ ID NO: 31307 - DNA, 25 bp, E. coli
cgaaagcacaaataatgggagcgtc

SEQ ID NO: 31308 - DNA, 25 bp, E. coli
cgaaagcacaaaaaatgggagcgtc

SEQ ID NO: 31309 - DNA, 25 bp, E. coli
ggataatttctggtagcaaagccta

SEQ ID NO: 31310 - DNA, 25 bp, E. coli
ggataatttctgctagcaaagccta

SEQ ID NO: 31311 - DNA, 25 bp, E. coli
taatgggagcgtcaatttttcgagt

SEQ ID NO: 31312 - DNA, 25 bp, E. coli
taatgggagcgtgaatttttcgagt

SEQ ID NO: 31313 - DNA, 25 bp, E. coli
aacgggtctgttttggtcctttctg

SEQ ID NO: 31314 - DNA, 25 bp, E. coli
aacgggtctgttatggtcctttctg

SEQ ID NO: 31315 - DNA, 25 bp, E. coli
ttagcagtctggatggcgatgccca

SEQ ID NO: 31316 - DNA, 25 bp, E. coli
ttagcagtctggttggcgatgccca

SEQ ID NO: 31317 - DNA, 25 bp, E. coli
ttgtacataaatccccgagtccggg

SEQ ID NO: 31318 - DNA, 25 bp, E. coli
ttgtacataaatgcccgagtccggg

SEQ ID NO: 31319 - DNA, 25 bp, E. coli
tgtggctacgctttccattcggtaa

SEQ ID NO: 31320 - DNA, 25 bp, E. coli
tgtggctacgctatccattcggtaa

SEQ ID NO: 31321 - DNA, 25 bp, E. coli
tcctgctccacagcgaatttttgaa

SEQ ID NO: 31322 - DNA, 25 bp, E. coli
tcctgctccacaccgaatttttgaa

SEQ ID NO: 31323 - DNA, 25 bp, E. coli
gcgatgcccatctcggtgatccgtg

SEQ ID NO: 31324 - DNA, 25 bp, E. coli
gcgatgcccatcacggtgatccgtg

SEQ ID NO: 31325 - DNA, 25 bp, E. coli
gaaatcatcccaggctactgctaag

SEQ ID NO: 31326 - DNA, 25 bp, E. coli
gaaatcatcccacgctactgctaag

SEQ ID NO: 31327 - DNA, 25 bp, E. coli
ctttcagttgttgcgtgtggctacg

SEQ ID NO: 31328 - DNA, 25 bp, E. coli
ctttcagttgttccgtgtggctacg

SEQ ID NO: 31329 - DNA, 25 bp, E. coli
gtttataccctcatcctaagggctg

SEQ ID NO: 31330 - DNA, 25 bp, E. coli
gtttataccctcttcctaagggctg

SEQ ID NO: 31331 - DNA, 25 bp, E. coli
gtgatccgtgtcctgcacgacgcct

SEQ ID NO: 31332 - DNA, 25 bp, E. coli
gtgatccgtgtcgtgcacgacgcct

SEQ ID NO: 31333 - DNA, 25 bp, E. coli
taagggctgcctgttgtacataaat

SEQ ID NO: 31334 - DNA, 25 bp, E. coli
taagggctgcctcttgtacataaat

SEQ ID NO: 31335 - DNA, 25 bp, E. coli
tagcagctctcagggcgacgtagat

SEQ ID NO: 31336 - DNA, 25 bp, E. coli
tagcagctctcacggcgacgtagat

SEQ ID NO: 31337 - DNA, 25 bp, E. coli
aacaaatgttctctggtctggtcga

SEQ ID NO: 31338 - DNA, 25 bp, E. coli
aacaaatgttctgtggtctggtcga

SEQ ID NO: 31339 - DNA, 25 bp, E. coli
tatgattcgcatggtgaaacagcac

SEQ ID NO: 31340 - DNA, 25 bp, E. coli
tatgattcgcatcgtgaaacagcac

SEQ ID NO: 31341 - DNA, 25 bp, E. coli
tagattacgctctggcgtctgcgga

SEQ ID NO: 31342 - DNA, 25 bp, E. coli
tagattacgctcaggcgtctgcgga

SEQ ID NO: 31343 - DNA, 25 bp, E. coli
tcgtcagcgcagtgcaacaaatgtt

SEQ ID NO: 31344 - DNA, 25 bp, E. coli
tcgtcagcgcagagcaacaaatgtt

SEQ ID NO: 31345 - DNA, 25 bp, E. coli
ccatggaagcgatacgtaaggctga

SEQ ID NO: 31346 - DNA, 25 bp, E. coli
ccatggaagcgaaacgtaaggctga

SEQ ID NO: 31347 - DNA, 25 bp, E. coli
gctgcgcgttatcgagttgaccaaa

SEQ ID NO: 31348 - DNA, 25 bp, E. coli
gctgcgcgttatggagttgaccaaa

SEQ ID NO: 31349 - DNA, 25 bp, E. coli
gagaaaatccaggtaacgggtagcg

SEQ ID NO: 31350 - DNA, 25 bp, E. coli
gagaaaatccagctaacgggtagcg

SEQ ID NO: 31351 - DNA, 25 bp, E. coli
gtctgcggaactggccaaagcgatc

SEQ ID NO: 31352 - DNA, 25 bp, E. coli
gtctgcggaactcgccaaagcgatc

SEQ ID NO: 31353 - DNA, 25 bp, E. coli
tggcaatgactttccacctggacgt

SEQ ID NO: 31354 - DNA, 25 bp, E. coli
tggcaatgacttaccacctggacgt

SEQ ID NO: 31355 - DNA, 25 bp, E. coli
gagtttatctatctgtctggcggca

SEQ ID NO: 31356 - DNA, 25 bp, E. coli
gagtttatctatgtgtctggcggca

SEQ ID NO: 31357 - DNA, 25 bp, E. coli
catctgtgaatgtagcaaaccgcac

SEQ ID NO: 31358 - DNA, 25 bp, E. coli
catcgatgcgcggtgtgaattcctc

SEQ ID NO: 31359 - DNA, 25 bp, E. coli
catctgtgaatgaagcaaaccgcac

SEQ ID NO: 31360 - DNA, 25 bp, E. coli
catcgatgcgcgctgtgaattcctc

SEQ ID NO: 31361 - DNA, 25 bp, E. coli
aaatatcgcgccgaaggttcacgca

SEQ ID NO: 31362 - DNA, 25 bp, E. coli
aaatatcgcgcccaaggttcacgca

SEQ ID NO: 31363 - DNA, 25 bp, E. coli
tgaaatatggctggcaaaaacgcgc

SEQ ID NO: 31364 - DNA, 25 bp, E. coli
tgaaatatggctcgcaaaaacgcgc

SEQ ID NO: 31365 - DNA, 25 bp, E. coli
gccgcgcgtgataagccatgaacag

SEQ ID NO: 31366 - DNA, 25 bp, E. coli
gccgcgcgtgattagccatgaacag

SEQ ID NO: 31367 - DNA, 25 bp, E. coli
gccaacggtccggtgcatgataaaa

SEQ ID NO: 31368 - DNA, 25 bp, E. coli
gccaacggtccgctgcatgataaaa

SEQ ID NO: 31369 - DNA, 25 bp, E. coli
gcaacactcgtattctggaacgcca

SEQ ID NO: 31370 - DNA, 25 bp, E. coli
gaagcgccattttctggcactggaa

SEQ ID NO: 31371 - DNA, 25 bp, E. coli
gcaacactcgtaatctggaacgcca

SEQ ID NO: 31372 - DNA, 25 bp, E. coli
gaagcgccatttactggcactggaa

SEQ ID NO: 31373 - DNA, 25 bp, E. coli
gacattctgacgctcgacgaaacca

SEQ ID NO: 31374 - DNA, 25 bp, E. coli
gacattctgacggtcgacgaaacca

SEQ ID NO: 31375 - DNA, 25 bp, E. coli
cgatatgtttgaaggtcatgcgccg

SEQ ID NO: 31376 - DNA, 25 bp, E. coli
cgatatgtttgatggtcatgcgccg

SEQ ID NO: 31377 - DNA, 25 bp, E. coli
ggtgcctttaaacccggaatgcgtg

SEQ ID NO: 31378 - DNA, 25 bp, E. coli
ggtgcctttaaagccggaatgcgtg

SEQ ID NO: 31379 - DNA, 25 bp, E. coli
cacacttgttgaggttactattttg

SEQ ID NO: 31380 - DNA, 25 bp, E. coli
cacacttgttgacgttactattttg

SEQ ID NO: 31381 - DNA, 25 bp, E. coli
cagaaatgcgtgatgtgtgccacac

SEQ ID NO: 31382 - DNA, 25 bp, E. coli
cagaaatgcgtgttgtgtgccacac

SEQ ID NO: 31383 - DNA, 25 bp, E. coli
tacgggctaatttcaggcagaaatg

SEQ ID NO: 31384 - DNA, 25 bp, E. coli
tacgggctaattacaggcagaaatg

SEQ ID NO: 31385 - DNA, 25 bp, E. coli
tattttgttaaccactcttccggcg

SEQ ID NO: 31386 - DNA, 25 bp, E. coli
tattttgttaacgactcttccggcg

SEQ ID NO: 31387 - DNA, 25 bp, E. coli
tgttaaccactcatccggcgaggaa

SEQ ID NO: 31388 - DNA, 25 bp, E. coli
tgttaaccactcttccggcgaggaa

SEQ ID NO: 31389 - DNA, 25 bp, E. coli
tgtgtgccacacatgttgacgttac

SEQ ID NO: 31390 - DNA, 25 bp, E. coli
tgtgtgccacacttgttgacgttac

SEQ ID NO: 31391 - DNA, 25 bp, E. coli
tccgatgggtgctatggtctgaatt

SEQ ID NO: 31392 - DNA, 25 bp, E. coli
tccgatgggtgcaatggtctgaatt

SEQ ID NO: 31393 - DNA, 25 bp, E. coli
tcttccggcgagcaaagttagcccg

SEQ ID NO: 31394 - DNA, 25 bp, E. coli
tcttccggcgaggaaagttagcccg

SEQ ID NO: 31395 - DNA, 25 bp, E. coli
gcaatggtctgatttacgggctaat

SEQ ID NO: 31396 - DNA, 25 bp, E. coli
gcaatggtctgaattacgggctaat

SEQ ID NO: 31397 - DNA, 25 bp, E. coli
cccgctggtgcattgataataagga

SEQ ID NO: 31398 - DNA, 25 bp, E. coli
cccgctggtgcaatgataataagga

SEQ ID NO: 31399 - DNA, 25 bp, E. coli
cgaggaaagttagcccgctggtgca

SEQ ID NO: 31400 - DNA, 25 bp, E. coli
cgaggaaagttaccccgctggtgca

SEQ ID NO: 31401 - DNA, 25 bp, E. coli
caggcagaaattgcccgtcgaatga

SEQ ID NO: 31402 - DNA, 25 bp, E. coli
caggcagaaattccccgtcgaatga

SEQ ID NO: 31403 - DNA, 25 bp, E. coli
taaagagttcgcgagtaggcttgcg

SEQ ID NO: 31404 - DNA, 25 bp, E. coli
agttcgccagtaggcttgcgctagc

SEQ ID NO: 31405 - DNA, 25 bp, E. coli
agttcgccagtacgcttgcgctagc

SEQ ID NO: 31406 - DNA, 25 bp, E. coli
taggcttgcgcttgcctgtgaaaac

SEQ ID NO: 31407 - DNA, 25 bp, E. coli
tatgaacaacatcgaaggcaggcag

SEQ ID NO: 31408 - DNA, 25 bp, E. coli
taggcttgcgctagcctgtgaaaac

SEQ ID NO: 31409 - DNA, 25 bp, E. coli
tatgaacaacatggaaggcaggcag

SEQ ID NO: 31410 - DNA, 25 bp, E. coli
ttgcgctagcctgtgaaaacgctgg

SEQ ID NO: 31411 - DNA, 25 bp, E. coli
ttgcgctagcctctgaaaacgctgg

SEQ ID NO: 31412 - DNA, 25 bp, E. coli
tgcccgtcgaatcaaattaacacca

SEQ ID NO: 31413 - DNA, 25 bp, E. coli
tgcccgtcgaatgaaattaacacca

SEQ ID NO: 31414 - DNA, 25 bp, E. coli
gaaaacgctggttatgaacaacatg

SEQ ID NO: 31415 - DNA, 25 bp, E. coli
gaaaacgctggtaatgaacaacatg

SEQ ID NO: 31416 - DNA, 25 bp, E. coli
gataaagcgcgttaagagttcgcca

SEQ ID NO: 31417 - DNA, 25 bp, E. coli
gataaagcgcgtaaagagttcgcca

SEQ ID NO: 31418 - DNA, 25 bp, E. coli
tggaaggcaggcagaaattgcccgt

SEQ ID NO: 31419 - DNA, 25 bp, E. coli
tggttcatgaagttaaagcgcgtaa

SEQ ID NO: 31420 - DNA, 25 bp, E. coli
tggaaggcaggctgaaattgcccgt

SEQ ID NO: 31421 - DNA, 25 bp, E. coli
tggttcatgaagataaagcgcgtaa

SEQ ID NO: 31422 - DNA, 25 bp, E. coli
taaagagttcgccagtaggcttgcg

SEQ ID NO: 31423 - DNA, 25 bp, E. coli
aatctcaggccggatattcattcgg

SEQ ID NO: 31424 - DNA, 25 bp, E. coli
caatctgcgctaatcctttttctga

SEQ ID NO: 31425 - DNA, 25 bp, E. coli
caagttgaatcgttaagaggcggta

SEQ ID NO: 31426 - DNA, 25 bp, E. coli
caatctgcgctattcctttttctga

SEQ ID NO: 31427 - DNA, 25 bp, E. coli
aatctcaggccgcatattcattcgg

SEQ ID NO: 31428 - DNA, 25 bp, E. coli
caagttgaatcgataagaggcggta

SEQ ID NO: 31429 - DNA, 25 bp, E. coli
cacagcaattagatcttcttcctca

SEQ ID NO: 31430 - DNA, 25 bp, E. coli
cacagcaattagttcttcttcctca

SEQ ID NO: 31431 - DNA, 25 bp, E. coli
caggcccgcacatgcaaacttatca

SEQ ID NO: 31432 - DNA, 25 bp, E. coli
caggcccgcacaagcaaacttatca

SEQ ID NO: 31433 - DNA, 25 bp, E. coli
aaacttatcagcaatctcaggccgg

SEQ ID NO: 31434 - DNA, 25 bp, E. coli
aaacttatcagctatctcaggccgg

SEQ ID NO: 31435 - DNA, 25 bp, E. coli
ttcgaaagcgcggacggacagtccc

SEQ ID NO: 31436 - DNA, 25 bp, E. coli
ttcgaaagcgcgcacggacagtccc

SEQ ID NO: 31437 - DNA, 25 bp, E. coli
ttttacaaaaacctcaatctgcgct

SEQ ID NO: 31438 - DNA, 25 bp, E. coli
ttttacaaaaacgtcaatctgcgct

SEQ ID NO: 31439 - DNA, 25 bp, E. coli
tgatttgacctctcacagcaattag

SEQ ID NO: 31440 - DNA, 25 bp, E. coli
tgatttgacctcacacagcaattag

SEQ ID NO: 31441 - DNA, 25 bp, E. coli
tccgctacaattatcaacaagttga

SEQ ID NO: 31442 - DNA, 25 bp, E. coli
tccgctacaattttcaacaagttga

SEQ ID NO: 31443 - DNA, 25 bp, E. coli
cggatattcattgggccttttacaa

SEQ ID NO: 31444 - DNA, 25 bp, E. coli
cggatattcattcggccttttacaa

SEQ ID NO: 31445 - DNA, 25 bp, E. coli
cattcgtcaggatcgtgccggttca

SEQ ID NO: 31446 - DNA, 25 bp, E. coli
cattcgtcaggaacgtgccggttca

SEQ ID NO: 31447 - DNA, 25 bp, E. coli
tacggttctctgttcggtgaagcca

SEQ ID NO: 31448 - DNA, 25 bp, E. coli
tacggttctctgatcggtgaagcca

SEQ ID NO: 31449 - DNA, 25 bp, E. coli
aaatgatcgacatgcacggcggcga

SEQ ID NO: 31450 - DNA, 25 bp, E. coli
aaatgatcgacaagcacggcggcga

SEQ ID NO: 31451 - DNA, 25 bp, E. coli
ttgttgctgaagacccgctgacctg

SEQ ID NO: 31452 - DNA, 25 bp, E. coli
ttgttgctgaagtcccgctgacctg

SEQ ID NO: 31453 - DNA, 25 bp, E. coli
tcctgattgaagtaccgatggctgc

SEQ ID NO: 31454 - DNA, 25 bp, E. coli
tcctgattgaagaaccgatggctgc

SEQ ID NO: 31455 - DNA, 25 bp, E. coli
tcatgacgcgaaccagatgctgggc

SEQ ID NO: 31456 - DNA, 25 bp, E. coli
tcatgacgcgaagcagatgctgggc

SEQ ID NO: 31457 - DNA, 25 bp, E. coli
gctggtgcccgtgaagtcttcctga

SEQ ID NO: 31458 - DNA, 25 bp, E. coli
gcggcgacctgtacagcgaagagta

SEQ ID NO: 31459 - DNA, 25 bp, E. coli
gctggtgcccgtcaagtcttcctga

SEQ ID NO: 31460 - DNA, 25 bp, E. coli
gcggcgacctgttcagcgaagagta

SEQ ID NO: 31461 - DNA, 25 bp, E. coli
gaagaaaccggcattccagtcgttg

SEQ ID NO: 31462 - DNA, 25 bp, E. coli
gaagaaaccggctttccagtcgttg

SEQ ID NO: 31463 - DNA, 25 bp, E. coli
gaacgccgcgcatttcgtgaatccg

SEQ ID NO: 31464 - DNA, 25 bp, E. coli
gaacgccgcgcaattcgtgaatccg

SEQ ID NO: 31465 - DNA, 25 bp, E. coli
cggttcaccgaatagcgtagctgca

SEQ ID NO: 31466 - DNA, 25 bp, E. coli
cggttcaccgaaaagcgtagctgca

SEQ ID NO: 31467 - DNA, 25 bp, E. coli
cagcttaacgatttcggtaaaccgg

SEQ ID NO: 31468 - DNA, 25 bp, E. coli
acgatatcggtataccggtgcagcc

SEQ ID NO: 31469 - DNA, 25 bp, E. coli
aggaattatcgaaagcccgcgcgat

SEQ ID NO: 31470 - DNA, 25 bp, E. coli
cagcttaacgatatcggtaaaccgg

SEQ ID NO: 31471 - DNA, 25 bp, E. coli
acgatatcggtaaaccggtgcagcc

SEQ ID NO: 31472 - DNA, 25 bp, E. coli
aggaattatcgatagcccgcgcgat

SEQ ID NO: 31473 - DNA, 25 bp, E. coli
tatgcggtgtagaacagcttaacga

SEQ ID NO: 31474 - DNA, 25 bp, E. coli
tatgcggtgtagtacagcttaacga

SEQ ID NO: 31475 - DNA, 25 bp, E. coli
ttccgaaggaataatcgaaagcccg

SEQ ID NO: 31476 - DNA, 25 bp, E. coli
ttccgaaggaattatcgaaagcccg

SEQ ID NO: 31477 - DNA, 25 bp, E. coli
tgtagaacagcttaacgatatcggt

SEQ ID NO: 31478 - DNA, 25 bp, E. coli
tgtagaacagctaaacgatatcggt

SEQ ID NO: 31479 - DNA, 25 bp, E. coli
tctgacgctggtgggcttttgtaaa

SEQ ID NO: 31480 - DNA, 25 bp, E. coli
taatctgacgctcgtgggcttttgt

SEQ ID NO: 31481 - DNA, 25 bp, E. coli
taatctgacgctggtgggcttttgt

SEQ ID NO: 31482 - DNA, 25 bp, E. coli
tctgacgctggtcggcttttgtaaa

SEQ ID NO: 31483 - DNA, 25 bp, E. coli
gaaggaattatcgaaagcccgcgcg

SEQ ID NO: 31484 - DNA, 25 bp, E. coli
gaaggaattatccaaagcccgcgcg

SEQ ID NO: 31485 - DNA, 25 bp, E. coli
tggcgtatgcggagtagaacagctt

SEQ ID NO: 31486 - DNA, 25 bp, E. coli
tggcgtatgcggtgtagaacagctt

SEQ ID NO: 31487 - DNA, 25 bp, E. coli
taacgatatcggaaaaccggtgcag

SEQ ID NO: 31488 - DNA, 25 bp, E. coli
taacgatatcggtaaaccggtgcag

SEQ ID NO: 31489 - DNA, 25 bp, E. coli
caactggacctgttcaccaaactgg

SEQ ID NO: 31490 - DNA, 25 bp, E. coli
cactgtgtgggttttcgtgttagcg

SEQ ID NO: 31491 - DNA, 25 bp, E. coli
cagctacatctgtggtttcactgtg

SEQ ID NO: 31492 - DNA, 25 bp, E. coli
caactggacctgatcaccaaactgg

SEQ ID NO: 31493 - DNA, 25 bp, E. coli
cactgtgtgggtattcgtgttagcg

SEQ ID NO: 31494 - DNA, 25 bp, E. coli
cagctacatctgaggtttcactgtg

SEQ ID NO: 31495 - DNA, 25 bp, E. coli
cagtcctttgcccaaggtcttgatc

SEQ ID NO: 31496 - DNA, 25 bp, E. coli
cagtcctttgccgaaggtcttgatc

SEQ ID NO: 31497 - DNA, 25 bp, E. coli
acgttatcgctttgttgaactgcac

SEQ ID NO: 31498 - DNA, 25 bp, E. coli
acgttatcgcttagttgaactgcac

SEQ ID NO: 31499 - DNA, 25 bp, E. coli
tagcgaccaactcgaaaggctgctg

SEQ ID NO: 31500 - DNA, 25 bp, E. coli
tagcgaccaactggaaaggctgctg

SEQ ID NO: 31501 - DNA, 25 bp, E. coli
gccgaaggtcttgatctgaaaggcg

SEQ ID NO: 31502 - DNA, 25 bp, E. coli
gccgaaggtcttcatctgaaaggcg

SEQ ID NO: 31503 - DNA, 25 bp, E. coli
gcagggcgatcacccacgttatcgc

SEQ ID NO: 31504 - DNA, 25 bp, E. coli
gcagggcgatcagccacgttatcgc

SEQ ID NO: 31505 - DNA, 25 bp, E. coli
ggtattcgtgtttgcgaccaactgg

SEQ ID NO: 31506 - DNA, 25 bp, E. coli
ggtattcgtgttagcgaccaactgg

SEQ ID NO: 31507 - DNA, 25 bp, E. coli
tggtaccggctcgaactggacctgt

SEQ ID NO: 31508 - DNA, 25 bp, E. coli
tggtaccggctccaactggacctgt

SEQ ID NO: 31509 - DNA, 25 bp, E. coli
gacctgttcacctaactggtcgcca

SEQ ID NO: 31510 - DNA, 25 bp, E. coli
gacctgttcaccaaactggtcgcca

SEQ ID NO: 31511 - DNA, 25 bp, E. coli
aatgaatatgttgcgcagatggagc

SEQ ID NO: 31512 - DNA, 25 bp, E. coli
aatgaatatgttccgcagatggagc

SEQ ID NO: 31513 - DNA, 25 bp, E. coli
cacatcgtggttatgtatataaagc

SEQ ID NO: 31514 - DNA, 25 bp, E. coli
cacatcgtggttttgtatataaagc

SEQ ID NO: 31515 - DNA, 25 bp, E. coli
tatagtgatattcctgatgagcagt

SEQ ID NO: 31516 - DNA, 25 bp, E. coli
tatagtgatattgctgatgagcagt

SEQ ID NO: 31517 - DNA, 25 bp, E. coli
tgtcgaatggcgtaagtgctcgtcg

SEQ ID NO: 31518 - DNA, 25 bp, E. coli
tgtcgaatggcgaaagtgctcgtcg

SEQ ID NO: 31519 - DNA, 25 bp, E. coli
tccaataccccgaagagatgctcag

SEQ ID NO: 31520 - DNA, 25 bp, E. coli
tccaataccccgtagagatgctcag

SEQ ID NO: 31521 - DNA, 25 bp, E. coli
cctcaaaaatttatacacatcgtgg

SEQ ID NO: 31522 - DNA, 25 bp, E. coli
cctcaaaaatttttacacatcgtgg

SEQ ID NO: 31523 - DNA, 25 bp, E. coli
gaatcattggctttgttgcaaggct

SEQ ID NO: 31524 - DNA, 25 bp, E. coli
gaatcattggctatgttgcaaggct

SEQ ID NO: 31525 - DNA, 25 bp, E. coli
ccttcttcattatgccttgaacggc

SEQ ID NO: 31526 - DNA, 25 bp, E. coli
ccttcttcattaagccttgaacggc

SEQ ID NO: 31527 - DNA, 25 bp, E. coli
tcaagtttagaagtggcatgtcgaa

SEQ ID NO: 31528 - DNA, 25 bp, E. coli
tcaagtttagaactggcatgtcgaa

SEQ ID NO: 31529 - DNA, 25 bp, E. coli
gatgctcagttacccctaaaacgag

SEQ ID NO: 31530 - DNA, 25 bp, E. coli
gatgctcagttagccctaaaacgag

SEQ ID NO: 31531 - DNA, 25 bp, E. coli
gagattagtcttgatcctccaatac

SEQ ID NO: 31532 - DNA, 25 bp, E. coli
gagattagtcttcatcctccaatac

SEQ ID NO: 31533 - DNA, 25 bp, E. coli
caagacctttgcctgatgtggctca

SEQ ID NO: 31534 - DNA, 25 bp, E. coli
caagacctctgcctgatgtggctca

SEQ ID NO: 31535 - DNA, 25 bp, E. coli
caagacctctgcgtgatgtggctca

SEQ ID NO: 31536 - DNA, 25 bp, E. coli
caagacctttgcgtgatgtggctca

SEQ ID NO: 31537 - DNA, 25 bp, E. coli
cagtacaaaatgtacaatcaagacc

SEQ ID NO: 31538 - DNA, 25 bp, E. coli
cagtacaaaatgaacaatcaagacc

SEQ ID NO: 31539 - DNA, 25 bp, E. coli
tacaaaatgaacaatcaagacctct

SEQ ID NO: 31540 - DNA, 25 bp, E. coli
tacaaaatgaactatcaagacctct

SEQ ID NO: 31541 - DNA, 25 bp, E. coli
attcctccggcacctaactggcctg

SEQ ID NO: 31542 - DNA, 25 bp, E. coli
attcctccggcagctaactggcctg

SEQ ID NO: 31543 - DNA, 25 bp, E. coli
tgaacaatcaagacctctgcctgat

SEQ ID NO: 31544 - DNA, 25 bp, E. coli
tgaacaatcaagtcctctgcctgat

SEQ ID NO: 31545 - DNA, 25 bp, E. coli
gaacaatcaagacctttgcctgatg

SEQ ID NO: 31546 - DNA, 25 bp, E. coli
gaacaatcaagagctttgcctgatg

SEQ ID NO: 31547 - DNA, 25 bp, E. coli
cgccaacgccgccagtacaaaatga

SEQ ID NO: 31548 - DNA, 25 bp, E. coli
cgccaacgccgcgagtacaaaatga

SEQ ID NO: 31549 - DNA, 25 bp, E. coli
cattaatacatctaagcgctcgtga

SEQ ID NO: 31550 - DNA, 25 bp, E. coli
ctttgcctgatgtggctcagcgtct

SEQ ID NO: 31551 - DNA, 25 bp, E. coli
ctttgcctgatgaggctcagcgtct

SEQ ID NO: 31552 - DNA, 25 bp, E. coli
cattaatacatcaaagcgctcgtga

SEQ ID NO: 31553 - DNA, 25 bp, E. coli
gacctctgcctgatgtggctcagcg

SEQ ID NO: 31554 - DNA, 25 bp, E. coli
gacctctgcctgttgtggctcagcg

SEQ ID NO: 31555 - DNA, 25 bp, E. coli
gccattgcctgttctcagtctgcac

SEQ ID NO: 31556 - DNA, 25 bp, E. coli
gccattgcctgtactcagtctgcac

SEQ ID NO: 31557 - DNA, 25 bp, E. coli
atgccattgcctgtactcagtctgc

SEQ ID NO: 31558 - DNA, 25 bp, E. coli
atgccattgcctctactcagtctgc

SEQ ID NO: 31559 - DNA, 25 bp, E. coli
ttgcctgtactcagtctgcacagac

SEQ ID NO: 31560 - DNA, 25 bp, E. coli
ttgcctgtactctgtctgcacagac

SEQ ID NO: 31561 - DNA, 25 bp, E. coli
tcgggtgattctcgtgcctgaatca

SEQ ID NO: 31562 - DNA, 25 bp, E. coli
tgcctgtactcactctgcacagact

SEQ ID NO: 31563 - DNA, 25 bp, E. coli
tgcctgtactcagtctgcacagact

SEQ ID NO: 31564 - DNA, 25 bp, E. coli
tgccattgcctgaactcagtctgca

SEQ ID NO: 31565 - DNA, 25 bp, E. coli
tgccattgcctgtactcagtctgca

SEQ ID NO: 31566 - DNA, 25 bp, E. coli
tcgggtgattctggtgcctgaatca

SEQ ID NO: 31567 - DNA, 25 bp, E. coli
gcctgtactcagactgcacagactg

SEQ ID NO: 31568 - DNA, 25 bp, E. coli
gcctgtactcagtctgcacagactg

SEQ ID NO: 31569 - DNA, 25 bp, E. coli
cctgtactcagtctgcacagactga

SEQ ID NO: 31570 - DNA, 25 bp, E. coli
cctgtactcagtgtgcacagactga

SEQ ID NO: 31571 - DNA, 25 bp, E. coli
cgggtgattctggtgcctgaatcac

SEQ ID NO: 31572 - DNA, 25 bp, E. coli
cattgcctgtactcagtctgcacag

SEQ ID NO: 31573 - DNA, 25 bp, E. coli
cattgcctgtacacagtctgcacag

SEQ ID NO: 31574 - DNA, 25 bp, E. coli
cgggtgattctgctgcctgaatcac

SEQ ID NO: 31575 - DNA, 25 bp, E. coli
gtcgggtgattctggtgcctgaatc

SEQ ID NO: 31576 - DNA, 25 bp, E. coli
gtcgggtgattcaggtgcctgaatc

SEQ ID NO: 31577 - DNA, 25 bp, E. coli
aagttaccgctgaaggcattggccg

SEQ ID NO: 31578 - DNA, 25 bp, E. coli
aagttaccgctgtaggcattggccg

SEQ ID NO: 31579 - DNA, 25 bp, E. coli
caaatatgcgatcatcggcgacccg

SEQ ID NO: 31580 - DNA, 25 bp, E. coli
caaatatgcgatgatcggcgacccg

SEQ ID NO: 31581 - DNA, 25 bp, E. coli
caaagcatggcagagcagctctgaa

SEQ ID NO: 31582 - DNA, 25 bp, E. coli
caaagcatggcacagcagctctgaa

SEQ ID NO: 31583 - DNA, 25 bp, E. coli
catgcgtgaagatgaaggtctggct

SEQ ID NO: 31584 - DNA, 25 bp, E. coli
catgcgtgaagaagaaggtctggct

SEQ ID NO: 31585 - DNA, 25 bp, E. coli
aaaaagataccgaaggccgctggag

SEQ ID NO: 31586 - DNA, 25 bp, E. coli
aaaaagataccgtaggccgctggag

SEQ ID NO: 31587 - DNA, 25 bp, E. coli
tgacccgtaactacgacaacatgcg

SEQ ID NO: 31588 - DNA, 25 bp, E. coli
tgacccgtaacttcgacaacatgcg

SEQ ID NO: 31589 - DNA, 25 bp, E. coli
tcatccaggcaaacgaagttaccgc

SEQ ID NO: 31590 - DNA, 25 bp, E. coli
tcatccaggcaatcgaagttaccgc

SEQ ID NO: 31591 - DNA, 25 bp, E. coli
gcgtctgacctggtgcgtaaaatca

SEQ ID NO: 31592 - DNA, 25 bp, E. coli
gcgtctgacctgctgcgtaaaatca

SEQ ID NO: 31593 - DNA, 25 bp, E. coli
gactttactttcgtatgcccgaccg

SEQ ID NO: 31594 - DNA, 25 bp, E. coli
gactttactttcctatgcccgaccg

SEQ ID NO: 31595 - DNA, 25 bp, E. coli
ccgaactgggtgacgttgctgacca

SEQ ID NO: 31596 - DNA, 25 bp, E. coli
ccgaactgggtgtcgttgctgacca

SEQ ID NO: 31597 - DNA, 25 bp, E. coli
gcgaccttcgttcttgacccgcagg

SEQ ID NO: 31598 - DNA, 25 bp, E. coli
gcgaccttcgttgttgacccgcagg

SEQ ID NO: 31599 - DNA, 25 bp, E. coli
caaagatgtcctctgtttaaaagtg

SEQ ID NO: 31600 - DNA, 25 bp, E. coli
aagatgtcctgtctttaaaagtgat

SEQ ID NO: 31601 - DNA, 25 bp, E. coli
catcaaagatgtgctgtgtttaaaa

SEQ ID NO: 31602 - DNA, 25 bp, E. coli
catcaaagatgtcctgtgtttaaaa

SEQ ID NO: 31603 - DNA, 25 bp, E. coli
aaagatgtcctgagtttaaaagtga

SEQ ID NO: 31604 - DNA, 25 bp, E. coli
caaagatgtcctgtgtttaaaagtg

SEQ ID NO: 31605 - DNA, 25 bp, E. coli
aagatgtcctgtgtttaaaagtgat

SEQ ID NO: 31606 - DNA, 25 bp, E. coli
aaagatgtcctgtgtttaaaagtga

SEQ ID NO: 31607 - DNA, 25 bp, E. coli
tatcatcaaagaagtcctgtgttta

SEQ ID NO: 31608 - DNA, 25 bp, E. coli
tatcatcaaagatgtcctgtgttta

SEQ ID NO: 31609 - DNA, 25 bp, E. coli
tgccttatcatctaagatgtcctgt

SEQ ID NO: 31610 - DNA, 25 bp, E. coli
tgccttatcatcaaagatgtcctgt

SEQ ID NO: 31611 - DNA, 25 bp, E. coli
tcatcaaagatgacctgtgtttaaa

SEQ ID NO: 31612 - DNA, 25 bp, E. coli
tcatcaaagatgtcctgtgtttaaa

SEQ ID NO: 31613 - DNA, 25 bp, E. coli
tcaaagatgtcctgtgtttaaaagt

SEQ ID NO: 31614 - DNA, 25 bp, E. coli
tcaaagatgtccagtgtttaaaagt

SEQ ID NO: 31615 - DNA, 25 bp, E. coli
gccttatcatcatagatgtcctgtg

SEQ ID NO: 31616 - DNA, 25 bp, E. coli
ccttatcatcaaagatgtcctgtgt

SEQ ID NO: 31617 - DNA, 25 bp, E. coli
gccttatcatcaaagatgtcctgtg

SEQ ID NO: 31618 - DNA, 25 bp, E. coli
ccttatcatcaatgatgtcctgtgt

SEQ ID NO: 31619 - DNA, 25 bp, E. coli
cttatcatcaaacatgtcctgtgtt

SEQ ID NO: 31620 - DNA, 25 bp, E. coli
cttatcatcaaagatgtcctgtgtt

SEQ ID NO: 31621 - DNA, 25 bp, E. coli
caagcgaagtgtggcgatatttcgg

SEQ ID NO: 31622 - DNA, 25 bp, E. coli
caatatgctcttgattcctgcaagg

SEQ ID NO: 31623 - DNA, 25 bp, E. coli
caatatgctcttcattcctgcaagg

SEQ ID NO: 31624 - DNA, 25 bp, E. coli
caagcgaagtgtcgcgatatttcgg

SEQ ID NO: 31625 - DNA, 25 bp, E. coli
ttacaacttctctttgcctatggca

SEQ ID NO: 31626 - DNA, 25 bp, E. coli
ttacaacttctcattgcctatggca

SEQ ID NO: 31627 - DNA, 25 bp, E. coli
ccatctccggcgagcattacaactt

SEQ ID NO: 31628 - DNA, 25 bp, E. coli
ccatctccggcgtgcattacaactt

SEQ ID NO: 31629 - DNA, 25 bp, E. coli
gcgatatttcggccgctgatgctaa

SEQ ID NO: 31630 - DNA, 25 bp, E. coli
gcgatatttcgggcgctgatgctaa

SEQ ID NO: 31631 - DNA, 25 bp, E. coli
cgcgttattcgcaactactatcgct

SEQ ID NO: 31632 - DNA, 25 bp, E. coli
tcgcaactactaacgcttcggttgg

SEQ ID NO: 31633 - DNA, 25 bp, E. coli
tcgcaactactatcgcttcggttgg

SEQ ID NO: 31634 - DNA, 25 bp, E. coli
cgcgttattcgctactactatcgct

SEQ ID NO: 31635 - DNA, 25 bp, E. coli
ctcttcattcctgcaaggtaaacca

SEQ ID NO: 31636 - DNA, 25 bp, E. coli
ctccggcgtgcaatacaacttctct

SEQ ID NO: 31637 - DNA, 25 bp, E. coli
ctggcaagcgaagtgtggcgatatt

SEQ ID NO: 31638 - DNA, 25 bp, E. coli
ctcttcattcctccaaggtaaacca

SEQ ID NO: 31639 - DNA, 25 bp, E. coli
ctggcaagcgaactgtggcgatatt

SEQ ID NO: 31640 - DNA, 25 bp, E. coli
ctccggcgtgcattacaacttctct

SEQ ID NO: 31641 - DNA, 25 bp, E. coli
ggcgcgtctccgccaatatgctctt

SEQ ID NO: 31642 - DNA, 25 bp, E. coli
ggcgcgtctccggcaatatgctctt

SEQ ID NO: 31643 - DNA, 25 bp, E. coli
tactatggaaaatgtcgagaaacgc

SEQ ID NO: 31644 - DNA, 25 bp, E. coli
tactatggaaaaagtcgagaaacgc

SEQ ID NO: 31645 - DNA, 25 bp, E. coli
aactacctgatgtcccttactatgg

SEQ ID NO: 31646 - DNA, 25 bp, E. coli
aactacctgatgacccttactatgg

SEQ ID NO: 31647 - DNA, 25 bp, E. coli
aaagtcgagaaacgcctgacggatc

SEQ ID NO: 31648 - DNA, 25 bp, E. coli
aaagtcgagaaaggcctgacggatc

SEQ ID NO: 31649 - DNA, 25 bp, E. coli
taccagggagctcctggcaactacc

SEQ ID NO: 31650 - DNA, 25 bp, E. coli
taccagggagctgctggcaactacc

SEQ ID NO: 31651 - DNA, 25 bp, E. coli
tatggaaaaagtcgagaaacgcctg

SEQ ID NO: 31652 - DNA, 25 bp, E. coli
tacctgatgtccgttactatggaaa

SEQ ID NO: 31653 - DNA, 25 bp, E. coli
tatggaaaaagtggagaaacgcctg

SEQ ID NO: 31654 - DNA, 25 bp, E. coli
tacctgatgtcccttactatggaaa

SEQ ID NO: 31655 - DNA, 25 bp, E. coli
gaaaaagtcgagaaacgcctgacgg

SEQ ID NO: 31656 - DNA, 25 bp, E. coli
gaaaaagtcgagtaacgcctgacgg

SEQ ID NO: 31657 - DNA, 25 bp, E. coli
cggatctcagcgctgctcttgctca

SEQ ID NO: 31658 - DNA, 25 bp, E. coli
cggatctcagcggtgctcttgctca

SEQ ID NO: 31659 - DNA, 25 bp, E. coli
ggcaactacctgttgtcccttacta

SEQ ID NO: 31660 - DNA, 25 bp, E. coli
ggcaactacctgatgtcccttacta

SEQ ID NO: 31661 - DNA, 25 bp, E. coli
gagaaacgcctgtcggatctcagcg

SEQ ID NO: 31662 - DNA, 25 bp, E. coli
tgtcccttactatggaaaaagtcga

SEQ ID NO: 31663 - DNA, 25 bp, E. coli
gagaaacgcctgacggatctcagcg

SEQ ID NO: 31664 - DNA, 25 bp, E. coli
tgtcccttactaaggaaaaagtcga

SEQ ID NO: 31665 - DNA, 25 bp, E. coli
catctgctggcacctgaggtgtgta

SEQ ID NO: 31666 - DNA, 25 bp, E. coli
catctgctggcagctgaggtgtgta

SEQ ID NO: 31667 - DNA, 25 bp, E. coli
tacgcaatagcaagtttgtggtggc

SEQ ID NO: 31668 - DNA, 25 bp, E. coli
aggtgtgtattgttgttggcgcttc

SEQ ID NO: 31669 - DNA, 25 bp, E. coli
aggtgtgtattgatgttggcgcttc

SEQ ID NO: 31670 - DNA, 25 bp, E. coli
aaagtgattggtttttccggacatc

SEQ ID NO: 31671 - DNA, 25 bp, E. coli
aaagtgattggtatttccggacatc

SEQ ID NO: 31672 - DNA, 25 bp, E. coli
tacgcaatagcatgtttgtggtggc

SEQ ID NO: 31673 - DNA, 25 bp, E. coli
ttcacaggcagaagttggcgtggtt

SEQ ID NO: 31674 - DNA, 25 bp, E. coli
ttccggacatctcctggcacctgag

SEQ ID NO: 31675 - DNA, 25 bp, E. coli
ttcacaggcagatgttggcgtggtt

SEQ ID NO: 31676 - DNA, 25 bp, E. coli
ttccggacatctgctggcacctgag

SEQ ID NO: 31677 - DNA, 25 bp, E. coli
tggtatttccggtcatctgctggca

SEQ ID NO: 31678 - DNA, 25 bp, E. coli
gcggtattttcagaggcagatgttg

SEQ ID NO: 31679 - DNA, 25 bp, E. coli
gcggtattttcacaggcagatgttg

SEQ ID NO: 31680 - DNA, 25 bp, E. coli
gcaagtttgtggtggcgattaatca

SEQ ID NO: 31681 - DNA, 25 bp, E. coli
gcaagtttgtggaggcgattaatca

SEQ ID NO: 31682 - DNA, 25 bp, E. coli
tggcgattaatcttgacgccagcgc

SEQ ID NO: 31683 - DNA, 25 bp, E. coli
tggtatttccggacatctgctggca

SEQ ID NO: 31684 - DNA, 25 bp, E. coli
tggcgattaatcatgacgccagcgc

SEQ ID NO: 31685 - DNA, 25 bp, E. coli
taatggcgggcgtacgcaatagcaa

SEQ ID NO: 31686 - DNA, 25 bp, E. coli
taatggcgggcgaacgcaatagcaa

SEQ ID NO: 31687 - DNA, 25 bp, E. coli
taaaggacgtggtctggaacccagc

SEQ ID NO: 31688 - DNA, 25 bp, E. coli
taaaggacgtggactggaacccagc

SEQ ID NO: 31689 - DNA, 25 bp, E. coli
tttgccgaaaggatgattcagcacc

SEQ ID NO: 31690 - DNA, 25 bp, E. coli
tatcagggagagtaatgagcatgtc

SEQ ID NO: 31691 - DNA, 25 bp, E. coli
tatcagggagagaaatgagcatgtc

SEQ ID NO: 31692 - DNA, 25 bp, E. coli
tttgccgaaaggttgattcagcacc

SEQ ID NO: 31693 - DNA, 25 bp, E. coli
tgtttcgaatcgacgcacgagatgc

SEQ ID NO: 31694 - DNA, 25 bp, E. coli
tgtttcgaatcgtcgcacgagatgc

SEQ ID NO: 31695 - DNA, 25 bp, E. coli
tcccagggcttgtacgtcgaaattt

SEQ ID NO: 31696 - DNA, 25 bp, E. coli
tcgattccactcagcaggaagggct

SEQ ID NO: 31697 - DNA, 25 bp, E. coli
tcgattccactctgcaggaagggct

SEQ ID NO: 31698 - DNA, 25 bp, E. coli
tcccagggcttgaacgtcgaaattt

SEQ ID NO: 31699 - DNA, 25 bp, E. coli
tcagcagtgttctggatgccgcagt

SEQ ID NO: 31700 - DNA, 25 bp, E. coli
tcagcagtgttcaggatgccgcagt

SEQ ID NO: 31701 - DNA, 25 bp, E. coli
gaagagcgtcgtttacttattccgg

SEQ ID NO: 31702 - DNA, 25 bp, E. coli
gaagagcgtcgtatacttattccgg

SEQ ID NO: 31703 - DNA, 25 bp, E. coli
gagtaccacgcgatttttgccgaaa

SEQ ID NO: 31704 - DNA, 25 bp, E. coli
gaaaagccgtttcctgcctgtcttg

SEQ ID NO: 31705 - DNA, 25 bp, E. coli
gagtaccacgcgttttttgccgaaa

SEQ ID NO: 31706 - DNA, 25 bp, E. coli
gaaaagccgtttgctgcctgtcttg

SEQ ID NO: 31707 - DNA, 25 bp, E. coli
cgcagttgtggatgacgagcagatc

SEQ ID NO: 31708 - DNA, 25 bp, E. coli
cgcagttgtggaagacgagcagatc

SEQ ID NO: 31709 - DNA, 25 bp, E. coli
cacggttatcgtcagctcaaagagg

SEQ ID NO: 31710 - DNA, 25 bp, E. coli
cagagtgtcggttgcccgtttttca

SEQ ID NO: 31711 - DNA, 25 bp, E. coli
cacggttatcgtgagctcaaagagg

SEQ ID NO: 31712 - DNA, 25 bp, E. coli
cactgcaagcctagttatagcaaga

SEQ ID NO: 31713 - DNA, 25 bp, E. coli
cactgcaagccttgttatagcaaga

SEQ ID NO: 31714 - DNA, 25 bp, E. coli
cagagtgtcggtagcccgtttttca

SEQ ID NO: 31715 - DNA, 25 bp, E. coli
ttaacaaggatggacacggaaacgg

SEQ ID NO: 31716 - DNA, 25 bp, E. coli
ttaacaaggatgcacacggaaacgg

SEQ ID NO: 31717 - DNA, 25 bp, E. coli
tcagctcaaagaggcgcagagtgtc

SEQ ID NO: 31718 - DNA, 25 bp, E. coli
tcagctcaaagacgcgcagagtgtc

SEQ ID NO: 31719 - DNA, 25 bp, E. coli
ccattgctgcgtcgatgatcggtcg

SEQ ID NO: 31720 - DNA, 25 bp, E. coli
ccattgctgcgtggatgatcggtcg

SEQ ID NO: 31721 - DNA, 25 bp, E. coli
gaaacggcctcattattccactgca

SEQ ID NO: 31722 - DNA, 25 bp, E. coli
gaaatatttccatctaccggtaagg

SEQ ID NO: 31723 - DNA, 25 bp, E. coli
gaaacagactggctattactctcca

SEQ ID NO: 31724 - DNA, 25 bp, E. coli
gaaacggcctcaatattccactgca

SEQ ID NO: 31725 - DNA, 25 bp, E. coli
gaaacagactgggtattactctcca

SEQ ID NO: 31726 - DNA, 25 bp, E. coli
gaaatatttccaactaccggtaagg

SEQ ID NO: 31727 - DNA, 25 bp, E. coli
cccgctaactgcgtgaaagatcaat

SEQ ID NO: 31728 - DNA, 25 bp, E. coli
cccgctaactgcctgaaagatcaat

SEQ ID NO: 31729 - DNA, 25 bp, E. coli
gatcggtcgggctaaatgggttatt

SEQ ID NO: 31730 - DNA, 25 bp, E. coli
gatcggtcgggcaaaatgggttatt

SEQ ID NO: 31731 - DNA, 25 bp, E. coli
taacgtttcgcctggtattggttca

SEQ ID NO: 31732 - DNA, 25 bp, E. coli
tactgccgctcttcattctggttgg

SEQ ID NO: 31733 - DNA, 25 bp, E. coli
tactgccgctctacattctggttgg

SEQ ID NO: 31734 - DNA, 25 bp, E. coli
taacgtttcgccaggtattggttca

SEQ ID NO: 31735 - DNA, 25 bp, E. coli
tatgcctggcatgatacagtgcccc

SEQ ID NO: 31736 - DNA, 25 bp, E. coli
tatgcctggcatcatacagtgcccc

SEQ ID NO: 31737 - DNA, 25 bp, E. coli
tattgattttcgcactcagctcctg

SEQ ID NO: 31738 - DNA, 25 bp, E. coli
tattgattttcggactcagctcctg

SEQ ID NO: 31739 - DNA, 25 bp, E. coli
tttcaagctactggccgctgcaggc

SEQ ID NO: 31740 - DNA, 25 bp, E. coli
tttcaagctactcgccgctgcaggc

SEQ ID NO: 31741 - DNA, 25 bp, E. coli
tgatactgctgattgcctcgctggg

SEQ ID NO: 31742 - DNA, 25 bp, E. coli
tgatactgctgaatgcctcgctggg

SEQ ID NO: 31743 - DNA, 25 bp, E. coli
tgcgctcggcagcatgataaacctg

SEQ ID NO: 31744 - DNA, 25 bp, E. coli
tgcgctcggcaggatgataaacctg

SEQ ID NO: 31745 - DNA, 25 bp, E. coli
tcaccttaccgctgctctggcttgg

SEQ ID NO: 31746 - DNA, 25 bp, E. coli
gtttcacaacttctgcaacgccgga

SEQ ID NO: 31747 - DNA, 25 bp, E. coli
gtttcacaacttgtgcaacgccgga

SEQ ID NO: 31748 - DNA, 25 bp, E. coli
gggcgtctggtttgtttgtcacaaa

SEQ ID NO: 31749 - DNA, 25 bp, E. coli
gggcgtctggttagtttgtcacaaa

SEQ ID NO: 31750 - DNA, 25 bp, E. coli
tcacaaagagggattgggctacggt

SEQ ID NO: 31751 - DNA, 25 bp, E. coli
tcacaaagagggtttgggctacggt

SEQ ID NO: 31752 - DNA, 25 bp, E. coli
tcaccttaccgcagctctggcttgg

SEQ ID NO: 31753 - DNA, 25 bp, E. coli
cagcgtaacaccttcgaaacgcaac

SEQ ID NO: 31754 - DNA, 25 bp, E. coli
cagcgtaacaccatcgaaacgcaac

SEQ ID NO: 31755 - DNA, 25 bp, E. coli
catgagaaagaaccacaacccggtg

SEQ ID NO: 31756 - DNA, 25 bp, E. coli
catgagaaagaagcacaacccggtg

SEQ ID NO: 31757 - DNA, 25 bp, E. coli
taaagtcaccttaaagcatgttcgt

SEQ ID NO: 31758 - DNA, 25 bp, E. coli
taaagtcacctttaagcatgttcgt

SEQ ID NO: 31759 - DNA, 25 bp, E. coli
aaattattctcggtgtaggtcaaca

SEQ ID NO: 31760 - DNA, 25 bp, E. coli
aaattattctcgctgtaggtcaaca

SEQ ID NO: 31761 - DNA, 25 bp, E. coli
taccaggtgaacaaacgatagcggc

SEQ ID NO: 31762 - DNA, 25 bp, E. coli
taccaggtgaactaacgatagcggc

SEQ ID NO: 31763 - DNA, 25 bp, E. coli
ttatcgagcggttccgggttatcgc

SEQ ID NO: 31764 - DNA, 25 bp, E. coli
ttttttccgcactggaaccgcagcg

SEQ ID NO: 31765 - DNA, 25 bp, E. coli
ttatcgagcggtaccgggttatcgc

SEQ ID NO: 31766 - DNA, 25 bp, E. coli
ttttttccgcacaggaaccgcagcg

SEQ ID NO: 31767 - DNA, 25 bp, E. coli
gaaacgcaacattaccagacccgcg

SEQ ID NO: 31768 - DNA, 25 bp, E. coli
gaaacgcaacataaccagacccgcg

SEQ ID NO: 31769 - DNA, 25 bp, E. coli
cgatagcggcggacaaaattattct

SEQ ID NO: 31770 - DNA, 25 bp, E. coli
cgatagcggcggtcaaaattattct

SEQ ID NO: 31771 - DNA, 25 bp, E. coli
gtaggtcaacatgccgaacttgctg

SEQ ID NO: 31772 - DNA, 25 bp, E. coli
gtaggtcaacatcccgaacttgctg

SEQ ID NO: 31773 - DNA, 25 bp, E. coli
taagcatgttcgattaccaggtgaa

SEQ ID NO: 31774 - DNA, 25 bp, E. coli
taagcatgttcgtttaccaggtgaa

SEQ ID NO: 31775 - DNA, 25 bp, E. coli
aaccaggtgaacagcgtcgtgctga

SEQ ID NO: 31776 - DNA, 25 bp, E. coli
caaaccgctttgagcggtgggagcc

SEQ ID NO: 31777 - DNA, 25 bp, E. coli
caaaccgctttgtgcggtgggagcc

SEQ ID NO: 31778 - DNA, 25 bp, E. coli
cagagactgactggctggcagataa

SEQ ID NO: 31779 - DNA, 25 bp, E. coli
catcacttacaatcctggctgccgg

SEQ ID NO: 31780 - DNA, 25 bp, E. coli
cagagactgactcgctggcagataa

SEQ ID NO: 31781 - DNA, 25 bp, E. coli
catcacttacaaacctggctgccgg

SEQ ID NO: 31782 - DNA, 25 bp, E. coli
aaccaggtgaactgcgtcgtgctga

SEQ ID NO: 31783 - DNA, 25 bp, E. coli
tgagacagcaaatggtaagcacgct

SEQ ID NO: 31784 - DNA, 25 bp, E. coli
tgagacagcaaaaggtaagcacgct

SEQ ID NO: 31785 - DNA, 25 bp, E. coli
tcctggcgaagttcacaaaccgctt

SEQ ID NO: 31786 - DNA, 25 bp, E. coli
tcctggcgaagtacacaaaccgctt

SEQ ID NO: 31787 - DNA, 25 bp, E. coli
gaacttcgcgaagcaattgagtaca

SEQ ID NO: 31788 - DNA, 25 bp, E. coli
gaacttcgcgaaccaattgagtaca

SEQ ID NO: 31789 - DNA, 25 bp, E. coli
cccgctcaggtacggaaagcagtag

SEQ ID NO: 31790 - DNA, 25 bp, E. coli
cccgctcaggtagggaaagcagtag

SEQ ID NO: 31791 - DNA, 25 bp, E. coli
gatttctgaggatacgactgaacca

SEQ ID NO: 31792 - DNA, 25 bp, E. coli
gatttctgaggaaacgactgaacca

SEQ ID NO: 31793 - DNA, 25 bp, E. coli
ggatgacatttagcacgcaaccagc

SEQ ID NO: 31794 - DNA, 25 bp, E. coli
ggatgacatttaccacgcaaccagc

SEQ ID NO: 31795 - DNA, 25 bp, E. coli
taagcacgctatagacggcgaccgc

SEQ ID NO: 31796 - DNA, 25 bp, E. coli
taagcacgctattgacggcgaccgc

SEQ ID NO: 31797 - DNA, 25 bp, E. coli
tatgttcgaccggagcgtaaggcgc

SEQ ID NO: 31798 - DNA, 25 bp, E. coli
tatgttcgaccgcagcgtaaggcgc

SEQ ID NO: 31799 - DNA, 25 bp, E. coli
ttagcctggcccctgagtgaagcaa

SEQ ID NO: 31800 - DNA, 25 bp, E. coli
tttgcgttaattgaggcgggcctac

SEQ ID NO: 31801 - DNA, 25 bp, E. coli
ttagcctggcccgtgagtgaagcaa

SEQ ID NO: 31802 - DNA, 25 bp, E. coli
tttgcgttaattcaggcgggcctac

SEQ ID NO: 31803 - DNA, 25 bp, E. coli
tttattgcagcctaagcgagccgtg

SEQ ID NO: 31804 - DNA, 25 bp, E. coli
ttgcaatttcggtacaaagcgtggg

SEQ ID NO: 31805 - DNA, 25 bp, E. coli
ttgcaatttcggaacaaagcgtggg

SEQ ID NO: 31806 - DNA, 25 bp, E. coli
tttattgcagccaaagcgagccgtg

SEQ ID NO: 31807 - DNA, 25 bp, E. coli
tgagtgcggtgaagcgttctccaca

SEQ ID NO: 31808 - DNA, 25 bp, E. coli
tgagtgcggtgatgcgttctccaca

SEQ ID NO: 31809 - DNA, 25 bp, E. coli
tctgcaatttctcgtcgcgggtgac

SEQ ID NO: 31810 - DNA, 25 bp, E. coli
tcggcagttggaacgcgcttttcac

SEQ ID NO: 31811 - DNA, 25 bp, E. coli
tcggcagttggatcgcgcttttcac

SEQ ID NO: 31812 - DNA, 25 bp, E. coli
tctgcaatttctggtcgcgggtgac

SEQ ID NO: 31813 - DNA, 25 bp, E. coli
gaagaagccaaatctcaaagtcgcg

SEQ ID NO: 31814 - DNA, 25 bp, E. coli
gaagaagccaaaactcaaagtcgcg

SEQ ID NO: 31815 - DNA, 25 bp, E. coli
gactggcaactgctgcggcaaatta

SEQ ID NO: 31816 - DNA, 25 bp, E. coli
ctgtttgaaaaacgctggcatccct

SEQ ID NO: 31817 - DNA, 25 bp, E. coli
ctgtttgaaaaaggctggcatccct

SEQ ID NO: 31818 - DNA, 25 bp, E. coli
gactggcaactggtgcggcaaatta

SEQ ID NO: 31819 - DNA, 25 bp, E. coli
caacctgtttggagaggatccggct

SEQ ID NO: 31820 - DNA, 25 bp, E. coli
caacctgtttggtgaggatccggct

SEQ ID NO: 31821 - DNA, 25 bp, E. coli
taaagctcgtgatgaagccattgcg

SEQ ID NO: 31822 - DNA, 25 bp, E. coli
taaacctgctatttggcggcaagcg

SEQ ID NO: 31823 - DNA, 25 bp, E. coli
taaagctcgtgaagaagccattgcg

SEQ ID NO: 31824 - DNA, 25 bp, E. coli
taaacctgctatatggcggcaagcg

SEQ ID NO: 31825 - DNA, 25 bp, E. coli
tatgggtgacaattacgtcgtggcg

SEQ ID NO: 31826 - DNA, 25 bp, E. coli
tatgccaggtatcgcgggtatcgtc

SEQ ID NO: 31827 - DNA, 25 bp, E. coli
tatgggtgacaaatacgtcgtggcg

SEQ ID NO: 31828 - DNA, 25 bp, E. coli
tatgccaggtatggcgggtatcgtc

SEQ ID NO: 31829 - DNA, 25 bp, E. coli
tgttcagatcacaggtgcgcgcgga

SEQ ID NO: 31830 - DNA, 25 bp, E. coli
tgttcagatcactggtgcgcgcgga

SEQ ID NO: 31831 - DNA, 25 bp, E. coli
cctttgtggaagaacgtcatgctga

SEQ ID NO: 31832 - DNA, 25 bp, E. coli
cctttgtggaagtacgtcatgctga

SEQ ID NO: 31833 - DNA, 25 bp, E. coli
gcgtaccgggcgactctgaagtgaa

SEQ ID NO: 31834 - DNA, 25 bp, E. coli
gcgtaccgggcgtctctgaagtgaa

SEQ ID NO: 31835 - DNA, 25 bp, E. coli
ggtattcaggactctgcgcgtgcga

SEQ ID NO: 31836 - DNA, 25 bp, E. coli
ggtattcaggacactgcgcgtgcga

SEQ ID NO: 31837 - DNA, 25 bp, E. coli
tggaagtggataaggacaccgcgct

SEQ ID NO: 31838 - DNA, 25 bp, E. coli
tggaagtggatatggacaccgcgct

SEQ ID NO: 31839 - DNA, 25 bp, E. coli
gaccgtatcgttcttgaactgccag

SEQ ID NO: 31840 - DNA, 25 bp, E. coli
gaccgtatcgttgttgaactgccag

SEQ ID NO: 31841 - DNA, 25 bp, E. coli
attattttcttgtgccgggaggacg

SEQ ID NO: 31842 - DNA, 25 bp, E. coli
attattttcttgagccgggaggacg

SEQ ID NO: 31843 - DNA, 25 bp, E. coli
acttacagctcgcttgggatatcac

SEQ ID NO: 31844 - DNA, 25 bp, E. coli
acttacagctcggttgggatatcac

SEQ ID NO: 31845 - DNA, 25 bp, E. coli
tattttacggtgcatgactggctgc

SEQ ID NO: 31846 - DNA, 25 bp, E. coli
ttatgcatgcagatggcctgggcca

SEQ ID NO: 31847 - DNA, 25 bp, E. coli
ttatgcatgcagttggcctgggcca

SEQ ID NO: 31848 - DNA, 25 bp, E. coli
tattttacggtggatgactggctgc

SEQ ID NO: 31849 - DNA, 25 bp, E. coli
tctgtatcatcgcttctgggcggaa

SEQ ID NO: 31850 - DNA, 25 bp, E. coli
tctgtatcatcggttctgggcggaa

SEQ ID NO: 31851 - DNA, 25 bp, E. coli
gggtcggcggcatatccaaaaccgt

SEQ ID NO: 31852 - DNA, 25 bp, E. coli
gggtcggcggcaaatccaaaaccgt

SEQ ID NO: 31853 - DNA, 25 bp, E. coli
gaaacctggtgatacgctggtgcta

SEQ ID NO: 31854 - DNA, 25 bp, E. coli
gaaacctggtgaaacgctggtgcta

SEQ ID NO: 31855 - DNA, 25 bp, E. coli
gataaagcacatgccattgcgcaga

SEQ ID NO: 31856 - DNA, 25 bp, E. coli
gataaagcacatcccattgcgcaga

SEQ ID NO: 31857 - DNA, 25 bp, E. coli
taacactgctaaggatgcgcaacgg

SEQ ID NO: 31858 - DNA, 25 bp, E. coli
tcagcggcgtacgatgaaacctggt

SEQ ID NO: 31859 - DNA, 25 bp, E. coli
taacactgctaacgatgcgcaacgg

SEQ ID NO: 31860 - DNA, 25 bp, E. coli
tcagcggcgtaccatgaaacctggt

SEQ ID NO: 31861 - DNA, 25 bp, E. coli
gaccttccgcgtttgtttgccagag

SEQ ID NO: 31862 - DNA, 25 bp, E. coli
gaccttccgcgtatgtttgccagag

SEQ ID NO: 31863 - DNA, 25 bp, E. coli
aaaggtgatgaggtgttatgcgccc

SEQ ID NO: 31864 - DNA, 25 bp, E. coli
aaaggtgatgagctgttatgcgccc

SEQ ID NO: 31865 - DNA, 25 bp, E. coli
aaatctcgcattaacccggtggtca

SEQ ID NO: 31866 - DNA, 25 bp, E. coli
aaatctcgcatttacccggtggtca

SEQ ID NO: 31867 - DNA, 25 bp, E. coli
tattactgagcaaaaacggctggag

SEQ ID NO: 31868 - DNA, 25 bp, E. coli
tattactgagcataaacggctggag

SEQ ID NO: 31869 - DNA, 25 bp, E. coli
ttttcgaaggtatcgaagcgccggc

SEQ ID NO: 31870 - DNA, 25 bp, E. coli
ttttcgaaggtaacgaagcgccggc

SEQ ID NO: 31871 - DNA, 25 bp, E. coli
gaaaaatgatggtcgcaaccgcgtg

SEQ ID NO: 31872 - DNA, 25 bp, E. coli
gaaactatccgcctaagcgtggcaa

SEQ ID NO: 31873 - DNA, 25 bp, E. coli
gaaaaatgatggacgcaaccgcgtg

SEQ ID NO: 31874 - DNA, 25 bp, E. coli
gaaactatccgcgtaagcgtggcaa

SEQ ID NO: 31875 - DNA, 25 bp, E. coli
ccgtcagcattgctgtggcgcatca

SEQ ID NO: 31876 - DNA, 25 bp, E. coli
ccgtcagcattggtgtggcgcatca

SEQ ID NO: 31877 - DNA, 25 bp, E. coli
gggtttaaaagcgagtcgctcggca

SEQ ID NO: 31878 - DNA, 25 bp, E. coli
gggtttaaaagccagtcgctcggca

SEQ ID NO: 31879 - DNA, 25 bp, E. coli
gatcgtttcgccctttgaggaacag

SEQ ID NO: 31880 - DNA, 25 bp, E. coli
gatgatgctttgaatcgggcgaaaa

SEQ ID NO: 31881 - DNA, 25 bp, E. coli
gatggttcgactggtcatgtgcaga

SEQ ID NO: 31882 - DNA, 25 bp, E. coli
gatggttcgactcgtcatgtgcaga

SEQ ID NO: 31883 - DNA, 25 bp, E. coli
gatgatgctttgtatcgggcgaaaa

SEQ ID NO: 31884 - DNA, 25 bp, E. coli
gatcgtttcgccgtttgaggaacag

SEQ ID NO: 31885 - DNA, 25 bp, E. coli
tagcggacgcatgacactggatacg

SEQ ID NO: 31886 - DNA, 25 bp, E. coli
tagcggacgcatcacactggatacg

SEQ ID NO: 31887 - DNA, 25 bp, E. coli
ttcaccaccgcgcaaaaaagagcgg

SEQ ID NO: 31888 - DNA, 25 bp, E. coli
ttcaccaccgcggaaaaaagagcgg

SEQ ID NO: 31889 - DNA, 25 bp, E. coli
ttggtctgacatcggaagcaatgca

SEQ ID NO: 31890 - DNA, 25 bp, E. coli
ttggtctgacatgggaagcaatgca

SEQ ID NO: 31891 - DNA, 25 bp, E. coli
tgtttgacatttggcgccagggtaa

SEQ ID NO: 31892 - DNA, 25 bp, E. coli
tgtttgacatttcgcgccagggtaa

SEQ ID NO: 31893 - DNA, 25 bp, E. coli
gaacaggcgatgttgctaaaagcca

SEQ ID NO: 31894 - DNA, 25 bp, E. coli
gaacaggcgatgatgctaaaagcca

SEQ ID NO: 31895 - DNA, 25 bp, E. coli
ccctggcgcggtcacgattatcgat

SEQ ID NO: 31896 - DNA, 25 bp, E. coli
ccctggcgcggtgacgattatcgat

SEQ ID NO: 31897 - DNA, 25 bp, E. coli
ctgccggacgtgtactgtttgacat

SEQ ID NO: 31898 - DNA, 25 bp, E. coli
ctgccggacgtgaactgtttgacat

SEQ ID NO: 31899 - DNA, 25 bp, E. coli
gatacggtggaagatgagatcaacc

SEQ ID NO: 31900 - DNA, 25 bp, E. coli
gatacggtggaacatgagatcaacc

SEQ ID NO: 31901 - DNA, 25 bp, E. coli
ggaccttcaccttgccaggattacg

SEQ ID NO: 31902 - DNA, 25 bp, E. coli
ggattacgccaacgccaggaagata

SEQ ID NO: 31903 - DNA, 25 bp, E. coli
ggaccttcacctagccaggattacg

SEQ ID NO: 31904 - DNA, 25 bp, E. coli
ggattacgccaaggccaggaagata

SEQ ID NO: 31905 - DNA, 25 bp, E. coli
gaccggtgcgggtaagtcatttttg

SEQ ID NO: 31906 - DNA, 25 bp, E. coli
gaccggtgcgggaaagtcatttttg

SEQ ID NO: 31907 - DNA, 25 bp, E. coli
cagattcagctgattgagcaggcgc

SEQ ID NO: 31908 - DNA, 25 bp, E. coli
catcatgcgtgacatccgcgaggcg

SEQ ID NO: 31909 - DNA, 25 bp, E. coli
catctggaactgctggcgaaaacgc

SEQ ID NO: 31910 - DNA, 25 bp, E. coli
catcatgcgtgagatccgcgaggcg

SEQ ID NO: 31911 - DNA, 25 bp, E. coli
catctggaactggtggcgaaaacgc

SEQ ID NO: 31912 - DNA, 25 bp, E. coli
cagattcagctgtttgagcaggcgc

SEQ ID NO: 31913 - DNA, 25 bp, E. coli
tatgacgaactctgtaccatgctcg

SEQ ID NO: 31914 - DNA, 25 bp, E. coli
tatgacgaactcagtaccatgctcg

SEQ ID NO: 31915 - DNA, 25 bp, E. coli
tatggcatgaaactaccgagcagat

SEQ ID NO: 31916 - DNA, 25 bp, E. coli
tatggcatgaaagtaccgagcagat

SEQ ID NO: 31917 - DNA, 25 bp, E. coli
tatctgctatcacgcggtacgccgc

SEQ ID NO: 31918 - DNA, 25 bp, E. coli
tatctgctatcaggcggtacgccgc

SEQ ID NO: 31919 - DNA, 25 bp, E. coli
tgatcagatgatcgagagcgtctcc

SEQ ID NO: 31920 - DNA, 25 bp, E. coli
tgatcagatgatggagagcgtctcc

SEQ ID NO: 31921 - DNA, 25 bp, E. coli
gccaacggctgatattgaccatcgg

SEQ ID NO: 31922 - DNA, 25 bp, E. coli
gccaacggctgaaattgaccatcgg

SEQ ID NO: 31923 - DNA, 25 bp, E. coli
ccctgctgcggaagttattgcgaaa

SEQ ID NO: 31924 - DNA, 25 bp, E. coli
gcgaaacctggttgaaaacgcccat

SEQ ID NO: 31925 - DNA, 25 bp, E. coli
gcgaaacctggtagaaaacgcccat

SEQ ID NO: 31926 - DNA, 25 bp, E. coli
ccctgctgcggatgttattgcgaaa

SEQ ID NO: 31927 - DNA, 25 bp, E. coli
cattacacagttgcatcacgggcag

SEQ ID NO: 31928 - DNA, 25 bp, E. coli
cattacacagttccatcacgggcag

SEQ ID NO: 31929 - DNA, 25 bp, E. coli
tactggatgcggtgggcatatcacg

SEQ ID NO: 31930 - DNA, 25 bp, E. coli
tactggatgcggagggcatatcacg

SEQ ID NO: 31931 - DNA, 25 bp, E. coli
taccttgtcaattaacgagatatcg

SEQ ID NO: 31932 - DNA, 25 bp, E. coli
taccttgtcaataaacgagatatcg

SEQ ID NO: 31933 - DNA, 25 bp, E. coli
gcgcgcagcctgctgatttctacta

SEQ ID NO: 31934 - DNA, 25 bp, E. coli
cctgctgatttctactaccttgtca

SEQ ID NO: 31935 - DNA, 25 bp, E. coli
gcgcgcagcctggtgatttctacta

SEQ ID NO: 31936 - DNA, 25 bp, E. coli
cctgctgatttcaactaccttgtca

SEQ ID NO: 31937 - DNA, 25 bp, E. coli
gcggtgggcataacacgctccaatc

SEQ ID NO: 31938 - DNA, 25 bp, E. coli
gcggtgggcatatcacgctccaatc

SEQ ID NO: 31939 - DNA, 25 bp, E. coli
gcgaaaccattcacgccatgattca

SEQ ID NO: 31940 - DNA, 25 bp, E. coli
gcgaaaccattctcgccatgattca

SEQ ID NO: 31941 - DNA, 25 bp, E. coli
gaagaggtgggcgaaaccattcacg

SEQ ID NO: 31942 - DNA, 25 bp, E. coli
gaagaggtgggccaaaccattcacg

SEQ ID NO: 31943 - DNA, 25 bp, E. coli
ggtgggcgaaaccattcacgccatg

SEQ ID NO: 31944 - DNA, 25 bp, E. coli
gggcatatcacgctccaatcttgag

SEQ ID NO: 31945 - DNA, 25 bp, E. coli
ggtgggcgaaacgattcacgccatg

SEQ ID NO: 31946 - DNA, 25 bp, E. coli
gggcatatcacggtccaatcttgag

SEQ ID NO: 31947 - DNA, 25 bp, E. coli
gatgcggtgggcttatcacgctcca

SEQ ID NO: 31948 - DNA, 25 bp, E. coli
gtcaattaacgagatatcgcaaatg

SEQ ID NO: 31949 - DNA, 25 bp, E. coli
gtcaattaacgacatatcgcaaatg

SEQ ID NO: 31950 - DNA, 25 bp, E. coli
gatgcggtgggcatatcacgctcca

SEQ ID NO: 31951 - DNA, 25 bp, E. coli
catactattaaggtgccactgccga

SEQ ID NO: 31952 - DNA, 25 bp, E. coli
catactattaagctgccactgccga

SEQ ID NO: 31953 - DNA, 25 bp, E. coli
actatctggcctcgccggatgagac

SEQ ID NO: 31954 - DNA, 25 bp, E. coli
actatctggcctggccggatgagac

SEQ ID NO: 31955 - DNA, 25 bp, E. coli
tattaagctgcctctgccgacgcag

SEQ ID NO: 31956 - DNA, 25 bp, E. coli
tattaagctgccactgccgacgcag

SEQ ID NO: 31957 - DNA, 25 bp, E. coli
tcgccggatgagtccgaaggctttg

SEQ ID NO: 31958 - DNA, 25 bp, E. coli
tcgccggatgagaccgaaggctttg

SEQ ID NO: 31959 - DNA, 25 bp, E. coli
tctacgatagcgagtacaacgattt

SEQ ID NO: 31960 - DNA, 25 bp, E. coli
tctacgatagcgtgtacaacgattt

SEQ ID NO: 31961 - DNA, 25 bp, E. coli
gcgccgcagtgtaccacgaaggcat

SEQ ID NO: 31962 - DNA, 25 bp, E. coli
gctgcatactataaagctgccactg

SEQ ID NO: 31963 - DNA, 25 bp, E. coli
gcgccgcagtgttccacgaaggcat

SEQ ID NO: 31964 - DNA, 25 bp, E. coli
gctgcatactattaagctgccactg

SEQ ID NO: 31965 - DNA, 25 bp, E. coli
cgcagtgttccacgaaggcatgtcg

SEQ ID NO: 31966 - DNA, 25 bp, E. coli
cctcgccggatgtgaccgaaggctt

SEQ ID NO: 31967 - DNA, 25 bp, E. coli
cgagctgcatactattaagctgcca

SEQ ID NO: 31968 - DNA, 25 bp, E. coli
cctcgccggatgagaccgaaggctt

SEQ ID NO: 31969 - DNA, 25 bp, E. coli
cgcagtgttccaggaaggcatgtcg

SEQ ID NO: 31970 - DNA, 25 bp, E. coli
cgagctgcatacaattaagctgcca

SEQ ID NO: 31971 - DNA, 25 bp, E. coli
taactatctggcgtcgccggatgag

SEQ ID NO: 31972 - DNA, 25 bp, E. coli
taactatctggcctcgccggatgag

SEQ ID NO: 31973 - DNA, 25 bp, E. coli
cagggaaagatcttcggtgtgccgt

SEQ ID NO: 31974 - DNA, 25 bp, E. coli
cagggaaagatcatcggtgtgccgt

SEQ ID NO: 31975 - DNA, 25 bp, E. coli
agtcagacgtttgattcaggttctc

SEQ ID NO: 31976 - DNA, 25 bp, E. coli
agtcagacgtttcattcaggttctc

SEQ ID NO: 31977 - DNA, 25 bp, E. coli
aaagatcatcggtgtgccgtaggca

SEQ ID NO: 31978 - DNA, 25 bp, E. coli
aaagatcatcggagtgccgtaggca

SEQ ID NO: 31979 - DNA, 25 bp, E. coli
ttcaggttctcacgggcagattcag

SEQ ID NO: 31980 - DNA, 25 bp, E. coli
ttcaggttctcaggggcagattcag

SEQ ID NO: 31981 - DNA, 25 bp, E. coli
tgccgtaggcacaaagatgcaaaac

SEQ ID NO: 31982 - DNA, 25 bp, E. coli
tgccgtaggcactaagatgcaaaac

SEQ ID NO: 31983 - DNA, 25 bp, E. coli
tcagggaaagatgacagggaaagat

SEQ ID NO: 31984 - DNA, 25 bp, E. coli
tctgcgagtcagtcgtttgattcag

SEQ ID NO: 31985 - DNA, 25 bp, E. coli
tcagggaaagatcacagggaaagat

SEQ ID NO: 31986 - DNA, 25 bp, E. coli
tctgcgagtcagacgtttgattcag

SEQ ID NO: 31987 - DNA, 25 bp, E. coli
gcaaaacgggaccttttgcatgtaa

SEQ ID NO: 31988 - DNA, 25 bp, E. coli
gcaaaacgggacgttttgcatgtaa

SEQ ID NO: 31989 - DNA, 25 bp, E. coli
gcagattcagggtaagatcacaggg

SEQ ID NO: 31990 - DNA, 25 bp, E. coli
gcacaaagatgcaaaacgggacgtt

SEQ ID NO: 31991 - DNA, 25 bp, E. coli
gcagattcagggaaagatcacaggg

SEQ ID NO: 31992 - DNA, 25 bp, E. coli
gcacaaagatgctaaacgggacgtt

SEQ ID NO: 31993 - DNA, 25 bp, E. coli
gatcatcggtgtcccgtaggcacaa

SEQ ID NO: 31994 - DNA, 25 bp, E. coli
gatcatcggtgtgccgtaggcacaa

SEQ ID NO: 31995 - DNA, 25 bp, E. coli
aatgatggtcattgcagtggcggca

SEQ ID NO: 31996 - DNA, 25 bp, E. coli
aatgatggtcatagcagtggcggca

SEQ ID NO: 31997 - DNA, 25 bp, E. coli
cagtagcgagtttggattgccagac

SEQ ID NO: 31998 - DNA, 25 bp, E. coli
cagtagcgagttaggattgccagac

SEQ ID NO: 31999 - DNA, 25 bp, E. coli
tacggatgttatatgtcgcctcgac

SEQ ID NO: 32000 - DNA, 25 bp, E. coli
tacggatgttatttgtcgcctcgac

SEQ ID NO: 32001 - DNA, 25 bp, E. coli
tatctgacgcttttcacctgtggtg

SEQ ID NO: 32002 - DNA, 25 bp, E. coli
tatctgacgcttatcacctgtggtg

SEQ ID NO: 32003 - DNA, 25 bp, E. coli
tattgctgggatcggcgtaagcctc

SEQ ID NO: 32004 - DNA, 25 bp, E. coli
tattgctgggatgggcgtaagcctc

SEQ ID NO: 32005 - DNA, 25 bp, E. coli
tgtttagctcggtgatgcgtgcgca

SEQ ID NO: 32006 - DNA, 25 bp, E. coli
tgtttagctcggagatgcgtgcgca

SEQ ID NO: 32007 - DNA, 25 bp, E. coli
tgccgccgggattttcacactcagt

SEQ ID NO: 32008 - DNA, 25 bp, E. coli
tgccgccgggatattcacactcagt

SEQ ID NO: 32009 - DNA, 25 bp, E. coli
tctggataatgaggatggctcgccg

SEQ ID NO: 32010 - DNA, 25 bp, E. coli
tctggataatgacgatggctcgccg

SEQ ID NO: 32011 - DNA, 25 bp, E. coli
cctcgacgttaatgtggacctgcaa

SEQ ID NO: 32012 - DNA, 25 bp, E. coli
cctcgacgttaaagtggacctgcaa

SEQ ID NO: 32013 - DNA, 25 bp, E. coli
gcgttattcagggagcaattgcaca

SEQ ID NO: 32014 - DNA, 25 bp, E. coli
gcgttattcaggcagcaattgcaca

SEQ ID NO: 32015 - DNA, 25 bp, E. coli
gaatatgcggattactcggcgcgag

SEQ ID NO: 32016 - DNA, 25 bp, E. coli
gaatatgcggataactcggcgcgag

SEQ ID NO: 32017 - DNA, 25 bp, E. coli
caatgtatgctgattcgcgcgggaa

SEQ ID NO: 32018 - DNA, 25 bp, E. coli
caatgtatgctgtttcgcgcgggaa

SEQ ID NO: 32019 - DNA, 25 bp, E. coli
cacacatgtctaaacggaatcttcg

SEQ ID NO: 32020 - DNA, 25 bp, E. coli
cacacatgtctatacggaatcttcg

SEQ ID NO: 32021 - DNA, 25 bp, E. coli
tacgcaactcaattacccacacatg

SEQ ID NO: 32022 - DNA, 25 bp, E. coli
tagggtggtgttttagcataaccgc

SEQ ID NO: 32023 - DNA, 25 bp, E. coli
tagcataaccgcacgatcggatcat

SEQ ID NO: 32024 - DNA, 25 bp, E. coli
tacgcaactcaaatacccacacatg

SEQ ID NO: 32025 - DNA, 25 bp, E. coli
tagcataaccgctcgatcggatcat

SEQ ID NO: 32026 - DNA, 25 bp, E. coli
tagggtggtgttatagcataaccgc

SEQ ID NO: 32027 - DNA, 25 bp, E. coli
ttccgtttgattggtgcttcaaccc

SEQ ID NO: 32028 - DNA, 25 bp, E. coli
ttccgtttgattcgtgcttcaaccc

SEQ ID NO: 32029 - DNA, 25 bp, E. coli
tgttatagcatatccgcacgatcgg

SEQ ID NO: 32030 - DNA, 25 bp, E. coli
tgattcgcgcggcaaatatgggtat

SEQ ID NO: 32031 - DNA, 25 bp, E. coli
tgttatagcataaccgcacgatcgg

SEQ ID NO: 32032 - DNA, 25 bp, E. coli
tgattcgcgcgggaaatatgggtat

SEQ ID NO: 32033 - DNA, 25 bp, E. coli
tcgggtcatataaagggtggtgtta

SEQ ID NO: 32034 - DNA, 25 bp, E. coli
tcgggtcatatatagggtggtgtta

SEQ ID NO: 32035 - DNA, 25 bp, E. coli
gcatcctgttccctttgattggtgc

SEQ ID NO: 32036 - DNA, 25 bp, E. coli
gcatcctgttccgtttgattggtgc

SEQ ID NO: 32037 - DNA, 25 bp, E. coli
gaaatatgggtattatacgcaactc

SEQ ID NO: 32038 - DNA, 25 bp, E. coli
gaaatatgggtaatatacgcaactc

SEQ ID NO: 32039 - DNA, 25 bp, E. coli
taaagaagggttagcgcaagagaag

SEQ ID NO: 32040 - DNA, 25 bp, E. coli
tacggttcgagcagatttacggaca

SEQ ID NO: 32041 - DNA, 25 bp, E. coli
taaagaagggtttgcgcaagagaag

SEQ ID NO: 32042 - DNA, 25 bp, E. coli
tacggttcgagctgatttacggaca

SEQ ID NO: 32043 - DNA, 25 bp, E. coli
tgaaattagcgcgagcctgggcgtc

SEQ ID NO: 32044 - DNA, 25 bp, E. coli
tgaaattagcgccagcctgggcgtc

SEQ ID NO: 32045 - DNA, 25 bp, E. coli
tgcgcaagagaagaaaattaatgac

SEQ ID NO: 32046 - DNA, 25 bp, E. coli
tgcgcaagagaacaaaattaatgac

SEQ ID NO: 32047 - DNA, 25 bp, E. coli
gcaagccgtgtagttcgcgcattat

SEQ ID NO: 32048 - DNA, 25 bp, E. coli
gcaagccgtgtacttcgcgcattat

SEQ ID NO: 32049 - DNA, 25 bp, E. coli
gaaaattaatgaccagcaagccgtg

SEQ ID NO: 32050 - DNA, 25 bp, E. coli
gaaaattaatgagcagcaagccgtg

SEQ ID NO: 32051 - DNA, 25 bp, E. coli
gtacttcgcgcattatccgctgtaa

SEQ ID NO: 32052 - DNA, 25 bp, E. coli
ggttcgagctgatttacggacaatt

SEQ ID NO: 32053 - DNA, 25 bp, E. coli
ggttcgagctgaattacggacaatt

SEQ ID NO: 32054 - DNA, 25 bp, E. coli
gtacttcgcgcaatatccgctgtaa

SEQ ID NO: 32055 - DNA, 25 bp, E. coli
ggcgtctctgataatacggttcgag

SEQ ID NO: 32056 - DNA, 25 bp, E. coli
ggcgtctctgattatacggttcgag

SEQ ID NO: 32057 - DNA, 25 bp, E. coli
taatgaccagcatgccgtgtacttc

SEQ ID NO: 32058 - DNA, 25 bp, E. coli
taatgaccagcaagccgtgtacttc

SEQ ID NO: 32059 - DNA, 25 bp, E. coli
gagcctgggcgtctctgataatacg

SEQ ID NO: 32060 - DNA, 25 bp, E. coli
gagcctgggcgtgtctgataatacg

SEQ ID NO: 32061 - DNA, 25 bp, E. coli
cacggcgcagataagcgcaggtgaa

SEQ ID NO: 32062 - DNA, 25 bp, E. coli
cacggcgcagattagcgcaggtgaa

SEQ ID NO: 32063 - DNA, 25 bp, E. coli
cacccgtcacctttctgctggtggg

SEQ ID NO: 32064 - DNA, 25 bp, E. coli
cacccgtcacctatctgctggtggg

SEQ ID NO: 32065 - DNA, 25 bp, E. coli
cagggtgccccgcaagagaaaacac

SEQ ID NO: 32066 - DNA, 25 bp, E. coli
agcgcaggtgaagcgctgttatcca

SEQ ID NO: 32067 - DNA, 25 bp, E. coli
agcgcaggtgaaccgctgttatcca

SEQ ID NO: 32068 - DNA, 25 bp, E. coli
cagggtgccccggaagagaaaacac

SEQ ID NO: 32069 - DNA, 25 bp, E. coli
aaatcttcgtcaagttcggactgca

SEQ ID NO: 32070 - DNA, 25 bp, E. coli
aaatcttcgtcatgttcggactgca

SEQ ID NO: 32071 - DNA, 25 bp, E. coli
tatgtctgatggttatcacacccgt

SEQ ID NO: 32072 - DNA, 25 bp, E. coli
tatgtctgatggatatcacacccgt

SEQ ID NO: 32073 - DNA, 25 bp, E. coli
ttgacgagtctgtttggtatcaccg

SEQ ID NO: 32074 - DNA, 25 bp, E. coli
ttgacgagtctgattggtatcaccg

SEQ ID NO: 32075 - DNA, 25 bp, E. coli
cctggtgccgctctgtatcaataac

SEQ ID NO: 32076 - DNA, 25 bp, E. coli
cctggtgccgctgtgtatcaataac

SEQ ID NO: 32077 - DNA, 25 bp, E. coli
ctttgttatcgcgtgtatcagtggg

SEQ ID NO: 32078 - DNA, 25 bp, E. coli
cttgaaaggtatgctggctctggcg

SEQ ID NO: 32079 - DNA, 25 bp, E. coli
cttgaaaggtatcctggctctggcg

SEQ ID NO: 32080 - DNA, 25 bp, E. coli
ctttgttatcgcctgtatcagtggg

SEQ ID NO: 32081 - DNA, 25 bp, E. coli
tcagcggcgttgacgagtctgtttg

SEQ ID NO: 32082 - DNA, 25 bp, E. coli
tcagcggcgttgtcgagtctgtttg

SEQ ID NO: 32083 - DNA, 25 bp, E. coli
aattgcctctactctctctccgcgt

SEQ ID NO: 32084 - DNA, 25 bp, E. coli
aattgcctctacactctctccgcgt

SEQ ID NO: 32085 - DNA, 25 bp, E. coli
cagaaaattgccactacactctctc

SEQ ID NO: 32086 - DNA, 25 bp, E. coli
cagaaaattgcctctacactctctc

SEQ ID NO: 32087 - DNA, 25 bp, E. coli
cttcagaaaattgcctctacactct

SEQ ID NO: 32088 - DNA, 25 bp, E. coli
tgcctctacactctctccgcgtgct

SEQ ID NO: 32089 - DNA, 25 bp, E. coli
tgcctctacactgtctccgcgtgct

SEQ ID NO: 32090 - DNA, 25 bp, E. coli
tcagaaaattgcgtctacactctct

SEQ ID NO: 32091 - DNA, 25 bp, E. coli
tcttcagaaaatagcctctacactc

SEQ ID NO: 32092 - DNA, 25 bp, E. coli
tcagaaaattgcctctacactctct

SEQ ID NO: 32093 - DNA, 25 bp, E. coli
tcttcagaaaattgcctctacactc

SEQ ID NO: 32094 - DNA, 25 bp, E. coli
gaaaattgcctcaacactctctccg

SEQ ID NO: 32095 - DNA, 25 bp, E. coli
gaaaattgcctctacactctctccg

SEQ ID NO: 32096 - DNA, 25 bp, E. coli
cttcagaaaattccctctacactct

SEQ ID NO: 32097 - DNA, 25 bp, E. coli
gatcttcagaaatttgcctctacac

SEQ ID NO: 32098 - DNA, 25 bp, E. coli
ggatcttcagaaaattgcctctaca

SEQ ID NO: 32099 - DNA, 25 bp, E. coli
ggatcttcagaatattgcctctaca

SEQ ID NO: 32100 - DNA, 25 bp, E. coli
tggatcttcagaaaattgcctctac

SEQ ID NO: 32101 - DNA, 25 bp, E. coli
tggatcttcagataattgcctctac

SEQ ID NO: 32102 - DNA, 25 bp, E. coli
gatcttcagaaaattgcctctacac

SEQ ID NO: 32103 - DNA, 25 bp, E. coli
gatggatcttcagaaaattgcctct

SEQ ID NO: 32104 - DNA, 25 bp, E. coli
gatggatcttcacaaaattgcctct

SEQ ID NO: 32105 - DNA, 25 bp, E. coli
caatttatctgtattggcagtgcaa

SEQ ID NO: 32106 - DNA, 25 bp, E. coli
caatttatctgttttggcagtgcaa

SEQ ID NO: 32107 - DNA, 25 bp, E. coli
caacctggaggaaaaatacgatttc

SEQ ID NO: 32108 - DNA, 25 bp, E. coli
caacctggaggataaatacgatttc

SEQ ID NO: 32109 - DNA, 25 bp, E. coli
tacgatttcgccgttggaatcaagg

SEQ ID NO: 32110 - DNA, 25 bp, E. coli
tacgatttcgcccttggaatcaagg

SEQ ID NO: 32111 - DNA, 25 bp, E. coli
tcgccgttggaatcaaggttgttct

SEQ ID NO: 32112 - DNA, 25 bp, E. coli
tcgccgttggaaacaaggttgttct

SEQ ID NO: 32113 - DNA, 25 bp, E. coli
tctaccagctgcttcaatttatctg

SEQ ID NO: 32114 - DNA, 25 bp, E. coli
tctaccagctgcatcaatttatctg

SEQ ID NO: 32115 - DNA, 25 bp, E. coli
cctggaggataaatacgatttcgcc

SEQ ID NO: 32116 - DNA, 25 bp, E. coli
cctggaggataattacgatttcgcc

SEQ ID NO: 32117 - DNA, 25 bp, E. coli
gataaatacgatatcgccgttggaa

SEQ ID NO: 32118 - DNA, 25 bp, E. coli
gataaatacgatttcgccgttggaa

SEQ ID NO: 32119 - DNA, 25 bp, E. coli
tggacggcaacctggaggataaata

SEQ ID NO: 32120 - DNA, 25 bp, E. coli
ggttgttctgcattatctaccagct

SEQ ID NO: 32121 - DNA, 25 bp, E. coli
ggttgttctgcaatatctaccagct

SEQ ID NO: 32122 - DNA, 25 bp, E. coli
tggacggcaaccaggaggataaata

SEQ ID NO: 32123 - DNA, 25 bp, E. coli
ggcagtgcaatattcttaatttaac

SEQ ID NO: 32124 - DNA, 25 bp, E. coli
ggcagtgcaataatcttaatttaac

SEQ ID NO: 32125 - DNA, 25 bp, E. coli
ggaatcaaggttgttctgcaatatc

SEQ ID NO: 32126 - DNA, 25 bp, E. coli
ggaatcaaggttcttctgcaatatc

SEQ ID NO: 32127 - DNA, 25 bp, E. coli
aatctgaaaaggcagatcaggcgct

SEQ ID NO: 32128 - DNA, 25 bp, E. coli
aatctgaaaagggagatcaggcgct

SEQ ID NO: 32129 - DNA, 25 bp, E. coli
aaagaagagtatgctttcaacggct

SEQ ID NO: 32130 - DNA, 25 bp, E. coli
aaagggagatcaggcgctaaacagg

SEQ ID NO: 32131 - DNA, 25 bp, E. coli
aaagaagagtatcctttcaacggct

SEQ ID NO: 32132 - DNA, 25 bp, E. coli
aaagggagatcacgcgctaaacagg

SEQ ID NO: 32133 - DNA, 25 bp, E. coli
tatcgggcagaaatctgaaaaggga

SEQ ID NO: 32134 - DNA, 25 bp, E. coli
tatcgggcagaattctgaaaaggga

SEQ ID NO: 32135 - DNA, 25 bp, E. coli
tgctttcaacgggttagctactcgt

SEQ ID NO: 32136 - DNA, 25 bp, E. coli
tgctttcaacggcttagctactcgt

SEQ ID NO: 32137 - DNA, 25 bp, E. coli
tgcgaacccatacccttgcaacaga

SEQ ID NO: 32138 - DNA, 25 bp, E. coli
tgcgaacccatagccttgcaacaga

SEQ ID NO: 32139 - DNA, 25 bp, E. coli
gaaaaggtcttatatcgggcagaaa

SEQ ID NO: 32140 - DNA, 25 bp, E. coli
gaaaaggtcttaaatcgggcagaaa

SEQ ID NO: 32141 - DNA, 25 bp, E. coli
gccttgcaacagttattagtccaca

SEQ ID NO: 32142 - DNA, 25 bp, E. coli
gccttgcaacagatattagtccaca

SEQ ID NO: 32143 - DNA, 25 bp, E. coli
cgctaaacaggacggaaagaagagt

SEQ ID NO: 32144 - DNA, 25 bp, E. coli
cgctaaacaggagggaaagaagagt

SEQ ID NO: 32145 - DNA, 25 bp, E. coli
gtgcaggtgcgatcccatagccttg

SEQ ID NO: 32146 - DNA, 25 bp, E. coli
gtgcaggtgcgaacccatagccttg

SEQ ID NO: 32147 - DNA, 25 bp, E. coli
ggcttagctactggtttaaaggatt

SEQ ID NO: 32148 - DNA, 25 bp, E. coli
ggcttagctactcgtttaaaggatt

SEQ ID NO: 32149 - DNA, 25 bp, E. coli
caagcccagggatcttcatcacatg

SEQ ID NO: 32150 - DNA, 25 bp, E. coli
caagcccagggaacttcatcacatg

SEQ ID NO: 32151 - DNA, 25 bp, E. coli
tacgcaaagaagtttagatgtccag

SEQ ID NO: 32152 - DNA, 25 bp, E. coli
acttcatcacatcacgcgtaaacag

SEQ ID NO: 32153 - DNA, 25 bp, E. coli
acttcatcacatgacgcgtaaacag

SEQ ID NO: 32154 - DNA, 25 bp, E. coli
acaatgtttactctggtgcctgaca

SEQ ID NO: 32155 - DNA, 25 bp, E. coli
acaatgtttactgtggtgcctgaca

SEQ ID NO: 32156 - DNA, 25 bp, E. coli
tagatgtccagaagtattgacgtcc

SEQ ID NO: 32157 - DNA, 25 bp, E. coli
tacgcaaagaagattagatgtccag

SEQ ID NO: 32158 - DNA, 25 bp, E. coli
tagatgtccagatgtattgacgtcc

SEQ ID NO: 32159 - DNA, 25 bp, E. coli
tttcaccgaccaagcccagggaact

SEQ ID NO: 32160 - DNA, 25 bp, E. coli
tttcaccgaccatgcccagggaact

SEQ ID NO: 32161 - DNA, 25 bp, E. coli
tgctcaatctatacgcaaagaagtt

SEQ ID NO: 32162 - DNA, 25 bp, E. coli
tgctcaatctattcgcaaagaagtt

SEQ ID NO: 32163 - DNA, 25 bp, E. coli
ccagatgtattgtcgtccattaaca

SEQ ID NO: 32164 - DNA, 25 bp, E. coli
ccagatgtattgacgtccattaaca

SEQ ID NO: 32165 - DNA, 25 bp, E. coli
gggaacttcatcacatgacgcgtaa

SEQ ID NO: 32166 - DNA, 25 bp, E. coli
ggtgcctgacatatcaccgaccaag

SEQ ID NO: 32167 - DNA, 25 bp, E. coli
gggaacttcatctcatgacgcgtaa

SEQ ID NO: 32168 - DNA, 25 bp, E. coli
ggtgcctgacatttcaccgaccaag

SEQ ID NO: 32169 - DNA, 25 bp, E. coli
tgacgtccattaacacaatgtttac

SEQ ID NO: 32170 - DNA, 25 bp, E. coli
tgacgtccattatcacaatgtttac

SEQ ID NO: 32171 - DNA, 25 bp, E. coli
aatcgccggtgatagatgtctggac

SEQ ID NO: 32172 - DNA, 25 bp, E. coli
aatcgccggtgaaagatgtctggac

SEQ ID NO: 32173 - DNA, 25 bp, E. coli
cattatcccgaaccgttccgcatga

SEQ ID NO: 32174 - DNA, 25 bp, E. coli
cattatcccgaagcgttccgcatga

SEQ ID NO: 32175 - DNA, 25 bp, E. coli
atgacgcgccaatggtgccgagcat

SEQ ID NO: 32176 - DNA, 25 bp, E. coli
atacctggcgcgataccgaaccgct

SEQ ID NO: 32177 - DNA, 25 bp, E. coli
atgacgcgccaaaggtgccgagcat

SEQ ID NO: 32178 - DNA, 25 bp, E. coli
atacctggcgcgttaccgaaccgct

SEQ ID NO: 32179 - DNA, 25 bp, E. coli
agcattgcctttatacctggcgcga

SEQ ID NO: 32180 - DNA, 25 bp, E. coli
agcattgcctttttacctggcgcga

SEQ ID NO: 32181 - DNA, 25 bp, E. coli
tgtccacgttgtgccgatgaacaga

SEQ ID NO: 32182 - DNA, 25 bp, E. coli
tgtccacgttgtcccgatgaacaga

SEQ ID NO: 32183 - DNA, 25 bp, E. coli
gcagaaagatatagatgacgcgcca

SEQ ID NO: 32184 - DNA, 25 bp, E. coli
gcagaaagatattgatgacgcgcca

SEQ ID NO: 32185 - DNA, 25 bp, E. coli
cgttccgcatgacgcagaaagatat

SEQ ID NO: 32186 - DNA, 25 bp, E. coli
cgttccgcatgaggcagaaagatat

SEQ ID NO: 32187 - DNA, 25 bp, E. coli
gtaccagccgcgaacattatcccga

SEQ ID NO: 32188 - DNA, 25 bp, E. coli
gattgaagtgatcgcgaaatcgccg

SEQ ID NO: 32189 - DNA, 25 bp, E. coli
gattgaagtgatggcgaaatcgccg

SEQ ID NO: 32190 - DNA, 25 bp, E. coli
gtaccagccgcgtacattatcccga

SEQ ID NO: 32191 - DNA, 25 bp, E. coli
ggacggtatatcagtgccagcattg

SEQ ID NO: 32192 - DNA, 25 bp, E. coli
ggacggtatatctgtgccagcattg

SEQ ID NO: 32193 - DNA, 25 bp, E. coli
caaatgcagagcgttttacgcgaac

SEQ ID NO: 32194 - DNA, 25 bp, E. coli
caaatgcagagccttttacgcgaac

SEQ ID NO: 32195 - DNA, 25 bp, E. coli
taacagtagcgatatgagcgcgccg

SEQ ID NO: 32196 - DNA, 25 bp, E. coli
aaaaatgtctttgctctacccacgg

SEQ ID NO: 32197 - DNA, 25 bp, E. coli
aaaaatgtctttcctctacccacgg

SEQ ID NO: 32198 - DNA, 25 bp, E. coli
tttgctctacccacggatatgccta

SEQ ID NO: 32199 - DNA, 25 bp, E. coli
tttgctctaccctcggatatgccta

SEQ ID NO: 32200 - DNA, 25 bp, E. coli
tgtctttgctcttcccacggatatg

SEQ ID NO: 32201 - DNA, 25 bp, E. coli
tgtctttgctctacccacggatatg

SEQ ID NO: 32202 - DNA, 25 bp, E. coli
gcgaaaaaatgtctttgctctaccc

SEQ ID NO: 32203 - DNA, 25 bp, E. coli
gcgaaaaaatgtgtttgctctaccc

SEQ ID NO: 32204 - DNA, 25 bp, E. coli
gcttttcatttaccgcaaggttgtg

SEQ ID NO: 32205 - DNA, 25 bp, E. coli
gctctacccacggatatgcctattg

SEQ ID NO: 32206 - DNA, 25 bp, E. coli
gcttttcatttagcgcaaggttgtg

SEQ ID NO: 32207 - DNA, 25 bp, E. coli
gctctacccacgcatatgcctattg

SEQ ID NO: 32208 - DNA, 25 bp, E. coli
gcaaacatttaagagtagcgaaatg

SEQ ID NO: 32209 - DNA, 25 bp, E. coli
gcagagcgttttacgcgaactgcgc

SEQ ID NO: 32210 - DNA, 25 bp, E. coli
gcatgcttttcatttagcgcaaggt

SEQ ID NO: 32211 - DNA, 25 bp, E. coli
gcatgcttttcaattagcgcaaggt

SEQ ID NO: 32212 - DNA, 25 bp, E. coli
gcagagcgtttttcgcgaactgcgc

SEQ ID NO: 32213 - DNA, 25 bp, E. coli
gcaaacatttaacagtagcgaaatg

SEQ ID NO: 32214 - DNA, 25 bp, E. coli
taacagtagcgaaatgagcgcgccg

SEQ ID NO: 32215 - DNA, 25 bp, E. coli
caatgggtggttagccgtgtcgctt

SEQ ID NO: 32216 - DNA, 25 bp, E. coli
caatgggtggtttgccgtgtcgctt

SEQ ID NO: 32217 - DNA, 25 bp, E. coli
cagcccattggtattgcagcccgga

SEQ ID NO: 32218 - DNA, 25 bp, E. coli
cagcccattggttttgcagcccgga

SEQ ID NO: 32219 - DNA, 25 bp, E. coli
actatcataagctcccaactccggg

SEQ ID NO: 32220 - DNA, 25 bp, E. coli
aactccgggagcttttttgtgtctg

SEQ ID NO: 32221 - DNA, 25 bp, E. coli
actatcataagcacccaactccggg

SEQ ID NO: 32222 - DNA, 25 bp, E. coli
aactccgggagcatttttgtgtctg

SEQ ID NO: 32223 - DNA, 25 bp, E. coli
tctctttttagcgacacagtggctg

SEQ ID NO: 32224 - DNA, 25 bp, E. coli
tctctttttagccacacagtggctg

SEQ ID NO: 32225 - DNA, 25 bp, E. coli
tctgtaaatcacgacaatgggtggt

SEQ ID NO: 32226 - DNA, 25 bp, E. coli
tctgtaaatcaccacaatgggtggt

SEQ ID NO: 32227 - DNA, 25 bp, E. coli
gctttctggcgagacttaactcatt

SEQ ID NO: 32228 - DNA, 25 bp, E. coli
gctttctggcgacacttaactcatt

SEQ ID NO: 32229 - DNA, 25 bp, E. coli
gacataaacccctcaaagcaacgta

SEQ ID NO: 32230 - DNA, 25 bp, E. coli
gacataaaccccacaaagcaacgta

SEQ ID NO: 32231 - DNA, 25 bp, E. coli
gatttacattcaaacagcggaggag

SEQ ID NO: 32232 - DNA, 25 bp, E. coli
gatttacattcatacagcggaggag

SEQ ID NO: 32233 - DNA, 25 bp, E. coli
tcaaacagcggacgagacataaacc

SEQ ID NO: 32234 - DNA, 25 bp, E. coli
tcaaacagcggaggagacataaacc

SEQ ID NO: 32235 - DNA, 25 bp, E. coli
gatgcggcattatgcaccaaccact

SEQ ID NO: 32236 - DNA, 25 bp, E. coli
gatgcggcattaagcaccaaccact

SEQ ID NO: 32237 - DNA, 25 bp, E. coli
ccgacgcggagtagccagcgctttg

SEQ ID NO: 32238 - DNA, 25 bp, E. coli
ccgacgcggagttgccagcgctttg

SEQ ID NO: 32239 - DNA, 25 bp, E. coli
tacgatgacggccagtcagcactat

SEQ ID NO: 32240 - DNA, 25 bp, E. coli
tacgatgacggcgagtcagcactat

SEQ ID NO: 32241 - DNA, 25 bp, E. coli
actattctccactgcaaattgccgc

SEQ ID NO: 32242 - DNA, 25 bp, E. coli
actattctccacagcaaattgccgc

SEQ ID NO: 32243 - DNA, 25 bp, E. coli
tatgcgctattttccttcgagctgt

SEQ ID NO: 32244 - DNA, 25 bp, E. coli
tatgcgctatttaccttcgagctgt

SEQ ID NO: 32245 - DNA, 25 bp, E. coli
ttgttgaaccggaatacacccgacg

SEQ ID NO: 32246 - DNA, 25 bp, E. coli
ttgttgaaccggtatacacccgacg

SEQ ID NO: 32247 - DNA, 25 bp, E. coli
tccttcgagctgttacgatgacggc

SEQ ID NO: 32248 - DNA, 25 bp, E. coli
tccttcgagctgatacgatgacggc

SEQ ID NO: 32249 - DNA, 25 bp, E. coli
gacggcgagtcagcactattctcca

SEQ ID NO: 32250 - DNA, 25 bp, E. coli
gttgaaccggaatacacccgacgcg

SEQ ID NO: 32251 - DNA, 25 bp, E. coli
gttgaaccggaaaacacccgacgcg

SEQ ID NO: 32252 - DNA, 25 bp, E. coli
ggaatacacccgtcgcggagttgcc

SEQ ID NO: 32253 - DNA, 25 bp, E. coli
ggaatacacccgacgcggagttgcc

SEQ ID NO: 32254 - DNA, 25 bp, E. coli
gacggcgagtcaccactattctcca

SEQ ID NO: 32255 - DNA, 25 bp, E. coli
gagctgttacgaagacggcgagtca

SEQ ID NO: 32256 - DNA, 25 bp, E. coli
gagtcagcactattctccacagcaa

SEQ ID NO: 32257 - DNA, 25 bp, E. coli
gagctgttacgatgacggcgagtca

SEQ ID NO: 32258 - DNA, 25 bp, E. coli
gagtcagcactaatctccacagcaa

SEQ ID NO: 32259 - DNA, 25 bp, E. coli
cacacgatatgctggcagcgattgc

SEQ ID NO: 32260 - DNA, 25 bp, E. coli
cagcgattgcctctaactcatgcca

SEQ ID NO: 32261 - DNA, 25 bp, E. coli
cagcgattgcctgtaactcatgcca

SEQ ID NO: 32262 - DNA, 25 bp, E. coli
cacacgatatgcaggcagcgattgc

SEQ ID NO: 32263 - DNA, 25 bp, E. coli
taaagcggctaaaggccagatatgc

SEQ ID NO: 32264 - DNA, 25 bp, E. coli
taaagcggctaatggccagatatgc

SEQ ID NO: 32265 - DNA, 25 bp, E. coli
agatatgccagatcagaatccctgg

SEQ ID NO: 32266 - DNA, 25 bp, E. coli
agatatgccagaacagaatccctgg

SEQ ID NO: 32267 - DNA, 25 bp, E. coli
tggtgaatttacctaaagcggctaa

SEQ ID NO: 32268 - DNA, 25 bp, E. coli
tggtgaatttacgtaaagcggctaa

SEQ ID NO: 32269 - DNA, 25 bp, E. coli
tgcaatcacaatcccgaaacctctg

SEQ ID NO: 32270 - DNA, 25 bp, E. coli
tgcaatcacaatgccgaaacctctg

SEQ ID NO: 32271 - DNA, 25 bp, E. coli
gcctgtaactcatgccacgatttaa

SEQ ID NO: 32272 - DNA, 25 bp, E. coli
gcctgtaactcaagccacgatttaa

SEQ ID NO: 32273 - DNA, 25 bp, E. coli
gcgataaagccagacgatatgcagg

SEQ ID NO: 32274 - DNA, 25 bp, E. coli
gcgataaagccacacgatatgcagg

SEQ ID NO: 32275 - DNA, 25 bp, E. coli
gaatccctggcttctgcaatcacaa

SEQ ID NO: 32276 - DNA, 25 bp, E. coli
gaatccctggctactgcaatcacaa

SEQ ID NO: 32277 - DNA, 25 bp, E. coli
gaaacctctgtgctggcgcattaca

SEQ ID NO: 32278 - DNA, 25 bp, E. coli
gaaacctctgtggtggcgcattaca

SEQ ID NO: 32279 - DNA, 25 bp, E. coli
gaacgtgcggaagagcgataaagcc

SEQ ID NO: 32280 - DNA, 25 bp, E. coli
gaacgtgcggaacagcgataaagcc

SEQ ID NO: 32281 - DNA, 25 bp, E. coli
cataagatgatcgaatttgacgcga

SEQ ID NO: 32282 - DNA, 25 bp, E. coli
cataagatgatccaatttgacgcga

SEQ ID NO: 32283 - DNA, 25 bp, E. coli
taaagcgcgagtcatgcagttgaaa

SEQ ID NO: 32284 - DNA, 25 bp, E. coli
taaagcgcgagtgatgcagttgaaa

SEQ ID NO: 32285 - DNA, 25 bp, E. coli
agtgatgcagttcaaagacgccgga

SEQ ID NO: 32286 - DNA, 25 bp, E. coli
agtgatgcagttgaaagacgccgga

SEQ ID NO: 32287 - DNA, 25 bp, E. coli
tgattggtccgaactttacggccca

SEQ ID NO: 32288 - DNA, 25 bp, E. coli
tgagtaactggccttatccccgcat

SEQ ID NO: 32289 - DNA, 25 bp, E. coli
tgagtaactggcgttatccccgcat

SEQ ID NO: 32290 - DNA, 25 bp, E. coli
tgattggtccgatctttacggccca

SEQ ID NO: 32291 - DNA, 25 bp, E. coli
tcttcctgctccatgacgacaatct

SEQ ID NO: 32292 - DNA, 25 bp, E. coli
tcttcctgctccttgacgacaatct

SEQ ID NO: 32293 - DNA, 25 bp, E. coli
cgtttgagattgatgctttagaagc

SEQ ID NO: 32294 - DNA, 25 bp, E. coli
cgtttgagattgttgctttagaagc

SEQ ID NO: 32295 - DNA, 25 bp, E. coli
cattaacgggcataatggtggcgct

SEQ ID NO: 32296 - DNA, 25 bp, E. coli
cattaacgggcaaaatggtggcgct

SEQ ID NO: 32297 - DNA, 25 bp, E. coli
gggcaaaatacgctcataagatgat

SEQ ID NO: 32298 - DNA, 25 bp, E. coli
gggcaaaatacggtcataagatgat

SEQ ID NO: 32299 - DNA, 25 bp, E. coli
gtggattgcatctgtaccgatgcga

SEQ ID NO: 32300 - DNA, 25 bp, E. coli
gtggattgcatcagtaccgatgcga

SEQ ID NO: 32301 - DNA, 25 bp, E. coli
gatggcgaatatggaaatcaaaccc

SEQ ID NO: 32302 - DNA, 25 bp, E. coli
gatggcgaatatcgaaatcaaaccc

SEQ ID NO: 32303 - DNA, 25 bp, E. coli
cagatatcatcgtcaacgccgctga

SEQ ID NO: 32304 - DNA, 25 bp, E. coli
cagatatcatcgacaacgccgctga

SEQ ID NO: 32305 - DNA, 25 bp, E. coli
tacaaatccgatagtaatgccccat

SEQ ID NO: 32306 - DNA, 25 bp, E. coli
tacaaatccgattgtaatgccccat

SEQ ID NO: 32307 - DNA, 25 bp, E. coli
acgccgctgaaatcgaagaattgca

SEQ ID NO: 32308 - DNA, 25 bp, E. coli
acgccgctgaaaacgaagaattgca

SEQ ID NO: 32309 - DNA, 25 bp, E. coli
tctccctgcaaatatacaaatccga

SEQ ID NO: 32310 - DNA, 25 bp, E. coli
tctccctgcaaaaatacaaatccga

SEQ ID NO: 32311 - DNA, 25 bp, E. coli
gccccatctgcttctcattgttgcg

SEQ ID NO: 32312 - DNA, 25 bp, E. coli
gccccatctgctactcattgttgcg

SEQ ID NO: 32313 - DNA, 25 bp, E. coli
gccagcaggatattgaacttatcaa

SEQ ID NO: 32314 - DNA, 25 bp, E. coli
gccagcaggataatgaacttatcaa

SEQ ID NO: 32315 - DNA, 25 bp, E. coli
gcttgcgccagtagccagcaggata

SEQ ID NO: 32316 - DNA, 25 bp, E. coli
gcttgcgccagttgccagcaggata

SEQ ID NO: 32317 - DNA, 25 bp, E. coli
gaattgcagcgcaatctctccctgc

SEQ ID NO: 32318 - DNA, 25 bp, E. coli
gaattgcagcgctatctctccctgc

SEQ ID NO: 32319 - DNA, 25 bp, E. coli
cgacgcctggctcttcgtggatgca

SEQ ID NO: 32320 - DNA, 25 bp, E. coli
cgacgcctggctgttcgtggatgca

SEQ ID NO: 32321 - DNA, 25 bp, E. coli
cttatcaacaaagagagaggtgtga

SEQ ID NO: 32322 - DNA, 25 bp, E. coli
cttatcaacaaacagagaggtgtga

SEQ ID NO: 32323 - DNA, 25 bp, E. coli
gttcgtggatgctgagcttgcgcca

SEQ ID NO: 32324 - DNA, 25 bp, E. coli
gttcgtggatgcagagcttgcgcca

SEQ ID NO: 32325 - DNA, 25 bp, E. coli
caaaaaacaatatgaaggatttgag

SEQ ID NO: 32326 - DNA, 25 bp, E. coli
caaaaaacaataagaaggatttgag

SEQ ID NO: 32327 - DNA, 25 bp, E. coli
cagaagcctgttttatgctgttaca

SEQ ID NO: 32328 - DNA, 25 bp, E. coli
cagtcatcgttatattccttattgg

SEQ ID NO: 32329 - DNA, 25 bp, E. coli
cagaagcctgttatatgctgttaca

SEQ ID NO: 32330 - DNA, 25 bp, E. coli
cagtcatcgttaaattccttattgg

SEQ ID NO: 32331 - DNA, 25 bp, E. coli
atcgttatattcgttattggatggg

SEQ ID NO: 32332 - DNA, 25 bp, E. coli
atcgttatattccttattggatggg

SEQ ID NO: 32333 - DNA, 25 bp, E. coli
ttttactatggctttccatggtggg

SEQ ID NO: 32334 - DNA, 25 bp, E. coli
ttttactatggcattccatggtggg

SEQ ID NO: 32335 - DNA, 25 bp, E. coli
tgatgatgtggccagaagcctgttt

SEQ ID NO: 32336 - DNA, 25 bp, E. coli
tgatgatgtggcgagaagcctgttt

SEQ ID NO: 32337 - DNA, 25 bp, E. coli
gctgttacagtcttcgttatattcc

SEQ ID NO: 32338 - DNA, 25 bp, E. coli
gctgttacagtcatcgttatattcc

SEQ ID NO: 32339 - DNA, 25 bp, E. coli
gcaggtattgttatctttctgggaa

SEQ ID NO: 32340 - DNA, 25 bp, E. coli
gcaggtattgttttctttctgggaa

SEQ ID NO: 32341 - DNA, 25 bp, E. coli
ctaggtgcttgtatctatagctggg

SEQ ID NO: 32342 - DNA, 25 bp, E. coli
ctaggtgcttgtttctatagctggg

SEQ ID NO: 32343 - DNA, 25 bp, E. coli
gggcacttccttttactatggcttt

SEQ ID NO: 32344 - DNA, 25 bp, E. coli
gggcacttccttatactatggcttt

SEQ ID NO: 32345 - DNA, 25 bp, E. coli
tgggaattaaactaaaaacaatatg

SEQ ID NO: 32346 - DNA, 25 bp, E. coli
tgggaattaaacaaaaaacaatatg

SEQ ID NO: 32347 - DNA, 25 bp, E. coli
caaccaatattaacccggtgtgcaa

SEQ ID NO: 32348 - DNA, 25 bp, E. coli
caaccaatattatcccggtgtgcaa

SEQ ID NO: 32349 - DNA, 25 bp, E. coli
aaccaatattatcccggtgtgcaat

SEQ ID NO: 32350 - DNA, 25 bp, E. coli
aatattatcccggtgtgcaatggga

SEQ ID NO: 32351 - DNA, 25 bp, E. coli
aatattatcccgctgtgcaatggga

SEQ ID NO: 32352 - DNA, 25 bp, E. coli
aaccaatattatgccggtgtgcaat

SEQ ID NO: 32353 - DNA, 25 bp, E. coli
catggcaaccaaaattatcccggtg

SEQ ID NO: 32354 - DNA, 25 bp, E. coli
catggcaaccaatattatcccggtg

SEQ ID NO: 32355 - DNA, 25 bp, E. coli
atactttactgcagccgatcgacat

SEQ ID NO: 32356 - DNA, 25 bp, E. coli
atactttactgctgccgatcgacat

SEQ ID NO: 32357 - DNA, 25 bp, E. coli
gcatggcaaccaatattatcccggt

SEQ ID NO: 32358 - DNA, 25 bp, E. coli
gcatggcaaccattattatcccggt

SEQ ID NO: 32359 - DNA, 25 bp, E. coli
gatactttactggtgccgatcgaca

SEQ ID NO: 32360 - DNA, 25 bp, E. coli
gatactttactgctgccgatcgaca

SEQ ID NO: 32361 - DNA, 25 bp, E. coli
gggcatggcaaccaatattatcccg

SEQ ID NO: 32362 - DNA, 25 bp, E. coli
gggcatggcaacgaatattatcccg

SEQ ID NO: 32363 - DNA, 25 bp, E. coli
ggcatggcaacctatattatcccgg

SEQ ID NO: 32364 - DNA, 25 bp, E. coli
ggcatggcaaccaatattatcccgg

SEQ ID NO: 32365 - DNA, 25 bp, E. coli
tggcaaccaataatatcccggtgtg

SEQ ID NO: 32366 - DNA, 25 bp, E. coli
ggcaaccaatattatcccggtgtgc

SEQ ID NO: 32367 - DNA, 25 bp, E. coli
tggcaaccaatattatcccggtgtg

SEQ ID NO: 32368 - DNA, 25 bp, E. coli
ggcaaccaatataatcccggtgtgc

SEQ ID NO: 32369 - DNA, 25 bp, E. coli
caatcggtatcattaatttatctca

SEQ ID NO: 32370 - DNA, 25 bp, E. coli
caatcggtatcaataatttatctca

SEQ ID NO: 32371 - DNA, 25 bp, E. coli
cacatcaacaccagtgctactgata

SEQ ID NO: 32372 - DNA, 25 bp, E. coli
cacatcaacacctgtgctactgata

SEQ ID NO: 32373 - DNA, 25 bp, E. coli
catttatagtttcaacatggatggc

SEQ ID NO: 32374 - DNA, 25 bp, E. coli
cagaagataatcctatctcacctta

SEQ ID NO: 32375 - DNA, 25 bp, E. coli
cagaagataatcgtatctcacctta

SEQ ID NO: 32376 - DNA, 25 bp, E. coli
tatgtattcagaagataatcctatc

SEQ ID NO: 32377 - DNA, 25 bp, E. coli
tagataaacacaacaacaccagtgc

SEQ ID NO: 32378 - DNA, 25 bp, E. coli
tagataaacacatcaacaccagtgc

SEQ ID NO: 32379 - DNA, 25 bp, E. coli
tatgtattcagatgataatcctatc

SEQ ID NO: 32380 - DNA, 25 bp, E. coli
tttatctcaaagatcaaatatagcg

SEQ ID NO: 32381 - DNA, 25 bp, E. coli
tttatctcaaagttcaaatatagcg

SEQ ID NO: 32382 - DNA, 25 bp, E. coli
tgactaatccaatcggtatcaataa

SEQ ID NO: 32383 - DNA, 25 bp, E. coli
tgactaatccaaacggtatcaataa

SEQ ID NO: 32384 - DNA, 25 bp, E. coli
cgaatgcaacggctgatgaagtcgt

SEQ ID NO: 32385 - DNA, 25 bp, E. coli
cgaatgcaacgggtgatgaagtcgt

SEQ ID NO: 32386 - DNA, 25 bp, E. coli
cttttcaaaatgatatgtattcaga

SEQ ID NO: 32387 - DNA, 25 bp, E. coli
catttatagtttgaacatggatggc

SEQ ID NO: 32388 - DNA, 25 bp, E. coli
cttttcaaaatgttatgtattcaga

SEQ ID NO: 32389 - DNA, 25 bp, E. coli
tcaaatatagcgtatgcaacgggtg

SEQ ID NO: 32390 - DNA, 25 bp, E. coli
tcaaatatagcgaatgcaacgggtg

SEQ ID NO: 32391 - DNA, 25 bp, E. coli
ctctccctcccccactatcatttaa

SEQ ID NO: 32392 - DNA, 25 bp, E. coli
attgcgccctcctcttctctccctc

SEQ ID NO: 32393 - DNA, 25 bp, E. coli
agccattgcgccctcctcttctctc

SEQ ID NO: 32394 - DNA, 25 bp, E. coli
ctctccctccccgactatcatttaa

SEQ ID NO: 32395 - DNA, 25 bp, E. coli
attgcgccctccacttctctccctc

SEQ ID NO: 32396 - DNA, 25 bp, E. coli
agccattgcgccgtcctcttctctc

SEQ ID NO: 32397 - DNA, 25 bp, E. coli
tatttttcgggcccagccattgcgc

SEQ ID NO: 32398 - DNA, 25 bp, E. coli
tatttttcgggcgcagccattgcgc

SEQ ID NO: 32399 - DNA, 25 bp, E. coli
ttgcgccctcctgttctctccctcc

SEQ ID NO: 32400 - DNA, 25 bp, E. coli
ttgcgccctcctcttctctccctcc

SEQ ID NO: 32401 - DNA, 25 bp, E. coli
tttatttttcggccgcagccattgc

SEQ ID NO: 32402 - DNA, 25 bp, E. coli
tttatttttcgggcgcagccattgc

SEQ ID NO: 32403 - DNA, 25 bp, E. coli
tcttctctccctccccgactatcat

SEQ ID NO: 32404 - DNA, 25 bp, E. coli
tcttctctccctgcccgactatcat

SEQ ID NO: 32405 - DNA, 25 bp, E. coli
gccattgcgccctcctcttctctcc

SEQ ID NO: 32406 - DNA, 25 bp, E. coli
gccattgcgcccacctcttctctcc

SEQ ID NO: 32407 - DNA, 25 bp, E. coli
cattgcgccctcgtcttctctccct

SEQ ID NO: 32408 - DNA, 25 bp, E. coli
cttctctccctcgccgactatcatt

SEQ ID NO: 32409 - DNA, 25 bp, E. coli
cttctctccctccccgactatcatt

SEQ ID NO: 32410 - DNA, 25 bp, E. coli
cattgcgccctcctcttctctccct

SEQ ID NO: 32411 - DNA, 25 bp, E. coli
ggcgcagccattccgccctcctctt

SEQ ID NO: 32412 - DNA, 25 bp, E. coli
ggcgcagccattgcgccctcctctt

SEQ ID NO: 32413 - DNA, 25 bp, E. coli
catgctgccgacaaagcttgccgaa

SEQ ID NO: 32414 - DNA, 25 bp, E. coli
catgctgccgactaagcttgccgaa

SEQ ID NO: 32415 - DNA, 25 bp, E. coli
tactgatgtagtggaaaacccggaa

SEQ ID NO: 32416 - DNA, 25 bp, E. coli
tactgatgtagtcgaaaacccggaa

SEQ ID NO: 32417 - DNA, 25 bp, E. coli
tatggagctggctaattcaacggca

SEQ ID NO: 32418 - DNA, 25 bp, E. coli
tatggcgctgatcgtgatgtcctgc

SEQ ID NO: 32419 - DNA, 25 bp, E. coli
tatggcgctgatggtgatgtcctgc

SEQ ID NO: 32420 - DNA, 25 bp, E. coli
tagcccgtcgctaaacagtcagttc

SEQ ID NO: 32421 - DNA, 25 bp, E. coli
tatggagctggcaaattcaacggca

SEQ ID NO: 32422 - DNA, 25 bp, E. coli
tagcccgtcgcttaacagtcagttc

SEQ ID NO: 32423 - DNA, 25 bp, E. coli
tattcagaaggtggctaatgtgccc

SEQ ID NO: 32424 - DNA, 25 bp, E. coli
tattcagaaggtcgctaatgtgccc

SEQ ID NO: 32425 - DNA, 25 bp, E. coli
taactttggtggtgcgcgcattacc

SEQ ID NO: 32426 - DNA, 25 bp, E. coli
taactttggtggagcgcgcattacc

SEQ ID NO: 32427 - DNA, 25 bp, E. coli
cccggaacgtaaagtgccaatcgcg

SEQ ID NO: 32428 - DNA, 25 bp, E. coli
cccggaacgtaatgtgccaatcgcg

SEQ ID NO: 32429 - DNA, 25 bp, E. coli
tggcactggcatcggcattcgcaaa

SEQ ID NO: 32430 - DNA, 25 bp, E. coli
tggcactggcatgggcattcgcaaa

SEQ ID NO: 32431 - DNA, 25 bp, E. coli
taaccaaagtggttgcaccggtgca

SEQ ID NO: 32432 - DNA, 25 bp, E. coli
taaccaaagtggatgcaccggtgca

SEQ ID NO: 32433 - DNA, 25 bp, E. coli
gatggtcaacatcatgggctccggt

SEQ ID NO: 32434 - DNA, 25 bp, E. coli
gatggtcaacatgatgggctccggt

SEQ ID NO: 32435 - DNA, 25 bp, E. coli
tactggatgttttcgagcgcggcga

SEQ ID NO: 32436 - DNA, 25 bp, E. coli
tactggatgtttacgagcgcggcga

SEQ ID NO: 32437 - DNA, 25 bp, E. coli
ttatcaggataagggtggcgatgcc

SEQ ID NO: 32438 - DNA, 25 bp, E. coli
ttatcaggataacggtggcgatgcc

SEQ ID NO: 32439 - DNA, 25 bp, E. coli
tgaaagaacttgaccggcagcaacg

SEQ ID NO: 32440 - DNA, 25 bp, E. coli
tgaaaaaatgcgaacatggctgcgc

SEQ ID NO: 32441 - DNA, 25 bp, E. coli
tgaaaaaatgcgtacatggctgcgc

SEQ ID NO: 32442 - DNA, 25 bp, E. coli
tgaaagaacttgtccggcagcaacg

SEQ ID NO: 32443 - DNA, 25 bp, E. coli
tccgcactgagcagttgaaagaact

SEQ ID NO: 32444 - DNA, 25 bp, E. coli
tgccgacttgctgcgcctgaatctg

SEQ ID NO: 32445 - DNA, 25 bp, E. coli
tgccgacttgctccgcctgaatctg

SEQ ID NO: 32446 - DNA, 25 bp, E. coli
tccgcactgagctgttgaaagaact

SEQ ID NO: 32447 - DNA, 25 bp, E. coli
gaacgtctggatttcgaactggcct

SEQ ID NO: 32448 - DNA, 25 bp, E. coli
gaacgtctggatatcgaactggcct

SEQ ID NO: 32449 - DNA, 25 bp, E. coli
gattgctctggtgcgtcagcgactg

SEQ ID NO: 32450 - DNA, 25 bp, E. coli
gattgctctggtccgtcagcgactg

SEQ ID NO: 32451 - DNA, 25 bp, E. coli
ggaccagagccgtattgaagcatta

SEQ ID NO: 32452 - DNA, 25 bp, E. coli
ggaccagagccgaattgaagcatta

SEQ ID NO: 32453 - DNA, 25 bp, E. coli
taattcagcagttaaaagcggcggg

SEQ ID NO: 32454 - DNA, 25 bp, E. coli
taattcagcagtaaaaagcggcggg

SEQ ID NO: 32455 - DNA, 25 bp, E. coli
gacccaggtcctttttgaacatcca

SEQ ID NO: 32456 - DNA, 25 bp, E. coli
gacccaggtcctatttgaacatcca

SEQ ID NO: 32457 - DNA, 25 bp, E. coli
aagtgtttcgctggccggtcagtca

SEQ ID NO: 32458 - DNA, 25 bp, E. coli
caccatatggagagcggcgtattac

SEQ ID NO: 32459 - DNA, 25 bp, E. coli
caccatatggagtgcggcgtattac

SEQ ID NO: 32460 - DNA, 25 bp, E. coli
cagtatgaagcgcagttagccgaaa

SEQ ID NO: 32461 - DNA, 25 bp, E. coli
cagtatgaagcggagttagccgaaa

SEQ ID NO: 32462 - DNA, 25 bp, E. coli
tacaaattattcgtatggcggcaga

SEQ ID NO: 32463 - DNA, 25 bp, E. coli
tacaaattattcctatggcggcaga

SEQ ID NO: 32464 - DNA, 25 bp, E. coli
aagtgtttcgctcgccggtcagtca

SEQ ID NO: 32465 - DNA, 25 bp, E. coli
tatgatggcacccttttctgacctg

SEQ ID NO: 32466 - DNA, 25 bp, E. coli
tatgatggcaccgttttctgacctg

SEQ ID NO: 32467 - DNA, 25 bp, E. coli
tattcagatgctggaatgggcgctg

SEQ ID NO: 32468 - DNA, 25 bp, E. coli
tattcagatgctcgaatgggcgctg

SEQ ID NO: 32469 - DNA, 25 bp, E. coli
gcatctgattggacgggcaacgaaa

SEQ ID NO: 32470 - DNA, 25 bp, E. coli
gcatctgattggtcgggcaacgaaa

SEQ ID NO: 32471 - DNA, 25 bp, E. coli
gacgtaaccaaaggctcaaaaggcg

SEQ ID NO: 32472 - DNA, 25 bp, E. coli
gacgtaaccaaacgctcaaaaggcg

SEQ ID NO: 32473 - DNA, 25 bp, E. coli
cgaacgcggcgaagaatattcagat

SEQ ID NO: 32474 - DNA, 25 bp, E. coli
cgaacgcggcgatgaatattcagat

SEQ ID NO: 32475 - DNA, 25 bp, E. coli
cattaagccagaggcacaaggtcga

SEQ ID NO: 32476 - DNA, 25 bp, E. coli
cattaagccagacgcacaaggtcga

SEQ ID NO: 32477 - DNA, 25 bp, E. coli
gattgcgggtgtgcgtaataatccc

SEQ ID NO: 32478 - DNA, 25 bp, E. coli
gattgcgggtgtccgtaataatccc

SEQ ID NO: 32479 - DNA, 25 bp, E. coli
caaacttgcgcctcgtctgggtaaa

SEQ ID NO: 32480 - DNA, 25 bp, E. coli
caaacttgcgccacgtctgggtaaa

SEQ ID NO: 32481 - DNA, 25 bp, E. coli
cagggaaaacgagacaatcaggcgc

SEQ ID NO: 32482 - DNA, 25 bp, E. coli
cagggaaaacgacacaatcaggcgc

SEQ ID NO: 32483 - DNA, 25 bp, E. coli
taaagatacgcatcacgctgtagcc

SEQ ID NO: 32484 - DNA, 25 bp, E. coli
taaagatacgcaacacgctgtagcc

SEQ ID NO: 32485 - DNA, 25 bp, E. coli
taaaactgatgcacgtgacgctgcc

SEQ ID NO: 32486 - DNA, 25 bp, E. coli
taaaactgatgctcgtgacgctgcc

SEQ ID NO: 32487 - DNA, 25 bp, E. coli
agatacatccggcactggagcgcgt

SEQ ID NO: 32488 - DNA, 25 bp, E. coli
agatacatccgggactggagcgcgt

SEQ ID NO: 32489 - DNA, 25 bp, E. coli
tgatcagccagctaccatcggtgcg

SEQ ID NO: 32490 - DNA, 25 bp, E. coli
tgggtaaacgccttgcagcagacat

SEQ ID NO: 32491 - DNA, 25 bp, E. coli
tgggtaaacgccatgcagcagacat

SEQ ID NO: 32492 - DNA, 25 bp, E. coli
tgatcagccagcaaccatcggtgcg

SEQ ID NO: 32493 - DNA, 25 bp, E. coli
tccgagacttgatcacccggcggta

SEQ ID NO: 32494 - DNA, 25 bp, E. coli
tccgagacttgaacacccggcggta

SEQ ID NO: 32495 - DNA, 25 bp, E. coli
gccatgatgcgcgacgggacttttt

SEQ ID NO: 32496 - DNA, 25 bp, E. coli
gccatgatgcgccacgggacttttt

SEQ ID NO: 32497 - DNA, 25 bp, E. coli
gcatagccgacttacacgccggtga

SEQ ID NO: 32498 - DNA, 25 bp, E. coli
gcatagccgactaacacgccggtga

SEQ ID NO: 32499 - DNA, 25 bp, E. coli
gaaacaacatggacagatactgctg

SEQ ID NO: 32500 - DNA, 25 bp, E. coli
gaaacaacatggtcagatactgctg

SEQ ID NO: 32501 - DNA, 25 bp, E. coli
caggcttctcacaatcaggtgctgg

SEQ ID NO: 32502 - DNA, 25 bp, E. coli
catttgattcgcacggcggtgccgc

SEQ ID NO: 32503 - DNA, 25 bp, E. coli
catttgattcgctcggcggtgccgc

SEQ ID NO: 32504 - DNA, 25 bp, E. coli
caggcttctcactatcaggtgctgg

SEQ ID NO: 32505 - DNA, 25 bp, E. coli
acgatatcgagctggaaggccacca

SEQ ID NO: 32506 - DNA, 25 bp, E. coli
acgatatcgagcaggaaggccacca

SEQ ID NO: 32507 - DNA, 25 bp, E. coli
aaagcagatcgaacgccagcatgcg

SEQ ID NO: 32508 - DNA, 25 bp, E. coli
aaagcagatcgatcgccagcatgcg

SEQ ID NO: 32509 - DNA, 25 bp, E. coli
tatgaaaaaatggtcgccgccagtg

SEQ ID NO: 32510 - DNA, 25 bp, E. coli
tatgaaaaaatgctcgccgccagtg

SEQ ID NO: 32511 - DNA, 25 bp, E. coli
tgtgcggaccgtgaaaaagaatctc

SEQ ID NO: 32512 - DNA, 25 bp, E. coli
tgtgcggaccgtcaaaaagaatctc

SEQ ID NO: 32513 - DNA, 25 bp, E. coli
tcgaacatgcgctgttggatcacgc

SEQ ID NO: 32514 - DNA, 25 bp, E. coli
tcgaacatgcgcagttggatcacgc

SEQ ID NO: 32515 - DNA, 25 bp, E. coli
tgccgctggagaagaacctgagtta

SEQ ID NO: 32516 - DNA, 25 bp, E. coli
tgccgctggagatgaacctgagtta

SEQ ID NO: 32517 - DNA, 25 bp, E. coli
tctacaacgcggagttgcagcggct

SEQ ID NO: 32518 - DNA, 25 bp, E. coli
tctacaacgcggtgttgcagcggct

SEQ ID NO: 32519 - DNA, 25 bp, E. coli
cgcattactggacggcgaatcggca

SEQ ID NO: 32520 - DNA, 25 bp, E. coli
cgcattactggagggcgaatcggca

SEQ ID NO: 32521 - DNA, 25 bp, E. coli
cggaacgtcgactgtgtgaaaagct

SEQ ID NO: 32522 - DNA, 25 bp, E. coli
cggaacgtcgacagtgtgaaaagct

SEQ ID NO: 32523 - DNA, 25 bp, E. coli
caatgaagaagaggcgctggaaatc

SEQ ID NO: 32524 - DNA, 25 bp, E. coli
caatgaagaagacgcgctggaaatc

SEQ ID NO: 32525 - DNA, 25 bp, E. coli
caaagtacgccggtggatgagcgta

SEQ ID NO: 32526 - DNA, 25 bp, E. coli
caaagtacgccgctggatgagcgta

SEQ ID NO: 32527 - DNA, 25 bp, E. coli
caggcaatcgaagaaccgctggatc

SEQ ID NO: 32528 - DNA, 25 bp, E. coli
caggcaatcgaacaaccgctggatc

SEQ ID NO: 32529 - DNA, 25 bp, E. coli
tacaaagataaatttcgcgcggcgc

SEQ ID NO: 32530 - DNA, 25 bp, E. coli
tacaaagataaaattcgcgcggcgc

SEQ ID NO: 32531 - DNA, 25 bp, E. coli
tattgatgccaaagaacgtgcggca

SEQ ID NO: 32532 - DNA, 25 bp, E. coli
tattgatgccaatgaacgtgcggca

SEQ ID NO: 32533 - DNA, 25 bp, E. coli
tactcattgagcaggcaatcgaaca

SEQ ID NO: 32534 - DNA, 25 bp, E. coli
tactcattgagctggcaatcgaaca

SEQ ID NO: 32535 - DNA, 25 bp, E. coli
tctttgccgctataagtgatggtca

SEQ ID NO: 32536 - DNA, 25 bp, E. coli
tctttgccgctaaaagtgatggtca

SEQ ID NO: 32537 - DNA, 25 bp, E. coli
gcattgaacgcgatctcgaacagca

SEQ ID NO: 32538 - DNA, 25 bp, E. coli
gcattgaacgcgttctcgaacagca

SEQ ID NO: 32539 - DNA, 25 bp, E. coli
gaacgcagttacctgaatgcactgg

SEQ ID NO: 32540 - DNA, 25 bp, E. coli
gaacgcagttacgtgaatgcactgg

SEQ ID NO: 32541 - DNA, 25 bp, E. coli
cgggtacggtgctgtggaataaata

SEQ ID NO: 32542 - DNA, 25 bp, E. coli
cgggtacggtgcagtggaataaata

SEQ ID NO: 32543 - DNA, 25 bp, E. coli
ggcgcatcaggaggaaccgcagttt

SEQ ID NO: 32544 - DNA, 25 bp, E. coli
ggcgcatcaggacgaaccgcagttt

SEQ ID NO: 32545 - DNA, 25 bp, E. coli
catgtcacggttacctgtaaagtgg

SEQ ID NO: 32546 - DNA, 25 bp, E. coli
catgtcacggtttcctgtaaagtgg

SEQ ID NO: 32547 - DNA, 25 bp, E. coli
tgtgtcaacggctaattgcaacgtg

SEQ ID NO: 32548 - DNA, 25 bp, E. coli
tgtgtcaacggcaaattgcaacgtg

SEQ ID NO: 32549 - DNA, 25 bp, E. coli
tgacgggcggcatcatatgaattcc

SEQ ID NO: 32550 - DNA, 25 bp, E. coli
tgacgggcggcaacatatgaattcc

SEQ ID NO: 32551 - DNA, 25 bp, E. coli
tgaacaattttgcaaaaccgctcgc

SEQ ID NO: 32552 - DNA, 25 bp, E. coli
tgaacaattttggaaaaccgctcgc

SEQ ID NO: 32553 - DNA, 25 bp, E. coli
tcgctgaaaaatcaggcaaatgaac

SEQ ID NO: 32554 - DNA, 25 bp, E. coli
tcgctgaaaaatgaggcaaatgaac

SEQ ID NO: 32555 - DNA, 25 bp, E. coli
gaattccgcccgtatgtgtcaacgg

SEQ ID NO: 32556 - DNA, 25 bp, E. coli
gcaacgtgtagtatcaatcgctgaa

SEQ ID NO: 32557 - DNA, 25 bp, E. coli
gaattccgcccgaatgtgtcaacgg

SEQ ID NO: 32558 - DNA, 25 bp, E. coli
gcaacgtgtagtttcaatcgctgaa

SEQ ID NO: 32559 - DNA, 25 bp, E. coli
cattcagtagtttttcatgtcacgg

SEQ ID NO: 32560 - DNA, 25 bp, E. coli
cattcagtagttattcatgtcacgg

SEQ ID NO: 32561 - DNA, 25 bp, E. coli
tggaaaaccgctcgcattcagtagt

SEQ ID NO: 32562 - DNA, 25 bp, E. coli
tggaaaaccgctggcattcagtagt

SEQ ID NO: 32563 - DNA, 25 bp, E. coli
taatagacccacttacattcaggga

SEQ ID NO: 32564 - DNA, 25 bp, E. coli
taatagacccacatacattcaggga

SEQ ID NO: 32565 - DNA, 25 bp, E. coli
tcacgtaaagcttgtcgagttgacg

SEQ ID NO: 32566 - DNA, 25 bp, E. coli
tcacgtaaagctagtcgagttgacg

SEQ ID NO: 32567 - DNA, 25 bp, E. coli
caacatccgacgaggtgatgtgtca

SEQ ID NO: 32568 - DNA, 25 bp, E. coli
caacatccgacgtggtgatgtgtca

SEQ ID NO: 32569 - DNA, 25 bp, E. coli
catccgacgtggagatgtgtcaaat

SEQ ID NO: 32570 - DNA, 25 bp, E. coli
catccgacgtggtgatgtgtcaaat

SEQ ID NO: 32571 - DNA, 25 bp, E. coli
atccatgccccaggcggtgagatcg

SEQ ID NO: 32572 - DNA, 25 bp, E. coli
atacggatcgtgcatggcagaaaac

SEQ ID NO: 32573 - DNA, 25 bp, E. coli
atacggatcgtggatggcagaaaac

SEQ ID NO: 32574 - DNA, 25 bp, E. coli
atccatgccccacgcggtgagatcg

SEQ ID NO: 32575 - DNA, 25 bp, E. coli
tatacggatcgtggatggcagaaaa

SEQ ID NO: 32576 - DNA, 25 bp, E. coli
tatacggatcgtcgatggcagaaaa

SEQ ID NO: 32577 - DNA, 25 bp, E. coli
tggtcgtaacaagatccgacgtggt

SEQ ID NO: 32578 - DNA, 25 bp, E. coli
tccgacgtggtgttgtgtcaaatga

SEQ ID NO: 32579 - DNA, 25 bp, E. coli
tccgacgtggtgatgtgtcaaatga

SEQ ID NO: 32580 - DNA, 25 bp, E. coli
tgccccacgcggagagatcggatgt

SEQ ID NO: 32581 - DNA, 25 bp, E. coli
tgccccacgcggtgagatcggatgt

SEQ ID NO: 32582 - DNA, 25 bp, E. coli
tcgtaacaacatgcgacgtggtgat

SEQ ID NO: 32583 - DNA, 25 bp, E. coli
tcgtaacaacatccgacgtggtgat

SEQ ID NO: 32584 - DNA, 25 bp, E. coli
gacgtggtgatgagtcaaatgagac

SEQ ID NO: 32585 - DNA, 25 bp, E. coli
gacgtggtgatgtgtcaaatgagac

SEQ ID NO: 32586 - DNA, 25 bp, E. coli
tggtcgtaacaacatccgacgtggt

SEQ ID NO: 32587 - DNA, 25 bp, E. coli
taacaacatccgacgtggtgatgtg

SEQ ID NO: 32588 - DNA, 25 bp, E. coli
taacaacatccgtcgtggtgatgtg

SEQ ID NO: 32589 - DNA, 25 bp, E. coli
caattattggtaatgcgcgggcgta

SEQ ID NO: 32590 - DNA, 25 bp, E. coli
caattattggtattgcgcgggcgta

SEQ ID NO: 32591 - DNA, 25 bp, E. coli
caaatggaacagtacggcgaaccgt

SEQ ID NO: 32592 - DNA, 25 bp, E. coli
caaatggaacagaacggcgaaccgt

SEQ ID NO: 32593 - DNA, 25 bp, E. coli
tactcctttatggaggcatgtgggc

SEQ ID NO: 32594 - DNA, 25 bp, E. coli
tactcctttatgcaggcatgtgggc

SEQ ID NO: 32595 - DNA, 25 bp, E. coli
aaaaaactgttcgaaatgatctgcc

SEQ ID NO: 32596 - DNA, 25 bp, E. coli
aaaaaactgttccaaatgatctgcc

SEQ ID NO: 32597 - DNA, 25 bp, E. coli
tgcaggaagaggttgtcgaaagact

SEQ ID NO: 32598 - DNA, 25 bp, E. coli
tgcaggaagaggatgtcgaaagact

SEQ ID NO: 32599 - DNA, 25 bp, E. coli
tgctttcatcagatcgatccggtga

SEQ ID NO: 32600 - DNA, 25 bp, E. coli
tgctttcatcagttcgatccggtga

SEQ ID NO: 32601 - DNA, 25 bp, E. coli
gactggtacaggacgccgggattat

SEQ ID NO: 32602 - DNA, 25 bp, E. coli
gacccgctttatattgcctaccatg

SEQ ID NO: 32603 - DNA, 25 bp, E. coli
gactggtacaggtcgccgggattat

SEQ ID NO: 32604 - DNA, 25 bp, E. coli
gacccgctttattttgcctaccatg

SEQ ID NO: 32605 - DNA, 25 bp, E. coli
cgcgggcgtaccagcaaatggaaca

SEQ ID NO: 32606 - DNA, 25 bp, E. coli
cgcgggcgtacctgcaaatggaaca

SEQ ID NO: 32607 - DNA, 25 bp, E. coli
gtgacacaagccacaacgttgagcg

SEQ ID NO: 32608 - DNA, 25 bp, E. coli
gtgacacaagcctcaacgttgagcg

SEQ ID NO: 32609 - DNA, 25 bp, E. coli
tggatcaccgtcgtcaaaaaacgcg

SEQ ID NO: 32610 - DNA, 25 bp, E. coli
tggatcaccgtcctcaaaaaacgcg

SEQ ID NO: 32611 - DNA, 25 bp, E. coli
catgatgaagagttagaacgcgtgc

SEQ ID NO: 32612 - DNA, 25 bp, E. coli
catgatgaagagatagaacgcgtgc

SEQ ID NO: 32613 - DNA, 25 bp, E. coli
atccgcagcgcccaaccgtggtttt

SEQ ID NO: 32614 - DNA, 25 bp, E. coli
atccgcagcgccgaaccgtggtttt

SEQ ID NO: 32615 - DNA, 25 bp, E. coli
tgcaagcgcagttccatgatgaaga

SEQ ID NO: 32616 - DNA, 25 bp, E. coli
tgaatgggctgaacgtgcaagcgca

SEQ ID NO: 32617 - DNA, 25 bp, E. coli
tgcaagcgcagtaccatgatgaaga

SEQ ID NO: 32618 - DNA, 25 bp, E. coli
tgaatgggctgatcgtgcaagcgca

SEQ ID NO: 32619 - DNA, 25 bp, E. coli
tcgatctttatcaatgcgccagcta

SEQ ID NO: 32620 - DNA, 25 bp, E. coli
tcgatctttatctatgcgccagcta

SEQ ID NO: 32621 - DNA, 25 bp, E. coli
ccagctactgcgatgcgggaacgac

SEQ ID NO: 32622 - DNA, 25 bp, E. coli
ccagctactgcgttgcgggaacgac

SEQ ID NO: 32623 - DNA, 25 bp, E. coli
cgcaccaataatcatcgtcgaagga

SEQ ID NO: 32624 - DNA, 25 bp, E. coli
cgcaccaataatgatcgtcgaagga

SEQ ID NO: 32625 - DNA, 25 bp, E. coli
ctattgctggatcacgataactggc

SEQ ID NO: 32626 - DNA, 25 bp, E. coli
ctattgctggatgacgataactggc

SEQ ID NO: 32627 - DNA, 25 bp, E. coli
gataactggcgccagctagcgcaat

SEQ ID NO: 32628 - DNA, 25 bp, E. coli
gatagaacgcgtgcataaaccgttg

SEQ ID NO: 32629 - DNA, 25 bp, E. coli
gataactggcgcgagctagcgcaat

SEQ ID NO: 32630 - DNA, 25 bp, E. coli
gatagaacgcgtccataaaccgttg

SEQ ID NO: 32631 - DNA, 25 bp, E. coli
gtcgaaggaaacaggctattgctgg

SEQ ID NO: 32632 - DNA, 25 bp, E. coli
gtcgaaggaaactggctattgctgg

SEQ ID NO: 32633 - DNA, 25 bp, E. coli
gagtcagttacgattgcaaggcttc

SEQ ID NO: 32634 - DNA, 25 bp, E. coli
gagtcagttacgtttgcaaggcttc

SEQ ID NO: 32635 - DNA, 25 bp, E. coli
caggttaccgatacccagtggcagg

SEQ ID NO: 32636 - DNA, 25 bp, E. coli
caggttaccgattcccagtggcagg

SEQ ID NO: 32637 - DNA, 25 bp, E. coli
tatcttaatcgcctgctggctgccg

SEQ ID NO: 32638 - DNA, 25 bp, E. coli
tatcttaatcgcgtgctggctgccg

SEQ ID NO: 32639 - DNA, 25 bp, E. coli
gcgaaacgttcctcttgcggtaaag

SEQ ID NO: 32640 - DNA, 25 bp, E. coli
gcgaaacgttccacttgcggtaaag

SEQ ID NO: 32641 - DNA, 25 bp, E. coli
gcagaaattgcctcgctgttagcga

SEQ ID NO: 32642 - DNA, 25 bp, E. coli
gcagaaattgccacgctgttagcga

SEQ ID NO: 32643 - DNA, 25 bp, E. coli
gaaattgacgacgtgaactggcgca

SEQ ID NO: 32644 - DNA, 25 bp, E. coli
gaaattgacgacctgaactggcgca

SEQ ID NO: 32645 - DNA, 25 bp, E. coli
gttttgcaatggtcccgttacggcg

SEQ ID NO: 32646 - DNA, 25 bp, E. coli
gttttgcaatggacccgttacggcg

SEQ ID NO: 32647 - DNA, 25 bp, E. coli
gggctgaacgcccatccggaatttt

SEQ ID NO: 32648 - DNA, 25 bp, E. coli
gggctgaacgccgatccggaatttt

SEQ ID NO: 32649 - DNA, 25 bp, E. coli
taatgtctgggtacaggatggcagc

SEQ ID NO: 32650 - DNA, 25 bp, E. coli
taacatggttaatcaacgcgcagcg

SEQ ID NO: 32651 - DNA, 25 bp, E. coli
taacatggttaaacaacgcgcagcg

SEQ ID NO: 32652 - DNA, 25 bp, E. coli
taatgtctgggttcaggatggcagc

SEQ ID NO: 32653 - DNA, 25 bp, E. coli
gatggctatcgcgaactgctggaac

SEQ ID NO: 32654 - DNA, 25 bp, E. coli
gatggctatcgccaactgctggaac

SEQ ID NO: 32655 - DNA, 25 bp, E. coli
aatgcagcgcattgaaattcgttgc

SEQ ID NO: 32656 - DNA, 25 bp, E. coli
aatgcagcgcatagaaattcgttgc

SEQ ID NO: 32657 - DNA, 25 bp, E. coli
cagccaacgggcgaacgttattgtg

SEQ ID NO: 32658 - DNA, 25 bp, E. coli
cagccaacgggccaacgttattgtg

SEQ ID NO: 32659 - DNA, 25 bp, E. coli
tacgtgacgcagaatcatgggacag

SEQ ID NO: 32660 - DNA, 25 bp, E. coli
tatgattccggcagtggctggccca

SEQ ID NO: 32661 - DNA, 25 bp, E. coli
tatgattccggctgtggctggccca

SEQ ID NO: 32662 - DNA, 25 bp, E. coli
tacgtgacgcagtatcatgggacag

SEQ ID NO: 32663 - DNA, 25 bp, E. coli
ttactgcataacaagcgtgacggcg

SEQ ID NO: 32664 - DNA, 25 bp, E. coli
ttactgcataactagcgtgacggcg

SEQ ID NO: 32665 - DNA, 25 bp, E. coli
ccatttacgggtcgtttactgcata

SEQ ID NO: 32666 - DNA, 25 bp, E. coli
ccatttacgggtggtttactgcata

SEQ ID NO: 32667 - DNA, 25 bp, E. coli
gacttgtcacatggaatgcagcgca

SEQ ID NO: 32668 - DNA, 25 bp, E. coli
gacttgtcacatcgaatgcagcgca

SEQ ID NO: 32669 - DNA, 25 bp, E. coli
gctggcccagtttctacgaaccggt

SEQ ID NO: 32670 - DNA, 25 bp, E. coli
gctggcccagttactacgaaccggt

SEQ ID NO: 32671 - DNA, 25 bp, E. coli
tggctaataaacgttcggcagaaga

SEQ ID NO: 32672 - DNA, 25 bp, E. coli
tggctaataaaccttcggcagaaga

SEQ ID NO: 32673 - DNA, 25 bp, E. coli
tcactgtttgatctgcgatgccccg

SEQ ID NO: 32674 - DNA, 25 bp, E. coli
tcactgtttgatgtgcgatgccccg

SEQ ID NO: 32675 - DNA, 25 bp, E. coli
gatgccccgctgtttcattcccaaa

SEQ ID NO: 32676 - DNA, 25 bp, E. coli
gatgccccgctgattcattcccaaa

SEQ ID NO: 32677 - DNA, 25 bp, E. coli
taaagccgtaagcatataagcatgg

SEQ ID NO: 32678 - DNA, 25 bp, E. coli
tactgtgaagatattgacctgtgct

SEQ ID NO: 32679 - DNA, 25 bp, E. coli
tactgtgaagattttgacctgtgct

SEQ ID NO: 32680 - DNA, 25 bp, E. coli
taaagccgtaaggatataagcatgg

SEQ ID NO: 32681 - DNA, 25 bp, E. coli
tatttgcgaacaatccaggccgcga

SEQ ID NO: 32682 - DNA, 25 bp, E. coli
tatttgcgaacattccaggccgcga

SEQ ID NO: 32683 - DNA, 25 bp, E. coli
ttagcctggctggtgtcagacttca

SEQ ID NO: 32684 - DNA, 25 bp, E. coli
ttagcctggctgctgtcagacttca

SEQ ID NO: 32685 - DNA, 25 bp, E. coli
ttttcaaaagccttcagatggcact

SEQ ID NO: 32686 - DNA, 25 bp, E. coli
ttttcaaaagccatcagatggcact

SEQ ID NO: 32687 - DNA, 25 bp, E. coli
tgatacggttgtagattggtgcgca

SEQ ID NO: 32688 - DNA, 25 bp, E. coli
tgatacggttgttgattggtgcgca

SEQ ID NO: 32689 - DNA, 25 bp, E. coli
tgtgcgtgtaaaaggcttcgatcaa

SEQ ID NO: 32690 - DNA, 25 bp, E. coli
tgtgcgtgtaaatggcttcgatcaa

SEQ ID NO: 32691 - DNA, 25 bp, E. coli
tcacccgtaataaaaagccgtaagc

SEQ ID NO: 32692 - DNA, 25 bp, E. coli
tcacccgtaatataaagccgtaagc

SEQ ID NO: 32693 - DNA, 25 bp, E. coli
gcggtgatcacacctgacaggagta

SEQ ID NO: 32694 - DNA, 25 bp, E. coli
gcggtgatcacagctgacaggagta

SEQ ID NO: 32695 - DNA, 25 bp, E. coli
gaatttcatcagtttttcacccgta

SEQ ID NO: 32696 - DNA, 25 bp, E. coli
gaatttcatcagattttcacccgta

SEQ ID NO: 32697 - DNA, 25 bp, E. coli
gacctgtgcttgaggcttagcctgg

SEQ ID NO: 32698 - DNA, 25 bp, E. coli
gacctgtgcttgtggcttagcctgg

SEQ ID NO: 32699 - DNA, 25 bp, E. coli
acgactgcgtggtctgagcgacaaa

SEQ ID NO: 32700 - DNA, 25 bp, E. coli
acgactgcgtggactgagcgacaaa

SEQ ID NO: 32701 - DNA, 25 bp, E. coli
actgcgtggtctgagcgacaaacag

SEQ ID NO: 32702 - DNA, 25 bp, E. coli
actgcgtggtctcagcgacaaacag

SEQ ID NO: 32703 - DNA, 25 bp, E. coli
aaacagaccgaaggccgccatattc

SEQ ID NO: 32704 - DNA, 25 bp, E. coli
aaacagaccgaacgccgccatattc

SEQ ID NO: 32705 - DNA, 25 bp, E. coli
gctggcctctactcgaactatgctg

SEQ ID NO: 32706 - DNA, 25 bp, E. coli
gctggcctctacacgaactatgctg

SEQ ID NO: 32707 - DNA, 25 bp, E. coli
gcacgactgcgtcgtctgagcgaca

SEQ ID NO: 32708 - DNA, 25 bp, E. coli
gcacgactgcgtggtctgagcgaca

SEQ ID NO: 32709 - DNA, 25 bp, E. coli
ctcgaactatgcaggggctggatca

SEQ ID NO: 32710 - DNA, 25 bp, E. coli
cggcgcttgattttttgcgtttatc

SEQ ID NO: 32711 - DNA, 25 bp, E. coli
cgtcacctgggcacgactgcgtggt

SEQ ID NO: 32712 - DNA, 25 bp, E. coli
ctcgaactatgctggggctggatca

SEQ ID NO: 32713 - DNA, 25 bp, E. coli
cggcgcttgattatttgcgtttatc

SEQ ID NO: 32714 - DNA, 25 bp, E. coli
cgtcacctgggctcgactgcgtggt

SEQ ID NO: 32715 - DNA, 25 bp, E. coli
tggcctctactccaactatgctggg

SEQ ID NO: 32716 - DNA, 25 bp, E. coli
tggcctctactcgaactatgctggg

SEQ ID NO: 32717 - DNA, 25 bp, E. coli
tcacctgggcacgactgcgtggtct

SEQ ID NO: 32718 - DNA, 25 bp, E. coli
tcacctgggcaccactgcgtggtct

SEQ ID NO: 32719 - DNA, 25 bp, E. coli
gatgctggcctcaactcgaactatg

SEQ ID NO: 32720 - DNA, 25 bp, E. coli
gatgctggcctctactcgaactatg

SEQ ID NO: 32721 - DNA, 25 bp, E. coli
aatcaaaatcctagccgagtggctg

SEQ ID NO: 32722 - DNA, 25 bp, E. coli
aatcaaaatccttgccgagtggctg

SEQ ID NO: 32723 - DNA, 25 bp, E. coli
cactttctacggaggtgcgattccg

SEQ ID NO: 32724 - DNA, 25 bp, E. coli
cactttctacggtggtgcgattccg

SEQ ID NO: 32725 - DNA, 25 bp, E. coli
tatcgacaatatttactgccgctgg

SEQ ID NO: 32726 - DNA, 25 bp, E. coli
tatcgacaatatatactgccgctgg

SEQ ID NO: 32727 - DNA, 25 bp, E. coli
tgggaacggcatcgcaaatcaaaat

SEQ ID NO: 32728 - DNA, 25 bp, E. coli
tgggaacggcatggcaaatcaaaat

SEQ ID NO: 32729 - DNA, 25 bp, E. coli
cctgaatgtcttagccgtgccgacg

SEQ ID NO: 32730 - DNA, 25 bp, E. coli
cctgctatcaaagagaacggcctga

SEQ ID NO: 32731 - DNA, 25 bp, E. coli
cctgctatcaaacagaacggcctga

SEQ ID NO: 32732 - DNA, 25 bp, E. coli
cctgaatgtctttgccgtgccgacg

SEQ ID NO: 32733 - DNA, 25 bp, E. coli
gcgctgcgccaagttcgtgctgtaa

SEQ ID NO: 32734 - DNA, 25 bp, E. coli
gcgctgcgccaacttcgtgctgtaa

SEQ ID NO: 32735 - DNA, 25 bp, E. coli
gacctgaaagggactggcgacctgt

SEQ ID NO: 32736 - DNA, 25 bp, E. coli
gacctgaaagggtctggcgacctgt

SEQ ID NO: 32737 - DNA, 25 bp, E. coli
cccagcagcatgtgagcgatgaatt

SEQ ID NO: 32738 - DNA, 25 bp, E. coli
cccagcagcatgagagcgatgaatt

SEQ ID NO: 32739 - DNA, 25 bp, E. coli
gatctcgacagtcccattgctgccg

SEQ ID NO: 32740 - DNA, 25 bp, E. coli
gatctcgacagtgccattgctgccg

SEQ ID NO: 32741 - DNA, 25 bp, E. coli
taaccacgggctttatgggaacggc

SEQ ID NO: 32742 - DNA, 25 bp, E. coli
taaccacgggctatatgggaacggc

SEQ ID NO: 32743 - DNA, 25 bp, E. coli
aaaaggccgccagcttggtgaactg

SEQ ID NO: 32744 - DNA, 25 bp, E. coli
aaaaggccgccaccttggtgaactg

SEQ ID NO: 32745 - DNA, 25 bp, E. coli
aaagttctcagcgatgacgttccgc

SEQ ID NO: 32746 - DNA, 25 bp, E. coli
aaagttctcagccatgacgttccgc

SEQ ID NO: 32747 - DNA, 25 bp, E. coli
tatcaggccgactgtatctgggaaa

SEQ ID NO: 32748 - DNA, 25 bp, E. coli
tatcaggccgacagtatctgggaaa

SEQ ID NO: 32749 - DNA, 25 bp, E. coli
ttatttcgttgcctgcggatcgcca

SEQ ID NO: 32750 - DNA, 25 bp, E. coli
ttatttcgttgcgtgcggatcgcca

SEQ ID NO: 32751 - DNA, 25 bp, E. coli
tgttaaacagcgaactgacaacgtg

SEQ ID NO: 32752 - DNA, 25 bp, E. coli
tgttaaacagcgtactgacaacgtg

SEQ ID NO: 32753 - DNA, 25 bp, E. coli
tccggctgggagatctgcgataaca

SEQ ID NO: 32754 - DNA, 25 bp, E. coli
tccggctgggagttctgcgataaca

SEQ ID NO: 32755 - DNA, 25 bp, E. coli
cctgatgttcgtcccaatggagtgg

SEQ ID NO: 32756 - DNA, 25 bp, E. coli
cctgatgttcgtgccaatggagtgg

SEQ ID NO: 32757 - DNA, 25 bp, E. coli
cctgctcggcaatgatgaaagtcgc

SEQ ID NO: 32758 - DNA, 25 bp, E. coli
cctgctcggcaaagatgaaagtcgc

SEQ ID NO: 32759 - DNA, 25 bp, E. coli
gaagaggtaatcaaagcgctggagc

SEQ ID NO: 32760 - DNA, 25 bp, E. coli
gaagaggtaatctaagcgctggagc

SEQ ID NO: 32761 - DNA, 25 bp, E. coli
tggagattgtcgtaccgggcgttcc

SEQ ID NO: 32762 - DNA, 25 bp, E. coli
tggaatttacctggacgcacggctg

SEQ ID NO: 32763 - DNA, 25 bp, E. coli
tggaatttacctcgacgcacggctg

SEQ ID NO: 32764 - DNA, 25 bp, E. coli
tggagattgtcgaaccgggcgttcc

SEQ ID NO: 32765 - DNA, 25 bp, E. coli
caaatcggcgaacatgcctggctga

SEQ ID NO: 32766 - DNA, 25 bp, E. coli
caaatttcgtaaaggcgtagaacgc

SEQ ID NO: 32767 - DNA, 25 bp, E. coli
caaatttcgtaatggcgtagaacgc

SEQ ID NO: 32768 - DNA, 25 bp, E. coli
caaatcggcgaagatgcctggctga

SEQ ID NO: 32769 - DNA, 25 bp, E. coli
cagtgcatcacgaagtaacagtcgc

SEQ ID NO: 32770 - DNA, 25 bp, E. coli
cagtgcatcacgtagtaacagtcgc

SEQ ID NO: 32771 - DNA, 25 bp, E. coli
tgatcgtctgcttcgcgggcaaagt

SEQ ID NO: 32772 - DNA, 25 bp, E. coli
tgatcgtctgctacgcgggcaaagt

SEQ ID NO: 32773 - DNA, 25 bp, E. coli
tcacttcgggcacgatttcacatta

SEQ ID NO: 32774 - DNA, 25 bp, E. coli
tcacttcgggcaggatttcacatta

SEQ ID NO: 32775 - DNA, 25 bp, E. coli
gaagcacttcgctcggttgatcgtc

SEQ ID NO: 32776 - DNA, 25 bp, E. coli
gaagcacttcgcacggttgatcgtc

SEQ ID NO: 32777 - DNA, 25 bp, E. coli
gaactgcggcgagaatcacttcggg

SEQ ID NO: 32778 - DNA, 25 bp, E. coli
gaaagctggaatggtggtccacaaa

SEQ ID NO: 32779 - DNA, 25 bp, E. coli
gaactgcggcgacaatcacttcggg

SEQ ID NO: 32780 - DNA, 25 bp, E. coli
gaaagctggaatcgtggtccacaaa

SEQ ID NO: 32781 - DNA, 25 bp, E. coli
gtagaacgccatgtacaccacgtcg

SEQ ID NO: 32782 - DNA, 25 bp, E. coli
gtagaacgccatctacaccacgtcg

SEQ ID NO: 32783 - DNA, 25 bp, E. coli
taacctgaacgagacgcatgcaaca

SEQ ID NO: 32784 - DNA, 25 bp, E. coli
taacctgaacgacacgcatgcaaca

SEQ ID NO: 32785 - DNA, 25 bp, E. coli
gatggccacgctctaaaacaaatcg

SEQ ID NO: 32786 - DNA, 25 bp, E. coli
gatggccacgctgtaaaacaaatcg

SEQ ID NO: 32787 - DNA, 25 bp, E. coli
tactggatagcctccctgtgcagac

SEQ ID NO: 32788 - DNA, 25 bp, E. coli
tactggatagccaccctgtgcagac

SEQ ID NO: 32789 - DNA, 25 bp, E. coli
atatggtgttgatgggcctggcccc

SEQ ID NO: 32790 - DNA, 25 bp, E. coli
atatggtgttgaagggcctggcccc

SEQ ID NO: 32791 - DNA, 25 bp, E. coli
aaaagctgggcattttgcatctggc

SEQ ID NO: 32792 - DNA, 25 bp, E. coli
aaaagctgggcaatttgcatctggc

SEQ ID NO: 32793 - DNA, 25 bp, E. coli
tgtctgttaggagccaatggttgcg

SEQ ID NO: 32794 - DNA, 25 bp, E. coli
tgtctgttaggacccaatggttgcg

SEQ ID NO: 32795 - DNA, 25 bp, E. coli
tcccggtaagcatgaacgcctgaaa

SEQ ID NO: 32796 - DNA, 25 bp, E. coli
tgccgacagcataatccaggtagag

SEQ ID NO: 32797 - DNA, 25 bp, E. coli
tgccgacagcattatccaggtagag

SEQ ID NO: 32798 - DNA, 25 bp, E. coli
tcccggtaagcaagaacgcctgaaa

SEQ ID NO: 32799 - DNA, 25 bp, E. coli
ccagatggacgactaacacaaggct

SEQ ID NO: 32800 - DNA, 25 bp, E. coli
ccagatggacgagtaacacaaggct

SEQ ID NO: 32801 - DNA, 25 bp, E. coli
cggcggtgaacgtcagctggcttta

SEQ ID NO: 32802 - DNA, 25 bp, E. coli
cggcggtgaacgacagctggcttta

SEQ ID NO: 32803 - DNA, 25 bp, E. coli
gttgcggcaaaagcacactcatgcg

SEQ ID NO: 32804 - DNA, 25 bp, E. coli
gttgcggcaaaaccacactcatgcg

SEQ ID NO: 32805 - DNA, 25 bp, E. coli
gtcatgcgtctcagggttactcccg

SEQ ID NO: 32806 - DNA, 25 bp, E. coli
gtcatgcgtctctgggttactcccg

SEQ ID NO: 32807 - DNA, 25 bp, E. coli
tcaccctgtcgcaaggaacaatttg

SEQ ID NO: 32808 - DNA, 25 bp, E. coli
tcaccctgtcgctaggaacaatttg

SEQ ID NO: 32809 - DNA, 25 bp, E. coli
aacctcgcgcaagatcatccgtgag

SEQ ID NO: 32810 - DNA, 25 bp, E. coli
caaatacgtgccaggctcgccgctt

SEQ ID NO: 32811 - DNA, 25 bp, E. coli
caaatacgtgcctggctcgccgctt

SEQ ID NO: 32812 - DNA, 25 bp, E. coli
tacgctgggtaaacagatcgttcac

SEQ ID NO: 32813 - DNA, 25 bp, E. coli
aacctcgcgcaacatcatccgtgag

SEQ ID NO: 32814 - DNA, 25 bp, E. coli
tacgctgggtaatcagatcgttcac

SEQ ID NO: 32815 - DNA, 25 bp, E. coli
ttcgctgatggccaagcggctgatt

SEQ ID NO: 32816 - DNA, 25 bp, E. coli
ttcgctgatggcgaagcggctgatt

SEQ ID NO: 32817 - DNA, 25 bp, E. coli
tgtgaggagtttccaacctcgcgca

SEQ ID NO: 32818 - DNA, 25 bp, E. coli
tgtgaggagtttgcaacctcgcgca

SEQ ID NO: 32819 - DNA, 25 bp, E. coli
tgactctcaatataaccgatcgcat

SEQ ID NO: 32820 - DNA, 25 bp, E. coli
tgactctcaataaaaccgatcgcat

SEQ ID NO: 32821 - DNA, 25 bp, E. coli
cctcgacactgacgtactgcaatgg

SEQ ID NO: 32822 - DNA, 25 bp, E. coli
cctcgacactgaggtactgcaatgg

SEQ ID NO: 32823 - DNA, 25 bp, E. coli
cgatctggcgcagattgaatcggcg

SEQ ID NO: 32824 - DNA, 25 bp, E. coli
cgatctggcgcacattgaatcggcg

SEQ ID NO: 32825 - DNA, 25 bp, E. coli
cgtaaccagtggtattacctcgaca

SEQ ID NO: 32826 - DNA, 25 bp, E. coli
cgtaaccagtggaattacctcgaca

SEQ ID NO: 32827 - DNA, 25 bp, E. coli
gattgaaatgaaacgttatcgcggg

SEQ ID NO: 32828 - DNA, 25 bp, E. coli
gattgaaatgaatcgttatcgcggg

SEQ ID NO: 32829 - DNA, 25 bp, E. coli
gatcgttcacggcaaatacgtgcca

SEQ ID NO: 32830 - DNA, 25 bp, E. coli
gatcgttcacgggaaatacgtgcca

SEQ ID NO: 32831 - DNA, 25 bp, E. coli
cagcgttaacgtgactcaggttggc

SEQ ID NO: 32832 - DNA, 25 bp, E. coli
cagcgttaacgtcactcaggttggc

SEQ ID NO: 32833 - DNA, 25 bp, E. coli
actgcatctaactccagcgttaacg

SEQ ID NO: 32834 - DNA, 25 bp, E. coli
actgcatctaacaccagcgttaacg

SEQ ID NO: 32835 - DNA, 25 bp, E. coli
tgatctgaccattacccagcacggc

SEQ ID NO: 32836 - DNA, 25 bp, E. coli
tgacgcccgtaactctgatctgacc

SEQ ID NO: 32837 - DNA, 25 bp, E. coli
tgacgcccgtaagtctgatctgacc

SEQ ID NO: 32838 - DNA, 25 bp, E. coli
tgatctgaccataacccagcacggc

SEQ ID NO: 32839 - DNA, 25 bp, E. coli
tcagtggaatggaaaagattctact

SEQ ID NO: 32840 - DNA, 25 bp, E. coli
tcttgctcagcaagctgacgcccgt

SEQ ID NO: 32841 - DNA, 25 bp, E. coli
tcagtggaatggtaaagattctact

SEQ ID NO: 32842 - DNA, 25 bp, E. coli
tcttgctcagcatgctgacgcccgt

SEQ ID NO: 32843 - DNA, 25 bp, E. coli
tcaatcgatctgactcagcgtggtt

SEQ ID NO: 32844 - DNA, 25 bp, E. coli
gcgtggtttcggcaacagcgctact

SEQ ID NO: 32845 - DNA, 25 bp, E. coli
gcgtggtttcgggaacagcgctact

SEQ ID NO: 32846 - DNA, 25 bp, E. coli
cggtaacggtgctgctgttgaccag

SEQ ID NO: 32847 - DNA, 25 bp, E. coli
cggtaacggtgcagctgttgaccag

SEQ ID NO: 32848 - DNA, 25 bp, E. coli
gattctactatgtctgttaaacagt

SEQ ID NO: 32849 - DNA, 25 bp, E. coli
gattctactatgactgttaaacagt

SEQ ID NO: 32850 - DNA, 25 bp, E. coli
gggccaaggttctgatgacagctca

SEQ ID NO: 32851 - DNA, 25 bp, E. coli
gggccaaggttcagatgacagctca

SEQ ID NO: 32852 - DNA, 25 bp, E. coli
tcaatcgatctgtctcagcgtggtt

SEQ ID NO: 32853 - DNA, 25 bp, E. coli
caacgtagtaaatattgcgccggac

SEQ ID NO: 32854 - DNA, 25 bp, E. coli
caacgtagtaaaaattgcgccggac

SEQ ID NO: 32855 - DNA, 25 bp, E. coli
cacgctactggttctggcgaatcct

SEQ ID NO: 32856 - DNA, 25 bp, E. coli
cacgctactggtactggcgaatcct

SEQ ID NO: 32857 - DNA, 25 bp, E. coli
tactggcgaatcctatcggaccaac

SEQ ID NO: 32858 - DNA, 25 bp, E. coli
tactggcgaatcgtatcggaccaac

SEQ ID NO: 32859 - DNA, 25 bp, E. coli
actggtactggcgaatcctatcgga

SEQ ID NO: 32860 - DNA, 25 bp, E. coli
actggtactggccaatcctatcgga

SEQ ID NO: 32861 - DNA, 25 bp, E. coli
actggccgcgacagtacatgaccgc

SEQ ID NO: 32862 - DNA, 25 bp, E. coli
actggccgcgactgtacatgaccgc

SEQ ID NO: 32863 - DNA, 25 bp, E. coli
tcctcaacgtagaaaatattgcgcc

SEQ ID NO: 32864 - DNA, 25 bp, E. coli
tcctcaacgtagtaaatattgcgcc

SEQ ID NO: 32865 - DNA, 25 bp, E. coli
gctactggtactcgcgaatcctatc

SEQ ID NO: 32866 - DNA, 25 bp, E. coli
gctactggtactggcgaatcctatc

SEQ ID NO: 32867 - DNA, 25 bp, E. coli
cgtagtaaatatagcgccggactgc

SEQ ID NO: 32868 - DNA, 25 bp, E. coli
cgtagtaaatattgcgccggactgc

SEQ ID NO: 32869 - DNA, 25 bp, E. coli
ggtactggcgaaacctatcggacca

SEQ ID NO: 32870 - DNA, 25 bp, E. coli
ggtactggcgaatcctatcggacca

SEQ ID NO: 32871 - DNA, 25 bp, E. coli
ggccgcgactgtacatgaccgcttt

SEQ ID NO: 32872 - DNA, 25 bp, E. coli
ggaaaccgcactcgccgcgactgta

SEQ ID NO: 32873 - DNA, 25 bp, E. coli
ggaaaccgcactggccgcgactgta

SEQ ID NO: 32874 - DNA, 25 bp, E. coli
ggccgcgactgttcatgaccgcttt

SEQ ID NO: 32875 - DNA, 25 bp, E. coli
aatcgtgcgatttcctattcctgtt

SEQ ID NO: 32876 - DNA, 25 bp, E. coli
aatcgtgcgattacctattcctgtt

SEQ ID NO: 32877 - DNA, 25 bp, E. coli
attacctattcctgttccaaatgta

SEQ ID NO: 32878 - DNA, 25 bp, E. coli
acctattcctgttccaaatgtattg

SEQ ID NO: 32879 - DNA, 25 bp, E. coli
atcgtgcgattacctattcctgttc

SEQ ID NO: 32880 - DNA, 25 bp, E. coli
atcgtgcgattagctattcctgttc

SEQ ID NO: 32881 - DNA, 25 bp, E. coli
attacctattccagttccaaatgta

SEQ ID NO: 32882 - DNA, 25 bp, E. coli
acctattcctgtaccaaatgtattg

SEQ ID NO: 32883 - DNA, 25 bp, E. coli
tgcgattacctaatcctgttccaaa

SEQ ID NO: 32884 - DNA, 25 bp, E. coli
tgcgattacctattcctgttccaaa

SEQ ID NO: 32885 - DNA, 25 bp, E. coli
tcgtgcgattacctattcctgttcc

SEQ ID NO: 32886 - DNA, 25 bp, E. coli
tcgtgcgattacgtattcctgttcc

SEQ ID NO: 32887 - DNA, 25 bp, E. coli
gcgattacctatacctgttccaaat

SEQ ID NO: 32888 - DNA, 25 bp, E. coli
gcgattacctattcctgttccaaat

SEQ ID NO: 32889 - DNA, 25 bp, E. coli
cgtgcgattaccaattcctgttcca

SEQ ID NO: 32890 - DNA, 25 bp, E. coli
cgattacctattgctgttccaaatg

SEQ ID NO: 32891 - DNA, 25 bp, E. coli
cgattacctattcctgttccaaatg

SEQ ID NO: 32892 - DNA, 25 bp, E. coli
cgtgcgattacctattcctgttcca

SEQ ID NO: 32893 - DNA, 25 bp, E. coli
gattacctattcgtgttccaaatgt

SEQ ID NO: 32894 - DNA, 25 bp, E. coli
gattacctattcctgttccaaatgt

SEQ ID NO: 32895 - DNA, 25 bp, E. coli
gtgcgattacctattcctgttccaa

SEQ ID NO: 32896 - DNA, 25 bp, E. coli
gtgcgattaccttttcctgttccaa

SEQ ID NO: 32897 - DNA, 25 bp, E. coli
caactggaaaatcctgccgggtgta

SEQ ID NO: 32898 - DNA, 25 bp, E. coli
caactggaaaatgctgccgggtgta

SEQ ID NO: 32899 - DNA, 25 bp, E. coli
agcttgatggtatccttcgccggca

SEQ ID NO: 32900 - DNA, 25 bp, E. coli
agcttgatggtaaccttcgccggca

SEQ ID NO: 32901 - DNA, 25 bp, E. coli
tacctggagcagtatccccgaaagg

SEQ ID NO: 32902 - DNA, 25 bp, E. coli
tacctggagcagaatccccgaaagg

SEQ ID NO: 32903 - DNA, 25 bp, E. coli
tatacaaggaggctacagcgttccc

SEQ ID NO: 32904 - DNA, 25 bp, E. coli
tattgacggctaaacatcggcagca

SEQ ID NO: 32905 - DNA, 25 bp, E. coli
tatacaaggagggtacagcgttccc

SEQ ID NO: 32906 - DNA, 25 bp, E. coli
tatatgtcggtatatggctatcccg

SEQ ID NO: 32907 - DNA, 25 bp, E. coli
tatatgtcggtaaatggctatcccg

SEQ ID NO: 32908 - DNA, 25 bp, E. coli
tattgacggctatacatcggcagca

SEQ ID NO: 32909 - DNA, 25 bp, E. coli
gacagtctgaaaccacagcctctga

SEQ ID NO: 32910 - DNA, 25 bp, E. coli
gacgacgcttaccaatcagcacggg

SEQ ID NO: 32911 - DNA, 25 bp, E. coli
gacagtctgaaagcacagcctctga

SEQ ID NO: 32912 - DNA, 25 bp, E. coli
gacgacgcttacgaatcagcacggg

SEQ ID NO: 32913 - DNA, 25 bp, E. coli
gaaaggttgcctcttacctcgccag

SEQ ID NO: 32914 - DNA, 25 bp, E. coli
gaaaggttgcctgttacctcgccag

SEQ ID NO: 32915 - DNA, 25 bp, E. coli
ggaatttcaggaactgccagacggt

SEQ ID NO: 32916 - DNA, 25 bp, E. coli
ggaatttcaggatctgccagacggt

SEQ ID NO: 32917 - DNA, 25 bp, E. coli
ggctgaccggcattcgtactgaaaa

SEQ ID NO: 32918 - DNA, 25 bp, E. coli
ggctgaccggcaatcgtactgaaaa

SEQ ID NO: 32919 - DNA, 25 bp, E. coli
cagaagtgcgttccagtcgttcggc

SEQ ID NO: 32920 - DNA, 25 bp, E. coli
cagaagtgcgttgcagtcgttcggc

SEQ ID NO: 32921 - DNA, 25 bp, E. coli
agatttagccgaagccgaagccgaa

SEQ ID NO: 32922 - DNA, 25 bp, E. coli
agatttagccgatgccgaagccgaa

SEQ ID NO: 32923 - DNA, 25 bp, E. coli
tgttcacgcgtgcacgtcagcaggt

SEQ ID NO: 32924 - DNA, 25 bp, E. coli
tgttcacgcgtggacgtcagcaggt

SEQ ID NO: 32925 - DNA, 25 bp, E. coli
tgtgcgaatacttcagacgtctgct

SEQ ID NO: 32926 - DNA, 25 bp, E. coli
tgtgcgaatactacagacgtctgct

SEQ ID NO: 32927 - DNA, 25 bp, E. coli
tcaggtcttcagctcagtggtgaca

SEQ ID NO: 32928 - DNA, 25 bp, E. coli
tcaggtcttcaggtcagtggtgaca

SEQ ID NO: 32929 - DNA, 25 bp, E. coli
gacaattctgtctcggtgctggcag

SEQ ID NO: 32930 - DNA, 25 bp, E. coli
gacaattctgtcacggtgctggcag

SEQ ID NO: 32931 - DNA, 25 bp, E. coli
ggacaggatgctgcccggaaaaaga

SEQ ID NO: 32932 - DNA, 25 bp, E. coli
gtggcagcaacagatgattcaggtc

SEQ ID NO: 32933 - DNA, 25 bp, E. coli
ggacaggatgctccccggaaaaaga

SEQ ID NO: 32934 - DNA, 25 bp, E. coli
ggtaacaaagcgcaacaggcccgtg

SEQ ID NO: 32935 - DNA, 25 bp, E. coli
ggtaacaaagcggaacaggcccgtg

SEQ ID NO: 32936 - DNA, 25 bp, E. coli
ggagccatgcctgactgtgcgaata

SEQ ID NO: 32937 - DNA, 25 bp, E. coli
ggagccatgcctcactgtgcgaata

SEQ ID NO: 32938 - DNA, 25 bp, E. coli
gtggcagcaacacatgattcaggtc

SEQ ID NO: 32939 - DNA, 25 bp, E. coli
tggttcatgcagaggccggtacaga

SEQ ID NO: 32940 - DNA, 25 bp, E. coli
tggttcatgcagtggccggtacaga

SEQ ID NO: 32941 - DNA, 25 bp, E. coli
aagaaacacaatagatcggcgcgcg

SEQ ID NO: 32942 - DNA, 25 bp, E. coli
aagaaacacaattgatcggcgcgcg

SEQ ID NO: 32943 - DNA, 25 bp, E. coli
cactcattgattggcgcaggtttgc

SEQ ID NO: 32944 - DNA, 25 bp, E. coli
cactcattgattcgcgcaggtttgc

SEQ ID NO: 32945 - DNA, 25 bp, E. coli
tttatcagggcgtccactgcctgga

SEQ ID NO: 32946 - DNA, 25 bp, E. coli
tttatcagggcgaccactgcctgga

SEQ ID NO: 32947 - DNA, 25 bp, E. coli
tgacagctcgctacatcgcaattga

SEQ ID NO: 32948 - DNA, 25 bp, E. coli
tgacagctcgcttcatcgcaattga

SEQ ID NO: 32949 - DNA, 25 bp, E. coli
cctttcaggcgaagggttgcgacgt

SEQ ID NO: 32950 - DNA, 25 bp, E. coli
cctttcaggcgatgggttgcgacgt

SEQ ID NO: 32951 - DNA, 25 bp, E. coli
gcaggcaatcagtagcaggcgtcac

SEQ ID NO: 32952 - DNA, 25 bp, E. coli
gaagttcgcgccacgcatgtgctgg

SEQ ID NO: 32953 - DNA, 25 bp, E. coli
gcaggcaatcagaagcaggcgtcac

SEQ ID NO: 32954 - DNA, 25 bp, E. coli
gaagttcgcgcctcgcatgtgctgg

SEQ ID NO: 32955 - DNA, 25 bp, E. coli
cattgcaaatggctgcaggccgata

SEQ ID NO: 32956 - DNA, 25 bp, E. coli
cattgcaaatgggtgcaggccgata

SEQ ID NO: 32957 - DNA, 25 bp, E. coli
ggcgacacggcaattcaggctggta

SEQ ID NO: 32958 - DNA, 25 bp, E. coli
ggcgacacggcatttcaggctggta

SEQ ID NO: 32959 - DNA, 25 bp, E. coli
taaccacaatgtcatgcgcggcgaa

SEQ ID NO: 32960 - DNA, 25 bp, E. coli
taaggagcatcgctcatgcagtggc

SEQ ID NO: 32961 - DNA, 25 bp, E. coli
taaccacaatgtgatgcgcggcgaa

SEQ ID NO: 32962 - DNA, 25 bp, E. coli
taaggagcatcggtcatgcagtggc

SEQ ID NO: 32963 - DNA, 25 bp, E. coli
caatcactctggaatggcatgggaa

SEQ ID NO: 32964 - DNA, 25 bp, E. coli
caatcactctggtatggcatgggaa

SEQ ID NO: 32965 - DNA, 25 bp, E. coli
catttcagcagaaattttccccgga

SEQ ID NO: 32966 - DNA, 25 bp, E. coli
catttcagcagatattttccccgga

SEQ ID NO: 32967 - DNA, 25 bp, E. coli
taaaacttctcaatggtgcgatgcg

SEQ ID NO: 32968 - DNA, 25 bp, E. coli
taaaacttctcattggtgcgatgcg

SEQ ID NO: 32969 - DNA, 25 bp, E. coli
tactgaatacgcgaggagttgcagg

SEQ ID NO: 32970 - DNA, 25 bp, E. coli
tactgaatacgccaggagttgcagg

SEQ ID NO: 32971 - DNA, 25 bp, E. coli
aaaaaacgccttatcctggcgagcg

SEQ ID NO: 32972 - DNA, 25 bp, E. coli
aaaaaacgccttttcctggcgagcg

SEQ ID NO: 32973 - DNA, 25 bp, E. coli
tatgggcgttgccaatcaaccacgg

SEQ ID NO: 32974 - DNA, 25 bp, E. coli
tatgggcgttgcgaatcaaccacgg

SEQ ID NO: 32975 - DNA, 25 bp, E. coli
ttccgatgggaaacctaacgctagg

SEQ ID NO: 32976 - DNA, 25 bp, E. coli
ttccgatgggaatcctaacgctagg

SEQ ID NO: 32977 - DNA, 25 bp, E. coli
ttttggattgatcggcaacccacgc

SEQ ID NO: 32978 - DNA, 25 bp, E. coli
ttttggattgatgggcaacccacgc

SEQ ID NO: 32979 - DNA, 25 bp, E. coli
tgctcttgataatggcaccagcctg

SEQ ID NO: 32980 - DNA, 25 bp, E. coli
tgctcttgataaaggcaccagcctg

SEQ ID NO: 32981 - DNA, 25 bp, E. coli
gaaaggttctctgccaaaagtcgac

SEQ ID NO: 32982 - DNA, 25 bp, E. coli
gaaaggttctctcccaaaagtcgac

SEQ ID NO: 32983 - DNA, 25 bp, E. coli
tcagcggtacgaagaagaatccaac

SEQ ID NO: 32984 - DNA, 25 bp, E. coli
tcagcggtacgatgaagaatccaac

SEQ ID NO: 32985 - DNA, 25 bp, E. coli
acccgctgctgttgccgcgtggcga

SEQ ID NO: 32986 - DNA, 25 bp, E. coli
atctggttagcgtacagcctggcgt

SEQ ID NO: 32987 - DNA, 25 bp, E. coli
accctgcggcgctgatctccggtca

SEQ ID NO: 32988 - DNA, 25 bp, E. coli
atctggttagcgaacagcctggcgt

SEQ ID NO: 32989 - DNA, 25 bp, E. coli
accctgcggcgcagatctccggtca

SEQ ID NO: 32990 - DNA, 25 bp, E. coli
acccgctgctgtagccgcgtggcga

SEQ ID NO: 32991 - DNA, 25 bp, E. coli
acaaccacaggctgcaaaaatcaac

SEQ ID NO: 32992 - DNA, 25 bp, E. coli
aaacctttgccgacccgctgctgtt

SEQ ID NO: 32993 - DNA, 25 bp, E. coli
acaaccacaggcagcaaaaatcaac

SEQ ID NO: 32994 - DNA, 25 bp, E. coli
aaacctttgccgtcccgctgctgtt

SEQ ID NO: 32995 - DNA, 25 bp, E. coli
tgccgccacgcaacagcaactggat

SEQ ID NO: 32996 - DNA, 25 bp, E. coli
tgccgccacgcatcagcaactggat

SEQ ID NO: 32997 - DNA, 25 bp, E. coli
gccacgcaacaggaactggataatc

SEQ ID NO: 32998 - DNA, 25 bp, E. coli
gccacgcaacagcaactggataatc

SEQ ID NO: 32999 - DNA, 25 bp, E. coli
gctgttgccgcgtggcgaacgccaa

SEQ ID NO: 33000 - DNA, 25 bp, E. coli
gctgttgccgcgaggcgaacgccaa

SEQ ID NO: 33001 - DNA, 25 bp, E. coli
ctcaccgctgctggtgcgcgtaaag

SEQ ID NO: 33002 - DNA, 25 bp, E. coli
ctcaccgctgctcgtgcgcgtaaag

SEQ ID NO: 33003 - DNA, 25 bp, E. coli
gtgtgcgccaactacaaccacaggc

SEQ ID NO: 33004 - DNA, 25 bp, E. coli
gtgtgcgccaacaacaaccacaggc

SEQ ID NO: 33005 - DNA, 25 bp, E. coli
tcactgctgatgagccactcttcca

SEQ ID NO: 33006 - DNA, 25 bp, E. coli
tcactgctgatgtgccactcttcca

SEQ ID NO: 33007 - DNA, 25 bp, E. coli
caagaatggtctaccctccacggtt

SEQ ID NO: 33008 - DNA, 25 bp, E. coli
caagaatggtcttccctccacggtt

SEQ ID NO: 33009 - DNA, 25 bp, E. coli
taaagatgcgactctcatagaacga

SEQ ID NO: 33010 - DNA, 25 bp, E. coli
taaacgatctcataatgtgtgtcaa

SEQ ID NO: 33011 - DNA, 25 bp, E. coli
taaacgatctcaaaatgtgtgtcaa

SEQ ID NO: 33012 - DNA, 25 bp, E. coli
taaagatgcgacactcatagaacga

SEQ ID NO: 33013 - DNA, 25 bp, E. coli
tagtgtctactctgattttgcagga

SEQ ID NO: 33014 - DNA, 25 bp, E. coli
tagtgtctactcagattttgcagga

SEQ ID NO: 33015 - DNA, 25 bp, E. coli
tataatgataactacctgaaagctc

SEQ ID NO: 33016 - DNA, 25 bp, E. coli
tataatgataacaacctgaaagctc

SEQ ID NO: 33017 - DNA, 25 bp, E. coli
tttgatgtagaaaccaagaatggtc

SEQ ID NO: 33018 - DNA, 25 bp, E. coli
tttgatgtagaatccaagaatggtc

SEQ ID NO: 33019 - DNA, 25 bp, E. coli
tgattattcaacgatgcgtcatcgg

SEQ ID NO: 33020 - DNA, 25 bp, E. coli
tgactttgctaagtcgtttgaccca

SEQ ID NO: 33021 - DNA, 25 bp, E. coli
tgactttgctaactcgtttgaccca

SEQ ID NO: 33022 - DNA, 25 bp, E. coli
tgattattcaaccatgcgtcatcgg

SEQ ID NO: 33023 - DNA, 25 bp, E. coli
tcataatttatggactgcacgtgaa

SEQ ID NO: 33024 - DNA, 25 bp, E. coli
tcataatttatgcactgcacgtgaa

SEQ ID NO: 33025 - DNA, 25 bp, E. coli
taatcccgaggaaaataaagatgcg

SEQ ID NO: 33026 - DNA, 25 bp, E. coli
taatcccgaggataataaagatgcg

SEQ ID NO: 33027 - DNA, 25 bp, E. coli
gatgctgcaccgtaattaattgact

SEQ ID NO: 33028 - DNA, 25 bp, E. coli
gatgctgcaccgaaattaattgact

SEQ ID NO: 33029 - DNA, 25 bp, E. coli
catttatggttgatttcactgctgg

SEQ ID NO: 33030 - DNA, 25 bp, E. coli
atacctttcacaccctgccgattgg

SEQ ID NO: 33031 - DNA, 25 bp, E. coli
atacctttcacagcctgccgattgg

SEQ ID NO: 33032 - DNA, 25 bp, E. coli
tgatgctggcgtaaccgctcattac

SEQ ID NO: 33033 - DNA, 25 bp, E. coli
tgattttccttaacgggctgatgct

SEQ ID NO: 33034 - DNA, 25 bp, E. coli
tgattttccttatcgggctgatgct

SEQ ID NO: 33035 - DNA, 25 bp, E. coli
tgatgctggcgttaccgctcattac

SEQ ID NO: 33036 - DNA, 25 bp, E. coli
tgactgtcggcatctctttaatggc

SEQ ID NO: 33037 - DNA, 25 bp, E. coli
tgactgtcggcaactctttaatggc

SEQ ID NO: 33038 - DNA, 25 bp, E. coli
ccaaagcagggactttgattttcct

SEQ ID NO: 33039 - DNA, 25 bp, E. coli
ccaaagcagggagtttgattttcct

SEQ ID NO: 33040 - DNA, 25 bp, E. coli
cctgacatttaacggtcatttatgg

SEQ ID NO: 33041 - DNA, 25 bp, E. coli
cctgacatttaagggtcatttatgg

SEQ ID NO: 33042 - DNA, 25 bp, E. coli
gcgaaccgttgaacagcaatgcgtt

SEQ ID NO: 33043 - DNA, 25 bp, E. coli
gcgaaccgttgatcagcaatgcgtt

SEQ ID NO: 33044 - DNA, 25 bp, E. coli
gcaatgcgtttctggcactcaccaa

SEQ ID NO: 33045 - DNA, 25 bp, E. coli
gcaatgcgtttcaggcactcaccaa

SEQ ID NO: 33046 - DNA, 25 bp, E. coli
catttatggttgttttcactgctgg

SEQ ID NO: 33047 - DNA, 25 bp, E. coli
gatttccattaagtctgactgtcgg

SEQ ID NO: 33048 - DNA, 25 bp, E. coli
gatttccattaactctgactgtcgg

SEQ ID NO: 33049 - DNA, 25 bp, E. coli
tcactgctggtcgatacctttcaca

SEQ ID NO: 33050 - DNA, 25 bp, E. coli
tcactgctggtccatacctttcaca

SEQ ID NO: 33051 - DNA, 25 bp, E. coli
cactcccggtgaacatataatttca

SEQ ID NO: 33052 - DNA, 25 bp, E. coli
cactcccggtgatcatataatttca

SEQ ID NO: 33053 - DNA, 25 bp, E. coli
ttatacatttatgggtgatgctgcc

SEQ ID NO: 33054 - DNA, 25 bp, E. coli
ttatacatttatcggtgatgctgcc

SEQ ID NO: 33055 - DNA, 25 bp, E. coli
tgctagcgtagcgaaaaacttttta

SEQ ID NO: 33056 - DNA, 25 bp, E. coli
tgctagcgtagccaaaaacttttta

SEQ ID NO: 33057 - DNA, 25 bp, E. coli
tcctaatggagatacgacgcaatcc

SEQ ID NO: 33058 - DNA, 25 bp, E. coli
tcctaatggagaaacgacgcaatcc

SEQ ID NO: 33059 - DNA, 25 bp, E. coli
ccttattctgtgaacttcaggtgac

SEQ ID NO: 33060 - DNA, 25 bp, E. coli
ccttattctgtgtacttcaggtgac

SEQ ID NO: 33061 - DNA, 25 bp, E. coli
gcaatcccaactgggtcaaacaggt

SEQ ID NO: 33062 - DNA, 25 bp, E. coli
gcaatcccaactcggtcaaacaggt

SEQ ID NO: 33063 - DNA, 25 bp, E. coli
gaaaatagtgtactgattctccgca

SEQ ID NO: 33064 - DNA, 25 bp, E. coli
gactgtgcgcaacatcccatttcga

SEQ ID NO: 33065 - DNA, 25 bp, E. coli
gactgtgcgcaagatcccatttcga

SEQ ID NO: 33066 - DNA, 25 bp, E. coli
gaaaatagtgtagtgattctccgca

SEQ ID NO: 33067 - DNA, 25 bp, E. coli
cggtgagttattatgactgtgcgca

SEQ ID NO: 33068 - DNA, 25 bp, E. coli
cggtgagttattttgactgtgcgca

SEQ ID NO: 33069 - DNA, 25 bp, E. coli
gattctccgcattaaacaagtggtt

SEQ ID NO: 33070 - DNA, 25 bp, E. coli
gattctccgcataaaacaagtggtt

SEQ ID NO: 33071 - DNA, 25 bp, E. coli
gataattaatcaatcactcccggtg

SEQ ID NO: 33072 - DNA, 25 bp, E. coli
gataattaatcattcactcccggtg

SEQ ID NO: 33073 - DNA, 25 bp, E. coli
taactggaccggcaaccgtgtcacc

SEQ ID NO: 33074 - DNA, 25 bp, E. coli
taactggaccgggaaccgtgtcacc

SEQ ID NO: 33075 - DNA, 25 bp, E. coli
actacccgctctggccgtgaagtgg

SEQ ID NO: 33076 - DNA, 25 bp, E. coli
actacccgctctcgccgtgaagtgg

SEQ ID NO: 33077 - DNA, 25 bp, E. coli
ttgtatgtcgatcgtggcaaccttg

SEQ ID NO: 33078 - DNA, 25 bp, E. coli
ttgtatgtcgatggtggcaaccttg

SEQ ID NO: 33079 - DNA, 25 bp, E. coli
ttctttcgctggcacgcggcgcaaa

SEQ ID NO: 33080 - DNA, 25 bp, E. coli
ttctttcgctgggacgcggcgcaaa

SEQ ID NO: 33081 - DNA, 25 bp, E. coli
tgttacctgtttccgttggtggctg

SEQ ID NO: 33082 - DNA, 25 bp, E. coli
tgttacctgtttgcgttggtggctg

SEQ ID NO: 33083 - DNA, 25 bp, E. coli
tgaactggaaaaaggacgtcattgg

SEQ ID NO: 33084 - DNA, 25 bp, E. coli
tgaactggaaaatggacgtcattgg

SEQ ID NO: 33085 - DNA, 25 bp, E. coli
gacggtacgtggactgttgcagcat

SEQ ID NO: 33086 - DNA, 25 bp, E. coli
gacggtacgtggtctgttgcagcat

SEQ ID NO: 33087 - DNA, 25 bp, E. coli
cgtggtctgttggagcatcgcgcat

SEQ ID NO: 33088 - DNA, 25 bp, E. coli
ctggagttgtatgtcgatcgtggca

SEQ ID NO: 33089 - DNA, 25 bp, E. coli
cgtggtctgttgcagcatcgcgcat

SEQ ID NO: 33090 - DNA, 25 bp, E. coli
ctggagttgtatctcgatcgtggca

SEQ ID NO: 33091 - DNA, 25 bp, E. coli
ggctggtgatttagatgtactgcgc

SEQ ID NO: 33092 - DNA, 25 bp, E. coli
ggctggtgattttgatgtactgcgc

SEQ ID NO: 33093 - DNA, 25 bp, E. coli
taatgatttctttcgctgggacgcg

SEQ ID NO: 33094 - DNA, 25 bp, E. coli
taatgatttcttacgctgggacgcg

SEQ ID NO: 33095 - DNA, 25 bp, E. coli
cagcaatgcgccttcagtagagtca

SEQ ID NO: 33096 - DNA, 25 bp, E. coli
cagcaatgcgccatcagtagagtca

SEQ ID NO: 33097 - DNA, 25 bp, E. coli
tatcggcagaagaacagcagaacgt

SEQ ID NO: 33098 - DNA, 25 bp, E. coli
tatcggcagaagtacagcagaacgt

SEQ ID NO: 33099 - DNA, 25 bp, E. coli
tgggcaaaatcaaacgtatacggtg

SEQ ID NO: 33100 - DNA, 25 bp, E. coli
tgggcaaaatcatacgtatacggtg

SEQ ID NO: 33101 - DNA, 25 bp, E. coli
tgaagccaataagactatcgccccg

SEQ ID NO: 33102 - DNA, 25 bp, E. coli
tgaagccaataacactatcgccccg

SEQ ID NO: 33103 - DNA, 25 bp, E. coli
tcgctggagcgtcgcattaaattac

SEQ ID NO: 33104 - DNA, 25 bp, E. coli
tcgctggagcgtggcattaaattac

SEQ ID NO: 33105 - DNA, 25 bp, E. coli
ccagagcaagggaatatgttacgcg

SEQ ID NO: 33106 - DNA, 25 bp, E. coli
ccagagcaagggtatatgttacgcg

SEQ ID NO: 33107 - DNA, 25 bp, E. coli
gccagcaggcttaacgcaatttaaa

SEQ ID NO: 33108 - DNA, 25 bp, E. coli
gccagcaggctttacgcaatttaaa

SEQ ID NO: 33109 - DNA, 25 bp, E. coli
gcggcaatgttgttccttgaagcca

SEQ ID NO: 33110 - DNA, 25 bp, E. coli
gcggcaatgttgatccttgaagcca

SEQ ID NO: 33111 - DNA, 25 bp, E. coli
gaagtacatcgaccactatcggcag

SEQ ID NO: 33112 - DNA, 25 bp, E. coli
gaagtacatcgagcactatcggcag

SEQ ID NO: 33113 - DNA, 25 bp, E. coli
gaaacgcgcgtcattgcttacactc

SEQ ID NO: 33114 - DNA, 25 bp, E. coli
gaaacgcgcgtctttgcttacactc

SEQ ID NO: 33115 - DNA, 25 bp, E. coli
gataaagcgttgaatcgtcgggcag

SEQ ID NO: 33116 - DNA, 25 bp, E. coli
gataaagcgttgtatcgtcgggcag

SEQ ID NO: 33117 - DNA, 25 bp, E. coli
tactgggcagacgtattaaacaaaa

SEQ ID NO: 33118 - DNA, 25 bp, E. coli
taccgtcaataatccaggcaaaacc

SEQ ID NO: 33119 - DNA, 25 bp, E. coli
tactgggcagacctattaaacaaaa

SEQ ID NO: 33120 - DNA, 25 bp, E. coli
agttgcctatgaaaataaccctggg

SEQ ID NO: 33121 - DNA, 25 bp, E. coli
agttgcctatgataataaccctggg

SEQ ID NO: 33122 - DNA, 25 bp, E. coli
taccgtcaataaaccaggcaaaacc

SEQ ID NO: 33123 - DNA, 25 bp, E. coli
tagcgatgctaattactgtcagtac

SEQ ID NO: 33124 - DNA, 25 bp, E. coli
tagcgatgctaaatactgtcagtac

SEQ ID NO: 33125 - DNA, 25 bp, E. coli
tgagcaaaataatagcgatgctaat

SEQ ID NO: 33126 - DNA, 25 bp, E. coli
tgagcaaaataaaagcgatgctaat

SEQ ID NO: 33127 - DNA, 25 bp, E. coli
taatccaggcaaaacctatttcaat

SEQ ID NO: 33128 - DNA, 25 bp, E. coli
taatccaggcaatacctatttcaat

SEQ ID NO: 33129 - DNA, 25 bp, E. coli
cctatttcaatataagttgcctatg

SEQ ID NO: 33130 - DNA, 25 bp, E. coli
cctatttcaataaaagttgcctatg

SEQ ID NO: 33131 - DNA, 25 bp, E. coli
gaacccctggatctggtcatgccgt

SEQ ID NO: 33132 - DNA, 25 bp, E. coli
gaacccctggatgtggtcatgccgt

SEQ ID NO: 33133 - DNA, 25 bp, E. coli
ctggatgtggtcttgccgttactgg

SEQ ID NO: 33134 - DNA, 25 bp, E. coli
cgttactgggcacacctattaaaca

SEQ ID NO: 33135 - DNA, 25 bp, E. coli
cgttactgggcagacctattaaaca

SEQ ID NO: 33136 - DNA, 25 bp, E. coli
ctggatgtggtcatgccgttactgg

SEQ ID NO: 33137 - DNA, 25 bp, E. coli
gatgctaattacagtcagtaccctt

SEQ ID NO: 33138 - DNA, 25 bp, E. coli
gatgctaattactgtcagtaccctt

SEQ ID NO: 33139 - DNA, 25 bp, E. coli
caagaaccacttacccatgatgaga

SEQ ID NO: 33140 - DNA, 25 bp, E. coli
caagaaccactttcccatgatgaga

SEQ ID NO: 33141 - DNA, 25 bp, E. coli
cagaacctgtaaacatccttttgag

SEQ ID NO: 33142 - DNA, 25 bp, E. coli
catgatgagatacatatcctgcggt

SEQ ID NO: 33143 - DNA, 25 bp, E. coli
catgatgagatagatatcctgcggt

SEQ ID NO: 33144 - DNA, 25 bp, E. coli
cagaacctgtaatcatccttttgag

SEQ ID NO: 33145 - DNA, 25 bp, E. coli
tacttcactgtacgcactaatgcat

SEQ ID NO: 33146 - DNA, 25 bp, E. coli
taaactccaatcttgcgtaagagaa

SEQ ID NO: 33147 - DNA, 25 bp, E. coli
tacttcactgtaggcactaatgcat

SEQ ID NO: 33148 - DNA, 25 bp, E. coli
taaactccaatcatgcgtaagagaa

SEQ ID NO: 33149 - DNA, 25 bp, E. coli
tatctgatttaaggcatttcctggt

SEQ ID NO: 33150 - DNA, 25 bp, E. coli
tagttgcgttggatgatcttggaca

SEQ ID NO: 33151 - DNA, 25 bp, E. coli
tagttgcgttggttgatcttggaca

SEQ ID NO: 33152 - DNA, 25 bp, E. coli
tatctgatttaacgcatttcctggt

SEQ ID NO: 33153 - DNA, 25 bp, E. coli
tagcactctgtgtatgggataaaca

SEQ ID NO: 33154 - DNA, 25 bp, E. coli
tagcactctgtgaatgggataaaca

SEQ ID NO: 33155 - DNA, 25 bp, E. coli
tcatatcacaaaataagagccctca

SEQ ID NO: 33156 - DNA, 25 bp, E. coli
tcatatcacaaattaagagccctca

SEQ ID NO: 33157 - DNA, 25 bp, E. coli
gcaagtcttttccagtgatgtctac

SEQ ID NO: 33158 - DNA, 25 bp, E. coli
gcatcccaaaaggaatattacagcg

SEQ ID NO: 33159 - DNA, 25 bp, E. coli
gcatcccaaaagcaatattacagcg

SEQ ID NO: 33160 - DNA, 25 bp, E. coli
gcaagtcttttcgagtgatgtctac

SEQ ID NO: 33161 - DNA, 25 bp, E. coli
cactggcagccgagttatggttagc

SEQ ID NO: 33162 - DNA, 25 bp, E. coli
cactggcagccgtgttatggttagc

SEQ ID NO: 33163 - DNA, 25 bp, E. coli
tatggttagcgggaccggtcacact

SEQ ID NO: 33164 - DNA, 25 bp, E. coli
tatggttagcggcaccggtcacact

SEQ ID NO: 33165 - DNA, 25 bp, E. coli
tgtgaagagaaactggcaccactgg

SEQ ID NO: 33166 - DNA, 25 bp, E. coli
tgtgaagagaaagtggcaccactgg

SEQ ID NO: 33167 - DNA, 25 bp, E. coli
tgacgacctacgatcgtaaccgtaa

SEQ ID NO: 33168 - DNA, 25 bp, E. coli
tgacgacctacgttcgtaaccgtaa

SEQ ID NO: 33169 - DNA, 25 bp, E. coli
cctgattcgtctgggcatgaactaa

SEQ ID NO: 33170 - DNA, 25 bp, E. coli
cctgattcgtctcggcatgaactaa

SEQ ID NO: 33171 - DNA, 25 bp, E. coli
cgctgagcaaatccgccgcggaaaa

SEQ ID NO: 33172 - DNA, 25 bp, E. coli
ccgtagttgttgtaggttgtgaaga

SEQ ID NO: 33173 - DNA, 25 bp, E. coli
ccgtagttgttgaaggttgtgaaga

SEQ ID NO: 33174 - DNA, 25 bp, E. coli
cgctgagcaaatgcgccgcggaaaa

SEQ ID NO: 33175 - DNA, 25 bp, E. coli
gattgatactgaaggtctgaccgct

SEQ ID NO: 33176 - DNA, 25 bp, E. coli
gtaaccgtaacgcaatcaccactgg

SEQ ID NO: 33177 - DNA, 25 bp, E. coli
gattgatactgatggtctgaccgct

SEQ ID NO: 33178 - DNA, 25 bp, E. coli
gtaaccgtaacggaatcaccactgg

SEQ ID NO: 33179 - DNA, 25 bp, E. coli
ggtcacactggcaagatcctgtcga

SEQ ID NO: 33180 - DNA, 25 bp, E. coli
ggtcacactggctagatcctgtcga

SEQ ID NO: 33181 - DNA, 25 bp, E. coli
tggcaccactggacctgattcgtct

SEQ ID NO: 33182 - DNA, 25 bp, E. coli
tggcaccactggtcctgattcgtct

SEQ ID NO: 33183 - DNA, 25 bp, E. coli
aatatgcactggaggatcgcagcgg

SEQ ID NO: 33184 - DNA, 25 bp, E. coli
aatatgcactggtggatcgcagcgg

SEQ ID NO: 33185 - DNA, 25 bp, E. coli
tactggatccgtcgcaaaattccgc

SEQ ID NO: 33186 - DNA, 25 bp, E. coli
tactggatccgtggcaaaattccgc

SEQ ID NO: 33187 - DNA, 25 bp, E. coli
ttaaaaccagctttcccggtcaggc

SEQ ID NO: 33188 - DNA, 25 bp, E. coli
ttaaaaccagctatcccggtcaggc

SEQ ID NO: 33189 - DNA, 25 bp, E. coli
tataagctgatgaggctgcaccgac

SEQ ID NO: 33190 - DNA, 25 bp, E. coli
tataagctgatgtggctgcaccgac

SEQ ID NO: 33191 - DNA, 25 bp, E. coli
ttgtatatgccatcgacgctgccgg

SEQ ID NO: 33192 - DNA, 25 bp, E. coli
ttgtatatgccaacgacgctgccgg

SEQ ID NO: 33193 - DNA, 25 bp, E. coli
tctcgccgaagttaaaagcgcgctg

SEQ ID NO: 33194 - DNA, 25 bp, E. coli
tctcgccgaagtaaaaagcgcgctg

SEQ ID NO: 33195 - DNA, 25 bp, E. coli
gcgcccgacgagctggatttatatc

SEQ ID NO: 33196 - DNA, 25 bp, E. coli
gctgaaagtactccactggccgaaa

SEQ ID NO: 33197 - DNA, 25 bp, E. coli
gctgaaagtactgcactggccgaaa

SEQ ID NO: 33198 - DNA, 25 bp, E. coli
gcgcccgacgaggtggatttatatc

SEQ ID NO: 33199 - DNA, 25 bp, E. coli
tgtgggtgccgccaattcgtaaccg

SEQ ID NO: 33200 - DNA, 25 bp, E. coli
tgtgggtgccgcgaattcgtaaccg

SEQ ID NO: 33201 - DNA, 25 bp, E. coli
tcaaccaggtactgggtaagctgcc

SEQ ID NO: 33202 - DNA, 25 bp, E. coli
tcaaccaggtacagggtaagctgcc

SEQ ID NO: 33203 - DNA, 25 bp, E. coli
taagcacgatctggccgatttacgc

SEQ ID NO: 33204 - DNA, 25 bp, E. coli
taagcacgatctcgccgatttacgc

SEQ ID NO: 33205 - DNA, 25 bp, E. coli
ctcttgaccagaaaggttcagaaaa

SEQ ID NO: 33206 - DNA, 25 bp, E. coli
ctcttgaccagataggttcagaaaa

SEQ ID NO: 33207 - DNA, 25 bp, E. coli
tacacagtatgcactgcgatggctg

SEQ ID NO: 33208 - DNA, 25 bp, E. coli
taaaaaagaatgatacacagtatgc

SEQ ID NO: 33209 - DNA, 25 bp, E. coli
tacacagtatgctctgcgatggctg

SEQ ID NO: 33210 - DNA, 25 bp, E. coli
taaaaaagaatgttacacagtatgc

SEQ ID NO: 33211 - DNA, 25 bp, E. coli
tatgctctgcgaaggctgttcatat

SEQ ID NO: 33212 - DNA, 25 bp, E. coli
tatgctctgcgatggctgttcatat

SEQ ID NO: 33213 - DNA, 25 bp, E. coli
tctgcgtgggtctttgaatcttgcc

SEQ ID NO: 33214 - DNA, 25 bp, E. coli
tctgcgtgggtcattgaatcttgcc

SEQ ID NO: 33215 - DNA, 25 bp, E. coli
ccgggagctggcagcagacataaaa

SEQ ID NO: 33216 - DNA, 25 bp, E. coli
ccgggagctggctgcagacataaaa

SEQ ID NO: 33217 - DNA, 25 bp, E. coli
gcccgtcagttgtctataaaaaaga

SEQ ID NO: 33218 - DNA, 25 bp, E. coli
gcccgtcagttgactataaaaaaga

SEQ ID NO: 33219 - DNA, 25 bp, E. coli
gacataaaatatgcccgtcagttga

SEQ ID NO: 33220 - DNA, 25 bp, E. coli
gaaaatttttctccgtgggtcattg

SEQ ID NO: 33221 - DNA, 25 bp, E. coli
gacataaaatatccccgtcagttga

SEQ ID NO: 33222 - DNA, 25 bp, E. coli
gaaaatttttctgcgtgggtcattg

SEQ ID NO: 33223 - DNA, 25 bp, E. coli
gtcattgaatcttgccgccgggagc

SEQ ID NO: 33224 - DNA, 25 bp, E. coli
gtcattgaatctagccgccgggagc

SEQ ID NO: 33225 - DNA, 25 bp, E. coli
tggcagcagacaaaaaatatgcccg

SEQ ID NO: 33226 - DNA, 25 bp, E. coli
tggcagcagacataaaatatgcccg

SEQ ID NO: 33227 - DNA, 25 bp, E. coli
gaattaccctttgtacggaagcagc

SEQ ID NO: 33228 - DNA, 25 bp, E. coli
gaattaccctttctacggaagcagc

SEQ ID NO: 33229 - DNA, 25 bp, E. coli
caaatggcaatctttacgctgcgga

SEQ ID NO: 33230 - DNA, 25 bp, E. coli
caaactgggcggagatgatggcaaa

SEQ ID NO: 33231 - DNA, 25 bp, E. coli
caaactgggcggtgatgatggcaaa

SEQ ID NO: 33232 - DNA, 25 bp, E. coli
caaatggcaatcattacgctgcgga

SEQ ID NO: 33233 - DNA, 25 bp, E. coli
taaaaccacggaaccgctgaaagcg

SEQ ID NO: 33234 - DNA, 25 bp, E. coli
taaatggcggtaatctgcaaacagg

SEQ ID NO: 33235 - DNA, 25 bp, E. coli
taaaaccacggatccgctgaaagcg

SEQ ID NO: 33236 - DNA, 25 bp, E. coli
tactatgcgaaaatcaccggtggtg

SEQ ID NO: 33237 - DNA, 25 bp, E. coli
taaatggcggtattctgcaaacagg

SEQ ID NO: 33238 - DNA, 25 bp, E. coli
tactatgcgaaattcaccggtggtg

SEQ ID NO: 33239 - DNA, 25 bp, E. coli
tagtaaaactgctggattccaaggg

SEQ ID NO: 33240 - DNA, 25 bp, E. coli
tagtaaaactgcaggattccaaggg

SEQ ID NO: 33241 - DNA, 25 bp, E. coli
gaagcagccactgatactggcggaa

SEQ ID NO: 33242 - DNA, 25 bp, E. coli
gaagcagccactcatactggcggaa

SEQ ID NO: 33243 - DNA, 25 bp, E. coli
gaaagcgctggacgatgctatcgca

SEQ ID NO: 33244 - DNA, 25 bp, E. coli
gaaagcgctggaggatgctatcgca

SEQ ID NO: 33245 - DNA, 25 bp, E. coli
gaacgtgctggctaaaaatggctcc

SEQ ID NO: 33246 - DNA, 25 bp, E. coli
gaacgtgctggcaaaaaatggctcc

SEQ ID NO: 33247 - DNA, 25 bp, E. coli
gattgataatacagcaggttccgca

SEQ ID NO: 33248 - DNA, 25 bp, E. coli
gattgataatactgcaggttccgca

SEQ ID NO: 33249 - DNA, 25 bp, E. coli
tctcacatgtaattctgatcactca

SEQ ID NO: 33250 - DNA, 25 bp, E. coli
tctcacatgtaaatctgatcactca

SEQ ID NO: 33251 - DNA, 25 bp, E. coli
ccaagtgagcgtttatcgacaaccg

SEQ ID NO: 33252 - DNA, 25 bp, E. coli
ccaagtgagcgtatatcgacaaccg

SEQ ID NO: 33253 - DNA, 25 bp, E. coli
ccatttaaaaaactagcatcatata

SEQ ID NO: 33254 - DNA, 25 bp, E. coli
ccatttaaaaaagtagcatcatata

SEQ ID NO: 33255 - DNA, 25 bp, E. coli
gacaaccgcccgatttgagcggatg

SEQ ID NO: 33256 - DNA, 25 bp, E. coli
gagcgtttatcgtcaaccgcccgtt

SEQ ID NO: 33257 - DNA, 25 bp, E. coli
gacaaccgcccgttttgagcggatg

SEQ ID NO: 33258 - DNA, 25 bp, E. coli
gagcggatgccgacaggtaaaaacc

SEQ ID NO: 33259 - DNA, 25 bp, E. coli
gagcgtttatcgacaaccgcccgtt

SEQ ID NO: 33260 - DNA, 25 bp, E. coli
gagcggatgccgtcaggtaaaaacc

SEQ ID NO: 33261 - DNA, 25 bp, E. coli
cgttttgagcggatgccgacaggta

SEQ ID NO: 33262 - DNA, 25 bp, E. coli
cgttttgagcggttgccgacaggta

SEQ ID NO: 33263 - DNA, 25 bp, E. coli
gatcactcatcaatatagataattg

SEQ ID NO: 33264 - DNA, 25 bp, E. coli
gatcactcatcattatagataattg

SEQ ID NO: 33265 - DNA, 25 bp, E. coli
gtgaaatgattaaccaagtgagcgt

SEQ ID NO: 33266 - DNA, 25 bp, E. coli
gtgaaatgattatccaagtgagcgt

SEQ ID NO: 33267 - DNA, 25 bp, E. coli
taattgaagagtcaaatgattaacc

SEQ ID NO: 33268 - DNA, 25 bp, E. coli
taattgaagagtgaaatgattaacc

SEQ ID NO: 33269 - DNA, 25 bp, E. coli
gatgccgacaggaaaaaaccattta

SEQ ID NO: 33270 - DNA, 25 bp, E. coli
gatgccgacaggtaaaaaccattta

SEQ ID NO: 33271 - DNA, 25 bp, E. coli
aagcatttttgagtatcagccctgg

SEQ ID NO: 33272 - DNA, 25 bp, E. coli
aagcatttttgactatcagccctgg

SEQ ID NO: 33273 - DNA, 25 bp, E. coli
cactgaaggctacgatctcggtaaa

SEQ ID NO: 33274 - DNA, 25 bp, E. coli
cactgaaggctaggatctcggtaaa

SEQ ID NO: 33275 - DNA, 25 bp, E. coli
catgatcatcaagctgaaaggcgtt

SEQ ID NO: 33276 - DNA, 25 bp, E. coli
catgatcatcaacctgaaaggcgtt

SEQ ID NO: 33277 - DNA, 25 bp, E. coli
tactactggaaacacctgatgggct

SEQ ID NO: 33278 - DNA, 25 bp, E. coli
tactactggaaagacctgatgggct

SEQ ID NO: 33279 - DNA, 25 bp, E. coli
ttccaccgaagacgccgaaagcatt

SEQ ID NO: 33280 - DNA, 25 bp, E. coli
ttccaccgaagaggccgaaagcatt

SEQ ID NO: 33281 - DNA, 25 bp, E. coli
tgatgagcaaacaactcaccgcgca

SEQ ID NO: 33282 - DNA, 25 bp, E. coli
tgatgagcaaactactcaccgcgca

SEQ ID NO: 33283 - DNA, 25 bp, E. coli
tcgtaccgttccacgatgggcaggt

SEQ ID NO: 33284 - DNA, 25 bp, E. coli
tcgtaccgttcctcgatgggcaggt

SEQ ID NO: 33285 - DNA, 25 bp, E. coli
cctggtttatcctgaaggcgggtca

SEQ ID NO: 33286 - DNA, 25 bp, E. coli
cctggtttatccagaaggcgggtca

SEQ ID NO: 33287 - DNA, 25 bp, E. coli
tggaagcaccactatcaggacatga

SEQ ID NO: 33288 - DNA, 25 bp, E. coli
tggaagcaccacaatcaggacatga

SEQ ID NO: 33289 - DNA, 25 bp, E. coli
ggcgaacctgctgacgaattgtgaa

SEQ ID NO: 33290 - DNA, 25 bp, E. coli
ggcgaacctgctcacgaattgtgaa

SEQ ID NO: 33291 - DNA, 25 bp, E. coli
gatgggctgccaggtagtaaccact

SEQ ID NO: 33292 - DNA, 25 bp, E. coli
gatgggctgccacgtagtaaccact

SEQ ID NO: 33293 - DNA, 25 bp, E. coli
tagtcagtcactttggagatcgcgg

SEQ ID NO: 33294 - DNA, 25 bp, E. coli
tagtcagtcactatggagatcgcgg

SEQ ID NO: 33295 - DNA, 25 bp, E. coli
tattaagtagcaccggaagttcccg

SEQ ID NO: 33296 - DNA, 25 bp, E. coli
tattgttgcaattaatgcgagatct

SEQ ID NO: 33297 - DNA, 25 bp, E. coli
tattgttgcaataaatgcgagatct

SEQ ID NO: 33298 - DNA, 25 bp, E. coli
tattaagtagcagcggaagttcccg

SEQ ID NO: 33299 - DNA, 25 bp, E. coli
ttatcatgcctacaatcagtgcggg

SEQ ID NO: 33300 - DNA, 25 bp, E. coli
ttatcatgcctagaatcagtgcggg

SEQ ID NO: 33301 - DNA, 25 bp, E. coli
tgcgagatctgtagtacttattaag

SEQ ID NO: 33302 - DNA, 25 bp, E. coli
tgcctgatgcaattcctgctgaaag

SEQ ID NO: 33303 - DNA, 25 bp, E. coli
tgcgagatctgttgtacttattaag

SEQ ID NO: 33304 - DNA, 25 bp, E. coli
tgcctgatgcaaatcctgctgaaag

SEQ ID NO: 33305 - DNA, 25 bp, E. coli
gcctacaatcagagcgggtttggta

SEQ ID NO: 33306 - DNA, 25 bp, E. coli
gcctacaatcagtgcgggtttggta

SEQ ID NO: 33307 - DNA, 25 bp, E. coli
gaagttcccggctgtgatagtcagt

SEQ ID NO: 33308 - DNA, 25 bp, E. coli
gaagttcccggcagtgatagtcagt

SEQ ID NO: 33309 - DNA, 25 bp, E. coli
cgcatccggcgaacgtgcactgatg

SEQ ID NO: 33310 - DNA, 25 bp, E. coli
cgcatccggcgatcgtgcactgatg

SEQ ID NO: 33311 - DNA, 25 bp, E. coli
gataaggcatttgtgcgcagatgcc

SEQ ID NO: 33312 - DNA, 25 bp, E. coli
gataaggcatttctgcgcagatgcc

SEQ ID NO: 33313 - DNA, 25 bp, E. coli
gatcgtgcactgttgcctgatgcaa

SEQ ID NO: 33314 - DNA, 25 bp, E. coli
gatcgtgcactgatgcctgatgcaa

SEQ ID NO: 33315 - DNA, 25 bp, E. coli
caatgtgcggttaactggtgatgca

SEQ ID NO: 33316 - DNA, 25 bp, E. coli
caatgtgcggtttactggtgatgca

SEQ ID NO: 33317 - DNA, 25 bp, E. coli
tactaccggaagtaaagatcagtcg

SEQ ID NO: 33318 - DNA, 25 bp, E. coli
tacatgccgggcaagcaaatgctct

SEQ ID NO: 33319 - DNA, 25 bp, E. coli
taaatgtaggtgatgtttctccgag

SEQ ID NO: 33320 - DNA, 25 bp, E. coli
tacatgccgggctagcaaatgctct

SEQ ID NO: 33321 - DNA, 25 bp, E. coli
tactaccggaagaaaagatcagtcg

SEQ ID NO: 33322 - DNA, 25 bp, E. coli
taaatgtaggtgttgtttctccgag

SEQ ID NO: 33323 - DNA, 25 bp, E. coli
aaagctgtgacaatactaccggaag

SEQ ID NO: 33324 - DNA, 25 bp, E. coli
aaagctgtgacattactaccggaag

SEQ ID NO: 33325 - DNA, 25 bp, E. coli
tatagttctggtctgagcgccaatg

SEQ ID NO: 33326 - DNA, 25 bp, E. coli
tatagttctggtgtgagcgccaatg

SEQ ID NO: 33327 - DNA, 25 bp, E. coli
tctccgccggtgcagatagtgcgac

SEQ ID NO: 33328 - DNA, 25 bp, E. coli
tctccgccggtggagatagtgcgac

SEQ ID NO: 33329 - DNA, 25 bp, E. coli
cgattaatgtacaaggatgcccgac

SEQ ID NO: 33330 - DNA, 25 bp, E. coli
cgattaatgtactaggatgcccgac

SEQ ID NO: 33331 - DNA, 25 bp, E. coli
gatcagtcggtataaatgggcactt

SEQ ID NO: 33332 - DNA, 25 bp, E. coli
gatcagtcggtaaaaatgggcactt

SEQ ID NO: 33333 - DNA, 25 bp, E. coli
tcaactcaggaatatgtacatgccg

SEQ ID NO: 33334 - DNA, 25 bp, E. coli
tcaactcaggaaaatgtacatgccg

SEQ ID NO: 33335 - DNA, 25 bp, E. coli
gatgcccgactggaaaaagtactgt

SEQ ID NO: 33336 - DNA, 25 bp, E. coli
gatgcccgactgcaaaaagtactgt

SEQ ID NO: 33337 - DNA, 25 bp, E. coli
cagaagtacagaccgtgagtgccac

SEQ ID NO: 33338 - DNA, 25 bp, E. coli
cagaagtacagagcgtgagtgccac

SEQ ID NO: 33339 - DNA, 25 bp, E. coli
taccgtagcccggaaaatctttcag

SEQ ID NO: 33340 - DNA, 25 bp, E. coli
accaagatgcgcctccgggaatttc

SEQ ID NO: 33341 - DNA, 25 bp, E. coli
accaagatgcgcgtccgggaatttc

SEQ ID NO: 33342 - DNA, 25 bp, E. coli
taccgtagcccgcaaaatctttcag

SEQ ID NO: 33343 - DNA, 25 bp, E. coli
tgtggatcaacacatcgaactgggt

SEQ ID NO: 33344 - DNA, 25 bp, E. coli
tgtggatcaacagatcgaactgggt

SEQ ID NO: 33345 - DNA, 25 bp, E. coli
tcgtgacgcagagaaagaatgtgga

SEQ ID NO: 33346 - DNA, 25 bp, E. coli
tcgtgacgcagacaaagaatgtgga

SEQ ID NO: 33347 - DNA, 25 bp, E. coli
gccgcgcggcaatgttctggcaaaa

SEQ ID NO: 33348 - DNA, 25 bp, E. coli
gccgcgcggcaaagttctggcaaaa

SEQ ID NO: 33349 - DNA, 25 bp, E. coli
gcaaaatgccactctgaacctgaga

SEQ ID NO: 33350 - DNA, 25 bp, E. coli
gcaaatgttttagtggccgcacgca

SEQ ID NO: 33351 - DNA, 25 bp, E. coli
gcaaaatgccacactgaacctgaga

SEQ ID NO: 33352 - DNA, 25 bp, E. coli
gcaaatgttttactggccgcacgca

SEQ ID NO: 33353 - DNA, 25 bp, E. coli
gaaacgcaacatcgcatcacgctta

SEQ ID NO: 33354 - DNA, 25 bp, E. coli
gaaacgcaacatggcatcacgctta

SEQ ID NO: 33355 - DNA, 25 bp, E. coli
gttggcttcgatgcaaatcgccgcg

SEQ ID NO: 33356 - DNA, 25 bp, E. coli
gttggcttcgatccaaatcgccgcg

SEQ ID NO: 33357 - DNA, 25 bp, E. coli
tcaatgttatgctgacgcgcgcagt

SEQ ID NO: 33358 - DNA, 25 bp, E. coli
tcaatgttatgcagacgcgcgcagt

SEQ ID NO: 33359 - DNA, 25 bp, E. coli
cactgcctgacagtcgttttgtgtc

SEQ ID NO: 33360 - DNA, 25 bp, E. coli
cacatccggtactggaagcgtttat

SEQ ID NO: 33361 - DNA, 25 bp, E. coli
cagcctgttatcactgcctgacagt

SEQ ID NO: 33362 - DNA, 25 bp, E. coli
cagcctgttatctctgcctgacagt

SEQ ID NO: 33363 - DNA, 25 bp, E. coli
cacatccggtacaggaagcgtttat

SEQ ID NO: 33364 - DNA, 25 bp, E. coli
cactgcctgacactcgttttgtgtc

SEQ ID NO: 33365 - DNA, 25 bp, E. coli
agtcgttttgtgacagaggatgtgc

SEQ ID NO: 33366 - DNA, 25 bp, E. coli
agtcgttttgtgtcagaggatgtgc

SEQ ID NO: 33367 - DNA, 25 bp, E. coli
ttatctggcgaatctgctgacccgt

SEQ ID NO: 33368 - DNA, 25 bp, E. coli
ttatctggcgaaactgctgacccgt

SEQ ID NO: 33369 - DNA, 25 bp, E. coli
tgctgacccgtcagcgtcgacacag

SEQ ID NO: 33370 - DNA, 25 bp, E. coli
tgctgacccgtctgcgtcgacacag

SEQ ID NO: 33371 - DNA, 25 bp, E. coli
gccgctatttcgtgatagcgaaaat

SEQ ID NO: 33372 - DNA, 25 bp, E. coli
gccgctatttcgagatagcgaaaat

SEQ ID NO: 33373 - DNA, 25 bp, E. coli
gcgaattgccgcaatttcgtgatag

SEQ ID NO: 33374 - DNA, 25 bp, E. coli
gcgaattgccgctatttcgtgatag

SEQ ID NO: 33375 - DNA, 25 bp, E. coli
cgcggcagtcacatccggtactgga

SEQ ID NO: 33376 - DNA, 25 bp, E. coli
ccgtcagcgtcgacacagttttgaa

SEQ ID NO: 33377 - DNA, 25 bp, E. coli
cgcggcagtcacttccggtactgga

SEQ ID NO: 33378 - DNA, 25 bp, E. coli
ccgtcagcgtcgtcacagttttgaa

SEQ ID NO: 33379 - DNA, 25 bp, E. coli
tggcgaaactgcagacccgtcagcg

SEQ ID NO: 33380 - DNA, 25 bp, E. coli
tggcgaaactgctgacccgtcagcg

SEQ ID NO: 33381 - DNA, 25 bp, E. coli
cagaagtttatgtgttgtgtgtcca

SEQ ID NO: 33382 - DNA, 25 bp, E. coli
cagaagtttatgagttgtgtgtcca

SEQ ID NO: 33383 - DNA, 25 bp, E. coli
cagttttcggtaaatgtcatgagga

SEQ ID NO: 33384 - DNA, 25 bp, E. coli
cagttttcggtatatgtcatgagga

SEQ ID NO: 33385 - DNA, 25 bp, E. coli
tatcgaatactgcataggtgctggc

SEQ ID NO: 33386 - DNA, 25 bp, E. coli
tatcgaatactggataggtgctggc

SEQ ID NO: 33387 - DNA, 25 bp, E. coli
tgtgtgtccatcgatattaatctgg

SEQ ID NO: 33388 - DNA, 25 bp, E. coli
tgtgtgtccatccatattaatctgg

SEQ ID NO: 33389 - DNA, 25 bp, E. coli
gcccaagatactatcccgggtgata

SEQ ID NO: 33390 - DNA, 25 bp, E. coli
ccatttcagaaacgttgatacgtga

SEQ ID NO: 33391 - DNA, 25 bp, E. coli
gcccaagatactttcccgggtgata

SEQ ID NO: 33392 - DNA, 25 bp, E. coli
ccatttcagaaaggttgatacgtga

SEQ ID NO: 33393 - DNA, 25 bp, E. coli
gaatatgaactatggcgtccggtcc

SEQ ID NO: 33394 - DNA, 25 bp, E. coli
gaatatgaactaaggcgtccggtcc

SEQ ID NO: 33395 - DNA, 25 bp, E. coli
gcacttccaccttcattaagaaaga

SEQ ID NO: 33396 - DNA, 25 bp, E. coli
gcacttccacctacattaagaaaga

SEQ ID NO: 33397 - DNA, 25 bp, E. coli
cccgggtgatatcatcagaagttta

SEQ ID NO: 33398 - DNA, 25 bp, E. coli
cccgggtgatatgatcagaagttta

SEQ ID NO: 33399 - DNA, 25 bp, E. coli
ggtgctggcgtctcatttatctcga

SEQ ID NO: 33400 - DNA, 25 bp, E. coli
ggtgctggcgtcacatttatctcga

SEQ ID NO: 33401 - DNA, 25 bp, E. coli
gaggctgatacaggagaatatgaac

SEQ ID NO: 33402 - DNA, 25 bp, E. coli
gaggctgatacacgagaatatgaac

SEQ ID NO: 33403 - DNA, 25 bp, E. coli
tactacattgaaaccgacagcaccg

SEQ ID NO: 33404 - DNA, 25 bp, E. coli
tactacattgaatccgacagcaccg

SEQ ID NO: 33405 - DNA, 25 bp, E. coli
aaaagctgctttgcctgctgcgcga

SEQ ID NO: 33406 - DNA, 25 bp, E. coli
aaaagctgctttccctgctgcgcga

SEQ ID NO: 33407 - DNA, 25 bp, E. coli
cctgtgggccagcaaagaagagaca

SEQ ID NO: 33408 - DNA, 25 bp, E. coli
cctgtgggccaggaaagaagagaca

SEQ ID NO: 33409 - DNA, 25 bp, E. coli
gacaataactatggtccgcgcctgt

SEQ ID NO: 33410 - DNA, 25 bp, E. coli
gaacggacagttatagccagcagat

SEQ ID NO: 33411 - DNA, 25 bp, E. coli
gaacggacagttttagccagcagat

SEQ ID NO: 33412 - DNA, 25 bp, E. coli
gacaataactatcgtccgcgcctgt

SEQ ID NO: 33413 - DNA, 25 bp, E. coli
gaaaaagtgatccataccaccgcag

SEQ ID NO: 33414 - DNA, 25 bp, E. coli
gaaaaagtgatcgataccaccgcag

SEQ ID NO: 33415 - DNA, 25 bp, E. coli
cgttcattacgtaacggcgctggga

SEQ ID NO: 33416 - DNA, 25 bp, E. coli
cgttcattacgttacggcgctggga

SEQ ID NO: 33417 - DNA, 25 bp, E. coli
gattagcctggcgatcttaagcccg

SEQ ID NO: 33418 - DNA, 25 bp, E. coli
gattagcctggccatcttaagcccg

SEQ ID NO: 33419 - DNA, 25 bp, E. coli
gatacttccctgtcccaacggatgg

SEQ ID NO: 33420 - DNA, 25 bp, E. coli
gatacttccctgacccaacggatgg

SEQ ID NO: 33421 - DNA, 25 bp, E. coli
tcaacagccggtggaagacgtcatt

SEQ ID NO: 33422 - DNA, 25 bp, E. coli
tcaacagccggtcgaagacgtcatt

SEQ ID NO: 33423 - DNA, 25 bp, E. coli
gatggaaaaccgtctgccgggcctt

SEQ ID NO: 33424 - DNA, 25 bp, E. coli
gatggaaaaccgactgccgggcctt

SEQ ID NO: 33425 - DNA, 25 bp, E. coli
caaagtcagctaagtgggtggcaac

SEQ ID NO: 33426 - DNA, 25 bp, E. coli
caaagtcagctatgtgggtggcaac

SEQ ID NO: 33427 - DNA, 25 bp, E. coli
catctgaaattgtcataccgacggg

SEQ ID NO: 33428 - DNA, 25 bp, E. coli
cataaaagtcggcaaacacagcgct

SEQ ID NO: 33429 - DNA, 25 bp, E. coli
cataaaagtcgggaaacacagcgct

SEQ ID NO: 33430 - DNA, 25 bp, E. coli
catctgaaattgacataccgacggg

SEQ ID NO: 33431 - DNA, 25 bp, E. coli
tgggtggcaacagcaaaagctcagc

SEQ ID NO: 33432 - DNA, 25 bp, E. coli
tggtgctttacatagtggaacgggc

SEQ ID NO: 33433 - DNA, 25 bp, E. coli
tggtgctttacaaagtggaacgggc

SEQ ID NO: 33434 - DNA, 25 bp, E. coli
tgggtggcaacaccaaaagctcagc

SEQ ID NO: 33435 - DNA, 25 bp, E. coli
tctgaaatcatttcccgcaggacgt

SEQ ID NO: 33436 - DNA, 25 bp, E. coli
tctgaaatcattacccgcaggacgt

SEQ ID NO: 33437 - DNA, 25 bp, E. coli
gaactgataaaagactctcccggat

SEQ ID NO: 33438 - DNA, 25 bp, E. coli
gaactgataaaacactctcccggat

SEQ ID NO: 33439 - DNA, 25 bp, E. coli
gataaacctatcacgctcatagtgg

SEQ ID NO: 33440 - DNA, 25 bp, E. coli
gatttatcagcctgtttactcgccg

SEQ ID NO: 33441 - DNA, 25 bp, E. coli
gataaacctatctcgctcatagtgg

SEQ ID NO: 33442 - DNA, 25 bp, E. coli
gatttatcagccagtttactcgccg

SEQ ID NO: 33443 - DNA, 25 bp, E. coli
tggacgaatgtagtgcggagcatcc

SEQ ID NO: 33444 - DNA, 25 bp, E. coli
tggacgaatgtactgcggagcatcc

SEQ ID NO: 33445 - DNA, 25 bp, E. coli
taaccgagtgcctgttacatgccgg

SEQ ID NO: 33446 - DNA, 25 bp, E. coli
taaccgagtgccagttacatgccgg

SEQ ID NO: 33447 - DNA, 25 bp, E. coli
aaccgtctgtacagaagcgcaaccg

SEQ ID NO: 33448 - DNA, 25 bp, E. coli
cacggcttccgtgctcgtatggcta

SEQ ID NO: 33449 - DNA, 25 bp, E. coli
cacggcttccgtcctcgtatggcta

SEQ ID NO: 33450 - DNA, 25 bp, E. coli
taaaggccgcgctcgtctgaccgtt

SEQ ID NO: 33451 - DNA, 25 bp, E. coli
taaaaatggtcgacaggttctggca

SEQ ID NO: 33452 - DNA, 25 bp, E. coli
taaaaatggtcgtcaggttctggca

SEQ ID NO: 33453 - DNA, 25 bp, E. coli
taaaggccgcgcacgtctgaccgtt

SEQ ID NO: 33454 - DNA, 25 bp, E. coli
cacttttcaaccgtctgtactgaag

SEQ ID NO: 33455 - DNA, 25 bp, E. coli
cacttttcaaccctctgtactgaag

SEQ ID NO: 33456 - DNA, 25 bp, E. coli
aaccgtctgtactgaagcgcaaccg

SEQ ID NO: 33457 - DNA, 25 bp, E. coli
tgaagcgcaaccgttctcacggctt

SEQ ID NO: 33458 - DNA, 25 bp, E. coli
tgaagcgcaacccttctcacggctt

SEQ ID NO: 33459 - DNA, 25 bp, E. coli
tcgtcaggttctcgcacgtcgtcgt

SEQ ID NO: 33460 - DNA, 25 bp, E. coli
tcgtcaggttctggcacgtcgtcgt

SEQ ID NO: 33461 - DNA, 25 bp, E. coli
gcgctcgtctgaccgtttctaagta

SEQ ID NO: 33462 - DNA, 25 bp, E. coli
gcgctcgtctgagcgtttctaagta

SEQ ID NO: 33463 - DNA, 25 bp, E. coli
gcacgtcgtcgtcctaaaggccgcg

SEQ ID NO: 33464 - DNA, 25 bp, E. coli
gcacgtcgtcgtgctaaaggccgcg

SEQ ID NO: 33465 - DNA, 25 bp, E. coli
cgtatggctacttaaaatggtcgtc

SEQ ID NO: 33466 - DNA, 25 bp, E. coli
cgtatggctactaaaaatggtcgtc

SEQ ID NO: 33467 - DNA, 25 bp, E. coli
gtctgtactgaagcgcaaccgttct

SEQ ID NO: 33468 - DNA, 25 bp, E. coli
gtctgtactgaaccgcaaccgttct

SEQ ID NO: 33469 - DNA, 25 bp, E. coli
caagtaagtttgttcgcggcgatgc

SEQ ID NO: 33470 - DNA, 25 bp, E. coli
caagtaagtttgatcgcggcgatgc

SEQ ID NO: 33471 - DNA, 25 bp, E. coli
accgatcaggatgttggcgagcaga

SEQ ID NO: 33472 - DNA, 25 bp, E. coli
accgatcaggatcttggcgagcaga

SEQ ID NO: 33473 - DNA, 25 bp, E. coli
acaatatggatcagcaacctgcccg

SEQ ID NO: 33474 - DNA, 25 bp, E. coli
acaatatggatctgcaacctgcccg

SEQ ID NO: 33475 - DNA, 25 bp, E. coli
ttattggcctcgatacaccgctgga

SEQ ID NO: 33476 - DNA, 25 bp, E. coli
ttattggcctcgttacaccgctgga

SEQ ID NO: 33477 - DNA, 25 bp, E. coli
tgccaaagctgacggaagatctcgt

SEQ ID NO: 33478 - DNA, 25 bp, E. coli
tgccaaagctgagggaagatctcgt

SEQ ID NO: 33479 - DNA, 25 bp, E. coli
tctcgaaacgctggcggaacatgcg

SEQ ID NO: 33480 - DNA, 25 bp, E. coli
tcattagccagcttgccgcagagct

SEQ ID NO: 33481 - DNA, 25 bp, E. coli
tctcgaaacgctcgcggaacatgcg

SEQ ID NO: 33482 - DNA, 25 bp, E. coli
tcattagccagcatgccgcagagct

SEQ ID NO: 33483 - DNA, 25 bp, E. coli
ccagtggtgcactttcgcgacaata

SEQ ID NO: 33484 - DNA, 25 bp, E. coli
ccagtggtgcacattcgcgacaata

SEQ ID NO: 33485 - DNA, 25 bp, E. coli
gatcttgtcgatgatggtgctgcca

SEQ ID NO: 33486 - DNA, 25 bp, E. coli
gatcttgtcgatcatggtgctgcca

SEQ ID NO: 33487 - DNA, 25 bp, E. coli
gacgtggaacgatgtacaactggaa

SEQ ID NO: 33488 - DNA, 25 bp, E. coli
gatgtttacccagcgcacgcttgag

SEQ ID NO: 33489 - DNA, 25 bp, E. coli
gacgtggaacgaagtacaactggaa

SEQ ID NO: 33490 - DNA, 25 bp, E. coli
gatgtttacccaccgcacgcttgag

SEQ ID NO: 33491 - DNA, 25 bp, E. coli
aagatctgccgcacagtgagttgca

SEQ ID NO: 33492 - DNA, 25 bp, E. coli
aaggcgtaccgtaccgcgaggcgca

SEQ ID NO: 33493 - DNA, 25 bp, E. coli
aagatctgccgctcagtgagttgca

SEQ ID NO: 33494 - DNA, 25 bp, E. coli
aaggcgtaccgttccgcgaggcgca

SEQ ID NO: 33495 - DNA, 25 bp, E. coli
tgggctttgcttgggcgacccgtaa

SEQ ID NO: 33496 - DNA, 25 bp, E. coli
gctgggctttgcttcggcgacccgt

SEQ ID NO: 33497 - DNA, 25 bp, E. coli
gctgggctttgcatcggcgacccgt

SEQ ID NO: 33498 - DNA, 25 bp, E. coli
gaagatctgccgctcagtgagttgc

SEQ ID NO: 33499 - DNA, 25 bp, E. coli
gaagatctgccggtcagtgagttgc

SEQ ID NO: 33500 - DNA, 25 bp, E. coli
cgctcagtgagtagcagaaattcag

SEQ ID NO: 33501 - DNA, 25 bp, E. coli
ccgctcagtgagttgcagaaattca

SEQ ID NO: 33502 - DNA, 25 bp, E. coli
cgctcagtgagttgcagaaattcag

SEQ ID NO: 33503 - DNA, 25 bp, E. coli
ccgctcagtgagatgcagaaattca

SEQ ID NO: 33504 - DNA, 25 bp, E. coli
ctggctgggcttagcttcggcgacc

SEQ ID NO: 33505 - DNA, 25 bp, E. coli
ctggctgggctttgcttcggcgacc

SEQ ID NO: 33506 - DNA, 25 bp, E. coli
gatctgccgctctgtgagttgcaga

SEQ ID NO: 33507 - DNA, 25 bp, E. coli
gatctgccgctcagtgagttgcaga

SEQ ID NO: 33508 - DNA, 25 bp, E. coli
tgggctttgcttcggcgacccgtaa

SEQ ID NO: 33509 - DNA, 25 bp, E. coli
tggctgggctttccttcggcgaccc

SEQ ID NO: 33510 - DNA, 25 bp, E. coli
tggctgggctttgcttcggcgaccc

SEQ ID NO: 33511 - DNA, 25 bp, E. coli
ggctttgcttcggcgacccgtaaca

SEQ ID NO: 33512 - DNA, 25 bp, E. coli
ggctttgcttcgccgacccgtaaca

SEQ ID NO: 33513 - DNA, 25 bp, E. coli
caagggctgtatgagacgttcgtca

SEQ ID NO: 33514 - DNA, 25 bp, E. coli
caagggctgtatcagacgttcgtca

SEQ ID NO: 33515 - DNA, 25 bp, E. coli
tttttgttcgacttcgaacgcgttt

SEQ ID NO: 33516 - DNA, 25 bp, E. coli
ttcttaaagttgttcgcacgatgca

SEQ ID NO: 33517 - DNA, 25 bp, E. coli
ttcgcacgatgcttgtttaaagctc

SEQ ID NO: 33518 - DNA, 25 bp, E. coli
tttatcggccacgatcatctttgca

SEQ ID NO: 33519 - DNA, 25 bp, E. coli
ttcttaaagttgatcgcacgatgca

SEQ ID NO: 33520 - DNA, 25 bp, E. coli
tttttgttcgacatcgaacgcgttt

SEQ ID NO: 33521 - DNA, 25 bp, E. coli
tttatcggccaccatcatctttgca

SEQ ID NO: 33522 - DNA, 25 bp, E. coli
ttcgcacgatgcatgtttaaagctc

SEQ ID NO: 33523 - DNA, 25 bp, E. coli
tctccggaggaattatggatcatga

SEQ ID NO: 33524 - DNA, 25 bp, E. coli
tctccggaggaaatatggatcatga

SEQ ID NO: 33525 - DNA, 25 bp, E. coli
ccattcatgcaagggctgtatcaga

SEQ ID NO: 33526 - DNA, 25 bp, E. coli
ccattcatgcaacggctgtatcaga

SEQ ID NO: 33527 - DNA, 25 bp, E. coli
gctagtttttgcttttttatcggcc

SEQ ID NO: 33528 - DNA, 25 bp, E. coli
gctagtttttgcatttttatcggcc

SEQ ID NO: 33529 - DNA, 25 bp, E. coli
gcatgtttaaagctctccggaggaa

SEQ ID NO: 33530 - DNA, 25 bp, E. coli
gcatgtttaaaggtctccggaggaa

SEQ ID NO: 33531 - DNA, 25 bp, E. coli
gacatcgaacgccttttcttaaagt

SEQ ID NO: 33532 - DNA, 25 bp, E. coli
gacatcgaacgcgttttcttaaagt

SEQ ID NO: 33533 - DNA, 25 bp, E. coli
ggccaccatcatgtttgcatcttat

SEQ ID NO: 33534 - DNA, 25 bp, E. coli
ggccaccatcatctttgcatcttat

SEQ ID NO: 33535 - DNA, 25 bp, E. coli
actgcaccgatgatggtggcgtcaa

SEQ ID NO: 33536 - DNA, 25 bp, E. coli
actgcaccgatgttggtggcgtcaa

SEQ ID NO: 33537 - DNA, 25 bp, E. coli
ttttcatttaaacatattcttgcgc

SEQ ID NO: 33538 - DNA, 25 bp, E. coli
ttttcatttaaagatattcttgcgc

SEQ ID NO: 33539 - DNA, 25 bp, E. coli
tgcataaggagcagtagagtattcg

SEQ ID NO: 33540 - DNA, 25 bp, E. coli
tgacattacgcctggccttctgcgt

SEQ ID NO: 33541 - DNA, 25 bp, E. coli
tgacattacgccaggccttctgcgt

SEQ ID NO: 33542 - DNA, 25 bp, E. coli
tgcataaggagctgtagagtattcg

SEQ ID NO: 33543 - DNA, 25 bp, E. coli
gcagtagagtatacgttttcattta

SEQ ID NO: 33544 - DNA, 25 bp, E. coli
gcagtagagtattcgttttcattta

SEQ ID NO: 33545 - DNA, 25 bp, E. coli
gaaaggagcgcaacaagatgatgaa

SEQ ID NO: 33546 - DNA, 25 bp, E. coli
gaaaggagcgcatcaagatgatgaa

SEQ ID NO: 33547 - DNA, 25 bp, E. coli
cgccagtggcaaaatgttgcttagc

SEQ ID NO: 33548 - DNA, 25 bp, E. coli
cgccagtggcaatatgttgcttagc

SEQ ID NO: 33549 - DNA, 25 bp, E. coli
gttgcttagctcttgaaaggagcgc

SEQ ID NO: 33550 - DNA, 25 bp, E. coli
gatattcttgcggtttaattacaaa

SEQ ID NO: 33551 - DNA, 25 bp, E. coli
gttgcttagctcatgaaaggagcgc

SEQ ID NO: 33552 - DNA, 25 bp, E. coli
gatattcttgcgctttaattacaaa

SEQ ID NO: 33553 - DNA, 25 bp, E. coli
taattacaaactgcaccgatgttgg

SEQ ID NO: 33554 - DNA, 25 bp, E. coli
taattacaaactccaccgatgttgg

SEQ ID NO: 33555 - DNA, 25 bp, E. coli
gatgatgaatcatcatataacaaca

SEQ ID NO: 33556 - DNA, 25 bp, E. coli
gatgatgaatcaacatataacaaca

SEQ ID NO: 33557 - DNA, 25 bp, E. coli
tacataactcctccaatattttgga

SEQ ID NO: 33558 - DNA, 25 bp, E. coli
tacataactcctgcaatattttgga

SEQ ID NO: 33559 - DNA, 25 bp, E. coli
gaggttacccctcaccctgtcatat

SEQ ID NO: 33560 - DNA, 25 bp, E. coli
caccctgtcatatccgtaaaaacgg

SEQ ID NO: 33561 - DNA, 25 bp, E. coli
gaggttacccctgaccctgtcatat

SEQ ID NO: 33562 - DNA, 25 bp, E. coli
caccctgtcataaccgtaaaaacgg

SEQ ID NO: 33563 - DNA, 25 bp, E. coli
ttggatttgcatgatttgtaggccg

SEQ ID NO: 33564 - DNA, 25 bp, E. coli
ttggatttgcatcatttgtaggccg

SEQ ID NO: 33565 - DNA, 25 bp, E. coli
taatcaggatgtgaggttacccctc

SEQ ID NO: 33566 - DNA, 25 bp, E. coli
taatcaggatgtcaggttacccctc

SEQ ID NO: 33567 - DNA, 25 bp, E. coli
gcacctcagaataaaaaagggcgag

SEQ ID NO: 33568 - DNA, 25 bp, E. coli
gcgcacttagtcaataatcaggatg

SEQ ID NO: 33569 - DNA, 25 bp, E. coli
gcacctcagaattaaaaagggcgag

SEQ ID NO: 33570 - DNA, 25 bp, E. coli
gcgcacttagtctataatcaggatg

SEQ ID NO: 33571 - DNA, 25 bp, E. coli
gaacaacgcgcacttagtcaataat

SEQ ID NO: 33572 - DNA, 25 bp, E. coli
gaacaacgcgcagttagtcaataat

SEQ ID NO: 33573 - DNA, 25 bp, E. coli
cgtaaaaacggcttacagaatatca

SEQ ID NO: 33574 - DNA, 25 bp, E. coli
ccctaaacgcataaatgcctgatgc

SEQ ID NO: 33575 - DNA, 25 bp, E. coli
ccctaaacgcattaatgcctgatgc

SEQ ID NO: 33576 - DNA, 25 bp, E. coli
cgtaaaaacggcatacagaatatca

SEQ ID NO: 33577 - DNA, 25 bp, E. coli
ggttatccctcaccctaaacgcata

SEQ ID NO: 33578 - DNA, 25 bp, E. coli
ggttatccctcagcctaaacgcata

SEQ ID NO: 33579 - DNA, 25 bp, E. coli
atgaagagttaagcgagcggcgacc

SEQ ID NO: 33580 - DNA, 25 bp, E. coli
atgaagagttaaccgagcggcgacc

SEQ ID NO: 33581 - DNA, 25 bp, E. coli
taggctgcctgctggtgattctgat

SEQ ID NO: 33582 - DNA, 25 bp, E. coli
taggctgcctgcaggtgattctgat

SEQ ID NO: 33583 - DNA, 25 bp, E. coli
tttcatgaagagttaagcgagcggc

SEQ ID NO: 33584 - DNA, 25 bp, E. coli
tttcatgaagagataagcgagcggc

SEQ ID NO: 33585 - DNA, 25 bp, E. coli
tgctggtgattctgatctcgatgac

SEQ ID NO: 33586 - DNA, 25 bp, E. coli
tgctggtgattcagatctcgatgac

SEQ ID NO: 33587 - DNA, 25 bp, E. coli
tgcaactctgggtaggctgcctgct

SEQ ID NO: 33588 - DNA, 25 bp, E. coli
tgcaactctgggaaggctgcctgct

SEQ ID NO: 33589 - DNA, 25 bp, E. coli
tgcctgctggtgtttctgatctcga

SEQ ID NO: 33590 - DNA, 25 bp, E. coli
tgcctgctggtgattctgatctcga

SEQ ID NO: 33591 - DNA, 25 bp, E. coli
cattaccggtggtcaggctgctggc

SEQ ID NO: 33592 - DNA, 25 bp, E. coli
cattaccggtggacaggctgctggc

SEQ ID NO: 33593 - DNA, 25 bp, E. coli
gattctgatctccatgacttttgag

SEQ ID NO: 33594 - DNA, 25 bp, E. coli
gattctgatctcgatgacttttgag

SEQ ID NO: 33595 - DNA, 25 bp, E. coli
tggtcaggctgcaggcgttctttca

SEQ ID NO: 33596 - DNA, 25 bp, E. coli
tggtcaggctgctggcgttctttca

SEQ ID NO: 33597 - DNA, 25 bp, E. coli
ggctgctggcgtactttcatgaaga

SEQ ID NO: 33598 - DNA, 25 bp, E. coli
ggctgctggcgttctttcatgaaga

SEQ ID NO: 33599 - DNA, 25 bp, E. coli
tcaactccctgccattaccggtggt

SEQ ID NO: 33600 - DNA, 25 bp, E. coli
tcaactccctgcgattaccggtggt

SEQ ID NO: 33601 - DNA, 25 bp, E. coli
caacctgccggttaagagtgacccg

SEQ ID NO: 33602 - DNA, 25 bp, E. coli
caacctgccggtaaagagtgacccg

SEQ ID NO: 33603 - DNA, 25 bp, E. coli
tatgccagtggcaccatcacggtaa

SEQ ID NO: 33604 - DNA, 25 bp, E. coli
tatgccagtggctccatcacggtaa

SEQ ID NO: 33605 - DNA, 25 bp, E. coli
tattccgcggtgctaagcatgagaa

SEQ ID NO: 33606 - DNA, 25 bp, E. coli
tattccgcggtggtaagcatgagaa

SEQ ID NO: 33607 - DNA, 25 bp, E. coli
tccacagcaggtatcagtatcagct

SEQ ID NO: 33608 - DNA, 25 bp, E. coli
tccacgacggatcctcagggcgtat

SEQ ID NO: 33609 - DNA, 25 bp, E. coli
tccacagcaggtttcagtatcagct

SEQ ID NO: 33610 - DNA, 25 bp, E. coli
tccacgacggatgctcagggcgtat

SEQ ID NO: 33611 - DNA, 25 bp, E. coli
tcatcaggagcgtataactggacac

SEQ ID NO: 33612 - DNA, 25 bp, E. coli
tcatcaggagcgaataactggacac

SEQ ID NO: 33613 - DNA, 25 bp, E. coli
tcaaaacggtcaccaagtctttccc

SEQ ID NO: 33614 - DNA, 25 bp, E. coli
tcaaaacggtcagcaagtctttccc

SEQ ID NO: 33615 - DNA, 25 bp, E. coli
gcaggtcatgattccgccagtgtta

SEQ ID NO: 33616 - DNA, 25 bp, E. coli
gcaggtcatgataccgccagtgtta

SEQ ID NO: 33617 - DNA, 25 bp, E. coli
gacattcaccgtttcttcatcagga

SEQ ID NO: 33618 - DNA, 25 bp, E. coli
gacattcaccgtatcttcatcagga

SEQ ID NO: 33619 - DNA, 25 bp, E. coli
ctcagttatagaaatgcctgccgga

SEQ ID NO: 33620 - DNA, 25 bp, E. coli
ctcagttatagatatgcctgccgga

SEQ ID NO: 33621 - DNA, 25 bp, E. coli
gagatttttaatcagtccacgacgg

SEQ ID NO: 33622 - DNA, 25 bp, E. coli
gagatttttaatgagtccacgacgg

SEQ ID NO: 33623 - DNA, 25 bp, E. coli
tactggtatctgtaggctgccgctc

SEQ ID NO: 33624 - DNA, 25 bp, E. coli
tactggtatctgaaggctgccgctc

SEQ ID NO: 33625 - DNA, 25 bp, E. coli
tatgaagacggataaggcgttgctc

SEQ ID NO: 33626 - DNA, 25 bp, E. coli
tagtgacgcgcataacaatctggcc

SEQ ID NO: 33627 - DNA, 25 bp, E. coli
tatgaagacggaaaaggcgttgctc

SEQ ID NO: 33628 - DNA, 25 bp, E. coli
tatgtataaacagggacaaggcgtt

SEQ ID NO: 33629 - DNA, 25 bp, E. coli
tatgtataaacacggacaaggcgtt

SEQ ID NO: 33630 - DNA, 25 bp, E. coli
tagtgacgcgcaaaacaatctggcc

SEQ ID NO: 33631 - DNA, 25 bp, E. coli
tttgaatggtttacgaaagccgctg

SEQ ID NO: 33632 - DNA, 25 bp, E. coli
tttgaatggttttcgaaagccgctg

SEQ ID NO: 33633 - DNA, 25 bp, E. coli
tgaaaagcgcactgcagggtaatcg

SEQ ID NO: 33634 - DNA, 25 bp, E. coli
tgaatgcaatgacgccactgcctgg

SEQ ID NO: 33635 - DNA, 25 bp, E. coli
tgaaaagcgcacagcagggtaatcg

SEQ ID NO: 33636 - DNA, 25 bp, E. coli
tgaatgcaatgaggccactgcctgg

SEQ ID NO: 33637 - DNA, 25 bp, E. coli
ccggaaccagagttgtcagtcagga

SEQ ID NO: 33638 - DNA, 25 bp, E. coli
ccggaaccagagatgtcagtcagga

SEQ ID NO: 33639 - DNA, 25 bp, E. coli
cattacaaggccatagtgacgcgca

SEQ ID NO: 33640 - DNA, 25 bp, E. coli
cattacaaggccttagtgacgcgca

SEQ ID NO: 33641 - DNA, 25 bp, E. coli
tggaccaggactttaagcaagcgat

SEQ ID NO: 33642 - DNA, 25 bp, E. coli
tggaccaggactataagcaagcgat

SEQ ID NO: 33643 - DNA, 25 bp, E. coli
tcactacggagatggaagacctgtc

SEQ ID NO: 33644 - DNA, 25 bp, E. coli
tcactacggagaaggaagacctgtc

SEQ ID NO: 33645 - DNA, 25 bp, E. coli
caaagggattatgctgcgttccgag

SEQ ID NO: 33646 - DNA, 25 bp, E. coli
caaagggattatcctgcgttccgag

SEQ ID NO: 33647 - DNA, 25 bp, E. coli
taaaagaatattttgcgcagcacct

SEQ ID NO: 33648 - DNA, 25 bp, E. coli
taaaagaatattatgcgcagcacct

SEQ ID NO: 33649 - DNA, 25 bp, E. coli
tatctgggctgtttaccgggagccg

SEQ ID NO: 33650 - DNA, 25 bp, E. coli
tatctgggctgtataccgggagccg

SEQ ID NO: 33651 - DNA, 25 bp, E. coli
tttctggagagtcgcaaactggtgc

SEQ ID NO: 33652 - DNA, 25 bp, E. coli
tttctggagagtggcaaactggtgc

SEQ ID NO: 33653 - DNA, 25 bp, E. coli
tggtgaccaaagtgcgcgatatgac

SEQ ID NO: 33654 - DNA, 25 bp, E. coli
tgcacaaagcgcgaatatctgggct

SEQ ID NO: 33655 - DNA, 25 bp, E. coli
tgcatttgtcaccaagcggatccaa

SEQ ID NO: 33656 - DNA, 25 bp, E. coli
tgcacaaagcgccaatatctgggct

SEQ ID NO: 33657 - DNA, 25 bp, E. coli
tgcatttgtcacgaagcggatccaa

SEQ ID NO: 33658 - DNA, 25 bp, E. coli
ccaatagcggcgagattgtgctgca

SEQ ID NO: 33659 - DNA, 25 bp, E. coli
ccaatagcggcgtgattgtgctgca

SEQ ID NO: 33660 - DNA, 25 bp, E. coli
gcagttttggttatgggcgcagcca

SEQ ID NO: 33661 - DNA, 25 bp, E. coli
gcagttttggttttgggcgcagcca

SEQ ID NO: 33662 - DNA, 25 bp, E. coli
cgactggtcgatgacgtcacgcaaa

SEQ ID NO: 33663 - DNA, 25 bp, E. coli
cgactggtcgatcacgtcacgcaaa

SEQ ID NO: 33664 - DNA, 25 bp, E. coli
gggagccgctctatcgcagcatgaa

SEQ ID NO: 33665 - DNA, 25 bp, E. coli
gggagccgctctttcgcagcatgaa

SEQ ID NO: 33666 - DNA, 25 bp, E. coli
tggtgaccaaagagcgcgatatgac

SEQ ID NO: 33667 - DNA, 25 bp, E. coli
taaagattttcgtaccgatcaaccg

SEQ ID NO: 33668 - DNA, 25 bp, E. coli
taaagattttcgaaccgatcaaccg

SEQ ID NO: 33669 - DNA, 25 bp, E. coli
tatcggcagcgaatatgaacatcag

SEQ ID NO: 33670 - DNA, 25 bp, E. coli
tatcggcagcgattatgaacatcag

SEQ ID NO: 33671 - DNA, 25 bp, E. coli
tttccagtctgaccatccggtggcg

SEQ ID NO: 33672 - DNA, 25 bp, E. coli
tttaccctgaaacgttgcggtgcgc

SEQ ID NO: 33673 - DNA, 25 bp, E. coli
tttaccctgaaaggttgcggtgcgc

SEQ ID NO: 33674 - DNA, 25 bp, E. coli
tttccagtctgagcatccggtggcg

SEQ ID NO: 33675 - DNA, 25 bp, E. coli
tgaaagtgggaaagccgaccatggc

SEQ ID NO: 33676 - DNA, 25 bp, E. coli
tgaaagtgggaatgccgaccatggc

SEQ ID NO: 33677 - DNA, 25 bp, E. coli
gccggatgtccgctacccattgtta

SEQ ID NO: 33678 - DNA, 25 bp, E. coli
gccggatgtccggtacccattgtta

SEQ ID NO: 33679 - DNA, 25 bp, E. coli
cgctggaaatgtgctggcaggctat

SEQ ID NO: 33680 - DNA, 25 bp, E. coli
cgaaacggctgaacgggcatatgaa

SEQ ID NO: 33681 - DNA, 25 bp, E. coli
cgaaacggctgatcgggcatatgaa

SEQ ID NO: 33682 - DNA, 25 bp, E. coli
cgctggaaatgtcctggcaggctat

SEQ ID NO: 33683 - DNA, 25 bp, E. coli
ggtggttcaccataacgaaacggct

SEQ ID NO: 33684 - DNA, 25 bp, E. coli
ggtggttcaccaaaacgaaacggct

SEQ ID NO: 33685 - DNA, 25 bp, E. coli
gttatcgatggatgacgccgtgcgc

SEQ ID NO: 33686 - DNA, 25 bp, E. coli
gttatcgatggaagacgccgtgcgc

SEQ ID NO: 33687 - DNA, 25 bp, E. coli
gggaatgcagtcacgcttatcgcgg

SEQ ID NO: 33688 - DNA, 25 bp, E. coli
gggaatgcagtctcgcttatcgcgg

SEQ ID NO: 33689 - DNA, 25 bp, E. coli
gaacgttcggttccttattttatgg

SEQ ID NO: 33690 - DNA, 25 bp, E. coli
gaacgttcggttgcttattttatgg

SEQ ID NO: 33691 - DNA, 25 bp, E. coli
tattttatggctactgtcaacgctg

SEQ ID NO: 33692 - DNA, 25 bp, E. coli
tattttatggcttctgtcaacgctg

SEQ ID NO: 33693 - DNA, 25 bp, E. coli
ttctctctctttatcggcgggctgg

SEQ ID NO: 33694 - DNA, 25 bp, E. coli
ttctctctctttttcggcgggctgg

SEQ ID NO: 33695 - DNA, 25 bp, E. coli
tggtgataactgagcccgcgtttca

SEQ ID NO: 33696 - DNA, 25 bp, E. coli
tgtgcaaaaattatccttcccggct

SEQ ID NO: 33697 - DNA, 25 bp, E. coli
tgtgcaaaaattttccttcccggct

SEQ ID NO: 33698 - DNA, 25 bp, E. coli
tggtgataactgtgcccgcgtttca

SEQ ID NO: 33699 - DNA, 25 bp, E. coli
tcccaatacgctggaacgaacgttc

SEQ ID NO: 33700 - DNA, 25 bp, E. coli
tcccaatacgctcgaacgaacgttc

SEQ ID NO: 33701 - DNA, 25 bp, E. coli
tctcttccatgggtttctcacagat

SEQ ID NO: 33702 - DNA, 25 bp, E. coli
tctcttccatggctttctcacagat

SEQ ID NO: 33703 - DNA, 25 bp, E. coli
tcacagataactctgtgcaacacag

SEQ ID NO: 33704 - DNA, 25 bp, E. coli
tcactgtagccatatgtcatgagag

SEQ ID NO: 33705 - DNA, 25 bp, E. coli
tcacagataactgtgtgcaacacag

SEQ ID NO: 33706 - DNA, 25 bp, E. coli
tcactgtagccaaatgtcatgagag

SEQ ID NO: 33707 - DNA, 25 bp, E. coli
taatgcgatctaaatcacgctgtgg

SEQ ID NO: 33708 - DNA, 25 bp, E. coli
taatgcgatctatatcacgctgtgg

SEQ ID NO: 33709 - DNA, 25 bp, E. coli
tgagagtttatccttcccaatacgc

SEQ ID NO: 33710 - DNA, 25 bp, E. coli
tgagagtttatcgttcccaatacgc

SEQ ID NO: 33711 - DNA, 25 bp, E. coli
aatctgaggaaattatggctgacac

SEQ ID NO: 33712 - DNA, 25 bp, E. coli
aatctgaggaaaatatggctgacac

SEQ ID NO: 33713 - DNA, 25 bp, E. coli
atctgaggaaattatggctgacact

SEQ ID NO: 33714 - DNA, 25 bp, E. coli
atctgaggaaataatggctgacact

SEQ ID NO: 33715 - DNA, 25 bp, E. coli
acggcccggcgctaccgttaatctg

SEQ ID NO: 33716 - DNA, 25 bp, E. coli
acggcccggcgcaaccgttaatctg

SEQ ID NO: 33717 - DNA, 25 bp, E. coli
tgaggaaattatcgctgacactcgc

SEQ ID NO: 33718 - DNA, 25 bp, E. coli
tgaggaaattatggctgacactcgc

SEQ ID NO: 33719 - DNA, 25 bp, E. coli
tctgaggaaattttggctgacactc

SEQ ID NO: 33720 - DNA, 25 bp, E. coli
tctgaggaaattatggctgacactc

SEQ ID NO: 33721 - DNA, 25 bp, E. coli
gcccggcgctaccgttaatctgagg

SEQ ID NO: 33722 - DNA, 25 bp, E. coli
gcccggcgctacggttaatctgagg

SEQ ID NO: 33723 - DNA, 25 bp, E. coli
gacggcccggcggtaccgttaatct

SEQ ID NO: 33724 - DNA, 25 bp, E. coli
gacggcccggcgctaccgttaatct

SEQ ID NO: 33725 - DNA, 25 bp, E. coli
cggcccggcgctaccgttaatctga

SEQ ID NO: 33726 - DNA, 25 bp, E. coli
cggcccggcgcttccgttaatctga

SEQ ID NO: 33727 - DNA, 25 bp, E. coli
ctgaggaaattatggctgacactcg

SEQ ID NO: 33728 - DNA, 25 bp, E. coli
ctgaggaaattaaggctgacactcg

SEQ ID NO: 33729 - DNA, 25 bp, E. coli
ggcccggcgctaccgttaatctgag

SEQ ID NO: 33730 - DNA, 25 bp, E. coli
ggcccggcgctagcgttaatctgag

SEQ ID NO: 33731 - DNA, 25 bp, E. coli
taatctgaggaatttatggctgaca

SEQ ID NO: 33732 - DNA, 25 bp, E. coli
taatctgaggaaattatggctgaca

SEQ ID NO: 33733 - DNA, 25 bp, E. coli
aatttgtaatcacgagaggctcgac

SEQ ID NO: 33734 - DNA, 25 bp, E. coli
aatttgtaatcaggagaggctcgac

SEQ ID NO: 33735 - DNA, 25 bp, E. coli
cattaaccgtttctggtggccagcc

SEQ ID NO: 33736 - DNA, 25 bp, E. coli
taaagcctgggatgaaggtacctgg

SEQ ID NO: 33737 - DNA, 25 bp, E. coli
taaagcctgggaagaaggtacctgg

SEQ ID NO: 33738 - DNA, 25 bp, E. coli
taccgctttggtgagatcgactggc

SEQ ID NO: 33739 - DNA, 25 bp, E. coli
taccaaaaaatggtcgacggacgga

SEQ ID NO: 33740 - DNA, 25 bp, E. coli
taccgctttggtcagatcgactggc

SEQ ID NO: 33741 - DNA, 25 bp, E. coli
taccaaaaaatgctcgacggacgga

SEQ ID NO: 33742 - DNA, 25 bp, E. coli
tgttcgggccaatcgatgataactc

SEQ ID NO: 33743 - DNA, 25 bp, E. coli
tgttcgggccaaacgatgataactc

SEQ ID NO: 33744 - DNA, 25 bp, E. coli
ccaaagtgcaggttgaagccggtca

SEQ ID NO: 33745 - DNA, 25 bp, E. coli
ccaaagtgcaggatgaagccggtca

SEQ ID NO: 33746 - DNA, 25 bp, E. coli
gaacgctttgaggaacggatagccc

SEQ ID NO: 33747 - DNA, 25 bp, E. coli
gaacgctttgagcaacggatagccc

SEQ ID NO: 33748 - DNA, 25 bp, E. coli
cattgatccgccagattgggcagca

SEQ ID NO: 33749 - DNA, 25 bp, E. coli
cattgatccgcctgattgggcagca

SEQ ID NO: 33750 - DNA, 25 bp, E. coli
cattaaccgtttgtggtggccagcc

SEQ ID NO: 33751 - DNA, 25 bp, E. coli
gtctgtatctctatagcgccgccga

SEQ ID NO: 33752 - DNA, 25 bp, E. coli
gtctgtatctctttagcgccgccga

SEQ ID NO: 33753 - DNA, 25 bp, E. coli
tggatgcccgatgcttaccgaaaga

SEQ ID NO: 33754 - DNA, 25 bp, E. coli
tggatgcccgatccttaccgaaaga

SEQ ID NO: 33755 - DNA, 25 bp, E. coli
aatcgactatcgctggacgggcaac

SEQ ID NO: 33756 - DNA, 25 bp, E. coli
aatcgactatcggtggacgggcaac

SEQ ID NO: 33757 - DNA, 25 bp, E. coli
tacggcgtggaacactgtaattatc

SEQ ID NO: 33758 - DNA, 25 bp, E. coli
tacggcgtggaagactgtaattatc

SEQ ID NO: 33759 - DNA, 25 bp, E. coli
tgatcaccaccgagcggctttccga

SEQ ID NO: 33760 - DNA, 25 bp, E. coli
tgtcttccgcactgcatctggcgga

SEQ ID NO: 33761 - DNA, 25 bp, E. coli
tgatcaccaccgtgcggctttccga

SEQ ID NO: 33762 - DNA, 25 bp, E. coli
tgtatgagctttccgcagtgacgca

SEQ ID NO: 33763 - DNA, 25 bp, E. coli
tgtcttccgcacagcatctggcgga

SEQ ID NO: 33764 - DNA, 25 bp, E. coli
tgtatgagctttgcgcagtgacgca

SEQ ID NO: 33765 - DNA, 25 bp, E. coli
gcggcgggcataatcacccgctgaa

SEQ ID NO: 33766 - DNA, 25 bp, E. coli
gcggcgggcatattcacccgctgaa

SEQ ID NO: 33767 - DNA, 25 bp, E. coli
gctttccgatgatttagcccgttcg

SEQ ID NO: 33768 - DNA, 25 bp, E. coli
gctataccgggcagtcttccgcact

SEQ ID NO: 33769 - DNA, 25 bp, E. coli
gctataccgggctgtcttccgcact

SEQ ID NO: 33770 - DNA, 25 bp, E. coli
gctttccgatgaattagcccgttcg

SEQ ID NO: 33771 - DNA, 25 bp, E. coli
gaagggcgtgaatatcgactatcgc

SEQ ID NO: 33772 - DNA, 25 bp, E. coli
gaagggcgtgaaaatcgactatcgc

SEQ ID NO: 33773 - DNA, 25 bp, E. coli
cgccagcgatcgctacactggtgcg

SEQ ID NO: 33774 - DNA, 25 bp, E. coli
cgccagcgatcggtacactggtgcg

SEQ ID NO: 33775 - DNA, 25 bp, E. coli
gtagtgcgtacagccacaggtcagg

SEQ ID NO: 33776 - DNA, 25 bp, E. coli
gtagtgcgtacacccacaggtcagg

SEQ ID NO: 33777 - DNA, 25 bp, E. coli
catatagaacttccggacggttgcc

SEQ ID NO: 33778 - DNA, 25 bp, E. coli
catatagaacttgcggacggttgcc

SEQ ID NO: 33779 - DNA, 25 bp, E. coli
tttatcagtggccaaaccgtccggg

SEQ ID NO: 33780 - DNA, 25 bp, E. coli
ttttcggcataacaactgaagccgt

SEQ ID NO: 33781 - DNA, 25 bp, E. coli
ttttcggcataagaactgaagccgt

SEQ ID NO: 33782 - DNA, 25 bp, E. coli
tttatcagtggcgaaaccgtccggg

SEQ ID NO: 33783 - DNA, 25 bp, E. coli
tgaagccgtttatcagtggcgaaac

SEQ ID NO: 33784 - DNA, 25 bp, E. coli
tgaagccgtttaacagtggcgaaac

SEQ ID NO: 33785 - DNA, 25 bp, E. coli
tccaaaaggacgagcagcagaagct

SEQ ID NO: 33786 - DNA, 25 bp, E. coli
tccaaaaggacgtgcagcagaagct

SEQ ID NO: 33787 - DNA, 25 bp, E. coli
gcagaagctgcaaatagaacttgcg

SEQ ID NO: 33788 - DNA, 25 bp, E. coli
gcagaagctgcatatagaacttgcg

SEQ ID NO: 33789 - DNA, 25 bp, E. coli
gaaagttgctgcttttttcggcata

SEQ ID NO: 33790 - DNA, 25 bp, E. coli
gacggttgccatataaacctgagct

SEQ ID NO: 33791 - DNA, 25 bp, E. coli
gacggttgccatttaaacctgagct

SEQ ID NO: 33792 - DNA, 25 bp, E. coli
gacgatatcgaaagctacttcggca

SEQ ID NO: 33793 - DNA, 25 bp, E. coli
gaaagttgctgcatttttcggcata

SEQ ID NO: 33794 - DNA, 25 bp, E. coli
cttcggcagtattgagaaagttgct

SEQ ID NO: 33795 - DNA, 25 bp, E. coli
cttcggcagtatagagaaagttgct

SEQ ID NO: 33796 - DNA, 25 bp, E. coli
ggccagttaattgcaaaaggacgtg

SEQ ID NO: 33797 - DNA, 25 bp, E. coli
ggccagttaattccaaaaggacgtg

SEQ ID NO: 33798 - DNA, 25 bp, E. coli
gacgatatcgaatgctacttcggca

SEQ ID NO: 33799 - DNA, 25 bp, E. coli
cagagataacaaacaactaatactg

SEQ ID NO: 33800 - DNA, 25 bp, E. coli
cagagataacaatcaactaatactg

SEQ ID NO: 33801 - DNA, 25 bp, E. coli
acaatcaactaaaactgttttgttg

SEQ ID NO: 33802 - DNA, 25 bp, E. coli
acaatcaactaatactgttttgttg

SEQ ID NO: 33803 - DNA, 25 bp, E. coli
acaggagcaggagtatgaagtcaga

SEQ ID NO: 33804 - DNA, 25 bp, E. coli
acaggagcaggactatgaagtcaga

SEQ ID NO: 33805 - DNA, 25 bp, E. coli
tatgaagtcagacataacaatcaac

SEQ ID NO: 33806 - DNA, 25 bp, E. coli
tatgaagtcagagataacaatcaac

SEQ ID NO: 33807 - DNA, 25 bp, E. coli
tgttgatttttgcttgtaattggcg

SEQ ID NO: 33808 - DNA, 25 bp, E. coli
tgttgatttttggttgtaattggcg

SEQ ID NO: 33809 - DNA, 25 bp, E. coli
tctggtctgattattgtggagtaag

SEQ ID NO: 33810 - DNA, 25 bp, E. coli
tctggtctgatttttgtggagtaag

SEQ ID NO: 33811 - DNA, 25 bp, E. coli
cctgacaggagctggagtatgaagt

SEQ ID NO: 33812 - DNA, 25 bp, E. coli
cctgacaggagcaggagtatgaagt

SEQ ID NO: 33813 - DNA, 25 bp, E. coli
gcaggagtatgaagtcagagataac

SEQ ID NO: 33814 - DNA, 25 bp, E. coli
gcaggagtatgatgtcagagataac

SEQ ID NO: 33815 - DNA, 25 bp, E. coli
cttgtaattggcgttctggtctgat

SEQ ID NO: 33816 - DNA, 25 bp, E. coli
cttgtaattggccttctggtctgat

SEQ ID NO: 33817 - DNA, 25 bp, E. coli
ggtctgatttttgtggagtaagttg

SEQ ID NO: 33818 - DNA, 25 bp, E. coli
ggtctgatttttctggagtaagttg

SEQ ID NO: 33819 - DNA, 25 bp, E. coli
ggcgttctggtcagatttttgtgga

SEQ ID NO: 33820 - DNA, 25 bp, E. coli
ggcgttctggtctgatttttgtgga

SEQ ID NO: 33821 - DNA, 25 bp, E. coli
caatcagtactggtttagcgctcac

SEQ ID NO: 33822 - DNA, 25 bp, E. coli
caagggtatttgtacgcacagccga

SEQ ID NO: 33823 - DNA, 25 bp, E. coli
caagggtatttgaacgcacagccga

SEQ ID NO: 33824 - DNA, 25 bp, E. coli
caatcagtactgctttagcgctcac

SEQ ID NO: 33825 - DNA, 25 bp, E. coli
caaactgtgcgatccattggcctgg

SEQ ID NO: 33826 - DNA, 25 bp, E. coli
caaactgtgcgaaccattggcctgg

SEQ ID NO: 33827 - DNA, 25 bp, E. coli
taaagtactgcttcccctacaggca

SEQ ID NO: 33828 - DNA, 25 bp, E. coli
tacaggcaggtagcgaagtcttgct

SEQ ID NO: 33829 - DNA, 25 bp, E. coli
taaagtactgctacccctacaggca

SEQ ID NO: 33830 - DNA, 25 bp, E. coli
tacaggcaggtaccgaagtcttgct

SEQ ID NO: 33831 - DNA, 25 bp, E. coli
tttgattcaatggacgcctgcagcg

SEQ ID NO: 33832 - DNA, 25 bp, E. coli
tttgattcaatgcacgcctgcagcg

SEQ ID NO: 33833 - DNA, 25 bp, E. coli
gattaacatcgacttactgacggca

SEQ ID NO: 33834 - DNA, 25 bp, E. coli
gattttcccaaatggctggcgggca

SEQ ID NO: 33835 - DNA, 25 bp, E. coli
gattttcccaaaaggctggcgggca

SEQ ID NO: 33836 - DNA, 25 bp, E. coli
gattaacatcgagttactgacggca

SEQ ID NO: 33837 - DNA, 25 bp, E. coli
gggcctggcgcaacatgagttcgaa

SEQ ID NO: 33838 - DNA, 25 bp, E. coli
gggcctggcgcatcatgagttcgaa

SEQ ID NO: 33839 - DNA, 25 bp, E. coli
tggcgaccgctttccgaatgagctt

SEQ ID NO: 33840 - DNA, 25 bp, E. coli
tggcgaccgcttaccgaatgagctt

SEQ ID NO: 33841 - DNA, 25 bp, E. coli
taagtttactggagggctacatcgc

SEQ ID NO: 33842 - DNA, 25 bp, E. coli
taagtttactggtgggctacatcgc

SEQ ID NO: 33843 - DNA, 25 bp, E. coli
cacattggcgctattcaggcgttaa

SEQ ID NO: 33844 - DNA, 25 bp, E. coli
cacattggcgcttttcaggcgttaa

SEQ ID NO: 33845 - DNA, 25 bp, E. coli
caatggcccttattatattctcgca

SEQ ID NO: 33846 - DNA, 25 bp, E. coli
caatggcccttaatatattctcgca

SEQ ID NO: 33847 - DNA, 25 bp, E. coli
caggcgttaagtcaattactgtgcg

SEQ ID NO: 33848 - DNA, 25 bp, E. coli
caggcgttaagtgaattactgtgcg

SEQ ID NO: 33849 - DNA, 25 bp, E. coli
tactgtgcgaagtagaaatactcga

SEQ ID NO: 33850 - DNA, 25 bp, E. coli
tacattcagcaatagattggcagga

SEQ ID NO: 33851 - DNA, 25 bp, E. coli
tactgtgcgaagaagaaatactcga

SEQ ID NO: 33852 - DNA, 25 bp, E. coli
tacattcagcaaaagattggcagga

SEQ ID NO: 33853 - DNA, 25 bp, E. coli
aaacaattagcggacattatcagcc

SEQ ID NO: 33854 - DNA, 25 bp, E. coli
aaacaattagcgcacattatcagcc

SEQ ID NO: 33855 - DNA, 25 bp, E. coli
tatcagcgagaattacattcaggca

SEQ ID NO: 33856 - DNA, 25 bp, E. coli
tatattctcgcagcaggcgtggcaa

SEQ ID NO: 33857 - DNA, 25 bp, E. coli
tatcagcgagaaatacattcaggca

SEQ ID NO: 33858 - DNA, 25 bp, E. coli
tatattctcgcaccaggcgtggcaa

SEQ ID NO: 33859 - DNA, 25 bp, E. coli
ttggcaggaagctatcgatttctcg

SEQ ID NO: 33860 - DNA, 25 bp, E. coli
ttggcaggaagcaatcgatttctcg

SEQ ID NO: 33861 - DNA, 25 bp, E. coli
gcatcatcagaaaaacaattagcgg

SEQ ID NO: 33862 - DNA, 25 bp, E. coli
gcatcatcagaataacaattagcgg

SEQ ID NO: 33863 - DNA, 25 bp, E. coli
gatttctcgatgctatcattgctgg

SEQ ID NO: 33864 - DNA, 25 bp, E. coli
gatttctcgatggtatcattgctgg

SEQ ID NO: 33865 - DNA, 25 bp, E. coli
caaatacgtgggacgggctgatttt

SEQ ID NO: 33866 - DNA, 25 bp, E. coli
caaatacgtgggtcgggctgatttt

SEQ ID NO: 33867 - DNA, 25 bp, E. coli
acaggtcgattacgtgccgggtacg

SEQ ID NO: 33868 - DNA, 25 bp, E. coli
acaggtcgattaggtgccgggtacg

SEQ ID NO: 33869 - DNA, 25 bp, E. coli
ttttgagtttcgaaatggcgaaatg

SEQ ID NO: 33870 - DNA, 25 bp, E. coli
ttttgagtttcgtaatggcgaaatg

SEQ ID NO: 33871 - DNA, 25 bp, E. coli
tgagcacggctctaacgcaccgggc

SEQ ID NO: 33872 - DNA, 25 bp, E. coli
tgagcacggctcaaacgcaccgggc

SEQ ID NO: 33873 - DNA, 25 bp, E. coli
gctgattttgagtttcgtaatggcg

SEQ ID NO: 33874 - DNA, 25 bp, E. coli
gctgattttgagattcgtaatggcg

SEQ ID NO: 33875 - DNA, 25 bp, E. coli
gcaaatacgtggcacgggctgattt

SEQ ID NO: 33876 - DNA, 25 bp, E. coli
gcaaatacgtgggacgggctgattt

SEQ ID NO: 33877 - DNA, 25 bp, E. coli
gacgggctgattatgagtttcgtaa

SEQ ID NO: 33878 - DNA, 25 bp, E. coli
gacgggctgattttgagtttcgtaa

SEQ ID NO: 33879 - DNA, 25 bp, E. coli
ctgatatcgaatatcgtaagcccgc

SEQ ID NO: 33880 - DNA, 25 bp, E. coli
ctgatatcgaatttcgtaagcccgc

SEQ ID NO: 33881 - DNA, 25 bp, E. coli
gattttgagtttggtaatggcgaaa

SEQ ID NO: 33882 - DNA, 25 bp, E. coli
gattttgagtttcgtaatggcgaaa

SEQ ID NO: 33883 - DNA, 25 bp, E. coli
tggtgagcacgggtctaacgcaccg

SEQ ID NO: 33884 - DNA, 25 bp, E. coli
tggtgagcacggctctaacgcaccg

SEQ ID NO: 33885 - DNA, 25 bp, E. coli
tcactgatatcgtatttcgtaagcc

SEQ ID NO: 33886 - DNA, 25 bp, E. coli
tcactgatatcgaatttcgtaagcc

SEQ ID NO: 33887 - DNA, 25 bp, E. coli
aatttggcattgagattcgcggttg

SEQ ID NO: 33888 - DNA, 25 bp, E. coli
aatttggcattgtgattcgcggttg

SEQ ID NO: 33889 - DNA, 25 bp, E. coli
caattaaagatgacttccgtccagg

SEQ ID NO: 33890 - DNA, 25 bp, E. coli
caattaaagatgtcttccgtccagg

SEQ ID NO: 33891 - DNA, 25 bp, E. coli
taaagatgtcttgcgtccaggccat

SEQ ID NO: 33892 - DNA, 25 bp, E. coli
taaagatgtcttccgtccaggccat

SEQ ID NO: 33893 - DNA, 25 bp, E. coli
aggattacagcgcaattaaagatgt

SEQ ID NO: 33894 - DNA, 25 bp, E. coli
aggattacagcggaattaaagatgt

SEQ ID NO: 33895 - DNA, 25 bp, E. coli
ttaaagatgtcttccgtccaggcca

SEQ ID NO: 33896 - DNA, 25 bp, E. coli
ttaaagatgtctaccgtccaggcca

SEQ ID NO: 33897 - DNA, 25 bp, E. coli
ttgagattcgcggttgcctgaccca

SEQ ID NO: 33898 - DNA, 25 bp, E. coli
ttgagattcgcgcttgcctgaccca

SEQ ID NO: 33899 - DNA, 25 bp, E. coli
tctcaggattactgcgcaattaaag

SEQ ID NO: 33900 - DNA, 25 bp, E. coli
tctcaggattacagcgcaattaaag

SEQ ID NO: 33901 - DNA, 25 bp, E. coli
gccgagaaatttggcattgagattc

SEQ ID NO: 33902 - DNA, 25 bp, E. coli
gccgagaaatttcgcattgagattc

SEQ ID NO: 33903 - DNA, 25 bp, E. coli
cgagaaatttgggattgagattcgc

SEQ ID NO: 33904 - DNA, 25 bp, E. coli
cgagaaatttggcattgagattcgc

SEQ ID NO: 33905 - DNA, 25 bp, E. coli
cgttctcaggataacagcgcaatta

SEQ ID NO: 33906 - DNA, 25 bp, E. coli
cgttctcaggattacagcgcaatta

SEQ ID NO: 33907 - DNA, 25 bp, E. coli
tggcattgagatacgcggttgcctg

SEQ ID NO: 33908 - DNA, 25 bp, E. coli
tggcattgagattcgcggttgcctg

SEQ ID NO: 33909 - DNA, 25 bp, E. coli
aatctactgattgcgctgaaggcgc

SEQ ID NO: 33910 - DNA, 25 bp, E. coli
aatctactgattccgctgaaggcgc

SEQ ID NO: 33911 - DNA, 25 bp, E. coli
caaatcggcgaactcatcaaagtgg

SEQ ID NO: 33912 - DNA, 25 bp, E. coli
caaatcggcgaagtcatcaaagtgg

SEQ ID NO: 33913 - DNA, 25 bp, E. coli
taaaggccaggcttttgctcgcgtt

SEQ ID NO: 33914 - DNA, 25 bp, E. coli
tacaacgacggtgagttctggcact

SEQ ID NO: 33915 - DNA, 25 bp, E. coli
taaaggccaggcatttgctcgcgtt

SEQ ID NO: 33916 - DNA, 25 bp, E. coli
taaactgcgtcgtctgctgaccggt

SEQ ID NO: 33917 - DNA, 25 bp, E. coli
tacaacgacggtcagttctggcact

SEQ ID NO: 33918 - DNA, 25 bp, E. coli
taaactgcgtcgactgctgaccggt

SEQ ID NO: 33919 - DNA, 25 bp, E. coli
tccgggcctgaaaggtgataccgca

SEQ ID NO: 33920 - DNA, 25 bp, E. coli
tccgggcctgaatggtgataccgca

SEQ ID NO: 33921 - DNA, 25 bp, E. coli
gctgaccggtacacgcgtagaaaaa

SEQ ID NO: 33922 - DNA, 25 bp, E. coli
gctgaccggtactcgcgtagaaaaa

SEQ ID NO: 33923 - DNA, 25 bp, E. coli
gaaatcgttgattccgatccgggcc

SEQ ID NO: 33924 - DNA, 25 bp, E. coli
gaaatcgttgataccgatccgggcc

SEQ ID NO: 33925 - DNA, 25 bp, E. coli
tggtgaatacgtctctcgcgtgaag

SEQ ID NO: 33926 - DNA, 25 bp, E. coli
tggtgaatacgtgtctcgcgtgaag

SEQ ID NO: 33927 - DNA, 25 bp, E. coli
tcaaagtggatacccgctctggtga

SEQ ID NO: 33928 - DNA, 25 bp, E. coli
tcaaagtggatagccgctctggtga

SEQ ID NO: 33929 - DNA, 25 bp, E. coli
taactctgtggattggtcagccgat

SEQ ID NO: 33930 - DNA, 25 bp, E. coli
taactctgtggaatggtcagccgat

SEQ ID NO: 33931 - DNA, 25 bp, E. coli
aattgttagttgagacgagtccgca

SEQ ID NO: 33932 - DNA, 25 bp, E. coli
aattgttagttgtgacgagtccgca

SEQ ID NO: 33933 - DNA, 25 bp, E. coli
caaaaatcctgaatacgaatcgcgt

SEQ ID NO: 33934 - DNA, 25 bp, E. coli
caaaaatcctgattacgaatcgcgt

SEQ ID NO: 33935 - DNA, 25 bp, E. coli
tatccgtttactttcccaggtcgcg

SEQ ID NO: 33936 - DNA, 25 bp, E. coli
tatgcaagcaacgaataaagcggag

SEQ ID NO: 33937 - DNA, 25 bp, E. coli
tagtcagtatgcacaatccgatgtc

SEQ ID NO: 33938 - DNA, 25 bp, E. coli
tagtcagtatgctcaatccgatgtc

SEQ ID NO: 33939 - DNA, 25 bp, E. coli
tatccgtttactatcccaggtcgcg

SEQ ID NO: 33940 - DNA, 25 bp, E. coli
tatgcaagcaaccaataaagcggag

SEQ ID NO: 33941 - DNA, 25 bp, E. coli
tattccctgggatacgctggatggc

SEQ ID NO: 33942 - DNA, 25 bp, E. coli
tattccctgggaaacgctggatggc

SEQ ID NO: 33943 - DNA, 25 bp, E. coli
ttaatactacgcaggcaattggccg

SEQ ID NO: 33944 - DNA, 25 bp, E. coli
ttgaaaatcataatgcgatcccgca

SEQ ID NO: 33945 - DNA, 25 bp, E. coli
ttgaaaatcatattgcgatcccgca

SEQ ID NO: 33946 - DNA, 25 bp, E. coli
ttaatactacgctggcaattggccg

SEQ ID NO: 33947 - DNA, 25 bp, E. coli
tcttctcaaaaaagatggtgcgatc

SEQ ID NO: 33948 - DNA, 25 bp, E. coli
tcttctcaaaaatgatggtgcgatc

SEQ ID NO: 33949 - DNA, 25 bp, E. coli
cgcgctggcggatgatgacatcata

SEQ ID NO: 33950 - DNA, 25 bp, E. coli
cgcgctggcggaagatgacatcata

SEQ ID NO: 33951 - DNA, 25 bp, E. coli
tgcgatcgattgtcgggaaaccttt

SEQ ID NO: 33952 - DNA, 25 bp, E. coli
tgcgatcgattgacgggaaaccttt

SEQ ID NO: 33953 - DNA, 25 bp, E. coli
aaagaaatgccggtagttcgtgacg

SEQ ID NO: 33954 - DNA, 25 bp, E. coli
aaagaaatgccgctagttcgtgacg

SEQ ID NO: 33955 - DNA, 25 bp, E. coli
tttctgcatgggaaccggaacgacc

SEQ ID NO: 33956 - DNA, 25 bp, E. coli
ttcaatacgtccactgcttcagaga

SEQ ID NO: 33957 - DNA, 25 bp, E. coli
ttcatgatacggtagatggcccggt

SEQ ID NO: 33958 - DNA, 25 bp, E. coli
ttcaatacgtcctctgcttcagaga

SEQ ID NO: 33959 - DNA, 25 bp, E. coli
ttcgtgacggatatggctactggac

SEQ ID NO: 33960 - DNA, 25 bp, E. coli
ttcgtgacggatttggctactggac

SEQ ID NO: 33961 - DNA, 25 bp, E. coli
ttcatgatacggaagatggcccggt

SEQ ID NO: 33962 - DNA, 25 bp, E. coli
tttctgcatgggtaccggaacgacc

SEQ ID NO: 33963 - DNA, 25 bp, E. coli
tcagagatgaagcatgtgctgacct

SEQ ID NO: 33964 - DNA, 25 bp, E. coli
tctggttgcgaattaaggctgaagc

SEQ ID NO: 33965 - DNA, 25 bp, E. coli
tctggttgcgaaataaggctgaagc

SEQ ID NO: 33966 - DNA, 25 bp, E. coli
tcagagatgaaggatgtgctgacct

SEQ ID NO: 33967 - DNA, 25 bp, E. coli
gcccggtttgtgactggttgcgaaa

SEQ ID NO: 33968 - DNA, 25 bp, E. coli
gcccggtttgtgtctggttgcgaaa

SEQ ID NO: 33969 - DNA, 25 bp, E. coli
gatatggctactggacacatcctga

SEQ ID NO: 33970 - DNA, 25 bp, E. coli
gatatggctactcgacacatcctga

SEQ ID NO: 33971 - DNA, 25 bp, E. coli
ggcgatggctggattattggttcca

SEQ ID NO: 33972 - DNA, 25 bp, E. coli
ggcgatggctggtttattggttcca

SEQ ID NO: 33973 - DNA, 25 bp, E. coli
gaccttgatgcgagtgatgctgata

SEQ ID NO: 33974 - DNA, 25 bp, E. coli
gaccttgatgcgtgtgatgctgata

SEQ ID NO: 33975 - DNA, 25 bp, E. coli
taaaggccattctccgtgctgcaga

SEQ ID NO: 33976 - DNA, 25 bp, E. coli
taaaggccattcaccgtgctgcaga

SEQ ID NO: 33977 - DNA, 25 bp, E. coli
tatggaaacagaaagttcaggccgc

SEQ ID NO: 33978 - DNA, 25 bp, E. coli
taccaaggcggcaaagcgagcagat

SEQ ID NO: 33979 - DNA, 25 bp, E. coli
tatggaaacagatagttcaggccgc

SEQ ID NO: 33980 - DNA, 25 bp, E. coli
taccaaggcggctaagcgagcagat

SEQ ID NO: 33981 - DNA, 25 bp, E. coli
taccagcggtcagaaacaagcgagt

SEQ ID NO: 33982 - DNA, 25 bp, E. coli
taccagcggtcacaaacaagcgagt

SEQ ID NO: 33983 - DNA, 25 bp, E. coli
tatcagtgcttctggaaatgggcgg

SEQ ID NO: 33984 - DNA, 25 bp, E. coli
tatcagtgcttcaggaaatgggcgg

SEQ ID NO: 33985 - DNA, 25 bp, E. coli
tcgacatgcagccacgagttgcctg

SEQ ID NO: 33986 - DNA, 25 bp, E. coli
tcgacatgcagcgacgagttgcctg

SEQ ID NO: 33987 - DNA, 25 bp, E. coli
tctcttggcacataggacaaacggc

SEQ ID NO: 33988 - DNA, 25 bp, E. coli
tctcttggcacaaaggacaaacggc

SEQ ID NO: 33989 - DNA, 25 bp, E. coli
gccttattgatgagtgccccgaacc

SEQ ID NO: 33990 - DNA, 25 bp, E. coli
gccttattgatgtgtgccccgaacc

SEQ ID NO: 33991 - DNA, 25 bp, E. coli
gctatcagcttgacgtcgtgcagga

SEQ ID NO: 33992 - DNA, 25 bp, E. coli
gctatcagcttgtcgtcgtgcagga

SEQ ID NO: 33993 - DNA, 25 bp, E. coli
ggaaaaagcgccagtcatcaagata

SEQ ID NO: 33994 - DNA, 25 bp, E. coli
ggaaaaagcgcctgtcatcaagata

SEQ ID NO: 33995 - DNA, 25 bp, E. coli
gatgtcacttttcaagaggcctgcc

SEQ ID NO: 33996 - DNA, 25 bp, E. coli
gatgtcacttttgaagaggcctgcc

SEQ ID NO: 33997 - DNA, 25 bp, E. coli
cagtcgccgtttggccagatggtca

SEQ ID NO: 33998 - DNA, 25 bp, E. coli
cagtcgccgtttcgccagatggtca

SEQ ID NO: 33999 - DNA, 25 bp, E. coli
tataccatgtcggtggcgatgacca

SEQ ID NO: 34000 - DNA, 25 bp, E. coli
tattaatgacgtagccagccagtcg

SEQ ID NO: 34001 - DNA, 25 bp, E. coli
tataccatgtcgctggcgatgacca

SEQ ID NO: 34002 - DNA, 25 bp, E. coli
tattaatgacgttgccagccagtcg

SEQ ID NO: 34003 - DNA, 25 bp, E. coli
ttggatctgtttgccgatgctgaac

SEQ ID NO: 34004 - DNA, 25 bp, E. coli
ttggatctgtttcccgatgctgaac

SEQ ID NO: 34005 - DNA, 25 bp, E. coli
tgatccgcaaactaataaaccgtgg

SEQ ID NO: 34006 - DNA, 25 bp, E. coli
tgtcgctgcatcaggataaagacga

SEQ ID NO: 34007 - DNA, 25 bp, E. coli
tgatccgcaaacaaataaaccgtgg

SEQ ID NO: 34008 - DNA, 25 bp, E. coli
tgtcgctgcatctggataaagacga

SEQ ID NO: 34009 - DNA, 25 bp, E. coli
gacattccgtcaggcaggtaaaaaa

SEQ ID NO: 34010 - DNA, 25 bp, E. coli
gacattccgtcacgcaggtaaaaaa

SEQ ID NO: 34011 - DNA, 25 bp, E. coli
gataaagacgaagcggatctgcgcg

SEQ ID NO: 34012 - DNA, 25 bp, E. coli
gataaagacgaaccggatctgcgcg

SEQ ID NO: 34013 - DNA, 25 bp, E. coli
ggcggcgggctaaccagatttccag

SEQ ID NO: 34014 - DNA, 25 bp, E. coli
ggcggcgggctatccagatttccag

SEQ ID NO: 34015 - DNA, 25 bp, E. coli
taatttatgtcaacgtgcggctacg

SEQ ID NO: 34016 - DNA, 25 bp, E. coli
taatttatgtcatcgtgcggctacg

SEQ ID NO: 34017 - DNA, 25 bp, E. coli
gatgcttgtcttttcaaccgctacg

SEQ ID NO: 34018 - DNA, 25 bp, E. coli
gatgcttgtcttatcaaccgctacg

SEQ ID NO: 34019 - DNA, 25 bp, E. coli
cagataaacgttaccgtacaagttg

SEQ ID NO: 34020 - DNA, 25 bp, E. coli
cagataaacgtttccgtacaagttg

SEQ ID NO: 34021 - DNA, 25 bp, E. coli
aaaatggcacagttaaacgttaccg

SEQ ID NO: 34022 - DNA, 25 bp, E. coli
aaaatggcacagataaacgttaccg

SEQ ID NO: 34023 - DNA, 25 bp, E. coli
tagcgcactctgtatcattgaaaag

SEQ ID NO: 34024 - DNA, 25 bp, E. coli
tagcgcactctgaatcattgaaaag

SEQ ID NO: 34025 - DNA, 25 bp, E. coli
ttttcttcgtgttttgactgtagca

SEQ ID NO: 34026 - DNA, 25 bp, E. coli
ttttcttcgtgtattgactgtagca

SEQ ID NO: 34027 - DNA, 25 bp, E. coli
tgaatatttatagcgcactctgaat

SEQ ID NO: 34028 - DNA, 25 bp, E. coli
tgaatatttataccgcactctgaat

SEQ ID NO: 34029 - DNA, 25 bp, E. coli
tcgcgccctattctgaatatttata

SEQ ID NO: 34030 - DNA, 25 bp, E. coli
tcgcgccctattgtgaatatttata

SEQ ID NO: 34031 - DNA, 25 bp, E. coli
tcattgaaaaggagtgcgcggaagc

SEQ ID NO: 34032 - DNA, 25 bp, E. coli
tcattgaaaaggtgtgcgcggaagc

SEQ ID NO: 34033 - DNA, 25 bp, E. coli
gcacttgtcaaacgcgtgcgttttg

SEQ ID NO: 34034 - DNA, 25 bp, E. coli
gcacttgtcaaaggcgtgcgttttg

SEQ ID NO: 34035 - DNA, 25 bp, E. coli
gactgtagcacttgtcaaaggcgtg

SEQ ID NO: 34036 - DNA, 25 bp, E. coli
gactgtagcactagtcaaaggcgtg

SEQ ID NO: 34037 - DNA, 25 bp, E. coli
cgttttgcgtaatattcgcgcccta

SEQ ID NO: 34038 - DNA, 25 bp, E. coli
cgttttgcgtaaaattcgcgcccta

SEQ ID NO: 34039 - DNA, 25 bp, E. coli
ggtgattgtactcaaaaaatggcac

SEQ ID NO: 34040 - DNA, 25 bp, E. coli
ggtgattgtactgaaaaaatggcac

SEQ ID NO: 34041 - DNA, 25 bp, E. coli
aagcacaacgtctggcactgtatcg

SEQ ID NO: 34042 - DNA, 25 bp, E. coli
aagcacaacgtcaggcactgtatcg

SEQ ID NO: 34043 - DNA, 25 bp, E. coli
caattaagaagaacacttttaacgt

SEQ ID NO: 34044 - DNA, 25 bp, E. coli
agccggcaattaagaagatcacttt

SEQ ID NO: 34045 - DNA, 25 bp, E. coli
agcacaacgtcacgcactgtatcgc

SEQ ID NO: 34046 - DNA, 25 bp, E. coli
agcacaacgtcaggcactgtatcgc

SEQ ID NO: 34047 - DNA, 25 bp, E. coli
agccggcaattatgaagatcacttt

SEQ ID NO: 34048 - DNA, 25 bp, E. coli
caattaagaagatcacttttaacgt

SEQ ID NO: 34049 - DNA, 25 bp, E. coli
aaagccggcaataaagaagatcact

SEQ ID NO: 34050 - DNA, 25 bp, E. coli
aaagccggcaattaagaagatcact

SEQ ID NO: 34051 - DNA, 25 bp, E. coli
tgacgaagcacatcgtcaggcactg

SEQ ID NO: 34052 - DNA, 25 bp, E. coli
tgacgaagcacaacgtcaggcactg

SEQ ID NO: 34053 - DNA, 25 bp, E. coli
ccggcaattaagaagatcactttta

SEQ ID NO: 34054 - DNA, 25 bp, E. coli
ccatgacgaagcacaacgtcaggca

SEQ ID NO: 34055 - DNA, 25 bp, E. coli
ccatgacgaagctcaacgtcaggca

SEQ ID NO: 34056 - DNA, 25 bp, E. coli
ccggcaattaagtagatcactttta

SEQ ID NO: 34057 - DNA, 25 bp, E. coli
gaacccagcttaccatacccaactg

SEQ ID NO: 34058 - DNA, 25 bp, E. coli
gaacccagcttagcatacccaactg

SEQ ID NO: 34059 - DNA, 25 bp, E. coli
gacgaagcacaacgtcaggcactgt

SEQ ID NO: 34060 - DNA, 25 bp, E. coli
gacgaagcacaaggtcaggcactgt

SEQ ID NO: 34061 - DNA, 25 bp, E. coli
cgaagcacaacgtcaggcactgtat

SEQ ID NO: 34062 - DNA, 25 bp, E. coli
cgaagcacaacgacaggcactgtat

SEQ ID NO: 34063 - DNA, 25 bp, E. coli
aagttatcccgcctaataccacgat

SEQ ID NO: 34064 - DNA, 25 bp, E. coli
aagttatcccgcgtaataccacgat

SEQ ID NO: 34065 - DNA, 25 bp, E. coli
tatcccgcgtaataccacgattccg

SEQ ID NO: 34066 - DNA, 25 bp, E. coli
tatcccgcgtaaaaccacgattccg

SEQ ID NO: 34067 - DNA, 25 bp, E. coli
tgttctgcgctttcttaatgaaccg

SEQ ID NO: 34068 - DNA, 25 bp, E. coli
tgttctgcgcttacttaatgaaccg

SEQ ID NO: 34069 - DNA, 25 bp, E. coli
tcaggctatcgaggatgctgccgct

SEQ ID NO: 34070 - DNA, 25 bp, E. coli
tctggaagctaaacatggccttatt

SEQ ID NO: 34071 - DNA, 25 bp, E. coli
tcaggctatcgacgatgctgccgct

SEQ ID NO: 34072 - DNA, 25 bp, E. coli
tctggaagctaatcatggccttatt

SEQ ID NO: 34073 - DNA, 25 bp, E. coli
gaagctaaacatcgccttattacaa

SEQ ID NO: 34074 - DNA, 25 bp, E. coli
gaagctaaacatggccttattacaa

SEQ ID NO: 34075 - DNA, 25 bp, E. coli
ccgcagaacgtctggctatcgacga

SEQ ID NO: 34076 - DNA, 25 bp, E. coli
ccgcagaacgtcaggctatcgacga

SEQ ID NO: 34077 - DNA, 25 bp, E. coli
cgatgctgccatagcggccaaaatc

SEQ ID NO: 34078 - DNA, 25 bp, E. coli
cgatgctgccattgcggccaaaatc

SEQ ID NO: 34079 - DNA, 25 bp, E. coli
ctgctcgatttttaatttctggaag

SEQ ID NO: 34080 - DNA, 25 bp, E. coli
ctgctcgattttaaatttctggaag

SEQ ID NO: 34081 - DNA, 25 bp, E. coli
gggctgcatgttctgcgcttactta

SEQ ID NO: 34082 - DNA, 25 bp, E. coli
gggctgcatgttgtgcgcttactta

SEQ ID NO: 34083 - DNA, 25 bp, E. coli
taatttctggaagctaaacatggcc

SEQ ID NO: 34084 - DNA, 25 bp, E. coli
taatttctggaacctaaacatggcc

SEQ ID NO: 34085 - DNA, 25 bp, E. coli
cacatttggatgaggaatttcctaa

SEQ ID NO: 34086 - DNA, 25 bp, E. coli
cacatttggatgtggaatttcctaa

SEQ ID NO: 34087 - DNA, 25 bp, E. coli
catataatgaacttaccggaggagg

SEQ ID NO: 34088 - DNA, 25 bp, E. coli
catataatgaacataccggaggagg

SEQ ID NO: 34089 - DNA, 25 bp, E. coli
tagttagctataatacccggcaaga

SEQ ID NO: 34090 - DNA, 25 bp, E. coli
tagttagctatattacccggcaaga

SEQ ID NO: 34091 - DNA, 25 bp, E. coli
ttttccaaatattgatgctgccaac

SEQ ID NO: 34092 - DNA, 25 bp, E. coli
ttttccaaatatagatgctgccaac

SEQ ID NO: 34093 - DNA, 25 bp, E. coli
tgcttttcacaactctcggcttgga

SEQ ID NO: 34094 - DNA, 25 bp, E. coli
tgcttttcacaagtctcggcttgga

SEQ ID NO: 34095 - DNA, 25 bp, E. coli
tcctcaggtaaactattcgaagaca

SEQ ID NO: 34096 - DNA, 25 bp, E. coli
tgcgacagagcaatccttaatcggc

SEQ ID NO: 34097 - DNA, 25 bp, E. coli
tgcgacagagcattccttaatcggc

SEQ ID NO: 34098 - DNA, 25 bp, E. coli
tcctcaggtaaagtattcgaagaca

SEQ ID NO: 34099 - DNA, 25 bp, E. coli
tctcaatgaattaatcgggcttaag

SEQ ID NO: 34100 - DNA, 25 bp, E. coli
tctcaatgaatttatcgggcttaag

SEQ ID NO: 34101 - DNA, 25 bp, E. coli
gccaactatgttataaatgcagcaa

SEQ ID NO: 34102 - DNA, 25 bp, E. coli
gccaactatgttttaaatgcagcaa

SEQ ID NO: 34103 - DNA, 25 bp, E. coli
gctttttagaatactcatgccccac

SEQ ID NO: 34104 - DNA, 25 bp, E. coli
gctttttagaattctcatgccccac

SEQ ID NO: 34105 - DNA, 25 bp, E. coli
cccggcaagatataaatgcaatgga

SEQ ID NO: 34106 - DNA, 25 bp, E. coli
cccggcaagataaaaatgcaatgga

SEQ ID NO: 34107 - DNA, 25 bp, E. coli
aatcatcaggaacgttattccggcc

SEQ ID NO: 34108 - DNA, 25 bp, E. coli
aatcatcaggaaggttattccggcc

SEQ ID NO: 34109 - DNA, 25 bp, E. coli
catagcccgcgagctggaagggttc

SEQ ID NO: 34110 - DNA, 25 bp, E. coli
catagcccgcgacctggaagggttc

SEQ ID NO: 34111 - DNA, 25 bp, E. coli
aaagagggctggaaattgcctgcgc

SEQ ID NO: 34112 - DNA, 25 bp, E. coli
aaagagggctggtaattgcctgcgc

SEQ ID NO: 34113 - DNA, 25 bp, E. coli
gcctgcgcgttgctttcggatctga

SEQ ID NO: 34114 - DNA, 25 bp, E. coli
gcctgacgctcggtgaacttgaaga

SEQ ID NO: 34115 - DNA, 25 bp, E. coli
gcctgacgctcgctgaacttgaaga

SEQ ID NO: 34116 - DNA, 25 bp, E. coli
gcctgcgcgttggtttcggatctga

SEQ ID NO: 34117 - DNA, 25 bp, E. coli
gaacttgaagatgccatagcccgcg

SEQ ID NO: 34118 - DNA, 25 bp, E. coli
gaacttgaagatcccatagcccgcg

SEQ ID NO: 34119 - DNA, 25 bp, E. coli
ctgtatcgccgtgccgttgcctgtg

SEQ ID NO: 34120 - DNA, 25 bp, E. coli
ctgtatcgccgtcccgttgcctgtg

SEQ ID NO: 34121 - DNA, 25 bp, E. coli
gatatgctgtgaatctcttctggca

SEQ ID NO: 34122 - DNA, 25 bp, E. coli
gatatgctgtgattctcttctggca

SEQ ID NO: 34123 - DNA, 25 bp, E. coli
tggctggctctaagcaatcatcagg

SEQ ID NO: 34124 - DNA, 25 bp, E. coli
ggaagggttctatctgcgccagcat

SEQ ID NO: 34125 - DNA, 25 bp, E. coli
tggctggctctatgcaatcatcagg

SEQ ID NO: 34126 - DNA, 25 bp, E. coli
ggaagggttctaactgcgccagcat

SEQ ID NO: 34127 - DNA, 25 bp, E. coli
tcactgctcggaatgacggtcatgg

SEQ ID NO: 34128 - DNA, 25 bp, E. coli
tcactgctcggattgacggtcatgg

SEQ ID NO: 34129 - DNA, 25 bp, E. coli
caatgtattcttaggattttgctta

SEQ ID NO: 34130 - DNA, 25 bp, E. coli
caatgtattctttggattttgctta

SEQ ID NO: 34131 - DNA, 25 bp, E. coli
catgattttttaatgcctgtggtat

SEQ ID NO: 34132 - DNA, 25 bp, E. coli
catgattttttattgcctgtggtat

SEQ ID NO: 34133 - DNA, 25 bp, E. coli
aaagcatttacagtcaggatgaata

SEQ ID NO: 34134 - DNA, 25 bp, E. coli
aaagcatttacactcaggatgaata

SEQ ID NO: 34135 - DNA, 25 bp, E. coli
ttatttcatcaaagtattctttgga

SEQ ID NO: 34136 - DNA, 25 bp, E. coli
ttatttcatcaatgtattctttgga

SEQ ID NO: 34137 - DNA, 25 bp, E. coli
tgcctgtggtatttttttacgcaaa

SEQ ID NO: 34138 - DNA, 25 bp, E. coli
tgcctgtggtatatttttacgcaaa

SEQ ID NO: 34139 - DNA, 25 bp, E. coli
tgcgttaaagcatttacactcagga

SEQ ID NO: 34140 - DNA, 25 bp, E. coli
tgcgttaaagcaattacactcagga

SEQ ID NO: 34141 - DNA, 25 bp, E. coli
tcatctcatgatattttaatgcctg

SEQ ID NO: 34142 - DNA, 25 bp, E. coli
tcatctcatgattttttaatgcctg

SEQ ID NO: 34143 - DNA, 25 bp, E. coli
gcttataataataatggaagggatg

SEQ ID NO: 34144 - DNA, 25 bp, E. coli
gcttataataattatggaagggatg

SEQ ID NO: 34145 - DNA, 25 bp, E. coli
gaagggatgattataaatgaatgcg

SEQ ID NO: 34146 - DNA, 25 bp, E. coli
gaagggatgattttaaatgaatgcg

SEQ ID NO: 34147 - DNA, 25 bp, E. coli
gttaaagcatttacactcaggatga

SEQ ID NO: 34148 - DNA, 25 bp, E. coli
gttaaagcattttcactcaggatga

SEQ ID NO: 34149 - DNA, 25 bp, E. coli
gattataaatgaatgcgttaaagca

SEQ ID NO: 34150 - DNA, 25 bp, E. coli
gattataaatgattgcgttaaagca

SEQ ID NO: 34151 - DNA, 25 bp, E. coli
tacgtgttctggaaaaagcctggca

SEQ ID NO: 34152 - DNA, 25 bp, E. coli
acggcctgccgtcgaaatattatga

SEQ ID NO: 34153 - DNA, 25 bp, E. coli
acggcctgccgtggaaatattatga

SEQ ID NO: 34154 - DNA, 25 bp, E. coli
tacgtgttctggtaaaagcctggca

SEQ ID NO: 34155 - DNA, 25 bp, E. coli
tattaatgtcagctattgccgacgg

SEQ ID NO: 34156 - DNA, 25 bp, E. coli
tatttccgggcgaaactcaggtggc

SEQ ID NO: 34157 - DNA, 25 bp, E. coli
tattaatgtcaggtattgccgacgg

SEQ ID NO: 34158 - DNA, 25 bp, E. coli
tatttccgggcgtaactcaggtggc

SEQ ID NO: 34159 - DNA, 25 bp, E. coli
tgataccagtttgcaccagacgatg

SEQ ID NO: 34160 - DNA, 25 bp, E. coli
tgataccagtttccaccagacgatg

SEQ ID NO: 34161 - DNA, 25 bp, E. coli
gaattgcccgtcatattgccggaca

SEQ ID NO: 34162 - DNA, 25 bp, E. coli
gaaggcttgatgatgggtacccgca

SEQ ID NO: 34163 - DNA, 25 bp, E. coli
gaatcggcgcagcaattatttccgg

SEQ ID NO: 34164 - DNA, 25 bp, E. coli
gaatcggcgcaggaattatttccgg

SEQ ID NO: 34165 - DNA, 25 bp, E. coli
gaattgcccgtcttattgccggaca

SEQ ID NO: 34166 - DNA, 25 bp, E. coli
gaaggcttgatgttgggtacccgca

SEQ ID NO: 34167 - DNA, 25 bp, E. coli
gttatggtttcctcggcacgtcgca

SEQ ID NO: 34168 - DNA, 25 bp, E. coli
gttatggtttccacggcacgtcgca

SEQ ID NO: 34169 - DNA, 25 bp, E. coli
taattcgtcgtcaggtcatggaaca

SEQ ID NO: 34170 - DNA, 25 bp, E. coli
taattcgtcgtctggtcatggaaca

SEQ ID NO: 34171 - DNA, 25 bp, E. coli
gagtccgccatttttaccgatgaag

SEQ ID NO: 34172 - DNA, 25 bp, E. coli
gagtccgccattattaccgatgaag

SEQ ID NO: 34173 - DNA, 25 bp, E. coli
aatcgaatctttagttgcggttact

SEQ ID NO: 34174 - DNA, 25 bp, E. coli
caacgagttgttaaccgcaatttgt

SEQ ID NO: 34175 - DNA, 25 bp, E. coli
caacgagttgtttaccgcaatttgt

SEQ ID NO: 34176 - DNA, 25 bp, E. coli
aatcgaatcttttgttgcggttact

SEQ ID NO: 34177 - DNA, 25 bp, E. coli
gctctacttccctccgggaaaatgg

SEQ ID NO: 34178 - DNA, 25 bp, E. coli
gctctacttcccaccgggaaaatgg

SEQ ID NO: 34179 - DNA, 25 bp, E. coli
atcatgctctacatcccaccgggaa

SEQ ID NO: 34180 - DNA, 25 bp, E. coli
atcatgctctacttcccaccgggaa

SEQ ID NO: 34181 - DNA, 25 bp, E. coli
tttgcgcacggttggagccgcactg

SEQ ID NO: 34182 - DNA, 25 bp, E. coli
tttgcgcacggtaggagccgcactg

SEQ ID NO: 34183 - DNA, 25 bp, E. coli
tattttcgttactgcgctcatcagt

SEQ ID NO: 34184 - DNA, 25 bp, E. coli
tattttcgttacagcgctcatcagt

SEQ ID NO: 34185 - DNA, 25 bp, E. coli
tgcggttactactattttcctcggg

SEQ ID NO: 34186 - DNA, 25 bp, E. coli
tgcggttactacaattttcctcggg

SEQ ID NO: 34187 - DNA, 25 bp, E. coli
gaatcgcaacgacttgtttaccgca

SEQ ID NO: 34188 - DNA, 25 bp, E. coli
gaatcgcaacgagttgtttaccgca

SEQ ID NO: 34189 - DNA, 25 bp, E. coli
gaatcttttgttccggttactacta

SEQ ID NO: 34190 - DNA, 25 bp, E. coli
gaatcttttgttgcggttactacta

SEQ ID NO: 34191 - DNA, 25 bp, E. coli
gtattcttagccgggcaaccgagcc

SEQ ID NO: 34192 - DNA, 25 bp, E. coli
gtattcttagcccggcaaccgagcc

SEQ ID NO: 34193 - DNA, 25 bp, E. coli
tggagccgcactgctgctgcaaatc

SEQ ID NO: 34194 - DNA, 25 bp, E. coli
tggagccgcactcctgctgcaaatc

SEQ ID NO: 34195 - DNA, 25 bp, E. coli
aagtttgctttgttccgcgtggcag

SEQ ID NO: 34196 - DNA, 25 bp, E. coli
aagtttgctttgatccgcgtggcag

SEQ ID NO: 34197 - DNA, 25 bp, E. coli
cagaaagtttgctttgttccgcgtg

SEQ ID NO: 34198 - DNA, 25 bp, E. coli
cagaaagtttgcattgttccgcgtg

SEQ ID NO: 34199 - DNA, 25 bp, E. coli
cagtttgttggctagcggcgtagat

SEQ ID NO: 34200 - DNA, 25 bp, E. coli
cagtttgttggcaagcggcgtagat

SEQ ID NO: 34201 - DNA, 25 bp, E. coli
agtttgctttgttccgcgtggcagc

SEQ ID NO: 34202 - DNA, 25 bp, E. coli
agtttgctttgtaccgcgtggcagc

SEQ ID NO: 34203 - DNA, 25 bp, E. coli
aaagtttgctttgttccgcgtggca

SEQ ID NO: 34204 - DNA, 25 bp, E. coli
aaagtttgctttcttccgcgtggca

SEQ ID NO: 34205 - DNA, 25 bp, E. coli
ttggcaagcggcctagatgcccacg

SEQ ID NO: 34206 - DNA, 25 bp, E. coli
ttgctttgttccgcgtggcagccag

SEQ ID NO: 34207 - DNA, 25 bp, E. coli
ttggcaagcggcgtagatgcccacg

SEQ ID NO: 34208 - DNA, 25 bp, E. coli
ttgctttgttccccgtggcagccag

SEQ ID NO: 34209 - DNA, 25 bp, E. coli
ccagaaagtttgctttgttccgcgt

SEQ ID NO: 34210 - DNA, 25 bp, E. coli
ccagaaagtttggtttgttccgcgt

SEQ ID NO: 34211 - DNA, 25 bp, E. coli
gccagaaagtttcctttgttccgcg

SEQ ID NO: 34212 - DNA, 25 bp, E. coli
gccagaaagtttgctttgttccgcg

SEQ ID NO: 34213 - DNA, 25 bp, E. coli
gaatgccagaaactttgctttgttc

SEQ ID NO: 34214 - DNA, 25 bp, E. coli
gaatgccagaaagtttgctttgttc

SEQ ID NO: 34215 - DNA, 25 bp, E. coli
gtttgctttgttgcgcgtggcagcc

SEQ ID NO: 34216 - DNA, 25 bp, E. coli
gtttgctttgttccgcgtggcagcc

SEQ ID NO: 34217 - DNA, 25 bp, E. coli
caagctgccagtgaaaaagtcgaga

SEQ ID NO: 34218 - DNA, 25 bp, E. coli
caagctgccagtcaaaaagtcgaga

SEQ ID NO: 34219 - DNA, 25 bp, E. coli
cacgttggcggccataatatgtccg

SEQ ID NO: 34220 - DNA, 25 bp, E. coli
cacgttggcggcgataatatgtccg

SEQ ID NO: 34221 - DNA, 25 bp, E. coli
aataccggtaaacatgaagggccag

SEQ ID NO: 34222 - DNA, 25 bp, E. coli
aataccggtaaagatgaagggccag

SEQ ID NO: 34223 - DNA, 25 bp, E. coli
aaagacaaagcggtgatggtccacg

SEQ ID NO: 34224 - DNA, 25 bp, E. coli
aaagacaaagcgctgatggtccacg

SEQ ID NO: 34225 - DNA, 25 bp, E. coli
tattcatgccaatggaagctgccag

SEQ ID NO: 34226 - DNA, 25 bp, E. coli
tattcatgccaaaggaagctgccag

SEQ ID NO: 34227 - DNA, 25 bp, E. coli
tgccgggcattttggcgatctgcct

SEQ ID NO: 34228 - DNA, 25 bp, E. coli
tgccgggcatttaggcgatctgcct

SEQ ID NO: 34229 - DNA, 25 bp, E. coli
gcgcctcgtctgaaatcactggatg

SEQ ID NO: 34230 - DNA, 25 bp, E. coli
gcgcctcgtctgtaatcactggatg

SEQ ID NO: 34231 - DNA, 25 bp, E. coli
gcaggcgggcatgttgatccacaaa

SEQ ID NO: 34232 - DNA, 25 bp, E. coli
gcaggcgggcatcttgatccacaaa

SEQ ID NO: 34233 - DNA, 25 bp, E. coli
ggtagcgtcacctttactgaaaccg

SEQ ID NO: 34234 - DNA, 25 bp, E. coli
ggtagcgtcaccattactgaaaccg

SEQ ID NO: 34235 - DNA, 25 bp, E. coli
taaaggtctggacttttcgcccgat

SEQ ID NO: 34236 - DNA, 25 bp, E. coli
taaaggtctggagttttcgcccgat

SEQ ID NO: 34237 - DNA, 25 bp, E. coli
gagatgaacctcgtcacgtcgcaag

SEQ ID NO: 34238 - DNA, 25 bp, E. coli
gagatgaacctcctcacgtcgcaag

SEQ ID NO: 34239 - DNA, 25 bp, E. coli
aatatttgtcatagcagccctggcg

SEQ ID NO: 34240 - DNA, 25 bp, E. coli
aatatttgtcattgcagccctggcg

SEQ ID NO: 34241 - DNA, 25 bp, E. coli
caaagactggcaattccgctgcgta

SEQ ID NO: 34242 - DNA, 25 bp, E. coli
caaagactggcatttccgctgcgta

SEQ ID NO: 34243 - DNA, 25 bp, E. coli
acttgattgccagctacgtaacgcg

SEQ ID NO: 34244 - DNA, 25 bp, E. coli
acttgattgccacctacgtaacgcg

SEQ ID NO: 34245 - DNA, 25 bp, E. coli
tattcctcagcgttgaaggcgatga

SEQ ID NO: 34246 - DNA, 25 bp, E. coli
tattcctcagcgatgaaggcgatga

SEQ ID NO: 34247 - DNA, 25 bp, E. coli
tttttggtaaagagcagcgcgcccg

SEQ ID NO: 34248 - DNA, 25 bp, E. coli
tttttggtaaagtgcagcgcgcccg

SEQ ID NO: 34249 - DNA, 25 bp, E. coli
tgggcatggagccaaagcaaatcgc

SEQ ID NO: 34250 - DNA, 25 bp, E. coli
tgggcatggagcgaaagcaaatcgc

SEQ ID NO: 34251 - DNA, 25 bp, E. coli
tgaaagagtatgttcgcgtgctggc

SEQ ID NO: 34252 - DNA, 25 bp, E. coli
tgacgagcccggagaacatggcatt

SEQ ID NO: 34253 - DNA, 25 bp, E. coli
tgaaagagtatgatcgcgtgctggc

SEQ ID NO: 34254 - DNA, 25 bp, E. coli
tgagtaaaatcgttagctggcgggc

SEQ ID NO: 34255 - DNA, 25 bp, E. coli
tgacgagcccggtgaacatggcatt

SEQ ID NO: 34256 - DNA, 25 bp, E. coli
tgagtaaaatcgatagctggcgggc

SEQ ID NO: 34257 - DNA, 25 bp, E. coli
cgaagataatgatccctgcggtacc

SEQ ID NO: 34258 - DNA, 25 bp, E. coli
cgaagataatgaaccctgcggtacc

SEQ ID NO: 34259 - DNA, 25 bp, E. coli
gagagccttcgtacattgcgacacg

SEQ ID NO: 34260 - DNA, 25 bp, E. coli
gagagccttcgttcattgcgacacg

SEQ ID NO: 34261 - DNA, 25 bp, E. coli
cattttgtcttagcgcgtctgaaaa

SEQ ID NO: 34262 - DNA, 25 bp, E. coli
cagtgtgttcgagattttgtcttac

SEQ ID NO: 34263 - DNA, 25 bp, E. coli
cagtgtgttcgacattttgtcttac

SEQ ID NO: 34264 - DNA, 25 bp, E. coli
cattttgtcttaccgcgtctgaaaa

SEQ ID NO: 34265 - DNA, 25 bp, E. coli
aaagacgctggcgtgccgtttttct

SEQ ID NO: 34266 - DNA, 25 bp, E. coli
aaagacgctggcctgccgtttttct

SEQ ID NO: 34267 - DNA, 25 bp, E. coli
ttttttttgcccaggcgtcaggaga

SEQ ID NO: 34268 - DNA, 25 bp, E. coli
ttttttttgccctggcgtcaggaga

SEQ ID NO: 34269 - DNA, 25 bp, E. coli
ttttcttcccgttgatcacccattc

SEQ ID NO: 34270 - DNA, 25 bp, E. coli
ttttcttcccgtagatcacccattc

SEQ ID NO: 34271 - DNA, 25 bp, E. coli
tgccgtttttctacccgttgatcac

SEQ ID NO: 34272 - DNA, 25 bp, E. coli
tgccgtttttcttcccgttgatcac

SEQ ID NO: 34273 - DNA, 25 bp, E. coli
tctgaaaaaagaggctggcctgccg

SEQ ID NO: 34274 - DNA, 25 bp, E. coli
tctgaaaaaagacgctggcctgccg

SEQ ID NO: 34275 - DNA, 25 bp, E. coli
gacattttgtcttaccgcgtctgaa

SEQ ID NO: 34276 - DNA, 25 bp, E. coli
gaaaaaagacgcaggcctgccgttt

SEQ ID NO: 34277 - DNA, 25 bp, E. coli
gacattttgtctaaccgcgtctgaa

SEQ ID NO: 34278 - DNA, 25 bp, E. coli
gaaaaaagacgctggcctgccgttt

SEQ ID NO: 34279 - DNA, 25 bp, E. coli
cgtctgaaaaaagacgctggcctgc

SEQ ID NO: 34280 - DNA, 25 bp, E. coli
cgtctgaaaaaacacgctggcctgc

SEQ ID NO: 34281 - DNA, 25 bp, E. coli
gtttttcttcccgttgatcacccat

SEQ ID NO: 34282 - DNA, 25 bp, E. coli
gtttttcttccccttgatcacccat

SEQ ID NO: 34283 - DNA, 25 bp, E. coli
catgcgccgggattcaaagatgctt

SEQ ID NO: 34284 - DNA, 25 bp, E. coli
catgaaacttgcctgacgcgtgaaa

SEQ ID NO: 34285 - DNA, 25 bp, E. coli
catgcgccgggaatcaaagatgctt

SEQ ID NO: 34286 - DNA, 25 bp, E. coli
catgaaacttgcgtgacgcgtgaaa

SEQ ID NO: 34287 - DNA, 25 bp, E. coli
tacagtgactataaagcctcgggca

SEQ ID NO: 34288 - DNA, 25 bp, E. coli
tacagtgactattaagcctcgggca

SEQ ID NO: 34289 - DNA, 25 bp, E. coli
taccctcggaacaggttggaacacg

SEQ ID NO: 34290 - DNA, 25 bp, E. coli
taccctcggaactggttggaacacg

SEQ ID NO: 34291 - DNA, 25 bp, E. coli
tcctggtgagtgcaaaagcaacacg

SEQ ID NO: 34292 - DNA, 25 bp, E. coli
tcctggtgagtggaaaagcaacacg

SEQ ID NO: 34293 - DNA, 25 bp, E. coli
tcagaaagaggttccaccaggtccg

SEQ ID NO: 34294 - DNA, 25 bp, E. coli
tcagaaagaggtaccaccaggtccg

SEQ ID NO: 34295 - DNA, 25 bp, E. coli
gaaccgttgggatccgcgatcagtt

SEQ ID NO: 34296 - DNA, 25 bp, E. coli
gcaacttgttcagggcggaagctac

SEQ ID NO: 34297 - DNA, 25 bp, E. coli
gaaccgttgggaaccgcgatcagtt

SEQ ID NO: 34298 - DNA, 25 bp, E. coli
gcaacttgttcacggcggaagctac

SEQ ID NO: 34299 - DNA, 25 bp, E. coli
gaaccacgccgatgagaaacgcttt

SEQ ID NO: 34300 - DNA, 25 bp, E. coli
gaaccacgccgaagagaaacgcttt

SEQ ID NO: 34301 - DNA, 25 bp, E. coli
cgctgttccgcatgcctgggttgaa

SEQ ID NO: 34302 - DNA, 25 bp, E. coli
cgctgttccgcaagcctgggttgaa

SEQ ID NO: 34303 - DNA, 25 bp, E. coli
taactggcggcgcataagctatacc

SEQ ID NO: 34304 - DNA, 25 bp, E. coli
taactggcggcggataagctatacc

SEQ ID NO: 34305 - DNA, 25 bp, E. coli
taaagtttcggctacgccagaggca

SEQ ID NO: 34306 - DNA, 25 bp, E. coli
taaagtttcggcaacgccagaggca

SEQ ID NO: 34307 - DNA, 25 bp, E. coli
tatctggtatcatcgccaggccggg

SEQ ID NO: 34308 - DNA, 25 bp, E. coli
tatctggtatcaacgccaggccggg

SEQ ID NO: 34309 - DNA, 25 bp, E. coli
tatcgataaactggagaacgcgccg

SEQ ID NO: 34310 - DNA, 25 bp, E. coli
tatcgataaactcgagaacgcgccg

SEQ ID NO: 34311 - DNA, 25 bp, E. coli
ttaaagaactgatgcgcactcccga

SEQ ID NO: 34312 - DNA, 25 bp, E. coli
ttaaagaactgaagcgcactcccga

SEQ ID NO: 34313 - DNA, 25 bp, E. coli
tttttaagcaaagtcaccctgcggg

SEQ ID NO: 34314 - DNA, 25 bp, E. coli
ttgtcttatcttgagggcgcgccag

SEQ ID NO: 34315 - DNA, 25 bp, E. coli
tttttaagcaaactcaccctgcggg

SEQ ID NO: 34316 - DNA, 25 bp, E. coli
ttgtcttatcttcagggcgcgccag

SEQ ID NO: 34317 - DNA, 25 bp, E. coli
tggattattaactcccgcagcgaac

SEQ ID NO: 34318 - DNA, 25 bp, E. coli
tgatcccggataagctcaaagagcg

SEQ ID NO: 34319 - DNA, 25 bp, E. coli
tgaaatgcaggataacgcgccagct

SEQ ID NO: 34320 - DNA, 25 bp, E. coli
tgaaatgcaggaaaacgcgccagct

SEQ ID NO: 34321 - DNA, 25 bp, E. coli
tgaagtatgtctcccgcgatcaggc

SEQ ID NO: 34322 - DNA, 25 bp, E. coli
tgatcccggatatgctcaaagagcg

SEQ ID NO: 34323 - DNA, 25 bp, E. coli
tgaagtatgtctgccgcgatcaggc

SEQ ID NO: 34324 - DNA, 25 bp, E. coli
gaaacgctgctgaaaggaccatacc

SEQ ID NO: 34325 - DNA, 25 bp, E. coli
gaaacgctgctgtaaggaccatacc

SEQ ID NO: 34326 - DNA, 25 bp, E. coli
tggattattaacacccgcagcgaac

SEQ ID NO: 34327 - DNA, 25 bp, E. coli
caaggtggcgtcaggttacaactga

SEQ ID NO: 34328 - DNA, 25 bp, E. coli
caaggtggcgtctggttacaactga

SEQ ID NO: 34329 - DNA, 25 bp, E. coli
ttgtcatgccgtgaagcgtgagtcc

SEQ ID NO: 34330 - DNA, 25 bp, E. coli
ttttgtggatctacccgctgctggg

SEQ ID NO: 34331 - DNA, 25 bp, E. coli
ttttgtggatcttcccgctgctggg

SEQ ID NO: 34332 - DNA, 25 bp, E. coli
ttgtcatgccgtcaagcgtgagtcc

SEQ ID NO: 34333 - DNA, 25 bp, E. coli
tctctggagctagtacaaaatgtgg

SEQ ID NO: 34334 - DNA, 25 bp, E. coli
tctctggagctactacaaaatgtgg

SEQ ID NO: 34335 - DNA, 25 bp, E. coli
ccagagtgtatgcagcggcgttttc

SEQ ID NO: 34336 - DNA, 25 bp, E. coli
ccagagtgtatggagcggcgttttc

SEQ ID NO: 34337 - DNA, 25 bp, E. coli
gctacctggtgcctggatgaataat

SEQ ID NO: 34338 - DNA, 25 bp, E. coli
gctacctggtgcgtggatgaataat

SEQ ID NO: 34339 - DNA, 25 bp, E. coli
gaaacattgcgcttcatctggtggc

SEQ ID NO: 34340 - DNA, 25 bp, E. coli
gaaaaatcgccgttgcacgctggcg

SEQ ID NO: 34341 - DNA, 25 bp, E. coli
gaaacattgcgcatcatctggtggc

SEQ ID NO: 34342 - DNA, 25 bp, E. coli
gaaaaatcgccgatgcacgctggcg

SEQ ID NO: 34343 - DNA, 25 bp, E. coli
gattttcacggctggcatcacgctg

SEQ ID NO: 34344 - DNA, 25 bp, E. coli
gattttcacggcaggcatcacgctg

SEQ ID NO: 34345 - DNA, 25 bp, E. coli
taatgaaactggtggcagtgctacc

SEQ ID NO: 34346 - DNA, 25 bp, E. coli
taatgaaactggaggcagtgctacc

SEQ ID NO: 34347 - DNA, 25 bp, E. coli
gatggctttgtagtgctcgcccagg

SEQ ID NO: 34348 - DNA, 25 bp, E. coli
gatggctttgtactgctcgcccagg

SEQ ID NO: 34349 - DNA, 25 bp, E. coli
caatagcagcatggctggtggcaca

SEQ ID NO: 34350 - DNA, 25 bp, E. coli
caatagcagcatcgctggtggcaca

SEQ ID NO: 34351 - DNA, 25 bp, E. coli
caaagttgttggagttgtgacgcca

SEQ ID NO: 34352 - DNA, 25 bp, E. coli
cacataaggatgttatagagcgcca

SEQ ID NO: 34353 - DNA, 25 bp, E. coli
caaatttcaacggtgcatggtgtgg

SEQ ID NO: 34354 - DNA, 25 bp, E. coli
caaagttgttggtgttgtgacgcca

SEQ ID NO: 34355 - DNA, 25 bp, E. coli
cacataaggatgatatagagcgcca

SEQ ID NO: 34356 - DNA, 25 bp, E. coli
caaatttcaacgctgcatggtgtgg

SEQ ID NO: 34357 - DNA, 25 bp, E. coli
taactggttcagagctacacgggaa

SEQ ID NO: 34358 - DNA, 25 bp, E. coli
aaacgggatttctggcatcaatggc

SEQ ID NO: 34359 - DNA, 25 bp, E. coli
aaacgggatttcaggcatcaatggc

SEQ ID NO: 34360 - DNA, 25 bp, E. coli
tatggaccttatggagatgcagccc

SEQ ID NO: 34361 - DNA, 25 bp, E. coli
tatggaccttatcgagatgcagccc

SEQ ID NO: 34362 - DNA, 25 bp, E. coli
tatggtagtctgcatcaacgtcagc

SEQ ID NO: 34363 - DNA, 25 bp, E. coli
tatggtagtctggatcaacgtcagc

SEQ ID NO: 34364 - DNA, 25 bp, E. coli
gaagccaaatggtgggagccgtcat

SEQ ID NO: 34365 - DNA, 25 bp, E. coli
gaagccaaatggagggagccgtcat

SEQ ID NO: 34366 - DNA, 25 bp, E. coli
taagcgtcaggagaaacaacatctg

SEQ ID NO: 34367 - DNA, 25 bp, E. coli
taagcgtcaggacaaacaacatctg

SEQ ID NO: 34368 - DNA, 25 bp, E. coli
tcaatgttgctgtctcacgcgctaa

SEQ ID NO: 34369 - DNA, 25 bp, E. coli
tcaatgttgctgactcacgcgctaa

SEQ ID NO: 34370 - DNA, 25 bp, E. coli
taactggttcagtgctacacgggaa

SEQ ID NO: 34371 - DNA, 25 bp, E. coli
caaaaacggcgacaaatgggagatg

SEQ ID NO: 34372 - DNA, 25 bp, E. coli
caaaaagctgttcgccgaacgccgc

SEQ ID NO: 34373 - DNA, 25 bp, E. coli
caaaaacggcgagaaatgggagatg

SEQ ID NO: 34374 - DNA, 25 bp, E. coli
caaaaagctgttggccgaacgccgc

SEQ ID NO: 34375 - DNA, 25 bp, E. coli
ttacgatctcaacggcaaagcgatt

SEQ ID NO: 34376 - DNA, 25 bp, E. coli
ttacgatctcaagggcaaagcgatt

SEQ ID NO: 34377 - DNA, 25 bp, E. coli
tgaaaaagatcctgacaaccccgat

SEQ ID NO: 34378 - DNA, 25 bp, E. coli
tgaaaaagatccagacaaccccgat

SEQ ID NO: 34379 - DNA, 25 bp, E. coli
tgacaaccccgaacaaagctgaaga

SEQ ID NO: 34380 - DNA, 25 bp, E. coli
tgacaaccccgatcaaagctgaaga

SEQ ID NO: 34381 - DNA, 25 bp, E. coli
cctgatagccgaaaacaaaaagctg

SEQ ID NO: 34382 - DNA, 25 bp, E. coli
cctgatagccgataacaaaaagctg

SEQ ID NO: 34383 - DNA, 25 bp, E. coli
cccatcgtgcgctaaaacggcgaca

SEQ ID NO: 34384 - DNA, 25 bp, E. coli
cccatcgtgcgcaaaaacggcgaca

SEQ ID NO: 34385 - DNA, 25 bp, E. coli
ccgacaaccagtatgcgtatggaaa

SEQ ID NO: 34386 - DNA, 25 bp, E. coli
ccgacaaccagtttgcgtatggaaa

SEQ ID NO: 34387 - DNA, 25 bp, E. coli
gattttccacgcaggccccatcgtg

SEQ ID NO: 34388 - DNA, 25 bp, E. coli
gatacccacggcaacaacctgatag

SEQ ID NO: 34389 - DNA, 25 bp, E. coli
gatacccacggctacaacctgatag

SEQ ID NO: 34390 - DNA, 25 bp, E. coli
gattttccacgctggccccatcgtg

SEQ ID NO: 34391 - DNA, 25 bp, E. coli
tcaaagctgaagatctgcaagatat

SEQ ID NO: 34392 - DNA, 25 bp, E. coli
tcaaagctgaagttctgcaagatat

SEQ ID NO: 34393 - DNA, 25 bp, E. coli
aattgccgcccggaagatgatcccg

SEQ ID NO: 34394 - DNA, 25 bp, E. coli
aattgccgcccgcaagatgatcccg

SEQ ID NO: 34395 - DNA, 25 bp, E. coli
catttagtcgcaggcagtcgtcaac

SEQ ID NO: 34396 - DNA, 25 bp, E. coli
catttagtcgcacgcagtcgtcaac

SEQ ID NO: 34397 - DNA, 25 bp, E. coli
tactcaatggcttactggtgcagcg

SEQ ID NO: 34398 - DNA, 25 bp, E. coli
tactcaatggctaactggtgcagcg

SEQ ID NO: 34399 - DNA, 25 bp, E. coli
tattcaggatgctgaacaaacggct

SEQ ID NO: 34400 - DNA, 25 bp, E. coli
tattagctttactaccaggtgcgga

SEQ ID NO: 34401 - DNA, 25 bp, E. coli
tattagctttacaaccaggtgcgga

SEQ ID NO: 34402 - DNA, 25 bp, E. coli
tattcaggatgcagaacaaacggct

SEQ ID NO: 34403 - DNA, 25 bp, E. coli
tgcactggtacgaaaaagcggcgcg

SEQ ID NO: 34404 - DNA, 25 bp, E. coli
tgcactggtacgtaaaagcggcgcg

SEQ ID NO: 34405 - DNA, 25 bp, E. coli
tgccgccacacaaggacatgaggtt

SEQ ID NO: 34406 - DNA, 25 bp, E. coli
tgccgccacacatggacatgaggtt

SEQ ID NO: 34407 - DNA, 25 bp, E. coli
tctgtgaggagaatgaagcaacccc

SEQ ID NO: 34408 - DNA, 25 bp, E. coli
tctgtgaggagattgaagcaacccc

SEQ ID NO: 34409 - DNA, 25 bp, E. coli
ccctggattgaataagatgcgttgc

SEQ ID NO: 34410 - DNA, 25 bp, E. coli
ccctggattgaaaaagatgcgttgc

SEQ ID NO: 34411 - DNA, 25 bp, E. coli
gatgaaaatcatgcgctgcactggt

SEQ ID NO: 34412 - DNA, 25 bp, E. coli
gagcaaccgatctatatgtccaggg

SEQ ID NO: 34413 - DNA, 25 bp, E. coli
gagcaaccgatcaatatgtccaggg

SEQ ID NO: 34414 - DNA, 25 bp, E. coli
gatgaaaatcatccgctgcactggt

SEQ ID NO: 34415 - DNA, 25 bp, E. coli
caacaggtgcgtgaaaatctgccgc

SEQ ID NO: 34416 - DNA, 25 bp, E. coli
caacaggtgcgtcaaaatctgccgc

SEQ ID NO: 34417 - DNA, 25 bp, E. coli
aggagtatgaaaacccgctggcgca

SEQ ID NO: 34418 - DNA, 25 bp, E. coli
aggagtatgaaatcccgctggcgca

SEQ ID NO: 34419 - DNA, 25 bp, E. coli
tacctggtgcgacctgcctgaagat

SEQ ID NO: 34420 - DNA, 25 bp, E. coli
tacctggtgcgagctgcctgaagat

SEQ ID NO: 34421 - DNA, 25 bp, E. coli
tgcctaccatgccaagccaaaagtg

SEQ ID NO: 34422 - DNA, 25 bp, E. coli
tgcctaccatgcgaagccaaaagtg

SEQ ID NO: 34423 - DNA, 25 bp, E. coli
tcaggtgattcgactggcaggttca

SEQ ID NO: 34424 - DNA, 25 bp, E. coli
tcaggtgattcgtctggcaggttca

SEQ ID NO: 34425 - DNA, 25 bp, E. coli
gaagtgatgccactggattaccacg

SEQ ID NO: 34426 - DNA, 25 bp, E. coli
gaagtgatgccagtggattaccacg

SEQ ID NO: 34427 - DNA, 25 bp, E. coli
ccgcctggtgcgaggaagattatca

SEQ ID NO: 34428 - DNA, 25 bp, E. coli
ccgcctggtgcgtggaagattatca

SEQ ID NO: 34429 - DNA, 25 bp, E. coli
gattaccacgcaggtcgtagcggct

SEQ ID NO: 34430 - DNA, 25 bp, E. coli
gattaccacgcacgtcgtagcggct

SEQ ID NO: 34431 - DNA, 25 bp, E. coli
tggagccaatgacctgccgatgatc

SEQ ID NO: 34432 - DNA, 25 bp, E. coli
tggagccaatgagctgccgatgatc

SEQ ID NO: 34433 - DNA, 25 bp, E. coli
gatgaaattgccaaactggccggaa

SEQ ID NO: 34434 - DNA, 25 bp, E. coli
gatgcgcggcgaactcgattttacc

SEQ ID NO: 34435 - DNA, 25 bp, E. coli
gatgaaattgcctaactggccggaa

SEQ ID NO: 34436 - DNA, 25 bp, E. coli
gatgcgcggcgatctcgattttacc

SEQ ID NO: 34437 - DNA, 25 bp, E. coli
ccttatttaaagaggccactgccta

SEQ ID NO: 34438 - DNA, 25 bp, E. coli
ccttatttaaagtggccactgccta

SEQ ID NO: 34439 - DNA, 25 bp, E. coli
cacgccccaaaaataactgagttca

SEQ ID NO: 34440 - DNA, 25 bp, E. coli
cacgccccaaaattaactgagttca

SEQ ID NO: 34441 - DNA, 25 bp, E. coli
taccatctggtaaaagaattcgctt

SEQ ID NO: 34442 - DNA, 25 bp, E. coli
taccatctggtataagaattcgctt

SEQ ID NO: 34443 - DNA, 25 bp, E. coli
tgtcacacacgcgttatttaaagag

SEQ ID NO: 34444 - DNA, 25 bp, E. coli
tgtcacacacgccttatttaaagag

SEQ ID NO: 34445 - DNA, 25 bp, E. coli
gacaggtttacgatactatcaggca

SEQ ID NO: 34446 - DNA, 25 bp, E. coli
gaaaggatataaacatcagacaggt

SEQ ID NO: 34447 - DNA, 25 bp, E. coli
gaaaggatataatcatcagacaggt

SEQ ID NO: 34448 - DNA, 25 bp, E. coli
gacaggtttacgttactatcaggca

SEQ ID NO: 34449 - DNA, 25 bp, E. coli
ctgagttcacctaaacagaaaggat

SEQ ID NO: 34450 - DNA, 25 bp, E. coli
ctgagttcaccttaacagaaaggat

SEQ ID NO: 34451 - DNA, 25 bp, E. coli
gggtggaaatagtaataccatctgg

SEQ ID NO: 34452 - DNA, 25 bp, E. coli
gggtggaaatagaaataccatctgg

SEQ ID NO: 34453 - DNA, 25 bp, E. coli
ggccactgcctattgaaaaagatat

SEQ ID NO: 34454 - DNA, 25 bp, E. coli
ggccactgcctaatgaaaaagatat

SEQ ID NO: 34455 - DNA, 25 bp, E. coli
ggcatatcacctcagaatcagatga

SEQ ID NO: 34456 - DNA, 25 bp, E. coli
ggcatatcacctgagaatcagatga

SEQ ID NO: 34457 - DNA, 25 bp, E. coli
gatggatattcatgtcacgccccaa

SEQ ID NO: 34458 - DNA, 25 bp, E. coli
gatggatattcaagtcacgccccaa

SEQ ID NO: 34459 - DNA, 25 bp, E. coli
ccaacaactcggatggtagtccctt

SEQ ID NO: 34460 - DNA, 25 bp, E. coli
ccaacaactcggttggtagtccctt

SEQ ID NO: 34461 - DNA, 25 bp, E. coli
tgtgagttcaccctaaaggaacgta

SEQ ID NO: 34462 - DNA, 25 bp, E. coli
tgtgtgagttcagcgtaaaggaacg

SEQ ID NO: 34463 - DNA, 25 bp, E. coli
tccgagccccaagaactcggatggt

SEQ ID NO: 34464 - DNA, 25 bp, E. coli
tccgagccccaacaactcggatggt

SEQ ID NO: 34465 - DNA, 25 bp, E. coli
gctgtgtgagttgaccgtaaaggaa

SEQ ID NO: 34466 - DNA, 25 bp, E. coli
gctgtgtgagttcaccgtaaaggaa

SEQ ID NO: 34467 - DNA, 25 bp, E. coli
cgctgtgtgagttcaccgtaaagga

SEQ ID NO: 34468 - DNA, 25 bp, E. coli
gccccaacaactcggatggtagtcc

SEQ ID NO: 34469 - DNA, 25 bp, E. coli
gccccaacaactgggatggtagtcc

SEQ ID NO: 34470 - DNA, 25 bp, E. coli
cgctgtgtgagtacaccgtaaagga

SEQ ID NO: 34471 - DNA, 25 bp, E. coli
cgagccccaacaactcggatggtag

SEQ ID NO: 34472 - DNA, 25 bp, E. coli
cgagccccaacatctcggatggtag

SEQ ID NO: 34473 - DNA, 25 bp, E. coli
ctcgctgtgtgagttcaccgtaaag

SEQ ID NO: 34474 - DNA, 25 bp, E. coli
ctcgctgtgtgacttcaccgtaaag

SEQ ID NO: 34475 - DNA, 25 bp, E. coli
tgagttcaccgttaaggaacgtaat

SEQ ID NO: 34476 - DNA, 25 bp, E. coli
tgtgtgagttcaccgtaaaggaacg

SEQ ID NO: 34477 - DNA, 25 bp, E. coli
tgtgagttcaccgtaaaggaacgta

SEQ ID NO: 34478 - DNA, 25 bp, E. coli
tgagttcaccgtaaaggaacgtaat

SEQ ID NO: 34479 - DNA, 25 bp, E. coli
gagccccaacaactcggatggtagt

SEQ ID NO: 34480 - DNA, 25 bp, E. coli
gagccccaacaagtcggatggtagt

SEQ ID NO: 34481 - DNA, 25 bp, E. coli
cagcggtttatcacgatggttatga

SEQ ID NO: 34482 - DNA, 25 bp, E. coli
cagcggtttatctcgatggttatga

SEQ ID NO: 34483 - DNA, 25 bp, E. coli
taaagcgacaggaaaatcatggagt

SEQ ID NO: 34484 - DNA, 25 bp, E. coli
taaagcgacaggtaaatcatggagt

SEQ ID NO: 34485 - DNA, 25 bp, E. coli
aaaaaatccaggctgctggctgaca

SEQ ID NO: 34486 - DNA, 25 bp, E. coli
aaaaaatccagggtgctggctgaca

SEQ ID NO: 34487 - DNA, 25 bp, E. coli
tgatgtgcaacaacgccttcagcag

SEQ ID NO: 34488 - DNA, 25 bp, E. coli
tgatgtgcaacatcgccttcagcag

SEQ ID NO: 34489 - DNA, 25 bp, E. coli
tgctggctgacagcatttcagcggt

SEQ ID NO: 34490 - DNA, 25 bp, E. coli
tgctggctgacaccatttcagcggt

SEQ ID NO: 34491 - DNA, 25 bp, E. coli
tcatggagtgatgtgcaacaacgcc

SEQ ID NO: 34492 - DNA, 25 bp, E. coli
tcatggagtgatctgcaacaacgcc

SEQ ID NO: 34493 - DNA, 25 bp, E. coli
gccaggaatttttaaactcactccg

SEQ ID NO: 34494 - DNA, 25 bp, E. coli
ccttcagcagtttcacagccaggaa

SEQ ID NO: 34495 - DNA, 25 bp, E. coli
ccttcagcagttacacagccaggaa

SEQ ID NO: 34496 - DNA, 25 bp, E. coli
gccaggaattttaaaactcactccg

SEQ ID NO: 34497 - DNA, 25 bp, E. coli
gcacaactcaatatgcgggtaccga

SEQ ID NO: 34498 - DNA, 25 bp, E. coli
gcacaactcaatttgcgggtaccga

SEQ ID NO: 34499 - DNA, 25 bp, E. coli
cgggtaccgattaccgcagcaaaga

SEQ ID NO: 34500 - DNA, 25 bp, E. coli
cgggtaccgatttccgcagcaaaga

SEQ ID NO: 34501 - DNA, 25 bp, E. coli
gattaccgcagcaaagaccttaccc

SEQ ID NO: 34502 - DNA, 25 bp, E. coli
gattaccgcagctaagaccttaccc

SEQ ID NO: 34503 - DNA, 25 bp, E. coli
tactacggcatcactgctggtccgg

SEQ ID NO: 34504 - DNA, 25 bp, E. coli
tactacggcatctctgctggtccgg

SEQ ID NO: 34505 - DNA, 25 bp, E. coli
tattcgtagcgtagacgtaggcacc

SEQ ID NO: 34506 - DNA, 25 bp, E. coli
tattcgtagcgttgacgtaggcacc

SEQ ID NO: 34507 - DNA, 25 bp, E. coli
tcagggccaaatgaacaaaatgggc

SEQ ID NO: 34508 - DNA, 25 bp, E. coli
tcagggccaaatcaacaaaatgggc

SEQ ID NO: 34509 - DNA, 25 bp, E. coli
gcagttctggctatcaccgcaggta

SEQ ID NO: 34510 - DNA, 25 bp, E. coli
gcatgtctttcaccactggccgcag

SEQ ID NO: 34511 - DNA, 25 bp, E. coli
gcatgtctttcagcactggccgcag

SEQ ID NO: 34512 - DNA, 25 bp, E. coli
gcagttctggctttcaccgcaggta

SEQ ID NO: 34513 - DNA, 25 bp, E. coli
gactgggcaagcttctacggtgtag

SEQ ID NO: 34514 - DNA, 25 bp, E. coli
gactgggcaagcatctacggtgtag

SEQ ID NO: 34515 - DNA, 25 bp, E. coli
gaaaagccgtactgcaagctctggt

SEQ ID NO: 34516 - DNA, 25 bp, E. coli
gaaaagccgtacagcaagctctggt

SEQ ID NO: 34517 - DNA, 25 bp, E. coli
cccgatggaaaacgttgctctggac

SEQ ID NO: 34518 - DNA, 25 bp, E. coli
cccgatggaaaaggttgctctggac

SEQ ID NO: 34519 - DNA, 25 bp, E. coli
ctatgaagaagagaacagcccgctg

SEQ ID NO: 34520 - DNA, 25 bp, E. coli
ctatgaagaagacaacagcccgctg

SEQ ID NO: 34521 - DNA, 25 bp, E. coli
ggtacttccgtacctgcgacttcta

SEQ ID NO: 34522 - DNA, 25 bp, E. coli
ggtacttccgtagctgcgacttcta

SEQ ID NO: 34523 - DNA, 25 bp, E. coli
ggcttaccgcataaacgactgggca

SEQ ID NO: 34524 - DNA, 25 bp, E. coli
ggcttaccgcattaacgactgggca

SEQ ID NO: 34525 - DNA, 25 bp, E. coli
cacagcaaggtaaatggaaaaagtt

SEQ ID NO: 34526 - DNA, 25 bp, E. coli
cacagcaaggtatatggaaaaagtt

SEQ ID NO: 34527 - DNA, 25 bp, E. coli
catgtgcattgattactggcggtaa

SEQ ID NO: 34528 - DNA, 25 bp, E. coli
catgtgcattgaatactggcggtaa

SEQ ID NO: 34529 - DNA, 25 bp, E. coli
acgcattgcagtttttgtttgttgc

SEQ ID NO: 34530 - DNA, 25 bp, E. coli
acgcattgcagtatttgtttgttgc

SEQ ID NO: 34531 - DNA, 25 bp, E. coli
tatgcccatcatgttcacagcaagg

SEQ ID NO: 34532 - DNA, 25 bp, E. coli
tatgcccatcatcttcacagcaagg

SEQ ID NO: 34533 - DNA, 25 bp, E. coli
tgttcatggcggacatgtgcattga

SEQ ID NO: 34534 - DNA, 25 bp, E. coli
tgtaggaggaataatgaaaaacgca

SEQ ID NO: 34535 - DNA, 25 bp, E. coli
tgttgcgttctgcttgttcgtatca

SEQ ID NO: 34536 - DNA, 25 bp, E. coli
tgtaggaggaattatgaaaaacgca

SEQ ID NO: 34537 - DNA, 25 bp, E. coli
tgttgcgttctggttgttcgtatca

SEQ ID NO: 34538 - DNA, 25 bp, E. coli
tgttcatggcggtcatgtgcattga

SEQ ID NO: 34539 - DNA, 25 bp, E. coli
gttgttcgtatcttgtatgcccatc

SEQ ID NO: 34540 - DNA, 25 bp, E. coli
gttgttcgtatcatgtatgcccatc

SEQ ID NO: 34541 - DNA, 25 bp, E. coli
ggaataatgaaaaacgcattgcagt

SEQ ID NO: 34542 - DNA, 25 bp, E. coli
ggaataatgaaatacgcattgcagt

SEQ ID NO: 34543 - DNA, 25 bp, E. coli
taatatttggatatataaatgccct

SEQ ID NO: 34544 - DNA, 25 bp, E. coli
taatatttggatttataaatgccct

SEQ ID NO: 34545 - DNA, 25 bp, E. coli
taattgcacattgattgtaggagga

SEQ ID NO: 34546 - DNA, 25 bp, E. coli
taattgcacattcattgtaggagga

SEQ ID NO: 34547 - DNA, 25 bp, E. coli
taacgattccatcttcaacacgccg

SEQ ID NO: 34548 - DNA, 25 bp, E. coli
aagagtctttcgctgcgggcttaca

SEQ ID NO: 34549 - DNA, 25 bp, E. coli
aagagtctttcggtgcgggcttaca

SEQ ID NO: 34550 - DNA, 25 bp, E. coli
tatcgatgaaacaccagacttcggt

SEQ ID NO: 34551 - DNA, 25 bp, E. coli
tatcgatgaaactccagacttcggt

SEQ ID NO: 34552 - DNA, 25 bp, E. coli
tgtttgatgcgaaagtgaccgttga

SEQ ID NO: 34553 - DNA, 25 bp, E. coli
tgtttgatgcgatagtgaccgttga

SEQ ID NO: 34554 - DNA, 25 bp, E. coli
tggtacttatctcgcctggtcttca

SEQ ID NO: 34555 - DNA, 25 bp, E. coli
ccgttgatggtcttcgcgcagttaa

SEQ ID NO: 34556 - DNA, 25 bp, E. coli
ccgttgatggtcatcgcgcagttaa

SEQ ID NO: 34557 - DNA, 25 bp, E. coli
gcttacatgcgcagaaaggtcaccg

SEQ ID NO: 34558 - DNA, 25 bp, E. coli
gcttacatgcgctgaaaggtcaccg

SEQ ID NO: 34559 - DNA, 25 bp, E. coli
gaacgaaaccattgacggtatcgct

SEQ ID NO: 34560 - DNA, 25 bp, E. coli
gaacgaaaccatagacggtatcgct

SEQ ID NO: 34561 - DNA, 25 bp, E. coli
cggtgtggctgcaatggataagatc

SEQ ID NO: 34562 - DNA, 25 bp, E. coli
cggtgtggctgctatggataagatc

SEQ ID NO: 34563 - DNA, 25 bp, E. coli
gatagcgcgcttgataaattgttcc

SEQ ID NO: 34564 - DNA, 25 bp, E. coli
gatagcgcgcttcataaattgttcc

SEQ ID NO: 34565 - DNA, 25 bp, E. coli
ggttactgggcagcaagtgctatca

SEQ ID NO: 34566 - DNA, 25 bp, E. coli
ggttactgggcaccaagtgctatca

SEQ ID NO: 34567 - DNA, 25 bp, E. coli
tggtacttatctggcctggtcttca

SEQ ID NO: 34568 - DNA, 25 bp, E. coli
taacgattccatgttcaacacgccg

SEQ ID NO: 34569 - DNA, 25 bp, E. coli
cttggtgccctcaaaatgccgtgta

SEQ ID NO: 34570 - DNA, 25 bp, E. coli
tatgtactgcatcatccggccagag

SEQ ID NO: 34571 - DNA, 25 bp, E. coli
tatgtactgcatgatccggccagag

SEQ ID NO: 34572 - DNA, 25 bp, E. coli
tattgccacggtaaaaatccagggt

SEQ ID NO: 34573 - DNA, 25 bp, E. coli
tattgccacggttaaaatccagggt

SEQ ID NO: 34574 - DNA, 25 bp, E. coli
tgtgttatgcaggacgaccggctat

SEQ ID NO: 34575 - DNA, 25 bp, E. coli
tgtgttatgcagcacgaccggctat

SEQ ID NO: 34576 - DNA, 25 bp, E. coli
tctttatattgcacagggccgcggt

SEQ ID NO: 34577 - DNA, 25 bp, E. coli
taagtttaatctctcggcccgtgga

SEQ ID NO: 34578 - DNA, 25 bp, E. coli
tcatcaatatacagtggcagtcggg

SEQ ID NO: 34579 - DNA, 25 bp, E. coli
tcatcaatatactgtggcagtcggg

SEQ ID NO: 34580 - DNA, 25 bp, E. coli
tctttatattgctcagggccgcggt

SEQ ID NO: 34581 - DNA, 25 bp, E. coli
taagtttaatctgtcggcccgtgga

SEQ ID NO: 34582 - DNA, 25 bp, E. coli
gaaatcgttgctgacatgagcccgg

SEQ ID NO: 34583 - DNA, 25 bp, E. coli
gaaatcgttgctcacatgagcccgg

SEQ ID NO: 34584 - DNA, 25 bp, E. coli
cttggtgccctctaaatgccgtgta

SEQ ID NO: 34585 - DNA, 25 bp, E. coli
gttattcatcagtcggagaccgctg

SEQ ID NO: 34586 - DNA, 25 bp, E. coli
gttattcatcagacggagaccgctg

SEQ ID NO: 34587 - DNA, 25 bp, E. coli
taatgccggtgggaactcagctggt

SEQ ID NO: 34588 - DNA, 25 bp, E. coli
taagctaccggtttgacagccagtc

SEQ ID NO: 34589 - DNA, 25 bp, E. coli
taagctaccggtatgacagccagtc

SEQ ID NO: 34590 - DNA, 25 bp, E. coli
taatgccggtggcaactcagctggt

SEQ ID NO: 34591 - DNA, 25 bp, E. coli
aattctgtcatgcaagtccctcggg

SEQ ID NO: 34592 - DNA, 25 bp, E. coli
aattctgtcatggaagtccctcggg

SEQ ID NO: 34593 - DNA, 25 bp, E. coli
tacagcatgggtctccgtgagcaga

SEQ ID NO: 34594 - DNA, 25 bp, E. coli
taaagtaactctgcgtggcgaacgc

SEQ ID NO: 34595 - DNA, 25 bp, E. coli
taaagtaactctccgtggcgaacgc

SEQ ID NO: 34596 - DNA, 25 bp, E. coli
tacagcatgggtgtccgtgagcaga

SEQ ID NO: 34597 - DNA, 25 bp, E. coli
tacctcgtatccctgacttccgtgg

SEQ ID NO: 34598 - DNA, 25 bp, E. coli
tatccgatcggctgtaaagtaactc

SEQ ID NO: 34599 - DNA, 25 bp, E. coli
tacctcgtatccgtgacttccgtgg

SEQ ID NO: 34600 - DNA, 25 bp, E. coli
tatccgatcggcagtaaagtaactc

SEQ ID NO: 34601 - DNA, 25 bp, E. coli
ttcgacggtcgtggtaactacagca

SEQ ID NO: 34602 - DNA, 25 bp, E. coli
ttcgacggtcgtcgtaactacagca

SEQ ID NO: 34603 - DNA, 25 bp, E. coli
tgcaggcttcaaaatccgtcagggc

SEQ ID NO: 34604 - DNA, 25 bp, E. coli
tgcaggcttcaatatccgtcagggc

SEQ ID NO: 34605 - DNA, 25 bp, E. coli
tcgagaagatcagcctgaacatggg

SEQ ID NO: 34606 - DNA, 25 bp, E. coli
tcgagaagatcaccctgaacatggg

SEQ ID NO: 34607 - DNA, 25 bp, E. coli
gcgatcgctgactaaaaactgctgg

SEQ ID NO: 34608 - DNA, 25 bp, E. coli
gcgatcgctgacaaaaaactgctgg

SEQ ID NO: 34609 - DNA, 25 bp, E. coli
cgataaagtcgagcgcgttcgtggt

SEQ ID NO: 34610 - DNA, 25 bp, E. coli
cgataaagtcgaccgcgttcgtggt

SEQ ID NO: 34611 - DNA, 25 bp, E. coli
ctggataacgcagcagcagacctgg

SEQ ID NO: 34612 - DNA, 25 bp, E. coli
ctggataacgcaccagcagacctgg

SEQ ID NO: 34613 - DNA, 25 bp, E. coli
aagtctgacgattggcgcaggtagt

SEQ ID NO: 34614 - DNA, 25 bp, E. coli
aagtctgacgataggcgcaggtagt

SEQ ID NO: 34615 - DNA, 25 bp, E. coli
caaagtctgacgattggcgcaggta

SEQ ID NO: 34616 - DNA, 25 bp, E. coli
caaagtctgacgtttggcgcaggta

SEQ ID NO: 34617 - DNA, 25 bp, E. coli
caggtagtagcgcacagcggttggc

SEQ ID NO: 34618 - DNA, 25 bp, E. coli
caggtagtagcggacagcggttggc

SEQ ID NO: 34619 - DNA, 25 bp, E. coli
agtctgacgattggcgcaggtagta

SEQ ID NO: 34620 - DNA, 25 bp, E. coli
agtctgacgattcgcgcaggtagta

SEQ ID NO: 34621 - DNA, 25 bp, E. coli
aggtagtagcgcacagcggttggca

SEQ ID NO: 34622 - DNA, 25 bp, E. coli
aggtagtagcgctcagcggttggca

SEQ ID NO: 34623 - DNA, 25 bp, E. coli
aaagtctgacgattggcgcaggtag

SEQ ID NO: 34624 - DNA, 25 bp, E. coli
aaagtctgacgaatggcgcaggtag

SEQ ID NO: 34625 - DNA, 25 bp, E. coli
ccaaagtctgaccattggcgcaggt

SEQ ID NO: 34626 - DNA, 25 bp, E. coli
ccaaagtctgacgattggcgcaggt

SEQ ID NO: 34627 - DNA, 25 bp, E. coli
gcgcaggtagtagcgcacagcggtt

SEQ ID NO: 34628 - DNA, 25 bp, E. coli
gcgcaggtagtaccgcacagcggtt

SEQ ID NO: 34629 - DNA, 25 bp, E. coli
gtagtagcgcacagcggttggcaaa

SEQ ID NO: 34630 - DNA, 25 bp, E. coli
gtagtagcgcactgcggttggcaaa

SEQ ID NO: 34631 - DNA, 25 bp, E. coli
ggcgcaggtagttgcgcacagcggt

SEQ ID NO: 34632 - DNA, 25 bp, E. coli
tggcgcaggtagaagcgcacagcgg

SEQ ID NO: 34633 - DNA, 25 bp, E. coli
tggcgcaggtagtagcgcacagcgg

SEQ ID NO: 34634 - DNA, 25 bp, E. coli
ggcgcaggtagtagcgcacagcggt

SEQ ID NO: 34635 - DNA, 25 bp, E. coli
caagtttccctgtgatgcaacaagc

SEQ ID NO: 34636 - DNA, 25 bp, E. coli
caattctggtcgtaagtggacaacc

SEQ ID NO: 34637 - DNA, 25 bp, E. coli
caattctggtcgaaagtggacaacc

SEQ ID NO: 34638 - DNA, 25 bp, E. coli
aatgatgaaccagatcgaagcggac

SEQ ID NO: 34639 - DNA, 25 bp, E. coli
caagtttccctgagatgcaacaagc

SEQ ID NO: 34640 - DNA, 25 bp, E. coli
caaaagcgttcatcgaagtgggtca

SEQ ID NO: 34641 - DNA, 25 bp, E. coli
caaaagcgttcaacgaagtgggtca

SEQ ID NO: 34642 - DNA, 25 bp, E. coli
aatgatgaaccacatcgaagcggac

SEQ ID NO: 34643 - DNA, 25 bp, E. coli
cagcagcagcggaaatcagtggtca

SEQ ID NO: 34644 - DNA, 25 bp, E. coli
cagcagcagcggtaatcagtggtca

SEQ ID NO: 34645 - DNA, 25 bp, E. coli
tccggtaccgtgtaagcaattctgg

SEQ ID NO: 34646 - DNA, 25 bp, E. coli
tccggtaccgtgaaagcaattctgg

SEQ ID NO: 34647 - DNA, 25 bp, E. coli
tcagaaagtcaacgtgggcgatacc

SEQ ID NO: 34648 - DNA, 25 bp, E. coli
tcagaaagtcaaggtgggcgatacc

SEQ ID NO: 34649 - DNA, 25 bp, E. coli
gaagaatcaggcttctccgaactgg

SEQ ID NO: 34650 - DNA, 25 bp, E. coli
gaagaatcaggcatctccgaactgg

SEQ ID NO: 34651 - DNA, 25 bp, E. coli
gacaaccggtagtatttgacgagcc

SEQ ID NO: 34652 - DNA, 25 bp, E. coli
gacaaccggtagaatttgacgagcc

SEQ ID NO: 34653 - DNA, 25 bp, E. coli
gataccctgtgcttcgttgaagcca

SEQ ID NO: 34654 - DNA, 25 bp, E. coli
gataccctgtgcatcgttgaagcca

SEQ ID NO: 34655 - DNA, 25 bp, E. coli
gagtcagtacgctttagccgtgcag

SEQ ID NO: 34656 - DNA, 25 bp, E. coli
gagtcagtacgcattagccgtgcag

SEQ ID NO: 34657 - DNA, 25 bp, E. coli
cacaaatatgtgaaagtgacagtaa

SEQ ID NO: 34658 - DNA, 25 bp, E. coli
cacaaatatgtgtaagtgacagtaa

SEQ ID NO: 34659 - DNA, 25 bp, E. coli
caggcagtacaatcccgcagctttg

SEQ ID NO: 34660 - DNA, 25 bp, E. coli
caggcagtacaaacccgcagctttg

SEQ ID NO: 34661 - DNA, 25 bp, E. coli
taaaaagaaaccttgagaatacggt

SEQ ID NO: 34662 - DNA, 25 bp, E. coli
taaaaagaaaccatgagaatacggt

SEQ ID NO: 34663 - DNA, 25 bp, E. coli
tagttacaataactgactagatcct

SEQ ID NO: 34664 - DNA, 25 bp, E. coli
tagttacaataagtgactagatcct

SEQ ID NO: 34665 - DNA, 25 bp, E. coli
ttgaatcctctgagccaggcagtac

SEQ ID NO: 34666 - DNA, 25 bp, E. coli
ttgaatcctctgtgccaggcagtac

SEQ ID NO: 34667 - DNA, 25 bp, E. coli
tgtgtgtatcgaaaaagtgtgttta

SEQ ID NO: 34668 - DNA, 25 bp, E. coli
tgtgtgtatcgataaagtgtgttta

SEQ ID NO: 34669 - DNA, 25 bp, E. coli
tcgctcattgaatcctctgtgccag

SEQ ID NO: 34670 - DNA, 25 bp, E. coli
tcgctcattgaaacctctgtgccag

SEQ ID NO: 34671 - DNA, 25 bp, E. coli
tcttttgcgatgttaactgtactta

SEQ ID NO: 34672 - DNA, 25 bp, E. coli
tcttttgcgatgataactgtactta

SEQ ID NO: 34673 - DNA, 25 bp, E. coli
ccgcagctttgggaattttgattaa

SEQ ID NO: 34674 - DNA, 25 bp, E. coli
ccgcagctttggcaattttgattaa

SEQ ID NO: 34675 - DNA, 25 bp, E. coli
gtgacagtaatcacttttgcgatga

SEQ ID NO: 34676 - DNA, 25 bp, E. coli
gtgacagtaatctcttttgcgatga

SEQ ID NO: 34677 - DNA, 25 bp, E. coli
gagaatacggtatctcacaaatatg

SEQ ID NO: 34678 - DNA, 25 bp, E. coli
gagaatacggtaactcacaaatatg

SEQ ID NO: 34679 - DNA, 25 bp, E. coli
tactcgctaaaaattattcagcggg

SEQ ID NO: 34680 - DNA, 25 bp, E. coli
tactcgctaaaatttattcagcggg

SEQ ID NO: 34681 - DNA, 25 bp, E. coli
ttttgtcgataacctcacacaggcg

SEQ ID NO: 34682 - DNA, 25 bp, E. coli
ttgtcgataagcacacacaggcgca

SEQ ID NO: 34683 - DNA, 25 bp, E. coli
ttgtcgataagctcacacaggcgca

SEQ ID NO: 34684 - DNA, 25 bp, E. coli
ttttgtcgataagctcacacaggcg

SEQ ID NO: 34685 - DNA, 25 bp, E. coli
gcgtttacaggtttactcgctaaaa

SEQ ID NO: 34686 - DNA, 25 bp, E. coli
gcgtttacaggtatactcgctaaaa

SEQ ID NO: 34687 - DNA, 25 bp, E. coli
gctaaaaattatacagcgggtttgg

SEQ ID NO: 34688 - DNA, 25 bp, E. coli
gctaaaaattattcagcgggtttgg

SEQ ID NO: 34689 - DNA, 25 bp, E. coli
cgataagctcacacaggcgcagttg

SEQ ID NO: 34690 - DNA, 25 bp, E. coli
cgataagctcactcaggcgcagttg

SEQ ID NO: 34691 - DNA, 25 bp, E. coli
cggcgtttacaggtatactcgctaa

SEQ ID NO: 34692 - DNA, 25 bp, E. coli
cggcgtttacagctatactcgctaa

SEQ ID NO: 34693 - DNA, 25 bp, E. coli
gatttttgtcgataagctcacacag

SEQ ID NO: 34694 - DNA, 25 bp, E. coli
gatttttgtcgaaaagctcacacag

SEQ ID NO: 34695 - DNA, 25 bp, E. coli
gtcgataagctctcacaggcgcagt

SEQ ID NO: 34696 - DNA, 25 bp, E. coli
ggtatactcgctaaaaattattcag

SEQ ID NO: 34697 - DNA, 25 bp, E. coli
ggtatactcgcttaaaattattcag

SEQ ID NO: 34698 - DNA, 25 bp, E. coli
gtcgataagctcacacaggcgcagt

SEQ ID NO: 34699 - DNA, 25 bp, E. coli
taagctcacacacgcgcagttgatt

SEQ ID NO: 34700 - DNA, 25 bp, E. coli
taagctcacacaggcgcagttgatt

SEQ ID NO: 34701 - DNA, 25 bp, E. coli
cataccgaacttatcgataaaccgg

SEQ ID NO: 34702 - DNA, 25 bp, E. coli
cataccgaacttttcgataaaccgg

SEQ ID NO: 34703 - DNA, 25 bp, E. coli
tactcatcgaaatgaaaaccgcgca

SEQ ID NO: 34704 - DNA, 25 bp, E. coli
taccctgaatgccaacataccgaac

SEQ ID NO: 34705 - DNA, 25 bp, E. coli
tactcatcgaaaagaaaaccgcgca

SEQ ID NO: 34706 - DNA, 25 bp, E. coli
taccctgaatgcgaacataccgaac

SEQ ID NO: 34707 - DNA, 25 bp, E. coli
taaaacacttttgtgccagtaaaca

SEQ ID NO: 34708 - DNA, 25 bp, E. coli
taaaacacttttctgccagtaaaca

SEQ ID NO: 34709 - DNA, 25 bp, E. coli
ccatagctggagtatgccctgagtg

SEQ ID NO: 34710 - DNA, 25 bp, E. coli
gcgccgctcccgatatggcaaaaca

SEQ ID NO: 34711 - DNA, 25 bp, E. coli
ccatagctggagaatgccctgagtg

SEQ ID NO: 34712 - DNA, 25 bp, E. coli
gcgccgctcccgttatggcaaaaca

SEQ ID NO: 34713 - DNA, 25 bp, E. coli
ccgcgcagggtgtaaaacacttttg

SEQ ID NO: 34714 - DNA, 25 bp, E. coli
cgataaaccggacgaaacagcaatt

SEQ ID NO: 34715 - DNA, 25 bp, E. coli
cgataaaccggaggaaacagcaatt

SEQ ID NO: 34716 - DNA, 25 bp, E. coli
ccgcgcagggtgaaaaacacttttg

SEQ ID NO: 34717 - DNA, 25 bp, E. coli
gctacccggagtgtcaatttgccat

SEQ ID NO: 34718 - DNA, 25 bp, E. coli
cattatccgctagtcatcgaaaaga

SEQ ID NO: 34719 - DNA, 25 bp, E. coli
gctacccggagtctcaatttgccat

SEQ ID NO: 34720 - DNA, 25 bp, E. coli
cattatccgctactcatcgaaaaga

SEQ ID NO: 34721 - DNA, 25 bp, E. coli
cattaacttcaatcccatagctgga

SEQ ID NO: 34722 - DNA, 25 bp, E. coli
cattaacttcaaacccatagctgga

SEQ ID NO: 34723 - DNA, 25 bp, E. coli
tatcgaagagaacgtgatgacccca

SEQ ID NO: 34724 - DNA, 25 bp, E. coli
tatcgaagagaaggtgatgacccca

SEQ ID NO: 34725 - DNA, 25 bp, E. coli
tttaaacaaggtggactggtcggca

SEQ ID NO: 34726 - DNA, 25 bp, E. coli
tttaaacaaggtcgactggtcggca

SEQ ID NO: 34727 - DNA, 25 bp, E. coli
tattttgtcattacgcctggcgcaa

SEQ ID NO: 34728 - DNA, 25 bp, E. coli
tattttgtcatttcgcctggcgcaa

SEQ ID NO: 34729 - DNA, 25 bp, E. coli
tgtgttctggcggaataacgaaacg

SEQ ID NO: 34730 - DNA, 25 bp, E. coli
tgatgaatatcagccaacctgcgct

SEQ ID NO: 34731 - DNA, 25 bp, E. coli
tgatgaatatcacccaacctgcgct

SEQ ID NO: 34732 - DNA, 25 bp, E. coli
tgaaaattggctcttctcccgtcgc

SEQ ID NO: 34733 - DNA, 25 bp, E. coli
tgaaaattggctgttctcccgtcgc

SEQ ID NO: 34734 - DNA, 25 bp, E. coli
gaatcacactttatgagcggcacag

SEQ ID NO: 34735 - DNA, 25 bp, E. coli
gaatcacactttttgagcggcacag

SEQ ID NO: 34736 - DNA, 25 bp, E. coli
cattgctgcaagatctattggccgg

SEQ ID NO: 34737 - DNA, 25 bp, E. coli
cattgctgcaagttctattggccgg

SEQ ID NO: 34738 - DNA, 25 bp, E. coli
gataatgcgctgctagaccacggcg

SEQ ID NO: 34739 - DNA, 25 bp, E. coli
gataatgcgctggtagaccacggcg

SEQ ID NO: 34740 - DNA, 25 bp, E. coli
ggcaatctaaccgatgtcgcacgaa

SEQ ID NO: 34741 - DNA, 25 bp, E. coli
ggcaatctaacccatgtcgcacgaa

SEQ ID NO: 34742 - DNA, 25 bp, E. coli
tgtgttctggcgcaataacgaaacg

SEQ ID NO: 34743 - DNA, 25 bp, E. coli
taatcaatgacaaggagcgatcgca

SEQ ID NO: 34744 - DNA, 25 bp, E. coli
taatcaatgacatggagcgatcgca

SEQ ID NO: 34745 - DNA, 25 bp, E. coli
catcattgcggcttcatcgacggta

SEQ ID NO: 34746 - DNA, 25 bp, E. coli
catcattgcggcatcatcgacggta

SEQ ID NO: 34747 - DNA, 25 bp, E. coli
atgcctttagctcccagattaaacg

SEQ ID NO: 34748 - DNA, 25 bp, E. coli
atgcctttagctgccagattaaacg

SEQ ID NO: 34749 - DNA, 25 bp, E. coli
tacccagcatgatggctaccgtgag

SEQ ID NO: 34750 - DNA, 25 bp, E. coli
tacccagcatgaaggctaccgtgag

SEQ ID NO: 34751 - DNA, 25 bp, E. coli
tagctgccagattaaacgacaaagg

SEQ ID NO: 34752 - DNA, 25 bp, E. coli
tagctgccagataaaacgacaaagg

SEQ ID NO: 34753 - DNA, 25 bp, E. coli
tatttattgatgcattacctgccgc

SEQ ID NO: 34754 - DNA, 25 bp, E. coli
tatttattgatggattacctgccgc

SEQ ID NO: 34755 - DNA, 25 bp, E. coli
ttattgatggataacctgccgcccg

SEQ ID NO: 34756 - DNA, 25 bp, E. coli
ttattgatggattacctgccgcccg

SEQ ID NO: 34757 - DNA, 25 bp, E. coli
gcatgatggctagcgtgagacagtc

SEQ ID NO: 34758 - DNA, 25 bp, E. coli
gcatgatggctaccgtgagacagtc

SEQ ID NO: 34759 - DNA, 25 bp, E. coli
gacaaaggtaccgagcatgatggct

SEQ ID NO: 34760 - DNA, 25 bp, E. coli
gacaaaggtacccagcatgatggct

SEQ ID NO: 34761 - DNA, 25 bp, E. coli
cggcttcatcgagggtatttattga

SEQ ID NO: 34762 - DNA, 25 bp, E. coli
cggcttcatcgacggtatttattga

SEQ ID NO: 34763 - DNA, 25 bp, E. coli
cgtgagacagtcatcattgcggctt

SEQ ID NO: 34764 - DNA, 25 bp, E. coli
cgtgagacagtcttcattgcggctt

SEQ ID NO: 34765 - DNA, 25 bp, E. coli
gattaaacgacaaaggtacccagca

SEQ ID NO: 34766 - DNA, 25 bp, E. coli
gattaaacgacataggtacccagca

SEQ ID NO: 34767 - DNA, 25 bp, E. coli
caattaatttggacgctggaaccgc

SEQ ID NO: 34768 - DNA, 25 bp, E. coli
caagctgcatttcaccgatcgcgag

SEQ ID NO: 34769 - DNA, 25 bp, E. coli
caattaatttggtcgctggaaccgc

SEQ ID NO: 34770 - DNA, 25 bp, E. coli
caagctgcatttgaccgatcgcgag

SEQ ID NO: 34771 - DNA, 25 bp, E. coli
cacgattattgtggcgccagctcag

SEQ ID NO: 34772 - DNA, 25 bp, E. coli
cacgattattgtcgcgccagctcag

SEQ ID NO: 34773 - DNA, 25 bp, E. coli
agtctcttttacagccaagcggcgg

SEQ ID NO: 34774 - DNA, 25 bp, E. coli
agtctcttttactgccaagcggcgg

SEQ ID NO: 34775 - DNA, 25 bp, E. coli
tagcccgcacgaccaacagatgtgg

SEQ ID NO: 34776 - DNA, 25 bp, E. coli
tagcccgcacgagcaacagatgtgg

SEQ ID NO: 34777 - DNA, 25 bp, E. coli
tatcaggcgacagaaggctttctcg

SEQ ID NO: 34778 - DNA, 25 bp, E. coli
tatacgccaggaaatcgctgtcggg

SEQ ID NO: 34779 - DNA, 25 bp, E. coli
tatacgccaggatatcgctgtcggg

SEQ ID NO: 34780 - DNA, 25 bp, E. coli
tatttgccaaagtgcgggtggcgct

SEQ ID NO: 34781 - DNA, 25 bp, E. coli
tatttgccaaagagcgggtggcgct

SEQ ID NO: 34782 - DNA, 25 bp, E. coli
tatcaggcgacacaaggctttctcg

SEQ ID NO: 34783 - DNA, 25 bp, E. coli
gaaccgcaatgggtggatgagcacc

SEQ ID NO: 34784 - DNA, 25 bp, E. coli
gaaccgcaatggctggatgagcacc

SEQ ID NO: 34785 - DNA, 25 bp, E. coli
gattatcgcctggtacaaaccgggt

SEQ ID NO: 34786 - DNA, 25 bp, E. coli
gattatcgcctgctacaaaccgggt

SEQ ID NO: 34787 - DNA, 25 bp, E. coli
ggctttcatcaggtacatcgggtcg

SEQ ID NO: 34788 - DNA, 25 bp, E. coli
ggctttcatcagctacatcgggtcg

SEQ ID NO: 34789 - DNA, 25 bp, E. coli
caaatttaacgtccttggcggttcg

SEQ ID NO: 34790 - DNA, 25 bp, E. coli
caaatttaacgtgcttggcggttcg

SEQ ID NO: 34791 - DNA, 25 bp, E. coli
caactggtctttggtcaggtcgtac

SEQ ID NO: 34792 - DNA, 25 bp, E. coli
caactggtctttcgtcaggtcgtac

SEQ ID NO: 34793 - DNA, 25 bp, E. coli
cactggcgaagtcgacgatagcaaa

SEQ ID NO: 34794 - DNA, 25 bp, E. coli
cactggcgaagtggacgatagcaaa

SEQ ID NO: 34795 - DNA, 25 bp, E. coli
caggcgacggctattcatggcattc

SEQ ID NO: 34796 - DNA, 25 bp, E. coli
caggcgacggcttttcatggcattc

SEQ ID NO: 34797 - DNA, 25 bp, E. coli
agacattgcatgtacttcgccgtcg

SEQ ID NO: 34798 - DNA, 25 bp, E. coli
agacattgcatgaacttcgccgtcg

SEQ ID NO: 34799 - DNA, 25 bp, E. coli
actcaaagaagacgtgatgactgcc

SEQ ID NO: 34800 - DNA, 25 bp, E. coli
aacagtacgccgctgaccgatggcg

SEQ ID NO: 34801 - DNA, 25 bp, E. coli
actcaaagaagaggtgatgactgcc

SEQ ID NO: 34802 - DNA, 25 bp, E. coli
aacagtacgccggtgaccgatggcg

SEQ ID NO: 34803 - DNA, 25 bp, E. coli
ttggcgtcagtataaaactggcgcg

SEQ ID NO: 34804 - DNA, 25 bp, E. coli
ttggcgtcagtaaaaaactggcgcg

SEQ ID NO: 34805 - DNA, 25 bp, E. coli
gagcaaatggcgtaaacctacggca

SEQ ID NO: 34806 - DNA, 25 bp, E. coli
gagcaaatggcgaaaacctacggca

SEQ ID NO: 34807 - DNA, 25 bp, E. coli
cggcatcacccgtgaacagcaagat

SEQ ID NO: 34808 - DNA, 25 bp, E. coli
cggcatcacccgagaacagcaagat

SEQ ID NO: 34809 - DNA, 25 bp, E. coli
gatgcttacagcctcagccgcgctt

SEQ ID NO: 34810 - DNA, 25 bp, E. coli
gatgcttacagcgtcagccgcgctt

SEQ ID NO: 34811 - DNA, 25 bp, E. coli
cagtgaaatgcgatcgccggtgatc

SEQ ID NO: 34812 - DNA, 25 bp, E. coli
cagtgaaatgcgttcgccggtgatc

SEQ ID NO: 34813 - DNA, 25 bp, E. coli
taaacgctttgtcgaactgactggc

SEQ ID NO: 34814 - DNA, 25 bp, E. coli
tacggcgcacggcttatacagcaaa

SEQ ID NO: 34815 - DNA, 25 bp, E. coli
taaacgctttgtggaactgactggc

SEQ ID NO: 34816 - DNA, 25 bp, E. coli
tacggcgcacgggttatacagcaaa

SEQ ID NO: 34817 - DNA, 25 bp, E. coli
atatctgttacacgacgcccaggcc

SEQ ID NO: 34818 - DNA, 25 bp, E. coli
atatctgttacaggacgcccaggcc

SEQ ID NO: 34819 - DNA, 25 bp, E. coli
tttaacattcattacgccgagacga

SEQ ID NO: 34820 - DNA, 25 bp, E. coli
tttaacattcataacgccgagacga

SEQ ID NO: 34821 - DNA, 25 bp, E. coli
tgaagatgacatgagcgttgacgcc

SEQ ID NO: 34822 - DNA, 25 bp, E. coli
tgaagatgacatcagcgttgacgcc

SEQ ID NO: 34823 - DNA, 25 bp, E. coli
gcgatcctcgaactgtgcagtgaaa

SEQ ID NO: 34824 - DNA, 25 bp, E. coli
gcgatcctcgaagtgtgcagtgaaa

SEQ ID NO: 34825 - DNA, 25 bp, E. coli
cgaaagtgcattgctgaccgatcca

SEQ ID NO: 34826 - DNA, 25 bp, E. coli
cgctggaagagatctacgccctgtg

SEQ ID NO: 34827 - DNA, 25 bp, E. coli
cgaaagtgcattcctgaccgatcca

SEQ ID NO: 34828 - DNA, 25 bp, E. coli
cgctggaagagaactacgccctgtg

SEQ ID NO: 34829 - DNA, 25 bp, E. coli
cgaagattgattaccagcggctggc

SEQ ID NO: 34830 - DNA, 25 bp, E. coli
cgaagattgatttccagcggctggc

SEQ ID NO: 34831 - DNA, 25 bp, E. coli
gatattcgccgttaagtccacgcag

SEQ ID NO: 34832 - DNA, 25 bp, E. coli
gatattcgccgtaaagtccacgcag

SEQ ID NO: 34833 - DNA, 25 bp, E. coli
taaaggccgtgcattctgcgaaaaa

SEQ ID NO: 34834 - DNA, 25 bp, E. coli
taaaggccgtgctttctgcgaaaaa

SEQ ID NO: 34835 - DNA, 25 bp, E. coli
acgttaatgattgccgttagcccac

SEQ ID NO: 34836 - DNA, 25 bp, E. coli
agcaggcgggcaacgatcagtcaca

SEQ ID NO: 34837 - DNA, 25 bp, E. coli
agcaggcgggcatcgatcagtcaca

SEQ ID NO: 34838 - DNA, 25 bp, E. coli
acgttaatgattcccgttagcccac

SEQ ID NO: 34839 - DNA, 25 bp, E. coli
tgattgccgttaccccactggcgct

SEQ ID NO: 34840 - DNA, 25 bp, E. coli
tgattgccgttagcccactggcgct

SEQ ID NO: 34841 - DNA, 25 bp, E. coli
gcgggcatcgatgagtcacatccgg

SEQ ID NO: 34842 - DNA, 25 bp, E. coli
gcgggcatcgatcagtcacatccgg

SEQ ID NO: 34843 - DNA, 25 bp, E. coli
gcatcgatcagtgacatccggcgct

SEQ ID NO: 34844 - DNA, 25 bp, E. coli
gcatcgatcagtcacatccggcgct

SEQ ID NO: 34845 - DNA, 25 bp, E. coli
cgttagcccactcgcgctggtggat

SEQ ID NO: 34846 - DNA, 25 bp, E. coli
cgttagcccactggcgctggtggat

SEQ ID NO: 34847 - DNA, 25 bp, E. coli
cgtgcagtggacaatgaacgcctgg

SEQ ID NO: 34848 - DNA, 25 bp, E. coli
cgtgcagtggactatgaacgcctgg

SEQ ID NO: 34849 - DNA, 25 bp, E. coli
tcacggcacgggtaaaggccgtgca

SEQ ID NO: 34850 - DNA, 25 bp, E. coli
taatgattgccgatagcccactggc

SEQ ID NO: 34851 - DNA, 25 bp, E. coli
taatgattgccgttagcccactggc

SEQ ID NO: 34852 - DNA, 25 bp, E. coli
tcacggcacgggaaaaggccgtgca

SEQ ID NO: 34853 - DNA, 25 bp, E. coli
gggtaaaggccgtgcattctgcgaa

SEQ ID NO: 34854 - DNA, 25 bp, E. coli
gggtaaaggccgagcattctgcgaa

SEQ ID NO: 34855 - DNA, 25 bp, E. coli
aatgcagttgttgtaaaagaccgcg

SEQ ID NO: 34856 - DNA, 25 bp, E. coli
aatgcagttgttctaaaagaccgcg

SEQ ID NO: 34857 - DNA, 25 bp, E. coli
taaactgaactatgcgtcagcgaca

SEQ ID NO: 34858 - DNA, 25 bp, E. coli
taaaagttctcctgtacgtgcaatc

SEQ ID NO: 34859 - DNA, 25 bp, E. coli
taaactgaactaagcgtcagcgaca

SEQ ID NO: 34860 - DNA, 25 bp, E. coli
taccggtaaaggtgccgtcgagcga

SEQ ID NO: 34861 - DNA, 25 bp, E. coli
taccggtaaaggagccgtcgagcga

SEQ ID NO: 34862 - DNA, 25 bp, E. coli
tctccggagaaatggtggcgtctct

SEQ ID NO: 34863 - DNA, 25 bp, E. coli
tctccggagaaaaggtggcgtctct

SEQ ID NO: 34864 - DNA, 25 bp, E. coli
tcttcagcagctcggcgtaaactgg

SEQ ID NO: 34865 - DNA, 25 bp, E. coli
tcttcagcagctgggcgtaaactgg

SEQ ID NO: 34866 - DNA, 25 bp, E. coli
gctgccccgtcctctctggaaaaaa

SEQ ID NO: 34867 - DNA, 25 bp, E. coli
gctgccccgtccactctggaaaaaa

SEQ ID NO: 34868 - DNA, 25 bp, E. coli
gaacattgctgagagtgacaccacg

SEQ ID NO: 34869 - DNA, 25 bp, E. coli
gacagctcgaattgccttaccggaa

SEQ ID NO: 34870 - DNA, 25 bp, E. coli
gacagctcgaatagccttaccggaa

SEQ ID NO: 34871 - DNA, 25 bp, E. coli
gaacattgctgacagtgacaccacg

SEQ ID NO: 34872 - DNA, 25 bp, E. coli
taatggttcacttcccagtaccggt

SEQ ID NO: 34873 - DNA, 25 bp, E. coli
taaaagttctccagtacgtgcaatc

SEQ ID NO: 34874 - DNA, 25 bp, E. coli
taatggttcactacccagtaccggt

SEQ ID NO: 34875 - DNA, 25 bp, E. coli
gatgccagcagctccttacctgaag

SEQ ID NO: 34876 - DNA, 25 bp, E. coli
gatgccagcagcaccttacctgaag

SEQ ID NO: 34877 - DNA, 25 bp, E. coli
aatggctggcagatcgcaacgtaca

SEQ ID NO: 34878 - DNA, 25 bp, E. coli
aatggctggcagttcgcaacgtaca

SEQ ID NO: 34879 - DNA, 25 bp, E. coli
caacaaccggtattcgtgatgaagg

SEQ ID NO: 34880 - DNA, 25 bp, E. coli
caacaaccggtaatcgtgatgaagg

SEQ ID NO: 34881 - DNA, 25 bp, E. coli
cattaccgacagtttctgaaggagc

SEQ ID NO: 34882 - DNA, 25 bp, E. coli
cattaccgacagattctgaaggagc

SEQ ID NO: 34883 - DNA, 25 bp, E. coli
agtcgtaatacctgccagcccaatg

SEQ ID NO: 34884 - DNA, 25 bp, E. coli
agtcgtaataccagccagcccaatg

SEQ ID NO: 34885 - DNA, 25 bp, E. coli
taaattaggtcgcttcgggacggat

SEQ ID NO: 34886 - DNA, 25 bp, E. coli
taaattaggtcggttcgggacggat

SEQ ID NO: 34887 - DNA, 25 bp, E. coli
tatcgtattccgttaatggctggca

SEQ ID NO: 34888 - DNA, 25 bp, E. coli
tataacagccagacgggaaaatacg

SEQ ID NO: 34889 - DNA, 25 bp, E. coli
tatcgtattccgataatggctggca

SEQ ID NO: 34890 - DNA, 25 bp, E. coli
tataacagccagtcgggaaaatacg

SEQ ID NO: 34891 - DNA, 25 bp, E. coli
tattctcgagaaaagcataccgctc

SEQ ID NO: 34892 - DNA, 25 bp, E. coli
tattctcgagaatagcataccgctc

SEQ ID NO: 34893 - DNA, 25 bp, E. coli
tcgtaaccgtgaaggaatgcagtcc

SEQ ID NO: 34894 - DNA, 25 bp, E. coli
tcgtaaccgtgatggaatgcagtcc

SEQ ID NO: 34895 - DNA, 25 bp, E. coli
ccgtggtggatagcgacattggcta

SEQ ID NO: 34896 - DNA, 25 bp, E. coli
gcgggactacgcatcagactgaaaa

SEQ ID NO: 34897 - DNA, 25 bp, E. coli
gcgggactacgcttcagactgaaaa

SEQ ID NO: 34898 - DNA, 25 bp, E. coli
ccgtggtggataccgacattggcta

SEQ ID NO: 34899 - DNA, 25 bp, E. coli
caacccgttccatacgtggcatgcg

SEQ ID NO: 34900 - DNA, 25 bp, E. coli
caacccgttccaaacgtggcatgcg

SEQ ID NO: 34901 - DNA, 25 bp, E. coli
caaacgtggcatccgtcgttcccat

SEQ ID NO: 34902 - DNA, 25 bp, E. coli
caaacgtggcatgcgtcgttcccat

SEQ ID NO: 34903 - DNA, 25 bp, E. coli
tggccgtacaactgaataaaccaac

SEQ ID NO: 34904 - DNA, 25 bp, E. coli
tggccgtacaacagaataaaccaac

SEQ ID NO: 34905 - DNA, 25 bp, E. coli
atgacgcgctgagcgcagtcaccag

SEQ ID NO: 34906 - DNA, 25 bp, E. coli
atgacgcgctgaccgcagtcaccag

SEQ ID NO: 34907 - DNA, 25 bp, E. coli
ttctggtgaaaaacacctgcgtcac

SEQ ID NO: 34908 - DNA, 25 bp, E. coli
ttctggtgaaaatcacctgcgtcac

SEQ ID NO: 34909 - DNA, 25 bp, E. coli
tgtctgtagacataacttctggtga

SEQ ID NO: 34910 - DNA, 25 bp, E. coli
tgtctgtagacaaaacttctggtga

SEQ ID NO: 34911 - DNA, 25 bp, E. coli
tgcgtcgttcccatgacgcgctgac

SEQ ID NO: 34912 - DNA, 25 bp, E. coli
tgcgtcgttcccttgacgcgctgac

SEQ ID NO: 34913 - DNA, 25 bp, E. coli
gcagtcaccagcctgtctgtagaca

SEQ ID NO: 34914 - DNA, 25 bp, E. coli
gcagtcaccagcgtgtctgtagaca

SEQ ID NO: 34915 - DNA, 25 bp, E. coli
cggccgcaaggtcatcgctaagtaa

SEQ ID NO: 34916 - DNA, 25 bp, E. coli
cgacggttactagcgcggccgcaag

SEQ ID NO: 34917 - DNA, 25 bp, E. coli
cggccgcaaggtgatcgctaagtaa

SEQ ID NO: 34918 - DNA, 25 bp, E. coli
cgacggttactaccgcggccgcaag

SEQ ID NO: 34919 - DNA, 25 bp, E. coli
gtcaccacatcagtgccgacggtta

SEQ ID NO: 34920 - DNA, 25 bp, E. coli
gtcaccacatcactgccgacggtta

SEQ ID NO: 34921 - DNA, 25 bp, E. coli
cagcgaggcgtttcgccacattgcg

SEQ ID NO: 34922 - DNA, 25 bp, E. coli
cagcgaggcgttacgccacattgcg

SEQ ID NO: 34923 - DNA, 25 bp, E. coli
catgtgttggtgaaattcaccgtac

SEQ ID NO: 34924 - DNA, 25 bp, E. coli
catgtgttggtgtaattcaccgtac

SEQ ID NO: 34925 - DNA, 25 bp, E. coli
ttggtgaaattctccgtaccacagc

SEQ ID NO: 34926 - DNA, 25 bp, E. coli
ttggtgaaattcaccgtaccacagc

SEQ ID NO: 34927 - DNA, 25 bp, E. coli
tgagcgagctgactgatcttttact

SEQ ID NO: 34928 - DNA, 25 bp, E. coli
tgagcgagctgagtgatcttttact

SEQ ID NO: 34929 - DNA, 25 bp, E. coli
tctggcgggtggtcgataccggaaa

SEQ ID NO: 34930 - DNA, 25 bp, E. coli
tctggcgggtggacgataccggaaa

SEQ ID NO: 34931 - DNA, 25 bp, E. coli
gcaactgaatctgactgatgatata

SEQ ID NO: 34932 - DNA, 25 bp, E. coli
gcaactgaatctcactgatgatata

SEQ ID NO: 34933 - DNA, 25 bp, E. coli
gactgatgatatacgtctctggcag

SEQ ID NO: 34934 - DNA, 25 bp, E. coli
gactgatgatattcgtctctggcag

SEQ ID NO: 34935 - DNA, 25 bp, E. coli
ctgactgatcttatactgcaagggc

SEQ ID NO: 34936 - DNA, 25 bp, E. coli
ctgactgatcttttactgcaagggc

SEQ ID NO: 34937 - DNA, 25 bp, E. coli
gtttcgccacatagcgcaagaaatg

SEQ ID NO: 34938 - DNA, 25 bp, E. coli
gtttcgccacattgcgcaagaaatg

SEQ ID NO: 34939 - DNA, 25 bp, E. coli
gggtgacctgctaattgctgaatct

SEQ ID NO: 34940 - DNA, 25 bp, E. coli
gggtgacctgcttattgctgaatct

SEQ ID NO: 34941 - DNA, 25 bp, E. coli
gatctccgaccggagggctttttag

SEQ ID NO: 34942 - DNA, 25 bp, E. coli
gatctccgaccgcagggctttttag

SEQ ID NO: 34943 - DNA, 25 bp, E. coli
caggcggcgcatggtatacaggcaa

SEQ ID NO: 34944 - DNA, 25 bp, E. coli
caggcggcgcatcgtatacaggcaa

SEQ ID NO: 34945 - DNA, 25 bp, E. coli
taaaagcggtcagagcgtcatcttc

SEQ ID NO: 34946 - DNA, 25 bp, E. coli
taaaagcggtcacagcgtcatcttc

SEQ ID NO: 34947 - DNA, 25 bp, E. coli
tagcggcggcgacttccagttaaat

SEQ ID NO: 34948 - DNA, 25 bp, E. coli
tagcggcggcgagttccagttaaat

SEQ ID NO: 34949 - DNA, 25 bp, E. coli
tcaggagaaagtcacggaagccttc

SEQ ID NO: 34950 - DNA, 25 bp, E. coli
tcaggagaaagtgacggaagccttc

SEQ ID NO: 34951 - DNA, 25 bp, E. coli
cattccggtggatatggcaactgag

SEQ ID NO: 34952 - DNA, 25 bp, E. coli
cattccggtggaaatggcaactgag

SEQ ID NO: 34953 - DNA, 25 bp, E. coli
gttatcaaaactttcatcgcggcgt

SEQ ID NO: 34954 - DNA, 25 bp, E. coli
gattactcgctatacagcctgaagg

SEQ ID NO: 34955 - DNA, 25 bp, E. coli
gttatcaaaactatcatcgcggcgt

SEQ ID NO: 34956 - DNA, 25 bp, E. coli
gattactcgctaaacagcctgaagg

SEQ ID NO: 34957 - DNA, 25 bp, E. coli
ggtgattactatggcgccgctaagc

SEQ ID NO: 34958 - DNA, 25 bp, E. coli
ggtgattactatcgcgccgctaagc

SEQ ID NO: 34959 - DNA, 25 bp, E. coli
tggatgcgaaacagaccattccggt

SEQ ID NO: 34960 - DNA, 25 bp, E. coli
ggcatcaattcaaaccacgctggtt

SEQ ID NO: 34961 - DNA, 25 bp, E. coli
ggcatcaattcataccacgctggtt

SEQ ID NO: 34962 - DNA, 25 bp, E. coli
tggatgcgaaactgaccattccggt

SEQ ID NO: 34963 - DNA, 25 bp, E. coli
gatccggcaacgactaaagaagcgc

SEQ ID NO: 34964 - DNA, 25 bp, E. coli
gatccggcaacgtctaaagaagcgc

SEQ ID NO: 34965 - DNA, 25 bp, E. coli
caaaagagatcctcgctaaagccgg

SEQ ID NO: 34966 - DNA, 25 bp, E. coli
caaaagagatccacgctaaagccgg

SEQ ID NO: 34967 - DNA, 25 bp, E. coli
catcaaagtttcctgcccgtgggct

SEQ ID NO: 34968 - DNA, 25 bp, E. coli
catcaaagtttcgtgcccgtgggct

SEQ ID NO: 34969 - DNA, 25 bp, E. coli
taaaagtgatgagcattgcctccgc

SEQ ID NO: 34970 - DNA, 25 bp, E. coli
taaaagtgatgaccattgcctccgc

SEQ ID NO: 34971 - DNA, 25 bp, E. coli
taaaagttgatttgctgccagccgc

SEQ ID NO: 34972 - DNA, 25 bp, E. coli
taaaagttgattagctgccagccgc

SEQ ID NO: 34973 - DNA, 25 bp, E. coli
tataacgatggctaatccagcaccg

SEQ ID NO: 34974 - DNA, 25 bp, E. coli
tataacgatggcaaatccagcaccg

SEQ ID NO: 34975 - DNA, 25 bp, E. coli
ccagctttgctctgggcggtgtaaa

SEQ ID NO: 34976 - DNA, 25 bp, E. coli
cctggagcactggaagaaacaccgt

SEQ ID NO: 34977 - DNA, 25 bp, E. coli
cctggagcactgcaagaaacaccgt

SEQ ID NO: 34978 - DNA, 25 bp, E. coli
ccagctttgctcagggcggtgtaaa

SEQ ID NO: 34979 - DNA, 25 bp, E. coli
gaaatttgcctcaggtaatccggta

SEQ ID NO: 34980 - DNA, 25 bp, E. coli
gaaatttgcctctggtaatccggta

SEQ ID NO: 34981 - DNA, 25 bp, E. coli
tggacccggcagaagctaatgaact

SEQ ID NO: 34982 - DNA, 25 bp, E. coli
tggacccggcagtagctaatgaact

SEQ ID NO: 34983 - DNA, 25 bp, E. coli
taatcctgcgttctgggaggccgct

SEQ ID NO: 34984 - DNA, 25 bp, E. coli
taatcctgcgttgtgggaggccgct

SEQ ID NO: 34985 - DNA, 25 bp, E. coli
gatgatattgtgagtctggacccgg

SEQ ID NO: 34986 - DNA, 25 bp, E. coli
gatgatattgtgtgtctggacccgg

SEQ ID NO: 34987 - DNA, 25 bp, E. coli
caactgatcattgcggtcggcatag

SEQ ID NO: 34988 - DNA, 25 bp, E. coli
caactgatcattccggtcggcatag

SEQ ID NO: 34989 - DNA, 25 bp, E. coli
cacattgatgtcaccaacagcggca

SEQ ID NO: 34990 - DNA, 25 bp, E. coli
cagcggattttgtcggtcggtatca

SEQ ID NO: 34991 - DNA, 25 bp, E. coli
cacattgatgtctccaacagcggca

SEQ ID NO: 34992 - DNA, 25 bp, E. coli
cagcggattttgacggtcggtatca

SEQ ID NO: 34993 - DNA, 25 bp, E. coli
tatgcatattgttctggcaccctgg

SEQ ID NO: 34994 - DNA, 25 bp, E. coli
tatgcatattgtactggcaccctgg

SEQ ID NO: 34995 - DNA, 25 bp, E. coli
tatcgggttgagaatacgcatcgcg

SEQ ID NO: 34996 - DNA, 25 bp, E. coli
tatcgggttgagtatacgcatcgcg

SEQ ID NO: 34997 - DNA, 25 bp, E. coli
tcaggctggacgaaaacgcgatggc

SEQ ID NO: 34998 - DNA, 25 bp, E. coli
tcaggctggacgtaaacgcgatggc

SEQ ID NO: 34999 - DNA, 25 bp, E. coli
gcatcatcggctacgcaacggagtt

SEQ ID NO: 35000 - DNA, 25 bp, E. coli
gcatcatcggcttcgcaacggagtt

SEQ ID NO: 35001 - DNA, 25 bp, E. coli
gcaaacccgtatcatggcactggca

SEQ ID NO: 35002 - DNA, 25 bp, E. coli
gcaaacccgtatgatggcactggca

SEQ ID NO: 35003 - DNA, 25 bp, E. coli
gtataaattactcctgcgcatggcg

SEQ ID NO: 35004 - DNA, 25 bp, E. coli
gtataaattactgctgcgcatggcg

SEQ ID NO: 35005 - DNA, 25 bp, E. coli
taagcttgagccagacaacggcacg

SEQ ID NO: 35006 - DNA, 25 bp, E. coli
tcaaggcgcgggaaagatcatggtc

SEQ ID NO: 35007 - DNA, 25 bp, E. coli
taagcttgagcctgacaacggcacg

SEQ ID NO: 35008 - DNA, 25 bp, E. coli
tcaaggcgcgggtaagatcatggtc

SEQ ID NO: 35009 - DNA, 25 bp, E. coli
aagccgctcggccaaacgctgaaag

SEQ ID NO: 35010 - DNA, 25 bp, E. coli
aagccgctcggcgaaacgctgaaag

SEQ ID NO: 35011 - DNA, 25 bp, E. coli
caccgatcagatggccgggaaactc

SEQ ID NO: 35012 - DNA, 25 bp, E. coli
caccgatcagatcgccgggaaactc

SEQ ID NO: 35013 - DNA, 25 bp, E. coli
caggaactttccgtggcgcaggttc

SEQ ID NO: 35014 - DNA, 25 bp, E. coli
caggaactttccctggcgcaggttc

SEQ ID NO: 35015 - DNA, 25 bp, E. coli
acgggcgacacgcacatcaccgtga

SEQ ID NO: 35016 - DNA, 25 bp, E. coli
acgggcgacacggacatcaccgtga

SEQ ID NO: 35017 - DNA, 25 bp, E. coli
tttgccgcttaagctgaacattgaa

SEQ ID NO: 35018 - DNA, 25 bp, E. coli
tttgccgcttaacctgaacattgaa

SEQ ID NO: 35019 - DNA, 25 bp, E. coli
tgaccgacgtgcttttgccgcttaa

SEQ ID NO: 35020 - DNA, 25 bp, E. coli
tgaccgacgtgcatttgccgcttaa

SEQ ID NO: 35021 - DNA, 25 bp, E. coli
tcagatcgccgggaaactcgacgta

SEQ ID NO: 35022 - DNA, 25 bp, E. coli
gccgggaaactcgacgtacgcgttg

SEQ ID NO: 35023 - DNA, 25 bp, E. coli
cctgcgctggcaggaactttccgtg

SEQ ID NO: 35024 - DNA, 25 bp, E. coli
cctgcgctggcacgaactttccgtg

SEQ ID NO: 35025 - DNA, 25 bp, E. coli
gccgggaaactccacgtacgcgttg

SEQ ID NO: 35026 - DNA, 25 bp, E. coli
gacacggacatctccgtgagcacca

SEQ ID NO: 35027 - DNA, 25 bp, E. coli
gacacggacatcaccgtgagcacca

SEQ ID NO: 35028 - DNA, 25 bp, E. coli
gtgcatttgccggttaacctgaaca

SEQ ID NO: 35029 - DNA, 25 bp, E. coli
gtgcatttgccgcttaacctgaaca

SEQ ID NO: 35030 - DNA, 25 bp, E. coli
tcagatcgccggcaaactcgacgta

SEQ ID NO: 35031 - DNA, 25 bp, E. coli
agaagttcgtcctcaagttagcggg

SEQ ID NO: 35032 - DNA, 25 bp, E. coli
agaagttcgtccacaagttagcggg

SEQ ID NO: 35033 - DNA, 25 bp, E. coli
tgcagatcacaaccgagcttccggg

SEQ ID NO: 35034 - DNA, 25 bp, E. coli
tgcagatcacaagcgagcttccggg

SEQ ID NO: 35035 - DNA, 25 bp, E. coli
tgcctaccggatggcagaagttcgt

SEQ ID NO: 35036 - DNA, 25 bp, E. coli
tgcgaaaggtgaactggcgaaagcc

SEQ ID NO: 35037 - DNA, 25 bp, E. coli
tgcctaccggatcgcagaagttcgt

SEQ ID NO: 35038 - DNA, 25 bp, E. coli
tgcgaaaggtgatctggcgaaagcc

SEQ ID NO: 35039 - DNA, 25 bp, E. coli
gacggcattaagatcccgcaggacg

SEQ ID NO: 35040 - DNA, 25 bp, E. coli
gacgttaccgttcatcagaccactg

SEQ ID NO: 35041 - DNA, 25 bp, E. coli
gacggcattaagttcccgcaggacg

SEQ ID NO: 35042 - DNA, 25 bp, E. coli
gacgttaccgttgatcagaccactg

SEQ ID NO: 35043 - DNA, 25 bp, E. coli
cattggtacagaacggtcaggcgac

SEQ ID NO: 35044 - DNA, 25 bp, E. coli
cattggtacagatcggtcaggcgac

SEQ ID NO: 35045 - DNA, 25 bp, E. coli
gataataaccagcaagccgcaagcg

SEQ ID NO: 35046 - DNA, 25 bp, E. coli
gataataaccaggaagccgcaagcg

SEQ ID NO: 35047 - DNA, 25 bp, E. coli
taagtgggctgcagaaagtgcgtcc

SEQ ID NO: 35048 - DNA, 25 bp, E. coli
taacaggatgtgtcgacaaacaggc

SEQ ID NO: 35049 - DNA, 25 bp, E. coli
taagtgggctgctgaaagtgcgtcc

SEQ ID NO: 35050 - DNA, 25 bp, E. coli
taacaggatgtgacgacaaacaggc

SEQ ID NO: 35051 - DNA, 25 bp, E. coli
gacggtacgctggaattctctgacg

SEQ ID NO: 35052 - DNA, 25 bp, E. coli
gacggtacgctgcaattctctgacg

SEQ ID NO: 35053 - DNA, 25 bp, E. coli
caacgtttctttggtcacggtgaat

SEQ ID NO: 35054 - DNA, 25 bp, E. coli
caacgtttctttcgtcacggtgaat

SEQ ID NO: 35055 - DNA, 25 bp, E. coli
tgttgtaaacatcaaggccagccac

SEQ ID NO: 35056 - DNA, 25 bp, E. coli
tgttgtaaacatgaaggccagccac

SEQ ID NO: 35057 - DNA, 25 bp, E. coli
tgagccatcatcacgaagggtgttg

SEQ ID NO: 35058 - DNA, 25 bp, E. coli
tgagccatcatctcgaagggtgttg

SEQ ID NO: 35059 - DNA, 25 bp, E. coli
gctgctgcaaagctgagaagtcaga

SEQ ID NO: 35060 - DNA, 25 bp, E. coli
gctgctgcaaaggtgagaagtcaga

SEQ ID NO: 35061 - DNA, 25 bp, E. coli
gaagtcagaacacgagcactgcgga

SEQ ID NO: 35062 - DNA, 25 bp, E. coli
gaagtcagaacaggagcactgcgga

SEQ ID NO: 35063 - DNA, 25 bp, E. coli
gattttctgcagcagcagtcgctga

SEQ ID NO: 35064 - DNA, 25 bp, E. coli
gattttctgcaggagcagtcgctga

SEQ ID NO: 35065 - DNA, 25 bp, E. coli
gattgaagaacgcatcaaagcgcgt

SEQ ID NO: 35066 - DNA, 25 bp, E. coli
gattgaagaacggatcaaagcgcgt

SEQ ID NO: 35067 - DNA, 25 bp, E. coli
ggtcaccagcatgaacacggtcaat

SEQ ID NO: 35068 - DNA, 25 bp, E. coli
ggtgattctggatattctctcgcgc

SEQ ID NO: 35069 - DNA, 25 bp, E. coli
ggtcaccagcatcaacacggtcaat

SEQ ID NO: 35070 - DNA, 25 bp, E. coli
ggtgattctggaaattctctcgcgc

SEQ ID NO: 35071 - DNA, 25 bp, E. coli
ggctggaagaaaaccgcgaacaggt

SEQ ID NO: 35072 - DNA, 25 bp, E. coli
ggctggaagaaatccgcgaacaggt

SEQ ID NO: 35073 - DNA, 25 bp, E. coli
taagaagcagattgcgctgaccgaa

SEQ ID NO: 35074 - DNA, 25 bp, E. coli
taagaagcagatagcgctgaccgaa

SEQ ID NO: 35075 - DNA, 25 bp, E. coli
aagcagactcatagtgtttagggac

SEQ ID NO: 35076 - DNA, 25 bp, E. coli
catcggatcacacatggagagtttt

SEQ ID NO: 35077 - DNA, 25 bp, E. coli
catcggatcacagatggagagtttt

SEQ ID NO: 35078 - DNA, 25 bp, E. coli
aagcagactcattgtgtttagggac

SEQ ID NO: 35079 - DNA, 25 bp, E. coli
tagggacattgtactggaagaaaac

SEQ ID NO: 35080 - DNA, 25 bp, E. coli
tagggacattgttctggaagaaaac

SEQ ID NO: 35081 - DNA, 25 bp, E. coli
tgtactttggccctaatagctctgc

SEQ ID NO: 35082 - DNA, 25 bp, E. coli
tgtactttggccgtaatagctctgc

SEQ ID NO: 35083 - DNA, 25 bp, E. coli
tgaataaccccgactgtcttgatga

SEQ ID NO: 35084 - DNA, 25 bp, E. coli
taacgtcgggtatacaaagcccatc

SEQ ID NO: 35085 - DNA, 25 bp, E. coli
tgaaaaatgcaaacatcatgtcgcc

SEQ ID NO: 35086 - DNA, 25 bp, E. coli
tgaaaaatgcaatcatcatgtcgcc

SEQ ID NO: 35087 - DNA, 25 bp, E. coli
tgaataaccccgtctgtcttgatga

SEQ ID NO: 35088 - DNA, 25 bp, E. coli
taacgtcgggtaaacaaagcccatc

SEQ ID NO: 35089 - DNA, 25 bp, E. coli
gctttaatttcacgccccatcggat

SEQ ID NO: 35090 - DNA, 25 bp, E. coli
gctttaatttcaggccccatcggat

SEQ ID NO: 35091 - DNA, 25 bp, E. coli
ggcaaataaccaagtcaccagctaa

SEQ ID NO: 35092 - DNA, 25 bp, E. coli
ggcaaataaccatgtcaccagctaa

SEQ ID NO: 35093 - DNA, 25 bp, E. coli
taagttaacagacatgagtcccggg

SEQ ID NO: 35094 - DNA, 25 bp, E. coli
taagttaacagagatgagtcccggg

SEQ ID NO: 35095 - DNA, 25 bp, E. coli
gagtcccgggatgagattcaacatt

SEQ ID NO: 35096 - DNA, 25 bp, E. coli
gagtcccgggatcagattcaacatt

SEQ ID NO: 35097 - DNA, 25 bp, E. coli
cacagaatgatagcgaagcgttagc

SEQ ID NO: 35098 - DNA, 25 bp, E. coli
cacagaatgataccgaagcgttagc

SEQ ID NO: 35099 - DNA, 25 bp, E. coli
cagagtatctgcaatgcctggcttc

SEQ ID NO: 35100 - DNA, 25 bp, E. coli
cagagtatctgctatgcctggcttc

SEQ ID NO: 35101 - DNA, 25 bp, E. coli
acgcggcgcggttaatcttcctgat

SEQ ID NO: 35102 - DNA, 25 bp, E. coli
acgcggcgcggtaaatcttcctgat

SEQ ID NO: 35103 - DNA, 25 bp, E. coli
tagcgaagcgttagccgttcacctg

SEQ ID NO: 35104 - DNA, 25 bp, E. coli
tagcgaagcgtttgccgttcacctg

SEQ ID NO: 35105 - DNA, 25 bp, E. coli
tatctgcaatgcgtggcttccctcg

SEQ ID NO: 35106 - DNA, 25 bp, E. coli
tatctgcaatgcctggcttccctcg

SEQ ID NO: 35107 - DNA, 25 bp, E. coli
tcgcggtaaacgaaaaccagagtat

SEQ ID NO: 35108 - DNA, 25 bp, E. coli
tcgcggtaaacgtaaaccagagtat

SEQ ID NO: 35109 - DNA, 25 bp, E. coli
cctcgccagggctcagaatgatagc

SEQ ID NO: 35110 - DNA, 25 bp, E. coli
cctcgccagggcacagaatgatagc

SEQ ID NO: 35111 - DNA, 25 bp, E. coli
cgtaaaccagagaatctgcaatgcc

SEQ ID NO: 35112 - DNA, 25 bp, E. coli
cgttagccgttcacctgcaacgcgg

SEQ ID NO: 35113 - DNA, 25 bp, E. coli
cgtaaaccagagtatctgcaatgcc

SEQ ID NO: 35114 - DNA, 25 bp, E. coli
cgttagccgttctcctgcaacgcgg

SEQ ID NO: 35115 - DNA, 25 bp, E. coli
ggcttccctcgcgagggcacagaat

SEQ ID NO: 35116 - DNA, 25 bp, E. coli
ggcttccctcgccagggcacagaat

SEQ ID NO: 35117 - DNA, 25 bp, E. coli
taatcttcctgaattcgcctgggcg

SEQ ID NO: 35118 - DNA, 25 bp, E. coli
taatcttcctgatttcgcctgggcg

SEQ ID NO: 35119 - DNA, 25 bp, E. coli
aacgttaatgaatgatgcgccgaag

SEQ ID NO: 35120 - DNA, 25 bp, E. coli
tactggtgatgattgtctttggcgc

SEQ ID NO: 35121 - DNA, 25 bp, E. coli
tactggtgatgaatgtctttggcgc

SEQ ID NO: 35122 - DNA, 25 bp, E. coli
aacgttaatgaaagatgcgccgaag

SEQ ID NO: 35123 - DNA, 25 bp, E. coli
tctgtttaacggagcgctttctgcc

SEQ ID NO: 35124 - DNA, 25 bp, E. coli
tgcgccgaagcacgaagtgaaaacc

SEQ ID NO: 35125 - DNA, 25 bp, E. coli
tcctgactgcgtgcatgagtggtct

SEQ ID NO: 35126 - DNA, 25 bp, E. coli
tccggagcgtaagggacttatctct

SEQ ID NO: 35127 - DNA, 25 bp, E. coli
tgcgccgaagcaggaagtgaaaacc

SEQ ID NO: 35128 - DNA, 25 bp, E. coli
tccggagcgtaacggacttatctct

SEQ ID NO: 35129 - DNA, 25 bp, E. coli
tcctgactgcgtccatgagtggtct

SEQ ID NO: 35130 - DNA, 25 bp, E. coli
tctgtttaacggtgcgctttctgcc

SEQ ID NO: 35131 - DNA, 25 bp, E. coli
gccaatgctgtgtcggttatttcca

SEQ ID NO: 35132 - DNA, 25 bp, E. coli
gccaatgctgtgacggttatttcca

SEQ ID NO: 35133 - DNA, 25 bp, E. coli
gaaagatatcgctcaaagcctggcg

SEQ ID NO: 35134 - DNA, 25 bp, E. coli
gacacgcacctgctcgaaacggtgg

SEQ ID NO: 35135 - DNA, 25 bp, E. coli
gacacgcacctggtcgaaacggtgg

SEQ ID NO: 35136 - DNA, 25 bp, E. coli
gaaagatatcgcacaaagcctggcg

SEQ ID NO: 35137 - DNA, 25 bp, E. coli
taactttggtggcacgattacggtg

SEQ ID NO: 35138 - DNA, 25 bp, E. coli
taactttggtgggacgattacggtg

SEQ ID NO: 35139 - DNA, 25 bp, E. coli
gagaaggactacaccctggcagagt

SEQ ID NO: 35140 - DNA, 25 bp, E. coli
gagaaggactactccctggcagagt

SEQ ID NO: 35141 - DNA, 25 bp, E. coli
cacacgctgcgttagaattaaatgg

SEQ ID NO: 35142 - DNA, 25 bp, E. coli
cacacgctgcgtaagaattaaatgg

SEQ ID NO: 35143 - DNA, 25 bp, E. coli
taaattagttgtatatcggcgagaa

SEQ ID NO: 35144 - DNA, 25 bp, E. coli
taaatctgctatgtctttatgtgac

SEQ ID NO: 35145 - DNA, 25 bp, E. coli
taaattagttgtttatcggcgagaa

SEQ ID NO: 35146 - DNA, 25 bp, E. coli
taaatctgctatctctttatgtgac

SEQ ID NO: 35147 - DNA, 25 bp, E. coli
gactaacttcacatacatccactta

SEQ ID NO: 35148 - DNA, 25 bp, E. coli
gactaacttcacttacatccactta

SEQ ID NO: 35149 - DNA, 25 bp, E. coli
tagaacagaaagaaatgtcaacgct

SEQ ID NO: 35150 - DNA, 25 bp, E. coli
tagaacagaaagtaatgtcaacgct

SEQ ID NO: 35151 - DNA, 25 bp, E. coli
tatttgctaacgtgtagtcaaccac

SEQ ID NO: 35152 - DNA, 25 bp, E. coli
tatttgctaacgagtagtcaaccac

SEQ ID NO: 35153 - DNA, 25 bp, E. coli
tgcacttgcatatcctgttgcatga

SEQ ID NO: 35154 - DNA, 25 bp, E. coli
tgcacttgcataacctgttgcatga

SEQ ID NO: 35155 - DNA, 25 bp, E. coli
tgccccgcgttgattttaggcgata

SEQ ID NO: 35156 - DNA, 25 bp, E. coli
tgccccgcgttgtttttaggcgata

SEQ ID NO: 35157 - DNA, 25 bp, E. coli
tcggcgagaaattacttaatagaac

SEQ ID NO: 35158 - DNA, 25 bp, E. coli
tcggcgagaaataacttaatagaac

SEQ ID NO: 35159 - DNA, 25 bp, E. coli
gtagtcaaccacacacgctgcgtaa

SEQ ID NO: 35160 - DNA, 25 bp, E. coli
gtagtcaaccactcacgctgcgtaa

SEQ ID NO: 35161 - DNA, 25 bp, E. coli
taatgtcaacgcattatggactgtt

SEQ ID NO: 35162 - DNA, 25 bp, E. coli
taatgtcaacgctttatggactgtt

SEQ ID NO: 35163 - DNA, 25 bp, E. coli
catggcagcattcaactggcgggta

SEQ ID NO: 35164 - DNA, 25 bp, E. coli
catggcagcattgaactggcgggta

SEQ ID NO: 35165 - DNA, 25 bp, E. coli
cagagcgtggcgaagtttttcagaa

SEQ ID NO: 35166 - DNA, 25 bp, E. coli
cagagcgtggcgtagtttttcagaa

SEQ ID NO: 35167 - DNA, 25 bp, E. coli
tacgccgattatggcggcaaaccgg

SEQ ID NO: 35168 - DNA, 25 bp, E. coli
tacaggacaacgtggcgttcggcct

SEQ ID NO: 35169 - DNA, 25 bp, E. coli
tacaggacaacgaggcgttcggcct

SEQ ID NO: 35170 - DNA, 25 bp, E. coli
taccgtggcgcaatgtacaggacaa

SEQ ID NO: 35171 - DNA, 25 bp, E. coli
tacgccgattatcgcggcaaaccgg

SEQ ID NO: 35172 - DNA, 25 bp, E. coli
taccgtggcgcattgtacaggacaa

SEQ ID NO: 35173 - DNA, 25 bp, E. coli
tcgccatgcgcgaatatgttttaag

SEQ ID NO: 35174 - DNA, 25 bp, E. coli
tttaagccgcgtttttgagcaacgg

SEQ ID NO: 35175 - DNA, 25 bp, E. coli
tttaagccgcgtatttgagcaacgg

SEQ ID NO: 35176 - DNA, 25 bp, E. coli
tcgccatgcgcgtatatgttttaag

SEQ ID NO: 35177 - DNA, 25 bp, E. coli
gctacatctggctgctttccggtgg

SEQ ID NO: 35178 - DNA, 25 bp, E. coli
gctacatctggcagctttccggtgg

SEQ ID NO: 35179 - DNA, 25 bp, E. coli
gaaggcgcagaataacgctacatct

SEQ ID NO: 35180 - DNA, 25 bp, E. coli
gaaggcgcagaaaaacgctacatct

SEQ ID NO: 35181 - DNA, 25 bp, E. coli
gatatcaacctgtcgctggaaagcg

SEQ ID NO: 35182 - DNA, 25 bp, E. coli
gatatcaacctgacgctggaaagcg

SEQ ID NO: 35183 - DNA, 25 bp, E. coli
tgagcaacgggaggcgttctcatga

SEQ ID NO: 35184 - DNA, 25 bp, E. coli
tgagcaacgggacgcgttctcatga

SEQ ID NO: 35185 - DNA, 25 bp, E. coli
tactacggcggcttattgcttggca

SEQ ID NO: 35186 - DNA, 25 bp, E. coli
tactacggcggcatattgcttggca

SEQ ID NO: 35187 - DNA, 25 bp, E. coli
tatcaggcattccttctgctgcggg

SEQ ID NO: 35188 - DNA, 25 bp, E. coli
tatcaggcattcgttctgctgcggg

SEQ ID NO: 35189 - DNA, 25 bp, E. coli
tgttgaatcggtgcgggcagaacac

SEQ ID NO: 35190 - DNA, 25 bp, E. coli
tgttgaatcggtccgggcagaacac

SEQ ID NO: 35191 - DNA, 25 bp, E. coli
tccggcggcgaaagtggctgaattt

SEQ ID NO: 35192 - DNA, 25 bp, E. coli
tccggcggcgaatgtggctgaattt

SEQ ID NO: 35193 - DNA, 25 bp, E. coli
ccggtcacggtcgttgaagagatca

SEQ ID NO: 35194 - DNA, 25 bp, E. coli
ccggtcacggtccttgaagagatca

SEQ ID NO: 35195 - DNA, 25 bp, E. coli
gaacggcaggtataccgatgctcgc

SEQ ID NO: 35196 - DNA, 25 bp, E. coli
gcagtgtgacgggaaaattatcaac

SEQ ID NO: 35197 - DNA, 25 bp, E. coli
gaacggcaggtaaaccgatgctcgc

SEQ ID NO: 35198 - DNA, 25 bp, E. coli
gcagtgtgacggcaaaattatcaac

SEQ ID NO: 35199 - DNA, 25 bp, E. coli
gaaagctggttatttcctgcggcac

SEQ ID NO: 35200 - DNA, 25 bp, E. coli
gaaagctggttaattcctgcggcac

SEQ ID NO: 35201 - DNA, 25 bp, E. coli
cgggtgcgccggttgattctcaaca

SEQ ID NO: 35202 - DNA, 25 bp, E. coli
cgggtgcgccggatgattctcaaca

SEQ ID NO: 35203 - DNA, 25 bp, E. coli
ggattttagccgaggttcattgcaa

SEQ ID NO: 35204 - DNA, 25 bp, E. coli
ggattttagccgtggttcattgcaa

SEQ ID NO: 35205 - DNA, 25 bp, E. coli
taaccggcattgtagcgttgctggg

SEQ ID NO: 35206 - DNA, 25 bp, E. coli
taaccggcattgaagcgttgctggg

SEQ ID NO: 35207 - DNA, 25 bp, E. coli
caaatcgcgcgtaatgaataaagat

SEQ ID NO: 35208 - DNA, 25 bp, E. coli
caaatcgcgcgttatgaataaagat

SEQ ID NO: 35209 - DNA, 25 bp, E. coli
caggttagcaaactttaatacgccg

SEQ ID NO: 35210 - DNA, 25 bp, E. coli
caggttagcaaagtttaatacgccg

SEQ ID NO: 35211 - DNA, 25 bp, E. coli
tacgccgaacccgtgttttgatcaa

SEQ ID NO: 35212 - DNA, 25 bp, E. coli
tacgccgaacccctgttttgatcaa

SEQ ID NO: 35213 - DNA, 25 bp, E. coli
tagtcatacaacctgtttgaattgg

SEQ ID NO: 35214 - DNA, 25 bp, E. coli
tagtcatacaacgtgtttgaattgg

SEQ ID NO: 35215 - DNA, 25 bp, E. coli
ttatgagaaaagtgtggcgcggatc

SEQ ID NO: 35216 - DNA, 25 bp, E. coli
ttatgagaaaagagtggcgcggatc

SEQ ID NO: 35217 - DNA, 25 bp, E. coli
tttgaattggtaggacaggttagca

SEQ ID NO: 35218 - DNA, 25 bp, E. coli
tttgaattggtacgacaggttagca

SEQ ID NO: 35219 - DNA, 25 bp, E. coli
gaaaaacgccttttcctggatcata

SEQ ID NO: 35220 - DNA, 25 bp, E. coli
gaaaaacgccttatcctggatcata

SEQ ID NO: 35221 - DNA, 25 bp, E. coli
gaacacattgcaatcaaatcgcgcg

SEQ ID NO: 35222 - DNA, 25 bp, E. coli
gaacacattgcattcaaatcgcgcg

SEQ ID NO: 35223 - DNA, 25 bp, E. coli
cgcggatcatggtttaatcgaggaa

SEQ ID NO: 35224 - DNA, 25 bp, E. coli
cgcggatcatggattaatcgaggaa

SEQ ID NO: 35225 - DNA, 25 bp, E. coli
gggttcccttctgattagtcataca

SEQ ID NO: 35226 - DNA, 25 bp, E. coli
gggttcccttctcattagtcataca

SEQ ID NO: 35227 - DNA, 25 bp, E. coli
tcaactcctgatcattaatgagcag

SEQ ID NO: 35228 - DNA, 25 bp, E. coli
tcaactcctgatgattaatgagcag

SEQ ID NO: 35229 - DNA, 25 bp, E. coli
caccgctggcgaaggaagcattaat

SEQ ID NO: 35230 - DNA, 25 bp, E. coli
caccgctggcgatggaagcattaat

SEQ ID NO: 35231 - DNA, 25 bp, E. coli
actcattagataaacccgtgccggg

SEQ ID NO: 35232 - DNA, 25 bp, E. coli
aaatttgtgcactccgtaatggcgg

SEQ ID NO: 35233 - DNA, 25 bp, E. coli
aaatttgtgcacaccgtaatggcgg

SEQ ID NO: 35234 - DNA, 25 bp, E. coli
actcattagatatacccgtgccggg

SEQ ID NO: 35235 - DNA, 25 bp, E. coli
tatgaagtcgcggaagtacaaccgg

SEQ ID NO: 35236 - DNA, 25 bp, E. coli
tatcgcaaggcaatcgtgagccgca

SEQ ID NO: 35237 - DNA, 25 bp, E. coli
tatgaatcatgtcacagccgcacag

SEQ ID NO: 35238 - DNA, 25 bp, E. coli
tatgaatcatgtgacagccgcacag

SEQ ID NO: 35239 - DNA, 25 bp, E. coli
tatgaagtcgcgcaagtacaaccgg

SEQ ID NO: 35240 - DNA, 25 bp, E. coli
tatcgcaaggcattcgtgagccgca

SEQ ID NO: 35241 - DNA, 25 bp, E. coli
tctacctgatgcagaaatatgcccg

SEQ ID NO: 35242 - DNA, 25 bp, E. coli
tctacctgatgctgaaatatgcccg

SEQ ID NO: 35243 - DNA, 25 bp, E. coli
gacaccctgcgtttggagatgacca

SEQ ID NO: 35244 - DNA, 25 bp, E. coli
gaaaccatttacctggtcaccggca

SEQ ID NO: 35245 - DNA, 25 bp, E. coli
gaaaccatttacgtggtcaccggca

SEQ ID NO: 35246 - DNA, 25 bp, E. coli
gacaccctgcgtatggagatgacca

SEQ ID NO: 35247 - DNA, 25 bp, E. coli
cctggtatttacagcgcggacggga

SEQ ID NO: 35248 - DNA, 25 bp, E. coli
cctggtatttactgcgcggacggga

SEQ ID NO: 35249 - DNA, 25 bp, E. coli
gacgctgcgtgggaaaatcgaccag

SEQ ID NO: 35250 - DNA, 25 bp, E. coli
gacgctgcgtggcaaaatcgaccag

SEQ ID NO: 35251 - DNA, 25 bp, E. coli
cacgatgtctgggactacgctttgt

SEQ ID NO: 35252 - DNA, 25 bp, E. coli
cacgatgtctggcactacgctttgt

SEQ ID NO: 35253 - DNA, 25 bp, E. coli
tacgctttgtggagtttaatccagc

SEQ ID NO: 35254 - DNA, 25 bp, E. coli
cactacgctttgtggagtttaatcc

SEQ ID NO: 35255 - DNA, 25 bp, E. coli
cactacgctttgaggagtttaatcc

SEQ ID NO: 35256 - DNA, 25 bp, E. coli
tacgctttgtggtgtttaatccagc

SEQ ID NO: 35257 - DNA, 25 bp, E. coli
tttctggtgcgcattcgtgcgcagc

SEQ ID NO: 35258 - DNA, 25 bp, E. coli
tttgtggagttttatccagcaaagt

SEQ ID NO: 35259 - DNA, 25 bp, E. coli
tttgtggagtttaatccagcaaagt

SEQ ID NO: 35260 - DNA, 25 bp, E. coli
ttcgtgcgcagcagttatgggcctg

SEQ ID NO: 35261 - DNA, 25 bp, E. coli
tttctggtgcgctttcgtgcgcagc

SEQ ID NO: 35262 - DNA, 25 bp, E. coli
ttcgtgcgcagctgttatgggcctg

SEQ ID NO: 35263 - DNA, 25 bp, E. coli
tgtctggcactaggctttgtggagt

SEQ ID NO: 35264 - DNA, 25 bp, E. coli
cgctttgtggagtttaatccagcaa

SEQ ID NO: 35265 - DNA, 25 bp, E. coli
cgctttgtggagattaatccagcaa

SEQ ID NO: 35266 - DNA, 25 bp, E. coli
cattcgtgcgcagctgttatgggcc

SEQ ID NO: 35267 - DNA, 25 bp, E. coli
cattcgtgcgcacctgttatgggcc

SEQ ID NO: 35268 - DNA, 25 bp, E. coli
ggtgcgcattcgagcgcagctgtta

SEQ ID NO: 35269 - DNA, 25 bp, E. coli
ggtgcgcattcgtgcgcagctgtta

SEQ ID NO: 35270 - DNA, 25 bp, E. coli
tgtctggcactacgctttgtggagt

SEQ ID NO: 35271 - DNA, 25 bp, E. coli
gatgtctggcacaacgctttgtgga

SEQ ID NO: 35272 - DNA, 25 bp, E. coli
gatgtctggcactacgctttgtgga

SEQ ID NO: 35273 - DNA, 25 bp, E. coli
caatggttgttacagaagggcaagc

SEQ ID NO: 35274 - DNA, 25 bp, E. coli
aatgggcggctcagcaggtttctgc

SEQ ID NO: 35275 - DNA, 25 bp, E. coli
caatggttgttagagaagggcaagc

SEQ ID NO: 35276 - DNA, 25 bp, E. coli
aatgggcggctctgcaggtttctgc

SEQ ID NO: 35277 - DNA, 25 bp, E. coli
ttgattaatactgcccaatgggcgg

SEQ ID NO: 35278 - DNA, 25 bp, E. coli
ttatatcgggcctaccaagccctgg

SEQ ID NO: 35279 - DNA, 25 bp, E. coli
ttatatcgggccaaccaagccctgg

SEQ ID NO: 35280 - DNA, 25 bp, E. coli
ttgattaatactccccaatgggcgg

SEQ ID NO: 35281 - DNA, 25 bp, E. coli
tgcagcaggtgtatttccaggaaac

SEQ ID NO: 35282 - DNA, 25 bp, E. coli
tgcagcaggtgtttttccaggaaac

SEQ ID NO: 35283 - DNA, 25 bp, E. coli
tcgtaagtatttagatgccctggcg

SEQ ID NO: 35284 - DNA, 25 bp, E. coli
tgccctggcgttccagtataaaacc

SEQ ID NO: 35285 - DNA, 25 bp, E. coli
tgccctggcgttgcagtataaaacc

SEQ ID NO: 35286 - DNA, 25 bp, E. coli
tcgtaagtattttgatgccctggcg

SEQ ID NO: 35287 - DNA, 25 bp, E. coli
tctggacatcgcatatggaactgac

SEQ ID NO: 35288 - DNA, 25 bp, E. coli
tctggacatcgcttatggaactgac

SEQ ID NO: 35289 - DNA, 25 bp, E. coli
gctgactggtgggaaaaacgcgccc

SEQ ID NO: 35290 - DNA, 25 bp, E. coli
gctgactggtggcaaaaacgcgccc

SEQ ID NO: 35291 - DNA, 25 bp, E. coli
gattaatggtgaacgactgcgctca

SEQ ID NO: 35292 - DNA, 25 bp, E. coli
gattaatggtgatcgactgcgctca

SEQ ID NO: 35293 - DNA, 25 bp, E. coli
tacggcgttgctcaaaccgaacaat

SEQ ID NO: 35294 - DNA, 25 bp, E. coli
tacggcgttgctgaaaccgaacaat

SEQ ID NO: 35295 - DNA, 25 bp, E. coli
taaagaagcgcgctatcacctgcgt

SEQ ID NO: 35296 - DNA, 25 bp, E. coli
taaagaagcgcggtatcacctgcgt

SEQ ID NO: 35297 - DNA, 25 bp, E. coli
tacccgtctgatcgaaagccgtgat

SEQ ID NO: 35298 - DNA, 25 bp, E. coli
tacccgtctgatggaaagccgtgat

SEQ ID NO: 35299 - DNA, 25 bp, E. coli
tatcagggcaaatgatgcagcaggc

SEQ ID NO: 35300 - DNA, 25 bp, E. coli
tatcagggcaaaagatgcagcaggc

SEQ ID NO: 35301 - DNA, 25 bp, E. coli
ttttgccgggatgaacgaagccaca

SEQ ID NO: 35302 - DNA, 25 bp, E. coli
ttttgccgggatcaacgaagccaca

SEQ ID NO: 35303 - DNA, 25 bp, E. coli
tgcagcaggccatcaacaagttgtg

SEQ ID NO: 35304 - DNA, 25 bp, E. coli
tgcagcaggccaacaacaagttgtg

SEQ ID NO: 35305 - DNA, 25 bp, E. coli
gccgaactgttcgatgccgacgaga

SEQ ID NO: 35306 - DNA, 25 bp, E. coli
gccgaactgttccatgccgacgaga

SEQ ID NO: 35307 - DNA, 25 bp, E. coli
gcaccggaactggaaatcgatctcg

SEQ ID NO: 35308 - DNA, 25 bp, E. coli
gaagccacattgaacgtaccgcaag

SEQ ID NO: 35309 - DNA, 25 bp, E. coli
gcaccggaactgcaaatcgatctcg

SEQ ID NO: 35310 - DNA, 25 bp, E. coli
gaagccacattgtacgtaccgcaag

SEQ ID NO: 35311 - DNA, 25 bp, E. coli
gaaatgcagtatctccagcgtgtct

SEQ ID NO: 35312 - DNA, 25 bp, E. coli
gaaatgcagtatgtccagcgtgtct

SEQ ID NO: 35313 - DNA, 25 bp, E. coli
cgatttattaggtcaggcacgcaac

SEQ ID NO: 35314 - DNA, 25 bp, E. coli
cgatttattaggacaggcacgcaac

SEQ ID NO: 35315 - DNA, 25 bp, E. coli
taacggcttacaccttgcgcctggg

SEQ ID NO: 35316 - DNA, 25 bp, E. coli
taacggcttacagcttgcgcctggg

SEQ ID NO: 35317 - DNA, 25 bp, E. coli
tacaattaggaacgaagcgggacag

SEQ ID NO: 35318 - DNA, 25 bp, E. coli
tacaattaggaaggaagcgggacag

SEQ ID NO: 35319 - DNA, 25 bp, E. coli
gaactaacggacacctttcgggatg

SEQ ID NO: 35320 - DNA, 25 bp, E. coli
gaactaacggactcctttcgggatg

SEQ ID NO: 35321 - DNA, 25 bp, E. coli
tatcgccagatgaaattggtgacac

SEQ ID NO: 35322 - DNA, 25 bp, E. coli
tatcgccagatgtaattggtgacac

SEQ ID NO: 35323 - DNA, 25 bp, E. coli
ttttcatactagcactaacccgcag

SEQ ID NO: 35324 - DNA, 25 bp, E. coli
ttttcatactaggactaacccgcag

SEQ ID NO: 35325 - DNA, 25 bp, E. coli
ttatgcataaaataggccgcttacg

SEQ ID NO: 35326 - DNA, 25 bp, E. coli
ttatgcataaaaaaggccgcttacg

SEQ ID NO: 35327 - DNA, 25 bp, E. coli
ccaggattgctctgaatatgacgta

SEQ ID NO: 35328 - DNA, 25 bp, E. coli
ccaggattgctcagaatatgacgta

SEQ ID NO: 35329 - DNA, 25 bp, E. coli
gcttacgcggccatagtgattacac

SEQ ID NO: 35330 - DNA, 25 bp, E. coli
gcgggacaggacacactttttcata

SEQ ID NO: 35331 - DNA, 25 bp, E. coli
gcttacgcggccttagtgattacac

SEQ ID NO: 35332 - DNA, 25 bp, E. coli
gcgggacaggactcactttttcata

SEQ ID NO: 35333 - DNA, 25 bp, E. coli
gaaaaaacttactgacctggacttg

SEQ ID NO: 35334 - DNA, 25 bp, E. coli
gaaaaaacttacagacctggacttg

SEQ ID NO: 35335 - DNA, 25 bp, E. coli
cccgcagcaggtaaaagcagtttgc

SEQ ID NO: 35336 - DNA, 25 bp, E. coli
cccgcagcaggttaaagcagtttgc

SEQ ID NO: 35337 - DNA, 25 bp, E. coli
tggacttgccctctcgtttgttagc

SEQ ID NO: 35338 - DNA, 25 bp, E. coli
tggacttgccctgtcgtttgttagc

SEQ ID NO: 35339 - DNA, 25 bp, E. coli
agagacgtaatcactggcgcagcca

SEQ ID NO: 35340 - DNA, 25 bp, E. coli
agagacgtaatctctggcgcagcca

SEQ ID NO: 35341 - DNA, 25 bp, E. coli
aaagcaagggctatcagacccgtgg

SEQ ID NO: 35342 - DNA, 25 bp, E. coli
aaagcaagggctttcagacccgtgg

SEQ ID NO: 35343 - DNA, 25 bp, E. coli
tattatactacatgcacaacgatgc

SEQ ID NO: 35344 - DNA, 25 bp, E. coli
tattatactacaagcacaacgatgc

SEQ ID NO: 35345 - DNA, 25 bp, E. coli
tgctaataactgaaaagcaagggct

SEQ ID NO: 35346 - DNA, 25 bp, E. coli
tgctaataactgtaaagcaagggct

SEQ ID NO: 35347 - DNA, 25 bp, E. coli
tcccaattgttagaacggagtaatt

SEQ ID NO: 35348 - DNA, 25 bp, E. coli
tcagacccgtggcttcgactgggta

SEQ ID NO: 35349 - DNA, 25 bp, E. coli
tcccaattgttacaacggagtaatt

SEQ ID NO: 35350 - DNA, 25 bp, E. coli
tcagacccgtgggttcgactgggta

SEQ ID NO: 35351 - DNA, 25 bp, E. coli
gcacaacgatgctctcagagacgta

SEQ ID NO: 35352 - DNA, 25 bp, E. coli
gcacaacgatgcactcagagacgta

SEQ ID NO: 35353 - DNA, 25 bp, E. coli
cgactgggtaatctttctatgcaat

SEQ ID NO: 35354 - DNA, 25 bp, E. coli
cgactgggtaatgtttctatgcaat

SEQ ID NO: 35355 - DNA, 25 bp, E. coli
cgtaatgtggttgtttatgcatcac

SEQ ID NO: 35356 - DNA, 25 bp, E. coli
cgtaatgtggttctttatgcatcac

SEQ ID NO: 35357 - DNA, 25 bp, E. coli
gatacagtgatatatacaatgcgaa

SEQ ID NO: 35358 - DNA, 25 bp, E. coli
gatacagtgataaatacaatgcgaa

SEQ ID NO: 35359 - DNA, 25 bp, E. coli
ggcgcagccagatgttaatttataa

SEQ ID NO: 35360 - DNA, 25 bp, E. coli
ggcgcagccagaagttaatttataa

SEQ ID NO: 35361 - DNA, 25 bp, E. coli
caagttcttcagcaatatcggtgtt

SEQ ID NO: 35362 - DNA, 25 bp, E. coli
caagttcttcaggaatatcggtgtt

SEQ ID NO: 35363 - DNA, 25 bp, E. coli
caccggcggcagttcaagttcttca

SEQ ID NO: 35364 - DNA, 25 bp, E. coli
caccggcggcagatcaagttcttca

SEQ ID NO: 35365 - DNA, 25 bp, E. coli
taaaacgcgcgtgttcaatgatacc

SEQ ID NO: 35366 - DNA, 25 bp, E. coli
taaaacgcgcgtcttcaatgatacc

SEQ ID NO: 35367 - DNA, 25 bp, E. coli
acccattcggtgtccagggagctgg

SEQ ID NO: 35368 - DNA, 25 bp, E. coli
acccattcggtgaccagggagctgg

SEQ ID NO: 35369 - DNA, 25 bp, E. coli
ttgtcaaaggaacccacgttacgcg

SEQ ID NO: 35370 - DNA, 25 bp, E. coli
ttgtcaaaggaagccacgttacgcg

SEQ ID NO: 35371 - DNA, 25 bp, E. coli
tgcttttatagtccgcaatggcggc

SEQ ID NO: 35372 - DNA, 25 bp, E. coli
tgcttttatagtgcgcaatggcggc

SEQ ID NO: 35373 - DNA, 25 bp, E. coli
gcttcgtcgagacacttccctttca

SEQ ID NO: 35374 - DNA, 25 bp, E. coli
gcttcgtcgagagacttccctttca

SEQ ID NO: 35375 - DNA, 25 bp, E. coli
gctttgatcgcgacttctgccagaa

SEQ ID NO: 35376 - DNA, 25 bp, E. coli
gctttgatcgcgtcttctgccagaa

SEQ ID NO: 35377 - DNA, 25 bp, E. coli
gaacagtgaattttcaccggcggca

SEQ ID NO: 35378 - DNA, 25 bp, E. coli
gaacagtgaattatcaccggcggca

SEQ ID NO: 35379 - DNA, 25 bp, E. coli
gacgttctcgtcgttgttgtcaaag

SEQ ID NO: 35380 - DNA, 25 bp, E. coli
cgcggattctcgaaatggtcgataa

SEQ ID NO: 35381 - DNA, 25 bp, E. coli
cgcggattctcgtaatggtcgataa

SEQ ID NO: 35382 - DNA, 25 bp, E. coli
gacgttctcgtccttgttgtcaaag

SEQ ID NO: 35383 - DNA, 25 bp, E. coli
aatagaaagagagtagtcccctact

SEQ ID NO: 35384 - DNA, 25 bp, E. coli
taattcatttccacacaggataagt

SEQ ID NO: 35385 - DNA, 25 bp, E. coli
taattcatttcctcacaggataagt

SEQ ID NO: 35386 - DNA, 25 bp, E. coli
aatagaaagagactagtcccctact

SEQ ID NO: 35387 - DNA, 25 bp, E. coli
tacacctgtaagtaaatccgcgcac

SEQ ID NO: 35388 - DNA, 25 bp, E. coli
tacacctgtaagaaaatccgcgcac

SEQ ID NO: 35389 - DNA, 25 bp, E. coli
aggctattagcctacacctgtaaga

SEQ ID NO: 35390 - DNA, 25 bp, E. coli
aggctattagccaacacctgtaaga

SEQ ID NO: 35391 - DNA, 25 bp, E. coli
aacactatgagagatgatgcttaac

SEQ ID NO: 35392 - DNA, 25 bp, E. coli
aacactatgagacatgatgcttaac

SEQ ID NO: 35393 - DNA, 25 bp, E. coli
tatatccatgttggcgataatccct

SEQ ID NO: 35394 - DNA, 25 bp, E. coli
tatatccatgttcgcgataatccct

SEQ ID NO: 35395 - DNA, 25 bp, E. coli
tccgcgcacaattgaagccagagtc

SEQ ID NO: 35396 - DNA, 25 bp, E. coli
tccgcgcacaatagaagccagagtc

SEQ ID NO: 35397 - DNA, 25 bp, E. coli
gctccattcacgaaaattgcgcgga

SEQ ID NO: 35398 - DNA, 25 bp, E. coli
gctccattcacgtaaattgcgcgga

SEQ ID NO: 35399 - DNA, 25 bp, E. coli
gataatccctttctatgtactgtgc

SEQ ID NO: 35400 - DNA, 25 bp, E. coli
gtactgtgcatcatcgctattacaa

SEQ ID NO: 35401 - DNA, 25 bp, E. coli
gtactgtgcatcttcgctattacaa

SEQ ID NO: 35402 - DNA, 25 bp, E. coli
gaccttagtctatgcgctccattca

SEQ ID NO: 35403 - DNA, 25 bp, E. coli
gaccttagtctaagcgctccattca

SEQ ID NO: 35404 - DNA, 25 bp, E. coli
gataatccctttgtatgtactgtgc

SEQ ID NO: 35405 - DNA, 25 bp, E. coli
ttacaggatttgctcgaaaacggtg

SEQ ID NO: 35406 - DNA, 25 bp, E. coli
ttacaggatttggtcgaaaacggtg

SEQ ID NO: 35407 - DNA, 25 bp, E. coli
tgctggaagacagattcgatatttc

SEQ ID NO: 35408 - DNA, 25 bp, E. coli
tgctggatgtcaaaacccctgcgca

SEQ ID NO: 35409 - DNA, 25 bp, E. coli
tcgtcaacgatcatggcctggagtc

SEQ ID NO: 35410 - DNA, 25 bp, E. coli
tgctggatgtcataacccctgcgca

SEQ ID NO: 35411 - DNA, 25 bp, E. coli
tgctggaagacacattcgatatttc

SEQ ID NO: 35412 - DNA, 25 bp, E. coli
tcgtcaacgatcttggcctggagtc

SEQ ID NO: 35413 - DNA, 25 bp, E. coli
gcccgacagcgatctcgtcaacgat

SEQ ID NO: 35414 - DNA, 25 bp, E. coli
gcccgacagcgaactcgtcaacgat

SEQ ID NO: 35415 - DNA, 25 bp, E. coli
cctgcgcaattaatggaaactctac

SEQ ID NO: 35416 - DNA, 25 bp, E. coli
cctgcgcaattattggaaactctac

SEQ ID NO: 35417 - DNA, 25 bp, E. coli
gaaactctacttccatggctggaga

SEQ ID NO: 35418 - DNA, 25 bp, E. coli
gaaactctacttgcatggctggaga

SEQ ID NO: 35419 - DNA, 25 bp, E. coli
gattacatcctttcctgtttacagg

SEQ ID NO: 35420 - DNA, 25 bp, E. coli
gattacatccttacctgtttacagg

SEQ ID NO: 35421 - DNA, 25 bp, E. coli
tggcctggagtcgatcaaagtgatg

SEQ ID NO: 35422 - DNA, 25 bp, E. coli
tggcctggagtccatcaaagtgatg

SEQ ID NO: 35423 - DNA, 25 bp, E. coli
tgtggaaattaagcccgacagcgat

SEQ ID NO: 35424 - DNA, 25 bp, E. coli
tgtggaaattaaccccgacagcgat

SEQ ID NO: 35425 - DNA, 25 bp, E. coli
gatggatctctttatgatgctggaa

SEQ ID NO: 35426 - DNA, 25 bp, E. coli
gatggatctcttaatgatgctggaa

SEQ ID NO: 35427 - DNA, 25 bp, E. coli
aagaagtttattatgcgcgtcgcgc

SEQ ID NO: 35428 - DNA, 25 bp, E. coli
aagaagtttattttgcgcgtcgcgc

SEQ ID NO: 35429 - DNA, 25 bp, E. coli
tattcaccactgataacggccgaag

SEQ ID NO: 35430 - DNA, 25 bp, E. coli
tattcaccactgttaacggccgaag

SEQ ID NO: 35431 - DNA, 25 bp, E. coli
tgagtcagaataggctgaaagttca

SEQ ID NO: 35432 - DNA, 25 bp, E. coli
tgagtcagaatacgctgaaagttca

SEQ ID NO: 35433 - DNA, 25 bp, E. coli
tcgccgccggatcatcgagagtaac

SEQ ID NO: 35434 - DNA, 25 bp, E. coli
tcgccgccggatgatcgagagtaac

SEQ ID NO: 35435 - DNA, 25 bp, E. coli
gaacccagtgattacgatttggccg

SEQ ID NO: 35436 - DNA, 25 bp, E. coli
gaacccagtgataacgatttggccg

SEQ ID NO: 35437 - DNA, 25 bp, E. coli
gaactgttatcggagggagccacac

SEQ ID NO: 35438 - DNA, 25 bp, E. coli
gaactgttatcgcagggagccacac

SEQ ID NO: 35439 - DNA, 25 bp, E. coli
ccgttatggcaaacgtggtctggcg

SEQ ID NO: 35440 - DNA, 25 bp, E. coli
ccgttatggcaatcgtggtctggcg

SEQ ID NO: 35441 - DNA, 25 bp, E. coli
cgatttggccgaagaggaactgtta

SEQ ID NO: 35442 - DNA, 25 bp, E. coli
cgatttggccgatgaggaactgtta

SEQ ID NO: 35443 - DNA, 25 bp, E. coli
gtggtaaaaattccccgccgttatg

SEQ ID NO: 35444 - DNA, 25 bp, E. coli
gtggtaaaaattgcccgccgttatg

SEQ ID NO: 35445 - DNA, 25 bp, E. coli
gagtaacttgcgtctggtggtaaaa

SEQ ID NO: 35446 - DNA, 25 bp, E. coli
gacgcgactcagctttaccttggtg

SEQ ID NO: 35447 - DNA, 25 bp, E. coli
gacgcgactcaggtttaccttggtg

SEQ ID NO: 35448 - DNA, 25 bp, E. coli
gagtaacttgcgactggtggtaaaa

SEQ ID NO: 35449 - DNA, 25 bp, E. coli
caggcactggaacatcaacttggca

SEQ ID NO: 35450 - DNA, 25 bp, E. coli
cagttgttcatcaaagtcgcggagc

SEQ ID NO: 35451 - DNA, 25 bp, E. coli
caggcactggaagatcaacttggca

SEQ ID NO: 35452 - DNA, 25 bp, E. coli
caggatgccaccagtatcagcggta

SEQ ID NO: 35453 - DNA, 25 bp, E. coli
cagttgttcatctaagtcgcggagc

SEQ ID NO: 35454 - DNA, 25 bp, E. coli
caggatgccacctgtatcagcggta

SEQ ID NO: 35455 - DNA, 25 bp, E. coli
taaacctgtttatgcagtggctggc

SEQ ID NO: 35456 - DNA, 25 bp, E. coli
taaacctgtttaagcagtggctggc

SEQ ID NO: 35457 - DNA, 25 bp, E. coli
aactgagtagccttgaccgtccggt

SEQ ID NO: 35458 - DNA, 25 bp, E. coli
aactgagtagccatgaccgtccggt

SEQ ID NO: 35459 - DNA, 25 bp, E. coli
ttaccggaagatggcgttatcgccc

SEQ ID NO: 35460 - DNA, 25 bp, E. coli
ttaccggaagatcgcgttatcgccc

SEQ ID NO: 35461 - DNA, 25 bp, E. coli
tgtttcgcgccagatacaggcactg

SEQ ID NO: 35462 - DNA, 25 bp, E. coli
tgtttcgcgccacatacaggcactg

SEQ ID NO: 35463 - DNA, 25 bp, E. coli
tctggcggcatgatgacggtaaaca

SEQ ID NO: 35464 - DNA, 25 bp, E. coli
tctggcggcatgttgacggtaaaca

SEQ ID NO: 35465 - DNA, 25 bp, E. coli
gggtcaaactcaggccagaaggcat

SEQ ID NO: 35466 - DNA, 25 bp, E. coli
gggtcaaactcacgccagaaggcat

SEQ ID NO: 35467 - DNA, 25 bp, E. coli
tggaaagtttttcccgcgcagcgga

SEQ ID NO: 35468 - DNA, 25 bp, E. coli
tggtttatccgcagcgtcgggagct

SEQ ID NO: 35469 - DNA, 25 bp, E. coli
tggtttatccgctgcgtcgggagct

SEQ ID NO: 35470 - DNA, 25 bp, E. coli
tggaaagtttttgccgcgcagcgga

SEQ ID NO: 35471 - DNA, 25 bp, E. coli
aagtttcgtgcttattcggcttccg

SEQ ID NO: 35472 - DNA, 25 bp, E. coli
caactttaaaagctgagagccatca

SEQ ID NO: 35473 - DNA, 25 bp, E. coli
aagtttcgtgctaattcggcttccg

SEQ ID NO: 35474 - DNA, 25 bp, E. coli
caactttaaaaggtgagagccatca

SEQ ID NO: 35475 - DNA, 25 bp, E. coli
actggcgcggcctgcagcgagattt

SEQ ID NO: 35476 - DNA, 25 bp, E. coli
actggcgcggccagcagcgagattt

SEQ ID NO: 35477 - DNA, 25 bp, E. coli
tgtagggacattacctgacgacagc

SEQ ID NO: 35478 - DNA, 25 bp, E. coli
tgtagggacatttcctgacgacagc

SEQ ID NO: 35479 - DNA, 25 bp, E. coli
tcttcggactctggaaattggtgtg

SEQ ID NO: 35480 - DNA, 25 bp, E. coli
tgacgacagcaacgccagtactggc

SEQ ID NO: 35481 - DNA, 25 bp, E. coli
tcttcggactctcgaaattggtgtg

SEQ ID NO: 35482 - DNA, 25 bp, E. coli
tgacgacagcaaggccagtactggc

SEQ ID NO: 35483 - DNA, 25 bp, E. coli
tctaacaaatgaatgaatcggcaat

SEQ ID NO: 35484 - DNA, 25 bp, E. coli
tctaacaaatgattgaatcggcaat

SEQ ID NO: 35485 - DNA, 25 bp, E. coli
gcgacggcagaatgataacttgtca

SEQ ID NO: 35486 - DNA, 25 bp, E. coli
gcgacggcagaaagataacttgtca

SEQ ID NO: 35487 - DNA, 25 bp, E. coli
gcagcgagattttccactttgagag

SEQ ID NO: 35488 - DNA, 25 bp, E. coli
gcagcgagatttaccactttgagag

SEQ ID NO: 35489 - DNA, 25 bp, E. coli
cgacttatgattagcgacggcagaa

SEQ ID NO: 35490 - DNA, 25 bp, E. coli
cgacttatgatttgcgacggcagaa

SEQ ID NO: 35491 - DNA, 25 bp, E. coli
ggcaatttgcataccgtcgacttat

SEQ ID NO: 35492 - DNA, 25 bp, E. coli
ggcaatttgcattccgtcgacttat

SEQ ID NO: 35493 - DNA, 25 bp, E. coli
aaggtattcgcttatggcgcgaaaa

SEQ ID NO: 35494 - DNA, 25 bp, E. coli
aaggtattcgctaatggcgcgaaaa

SEQ ID NO: 35495 - DNA, 25 bp, E. coli
aatgaaggtattggcttatggcgcg

SEQ ID NO: 35496 - DNA, 25 bp, E. coli
aatgaaggtattcgcttatggcgcg

SEQ ID NO: 35497 - DNA, 25 bp, E. coli
cacgcctgaatgaaggtattcgctt

SEQ ID NO: 35498 - DNA, 25 bp, E. coli
cacgcctgaatgtaggtattcgctt

SEQ ID NO: 35499 - DNA, 25 bp, E. coli
aggtattcgcttatggcgcgaaaat

SEQ ID NO: 35500 - DNA, 25 bp, E. coli
aggtattcgcttttggcgcgaaaat

SEQ ID NO: 35501 - DNA, 25 bp, E. coli
tgaaggtattcgcttatggcgcgaa

SEQ ID NO: 35502 - DNA, 25 bp, E. coli
tgaaggtattcggttatggcgcgaa

SEQ ID NO: 35503 - DNA, 25 bp, E. coli
ccacgcctgaatgaaggtattcgct

SEQ ID NO: 35504 - DNA, 25 bp, E. coli
gccacgcctgaatgaaggtattcgc

SEQ ID NO: 35505 - DNA, 25 bp, E. coli
cctgaatgaaggtattcgcttatgg

SEQ ID NO: 35506 - DNA, 25 bp, E. coli
gccacgcctgaaagaaggtattcgc

SEQ ID NO: 35507 - DNA, 25 bp, E. coli
ccacgcctgaatcaaggtattcgct

SEQ ID NO: 35508 - DNA, 25 bp, E. coli
cctgaatgaaggaattcgcttatgg

SEQ ID NO: 35509 - DNA, 25 bp, E. coli
gaaggtattcgcttatggcgcgaaa

SEQ ID NO: 35510 - DNA, 25 bp, E. coli
gaatgaaggtatacgcttatggcgc

SEQ ID NO: 35511 - DNA, 25 bp, E. coli
gaaggtattcgcatatggcgcgaaa

SEQ ID NO: 35512 - DNA, 25 bp, E. coli
gaatgaaggtattcgcttatggcgc

SEQ ID NO: 35513 - DNA, 25 bp, E. coli
cgcctgaatgaaggtattcgcttat

SEQ ID NO: 35514 - DNA, 25 bp, E. coli
cgcctgaatgaacgtattcgcttat

SEQ ID NO: 35515 - DNA, 25 bp, E. coli
actcggctcattaccggaaaatgtt

SEQ ID NO: 35516 - DNA, 25 bp, E. coli
atttctgaactcggctcattaccgg

SEQ ID NO: 35517 - DNA, 25 bp, E. coli
actcggctcatttccggaaaatgtt

SEQ ID NO: 35518 - DNA, 25 bp, E. coli
attgagtggcctctaatacctgaag

SEQ ID NO: 35519 - DNA, 25 bp, E. coli
attgagtggcctgtaatacctgaag

SEQ ID NO: 35520 - DNA, 25 bp, E. coli
atttctgaactccgctcattaccgg

SEQ ID NO: 35521 - DNA, 25 bp, E. coli
aactcggctcataaccggaaaatgt

SEQ ID NO: 35522 - DNA, 25 bp, E. coli
aactcggctcattaccggaaaatgt

SEQ ID NO: 35523 - DNA, 25 bp, E. coli
tatttctgaactgggctcattaccg

SEQ ID NO: 35524 - DNA, 25 bp, E. coli
tatttctgaactcggctcattaccg

SEQ ID NO: 35525 - DNA, 25 bp, E. coli
tattgagtggccagtaatacctgaa

SEQ ID NO: 35526 - DNA, 25 bp, E. coli
tattgagtggcctgtaatacctgaa

SEQ ID NO: 35527 - DNA, 25 bp, E. coli
ttgagtggcctgtaatacctgaagt

SEQ ID NO: 35528 - DNA, 25 bp, E. coli
ttgagtggcctgaaatacctgaagt

SEQ ID NO: 35529 - DNA, 25 bp, E. coli
tgagtggcctgttatacctgaagtt

SEQ ID NO: 35530 - DNA, 25 bp, E. coli
tgagtggcctgtaatacctgaagtt

SEQ ID NO: 35531 - DNA, 25 bp, E. coli
tctgaactcggctcattaccggaaa

SEQ ID NO: 35532 - DNA, 25 bp, E. coli
tctgaactcggcacattaccggaaa

SEQ ID NO: 35533 - DNA, 25 bp, E. coli
ctgaactcggctgattaccggaaaa

SEQ ID NO: 35534 - DNA, 25 bp, E. coli
ctgaactcggctcattaccggaaaa

SEQ ID NO: 35535 - DNA, 25 bp, E. coli
caactttgccctcgtttgctggcgc

SEQ ID NO: 35536 - DNA, 25 bp, E. coli
caactttgccctggtttgctggcgc

SEQ ID NO: 35537 - DNA, 25 bp, E. coli
cacgggctgggtttttgctacgaca

SEQ ID NO: 35538 - DNA, 25 bp, E. coli
cacgggctgggtatttgctacgaca

SEQ ID NO: 35539 - DNA, 25 bp, E. coli
taactttgaacgaattcacgggctg

SEQ ID NO: 35540 - DNA, 25 bp, E. coli
taaaagaggatctggttgcggcgct

SEQ ID NO: 35541 - DNA, 25 bp, E. coli
taaaagaggatcaggttgcggcgct

SEQ ID NO: 35542 - DNA, 25 bp, E. coli
tcttctttattttcaacgcggtgcg

SEQ ID NO: 35543 - DNA, 25 bp, E. coli
tcttctttatttacaacgcggtgcg

SEQ ID NO: 35544 - DNA, 25 bp, E. coli
ccaacggcgcggaaattgatgacgg

SEQ ID NO: 35545 - DNA, 25 bp, E. coli
ccaacggcgcggtaattgatgacgg

SEQ ID NO: 35546 - DNA, 25 bp, E. coli
cctacagctcgggtttcgcaaaggg

SEQ ID NO: 35547 - DNA, 25 bp, E. coli
cctacagctcggctttcgcaaaggg

SEQ ID NO: 35548 - DNA, 25 bp, E. coli
gctgcaaaaactcaccgaaggcgcg

SEQ ID NO: 35549 - DNA, 25 bp, E. coli
gctgcaaaaactgaccgaaggcgcg

SEQ ID NO: 35550 - DNA, 25 bp, E. coli
cattaacggcatcaaagtcggtctg

SEQ ID NO: 35551 - DNA, 25 bp, E. coli
cattaacggcatgaaagtcggtctg

SEQ ID NO: 35552 - DNA, 25 bp, E. coli
gatctggtgagcttgtttctgcgct

SEQ ID NO: 35553 - DNA, 25 bp, E. coli
gatctggtgagcatgtttctgcgct

SEQ ID NO: 35554 - DNA, 25 bp, E. coli
taactttgaacgtattcacgggctg

SEQ ID NO: 35555 - DNA, 25 bp, E. coli
gatgaagtggtatggcctacagctc

SEQ ID NO: 35556 - DNA, 25 bp, E. coli
gatgaagtggtaaggcctacagctc

SEQ ID NO: 35557 - DNA, 25 bp, E. coli
caacaatcagatgctgctggcggcg

SEQ ID NO: 35558 - DNA, 25 bp, E. coli
caacaatcagatcctgctggcggcg

SEQ ID NO: 35559 - DNA, 25 bp, E. coli
cattatcgaaaaaccgcagccgctg

SEQ ID NO: 35560 - DNA, 25 bp, E. coli
tttggcgaacgcgtaccgtgcagct

SEQ ID NO: 35561 - DNA, 25 bp, E. coli
tttggcgaacgcctaccgtgcagct

SEQ ID NO: 35562 - DNA, 25 bp, E. coli
tgaccgcgcaggtatcaccattggt

SEQ ID NO: 35563 - DNA, 25 bp, E. coli
tgaccgcgcaggaatcaccattggt

SEQ ID NO: 35564 - DNA, 25 bp, E. coli
tgacgaaatcgcaaccaacctgact

SEQ ID NO: 35565 - DNA, 25 bp, E. coli
tgacgaaatcgctaccaacctgact

SEQ ID NO: 35566 - DNA, 25 bp, E. coli
tcgagcgacgctaaccatatttcag

SEQ ID NO: 35567 - DNA, 25 bp, E. coli
tcgagcgacgcttaccatatttcag

SEQ ID NO: 35568 - DNA, 25 bp, E. coli
tcggcatgatcaacgccctgggaaa

SEQ ID NO: 35569 - DNA, 25 bp, E. coli
tcggcatgatcatcgccctgggaaa

SEQ ID NO: 35570 - DNA, 25 bp, E. coli
gcttatcccggaaaaattcgctgcg

SEQ ID NO: 35571 - DNA, 25 bp, E. coli
gcttatcccggataaattcgctgcg

SEQ ID NO: 35572 - DNA, 25 bp, E. coli
cattatcgaaaatccgcagccgctg

SEQ ID NO: 35573 - DNA, 25 bp, E. coli
gattaacggtttacacagcctcgaa

SEQ ID NO: 35574 - DNA, 25 bp, E. coli
gattaacggttttcacagcctcgaa

SEQ ID NO: 35575 - DNA, 25 bp, E. coli
taatcaggcgctcaccgatgcgcag

SEQ ID NO: 35576 - DNA, 25 bp, E. coli
taatcaggcgctgaccgatgcgcag

SEQ ID NO: 35577 - DNA, 25 bp, E. coli
gatgacgtcggcaatatcaacctgc

SEQ ID NO: 35578 - DNA, 25 bp, E. coli
gatgacgtcggctatatcaacctgc

SEQ ID NO: 35579 - DNA, 25 bp, E. coli
caaagactggtcacggttgccgact

SEQ ID NO: 35580 - DNA, 25 bp, E. coli
caaagactggtctcggttgccgact

SEQ ID NO: 35581 - DNA, 25 bp, E. coli
cagttgcttttacgcaatggtgcgg

SEQ ID NO: 35582 - DNA, 25 bp, E. coli
cagttgcttttaggcaatggtgcgg

SEQ ID NO: 35583 - DNA, 25 bp, E. coli
tccaggtctggtccctttgtcgaac

SEQ ID NO: 35584 - DNA, 25 bp, E. coli
tccaggtctggtgcctttgtcgaac

SEQ ID NO: 35585 - DNA, 25 bp, E. coli
tgaacatatgctaacagtaccggga

SEQ ID NO: 35586 - DNA, 25 bp, E. coli
tgaacatatgcttacagtaccggga

SEQ ID NO: 35587 - DNA, 25 bp, E. coli
tcagagcgatttgctgtgtcagccg

SEQ ID NO: 35588 - DNA, 25 bp, E. coli
gcaccaccgggttgcaattgccgga

SEQ ID NO: 35589 - DNA, 25 bp, E. coli
gaagtaccgtcgcagagattgcgca

SEQ ID NO: 35590 - DNA, 25 bp, E. coli
gaagtaccgtcggagagattgcgca

SEQ ID NO: 35591 - DNA, 25 bp, E. coli
gcaccaccgggtagcaattgccgga

SEQ ID NO: 35592 - DNA, 25 bp, E. coli
gttgccgactatccgccgccgttaa

SEQ ID NO: 35593 - DNA, 25 bp, E. coli
gattatgctggctatgccgaatgcc

SEQ ID NO: 35594 - DNA, 25 bp, E. coli
gttgccgactatgcgccgccgttaa

SEQ ID NO: 35595 - DNA, 25 bp, E. coli
gattatgctggcaatgccgaatgcc

SEQ ID NO: 35596 - DNA, 25 bp, E. coli
gggccactgcgagccagcattttct

SEQ ID NO: 35597 - DNA, 25 bp, E. coli
gggccactgcgacccagcattttct

SEQ ID NO: 35598 - DNA, 25 bp, E. coli
tcagagcgatttcctgtgtcagccg

SEQ ID NO: 35599 - DNA, 25 bp, E. coli
tcagcgttccgtaatggcagcggcg

SEQ ID NO: 35600 - DNA, 25 bp, E. coli
tcagcgttccgttatggcagcggcg

SEQ ID NO: 35601 - DNA, 25 bp, E. coli
ttttctggtgaatctcgccggacgg

SEQ ID NO: 35602 - DNA, 25 bp, E. coli
ttttctggtgaaactcgccggacgg

SEQ ID NO: 35603 - DNA, 25 bp, E. coli
tgatgatgccaccaccaaagcgttc

SEQ ID NO: 35604 - DNA, 25 bp, E. coli
tgatgatgccacgaccaaagcgttc

SEQ ID NO: 35605 - DNA, 25 bp, E. coli
ccagcctggcggttatgaatgaccc

SEQ ID NO: 35606 - DNA, 25 bp, E. coli
ccagcctggcggatatgaatgaccc

SEQ ID NO: 35607 - DNA, 25 bp, E. coli
gcattgattctcagcgcggtggcta

SEQ ID NO: 35608 - DNA, 25 bp, E. coli
gcattgattctctgcgcggtggcta

SEQ ID NO: 35609 - DNA, 25 bp, E. coli
gaaaatattcgcactcgcctgctgg

SEQ ID NO: 35610 - DNA, 25 bp, E. coli
gacaacggaagctaaacctgcacct

SEQ ID NO: 35611 - DNA, 25 bp, E. coli
gaaaatattcgctctcgcctgctgg

SEQ ID NO: 35612 - DNA, 25 bp, E. coli
gacaacggaagcaaaacctgcacct

SEQ ID NO: 35613 - DNA, 25 bp, E. coli
cgtatcaatctgcaaaaaagctggc

SEQ ID NO: 35614 - DNA, 25 bp, E. coli
cgttgctgaaaactgcagacgccag

SEQ ID NO: 35615 - DNA, 25 bp, E. coli
cgtatcaatctggaaaaaagctggc

SEQ ID NO: 35616 - DNA, 25 bp, E. coli
cgttgctgaaaagtgcagacgccag

SEQ ID NO: 35617 - DNA, 25 bp, E. coli
tggatcttccggaaaccctgcaaag

SEQ ID NO: 35618 - DNA, 25 bp, E. coli
tggccgataatgacagcgatggttc

SEQ ID NO: 35619 - DNA, 25 bp, E. coli
tggccgataatgtcagcgatggttc

SEQ ID NO: 35620 - DNA, 25 bp, E. coli
tggatcttccggtaaccctgcaaag

SEQ ID NO: 35621 - DNA, 25 bp, E. coli
gatgaagtccaacaaaaggtcgcca

SEQ ID NO: 35622 - DNA, 25 bp, E. coli
gatgaagtccaagaaaaggtcgcca

SEQ ID NO: 35623 - DNA, 25 bp, E. coli
caaaattctgttctgcgtggtgccg

SEQ ID NO: 35624 - DNA, 25 bp, E. coli
caaaattctgttgtgcgtggtgccg

SEQ ID NO: 35625 - DNA, 25 bp, E. coli
cagtttttactttacggcagcctcg

SEQ ID NO: 35626 - DNA, 25 bp, E. coli
cagtttttacttaacggcagcctcg

SEQ ID NO: 35627 - DNA, 25 bp, E. coli
tacttcggcgccttgtgcgtgctgg

SEQ ID NO: 35628 - DNA, 25 bp, E. coli
tacacctttgaggtgcagccgggct

SEQ ID NO: 35629 - DNA, 25 bp, E. coli
tacttcggcgccatgtgcgtgctgg

SEQ ID NO: 35630 - DNA, 25 bp, E. coli
tacacctttgagctgcagccgggct

SEQ ID NO: 35631 - DNA, 25 bp, E. coli
acaaaattggcttcgggctgggaga

SEQ ID NO: 35632 - DNA, 25 bp, E. coli
acaaaattggctacgggctgggaga

SEQ ID NO: 35633 - DNA, 25 bp, E. coli
tgtttttggtctcccgcgtgctcga

SEQ ID NO: 35634 - DNA, 25 bp, E. coli
tgtttttggtctgccgcgtgctcga

SEQ ID NO: 35635 - DNA, 25 bp, E. coli
tccgcacagggcaagatcatctacg

SEQ ID NO: 35636 - DNA, 25 bp, E. coli
tccgcacagggctagatcatctacg

SEQ ID NO: 35637 - DNA, 25 bp, E. coli
gccttcaagtggatcatcgtcgcct

SEQ ID NO: 35638 - DNA, 25 bp, E. coli
gccttcaagtggttcatcgtcgcct

SEQ ID NO: 35639 - DNA, 25 bp, E. coli
gaaagaccttaagctgctgctgggc

SEQ ID NO: 35640 - DNA, 25 bp, E. coli
gaaagaccttaacctgctgctgggc

SEQ ID NO: 35641 - DNA, 25 bp, E. coli
cgttcaagatgaaggcgacctgctc

SEQ ID NO: 35642 - DNA, 25 bp, E. coli
cgttcaagatgatggcgacctgctc

SEQ ID NO: 35643 - DNA, 25 bp, E. coli
gggcgacgctcttcttcgtgaaata

SEQ ID NO: 35644 - DNA, 25 bp, E. coli
gggcgacgctctacttcgtgaaata

SEQ ID NO: 35645 - DNA, 25 bp, E. coli
cagcgttttctgttggctcgattca

SEQ ID NO: 35646 - DNA, 25 bp, E. coli
cagcgttttctgatggctcgattca

SEQ ID NO: 35647 - DNA, 25 bp, E. coli
catcttttggatcttttttcagcgt

SEQ ID NO: 35648 - DNA, 25 bp, E. coli
catcttttggatgttttttcagcgt

SEQ ID NO: 35649 - DNA, 25 bp, E. coli
tacgggcgagttattccatcttttg

SEQ ID NO: 35650 - DNA, 25 bp, E. coli
tacgggcgagtttttccatcttttg

SEQ ID NO: 35651 - DNA, 25 bp, E. coli
ttttcagcgtttactgttggctcga

SEQ ID NO: 35652 - DNA, 25 bp, E. coli
ttttcagcgttttctgttggctcga

SEQ ID NO: 35653 - DNA, 25 bp, E. coli
tgttggctcgatacatcagaaaaaa

SEQ ID NO: 35654 - DNA, 25 bp, E. coli
tgttggctcgattcatcagaaaaaa

SEQ ID NO: 35655 - DNA, 25 bp, E. coli
tcgttacgggcgagtttttccatct

SEQ ID NO: 35656 - DNA, 25 bp, E. coli
tcgttacgggcgtgtttttccatct

SEQ ID NO: 35657 - DNA, 25 bp, E. coli
cgcggtcaagttttcaccgcaaagg

SEQ ID NO: 35658 - DNA, 25 bp, E. coli
cgcggtcaagttatcaccgcaaagg

SEQ ID NO: 35659 - DNA, 25 bp, E. coli
gttttctgttgggtcgattcatcag

SEQ ID NO: 35660 - DNA, 25 bp, E. coli
gttttctgttggctcgattcatcag

SEQ ID NO: 35661 - DNA, 25 bp, E. coli
ggtcaagttttcaccgcaaaggtat

SEQ ID NO: 35662 - DNA, 25 bp, E. coli
ggtcaagttttctccgcaaaggtat

SEQ ID NO: 35663 - DNA, 25 bp, E. coli
ggctcgattcatgagaaaaaatgtt

SEQ ID NO: 35664 - DNA, 25 bp, E. coli
ggcgagtttttcgatcttttggatg

SEQ ID NO: 35665 - DNA, 25 bp, E. coli
ggctcgattcatcagaaaaaatgtt

SEQ ID NO: 35666 - DNA, 25 bp, E. coli
ggcgagtttttccatcttttggatg

SEQ ID NO: 35667 - DNA, 25 bp, E. coli
cagcgactggagtatgacgaaccgg

SEQ ID NO: 35668 - DNA, 25 bp, E. coli
cagcgactggagaatgacgaaccgg

SEQ ID NO: 35669 - DNA, 25 bp, E. coli
catcacgggatttggctgagtcgca

SEQ ID NO: 35670 - DNA, 25 bp, E. coli
catcacgggattaggctgagtcgca

SEQ ID NO: 35671 - DNA, 25 bp, E. coli
cagtgtgatgttaagcgttgccagc

SEQ ID NO: 35672 - DNA, 25 bp, E. coli
cagtgtgatgtttagcgttgccagc

SEQ ID NO: 35673 - DNA, 25 bp, E. coli
aaccgggtagttctggcgatgccaa

SEQ ID NO: 35674 - DNA, 25 bp, E. coli
aaccgggtagttgtggcgatgccaa

SEQ ID NO: 35675 - DNA, 25 bp, E. coli
tattaatgccatcaccacgctggcg

SEQ ID NO: 35676 - DNA, 25 bp, E. coli
tattaatgccatgaccacgctggcg

SEQ ID NO: 35677 - DNA, 25 bp, E. coli
ttacgatggaaatgcaaattggcgc

SEQ ID NO: 35678 - DNA, 25 bp, E. coli
ttacgatggaaaagcaaattggcgc

SEQ ID NO: 35679 - DNA, 25 bp, E. coli
tcgagcgtagccttgcggaagaagt

SEQ ID NO: 35680 - DNA, 25 bp, E. coli
tcgagcgtagccatgcggaagaagt

SEQ ID NO: 35681 - DNA, 25 bp, E. coli
tcagtttgcatctgccggaagaggt

SEQ ID NO: 35682 - DNA, 25 bp, E. coli
tcagtttgcatcagccggaagaggt

SEQ ID NO: 35683 - DNA, 25 bp, E. coli
gccaatatcatgcatgcgccggaga

SEQ ID NO: 35684 - DNA, 25 bp, E. coli
gccaatatcatggatgcgccggaga

SEQ ID NO: 35685 - DNA, 25 bp, E. coli
cgcaatgccggaggactcagtgtga

SEQ ID NO: 35686 - DNA, 25 bp, E. coli
cgcaatgccggacgactcagtgtga

SEQ ID NO: 35687 - DNA, 25 bp, E. coli
taagtctgctgtaccgtgaactggc

SEQ ID NO: 35688 - DNA, 25 bp, E. coli
taagtctgctgttccgtgaactggc

SEQ ID NO: 35689 - DNA, 25 bp, E. coli
tagacaatcatactttgtcagtaag

SEQ ID NO: 35690 - DNA, 25 bp, E. coli
tagacaatcatagtttgtcagtaag

SEQ ID NO: 35691 - DNA, 25 bp, E. coli
tatatagacaatcatactttgtcag

SEQ ID NO: 35692 - DNA, 25 bp, E. coli
tatatagacaatgatactttgtcag

SEQ ID NO: 35693 - DNA, 25 bp, E. coli
ttcagagcattacttcgccatcctc

SEQ ID NO: 35694 - DNA, 25 bp, E. coli
ttcagagcattagttcgccatcctc

SEQ ID NO: 35695 - DNA, 25 bp, E. coli
gcgattttatatttagacaatcata

SEQ ID NO: 35696 - DNA, 25 bp, E. coli
gcgattttatatatagacaatcata

SEQ ID NO: 35697 - DNA, 25 bp, E. coli
gaatgatggcaatcaatgtcagtca

SEQ ID NO: 35698 - DNA, 25 bp, E. coli
gaatgatggcaaacaatgtcagtca

SEQ ID NO: 35699 - DNA, 25 bp, E. coli
cgaatgatggcaaacaatgtcagtc

SEQ ID NO: 35700 - DNA, 25 bp, E. coli
cgaatgatggcatacaatgtcagtc

SEQ ID NO: 35701 - DNA, 25 bp, E. coli
gtcaacctgattaaacattactcct

SEQ ID NO: 35702 - DNA, 25 bp, E. coli
gtcgaatgatgggaaacaatgtcag

SEQ ID NO: 35703 - DNA, 25 bp, E. coli
gtcaacctgatttaacattactcct

SEQ ID NO: 35704 - DNA, 25 bp, E. coli
gtcgaatgatggcaaacaatgtcag

SEQ ID NO: 35705 - DNA, 25 bp, E. coli
tggcaaacaatgtcagtcatatgtc

SEQ ID NO: 35706 - DNA, 25 bp, E. coli
tggcaaacaatgacagtcatatgtc

SEQ ID NO: 35707 - DNA, 25 bp, E. coli
tcaacctgattatacattactcctc

SEQ ID NO: 35708 - DNA, 25 bp, E. coli
tcaacctgattaaacattactcctc

SEQ ID NO: 35709 - DNA, 25 bp, E. coli
gatggcaaacaaagtcagtcatatg

SEQ ID NO: 35710 - DNA, 25 bp, E. coli
gatggcaaacaatgtcagtcatatg

SEQ ID NO: 35711 - DNA, 25 bp, E. coli
caagcattgagaatgtaagcgtgac

SEQ ID NO: 35712 - DNA, 25 bp, E. coli
caagcattgagattgtaagcgtgac

SEQ ID NO: 35713 - DNA, 25 bp, E. coli
caccggcagcacgtagactaaaaat

SEQ ID NO: 35714 - DNA, 25 bp, E. coli
caccggcagcacctagactaaaaat

SEQ ID NO: 35715 - DNA, 25 bp, E. coli
tacttatatccagcaagcgaacggg

SEQ ID NO: 35716 - DNA, 25 bp, E. coli
tacttatatccaccaagcgaacggg

SEQ ID NO: 35717 - DNA, 25 bp, E. coli
taaaaatacgcaatgaaacatcggt

SEQ ID NO: 35718 - DNA, 25 bp, E. coli
taaaaatacgcattgaaacatcggt

SEQ ID NO: 35719 - DNA, 25 bp, E. coli
attttatggctaccgtctgctcgcg

SEQ ID NO: 35720 - DNA, 25 bp, E. coli
attttatggctagcgtctgctcgcg

SEQ ID NO: 35721 - DNA, 25 bp, E. coli
gctcgcgatgatatgcgccagatca

SEQ ID NO: 35722 - DNA, 25 bp, E. coli
gctcgcgatgatttgcgccagatca

SEQ ID NO: 35723 - DNA, 25 bp, E. coli
gattgagagagatcgtgacccaccc

SEQ ID NO: 35724 - DNA, 25 bp, E. coli
gatcataacttacatcgccaaggag

SEQ ID NO: 35725 - DNA, 25 bp, E. coli
gatcataacttagatcgccaaggag

SEQ ID NO: 35726 - DNA, 25 bp, E. coli
gattgagagagaacgtgacccaccc

SEQ ID NO: 35727 - DNA, 25 bp, E. coli
ggtattacctctttctgagcatccg

SEQ ID NO: 35728 - DNA, 25 bp, E. coli
ggtattacctctatctgagcatccg

SEQ ID NO: 35729 - DNA, 25 bp, E. coli
taatcctgtacacagtagctgcttc

SEQ ID NO: 35730 - DNA, 25 bp, E. coli
taagcgtgacacattctcggcgaca

SEQ ID NO: 35731 - DNA, 25 bp, E. coli
taatcctgtacagagtagctgcttc

SEQ ID NO: 35732 - DNA, 25 bp, E. coli
taagcgtgacactttctcggcgaca

SEQ ID NO: 35733 - DNA, 25 bp, E. coli
tactgaaactggttcgctaccgggt

SEQ ID NO: 35734 - DNA, 25 bp, E. coli
tacaggaaaaagacagcgaaggcag

SEQ ID NO: 35735 - DNA, 25 bp, E. coli
tactgaaactggatcgctaccgggt

SEQ ID NO: 35736 - DNA, 25 bp, E. coli
tacaggaaaaagtcagcgaaggcag

SEQ ID NO: 35737 - DNA, 25 bp, E. coli
agtaaccatccgttcagcatgtggg

SEQ ID NO: 35738 - DNA, 25 bp, E. coli
agtaaccatccgatcagcatgtggg

SEQ ID NO: 35739 - DNA, 25 bp, E. coli
tacgacttcagtcaggtgccggaac

SEQ ID NO: 35740 - DNA, 25 bp, E. coli
tatgcaatgaagtactcctgtggcg

SEQ ID NO: 35741 - DNA, 25 bp, E. coli
tatgcaatgaagaactcctgtggcg

SEQ ID NO: 35742 - DNA, 25 bp, E. coli
tacgacttcagtgaggtgccggaac

SEQ ID NO: 35743 - DNA, 25 bp, E. coli
tgaatggagctcagttccggcaact

SEQ ID NO: 35744 - DNA, 25 bp, E. coli
tgcaggaactacctaaagccagagc

SEQ ID NO: 35745 - DNA, 25 bp, E. coli
tgcgtcgttataaaaaggaggcccg

SEQ ID NO: 35746 - DNA, 25 bp, E. coli
tgcaggaactacgtaaagccagagc

SEQ ID NO: 35747 - DNA, 25 bp, E. coli
tgaatggagctctgttccggcaact

SEQ ID NO: 35748 - DNA, 25 bp, E. coli
tgcgtcgttatataaaggaggcccg

SEQ ID NO: 35749 - DNA, 25 bp, E. coli
tcctgtggcgcgtgagtgaaaaact

SEQ ID NO: 35750 - DNA, 25 bp, E. coli
tcctgtggcgcgagagtgaaaaact

SEQ ID NO: 35751 - DNA, 25 bp, E. coli
gccagttgccaaaacgctaagcgaa

SEQ ID NO: 35752 - DNA, 25 bp, E. coli
gccagttgccaatacgctaagcgaa

SEQ ID NO: 35753 - DNA, 25 bp, E. coli
gaaaacgttctggtgttcggagcca

SEQ ID NO: 35754 - DNA, 25 bp, E. coli
gaaaacgttctgctgttcggagcca

SEQ ID NO: 35755 - DNA, 25 bp, E. coli
aatgtgcagactaccgtcgtaccgg

SEQ ID NO: 35756 - DNA, 25 bp, E. coli
aatgtgcagacttccgtcgtaccgg

SEQ ID NO: 35757 - DNA, 25 bp, E. coli
tatcaaaggccgcaccgaagttgct

SEQ ID NO: 35758 - DNA, 25 bp, E. coli
tatcaaaggccggaccgaagttgct

SEQ ID NO: 35759 - DNA, 25 bp, E. coli
ttgaaatcggtcagcgcccgtggga

SEQ ID NO: 35760 - DNA, 25 bp, E. coli
ttgaaatcggtctgcgcccgtggga

SEQ ID NO: 35761 - DNA, 25 bp, E. coli
tatgaaaccccgcacgctgtagaag

SEQ ID NO: 35762 - DNA, 25 bp, E. coli
tatgaaaccccggacgctgtagaag

SEQ ID NO: 35763 - DNA, 25 bp, E. coli
tgccgaagcggtgattatcgacacg

SEQ ID NO: 35764 - DNA, 25 bp, E. coli
tcgtcagcgacttcaccggtggtca

SEQ ID NO: 35765 - DNA, 25 bp, E. coli
tcgtcagcgactacaccggtggtca

SEQ ID NO: 35766 - DNA, 25 bp, E. coli
tgccgaagcggtcattatcgacacg

SEQ ID NO: 35767 - DNA, 25 bp, E. coli
tcgtgaccaacgtagataaagctgc

SEQ ID NO: 35768 - DNA, 25 bp, E. coli
tcgtgaccaacgaagataaagctgc

SEQ ID NO: 35769 - DNA, 25 bp, E. coli
ccatgctggcgaacatgcgtgacga

SEQ ID NO: 35770 - DNA, 25 bp, E. coli
ccatgctggcgatcatgcgtgacga

SEQ ID NO: 35771 - DNA, 25 bp, E. coli
gaagttgctgtggtatacgatccta

SEQ ID NO: 35772 - DNA, 25 bp, E. coli
gaagttgctgtgctatacgatccta

SEQ ID NO: 35773 - DNA, 25 bp, E. coli
cgtgacgagttaagcgacgctctga

SEQ ID NO: 35774 - DNA, 25 bp, E. coli
cgtgacgagttatgcgacgctctga

SEQ ID NO: 35775 - DNA, 25 bp, E. coli
gtaacatcgttgctggtaacccgcg

SEQ ID NO: 35776 - DNA, 25 bp, E. coli
gtaacatcgttggtggtaacccgcg

SEQ ID NO: 35777 - DNA, 25 bp, E. coli
caagggcgcacgttgagcgttatct

SEQ ID NO: 35778 - DNA, 25 bp, E. coli
caagggcgcacgatgagcgttatct

SEQ ID NO: 35779 - DNA, 25 bp, E. coli
tatgatcaaggcgatgagcaggcaa

SEQ ID NO: 35780 - DNA, 25 bp, E. coli
tatgatcaaggccatgagcaggcaa

SEQ ID NO: 35781 - DNA, 25 bp, E. coli
ttacctgtagctggtgttccgcgca

SEQ ID NO: 35782 - DNA, 25 bp, E. coli
ttacctgtagctcgtgttccgcgca

SEQ ID NO: 35783 - DNA, 25 bp, E. coli
tggtggaacaaaaattgcgcttggc

SEQ ID NO: 35784 - DNA, 25 bp, E. coli
tggtggaacaaatattgcgcttggc

SEQ ID NO: 35785 - DNA, 25 bp, E. coli
tgaaaattatctgtctggtcgcggt

SEQ ID NO: 35786 - DNA, 25 bp, E. coli
tgaaaattatctctctggtcgcggt

SEQ ID NO: 35787 - DNA, 25 bp, E. coli
gaagatggtacggtgtatgccgcca

SEQ ID NO: 35788 - DNA, 25 bp, E. coli
gaatttcccggctatcacaacgcaa

SEQ ID NO: 35789 - DNA, 25 bp, E. coli
gaatttcccggcaatcacaacgcaa

SEQ ID NO: 35790 - DNA, 25 bp, E. coli
gaagatggtacgctgtatgccgcca

SEQ ID NO: 35791 - DNA, 25 bp, E. coli
cgtggtgcggccatcctacatctaa

SEQ ID NO: 35792 - DNA, 25 bp, E. coli
cgtggtgcggccttcctacatctaa

SEQ ID NO: 35793 - DNA, 25 bp, E. coli
tggtggtggcttttcgaatttcccg

SEQ ID NO: 35794 - DNA, 25 bp, E. coli
tggtggtggcttatcgaatttcccg

SEQ ID NO: 35795 - DNA, 25 bp, E. coli
gacctgagcgcaggtcttgatcgcg

SEQ ID NO: 35796 - DNA, 25 bp, E. coli
gatgtacgccttgataacgatgcca

SEQ ID NO: 35797 - DNA, 25 bp, E. coli
gacctgagcgcacgtcttgatcgcg

SEQ ID NO: 35798 - DNA, 25 bp, E. coli
gatgtacgccttcataacgatgcca

SEQ ID NO: 35799 - DNA, 25 bp, E. coli
caatcatctggtagcgaagctgaaa

SEQ ID NO: 35800 - DNA, 25 bp, E. coli
caatcatctggttgcgaagctgaaa

SEQ ID NO: 35801 - DNA, 25 bp, E. coli
cagatagcctctaacggtcgtggtt

SEQ ID NO: 35802 - DNA, 25 bp, E. coli
cagatagcctcttacggtcgtggtt

SEQ ID NO: 35803 - DNA, 25 bp, E. coli
tacgctaattgaagccggtgctgac

SEQ ID NO: 35804 - DNA, 25 bp, E. coli
tacgctaattgatgccggtgctgac

SEQ ID NO: 35805 - DNA, 25 bp, E. coli
tgtacaaccgatcaaagcggcgacg

SEQ ID NO: 35806 - DNA, 25 bp, E. coli
tgtacaaccgatgaaagcggcgacg

SEQ ID NO: 35807 - DNA, 25 bp, E. coli
tcatcgagcaacttattaatgagcc

SEQ ID NO: 35808 - DNA, 25 bp, E. coli
tcatcgagcaacatattaatgagcc

SEQ ID NO: 35809 - DNA, 25 bp, E. coli
ccagttgaaggagcgcaaagaaggc

SEQ ID NO: 35810 - DNA, 25 bp, E. coli
ccagttgaaggaccgcaaagaaggc

SEQ ID NO: 35811 - DNA, 25 bp, E. coli
gccaggccgcgttgcgtcataatgt

SEQ ID NO: 35812 - DNA, 25 bp, E. coli
gccaggccgcgtagcgtcataatgt

SEQ ID NO: 35813 - DNA, 25 bp, E. coli
gcagggatttggtatttccgccccg

SEQ ID NO: 35814 - DNA, 25 bp, E. coli
gcagggatttggaatttccgccccg

SEQ ID NO: 35815 - DNA, 25 bp, E. coli
gaaggcgcattcgttcctttcgtca

SEQ ID NO: 35816 - DNA, 25 bp, E. coli
gaaggcgcattccttcctttcgtca

SEQ ID NO: 35817 - DNA, 25 bp, E. coli
gaatctctgtttgcccagttgaagg

SEQ ID NO: 35818 - DNA, 25 bp, E. coli
gaatctctgtttccccagttgaagg

SEQ ID NO: 35819 - DNA, 25 bp, E. coli
gatggcccgacgtttcaaaacgcca

SEQ ID NO: 35820 - DNA, 25 bp, E. coli
gatggcccgacgattcaaaacgcca

SEQ ID NO: 35821 - DNA, 25 bp, E. coli
caatgggcccgctatttctggcgga

SEQ ID NO: 35822 - DNA, 25 bp, E. coli
aatgatttcacctcgttccgtgcgg

SEQ ID NO: 35823 - DNA, 25 bp, E. coli
aatgatttcaccacgttccgtgcgg

SEQ ID NO: 35824 - DNA, 25 bp, E. coli
caatgggcccgcaatttctggcgga

SEQ ID NO: 35825 - DNA, 25 bp, E. coli
catattaatgtcacgcgtcacggtc

SEQ ID NO: 35826 - DNA, 25 bp, E. coli
catttttacgaagcgctggacgctg

SEQ ID NO: 35827 - DNA, 25 bp, E. coli
catttttacgaaccgctggacgctg

SEQ ID NO: 35828 - DNA, 25 bp, E. coli
catattaatgtctcgcgtcacggtc

SEQ ID NO: 35829 - DNA, 25 bp, E. coli
agcctgatggaagtcggtgcccaca

SEQ ID NO: 35830 - DNA, 25 bp, E. coli
agcctgatggaactcggtgcccaca

SEQ ID NO: 35831 - DNA, 25 bp, E. coli
tatggtcaggaaaattgtcggcagc

SEQ ID NO: 35832 - DNA, 25 bp, E. coli
tatggtcaggaatattgtcggcagc

SEQ ID NO: 35833 - DNA, 25 bp, E. coli
ttttcatgcccgttttagcgccacg

SEQ ID NO: 35834 - DNA, 25 bp, E. coli
ttttcatgcccgatttagcgccacg

SEQ ID NO: 35835 - DNA, 25 bp, E. coli
tgatcttccaaatccgccaatgggc

SEQ ID NO: 35836 - DNA, 25 bp, E. coli
tgatcttccaaaaccgccaatgggc

SEQ ID NO: 35837 - DNA, 25 bp, E. coli
tgctggcggcaatggacagaacgct

SEQ ID NO: 35838 - DNA, 25 bp, E. coli
tgctggcggcaaaggacagaacgct

SEQ ID NO: 35839 - DNA, 25 bp, E. coli
ccgggcaggttgtgcatttcgaaac

SEQ ID NO: 35840 - DNA, 25 bp, E. coli
ccgggcaggttgagcatttcgaaac

SEQ ID NO: 35841 - DNA, 25 bp, E. coli
taagtattacggctggcaacggcag

SEQ ID NO: 35842 - DNA, 25 bp, E. coli
taagtattacgggtggcaacggcag

SEQ ID NO: 35843 - DNA, 25 bp, E. coli
cagcattggtgcacaactgccggat

SEQ ID NO: 35844 - DNA, 25 bp, E. coli
cagcattggtgctcaactgccggat

SEQ ID NO: 35845 - DNA, 25 bp, E. coli
ctaccgatccgggacaagtttgtag

SEQ ID NO: 35846 - DNA, 25 bp, E. coli
atccagcattggagcacaactgccg

SEQ ID NO: 35847 - DNA, 25 bp, E. coli
ctaccgatccggcacaagtttgtag

SEQ ID NO: 35848 - DNA, 25 bp, E. coli
agcattggtgcacaactgccggatg

SEQ ID NO: 35849 - DNA, 25 bp, E. coli
agcattggtgcagaactgccggatg

SEQ ID NO: 35850 - DNA, 25 bp, E. coli
atccagcattggtgcacaactgccg

SEQ ID NO: 35851 - DNA, 25 bp, E. coli
tatccagcattggtgcacaactgcc

SEQ ID NO: 35852 - DNA, 25 bp, E. coli
tatccagcattgctgcacaactgcc

SEQ ID NO: 35853 - DNA, 25 bp, E. coli
tccagcattggtgcacaactgccgg

SEQ ID NO: 35854 - DNA, 25 bp, E. coli
tccagcattggtccacaactgccgg

SEQ ID NO: 35855 - DNA, 25 bp, E. coli
gcctaccgatcccgcacaagtttgt

SEQ ID NO: 35856 - DNA, 25 bp, E. coli
ccagcattggtggacaactgccgga

SEQ ID NO: 35857 - DNA, 25 bp, E. coli
ccagcattggtgcacaactgccgga

SEQ ID NO: 35858 - DNA, 25 bp, E. coli
gcctaccgatccggcacaagtttgt

SEQ ID NO: 35859 - DNA, 25 bp, E. coli
gcattggtgcacaactgccggatgc

SEQ ID NO: 35860 - DNA, 25 bp, E. coli
gcattggtgcactactgccggatgc

SEQ ID NO: 35861 - DNA, 25 bp, E. coli
gtatccagcattggtgcacaactgc

SEQ ID NO: 35862 - DNA, 25 bp, E. coli
gtatccagcattcgtgcacaactgc

SEQ ID NO: 35863 - DNA, 25 bp, E. coli
ggcctaccgatccggcacaagtttg

SEQ ID NO: 35864 - DNA, 25 bp, E. coli
ggcctaccgatcgggcacaagtttg

SEQ ID NO: 35865 - DNA, 25 bp, E. coli
aaggtggatttggtccccgacagca

SEQ ID NO: 35866 - DNA, 25 bp, E. coli
aaggtggatttgctccccgacagca

SEQ ID NO: 35867 - DNA, 25 bp, E. coli
tttacgcgagcagacaaaagccatg

SEQ ID NO: 35868 - DNA, 25 bp, E. coli
tttacgcgagcacacaaaagccatg

SEQ ID NO: 35869 - DNA, 25 bp, E. coli
tgattctggaaaagtcccgcgccct

SEQ ID NO: 35870 - DNA, 25 bp, E. coli
tgattctggaaatgtcccgcgccct

SEQ ID NO: 35871 - DNA, 25 bp, E. coli
tgaagagatggctaacgcggtcacc

SEQ ID NO: 35872 - DNA, 25 bp, E. coli
tgaagagatggcaaacgcggtcacc

SEQ ID NO: 35873 - DNA, 25 bp, E. coli
gaatctctgaactgcgacagcgacg

SEQ ID NO: 35874 - DNA, 25 bp, E. coli
gaatctctgaacagcgacagcgacg

SEQ ID NO: 35875 - DNA, 25 bp, E. coli
gacagcgacgtggatatgcgcctca

SEQ ID NO: 35876 - DNA, 25 bp, E. coli
gacagcgacgtgcatatgcgcctca

SEQ ID NO: 35877 - DNA, 25 bp, E. coli
cccgtaatgagctgattgcccgtaa

SEQ ID NO: 35878 - DNA, 25 bp, E. coli
cccgtaatgagcagattgcccgtaa

SEQ ID NO: 35879 - DNA, 25 bp, E. coli
cgtgaaaaagaaatccgggccgcat

SEQ ID NO: 35880 - DNA, 25 bp, E. coli
cgtgaaaaagaattccgggccgcat

SEQ ID NO: 35881 - DNA, 25 bp, E. coli
taagccgctgctcgaaatgctgcgt

SEQ ID NO: 35882 - DNA, 25 bp, E. coli
taagccgctgctggaaatgctgcgt

SEQ ID NO: 35883 - DNA, 25 bp, E. coli
gatccgtgaggatatcaaccgtctg

SEQ ID NO: 35884 - DNA, 25 bp, E. coli
gatgagtgaacaccttgagtcccgt

SEQ ID NO: 35885 - DNA, 25 bp, E. coli
gatccgtgaggaaatcaaccgtctg

SEQ ID NO: 35886 - DNA, 25 bp, E. coli
gatgagtgaacagcttgagtcccgt

SEQ ID NO: 35887 - DNA, 25 bp, E. coli
cattattcttgaactgacggaagtc

SEQ ID NO: 35888 - DNA, 25 bp, E. coli
catcttcaaccaagcataaagcggg

SEQ ID NO: 35889 - DNA, 25 bp, E. coli
catcttcaaccatgcataaagcggg

SEQ ID NO: 35890 - DNA, 25 bp, E. coli
cattattcttgatctgacggaagtc

SEQ ID NO: 35891 - DNA, 25 bp, E. coli
tgccgaagtcaattggtcttaccaa

SEQ ID NO: 35892 - DNA, 25 bp, E. coli
tgccgaagtcaaatggtcttaccaa

SEQ ID NO: 35893 - DNA, 25 bp, E. coli
tgcacaaatgtacactttacgtagg

SEQ ID NO: 35894 - DNA, 25 bp, E. coli
tgcacaaatgtagactttacgtagg

SEQ ID NO: 35895 - DNA, 25 bp, E. coli
tcgctgccgcattccattattcttg

SEQ ID NO: 35896 - DNA, 25 bp, E. coli
tcgctgccgcataccattattcttg

SEQ ID NO: 35897 - DNA, 25 bp, E. coli
tcatgtctgtgaggctaaagtaaca

SEQ ID NO: 35898 - DNA, 25 bp, E. coli
tcatgtctgtgacgctaaagtaaca

SEQ ID NO: 35899 - DNA, 25 bp, E. coli
gcataaagcgggagcattcgctgcc

SEQ ID NO: 35900 - DNA, 25 bp, E. coli
gcataaagcgggtgcattcgctgcc

SEQ ID NO: 35901 - DNA, 25 bp, E. coli
gaaccgattcacttaccaattttgt

SEQ ID NO: 35902 - DNA, 25 bp, E. coli
gaaccgattcacataccaattttgt

SEQ ID NO: 35903 - DNA, 25 bp, E. coli
gattgaaatcatgaaactgtgcaca

SEQ ID NO: 35904 - DNA, 25 bp, E. coli
gattgaaatcatcaaactgtgcaca

SEQ ID NO: 35905 - DNA, 25 bp, E. coli
ggaattgcaaacatacacacgcatc

SEQ ID NO: 35906 - DNA, 25 bp, E. coli
ggaattgcaaacttacacacgcatc

SEQ ID NO: 35907 - DNA, 25 bp, E. coli
gaggctgagctttacaaacggtttc

SEQ ID NO: 35908 - DNA, 25 bp, E. coli
gaggctgagcttaacaaacggtttc

SEQ ID NO: 35909 - DNA, 25 bp, E. coli
caactgttatttgcgatcctcatga

SEQ ID NO: 35910 - DNA, 25 bp, E. coli
caactgttatttccgatcctcatga

SEQ ID NO: 35911 - DNA, 25 bp, E. coli
ttactggcacctcgtaagcaggctg

SEQ ID NO: 35912 - DNA, 25 bp, E. coli
ttactggcacctggtaagcaggctg

SEQ ID NO: 35913 - DNA, 25 bp, E. coli
tgacaactgttaattgcgatcctca

SEQ ID NO: 35914 - DNA, 25 bp, E. coli
tgacaactgttatttgcgatcctca

SEQ ID NO: 35915 - DNA, 25 bp, E. coli
tcgcggcctgacaactgttatttgc

SEQ ID NO: 35916 - DNA, 25 bp, E. coli
tcgcggcctgactactgttatttgc

SEQ ID NO: 35917 - DNA, 25 bp, E. coli
gcctgacaactgttatttgcgatcc

SEQ ID NO: 35918 - DNA, 25 bp, E. coli
gcctgacaactgatatttgcgatcc

SEQ ID NO: 35919 - DNA, 25 bp, E. coli
gcctcgcggcctgacaactgttatt

SEQ ID NO: 35920 - DNA, 25 bp, E. coli
gcctcgcggcctcacaactgttatt

SEQ ID NO: 35921 - DNA, 25 bp, E. coli
gcacctggtaaggaggctgatatcg

SEQ ID NO: 35922 - DNA, 25 bp, E. coli
gcacctggtaagcaggctgatatcg

SEQ ID NO: 35923 - DNA, 25 bp, E. coli
ctggcacctggttagcaggctgata

SEQ ID NO: 35924 - DNA, 25 bp, E. coli
ctggcacctggtaagcaggctgata

SEQ ID NO: 35925 - DNA, 25 bp, E. coli
ctggtaagcagggtgatatcgtcct

SEQ ID NO: 35926 - DNA, 25 bp, E. coli
ctggtaagcaggctgatatcgtcct

SEQ ID NO: 35927 - DNA, 25 bp, E. coli
ctttgaaaccgcgaccctgcctcgc

SEQ ID NO: 35928 - DNA, 25 bp, E. coli
ctttgaaaccgccaccctgcctcgc

SEQ ID NO: 35929 - DNA, 25 bp, E. coli
tggttttgagcggaatgatgtgtgc

SEQ ID NO: 35930 - DNA, 25 bp, E. coli
tggttttgagcgcaatgatgtgtgc

SEQ ID NO: 35931 - DNA, 25 bp, E. coli
aatattgccgccatgaagaaaggag

SEQ ID NO: 35932 - DNA, 25 bp, E. coli
aatattgccgccttgaagaaaggag

SEQ ID NO: 35933 - DNA, 25 bp, E. coli
caaacgtttgcgagactgctttaca

SEQ ID NO: 35934 - DNA, 25 bp, E. coli
caaacgtttgcgtgactgctttaca

SEQ ID NO: 35935 - DNA, 25 bp, E. coli
ttttcggatggaataatcttctttc

SEQ ID NO: 35936 - DNA, 25 bp, E. coli
ttttcggatggattaatcttctttc

SEQ ID NO: 35937 - DNA, 25 bp, E. coli
tttttgcacgtcttttccccaggcg

SEQ ID NO: 35938 - DNA, 25 bp, E. coli
tttttgcacgtcatttccccaggcg

SEQ ID NO: 35939 - DNA, 25 bp, E. coli
tgcgagactgctttacacaaccttt

SEQ ID NO: 35940 - DNA, 25 bp, E. coli
tgcgagactgctatacacaaccttt

SEQ ID NO: 35941 - DNA, 25 bp, E. coli
tctaacagggaatgcaaacgtttgc

SEQ ID NO: 35942 - DNA, 25 bp, E. coli
tctaacagggaaagcaaacgtttgc

SEQ ID NO: 35943 - DNA, 25 bp, E. coli
ccttgaagaaaggaggtataatccg

SEQ ID NO: 35944 - DNA, 25 bp, E. coli
ccttgaagaaagcaggtataatccg

SEQ ID NO: 35945 - DNA, 25 bp, E. coli
gctttacacaacctttttgcacgtc

SEQ ID NO: 35946 - DNA, 25 bp, E. coli
gctttacacaacgtttttgcacgtc

SEQ ID NO: 35947 - DNA, 25 bp, E. coli
gaaaggaggtataatccgtcgattt

SEQ ID NO: 35948 - DNA, 25 bp, E. coli
gaaaggaggtattatccgtcgattt

SEQ ID NO: 35949 - DNA, 25 bp, E. coli
cgcaattctaacagggaaagcaaac

SEQ ID NO: 35950 - DNA, 25 bp, E. coli
cgcaattctaactgggaaagcaaac

SEQ ID NO: 35951 - DNA, 25 bp, E. coli
gatggaataatcttctttcataacc

SEQ ID NO: 35952 - DNA, 25 bp, E. coli
gatggaataatcatctttcataacc

SEQ ID NO: 35953 - DNA, 25 bp, E. coli
taaaaacggacttgatgatgatctc

SEQ ID NO: 35954 - DNA, 25 bp, E. coli
tacttcaaagtatcgacactattcg

SEQ ID NO: 35955 - DNA, 25 bp, E. coli
tacttcaaagtaacgacactattcg

SEQ ID NO: 35956 - DNA, 25 bp, E. coli
taaaaacggactagatgatgatctc

SEQ ID NO: 35957 - DNA, 25 bp, E. coli
aaatctttggcaatttgaactacgc

SEQ ID NO: 35958 - DNA, 25 bp, E. coli
aaatctttggcattttgaactacgc

SEQ ID NO: 35959 - DNA, 25 bp, E. coli
tgctcagaggtctaagtcaaatctt

SEQ ID NO: 35960 - DNA, 25 bp, E. coli
tgctcagaggtcaaagtcaaatctt

SEQ ID NO: 35961 - DNA, 25 bp, E. coli
ccatcatgcgatgagagaagcgctg

SEQ ID NO: 35962 - DNA, 25 bp, E. coli
ccatcatgcgatcagagaagcgctg

SEQ ID NO: 35963 - DNA, 25 bp, E. coli
gacttaagtgaattgctcagaggtc

SEQ ID NO: 35964 - DNA, 25 bp, E. coli
gaaagcatttgttgcccatcatgcg

SEQ ID NO: 35965 - DNA, 25 bp, E. coli
gaaagcatttgtagcccatcatgcg

SEQ ID NO: 35966 - DNA, 25 bp, E. coli
gacttaagtgaaatgctcagaggtc

SEQ ID NO: 35967 - DNA, 25 bp, E. coli
gatagatacctctgaaagcatttgt

SEQ ID NO: 35968 - DNA, 25 bp, E. coli
gatagatacctcagaaagcatttgt

SEQ ID NO: 35969 - DNA, 25 bp, E. coli
tggagagcaacaatgaatcaaaatc

SEQ ID NO: 35970 - DNA, 25 bp, E. coli
tggagagcaacattgaatcaaaatc

SEQ ID NO: 35971 - DNA, 25 bp, E. coli
taatggcatttggtgtacttcaaag

SEQ ID NO: 35972 - DNA, 25 bp, E. coli
taatggcatttgctgtacttcaaag

SEQ ID NO: 35973 - DNA, 25 bp, E. coli
gagaaaaagttcataacaaatcgcc

SEQ ID NO: 35974 - DNA, 25 bp, E. coli
gagaaaaagttcttaacaaatcgcc

SEQ ID NO: 35975 - DNA, 25 bp, E. coli
caactgaagctgctgcgtctgtcga

SEQ ID NO: 35976 - DNA, 25 bp, E. coli
caactgaagctggtgcgtctgtcga

SEQ ID NO: 35977 - DNA, 25 bp, E. coli
catataaaaagtgtggccgatccgt

SEQ ID NO: 35978 - DNA, 25 bp, E. coli
catataaaaagtctggccgatccgt

SEQ ID NO: 35979 - DNA, 25 bp, E. coli
attcatgaagctccgctcccggtgg

SEQ ID NO: 35980 - DNA, 25 bp, E. coli
attcatgaagctgcgctcccggtgg

SEQ ID NO: 35981 - DNA, 25 bp, E. coli
aaaatgtgttggttgcgactgcggc

SEQ ID NO: 35982 - DNA, 25 bp, E. coli
aaaatgtgttggatgcgactgcggc

SEQ ID NO: 35983 - DNA, 25 bp, E. coli
tgaaaagcctctcctataagcggat

SEQ ID NO: 35984 - DNA, 25 bp, E. coli
tgaaaagcctctgctataagcggat

SEQ ID NO: 35985 - DNA, 25 bp, E. coli
tgcggcagcaaaacagtctggtgac

SEQ ID NO: 35986 - DNA, 25 bp, E. coli
tgcggcagcaaatcagtctggtgac

SEQ ID NO: 35987 - DNA, 25 bp, E. coli
tcttcgggcttgagagcaaagtgca

SEQ ID NO: 35988 - DNA, 25 bp, E. coli
tcttcgggcttgtgagcaaagtgca

SEQ ID NO: 35989 - DNA, 25 bp, E. coli
gaatacctggcaacgttgggcacaa

SEQ ID NO: 35990 - DNA, 25 bp, E. coli
gaatgggctgactctcttacgccga

SEQ ID NO: 35991 - DNA, 25 bp, E. coli
gaatgggctgacactcttacgccga

SEQ ID NO: 35992 - DNA, 25 bp, E. coli
gaatacctggcatcgttgggcacaa

SEQ ID NO: 35993 - DNA, 25 bp, E. coli
gaaatattctctcgatgcagcgctg

SEQ ID NO: 35994 - DNA, 25 bp, E. coli
gaaatattctctggatgcagcgctg

SEQ ID NO: 35995 - DNA, 25 bp, E. coli
ccgccaggagcttgcagaatgggct

SEQ ID NO: 35996 - DNA, 25 bp, E. coli
ccgccaggagctagcagaatgggct

SEQ ID NO: 35997 - DNA, 25 bp, E. coli
caccgatgcttctggaagccgaaga

SEQ ID NO: 35998 - DNA, 25 bp, E. coli
caccgatgcttcaggaagccgaaga

SEQ ID NO: 35999 - DNA, 25 bp, E. coli
taacacaccgatccttctggaagcc

SEQ ID NO: 36000 - DNA, 25 bp, E. coli
attcgcactcctgcttatcggcaaa

SEQ ID NO: 36001 - DNA, 25 bp, E. coli
attcgcactcctccttatcggcaaa

SEQ ID NO: 36002 - DNA, 25 bp, E. coli
actcctgcttatcggcaaatcatca

SEQ ID NO: 36003 - DNA, 25 bp, E. coli
actcctgcttatgggcaaatcatca

SEQ ID NO: 36004 - DNA, 25 bp, E. coli
tagacaacatgagtcacagtgagca

SEQ ID NO: 36005 - DNA, 25 bp, E. coli
tagacaacatgactcacagtgagca

SEQ ID NO: 36006 - DNA, 25 bp, E. coli
ttccataacacagcgatgcttctgg

SEQ ID NO: 36007 - DNA, 25 bp, E. coli
ttctggaagccgtagaaccccttgc

SEQ ID NO: 36008 - DNA, 25 bp, E. coli
ttctggaagccgaagaaccccttgc

SEQ ID NO: 36009 - DNA, 25 bp, E. coli
ttccataacacaccgatgcttctgg

SEQ ID NO: 36010 - DNA, 25 bp, E. coli
tgctcgtctcgacatagatgaatca

SEQ ID NO: 36011 - DNA, 25 bp, E. coli
tgctcgtctcgagatagatgaatca

SEQ ID NO: 36012 - DNA, 25 bp, E. coli
gcaatagacaacttgactcacagtg

SEQ ID NO: 36013 - DNA, 25 bp, E. coli
gcaatagacaacatgactcacagtg

SEQ ID NO: 36014 - DNA, 25 bp, E. coli
cgaagaacccctagccgaatacgca

SEQ ID NO: 36015 - DNA, 25 bp, E. coli
cgaagaaccccttgccgaatacgca

SEQ ID NO: 36016 - DNA, 25 bp, E. coli
ctcgtctcgacaaagatgaatcagc

SEQ ID NO: 36017 - DNA, 25 bp, E. coli
ctcgtctcgacatagatgaatcagc

SEQ ID NO: 36018 - DNA, 25 bp, E. coli
taacacaccgatgcttctggaagcc

SEQ ID NO: 36019 - DNA, 25 bp, E. coli
caacctgcgtcgtaaactgccggat

SEQ ID NO: 36020 - DNA, 25 bp, E. coli
caacctgcgtcgaaaactgccggat

SEQ ID NO: 36021 - DNA, 25 bp, E. coli
tgtcattatgttcacggcgcgcggc

SEQ ID NO: 36022 - DNA, 25 bp, E. coli
tgtcattatgttgacggcgcgcggc

SEQ ID NO: 36023 - DNA, 25 bp, E. coli
tgagctgggcgcagatgactatctc

SEQ ID NO: 36024 - DNA, 25 bp, E. coli
tgagctgggcgctgatgactatctc

SEQ ID NO: 36025 - DNA, 25 bp, E. coli
tcgacgggcaaacgctggagttaac

SEQ ID NO: 36026 - DNA, 25 bp, E. coli
tcgacgggcaaaggctggagttaac

SEQ ID NO: 36027 - DNA, 25 bp, E. coli
tcaccgacactggaagttgatgcct

SEQ ID NO: 36028 - DNA, 25 bp, E. coli
tcaccgacactgcaagttgatgcct

SEQ ID NO: 36029 - DNA, 25 bp, E. coli
gctggtggcacgtattcgcgcgatc

SEQ ID NO: 36030 - DNA, 25 bp, E. coli
gctgctcgagatcgaaggcttcaac

SEQ ID NO: 36031 - DNA, 25 bp, E. coli
gctgctcgagatggaaggcttcaac

SEQ ID NO: 36032 - DNA, 25 bp, E. coli
gctggtggcacgaattcgcgcgatc

SEQ ID NO: 36033 - DNA, 25 bp, E. coli
gaacaggcgcttgatcttctggacg

SEQ ID NO: 36034 - DNA, 25 bp, E. coli
gaaaccgtttaaagatcgtgagctg

SEQ ID NO: 36035 - DNA, 25 bp, E. coli
gaaaccgtttaatgatcgtgagctg

SEQ ID NO: 36036 - DNA, 25 bp, E. coli
gaacaggcgcttcatcttctggacg

SEQ ID NO: 36037 - DNA, 25 bp, E. coli
ggatcgtaaagaaggtcacccgtgg

SEQ ID NO: 36038 - DNA, 25 bp, E. coli
ggatcgtaaagatggtcacccgtgg

SEQ ID NO: 36039 - DNA, 25 bp, E. coli
gatgatgaccgacagctgacttccc

SEQ ID NO: 36040 - DNA, 25 bp, E. coli
gatgatgaccgagagctgacttccc

SEQ ID NO: 36041 - DNA, 25 bp, E. coli
tagcgcccgcgacttaatcatgctg

SEQ ID NO: 36042 - DNA, 25 bp, E. coli
tagcgcccgcgagttaatcatgctg

SEQ ID NO: 36043 - DNA, 25 bp, E. coli
tattcagaagaatgcggacggttcc

SEQ ID NO: 36044 - DNA, 25 bp, E. coli
tattcagaagaaagcggacggttcc

SEQ ID NO: 36045 - DNA, 25 bp, E. coli
ttactgctggcgacaatctcctggc

SEQ ID NO: 36046 - DNA, 25 bp, E. coli
ttactgctggcgtcaatctcctggc

SEQ ID NO: 36047 - DNA, 25 bp, E. coli
tgacgtcgcgcctcgatattgagca

SEQ ID NO: 36048 - DNA, 25 bp, E. coli
tgatcgaggcgcacaatcagttggc

SEQ ID NO: 36049 - DNA, 25 bp, E. coli
tgacgtcgcgccacgatattgagca

SEQ ID NO: 36050 - DNA, 25 bp, E. coli
tgatcgaggcgctcaatcagttggc

SEQ ID NO: 36051 - DNA, 25 bp, E. coli
tgacgtcactgaaaccattgccggt

SEQ ID NO: 36052 - DNA, 25 bp, E. coli
tgacgtcactgataccattgccggt

SEQ ID NO: 36053 - DNA, 25 bp, E. coli
tcgacgcccgccttgatattcagaa

SEQ ID NO: 36054 - DNA, 25 bp, E. coli
tcgacgcccgccatgatattcagaa

SEQ ID NO: 36055 - DNA, 25 bp, E. coli
cctgttgttcaatgccacgatggag

SEQ ID NO: 36056 - DNA, 25 bp, E. coli
cctgttgttcaaagccacgatggag

SEQ ID NO: 36057 - DNA, 25 bp, E. coli
gattgtgatcgaactggtcctcggc

SEQ ID NO: 36058 - DNA, 25 bp, E. coli
gattgtgatcgatctggtcctcggc

SEQ ID NO: 36059 - DNA, 25 bp, E. coli
gtgaatatcacagcattgccgggct

SEQ ID NO: 36060 - DNA, 25 bp, E. coli
gtgaatatcacaccattgccgggct

SEQ ID NO: 36061 - DNA, 25 bp, E. coli
gagcatatcgatctcaacgcgccgg

SEQ ID NO: 36062 - DNA, 25 bp, E. coli
gagcatatcgatgtcaacgcgccgg

SEQ ID NO: 36063 - DNA, 25 bp, E. coli
caatgatatcaaagagcgtgggtgt

SEQ ID NO: 36064 - DNA, 25 bp, E. coli
caaggaaggtggcaattgctgccct

SEQ ID NO: 36065 - DNA, 25 bp, E. coli
caatgcctggaattggttcacgaaa

SEQ ID NO: 36066 - DNA, 25 bp, E. coli
caaggaaggtgggaattgctgccct

SEQ ID NO: 36067 - DNA, 25 bp, E. coli
caatgcctggaaatggttcacgaaa

SEQ ID NO: 36068 - DNA, 25 bp, E. coli
caatgatatcaatgagcgtgggtgt

SEQ ID NO: 36069 - DNA, 25 bp, E. coli
actggaccacgttgaaaaattcgct

SEQ ID NO: 36070 - DNA, 25 bp, E. coli
actggaccacgtagaaaaattcgct

SEQ ID NO: 36071 - DNA, 25 bp, E. coli
ttcagatctatgtggccggaggcga

SEQ ID NO: 36072 - DNA, 25 bp, E. coli
ttcagatctatgaggccggaggcga

SEQ ID NO: 36073 - DNA, 25 bp, E. coli
tgcttcgcgtcaagcgtgaaccaga

SEQ ID NO: 36074 - DNA, 25 bp, E. coli
tgcttcgcgtcatgcgtgaaccaga

SEQ ID NO: 36075 - DNA, 25 bp, E. coli
cctggtggattccatgagctggttc

SEQ ID NO: 36076 - DNA, 25 bp, E. coli
cctggtggattcgatgagctggttc

SEQ ID NO: 36077 - DNA, 25 bp, E. coli
gaagcgccagttgacgctccgttag

SEQ ID NO: 36078 - DNA, 25 bp, E. coli
gaattgctagagttttggaagcgcc

SEQ ID NO: 36079 - DNA, 25 bp, E. coli
gaattgctagagatttggaagcgcc

SEQ ID NO: 36080 - DNA, 25 bp, E. coli
gaagcgccagttcacgctccgttag

SEQ ID NO: 36081 - DNA, 25 bp, E. coli
gaacacgcagaaacagtggcgacca

SEQ ID NO: 36082 - DNA, 25 bp, E. coli
gaacacgcagaatcagtggcgacca

SEQ ID NO: 36083 - DNA, 25 bp, E. coli
ccggaggcgatgcaatagagccact

SEQ ID NO: 36084 - DNA, 25 bp, E. coli
ccggaggcgatggaatagagccact

SEQ ID NO: 36085 - DNA, 25 bp, E. coli
cagctttgtaaaaaaacccgctctg

SEQ ID NO: 36086 - DNA, 25 bp, E. coli
cagctttgtaaataaacccgctctg

SEQ ID NO: 36087 - DNA, 25 bp, E. coli
agtacaaatgtttattttgaagctg

SEQ ID NO: 36088 - DNA, 25 bp, E. coli
agtacaaatgttaattttgaagctg

SEQ ID NO: 36089 - DNA, 25 bp, E. coli
aaattcggcctggaaagtacaaatg

SEQ ID NO: 36090 - DNA, 25 bp, E. coli
aaattcggcctgcaaagtacaaatg

SEQ ID NO: 36091 - DNA, 25 bp, E. coli
ttcggcctgcaatgtacaaatgttt

SEQ ID NO: 36092 - DNA, 25 bp, E. coli
ttcggcctgcaaagtacaaatgttt

SEQ ID NO: 36093 - DNA, 25 bp, E. coli
ttttttatatccatctgcaggccaa

SEQ ID NO: 36094 - DNA, 25 bp, E. coli
ttttttatatccttctgcaggccaa

SEQ ID NO: 36095 - DNA, 25 bp, E. coli
ttttatatccatgtgcaggccaaaa

SEQ ID NO: 36096 - DNA, 25 bp, E. coli
ttttatatccatctgcaggccaaaa

SEQ ID NO: 36097 - DNA, 25 bp, E. coli
tgcctgttgttgtcagctttgtaaa

SEQ ID NO: 36098 - DNA, 25 bp, E. coli
tgcctgttgttgacagctttgtaaa

SEQ ID NO: 36099 - DNA, 25 bp, E. coli
gcctgcaaagtagaaatgtttattt

SEQ ID NO: 36100 - DNA, 25 bp, E. coli
gcctgcaaagtacaaatgtttattt

SEQ ID NO: 36101 - DNA, 25 bp, E. coli
gcaggccaaaattcggcctgcaaag

SEQ ID NO: 36102 - DNA, 25 bp, E. coli
gcaggccaaaatacggcctgcaaag

SEQ ID NO: 36103 - DNA, 25 bp, E. coli
cctgttgttgtctgctttgtaaaaa

SEQ ID NO: 36104 - DNA, 25 bp, E. coli
cctgttgttgtcagctttgtaaaaa

SEQ ID NO: 36105 - DNA, 25 bp, E. coli
cggcctgcaaagaacaaatgtttat

SEQ ID NO: 36106 - DNA, 25 bp, E. coli
cggcctgcaaagtacaaatgtttat

SEQ ID NO: 36107 - DNA, 25 bp, E. coli
caacagaattatgcggagtctggat

SEQ ID NO: 36108 - DNA, 25 bp, E. coli
caacagaattatccggagtctggat

SEQ ID NO: 36109 - DNA, 25 bp, E. coli
tgtatgagcattcacctgccgcacg

SEQ ID NO: 36110 - DNA, 25 bp, E. coli
tgtatgagcattgacctgccgcacg

SEQ ID NO: 36111 - DNA, 25 bp, E. coli
ccagtttgccgcatgatgagttgta

SEQ ID NO: 36112 - DNA, 25 bp, E. coli
ccagtttgccgcttgatgagttgta

SEQ ID NO: 36113 - DNA, 25 bp, E. coli
gccgcttgatgacttgtatgagcat

SEQ ID NO: 36114 - DNA, 25 bp, E. coli
gccgcttgatgagttgtatgagcat

SEQ ID NO: 36115 - DNA, 25 bp, E. coli
gctatccgcgtgtccgtgttcttcg

SEQ ID NO: 36116 - DNA, 25 bp, E. coli
gctatccgcgtgaccgtgttcttcg

SEQ ID NO: 36117 - DNA, 25 bp, E. coli
gacggttgttcaaactcaacaatga

SEQ ID NO: 36118 - DNA, 25 bp, E. coli
gtatcgttcatcgtccagtttgccg

SEQ ID NO: 36119 - DNA, 25 bp, E. coli
gtatcgttcatcctccagtttgccg

SEQ ID NO: 36120 - DNA, 25 bp, E. coli
ggtgcgttggtaacggtatcgttca

SEQ ID NO: 36121 - DNA, 25 bp, E. coli
ggtgcgttggtatcggtatcgttca

SEQ ID NO: 36122 - DNA, 25 bp, E. coli
tgaccgtgttctacgacggttgttc

SEQ ID NO: 36123 - DNA, 25 bp, E. coli
tgaccgtgttcttcgacggttgttc

SEQ ID NO: 36124 - DNA, 25 bp, E. coli
tcagcgcaacagtattatccggagt

SEQ ID NO: 36125 - DNA, 25 bp, E. coli
tcaacaatgagtatcagcgcaacag

SEQ ID NO: 36126 - DNA, 25 bp, E. coli
tcaacaatgagtttcagcgcaacag

SEQ ID NO: 36127 - DNA, 25 bp, E. coli
tcagcgcaacagaattatccggagt

SEQ ID NO: 36128 - DNA, 25 bp, E. coli
gacggttgttcatactcaacaatga

SEQ ID NO: 36129 - DNA, 25 bp, E. coli
cagccagatgttgaccaggttgttc

SEQ ID NO: 36130 - DNA, 25 bp, E. coli
cagccagatgttcaccaggttgttc

SEQ ID NO: 36131 - DNA, 25 bp, E. coli
aaaatgcacgcagagtaccgcgctg

SEQ ID NO: 36132 - DNA, 25 bp, E. coli
aaaatgcacgcacagtaccgcgctg

SEQ ID NO: 36133 - DNA, 25 bp, E. coli
ttatcctctgccaaccgacgggagt

SEQ ID NO: 36134 - DNA, 25 bp, E. coli
ttatcctctgcctaccgacgggagt

SEQ ID NO: 36135 - DNA, 25 bp, E. coli
tgtactgaacattccgcagcagctg

SEQ ID NO: 36136 - DNA, 25 bp, E. coli
tgtactgaacataccgcagcagctg

SEQ ID NO: 36137 - DNA, 25 bp, E. coli
tgaaggtaacacacagccgctggag

SEQ ID NO: 36138 - DNA, 25 bp, E. coli
tgaaggtaacactcagccgctggag

SEQ ID NO: 36139 - DNA, 25 bp, E. coli
tccaatatgatggaagcgaacccgg

SEQ ID NO: 36140 - DNA, 25 bp, E. coli
tccaatatgatgcaagcgaacccgg

SEQ ID NO: 36141 - DNA, 25 bp, E. coli
gccaattaccctcacgaagagcgtg

SEQ ID NO: 36142 - DNA, 25 bp, E. coli
gccaattaccctgacgaagagcgtg

SEQ ID NO: 36143 - DNA, 25 bp, E. coli
ccgggatgccggttcgtctgaatta

SEQ ID NO: 36144 - DNA, 25 bp, E. coli
ccgggatgccggatcgtctgaatta

SEQ ID NO: 36145 - DNA, 25 bp, E. coli
gataccgttcatgaaggcatcgtca

SEQ ID NO: 36146 - DNA, 25 bp, E. coli
gataccgttcatcaaggcatcgtca

SEQ ID NO: 36147 - DNA, 25 bp, E. coli
gggtgtggatacgttcctgccgaaa

SEQ ID NO: 36148 - DNA, 25 bp, E. coli
gggtgtggataccttcctgccgaaa

SEQ ID NO: 36149 - DNA, 25 bp, E. coli
gagtcgcctggtaggtcagaatcag

SEQ ID NO: 36150 - DNA, 25 bp, E. coli
gagtcgcctggttggtcagaatcag

SEQ ID NO: 36151 - DNA, 25 bp, E. coli
caatggaaccggaagttctgttgtt

SEQ ID NO: 36152 - DNA, 25 bp, E. coli
caatggaaccggtagttctgttgtt

SEQ ID NO: 36153 - DNA, 25 bp, E. coli
cagctggcggaagagggaaaaacga

SEQ ID NO: 36154 - DNA, 25 bp, E. coli
cagctggcggaacagggaaaaacga

SEQ ID NO: 36155 - DNA, 25 bp, E. coli
atcggcccttgagccagagctggtg

SEQ ID NO: 36156 - DNA, 25 bp, E. coli
atcggcccttgacccagagctggtg

SEQ ID NO: 36157 - DNA, 25 bp, E. coli
aaaacgatggtggtggtgacccacg

SEQ ID NO: 36158 - DNA, 25 bp, E. coli
aaaacgatggtgctggtgacccacg

SEQ ID NO: 36159 - DNA, 25 bp, E. coli
tgtttccatagcccgggcgctggca

SEQ ID NO: 36160 - DNA, 25 bp, E. coli
tgatgaaccgacttcggcccttgac

SEQ ID NO: 36161 - DNA, 25 bp, E. coli
tgggtgaagtgctgcgcattatgca

SEQ ID NO: 36162 - DNA, 25 bp, E. coli
tgggtgaagtgcagcgcattatgca

SEQ ID NO: 36163 - DNA, 25 bp, E. coli
tgatgaaccgacatcggcccttgac

SEQ ID NO: 36164 - DNA, 25 bp, E. coli
tgtttccatagcgcgggcgctggca

SEQ ID NO: 36165 - DNA, 25 bp, E. coli
gctggcaatggaaccggaagttctg

SEQ ID NO: 36166 - DNA, 25 bp, E. coli
gctggcaatggatccggaagttctg

SEQ ID NO: 36167 - DNA, 25 bp, E. coli
gaagtgctgcgcattatgcagcagc

SEQ ID NO: 36168 - DNA, 25 bp, E. coli
gaagttctgttgattgatgaaccga

SEQ ID NO: 36169 - DNA, 25 bp, E. coli
gaagttctgttgtttgatgaaccga

SEQ ID NO: 36170 - DNA, 25 bp, E. coli
gaagtgctgcgctttatgcagcagc

SEQ ID NO: 36171 - DNA, 25 bp, E. coli
gaaaaacgatggaggtggtgaccca

SEQ ID NO: 36172 - DNA, 25 bp, E. coli
gaaaaacgatggtggtggtgaccca

SEQ ID NO: 36173 - DNA, 25 bp, E. coli
cagggtgaaccggtcattctcgaca

SEQ ID NO: 36174 - DNA, 25 bp, E. coli
cagggtgaaccgctcattctcgaca

SEQ ID NO: 36175 - DNA, 25 bp, E. coli
ataaagatgccctcacccgtgaagg

SEQ ID NO: 36176 - DNA, 25 bp, E. coli
ataaagatgcccacacccgtgaagg

SEQ ID NO: 36177 - DNA, 25 bp, E. coli
tatcggcctgcgaaatctcgacctg

SEQ ID NO: 36178 - DNA, 25 bp, E. coli
tattgcgcgcctgtaaccagggtga

SEQ ID NO: 36179 - DNA, 25 bp, E. coli
tatcggcctgcgtaatctcgacctg

SEQ ID NO: 36180 - DNA, 25 bp, E. coli
tattgcgcgcctctaaccagggtga

SEQ ID NO: 36181 - DNA, 25 bp, E. coli
tgttggtaagactacctccagcgcg

SEQ ID NO: 36182 - DNA, 25 bp, E. coli
tgttggtaagacaacctccagcgcg

SEQ ID NO: 36183 - DNA, 25 bp, E. coli
tgttaacgcgctataacccaggccg

SEQ ID NO: 36184 - DNA, 25 bp, E. coli
tgttaacgcgctttaacccaggccg

SEQ ID NO: 36185 - DNA, 25 bp, E. coli
gaatttatcgtttgtgactccccgg

SEQ ID NO: 36186 - DNA, 25 bp, E. coli
gaatttatcgttagtgactccccgg

SEQ ID NO: 36187 - DNA, 25 bp, E. coli
gaagccattatttccaccaacccgg

SEQ ID NO: 36188 - DNA, 25 bp, E. coli
gaagaaaggcttgctcaaacgcttg

SEQ ID NO: 36189 - DNA, 25 bp, E. coli
gaagatgtgctgcagatcctgcgca

SEQ ID NO: 36190 - DNA, 25 bp, E. coli
gaagaaaggcttcctcaaacgcttg

SEQ ID NO: 36191 - DNA, 25 bp, E. coli
gaagccattattaccaccaacccgg

SEQ ID NO: 36192 - DNA, 25 bp, E. coli
gaagatgtgctggagatcctgcgca

SEQ ID NO: 36193 - DNA, 25 bp, E. coli
gatttcgtcaacgtcattcagggcg

SEQ ID NO: 36194 - DNA, 25 bp, E. coli
gatttcgtcaacctcattcagggcg

SEQ ID NO: 36195 - DNA, 25 bp, E. coli
aagagagactctctcgcagccctgg

SEQ ID NO: 36196 - DNA, 25 bp, E. coli
aagagagactctgtcgcagccctgg

SEQ ID NO: 36197 - DNA, 25 bp, E. coli
caaagatggaagtgagactctctcg

SEQ ID NO: 36198 - DNA, 25 bp, E. coli
caaagatggaagagagactctctcg

SEQ ID NO: 36199 - DNA, 25 bp, E. coli
catggtgtggctttttcgtctgggc

SEQ ID NO: 36200 - DNA, 25 bp, E. coli
catggtgtggctatttcgtctgggc

SEQ ID NO: 36201 - DNA, 25 bp, E. coli
tatacatggtgtcgctatttcgtct

SEQ ID NO: 36202 - DNA, 25 bp, E. coli
tatacatggtgtggctatttcgtct

SEQ ID NO: 36203 - DNA, 25 bp, E. coli
tctcaaaatggaatacggttcgaca

SEQ ID NO: 36204 - DNA, 25 bp, E. coli
tctcaaaatggattacggttcgaca

SEQ ID NO: 36205 - DNA, 25 bp, E. coli
tcgacaaagatggaagagagactct

SEQ ID NO: 36206 - DNA, 25 bp, E. coli
tcgacaaagatgcaagagagactct

SEQ ID NO: 36207 - DNA, 25 bp, E. coli
gctatttcgtctgggcaatggcgcg

SEQ ID NO: 36208 - DNA, 25 bp, E. coli
gctatttcgtctcggcaatggcgcg

SEQ ID NO: 36209 - DNA, 25 bp, E. coli
gaatacggttcgtcaaagatggaag

SEQ ID NO: 36210 - DNA, 25 bp, E. coli
gaatacggttcgacaaagatggaag

SEQ ID NO: 36211 - DNA, 25 bp, E. coli
ccgggttatctcaaaatggaatacg

SEQ ID NO: 36212 - DNA, 25 bp, E. coli
ccgggttatctctaaatggaatacg

SEQ ID NO: 36213 - DNA, 25 bp, E. coli
taagtctgaattttccgggttatct

SEQ ID NO: 36214 - DNA, 25 bp, E. coli
taagtctgaattatccgggttatct

SEQ ID NO: 36215 - DNA, 25 bp, E. coli
gatgcccccgtgtcgggatttgaaa

SEQ ID NO: 36216 - DNA, 25 bp, E. coli
gatgcccccgtgacgggatttgaaa

SEQ ID NO: 36217 - DNA, 25 bp, E. coli
actctgtgatgacgctccggcatga

SEQ ID NO: 36218 - DNA, 25 bp, E. coli
actctgtgatgaggctccggcatga

SEQ ID NO: 36219 - DNA, 25 bp, E. coli
tttgccgccgctgcactctgtgatg

SEQ ID NO: 36220 - DNA, 25 bp, E. coli
tttgccgccgctccactctgtgatg

SEQ ID NO: 36221 - DNA, 25 bp, E. coli
ttgccgatgcagactgcgaggccgc

SEQ ID NO: 36222 - DNA, 25 bp, E. coli
ttgccgatgcagtctgcgaggccgc

SEQ ID NO: 36223 - DNA, 25 bp, E. coli
tttcgccgcattcttcgatgaggct

SEQ ID NO: 36224 - DNA, 25 bp, E. coli
tttcgccgcattgttcgatgaggct

SEQ ID NO: 36225 - DNA, 25 bp, E. coli
tcttcgatgagggtgctgccgtttc

SEQ ID NO: 36226 - DNA, 25 bp, E. coli
tcttcgatgaggctgctgccgtttc

SEQ ID NO: 36227 - DNA, 25 bp, E. coli
gccgctgccgccagtgcgctgttag

SEQ ID NO: 36228 - DNA, 25 bp, E. coli
gccgctgccgcctgtgcgctgttag

SEQ ID NO: 36229 - DNA, 25 bp, E. coli
gctgcactctgtcatgacgctccgg

SEQ ID NO: 36230 - DNA, 25 bp, E. coli
gctgcactctgtgatgacgctccgg

SEQ ID NO: 36231 - DNA, 25 bp, E. coli
gcattcttcgatgaggctgctgccg

SEQ ID NO: 36232 - DNA, 25 bp, E. coli
gcattcttcgatcaggctgctgccg

SEQ ID NO: 36233 - DNA, 25 bp, E. coli
cgatgaggctgctgccgtttcggat

SEQ ID NO: 36234 - DNA, 25 bp, E. coli
cgatgaggctgcagccgtttcggat

SEQ ID NO: 36235 - DNA, 25 bp, E. coli
cggagtttgccgatgcagtctgcga

SEQ ID NO: 36236 - DNA, 25 bp, E. coli
cggagtttgccgttgcagtctgcga

SEQ ID NO: 36237 - DNA, 25 bp, E. coli
ggctgctgccgtatcggatttcttt

SEQ ID NO: 36238 - DNA, 25 bp, E. coli
ggctgctgccgtttcggatttcttt

SEQ ID NO: 36239 - DNA, 25 bp, E. coli
aatagaaccagctgggagaggcgaa

SEQ ID NO: 36240 - DNA, 25 bp, E. coli
aatagaaccagcagggagaggcgaa

SEQ ID NO: 36241 - DNA, 25 bp, E. coli
cacacgtggatgcaggaaaaacaac

SEQ ID NO: 36242 - DNA, 25 bp, E. coli
cacacgtggatggaggaaaaacaac

SEQ ID NO: 36243 - DNA, 25 bp, E. coli
cattacttgcagtggaagatccact

SEQ ID NO: 36244 - DNA, 25 bp, E. coli
cagacggattctttggagcttgagc

SEQ ID NO: 36245 - DNA, 25 bp, E. coli
cattacttgcagaggaagatccact

SEQ ID NO: 36246 - DNA, 25 bp, E. coli
cagacggattctatggagcttgagc

SEQ ID NO: 36247 - DNA, 25 bp, E. coli
tgatttaggcaatacacagacggat

SEQ ID NO: 36248 - DNA, 25 bp, E. coli
tgatttaggcaaaacacagacggat

SEQ ID NO: 36249 - DNA, 25 bp, E. coli
tgaattttttagtccagccagcact

SEQ ID NO: 36250 - DNA, 25 bp, E. coli
tgaattttttagaccagccagcact

SEQ ID NO: 36251 - DNA, 25 bp, E. coli
ccattttgggcgacagtaggcttag

SEQ ID NO: 36252 - DNA, 25 bp, E. coli
ccagtattttgtcgtgctgcagcaa

SEQ ID NO: 36253 - DNA, 25 bp, E. coli
ccattttgggcgtcagtaggcttag

SEQ ID NO: 36254 - DNA, 25 bp, E. coli
gccagcactccaccagattttagaa

SEQ ID NO: 36255 - DNA, 25 bp, E. coli
gccagcactccagcagattttagaa

SEQ ID NO: 36256 - DNA, 25 bp, E. coli
ccagtattttgtggtgctgcagcaa

SEQ ID NO: 36257 - DNA, 25 bp, E. coli
gatttagaaactatgagggcaacct

SEQ ID NO: 36258 - DNA, 25 bp, E. coli
gatttagaaactttgagggcaacct

SEQ ID NO: 36259 - DNA, 25 bp, E. coli
taatataggaatggtagcacacgtg

SEQ ID NO: 36260 - DNA, 25 bp, E. coli
taatataggaatcgtagcacacgtg

SEQ ID NO: 36261 - DNA, 25 bp, E. coli
caagcgaataaagatatcgatgccg

SEQ ID NO: 36262 - DNA, 25 bp, E. coli
caagcgaataaacatatcgatgccg

SEQ ID NO: 36263 - DNA, 25 bp, E. coli
cacggttaaacaagcgaataaagat

SEQ ID NO: 36264 - DNA, 25 bp, E. coli
cacggttaaacatgcgaataaagat

SEQ ID NO: 36265 - DNA, 25 bp, E. coli
cggaaactgaaagaaccagattcta

SEQ ID NO: 36266 - DNA, 25 bp, E. coli
cggaaactgaaacaaccagattcta

SEQ ID NO: 36267 - DNA, 25 bp, E. coli
atgagtatcagataagacacggtaa

SEQ ID NO: 36268 - DNA, 25 bp, E. coli
atgagtatcagaaaagacacggtaa

SEQ ID NO: 36269 - DNA, 25 bp, E. coli
ttctttaccaccctgtctaacacgg

SEQ ID NO: 36270 - DNA, 25 bp, E. coli
ttctttaccaccgtgtctaacacgg

SEQ ID NO: 36271 - DNA, 25 bp, E. coli
tgtctaacacggataaacaagcgaa

SEQ ID NO: 36272 - DNA, 25 bp, E. coli
tgtctaacacggttaaacaagcgaa

SEQ ID NO: 36273 - DNA, 25 bp, E. coli
tcgatgccgccaaattgaaattaac

SEQ ID NO: 36274 - DNA, 25 bp, E. coli
tcgatgccgccatattgaaattaac

SEQ ID NO: 36275 - DNA, 25 bp, E. coli
taaagatatcgaagccgccaaattg

SEQ ID NO: 36276 - DNA, 25 bp, E. coli
taaagatatcgatgccgccaaattg

SEQ ID NO: 36277 - DNA, 25 bp, E. coli
gaataaagatatcgatgccgccaaa

SEQ ID NO: 36278 - DNA, 25 bp, E. coli
gaataaagatatggatgccgccaaa

SEQ ID NO: 36279 - DNA, 25 bp, E. coli
gattaacacctgaaatgagtatcag

SEQ ID NO: 36280 - DNA, 25 bp, E. coli
gattaacacctgtaatgagtatcag

SEQ ID NO: 36281 - DNA, 25 bp, E. coli
taatgagtatcagaaaagacacggt

SEQ ID NO: 36282 - DNA, 25 bp, E. coli
taatgagtatcacaaaagacacggt

SEQ ID NO: 36283 - DNA, 25 bp, E. coli
taaagctacatagtgtcggacgaaa

SEQ ID NO: 36284 - DNA, 25 bp, E. coli
taaagctacatactgtcggacgaaa

SEQ ID NO: 36285 - DNA, 25 bp, E. coli
acaaaggccgggaaacccagcgctg

SEQ ID NO: 36286 - DNA, 25 bp, E. coli
acaaaggccgggtaacccagcgctg

SEQ ID NO: 36287 - DNA, 25 bp, E. coli
accgaagtgcagagtcatttatcag

SEQ ID NO: 36288 - DNA, 25 bp, E. coli
accgaagtgcagtgtcatttatcag

SEQ ID NO: 36289 - DNA, 25 bp, E. coli
aaaaccatcacggtgctcgaggaca

SEQ ID NO: 36290 - DNA, 25 bp, E. coli
aaaaccatcacgctgctcgaggaca

SEQ ID NO: 36291 - DNA, 25 bp, E. coli
tgtcggacgaaaaccatcacgctgc

SEQ ID NO: 36292 - DNA, 25 bp, E. coli
tgttcatcagactgctgaagcggct

SEQ ID NO: 36293 - DNA, 25 bp, E. coli
tgtcggacgaaatccatcacgctgc

SEQ ID NO: 36294 - DNA, 25 bp, E. coli
tgttcatcagacagctgaagcggct

SEQ ID NO: 36295 - DNA, 25 bp, E. coli
ccagcgctggctgaaggataaaccg

SEQ ID NO: 36296 - DNA, 25 bp, E. coli
ccagcgctggctcaaggataaaccg

SEQ ID NO: 36297 - DNA, 25 bp, E. coli
gcggcttaaagcaacatactgtcgg

SEQ ID NO: 36298 - DNA, 25 bp, E. coli
gcggcttaaagctacatactgtcgg

SEQ ID NO: 36299 - DNA, 25 bp, E. coli
gaaggataaaccgaagtgcagagtc

SEQ ID NO: 36300 - DNA, 25 bp, E. coli
gaaggataaacccaagtgcagagtc

SEQ ID NO: 36301 - DNA, 25 bp, E. coli
cgctgctcgaggtcaactacattat

SEQ ID NO: 36302 - DNA, 25 bp, E. coli
cgctgctcgaggacaactacattat

SEQ ID NO: 36303 - DNA, 25 bp, E. coli
tcagactgctgaagcggcttaaagc

SEQ ID NO: 36304 - DNA, 25 bp, E. coli
tcagactgctgatgcggcttaaagc

SEQ ID NO: 36305 - DNA, 25 bp, E. coli
cacttccgtgtctgacctgaaaaaa

SEQ ID NO: 36306 - DNA, 25 bp, E. coli
catgacacagcgacgcaggggacct

SEQ ID NO: 36307 - DNA, 25 bp, E. coli
cacttccgtgtcagacctgaaaaaa

SEQ ID NO: 36308 - DNA, 25 bp, E. coli
catgacacagcgtcgcaggggacct

SEQ ID NO: 36309 - DNA, 25 bp, E. coli
agctggaagtgcagaccggcatgac

SEQ ID NO: 36310 - DNA, 25 bp, E. coli
agctggaagtgctgaccggcatgac

SEQ ID NO: 36311 - DNA, 25 bp, E. coli
agtgcagaccggcatgacacagcga

SEQ ID NO: 36312 - DNA, 25 bp, E. coli
agtgcagaccgggatgacacagcga

SEQ ID NO: 36313 - DNA, 25 bp, E. coli
tgcagaccggcaagacacagcgacg

SEQ ID NO: 36314 - DNA, 25 bp, E. coli
tgcagaccggcatgacacagcgacg

SEQ ID NO: 36315 - DNA, 25 bp, E. coli
ccacttccgtgtgtgacctgaaaaa

SEQ ID NO: 36316 - DNA, 25 bp, E. coli
ccacttccgtgtctgacctgaaaaa

SEQ ID NO: 36317 - DNA, 25 bp, E. coli
cttccgtgtctgacctgaaaaaata

SEQ ID NO: 36318 - DNA, 25 bp, E. coli
ctggaagtgcagaccggcatgacac

SEQ ID NO: 36319 - DNA, 25 bp, E. coli
cttccgtgtctgtcctgaaaaaata

SEQ ID NO: 36320 - DNA, 25 bp, E. coli
ctggaagtgcagtccggcatgacac

SEQ ID NO: 36321 - DNA, 25 bp, E. coli
gggacctgcaggtttttatgtatga

SEQ ID NO: 36322 - DNA, 25 bp, E. coli
gggacctgcaggattttatgtatga

SEQ ID NO: 36323 - DNA, 25 bp, E. coli
tggaagtgcagagcggcatgacaca

SEQ ID NO: 36324 - DNA, 25 bp, E. coli
tggaagtgcagaccggcatgacaca

SEQ ID NO: 36325 - DNA, 25 bp, E. coli
gaccggcatgacacagcgacgcagg

SEQ ID NO: 36326 - DNA, 25 bp, E. coli
gaccggcatgactcagcgacgcagg

SEQ ID NO: 36327 - DNA, 25 bp, E. coli
cacgcgcgaatatgtagaccacagc

SEQ ID NO: 36328 - DNA, 25 bp, E. coli
cacgcgcgaataagtagaccacagc

SEQ ID NO: 36329 - DNA, 25 bp, E. coli
catttcgttgatgcgtttgatgcac

SEQ ID NO: 36330 - DNA, 25 bp, E. coli
catttcgttgatccgtttgatgcac

SEQ ID NO: 36331 - DNA, 25 bp, E. coli
tacaaaaagcagaaaaaagggccag

SEQ ID NO: 36332 - DNA, 25 bp, E. coli
tacaaaaagcagtaaaaagggccag

SEQ ID NO: 36333 - DNA, 25 bp, E. coli
tagaccacagcaaagggaaaaagtg

SEQ ID NO: 36334 - DNA, 25 bp, E. coli
tagaccacagcatagggaaaaagtg

SEQ ID NO: 36335 - DNA, 25 bp, E. coli
ttgatgcacacggaagctgaagccc

SEQ ID NO: 36336 - DNA, 25 bp, E. coli
ttgatgcacacgcaagctgaagccc

SEQ ID NO: 36337 - DNA, 25 bp, E. coli
taattggcccaatttttacgagtca

SEQ ID NO: 36338 - DNA, 25 bp, E. coli
taattggcccaaattttacgagtca

SEQ ID NO: 36339 - DNA, 25 bp, E. coli
tgaagcccagtagctcgcggctgag

SEQ ID NO: 36340 - DNA, 25 bp, E. coli
tgaagcccagtacctcgcggctgag

SEQ ID NO: 36341 - DNA, 25 bp, E. coli
ttcaggcccggctgggaaaaagtgc

SEQ ID NO: 36342 - DNA, 25 bp, E. coli
ttcaggcccggcagggaaaaagtgc

SEQ ID NO: 36343 - DNA, 25 bp, E. coli
gcttagtggcttatcaggcccggca

SEQ ID NO: 36344 - DNA, 25 bp, E. coli
gcttagtggcttttcaggcccggca

SEQ ID NO: 36345 - DNA, 25 bp, E. coli
gaaaaagtgcggaggtagtcagata

SEQ ID NO: 36346 - DNA, 25 bp, E. coli
gaaaaagtgcggtggtagtcagata

SEQ ID NO: 36347 - DNA, 25 bp, E. coli
gataagtaaaatctacacgcgcgaa

SEQ ID NO: 36348 - DNA, 25 bp, E. coli
gataagtaaaatgtacacgcgcgaa

SEQ ID NO: 36349 - DNA, 25 bp, E. coli
actggcgttcgaaaccatggtcgat

SEQ ID NO: 36350 - DNA, 25 bp, E. coli
actggcgttcgataccatggtcgat

SEQ ID NO: 36351 - DNA, 25 bp, E. coli
ttccggcatcatagaagagtctgca

SEQ ID NO: 36352 - DNA, 25 bp, E. coli
ttccggcatcattgaagagtctgca

SEQ ID NO: 36353 - DNA, 25 bp, E. coli
ttgccaaagcctcggcggctgcaac

SEQ ID NO: 36354 - DNA, 25 bp, E. coli
ttgccaaagcctgggcggctgcaac

SEQ ID NO: 36355 - DNA, 25 bp, E. coli
tgtgctggaatcctccttcgttgcg

SEQ ID NO: 36356 - DNA, 25 bp, E. coli
tgtgctggaatcgtccttcgttgcg

SEQ ID NO: 36357 - DNA, 25 bp, E. coli
tgaactggcgttggaaaccatggtc

SEQ ID NO: 36358 - DNA, 25 bp, E. coli
tgaactggcgttcgaaaccatggtc

SEQ ID NO: 36359 - DNA, 25 bp, E. coli
tgcgctttctgatcagctgaaagag

SEQ ID NO: 36360 - DNA, 25 bp, E. coli
tgcgggtgtgctggaatcgtccttc

SEQ ID NO: 36361 - DNA, 25 bp, E. coli
tgcgctttctgaacagctgaaagag

SEQ ID NO: 36362 - DNA, 25 bp, E. coli
tgcgggtgtgctcgaatcgtccttc

SEQ ID NO: 36363 - DNA, 25 bp, E. coli
cgaaggcatggcgattgccaaagcc

SEQ ID NO: 36364 - DNA, 25 bp, E. coli
cgaaggcatggccattgccaaagcc

SEQ ID NO: 36365 - DNA, 25 bp, E. coli
cgtgcttatgcgctttctgaacagc

SEQ ID NO: 36366 - DNA, 25 bp, E. coli
cgtgcttatgcggtttctgaacagc

SEQ ID NO: 36367 - DNA, 25 bp, E. coli
ggtcgattccggcatcattgaagag

SEQ ID NO: 36368 - DNA, 25 bp, E. coli
ggtcgattccgggatcattgaagag

SEQ ID NO: 36369 - DNA, 25 bp, E. coli
gagtctgcatataatgaatcactgc

SEQ ID NO: 36370 - DNA, 25 bp, E. coli
gagtctgcatattatgaatcactgc

SEQ ID NO: 36371 - DNA, 25 bp, E. coli
cagaaatttttgatttgggacatgg

SEQ ID NO: 36372 - DNA, 25 bp, E. coli
cagaaatttttgttttgggacatgg

SEQ ID NO: 36373 - DNA, 25 bp, E. coli
tacgtattaatcagtgaatcaacaa

SEQ ID NO: 36374 - DNA, 25 bp, E. coli
tacgtattaatctgtgaatcaacaa

SEQ ID NO: 36375 - DNA, 25 bp, E. coli
ttttttggaacgagtatagggcaga

SEQ ID NO: 36376 - DNA, 25 bp, E. coli
ttttttggaacgtgtatagggcaga

SEQ ID NO: 36377 - DNA, 25 bp, E. coli
cgtgtatagggcagaaatttttgtt

SEQ ID NO: 36378 - DNA, 25 bp, E. coli
cgtgtatagggctgaaatttttgtt

SEQ ID NO: 36379 - DNA, 25 bp, E. coli
tatcaattttacgtattaatcagtg

SEQ ID NO: 36380 - DNA, 25 bp, E. coli
tatcaattttacctattaatcagtg

SEQ ID NO: 36381 - DNA, 25 bp, E. coli
tttgggacatggatgggacgccgta

SEQ ID NO: 36382 - DNA, 25 bp, E. coli
tttgggacatggttgggacgccgta

SEQ ID NO: 36383 - DNA, 25 bp, E. coli
tcgtcagcagacactctttgctgtt

SEQ ID NO: 36384 - DNA, 25 bp, E. coli
tcgtcagcagactctctttgctgtt

SEQ ID NO: 36385 - DNA, 25 bp, E. coli
ccagcagttatctattttacgtatt

SEQ ID NO: 36386 - DNA, 25 bp, E. coli
ccagcagttatcaattttacgtatt

SEQ ID NO: 36387 - DNA, 25 bp, E. coli
ctctttgctgttgaattttttggaa

SEQ ID NO: 36388 - DNA, 25 bp, E. coli
ctctttgctgttcaattttttggaa

SEQ ID NO: 36389 - DNA, 25 bp, E. coli
tggaacgtgtattgggcagaaattt

SEQ ID NO: 36390 - DNA, 25 bp, E. coli
tggaacgtgtatagggcagaaattt

SEQ ID NO: 36391 - DNA, 25 bp, E. coli
gatttccagcagatatcaattttac

SEQ ID NO: 36392 - DNA, 25 bp, E. coli
gatttccagcagttatcaattttac

SEQ ID NO: 36393 - DNA, 25 bp, E. coli
caactcactaaaggagaccgttacg

SEQ ID NO: 36394 - DNA, 25 bp, E. coli
caactcactaaacgagaccgttacg

SEQ ID NO: 36395 - DNA, 25 bp, E. coli
caacaccaaagacacgcaaattgac

SEQ ID NO: 36396 - DNA, 25 bp, E. coli
caacaccaaagagacgcaaattgac

SEQ ID NO: 36397 - DNA, 25 bp, E. coli
catgtagtgcgctacaccaaagaga

SEQ ID NO: 36398 - DNA, 25 bp, E. coli
catgtagtgcgcaacaccaaagaga

SEQ ID NO: 36399 - DNA, 25 bp, E. coli
agtgcgcaacacgaaagagacgcaa

SEQ ID NO: 36400 - DNA, 25 bp, E. coli
agctgctgaggctgcaaaaagcagg

SEQ ID NO: 36401 - DNA, 25 bp, E. coli
agctgctgaggcagcaaaaagcagg

SEQ ID NO: 36402 - DNA, 25 bp, E. coli
agtgcgcaacaccaaagagacgcaa

SEQ ID NO: 36403 - DNA, 25 bp, E. coli
acgagaccgttacgcccatgtagtg

SEQ ID NO: 36404 - DNA, 25 bp, E. coli
acgagaccgttaggcccatgtagtg

SEQ ID NO: 36405 - DNA, 25 bp, E. coli
tgagcaactcactaaacgagaccgt

SEQ ID NO: 36406 - DNA, 25 bp, E. coli
tgagcaactcacaaaacgagaccgt

SEQ ID NO: 36407 - DNA, 25 bp, E. coli
gccgatgattggtgagcaactcact

SEQ ID NO: 36408 - DNA, 25 bp, E. coli
gccgatgattggagagcaactcact

SEQ ID NO: 36409 - DNA, 25 bp, E. coli
gaccgttacgcccatgtagtgcgca

SEQ ID NO: 36410 - DNA, 25 bp, E. coli
gaccgttacgccgatgtagtgcgca

SEQ ID NO: 36411 - DNA, 25 bp, E. coli
gttacgcccatgaagtgcgcaacac

SEQ ID NO: 36412 - DNA, 25 bp, E. coli
gttacgcccatgtagtgcgcaacac

SEQ ID NO: 36413 - DNA, 25 bp, E. coli
taaacgagaccgttacgcccatgta

SEQ ID NO: 36414 - DNA, 25 bp, E. coli
taaacgagaccgatacgcccatgta

SEQ ID NO: 36415 - DNA, 25 bp, E. coli
accttcactgatagcgcgaccggaa

SEQ ID NO: 36416 - DNA, 25 bp, E. coli
accttcactgattgcgcgaccggaa

SEQ ID NO: 36417 - DNA, 25 bp, E. coli
aaaccgatgccgcaaagttggcgcg

SEQ ID NO: 36418 - DNA, 25 bp, E. coli
aaaaagcgatagagacagcgatggc

SEQ ID NO: 36419 - DNA, 25 bp, E. coli
aaaccgatgccggaaagttggcgcg

SEQ ID NO: 36420 - DNA, 25 bp, E. coli
aaaaagcgatagtgacagcgatggc

SEQ ID NO: 36421 - DNA, 25 bp, E. coli
tttttatatggctgatgcggcgacc

SEQ ID NO: 36422 - DNA, 25 bp, E. coli
tttttatatggcagatgcggcgacc

SEQ ID NO: 36423 - DNA, 25 bp, E. coli
tctctgttcctccaaaaagacggaa

SEQ ID NO: 36424 - DNA, 25 bp, E. coli
tctctgttcctcgaaaaagacggaa

SEQ ID NO: 36425 - DNA, 25 bp, E. coli
gcttcctacggtacatgggcgcgaa

SEQ ID NO: 36426 - DNA, 25 bp, E. coli
gcttcctacggttcatgggcgcgaa

SEQ ID NO: 36427 - DNA, 25 bp, E. coli
ccgctgacaagcaggtattaaccga

SEQ ID NO: 36428 - DNA, 25 bp, E. coli
ccgctgacaagctggtattaaccga

SEQ ID NO: 36429 - DNA, 25 bp, E. coli
gattgcgaaggaatcgaaacctctc

SEQ ID NO: 36430 - DNA, 25 bp, E. coli
gattgcgaaggattcgaaacctctc

SEQ ID NO: 36431 - DNA, 25 bp, E. coli
gtcgatacgcttactccggcgcagg

SEQ ID NO: 36432 - DNA, 25 bp, E. coli
gtcgatacgctttctccggcgcagg

SEQ ID NO: 36433 - DNA, 25 bp, E. coli
taatcgggccgaagtcgatacgctt

SEQ ID NO: 36434 - DNA, 25 bp, E. coli
taatcagcctctttactctgatggg

SEQ ID NO: 36435 - DNA, 25 bp, E. coli
taatcgggccgatgtcgatacgctt

SEQ ID NO: 36436 - DNA, 25 bp, E. coli
taatcagcctctatactctgatggg

SEQ ID NO: 36437 - DNA, 25 bp, E. coli
catattgccgatccttcactggcgg

SEQ ID NO: 36438 - DNA, 25 bp, E. coli
catattgccgatgcttcactggcgg

SEQ ID NO: 36439 - DNA, 25 bp, E. coli
tatcgtgcttggaaacctggtagga

SEQ ID NO: 36440 - DNA, 25 bp, E. coli
tatcagggccagttgatgatttccg

SEQ ID NO: 36441 - DNA, 25 bp, E. coli
tatcgtgcttggtaacctggtagga

SEQ ID NO: 36442 - DNA, 25 bp, E. coli
tatcagggccagatgatgatttccg

SEQ ID NO: 36443 - DNA, 25 bp, E. coli
tgtggaaccgtgctcaggacagctt

SEQ ID NO: 36444 - DNA, 25 bp, E. coli
tgtggaaccgtggtcaggacagctt

SEQ ID NO: 36445 - DNA, 25 bp, E. coli
gaaggcggctttcgtcactctggtc

SEQ ID NO: 36446 - DNA, 25 bp, E. coli
gaaggcggctttggtcactctggtc

SEQ ID NO: 36447 - DNA, 25 bp, E. coli
gacagcttcacctttcaacctggcg

SEQ ID NO: 36448 - DNA, 25 bp, E. coli
gacagcttcaccattcaacctggcg

SEQ ID NO: 36449 - DNA, 25 bp, E. coli
cgcgctccggattgggacataagca

SEQ ID NO: 36450 - DNA, 25 bp, E. coli
cgcgctccggatagggacataagca

SEQ ID NO: 36451 - DNA, 25 bp, E. coli
gtagaactggctccgggtgacacta

SEQ ID NO: 36452 - DNA, 25 bp, E. coli
gtagaactggctgcgggtgacacta

SEQ ID NO: 36453 - DNA, 25 bp, E. coli
ggtgacactacgctggttccgaccg

SEQ ID NO: 36454 - DNA, 25 bp, E. coli
ggtgacactacggtggttccgaccg

SEQ ID NO: 36455 - DNA, 25 bp, E. coli
taatctggtggatgatttcgacgcc

SEQ ID NO: 36456 - DNA, 25 bp, E. coli
taatctggtggaagatttcgacgcc

SEQ ID NO: 36457 - DNA, 25 bp, E. coli
gacgttaagattctggacccgcgcg

SEQ ID NO: 36458 - DNA, 25 bp, E. coli
gacgttaagattgtggacccgcgcg

SEQ ID NO: 36459 - DNA, 25 bp, E. coli
cgccgacttggcatctttttggaga

SEQ ID NO: 36460 - DNA, 25 bp, E. coli
cgccgacttggcttctttttggaga

SEQ ID NO: 36461 - DNA, 25 bp, E. coli
taaaactgtctcaggccgcattagg

SEQ ID NO: 36462 - DNA, 25 bp, E. coli
taaaactgtctctggccgcattagg

SEQ ID NO: 36463 - DNA, 25 bp, E. coli
tgttcgacgcacagcctgagtcaga

SEQ ID NO: 36464 - DNA, 25 bp, E. coli
tgttcgacgcactgcctgagtcaga

SEQ ID NO: 36465 - DNA, 25 bp, E. coli
tgaaaaacgaaagcttcggtgctcg

SEQ ID NO: 36466 - DNA, 25 bp, E. coli
tgaagataagcaaccaggcgaaccg

SEQ ID NO: 36467 - DNA, 25 bp, E. coli
tgaagataagcatccaggcgaaccg

SEQ ID NO: 36468 - DNA, 25 bp, E. coli
tgaaaaacgaaaccttcggtgctcg

SEQ ID NO: 36469 - DNA, 25 bp, E. coli
tctgttgtcagacatgcgtgctcga

SEQ ID NO: 36470 - DNA, 25 bp, E. coli
tctgttgtcagagatgcgtgctcga

SEQ ID NO: 36471 - DNA, 25 bp, E. coli
gaagaactactcaaagctcgcaaaa

SEQ ID NO: 36472 - DNA, 25 bp, E. coli
gaagaactactctaagctcgcaaaa

SEQ ID NO: 36473 - DNA, 25 bp, E. coli
gaaagagatgaatcacagccagcgg

SEQ ID NO: 36474 - DNA, 25 bp, E. coli
gaaagagatgaaacacagccagcgg

SEQ ID NO: 36475 - DNA, 25 bp, E. coli
gaaccgatcccagataatcagccag

SEQ ID NO: 36476 - DNA, 25 bp, E. coli
gaaccgatcccacataatcagccag

SEQ ID NO: 36477 - DNA, 25 bp, E. coli
ggtaagctggtcaaagtcgctcacg

SEQ ID NO: 36478 - DNA, 25 bp, E. coli
ggtaagctggtctaagtcgctcacg

SEQ ID NO: 36479 - DNA, 25 bp, E. coli
gagattattcgctctgagccaggcg

SEQ ID NO: 36480 - DNA, 25 bp, E. coli
gagattattcgcactgagccaggcg

SEQ ID NO: 36481 - DNA, 25 bp, E. coli
caatggatttgtttaatgaatgagc

SEQ ID NO: 36482 - DNA, 25 bp, E. coli
aagtctctgtgaatgtttattcaac

SEQ ID NO: 36483 - DNA, 25 bp, E. coli
aagtctctgtgattgtttattcaac

SEQ ID NO: 36484 - DNA, 25 bp, E. coli
caatggatttgtataatgaatgagc

SEQ ID NO: 36485 - DNA, 25 bp, E. coli
gacaataccttgttctacaaactaa

SEQ ID NO: 36486 - DNA, 25 bp, E. coli
gacaataccttgatctacaaactaa

SEQ ID NO: 36487 - DNA, 25 bp, E. coli
cactttcacgtttgaaagcaagggc

SEQ ID NO: 36488 - DNA, 25 bp, E. coli
cactttcacgttagaaagcaagggc

SEQ ID NO: 36489 - DNA, 25 bp, E. coli
ttagctgatggctccaaaaatagcg

SEQ ID NO: 36490 - DNA, 25 bp, E. coli
ttagctgatggcaccaaaaatagcg

SEQ ID NO: 36491 - DNA, 25 bp, E. coli
tcgtctcactgacaataccttgatc

SEQ ID NO: 36492 - DNA, 25 bp, E. coli
tcgtctcactgagaataccttgatc

SEQ ID NO: 36493 - DNA, 25 bp, E. coli
gaagcctggattttcgtctcactga

SEQ ID NO: 36494 - DNA, 25 bp, E. coli
gaagcctggattatcgtctcactga

SEQ ID NO: 36495 - DNA, 25 bp, E. coli
gttaattaacgctcatcattgtaca

SEQ ID NO: 36496 - DNA, 25 bp, E. coli
gttaattaacgcacatcattgtaca

SEQ ID NO: 36497 - DNA, 25 bp, E. coli
ggcaccaaaaattgcgaagcctgga

SEQ ID NO: 36498 - DNA, 25 bp, E. coli
ggcaccaaaaatagcgaagcctgga

SEQ ID NO: 36499 - DNA, 25 bp, E. coli
tcaactgatgtcatttaacctaaac

SEQ ID NO: 36500 - DNA, 25 bp, E. coli
tcaactgatgtcttttaacctaaac

SEQ ID NO: 36501 - DNA, 25 bp, E. coli
gaggactgtcctcttagctgatggc

SEQ ID NO: 36502 - DNA, 25 bp, E. coli
gaggactgtcctgttagctgatggc

SEQ ID NO: 36503 - DNA, 25 bp, E. coli
cagcgtctggaggagatgataagcc

SEQ ID NO: 36504 - DNA, 25 bp, E. coli
cagcgtctggagcagatgataagcc

SEQ ID NO: 36505 - DNA, 25 bp, E. coli
atctggctactgctcaatgacgacc

SEQ ID NO: 36506 - DNA, 25 bp, E. coli
atctggctactggtcaatgacgacc

SEQ ID NO: 36507 - DNA, 25 bp, E. coli
tgacccacgtttgtggcctttttgc

SEQ ID NO: 36508 - DNA, 25 bp, E. coli
tgacccacgtttctggcctttttgc

SEQ ID NO: 36509 - DNA, 25 bp, E. coli
tgaaagtgcagcctaatcagtccga

SEQ ID NO: 36510 - DNA, 25 bp, E. coli
tgaaagtgcagcgtaatcagtccga

SEQ ID NO: 36511 - DNA, 25 bp, E. coli
tgccgattcaggacagcgacaaaag

SEQ ID NO: 36512 - DNA, 25 bp, E. coli
tgccgattcaggtcagcgacaaaag

SEQ ID NO: 36513 - DNA, 25 bp, E. coli
cgcgcttttaacgttgaaggcattc

SEQ ID NO: 36514 - DNA, 25 bp, E. coli
ccgatccgacgaagtttaacaagat

SEQ ID NO: 36515 - DNA, 25 bp, E. coli
cgattcaggacaccgacaaaagcca

SEQ ID NO: 36516 - DNA, 25 bp, E. coli
cgcgcttttaaccttgaaggcattc

SEQ ID NO: 36517 - DNA, 25 bp, E. coli
cgattcaggacagcgacaaaagcca

SEQ ID NO: 36518 - DNA, 25 bp, E. coli
ccgatccgacgatgtttaacaagat

SEQ ID NO: 36519 - DNA, 25 bp, E. coli
cgtaatcagtcccatccgacgatgt

SEQ ID NO: 36520 - DNA, 25 bp, E. coli
cgtaatcagtccgatccgacgatgt

SEQ ID NO: 36521 - DNA, 25 bp, E. coli
gtaatgacccacgtttgtggccttt

SEQ ID NO: 36522 - DNA, 25 bp, E. coli
gtaatgacccacctttgtggccttt

SEQ ID NO: 36523 - DNA, 25 bp, E. coli
tcaatgacgaccagcgtctggagca

SEQ ID NO: 36524 - DNA, 25 bp, E. coli
tcaatgacgacctgcgtctggagca

SEQ ID NO: 36525 - DNA, 25 bp, E. coli
aattatctgatcaaggctggcggcg

SEQ ID NO: 36526 - DNA, 25 bp, E. coli
aattatctgatctaggctggcggcg

SEQ ID NO: 36527 - DNA, 25 bp, E. coli
cagccgtcaacgcagaagatgtgga

SEQ ID NO: 36528 - DNA, 25 bp, E. coli
cagccgtcaacggagaagatgtgga

SEQ ID NO: 36529 - DNA, 25 bp, E. coli
tattgtggtcaagcgcggtaaccgc

SEQ ID NO: 36530 - DNA, 25 bp, E. coli
tattgtggtcaaccgcggtaaccgc

SEQ ID NO: 36531 - DNA, 25 bp, E. coli
tgtggattcactcaaaccgggcgat

SEQ ID NO: 36532 - DNA, 25 bp, E. coli
tgtggattcactgaaaccgggcgat

SEQ ID NO: 36533 - DNA, 25 bp, E. coli
tgagttccgcgatagcagcattccc

SEQ ID NO: 36534 - DNA, 25 bp, E. coli
tgcagttctggataaagtccgcccg

SEQ ID NO: 36535 - DNA, 25 bp, E. coli
tgagttccgcgaaagcagcattccc

SEQ ID NO: 36536 - DNA, 25 bp, E. coli
tgcagttctggaaaaagtccgcccg

SEQ ID NO: 36537 - DNA, 25 bp, E. coli
tcagcatactttgagcgttcagggc

SEQ ID NO: 36538 - DNA, 25 bp, E. coli
tcagcatactttcagcgttcagggc

SEQ ID NO: 36539 - DNA, 25 bp, E. coli
tcggatacgcaaaacatgagcggct

SEQ ID NO: 36540 - DNA, 25 bp, E. coli
tcggatacgcaatacatgagcggct

SEQ ID NO: 36541 - DNA, 25 bp, E. coli
cgagaaatgtggtggcctgacgcaa

SEQ ID NO: 36542 - DNA, 25 bp, E. coli
cgagaaatgtggaggcctgacgcaa

SEQ ID NO: 36543 - DNA, 25 bp, E. coli
ggcgacgtcatcaatattccggaga

SEQ ID NO: 36544 - DNA, 25 bp, E. coli
ggcgacgtcatctatattccggaga

SEQ ID NO: 36545 - DNA, 25 bp, E. coli
taatcgtgagcactgaccgctatgc

SEQ ID NO: 36546 - DNA, 25 bp, E. coli
taatcgtgagcagtgaccgctatgc

SEQ ID NO: 36547 - DNA, 25 bp, E. coli
gaacgcgacatctctccggttaacg

SEQ ID NO: 36548 - DNA, 25 bp, E. coli
tacggccttaatgcgtggacgaaag

SEQ ID NO: 36549 - DNA, 25 bp, E. coli
tacggccttaatccgtggacgaaag

SEQ ID NO: 36550 - DNA, 25 bp, E. coli
gaacgcgacatcactccggttaacg

SEQ ID NO: 36551 - DNA, 25 bp, E. coli
tctgttcccagaaatttcgccgcga

SEQ ID NO: 36552 - DNA, 25 bp, E. coli
tctgttcccagatatttcgccgcga

SEQ ID NO: 36553 - DNA, 25 bp, E. coli
tctatgacaaggttgaagccgagcg

SEQ ID NO: 36554 - DNA, 25 bp, E. coli
tctatgacaaggatgaagccgagcg

SEQ ID NO: 36555 - DNA, 25 bp, E. coli
tcagaactgacacaggccgaagcag

SEQ ID NO: 36556 - DNA, 25 bp, E. coli
cctggataaaacttgggatgacgac

SEQ ID NO: 36557 - DNA, 25 bp, E. coli
cctggataaaacatgggatgacgac

SEQ ID NO: 36558 - DNA, 25 bp, E. coli
gaagccgagcgcattgtcgaaaata

SEQ ID NO: 36559 - DNA, 25 bp, E. coli
gaagccgagcgctttgtcgaaaata

SEQ ID NO: 36560 - DNA, 25 bp, E. coli
cggttaacgatgtaaccatgcagga

SEQ ID NO: 36561 - DNA, 25 bp, E. coli
cggttaacgatgaaaccatgcagga

SEQ ID NO: 36562 - DNA, 25 bp, E. coli
ggatgacgacttattgccgctctgt

SEQ ID NO: 36563 - DNA, 25 bp, E. coli
ggatgacgactttttgccgctctgt

SEQ ID NO: 36564 - DNA, 25 bp, E. coli
tggactttgagctggacaatgaatc

SEQ ID NO: 36565 - DNA, 25 bp, E. coli
tggactttgagcaggacaatgaatc

SEQ ID NO: 36566 - DNA, 25 bp, E. coli
tggcagtcgcatgccaaacggatgt

SEQ ID NO: 36567 - DNA, 25 bp, E. coli
tggcagtcgcatcccaaacggatgt

SEQ ID NO: 36568 - DNA, 25 bp, E. coli
tcagaactgacagaggccgaagcag

SEQ ID NO: 36569 - DNA, 25 bp, E. coli
aagaatcggctatacgcgaggcgca

SEQ ID NO: 36570 - DNA, 25 bp, E. coli
aagaatcggctaaacgcgaggcgca

SEQ ID NO: 36571 - DNA, 25 bp, E. coli
caaatggactgataacgcggaaccg

SEQ ID NO: 36572 - DNA, 25 bp, E. coli
caaatggactgaaaacgcggaaccg

SEQ ID NO: 36573 - DNA, 25 bp, E. coli
taaaggctctcaggtcatcaaagcg

SEQ ID NO: 36574 - DNA, 25 bp, E. coli
taaactcgaagaagaagcacgtcgc

SEQ ID NO: 36575 - DNA, 25 bp, E. coli
taaaggctctcacgtcatcaaagcg

SEQ ID NO: 36576 - DNA, 25 bp, E. coli
taaactcgaagatgaagcacgtcgc

SEQ ID NO: 36577 - DNA, 25 bp, E. coli
acaaaaagctgaacgtgaggccgca

SEQ ID NO: 36578 - DNA, 25 bp, E. coli
acaaaaagctgatcgtgaggccgca

SEQ ID NO: 36579 - DNA, 25 bp, E. coli
tgtgaaacgcgatccgcaagaggct

SEQ ID NO: 36580 - DNA, 25 bp, E. coli
tgtgaaacgcgaaccgcaagaggct

SEQ ID NO: 36581 - DNA, 25 bp, E. coli
tcgatcaggaaagcgcacagctggt

SEQ ID NO: 36582 - DNA, 25 bp, E. coli
tcgatcaggaaaccgcacagctggt

SEQ ID NO: 36583 - DNA, 25 bp, E. coli
tcgttcaacgaaagtggcctctggc

SEQ ID NO: 36584 - DNA, 25 bp, E. coli
tcgttcaacgaatgtggcctctggc

SEQ ID NO: 36585 - DNA, 25 bp, E. coli
gaagttgcactcaatcgtcagggta

SEQ ID NO: 36586 - DNA, 25 bp, E. coli
gaagttgcactctatcgtcagggta

SEQ ID NO: 36587 - DNA, 25 bp, E. coli
taagaacgaactgtcccagtacggc

SEQ ID NO: 36588 - DNA, 25 bp, E. coli
taagaacgaactctcccagtacggc

SEQ ID NO: 36589 - DNA, 25 bp, E. coli
gatatgactaaaaacgcccaggctg

SEQ ID NO: 36590 - DNA, 25 bp, E. coli
gatatgactaaatacgcccaggctg

SEQ ID NO: 36591 - DNA, 25 bp, E. coli
aagtcttccgcgacaccctgctgga

SEQ ID NO: 36592 - DNA, 25 bp, E. coli
aatatgggtcgccagcgcatacgga

SEQ ID NO: 36593 - DNA, 25 bp, E. coli
aagtcttccgcgtcaccctgctgga

SEQ ID NO: 36594 - DNA, 25 bp, E. coli
aatatgggtcgcgagcgcatacgga

SEQ ID NO: 36595 - DNA, 25 bp, E. coli
tacctgggaagtcttccgcgacacc

SEQ ID NO: 36596 - DNA, 25 bp, E. coli
tcgcgagcgcattcggagcgaagtt

SEQ ID NO: 36597 - DNA, 25 bp, E. coli
tcgcgagcgcatacggagcgaagtt

SEQ ID NO: 36598 - DNA, 25 bp, E. coli
tacctgggaagtgttccgcgacacc

SEQ ID NO: 36599 - DNA, 25 bp, E. coli
gccgccgcgcaaaccattgaagtgg

SEQ ID NO: 36600 - DNA, 25 bp, E. coli
gccgccgcgcaatccattgaagtgg

SEQ ID NO: 36601 - DNA, 25 bp, E. coli
gcaatgctctgctacgtaacgccga

SEQ ID NO: 36602 - DNA, 25 bp, E. coli
gcaatgctctgcaacgtaacgccga

SEQ ID NO: 36603 - DNA, 25 bp, E. coli
cgtgatggatctatccactggtcgc

SEQ ID NO: 36604 - DNA, 25 bp, E. coli
cgtgatggatctttccactggtcgc

SEQ ID NO: 36605 - DNA, 25 bp, E. coli
gataccgtgatggatctttccactg

SEQ ID NO: 36606 - DNA, 25 bp, E. coli
gattattggccgtaacttcctggta

SEQ ID NO: 36607 - DNA, 25 bp, E. coli
gataccgtgatgcatctttccactg

SEQ ID NO: 36608 - DNA, 25 bp, E. coli
gattattggccgaaacttcctggta

SEQ ID NO: 36609 - DNA, 25 bp, E. coli
ggtttggttgtggaatgctctgcta

SEQ ID NO: 36610 - DNA, 25 bp, E. coli
ggtttggttgtgcaatgctctgcta

SEQ ID NO: 36611 - DNA, 25 bp, E. coli
ggaacgagctatctctgcaacaaaa

SEQ ID NO: 36612 - DNA, 25 bp, E. coli
ggaacgagctatgtctgcaacaaaa

SEQ ID NO: 36613 - DNA, 25 bp, E. coli
tacgacctgaatccgctggcgttat

SEQ ID NO: 36614 - DNA, 25 bp, E. coli
tacgacctgaatgcgctggcgttat

SEQ ID NO: 36615 - DNA, 25 bp, E. coli
actttacgacctgaatgcgctggcg

SEQ ID NO: 36616 - DNA, 25 bp, E. coli
actttacgacctcaatgcgctggcg

SEQ ID NO: 36617 - DNA, 25 bp, E. coli
tgtggatgacatcgaagggcggctt

SEQ ID NO: 36618 - DNA, 25 bp, E. coli
tgtggatgacatggaagggcggctt

SEQ ID NO: 36619 - DNA, 25 bp, E. coli
tgactggtggcacgatgataagccg

SEQ ID NO: 36620 - DNA, 25 bp, E. coli
tgaagcgcctcgtcttgagagcgaa

SEQ ID NO: 36621 - DNA, 25 bp, E. coli
tgactggtggcaggatgataagccg

SEQ ID NO: 36622 - DNA, 25 bp, E. coli
tgaagcgcctcgacttgagagcgaa

SEQ ID NO: 36623 - DNA, 25 bp, E. coli
tcttgagagcgataaacagcgcgac

SEQ ID NO: 36624 - DNA, 25 bp, E. coli
tcttgagagcgaaaaacagcgcgac

SEQ ID NO: 36625 - DNA, 25 bp, E. coli
gcctcgtcttgacagcgaaaaacag

SEQ ID NO: 36626 - DNA, 25 bp, E. coli
gcctcgtcttgagagcgaaaaacag

SEQ ID NO: 36627 - DNA, 25 bp, E. coli
gagatggacgactctgggcttagct

SEQ ID NO: 36628 - DNA, 25 bp, E. coli
gcactttacgacgtgaatgcgctgg

SEQ ID NO: 36629 - DNA, 25 bp, E. coli
gagatggacgacactgggcttagct

SEQ ID NO: 36630 - DNA, 25 bp, E. coli
gcactttacgacctgaatgcgctgg

SEQ ID NO: 36631 - DNA, 25 bp, E. coli
cgtcttgagagccaaaaacagcgcg

SEQ ID NO: 36632 - DNA, 25 bp, E. coli
cgtcttgagagcgaaaaacagcgcg

SEQ ID NO: 36633 - DNA, 25 bp, E. coli
ggatgataagccgtggctgcgtgaa

SEQ ID NO: 36634 - DNA, 25 bp, E. coli
ggatgataagccctggctgcgtgaa

SEQ ID NO: 36635 - DNA, 25 bp, E. coli
aatttctacaaactcgtgtctggcg

SEQ ID NO: 36636 - DNA, 25 bp, E. coli
aatttctacaaagtcgtgtctggcg

SEQ ID NO: 36637 - DNA, 25 bp, E. coli
tgtctggcggaataagtctggctgc

SEQ ID NO: 36638 - DNA, 25 bp, E. coli
tgtctggcggaaaaagtctggctgc

SEQ ID NO: 36639 - DNA, 25 bp, E. coli
tgtcagtatacctgaaccagaggcg

SEQ ID NO: 36640 - DNA, 25 bp, E. coli
tgtcagtataccagaaccagaggcg

SEQ ID NO: 36641 - DNA, 25 bp, E. coli
gccgcagattgcatcgccatttttg

SEQ ID NO: 36642 - DNA, 25 bp, E. coli
gccgcagattgcttcgccatttttg

SEQ ID NO: 36643 - DNA, 25 bp, E. coli
cctgcccgggtctgtcaatggtcgt

SEQ ID NO: 36644 - DNA, 25 bp, E. coli
cctgcccgggtcagtcaatggtcgt

SEQ ID NO: 36645 - DNA, 25 bp, E. coli
gctgcggagaatttcagcctgcccg

SEQ ID NO: 36646 - DNA, 25 bp, E. coli
gctgcggagaatatcagcctgcccg

SEQ ID NO: 36647 - DNA, 25 bp, E. coli
gaaccagaggcgatttcgggacaat

SEQ ID NO: 36648 - DNA, 25 bp, E. coli
gaaccagaggcgttttcgggacaat

SEQ ID NO: 36649 - DNA, 25 bp, E. coli
cccctgggtgaatcaaatagataaa

SEQ ID NO: 36650 - DNA, 25 bp, E. coli
cgaatcggctttcgaaagtgggcta

SEQ ID NO: 36651 - DNA, 25 bp, E. coli
cccctgggtgaaacaaatagataaa

SEQ ID NO: 36652 - DNA, 25 bp, E. coli
cgaatcggctttggaaagtgggcta

SEQ ID NO: 36653 - DNA, 25 bp, E. coli
cgggacaattgtggccgaatcggct

SEQ ID NO: 36654 - DNA, 25 bp, E. coli
cgggacaattgtcgccgaatcggct

SEQ ID NO: 36655 - DNA, 25 bp, E. coli
tcaatggtcgttccggcttacccgt

SEQ ID NO: 36656 - DNA, 25 bp, E. coli
tcaatggtcgttgcggcttacccgt

SEQ ID NO: 36657 - DNA, 25 bp, E. coli
caaccatctggcttgaacctgcgag

SEQ ID NO: 36658 - DNA, 25 bp, E. coli
caaccatctggcatgaacctgcgag

SEQ ID NO: 36659 - DNA, 25 bp, E. coli
cagatggctgcttaaaaaaagaaca

SEQ ID NO: 36660 - DNA, 25 bp, E. coli
cagatggctgctaaaaaaaagaaca

SEQ ID NO: 36661 - DNA, 25 bp, E. coli
aacacgtcggataaagacatgagtg

SEQ ID NO: 36662 - DNA, 25 bp, E. coli
aacacgtcggattaagacatgagtg

SEQ ID NO: 36663 - DNA, 25 bp, E. coli
aaaagaacaaatcgtagtgtccgct

SEQ ID NO: 36664 - DNA, 25 bp, E. coli
aaaagaacaaatggtagtgtccgct

SEQ ID NO: 36665 - DNA, 25 bp, E. coli
tgtcagtacacctcaaccatctggc

SEQ ID NO: 36666 - DNA, 25 bp, E. coli
tgtcagtacaccacaaccatctggc

SEQ ID NO: 36667 - DNA, 25 bp, E. coli
tgcagatcaaaatcacgtcggataa

SEQ ID NO: 36668 - DNA, 25 bp, E. coli
tgcagatcaaaaacacgtcggataa

SEQ ID NO: 36669 - DNA, 25 bp, E. coli
tctggcttgaacctgcgagcgaacg

SEQ ID NO: 36670 - DNA, 25 bp, E. coli
tctggcttgaacgtgcgagcgaacg

SEQ ID NO: 36671 - DNA, 25 bp, E. coli
gaacgcaccgttttcctgcagatca

SEQ ID NO: 36672 - DNA, 25 bp, E. coli
gaacctgcgagcgaacgcaccgttt

SEQ ID NO: 36673 - DNA, 25 bp, E. coli
gaacgcaccgttatcctgcagatca

SEQ ID NO: 36674 - DNA, 25 bp, E. coli
gaacctgcgagccaacgcaccgttt

SEQ ID NO: 36675 - DNA, 25 bp, E. coli
ggataaagacatgagtggactacag

SEQ ID NO: 36676 - DNA, 25 bp, E. coli
ggataaagacatcagtggactacag

SEQ ID NO: 36677 - DNA, 25 bp, E. coli
ggtagtgtccgcaattgtcagtaca

SEQ ID NO: 36678 - DNA, 25 bp, E. coli
ggtagtgtccgctattgtcagtaca

SEQ ID NO: 36679 - DNA, 25 bp, E. coli
caactccagtgaagtgaatggctac

SEQ ID NO: 36680 - DNA, 25 bp, E. coli
caactccagtgatgtgaatggctac

SEQ ID NO: 36681 - DNA, 25 bp, E. coli
catccatgtgctcgtcaacaacgct

SEQ ID NO: 36682 - DNA, 25 bp, E. coli
catccatgtgctggtcaacaacgct

SEQ ID NO: 36683 - DNA, 25 bp, E. coli
ttatctggggctcattcgtcagtca

SEQ ID NO: 36684 - DNA, 25 bp, E. coli
ttatctggggctgattcgtcagtca

SEQ ID NO: 36685 - DNA, 25 bp, E. coli
tgtggtggcgatttctggcgacttt

SEQ ID NO: 36686 - DNA, 25 bp, E. coli
tgtggtggcgatatctggcgacttt

SEQ ID NO: 36687 - DNA, 25 bp, E. coli
tgctggtcaacaacgcttatctggg

SEQ ID NO: 36688 - DNA, 25 bp, E. coli
tccagtgaagtgaatggctacggtg

SEQ ID NO: 36689 - DNA, 25 bp, E. coli
tccagtgaagtgtatggctacggtg

SEQ ID NO: 36690 - DNA, 25 bp, E. coli
tgctggtcaacatcgcttatctggg

SEQ ID NO: 36691 - DNA, 25 bp, E. coli
gctacggtgttgtccacgtaaaagt

SEQ ID NO: 36692 - DNA, 25 bp, E. coli
gctacggtgttgaccacgtaaaagt

SEQ ID NO: 36693 - DNA, 25 bp, E. coli
gaagtgaatggcaacggtgttgacc

SEQ ID NO: 36694 - DNA, 25 bp, E. coli
gaatggctacggagttgaccacgta

SEQ ID NO: 36695 - DNA, 25 bp, E. coli
gaatggctacggtgttgaccacgta

SEQ ID NO: 36696 - DNA, 25 bp, E. coli
gaagtgaatggctacggtgttgacc

SEQ ID NO: 36697 - DNA, 25 bp, E. coli
cgatttctggcgtctttgacttcca

SEQ ID NO: 36698 - DNA, 25 bp, E. coli
cgatttctggcgactttgacttcca

SEQ ID NO: 36699 - DNA, 25 bp, E. coli
tggcgactttgagttccagttcctg

SEQ ID NO: 36700 - DNA, 25 bp, E. coli
tggcgactttgacttccagttcctg

SEQ ID NO: 36701 - DNA, 25 bp, E. coli
aatttttacaaagccagctcacggg

SEQ ID NO: 36702 - DNA, 25 bp, E. coli
aatttttacaaacccagctcacggg

SEQ ID NO: 36703 - DNA, 25 bp, E. coli
catgttgaagtccatcctcgggaaa

SEQ ID NO: 36704 - DNA, 25 bp, E. coli
catgttgaagtcgatcctcgggaaa

SEQ ID NO: 36705 - DNA, 25 bp, E. coli
cggatgcgtgaagaaagccctttac

SEQ ID NO: 36706 - DNA, 25 bp, E. coli
cggatgcgtgaacaaagccctttac

SEQ ID NO: 36707 - DNA, 25 bp, E. coli
tatttctgcgtagcggaacgcgcgg

SEQ ID NO: 36708 - DNA, 25 bp, E. coli
tatttctgcgtaccggaacgcgcgg

SEQ ID NO: 36709 - DNA, 25 bp, E. coli
ttgtgctgaaccgagtaaagcggat

SEQ ID NO: 36710 - DNA, 25 bp, E. coli
ttgtgctgaacccagtaaagcggat

SEQ ID NO: 36711 - DNA, 25 bp, E. coli
ttcatggatttaggcgtgctcgacc

SEQ ID NO: 36712 - DNA, 25 bp, E. coli
ttcatggatttacgcgtgctcgacc

SEQ ID NO: 36713 - DNA, 25 bp, E. coli
tccggcacgctaaaccatgttgaag

SEQ ID NO: 36714 - DNA, 25 bp, E. coli
tccggcacgctataccatgttgaag

SEQ ID NO: 36715 - DNA, 25 bp, E. coli
gataaaaataaaggcctcggcgctg

SEQ ID NO: 36716 - DNA, 25 bp, E. coli
gtatgtttcttttgccgaacgcggc

SEQ ID NO: 36717 - DNA, 25 bp, E. coli
gataaaaataaacgcctcggcgctg

SEQ ID NO: 36718 - DNA, 25 bp, E. coli
gtatgtttctttagccgaacgcggc

SEQ ID NO: 36719 - DNA, 25 bp, E. coli
taaccctggcaatagagatgctgga

SEQ ID NO: 36720 - DNA, 25 bp, E. coli
taaccctggcaaaagagatgctgga

SEQ ID NO: 36721 - DNA, 25 bp, E. coli
gatgccgcgcgataaaatgctgaag

SEQ ID NO: 36722 - DNA, 25 bp, E. coli
gatgccgcgcgaaaaaatgctgaag

SEQ ID NO: 36723 - DNA, 25 bp, E. coli
catcttcctggtcagcaaggccgtt

SEQ ID NO: 36724 - DNA, 25 bp, E. coli
catttgatggcgaaattagccgcgc

SEQ ID NO: 36725 - DNA, 25 bp, E. coli
catttgatggcgtaattagccgcgc

SEQ ID NO: 36726 - DNA, 25 bp, E. coli
catcttcctggtgagcaaggccgtt

SEQ ID NO: 36727 - DNA, 25 bp, E. coli
tgaacggtttatggatgtcggcacc

SEQ ID NO: 36728 - DNA, 25 bp, E. coli
tgaacggtttatcgatgtcggcacc

SEQ ID NO: 36729 - DNA, 25 bp, E. coli
tccttcgtcaggtgcaacatgagct

SEQ ID NO: 36730 - DNA, 25 bp, E. coli
tccttcgtcaggagcaacatgagct

SEQ ID NO: 36731 - DNA, 25 bp, E. coli
tctcgatagcatagtggtggcaccg

SEQ ID NO: 36732 - DNA, 25 bp, E. coli
tctcgatagcattgtggtggcaccg

SEQ ID NO: 36733 - DNA, 25 bp, E. coli
tctacgcgctgatagggcaaatgcc

SEQ ID NO: 36734 - DNA, 25 bp, E. coli
tctacgcgctgaaagggcaaatgcc

SEQ ID NO: 36735 - DNA, 25 bp, E. coli
gaaaaaccagctaattgcctacgtg

SEQ ID NO: 36736 - DNA, 25 bp, E. coli
gaacgatatggtgagctggtgccac

SEQ ID NO: 36737 - DNA, 25 bp, E. coli
gaaaaaccagcttattgcctacgtg

SEQ ID NO: 36738 - DNA, 25 bp, E. coli
gaacgatatggtcagctggtgccac

SEQ ID NO: 36739 - DNA, 25 bp, E. coli
tggatagccttggtaaacgcgtgcg

SEQ ID NO: 36740 - DNA, 25 bp, E. coli
tggatagccttgctaaacgcgtgcg

SEQ ID NO: 36741 - DNA, 25 bp, E. coli
gatcctaatgagttgctggtacgcc

SEQ ID NO: 36742 - DNA, 25 bp, E. coli
gatgaaatcgctatgttgcccgaag

SEQ ID NO: 36743 - DNA, 25 bp, E. coli
gatcctaatgagatgctggtacgcc

SEQ ID NO: 36744 - DNA, 25 bp, E. coli
gatgaaatcgctttgttgcccgaag

SEQ ID NO: 36745 - DNA, 25 bp, E. coli
caatacttaaatgccagccgtctgt

SEQ ID NO: 36746 - DNA, 25 bp, E. coli
caatacttaaatcccagccgtctgt

SEQ ID NO: 36747 - DNA, 25 bp, E. coli
cagccgtctgtccttggatttaaaa

SEQ ID NO: 36748 - DNA, 25 bp, E. coli
cagccgtctgtcgttggatttaaaa

SEQ ID NO: 36749 - DNA, 25 bp, E. coli
taaaaaagtgaatatgaaggctcct

SEQ ID NO: 36750 - DNA, 25 bp, E. coli
taaaaaagtgaaaatgaaggctcct

SEQ ID NO: 36751 - DNA, 25 bp, E. coli
tgtttctgacatgaatcctttcggg

SEQ ID NO: 36752 - DNA, 25 bp, E. coli
tgtttctgacatcaatcctttcggg

SEQ ID NO: 36753 - DNA, 25 bp, E. coli
gcccgtgttgtcttggttcccagta

SEQ ID NO: 36754 - DNA, 25 bp, E. coli
ccatattcactttagatgcccgtgt

SEQ ID NO: 36755 - DNA, 25 bp, E. coli
ccatattcacttaagatgcccgtgt

SEQ ID NO: 36756 - DNA, 25 bp, E. coli
gcccgtgttgtcatggttcccagta

SEQ ID NO: 36757 - DNA, 25 bp, E. coli
gaaaatgaaggcaccttcgggagct

SEQ ID NO: 36758 - DNA, 25 bp, E. coli
gaaaatgaaggctccttcgggagct

SEQ ID NO: 36759 - DNA, 25 bp, E. coli
cgggagcttttttgcttggtgtcta

SEQ ID NO: 36760 - DNA, 25 bp, E. coli
cgggagctttttagcttggtgtcta

SEQ ID NO: 36761 - DNA, 25 bp, E. coli
ggtgtctattcgatggatactcaca

SEQ ID NO: 36762 - DNA, 25 bp, E. coli
ggttcccagtattgaacatcatctt

SEQ ID NO: 36763 - DNA, 25 bp, E. coli
ggttcccagtatagaacatcatctt

SEQ ID NO: 36764 - DNA, 25 bp, E. coli
ggtgtctattcgttggatactcaca

SEQ ID NO: 36765 - DNA, 25 bp, E. coli
gatggatactcagatactacggtaa

SEQ ID NO: 36766 - DNA, 25 bp, E. coli
gatggatactcacatactacggtaa

SEQ ID NO: 36767 - DNA, 25 bp, E. coli
caagatgcccggttgctcaaagtca

SEQ ID NO: 36768 - DNA, 25 bp, E. coli
caattgctcgtggtaaagatgcccc

SEQ ID NO: 36769 - DNA, 25 bp, E. coli
caattgctcgtgctaaagatgcccc

SEQ ID NO: 36770 - DNA, 25 bp, E. coli
caagatgcccggatgctcaaagtca

SEQ ID NO: 36771 - DNA, 25 bp, E. coli
taaagcgtatctggactctggtgac

SEQ ID NO: 36772 - DNA, 25 bp, E. coli
tacgaaggttctctcggcggcatga

SEQ ID NO: 36773 - DNA, 25 bp, E. coli
taaagcgtatctcgactctggtgac

SEQ ID NO: 36774 - DNA, 25 bp, E. coli
tacgaaggttctgtcggcggcatga

SEQ ID NO: 36775 - DNA, 25 bp, E. coli
tataagcatcaggaaatgggccagc

SEQ ID NO: 36776 - DNA, 25 bp, E. coli
tatttgaacgttatgccgggccgga

SEQ ID NO: 36777 - DNA, 25 bp, E. coli
tattaacgatgtattccagtccggg

SEQ ID NO: 36778 - DNA, 25 bp, E. coli
tattctgcccgttaaacaaccctgg

SEQ ID NO: 36779 - DNA, 25 bp, E. coli
tatttgaacgttttgccgggccgga

SEQ ID NO: 36780 - DNA, 25 bp, E. coli
tataagcatcagcaaatgggccagc

SEQ ID NO: 36781 - DNA, 25 bp, E. coli
tattaacgatgttttccagtccggg

SEQ ID NO: 36782 - DNA, 25 bp, E. coli
tattctgcccgtaaaacaaccctgg

SEQ ID NO: 36783 - DNA, 25 bp, E. coli
ttaagtttcgccaggcaagcgccgg

SEQ ID NO: 36784 - DNA, 25 bp, E. coli
ttaagtttcgcctggcaagcgccgg

SEQ ID NO: 36785 - DNA, 25 bp, E. coli
tctttgacgaaaggccaacgctagg

SEQ ID NO: 36786 - DNA, 25 bp, E. coli
tcactggcggaactgggattttcac

SEQ ID NO: 36787 - DNA, 25 bp, E. coli
tctttgacgaaacgccaacgctagg

SEQ ID NO: 36788 - DNA, 25 bp, E. coli
tcactggcggaagtgggattttcac

SEQ ID NO: 36789 - DNA, 25 bp, E. coli
caatgaaagatgttgcccgcctggc

SEQ ID NO: 36790 - DNA, 25 bp, E. coli
caatgaaagatgatgcccgcctggc

SEQ ID NO: 36791 - DNA, 25 bp, E. coli
tattcaggataactcgttgctgggc

SEQ ID NO: 36792 - DNA, 25 bp, E. coli
tattcaggataagtcgttgctgggc

SEQ ID NO: 36793 - DNA, 25 bp, E. coli
ttaccaggcgttttatcaggcagag

SEQ ID NO: 36794 - DNA, 25 bp, E. coli
ttaccaggcgttatatcaggcagag

SEQ ID NO: 36795 - DNA, 25 bp, E. coli
tgacgatatcgatctggcaagcttt

SEQ ID NO: 36796 - DNA, 25 bp, E. coli
tgcaataccgaacgcgatgaacagc

SEQ ID NO: 36797 - DNA, 25 bp, E. coli
tgacgatatcgaactggcaagcttt

SEQ ID NO: 36798 - DNA, 25 bp, E. coli
tgcaataccgaaggcgatgaacagc

SEQ ID NO: 36799 - DNA, 25 bp, E. coli
tctggaaacgctgatgcaaaaacgc

SEQ ID NO: 36800 - DNA, 25 bp, E. coli
tcaggcagagttacaggttccgcag

SEQ ID NO: 36801 - DNA, 25 bp, E. coli
tctttaccggaaatgacgctatggc

SEQ ID NO: 36802 - DNA, 25 bp, E. coli
tctggaaacgctcatgcaaaaacgc

SEQ ID NO: 36803 - DNA, 25 bp, E. coli
tcaggcagagtttcaggttccgcag

SEQ ID NO: 36804 - DNA, 25 bp, E. coli
tctttaccggaattgacgctatggc

SEQ ID NO: 36805 - DNA, 25 bp, E. coli
gaaacgtgcgggtctcaacattcct

SEQ ID NO: 36806 - DNA, 25 bp, E. coli
gaaacgtgcgggactcaacattcct

SEQ ID NO: 36807 - DNA, 25 bp, E. coli
tggcgggcgtttgtacctcaacagt

SEQ ID NO: 36808 - DNA, 25 bp, E. coli
tggcgggcgtttctacctcaacagt

SEQ ID NO: 36809 - DNA, 25 bp, E. coli
taacggcgggtttgacgctatgcgc

SEQ ID NO: 36810 - DNA, 25 bp, E. coli
taacggcgggttagacgctatgcgc

SEQ ID NO: 36811 - DNA, 25 bp, E. coli
cagcctggcggatatcggtgaagca

SEQ ID NO: 36812 - DNA, 25 bp, E. coli
cagcctggcggaaatcggtgaagca

SEQ ID NO: 36813 - DNA, 25 bp, E. coli
tacatcgctggtgtgactgcgccga

SEQ ID NO: 36814 - DNA, 25 bp, E. coli
tacatcgctggtctgactgcgccga

SEQ ID NO: 36815 - DNA, 25 bp, E. coli
aaacaccaaggtaatctgccagggc

SEQ ID NO: 36816 - DNA, 25 bp, E. coli
aaacaccaaggttatctgccagggc

SEQ ID NO: 36817 - DNA, 25 bp, E. coli
tatgaagcggttaaacagaccacgg

SEQ ID NO: 36818 - DNA, 25 bp, E. coli
tatgaagcggtttaacagaccacgg

SEQ ID NO: 36819 - DNA, 25 bp, E. coli
tgaagcaggcgttcgtatgatcggc

SEQ ID NO: 36820 - DNA, 25 bp, E. coli
tgaagcaggcgtacgtatgatcggc

SEQ ID NO: 36821 - DNA, 25 bp, E. coli
ccaagccagttgtgggttacatcgc

SEQ ID NO: 36822 - DNA, 25 bp, E. coli
ccaagccagttgagggttacatcgc

SEQ ID NO: 36823 - DNA, 25 bp, E. coli
gcactaaaatggatggcggcgtaac

SEQ ID NO: 36824 - DNA, 25 bp, E. coli
gcactaaaatggttggcggcgtaac

SEQ ID NO: 36825 - DNA, 25 bp, E. coli
gaaattcgctgctctggaagccgca

SEQ ID NO: 36826 - DNA, 25 bp, E. coli
gaaatgttcgaataagatccgcaga

SEQ ID NO: 36827 - DNA, 25 bp, E. coli
gaaattcgctgcactggaagccgca

SEQ ID NO: 36828 - DNA, 25 bp, E. coli
gaaatgttcgaaaaagatccgcaga

SEQ ID NO: 36829 - DNA, 25 bp, E. coli
gatccgcagacccaagcgatcgtga

SEQ ID NO: 36830 - DNA, 25 bp, E. coli
ggtcacattcactaaccgggtaaag

SEQ ID NO: 36831 - DNA, 25 bp, E. coli
ggtcacattcacaaaccgggtaaag

SEQ ID NO: 36832 - DNA, 25 bp, E. coli
gatccgcagaccgaagcgatcgtga

SEQ ID NO: 36833 - DNA, 25 bp, E. coli
catttaaacggtgtaactgtctgcg

SEQ ID NO: 36834 - DNA, 25 bp, E. coli
catttaaacggtctaactgtctgcg

SEQ ID NO: 36835 - DNA, 25 bp, E. coli
tgttattaacgacaaacgtggctga

SEQ ID NO: 36836 - DNA, 25 bp, E. coli
tgtttatcccacaatcacggctgaa

SEQ ID NO: 36837 - DNA, 25 bp, E. coli
tgtgtggctcctgacacaggcaaac

SEQ ID NO: 36838 - DNA, 25 bp, E. coli
tgtttatcccactatcacggctgaa

SEQ ID NO: 36839 - DNA, 25 bp, E. coli
tgtgtggctcctcacacaggcaaac

SEQ ID NO: 36840 - DNA, 25 bp, E. coli
tgttattaacgagaaacgtggctga

SEQ ID NO: 36841 - DNA, 25 bp, E. coli
tcgtacatgagcagcttgtgtggct

SEQ ID NO: 36842 - DNA, 25 bp, E. coli
tcgccttgcgcataccaggtactgg

SEQ ID NO: 36843 - DNA, 25 bp, E. coli
tcgccttgcgcaaaccaggtactgg

SEQ ID NO: 36844 - DNA, 25 bp, E. coli
tcgtacatgagctgcttgtgtggct

SEQ ID NO: 36845 - DNA, 25 bp, E. coli
gacaattatcagactttatccggcg

SEQ ID NO: 36846 - DNA, 25 bp, E. coli
gacaattatcagtctttatccggcg

SEQ ID NO: 36847 - DNA, 25 bp, E. coli
gatttttggcgcaagatcacaggca

SEQ ID NO: 36848 - DNA, 25 bp, E. coli
gatttttggcgctagatcacaggca

SEQ ID NO: 36849 - DNA, 25 bp, E. coli
taatgttaagtactgattcgtgccg

SEQ ID NO: 36850 - DNA, 25 bp, E. coli
taatgttaagtagtgattcgtgccg

SEQ ID NO: 36851 - DNA, 25 bp, E. coli
taatattttgcgtgttcacgccgaa

SEQ ID NO: 36852 - DNA, 25 bp, E. coli
taatattttgcgagttcacgccgaa

SEQ ID NO: 36853 - DNA, 25 bp, E. coli
gatgtctcgtttaacccgaccgtcg

SEQ ID NO: 36854 - DNA, 25 bp, E. coli
gatgtctcgttttacccgaccgtcg

SEQ ID NO: 36855 - DNA, 25 bp, E. coli
caaatggatccagagcggcaaaacg

SEQ ID NO: 36856 - DNA, 25 bp, E. coli
cacgcagcgcagttgtaaggtgaca

SEQ ID NO: 36857 - DNA, 25 bp, E. coli
caaatggatccacagcggcaaaacg

SEQ ID NO: 36858 - DNA, 25 bp, E. coli
cacgcagcgcagatgtaaggtgaca

SEQ ID NO: 36859 - DNA, 25 bp, E. coli
aaaacggcgtgcatatcggtgcggt

SEQ ID NO: 36860 - DNA, 25 bp, E. coli
aaaacggcgtgcttatcggtgcggt

SEQ ID NO: 36861 - DNA, 25 bp, E. coli
tgtcattgatgaggcttgccgcacc

SEQ ID NO: 36862 - DNA, 25 bp, E. coli
tgtcattgatgacgcttgccgcacc

SEQ ID NO: 36863 - DNA, 25 bp, E. coli
tgcgagaagttctgcagcccgaacg

SEQ ID NO: 36864 - DNA, 25 bp, E. coli
tgcgagaagttcagcagcccgaacg

SEQ ID NO: 36865 - DNA, 25 bp, E. coli
gctttttatagctaccggcgcggca

SEQ ID NO: 36866 - DNA, 25 bp, E. coli
gctgcgaaagctgggaaaacgccaa

SEQ ID NO: 36867 - DNA, 25 bp, E. coli
gctttttatagcaaccggcgcggca

SEQ ID NO: 36868 - DNA, 25 bp, E. coli
gctgcgaaagctcggaaaacgccaa

SEQ ID NO: 36869 - DNA, 25 bp, E. coli
gatttacggtattggtatcagcgcc

SEQ ID NO: 36870 - DNA, 25 bp, E. coli
gatttacggtataggtatcagcgcc

SEQ ID NO: 36871 - DNA, 25 bp, E. coli
taatggtgcacttcaccgctgcgaa

SEQ ID NO: 36872 - DNA, 25 bp, E. coli
taatggtgcactacaccgctgcgaa

SEQ ID NO: 36873 - DNA, 25 bp, E. coli
gatgactggcttagtcgtggcaacc

SEQ ID NO: 36874 - DNA, 25 bp, E. coli
gatgcactgggacaacgctgcttta

SEQ ID NO: 36875 - DNA, 25 bp, E. coli
gatgactggctttgtcgtggcaacc

SEQ ID NO: 36876 - DNA, 25 bp, E. coli
gatgcactgggagaacgctgcttta

SEQ ID NO: 36877 - DNA, 25 bp, E. coli
aactgtaccagttagttttcgcgct

SEQ ID NO: 36878 - DNA, 25 bp, E. coli
caagttgagcttcatgcggccttca

SEQ ID NO: 36879 - DNA, 25 bp, E. coli
caagttgagcttgatgcggccttca

SEQ ID NO: 36880 - DNA, 25 bp, E. coli
caaactgaaagaccttgccgccgct

SEQ ID NO: 36881 - DNA, 25 bp, E. coli
caaactgaaagagcttgccgccgct

SEQ ID NO: 36882 - DNA, 25 bp, E. coli
catgccaggccgagatgattatttt

SEQ ID NO: 36883 - DNA, 25 bp, E. coli
catgccaggccgtgatgattatttt

SEQ ID NO: 36884 - DNA, 25 bp, E. coli
taaatgcagtactaaaggatgtgcg

SEQ ID NO: 36885 - DNA, 25 bp, E. coli
taaatgcagtacaaaaggatgtgcg

SEQ ID NO: 36886 - DNA, 25 bp, E. coli
aactgtaccagtaagttttcgcgct

SEQ ID NO: 36887 - DNA, 25 bp, E. coli
tttgccacccgcgaagaagcagagt

SEQ ID NO: 36888 - DNA, 25 bp, E. coli
tttgccacccgccaagaagcagagt

SEQ ID NO: 36889 - DNA, 25 bp, E. coli
tgattgataacgtcaactgtaccag

SEQ ID NO: 36890 - DNA, 25 bp, E. coli
tgattgataacgacaactgtaccag

SEQ ID NO: 36891 - DNA, 25 bp, E. coli
tgagttatcactccgttcgttagct

SEQ ID NO: 36892 - DNA, 25 bp, E. coli
tgagttatcactgcgttcgttagct

SEQ ID NO: 36893 - DNA, 25 bp, E. coli
ccagcgtggcctataagattaagga

SEQ ID NO: 36894 - DNA, 25 bp, E. coli
ccagcgtggcctttaagattaagga

SEQ ID NO: 36895 - DNA, 25 bp, E. coli
gaaagatgtcgttgataaatgcagt

SEQ ID NO: 36896 - DNA, 25 bp, E. coli
gaaagatgtcgtagataaatgcagt

SEQ ID NO: 36897 - DNA, 25 bp, E. coli
cgattgatatcggtacggtgattga

SEQ ID NO: 36898 - DNA, 25 bp, E. coli
cgattgatatcgctacggtgattga

SEQ ID NO: 36899 - DNA, 25 bp, E. coli
aacagtgtgctgtccgataccatcg

SEQ ID NO: 36900 - DNA, 25 bp, E. coli
aacagtgtgctgaccgataccatcg

SEQ ID NO: 36901 - DNA, 25 bp, E. coli
tatcgtgccagctacaacgttgaag

SEQ ID NO: 36902 - DNA, 25 bp, E. coli
taccgcgcagaaaggcaacaaaatg

SEQ ID NO: 36903 - DNA, 25 bp, E. coli
taccgcgcagaatggcaacaaaatg

SEQ ID NO: 36904 - DNA, 25 bp, E. coli
tatcgtgccagcaacaacgttgaag

SEQ ID NO: 36905 - DNA, 25 bp, E. coli
tgtatgctgacgagtcccagggcaa

SEQ ID NO: 36906 - DNA, 25 bp, E. coli
tgggcgtcaccgaaagcattaatgg

SEQ ID NO: 36907 - DNA, 25 bp, E. coli
tgggcgtcaccgtaagcattaatgg

SEQ ID NO: 36908 - DNA, 25 bp, E. coli
tgtatgctgacgtgtcccagggcaa

SEQ ID NO: 36909 - DNA, 25 bp, E. coli
tccaacaaaaatatcgccgatgcgg

SEQ ID NO: 36910 - DNA, 25 bp, E. coli
tccaacaaaaatttcgccgatgcgg

SEQ ID NO: 36911 - DNA, 25 bp, E. coli
gctggcaaaagtcacccgcgataat

SEQ ID NO: 36912 - DNA, 25 bp, E. coli
gcgtaccgatcaggcgctggcaaaa

SEQ ID NO: 36913 - DNA, 25 bp, E. coli
gcgtaccgatcacgcgctggcaaaa

SEQ ID NO: 36914 - DNA, 25 bp, E. coli
gctggcaaaagtgacccgcgataat

SEQ ID NO: 36915 - DNA, 25 bp, E. coli
gaattcatcaagcagaacgcgcgtt

SEQ ID NO: 36916 - DNA, 25 bp, E. coli
gaattcatcaaggagaacgcgcgtt

SEQ ID NO: 36917 - DNA, 25 bp, E. coli
cgaatggcccggataatctgcaaat

SEQ ID NO: 36918 - DNA, 25 bp, E. coli
cgaatggcccggttaatctgcaaat

SEQ ID NO: 36919 - DNA, 25 bp, E. coli
gatctgcgtttcgtgctgcaagaag

SEQ ID NO: 36920 - DNA, 25 bp, E. coli
gatctgcgtttcctgctgcaagaag

SEQ ID NO: 36921 - DNA, 25 bp, E. coli
aaatgtgttgctggcggtgtgctgg

SEQ ID NO: 36922 - DNA, 25 bp, E. coli
aaagctgcattacagaagaacccga

SEQ ID NO: 36923 - DNA, 25 bp, E. coli
aacccgaaaaatgtgttgctggcgg

SEQ ID NO: 36924 - DNA, 25 bp, E. coli
aaatgtgttgctcgcggtgtgctgg

SEQ ID NO: 36925 - DNA, 25 bp, E. coli
aaagctgcattagagaagaacccga

SEQ ID NO: 36926 - DNA, 25 bp, E. coli
aacccgaaaaatctgttgctggcgg

SEQ ID NO: 36927 - DNA, 25 bp, E. coli
tatatcaggacctgattgcgcgcac

SEQ ID NO: 36928 - DNA, 25 bp, E. coli
tatatcaggaccagattgcgcgcac

SEQ ID NO: 36929 - DNA, 25 bp, E. coli
tgcattacagaacaacccgaaaaat

SEQ ID NO: 36930 - DNA, 25 bp, E. coli
tgcattacagaagaacccgaaaaat

SEQ ID NO: 36931 - DNA, 25 bp, E. coli
tgtgggtaaacccttatatcaggac

SEQ ID NO: 36932 - DNA, 25 bp, E. coli
tgtgggtaaaccgttatatcaggac

SEQ ID NO: 36933 - DNA, 25 bp, E. coli
gctgcattacagaagaacccgaaaa

SEQ ID NO: 36934 - DNA, 25 bp, E. coli
gctgcattacagtagaacccgaaaa

SEQ ID NO: 36935 - DNA, 25 bp, E. coli
ccgaaaaatgtgttgctggcggtgt

SEQ ID NO: 36936 - DNA, 25 bp, E. coli
ccgaaaaatgtgatgctggcggtgt

SEQ ID NO: 36937 - DNA, 25 bp, E. coli
gtaaaccgttatatcaggacctgat

SEQ ID NO: 36938 - DNA, 25 bp, E. coli
gtaaaccgttatttcaggacctgat

SEQ ID NO: 36939 - DNA, 25 bp, E. coli
gggtaaaccgttatatcaggacctg

SEQ ID NO: 36940 - DNA, 25 bp, E. coli
gggtgtgggtaaaccgttatatcag

SEQ ID NO: 36941 - DNA, 25 bp, E. coli
gggtaaaccgttttatcaggacctg

SEQ ID NO: 36942 - DNA, 25 bp, E. coli
gggtgtgggtaatccgttatatcag

SEQ ID NO: 36943 - DNA, 25 bp, E. coli
caattggcgttgagctggagagcgg

SEQ ID NO: 36944 - DNA, 25 bp, E. coli
caattggcgttgtgctggagagcgg

SEQ ID NO: 36945 - DNA, 25 bp, E. coli
cagacggtcaggcaagttcagaatg

SEQ ID NO: 36946 - DNA, 25 bp, E. coli
cagacggtcagggaagttcagaatg

SEQ ID NO: 36947 - DNA, 25 bp, E. coli
agcagacggtcagggaagttcagaa

SEQ ID NO: 36948 - DNA, 25 bp, E. coli
agcagacggtcacggaagttcagaa

SEQ ID NO: 36949 - DNA, 25 bp, E. coli
tttgagcagacgctcagggaagttc

SEQ ID NO: 36950 - DNA, 25 bp, E. coli
tttgagcagacggtcagggaagttc

SEQ ID NO: 36951 - DNA, 25 bp, E. coli
tcagggaagttctgaatgtagtcag

SEQ ID NO: 36952 - DNA, 25 bp, E. coli
tcagggaagttcagaatgtagtcag

SEQ ID NO: 36953 - DNA, 25 bp, E. coli
tcagaatgtagtcagtcagaacgga

SEQ ID NO: 36954 - DNA, 25 bp, E. coli
gctagggcgtcgtgcaattggcgtt

SEQ ID NO: 36955 - DNA, 25 bp, E. coli
gctagggcgtcgagcaattggcgtt

SEQ ID NO: 36956 - DNA, 25 bp, E. coli
gaatgtagtcagacagaacggatga

SEQ ID NO: 36957 - DNA, 25 bp, E. coli
gaatgtagtcagtcagaacggatga

SEQ ID NO: 36958 - DNA, 25 bp, E. coli
gacggtcagggaagttcagaatgta

SEQ ID NO: 36959 - DNA, 25 bp, E. coli
tggagagcgggccttttgagcagac

SEQ ID NO: 36960 - DNA, 25 bp, E. coli
ggaagttcagaaagtagtcagtcag

SEQ ID NO: 36961 - DNA, 25 bp, E. coli
ggaagttcagaatgtagtcagtcag

SEQ ID NO: 36962 - DNA, 25 bp, E. coli
tggagagcgggcgttttgagcagac

SEQ ID NO: 36963 - DNA, 25 bp, E. coli
tcagaatgtagtgagtcagaacgga

SEQ ID NO: 36964 - DNA, 25 bp, E. coli
gacggtcagggatgttcagaatgta

SEQ ID NO: 36965 - DNA, 25 bp, E. coli
aaggcgtgctgcctattcccgaagg

SEQ ID NO: 36966 - DNA, 25 bp, E. coli
aaggcgtgctgcgtattcccgaagg

SEQ ID NO: 36967 - DNA, 25 bp, E. coli
catcaccggtttactcggcagcggg

SEQ ID NO: 36968 - DNA, 25 bp, E. coli
cagaccgcttgtagatagagccgac

SEQ ID NO: 36969 - DNA, 25 bp, E. coli
cagaccgcttgttgatagagccgac

SEQ ID NO: 36970 - DNA, 25 bp, E. coli
catcaccggttttctcggcagcggg

SEQ ID NO: 36971 - DNA, 25 bp, E. coli
tactgcgtcaggcaaaaccagaccg

SEQ ID NO: 36972 - DNA, 25 bp, E. coli
tactgcgtcagggaaaaccagaccg

SEQ ID NO: 36973 - DNA, 25 bp, E. coli
tatgaaccgtggatagatctgcgcg

SEQ ID NO: 36974 - DNA, 25 bp, E. coli
tatgaaccgtggttagatctgcgcg

SEQ ID NO: 36975 - DNA, 25 bp, E. coli
ttcccgaagggcaggtgcgaatcaa

SEQ ID NO: 36976 - DNA, 25 bp, E. coli
ttcccgaagggctggtgcgaatcaa

SEQ ID NO: 36977 - DNA, 25 bp, E. coli
tgcgaatcaaccctcagggcgatga

SEQ ID NO: 36978 - DNA, 25 bp, E. coli
tgcgaatcaaccgtcagggcgatga

SEQ ID NO: 36979 - DNA, 25 bp, E. coli
gaagcttcgtttagcgactaccgcg

SEQ ID NO: 36980 - DNA, 25 bp, E. coli
gaattgatggtggtttgctcgccga

SEQ ID NO: 36981 - DNA, 25 bp, E. coli
gaagcttcgttttgcgactaccgcg

SEQ ID NO: 36982 - DNA, 25 bp, E. coli
gaattgatggtgctttgctcgccga

SEQ ID NO: 36983 - DNA, 25 bp, E. coli
gactggaatgccttgcagagcgcgc

SEQ ID NO: 36984 - DNA, 25 bp, E. coli
gactggaatgccatgcagagcgcgc

SEQ ID NO: 36985 - DNA, 25 bp, E. coli
gggcgatgacctccacattgaaacg

SEQ ID NO: 36986 - DNA, 25 bp, E. coli
gggcgatgacctgcacattgaaacg

SEQ ID NO: 36987 - DNA, 25 bp, E. coli
aatttaatccgcgtggatacgcggc

SEQ ID NO: 36988 - DNA, 25 bp, E. coli
aatttaatccgcctggatacgcggc

SEQ ID NO: 36989 - DNA, 25 bp, E. coli
catattcgggaactggaggatgaac

SEQ ID NO: 36990 - DNA, 25 bp, E. coli
catattcgggaagtggaggatgaac

SEQ ID NO: 36991 - DNA, 25 bp, E. coli
tactgtctggttgggactgaagcga

SEQ ID NO: 36992 - DNA, 25 bp, E. coli
tactgtctggttcggactgaagcga

SEQ ID NO: 36993 - DNA, 25 bp, E. coli
actgaaccgggctaagcattactgg

SEQ ID NO: 36994 - DNA, 25 bp, E. coli
actgaaccgggcaaagcattactgg

SEQ ID NO: 36995 - DNA, 25 bp, E. coli
tttgttcgacgacgtaagcgactgc

SEQ ID NO: 36996 - DNA, 25 bp, E. coli
tttgttcgacgaggtaagcgactgc

SEQ ID NO: 36997 - DNA, 25 bp, E. coli
tgtttaccaacgttacgtctggcgt

SEQ ID NO: 36998 - DNA, 25 bp, E. coli
tgtttaccaacgatacgtctggcgt

SEQ ID NO: 36999 - DNA, 25 bp, E. coli
ccagcgagcgtttgagtaatgaccc

SEQ ID NO: 37000 - DNA, 25 bp, E. coli
cctgacagaggttgcgaatatgctt

SEQ ID NO: 37001 - DNA, 25 bp, E. coli
ccagcgagcgttagagtaatgaccc

SEQ ID NO: 37002 - DNA, 25 bp, E. coli
cctgacagaggtagcgaatatgctt

SEQ ID NO: 37003 - DNA, 25 bp, E. coli
gaatcaatagcgaagtggccgttaa

SEQ ID NO: 37004 - DNA, 25 bp, E. coli
gaatcaatagcgtagtggccgttaa

SEQ ID NO: 37005 - DNA, 25 bp, E. coli
cgactgctgggcttgactgaaccgg

SEQ ID NO: 37006 - DNA, 25 bp, E. coli
cgactgctgggcatgactgaaccgg

SEQ ID NO: 37007 - DNA, 25 bp, E. coli
ctgatattggtatcgccagcgagcg

SEQ ID NO: 37008 - DNA, 25 bp, E. coli
ctgatattggtaacgccagcgagcg

SEQ ID NO: 37009 - DNA, 25 bp, E. coli
aatatgacgaacgtctggagactga

SEQ ID NO: 37010 - DNA, 25 bp, E. coli
aatatgacgaacctctggagactga

SEQ ID NO: 37011 - DNA, 25 bp, E. coli
aagcgccgcccggaatatgacgaac

SEQ ID NO: 37012 - DNA, 25 bp, E. coli
aagttgaaccgtggcgtgctggaaa

SEQ ID NO: 37013 - DNA, 25 bp, E. coli
aagcgccgcccgcaatatgacgaac

SEQ ID NO: 37014 - DNA, 25 bp, E. coli
aagttgaaccgtcgcgtgctggaaa

SEQ ID NO: 37015 - DNA, 25 bp, E. coli
caaaaagttgaaccgtcgcgtgctg

SEQ ID NO: 37016 - DNA, 25 bp, E. coli
caaaaagttgaagcgtcgcgtgctg

SEQ ID NO: 37017 - DNA, 25 bp, E. coli
agggccaggccgtggctccggtgcg

SEQ ID NO: 37018 - DNA, 25 bp, E. coli
agggccaggccgaggctccggtgcg

SEQ ID NO: 37019 - DNA, 25 bp, E. coli
tgtcgcgttttatgaagaacacttc

SEQ ID NO: 37020 - DNA, 25 bp, E. coli
tgtcgcgttttaagaagaacacttc

SEQ ID NO: 37021 - DNA, 25 bp, E. coli
tgagtgtgtcgcgttttatgaagaa

SEQ ID NO: 37022 - DNA, 25 bp, E. coli
tgagtgtgtcgccttttatgaagaa

SEQ ID NO: 37023 - DNA, 25 bp, E. coli
gctccggtgcggcttcactggtggc

SEQ ID NO: 37024 - DNA, 25 bp, E. coli
gctccggtgcgggttcactggtggc

SEQ ID NO: 37025 - DNA, 25 bp, E. coli
gacaccaaaaagttgaaccgtcgcg

SEQ ID NO: 37026 - DNA, 25 bp, E. coli
gacaccaaaaagatgaaccgtcgcg

SEQ ID NO: 37027 - DNA, 25 bp, E. coli
ccgcccggaataagacgaacgtctg

SEQ ID NO: 37028 - DNA, 25 bp, E. coli
ccgcccggaatatgacgaacgtctg

SEQ ID NO: 37029 - DNA, 25 bp, E. coli
gatccgcgacgttggccgcgtgctg

SEQ ID NO: 37030 - DNA, 25 bp, E. coli
gatccgcgacgtaggccgcgtgctg

SEQ ID NO: 37031 - DNA, 25 bp, E. coli
taacaaatcgcgcaaatggtcaaaa

SEQ ID NO: 37032 - DNA, 25 bp, E. coli
taacaaatcgcggaaatggtcaaaa

SEQ ID NO: 37033 - DNA, 25 bp, E. coli
aggccagtgattattcttctatgaa

SEQ ID NO: 37034 - DNA, 25 bp, E. coli
atggtcaaaaatgaggcaaaaaggg

SEQ ID NO: 37035 - DNA, 25 bp, E. coli
atggtcaaaaatcaggcaaaaaggg

SEQ ID NO: 37036 - DNA, 25 bp, E. coli
aggccagtgatttttcttctatgaa

SEQ ID NO: 37037 - DNA, 25 bp, E. coli
tatgtgcgcattttagccggatgcg

SEQ ID NO: 37038 - DNA, 25 bp, E. coli
tatgtgcgcattatagccggatgcg

SEQ ID NO: 37039 - DNA, 25 bp, E. coli
tatttcaatgtgtaacaaatcgcgg

SEQ ID NO: 37040 - DNA, 25 bp, E. coli
tatttcaatgtgaaacaaatcgcgg

SEQ ID NO: 37041 - DNA, 25 bp, E. coli
ttaccaactggaattatatgctggg

SEQ ID NO: 37042 - DNA, 25 bp, E. coli
ttaccaactggatttatatgctggg

SEQ ID NO: 37043 - DNA, 25 bp, E. coli
ccaaatagatggctgaagaggctct

SEQ ID NO: 37044 - DNA, 25 bp, E. coli
ccaaatagatgggtgaagaggctct

SEQ ID NO: 37045 - DNA, 25 bp, E. coli
gaatagccatataacgcacagcaaa

SEQ ID NO: 37046 - DNA, 25 bp, E. coli
gaatagccatattacgcacagcaaa

SEQ ID NO: 37047 - DNA, 25 bp, E. coli
gtttcaagaggtaatgtgcgcatta

SEQ ID NO: 37048 - DNA, 25 bp, E. coli
gtttcaagaggttatgtgcgcatta

SEQ ID NO: 37049 - DNA, 25 bp, E. coli
gggagccaggccgaataaaatcgta

SEQ ID NO: 37050 - DNA, 25 bp, E. coli
gggagccaggcccaataaaatcgta

SEQ ID NO: 37051 - DNA, 25 bp, E. coli
ggaatgaaattgattgctcccaaat

SEQ ID NO: 37052 - DNA, 25 bp, E. coli
ggaatgaaattgtttgctcccaaat

SEQ ID NO: 37053 - DNA, 25 bp, E. coli
caagcgttactgcaaatgcatgcgc

SEQ ID NO: 37054 - DNA, 25 bp, E. coli
caagcgttactggaaatgcatgcgc

SEQ ID NO: 37055 - DNA, 25 bp, E. coli
tacagcgccgcggaaggattactgg

SEQ ID NO: 37056 - DNA, 25 bp, E. coli
tacagcgccgcgcaaggattactgg

SEQ ID NO: 37057 - DNA, 25 bp, E. coli
actgtacaggagttgcaagcgttac

SEQ ID NO: 37058 - DNA, 25 bp, E. coli
actgtacaggagatgcaagcgttac

SEQ ID NO: 37059 - DNA, 25 bp, E. coli
tgaaagaagcgatacacctgcgcga

SEQ ID NO: 37060 - DNA, 25 bp, E. coli
tgaaagaagcgaaacacctgcgcga

SEQ ID NO: 37061 - DNA, 25 bp, E. coli
tgaaaattccggtaacctctgaagg

SEQ ID NO: 37062 - DNA, 25 bp, E. coli
tgaaaattccggaaacctctgaagg

SEQ ID NO: 37063 - DNA, 25 bp, E. coli
tcaggcgctggattgtttgctggct

SEQ ID NO: 37064 - DNA, 25 bp, E. coli
tcaggcgctggaatgtttgctggct

SEQ ID NO: 37065 - DNA, 25 bp, E. coli
gcggtgacggcattcgtactgtaca

SEQ ID NO: 37066 - DNA, 25 bp, E. coli
gctggctggagcgaaatacgttgct

SEQ ID NO: 37067 - DNA, 25 bp, E. coli
gctggctggagccaaatacgttgct

SEQ ID NO: 37068 - DNA, 25 bp, E. coli
gctgggaaccgctgtgtacagcgcc

SEQ ID NO: 37069 - DNA, 25 bp, E. coli
gctgggaaccgcagtgtacagcgcc

SEQ ID NO: 37070 - DNA, 25 bp, E. coli
gcggtgacggcaatcgtactgtaca

SEQ ID NO: 37071 - DNA, 25 bp, E. coli
gaaggcattacttcgctgggaaccg

SEQ ID NO: 37072 - DNA, 25 bp, E. coli
gaaggcattactacgctgggaaccg

SEQ ID NO: 37073 - DNA, 25 bp, E. coli
ggctgccagcttaaaaacaccacgt

SEQ ID NO: 37074 - DNA, 25 bp, E. coli
ggctgccagctttaaaacaccacgt

SEQ ID NO: 37075 - DNA, 25 bp, E. coli
cagattgcagacgaggtaattattg

SEQ ID NO: 37076 - DNA, 25 bp, E. coli
cagattgcagaccaggtaattattg

SEQ ID NO: 37077 - DNA, 25 bp, E. coli
ctatctgaagctaaatgttaaagag

SEQ ID NO: 37078 - DNA, 25 bp, E. coli
ctatctgaagcttaatgttaaagag

SEQ ID NO: 37079 - DNA, 25 bp, E. coli
aaaatattcagattgcagaccaggt

SEQ ID NO: 37080 - DNA, 25 bp, E. coli
aaaatattcagaatgcagaccaggt

SEQ ID NO: 37081 - DNA, 25 bp, E. coli
tattcagattgcagaccaggtaatt

SEQ ID NO: 37082 - DNA, 25 bp, E. coli
tattcagattgctgaccaggtaatt

SEQ ID NO: 37083 - DNA, 25 bp, E. coli
ttgcagaccaggtaattattgatga

SEQ ID NO: 37084 - DNA, 25 bp, E. coli
ttgcagaccaggaaattattgatga

SEQ ID NO: 37085 - DNA, 25 bp, E. coli
ttgatgaaactgcaggtgaagttgt

SEQ ID NO: 37086 - DNA, 25 bp, E. coli
ttgatgaaactggaggtgaagttgt

SEQ ID NO: 37087 - DNA, 25 bp, E. coli
gcctgataggtatttggatttgccc

SEQ ID NO: 37088 - DNA, 25 bp, E. coli
gcctgataggtaattggatttgccc

SEQ ID NO: 37089 - DNA, 25 bp, E. coli
gcttaatgttaaagagaaaaatatt

SEQ ID NO: 37090 - DNA, 25 bp, E. coli
gcttaatgttaatgagaaaaatatt

SEQ ID NO: 37091 - DNA, 25 bp, E. coli
gaaaaatattcacattgcagaccag

SEQ ID NO: 37092 - DNA, 25 bp, E. coli
gaaaaatattcagattgcagaccag

SEQ ID NO: 37093 - DNA, 25 bp, E. coli
ctgcaggtgaagttgttatcggcgc

SEQ ID NO: 37094 - DNA, 25 bp, E. coli
ctgcaggtgaagatgttatcggcgc

SEQ ID NO: 37095 - DNA, 25 bp, E. coli
ctgataggtaataggatttgcccct

SEQ ID NO: 37096 - DNA, 25 bp, E. coli
ctgataggtaattggatttgcccct

SEQ ID NO: 37097 - DNA, 25 bp, E. coli
agcacggcaaaaccgggcgacaggt

SEQ ID NO: 37098 - DNA, 25 bp, E. coli
agtgaaggtgagggaactgccggtg

SEQ ID NO: 37099 - DNA, 25 bp, E. coli
agcacggcaaaagcgggcgacaggt

SEQ ID NO: 37100 - DNA, 25 bp, E. coli
agtgaaggtgagcgaactgccggtg

SEQ ID NO: 37101 - DNA, 25 bp, E. coli
acctgaaccagtgaaggtgagcgaa

SEQ ID NO: 37102 - DNA, 25 bp, E. coli
acctgaaccagtcaaggtgagcgaa

SEQ ID NO: 37103 - DNA, 25 bp, E. coli
tggttccatccggatcagcacggca

SEQ ID NO: 37104 - DNA, 25 bp, E. coli
tgctggttccatccgcatcagcacg

SEQ ID NO: 37105 - DNA, 25 bp, E. coli
tgctggttccatgcgcatcagcacg

SEQ ID NO: 37106 - DNA, 25 bp, E. coli
tgaaccagtgaaggtgagcgaactg

SEQ ID NO: 37107 - DNA, 25 bp, E. coli
tgaaccagtgaacgtgagcgaactg

SEQ ID NO: 37108 - DNA, 25 bp, E. coli
cctgaaccagtgtaggtgagcgaac

SEQ ID NO: 37109 - DNA, 25 bp, E. coli
gcacggcaaaacggggcgacaggtg

SEQ ID NO: 37110 - DNA, 25 bp, E. coli
gcacggcaaaaccgggcgacaggtg

SEQ ID NO: 37111 - DNA, 25 bp, E. coli
cctgaaccagtgaaggtgagcgaac

SEQ ID NO: 37112 - DNA, 25 bp, E. coli
gctggttccatcggcatcagcacgg

SEQ ID NO: 37113 - DNA, 25 bp, E. coli
gctggttccatccgcatcagcacgg

SEQ ID NO: 37114 - DNA, 25 bp, E. coli
ctgaaccagtgatggtgagcgaact

SEQ ID NO: 37115 - DNA, 25 bp, E. coli
ctgaaccagtgaaggtgagcgaact

SEQ ID NO: 37116 - DNA, 25 bp, E. coli
ggttccatccgcatcagcacggcaa

SEQ ID NO: 37117 - DNA, 25 bp, E. coli
ggttccatccgcttcagcacggcaa

SEQ ID NO: 37118 - DNA, 25 bp, E. coli
tggttccatccgcatcagcacggca

SEQ ID NO: 37119 - DNA, 25 bp, E. coli
cactgaacctgtgggtacaacgaaa

SEQ ID NO: 37120 - DNA, 25 bp, E. coli
cactgaacctgtcggtacaacgaaa

SEQ ID NO: 37121 - DNA, 25 bp, E. coli
acaataagaatagtggcgatgcgcc

SEQ ID NO: 37122 - DNA, 25 bp, E. coli
acaataagaatactggcgatgcgcc

SEQ ID NO: 37123 - DNA, 25 bp, E. coli
tcattggtcagtacctttacggtag

SEQ ID NO: 37124 - DNA, 25 bp, E. coli
tctgcgatggtggtggaagatctca

SEQ ID NO: 37125 - DNA, 25 bp, E. coli
tcattggtcagttcctttacggtag

SEQ ID NO: 37126 - DNA, 25 bp, E. coli
tctgcgatggtgctggaagatctca

SEQ ID NO: 37127 - DNA, 25 bp, E. coli
gcgtaacgctggaaattgaacaacg

SEQ ID NO: 37128 - DNA, 25 bp, E. coli
gcattcgtacttccggcctgctggg

SEQ ID NO: 37129 - DNA, 25 bp, E. coli
gctgctgcgccaggtaataatgaaa

SEQ ID NO: 37130 - DNA, 25 bp, E. coli
gcgtaacgctggtaattgaacaacg

SEQ ID NO: 37131 - DNA, 25 bp, E. coli
gcattcgtacttgcggcctgctggg

SEQ ID NO: 37132 - DNA, 25 bp, E. coli
gctgctgcgccacgtaataatgaaa

SEQ ID NO: 37133 - DNA, 25 bp, E. coli
gaaggatggcgatacaattcaggac

SEQ ID NO: 37134 - DNA, 25 bp, E. coli
gaaggatggcgaaacaattcaggac

SEQ ID NO: 37135 - DNA, 25 bp, E. coli
gacgttcgataacattggcggcctg

SEQ ID NO: 37136 - DNA, 25 bp, E. coli
gacgttcgataagattggcggcctg

SEQ ID NO: 37137 - DNA, 25 bp, E. coli
gatattacgctggacccgaaaacct

SEQ ID NO: 37138 - DNA, 25 bp, E. coli
gatattacgctgcacccgaaaacct

SEQ ID NO: 37139 - DNA, 25 bp, E. coli
gataccagttcgctgagcattcgta

SEQ ID NO: 37140 - DNA, 25 bp, E. coli
gataccagttcggtgagcattcgta

SEQ ID NO: 37141 - DNA, 25 bp, E. coli
catgggtatgtctgctcagacggga

SEQ ID NO: 37142 - DNA, 25 bp, E. coli
catgggtatgtcagctcagacggga

SEQ ID NO: 37143 - DNA, 25 bp, E. coli
agatcacgccttgtgcagcaccatt

SEQ ID NO: 37144 - DNA, 25 bp, E. coli
agcagcaatgtaatcgtgagctgga

SEQ ID NO: 37145 - DNA, 25 bp, E. coli
agatcacgccttctgcagcaccatt

SEQ ID NO: 37146 - DNA, 25 bp, E. coli
agcagcaatgtattcgtgagctgga

SEQ ID NO: 37147 - DNA, 25 bp, E. coli
aaagcaggtgcgagtaagcgtcaac

SEQ ID NO: 37148 - DNA, 25 bp, E. coli
aaagcaggtgcgtgtaagcgtcaac

SEQ ID NO: 37149 - DNA, 25 bp, E. coli
tatgtcagctcacacgggaacgtca

SEQ ID NO: 37150 - DNA, 25 bp, E. coli
tatgtcagctcagacgggaacgtca

SEQ ID NO: 37151 - DNA, 25 bp, E. coli
tgcagcaccattgacatcagagcag

SEQ ID NO: 37152 - DNA, 25 bp, E. coli
tgcagcaccattcacatcagagcag

SEQ ID NO: 37153 - DNA, 25 bp, E. coli
tcagagcagcaatgtattcgtgagc

SEQ ID NO: 37154 - DNA, 25 bp, E. coli
tcagacgggaacctcaggagatcac

SEQ ID NO: 37155 - DNA, 25 bp, E. coli
tctctactctggtggcatgggtatg

SEQ ID NO: 37156 - DNA, 25 bp, E. coli
tctctactctggaggcatgggtatg

SEQ ID NO: 37157 - DNA, 25 bp, E. coli
tcagacgggaacgtcaggagatcac

SEQ ID NO: 37158 - DNA, 25 bp, E. coli
gaacgtcaggagatcacgccttctg

SEQ ID NO: 37159 - DNA, 25 bp, E. coli
gaacgtcaggagttcacgccttctg

SEQ ID NO: 37160 - DNA, 25 bp, E. coli
gaatgttggtttgtctactctggag

SEQ ID NO: 37161 - DNA, 25 bp, E. coli
gaatgttggtttctctactctggag

SEQ ID NO: 37162 - DNA, 25 bp, E. coli
tcagagcagcaaagtattcgtgagc

SEQ ID NO: 37163 - DNA, 25 bp, E. coli
cagcagatgccggtgatggcttaca

SEQ ID NO: 37164 - DNA, 25 bp, E. coli
cagcagatgccgctgatggcttaca

SEQ ID NO: 37165 - DNA, 25 bp, E. coli
aacagaagttgcagcactacgcgcg

SEQ ID NO: 37166 - DNA, 25 bp, E. coli
aacagaagttgctgcactacgcgcg

SEQ ID NO: 37167 - DNA, 25 bp, E. coli
aacgcggtagtctacgaaattgcac

SEQ ID NO: 37168 - DNA, 25 bp, E. coli
aacatggtatatgggcgaagatgcc

SEQ ID NO: 37169 - DNA, 25 bp, E. coli
aaatgtatgccgatggcggtgccga

SEQ ID NO: 37170 - DNA, 25 bp, E. coli
aacatggtatatcggcgaagatgcc

SEQ ID NO: 37171 - DNA, 25 bp, E. coli
aaatgtatgccgttggcggtgccga

SEQ ID NO: 37172 - DNA, 25 bp, E. coli
aacgcggtagtcaacgaaattgcac

SEQ ID NO: 37173 - DNA, 25 bp, E. coli
tacgcgcgggcaatgaactcggttt

SEQ ID NO: 37174 - DNA, 25 bp, E. coli
tacgcgcgggcattgaactcggttt

SEQ ID NO: 37175 - DNA, 25 bp, E. coli
tatccggcaccataaggaaaaactg

SEQ ID NO: 37176 - DNA, 25 bp, E. coli
tatccggcaccaaaaggaaaaactg

SEQ ID NO: 37177 - DNA, 25 bp, E. coli
tgatcgcccaggcaaaaatccgccg

SEQ ID NO: 37178 - DNA, 25 bp, E. coli
tgatcgcccagggaaaaatccgccg

SEQ ID NO: 37179 - DNA, 25 bp, E. coli
tctatccgtggaatgctggcgggca

SEQ ID NO: 37180 - DNA, 25 bp, E. coli
tctatccgtggattgctggcgggca

SEQ ID NO: 37181 - DNA, 25 bp, E. coli
gcgataaatgcaagcgaagccagtt

SEQ ID NO: 37182 - DNA, 25 bp, E. coli
gcgataaatgcatgcgaagccagtt

SEQ ID NO: 37183 - DNA, 25 bp, E. coli
gtttaaccctcattgataccgccga

SEQ ID NO: 37184 - DNA, 25 bp, E. coli
gtttaaccctcaatgataccgccga

SEQ ID NO: 37185 - DNA, 25 bp, E. coli
tacgcgttgtcagaacagctgaaag

SEQ ID NO: 37186 - DNA, 25 bp, E. coli
aactgcgcgcttacgcgttgtcaga

SEQ ID NO: 37187 - DNA, 25 bp, E. coli
aactgcgcgctttcgcgttgtcaga

SEQ ID NO: 37188 - DNA, 25 bp, E. coli
actgcgcgcttacgcgttgtcagaa

SEQ ID NO: 37189 - DNA, 25 bp, E. coli
actgcgcgcttaggcgttgtcagaa

SEQ ID NO: 37190 - DNA, 25 bp, E. coli
tacgcgttgtcacaacagctgaaag

SEQ ID NO: 37191 - DNA, 25 bp, E. coli
gcgcttacgcgtagtcagaacagct

SEQ ID NO: 37192 - DNA, 25 bp, E. coli
gcgcgcttacgcgttgtcagaacag

SEQ ID NO: 37193 - DNA, 25 bp, E. coli
gcttacgcgttgtcagaacagctga

SEQ ID NO: 37194 - DNA, 25 bp, E. coli
gcttacgcgttgacagaacagctga

SEQ ID NO: 37195 - DNA, 25 bp, E. coli
gcgcgcttacgccttgtcagaacag

SEQ ID NO: 37196 - DNA, 25 bp, E. coli
gcgcttacgcgttgtcagaacagct

SEQ ID NO: 37197 - DNA, 25 bp, E. coli
gaaactgcgcgcttacgcgttgtca

SEQ ID NO: 37198 - DNA, 25 bp, E. coli
gaaactgcgcgcatacgcgttgtca

SEQ ID NO: 37199 - DNA, 25 bp, E. coli
cgcttacgcgttctcagaacagctg

SEQ ID NO: 37200 - DNA, 25 bp, E. coli
cgcttacgcgttgtcagaacagctg

SEQ ID NO: 37201 - DNA, 25 bp, E. coli
cgcgcttacgcgatgtcagaacagc

SEQ ID NO: 37202 - DNA, 25 bp, E. coli
cgcgcttacgcgttgtcagaacagc

SEQ ID NO: 37203 - DNA, 25 bp, E. coli
cgcgttgtcagatcagctgaaagag

SEQ ID NO: 37204 - DNA, 25 bp, E. coli
cgcgttgtcagaacagctgaaagag

SEQ ID NO: 37205 - DNA, 25 bp, E. coli
cttacgcgttgtgagaacagctgaa

SEQ ID NO: 37206 - DNA, 25 bp, E. coli
cttacgcgttgtcagaacagctgaa

SEQ ID NO: 37207 - DNA, 25 bp, E. coli
caggcagcgaagaaacacgccaaga

SEQ ID NO: 37208 - DNA, 25 bp, E. coli
caggcagcgaagtaacacgccaaga

SEQ ID NO: 37209 - DNA, 25 bp, E. coli
taaaaaacagcataaagcagcacct

SEQ ID NO: 37210 - DNA, 25 bp, E. coli
taaagcagcaccagcccagaaagcg

SEQ ID NO: 37211 - DNA, 25 bp, E. coli
taaagcagcacctgcccagaaagcg

SEQ ID NO: 37212 - DNA, 25 bp, E. coli
taaaaaacagcaaaaagcagcacct

SEQ ID NO: 37213 - DNA, 25 bp, E. coli
tgttgccgctgcaatgggtctgtct

SEQ ID NO: 37214 - DNA, 25 bp, E. coli
tgttgccgctgctatgggtctgtct

SEQ ID NO: 37215 - DNA, 25 bp, E. coli
gccaagaaacacagccatcagcaac

SEQ ID NO: 37216 - DNA, 25 bp, E. coli
gccaagaaacactgccatcagcaac

SEQ ID NO: 37217 - DNA, 25 bp, E. coli
gaacaaaaagcgcaggcagcgaaga

SEQ ID NO: 37218 - DNA, 25 bp, E. coli
gactgcgacgacgaccaaagcagcg

SEQ ID NO: 37219 - DNA, 25 bp, E. coli
gaaacacgccaacaaacacagccat

SEQ ID NO: 37220 - DNA, 25 bp, E. coli
gactgcgacgaccaccaaagcagcg

SEQ ID NO: 37221 - DNA, 25 bp, E. coli
gaacaaaaagcggaggcagcgaaga

SEQ ID NO: 37222 - DNA, 25 bp, E. coli
gaaacacgccaagaaacacagccat

SEQ ID NO: 37223 - DNA, 25 bp, E. coli
cccagaaagcgctggcggctaaaaa

SEQ ID NO: 37224 - DNA, 25 bp, E. coli
cccagaaagcgcaggcggctaaaaa

SEQ ID NO: 37225 - DNA, 25 bp, E. coli
cgcaggcggctataaagcatcataa

SEQ ID NO: 37226 - DNA, 25 bp, E. coli
ccgctgctatgggtctgtcttctgc

SEQ ID NO: 37227 - DNA, 25 bp, E. coli
ccgctgctatggctctgtcttctgc

SEQ ID NO: 37228 - DNA, 25 bp, E. coli
cgcaggcggctaaaaagcatcataa

SEQ ID NO: 37229 - DNA, 25 bp, E. coli
cacttcgatgcaactggtacgacca

SEQ ID NO: 37230 - DNA, 25 bp, E. coli
caccttgcggattcaggagactgac

SEQ ID NO: 37231 - DNA, 25 bp, E. coli
caccttgcggatacaggagactgac

SEQ ID NO: 37232 - DNA, 25 bp, E. coli
cagatcggcatttccttaatatttt

SEQ ID NO: 37233 - DNA, 25 bp, E. coli
cacttcgatgcatctggtacgacca

SEQ ID NO: 37234 - DNA, 25 bp, E. coli
cagatcggcattaccttaatatttt

SEQ ID NO: 37235 - DNA, 25 bp, E. coli
ttcaggagactgtcatgctttacaa

SEQ ID NO: 37236 - DNA, 25 bp, E. coli
ttcaggagactgacatgctttacaa

SEQ ID NO: 37237 - DNA, 25 bp, E. coli
tcgtcaaccgtgaactgttccccta

SEQ ID NO: 37238 - DNA, 25 bp, E. coli
tggtacgaccagttcaccttgcgga

SEQ ID NO: 37239 - DNA, 25 bp, E. coli
tcgtcaaccgtgtactgttccccta

SEQ ID NO: 37240 - DNA, 25 bp, E. coli
gcgtgatcagatcggcatttcctta

SEQ ID NO: 37241 - DNA, 25 bp, E. coli
gcgtgatcagatgggcatttcctta

SEQ ID NO: 37242 - DNA, 25 bp, E. coli
gaagatgtcgtcgttgacgacctgc

SEQ ID NO: 37243 - DNA, 25 bp, E. coli
gaagaaagaagaagatgtcgtcgtt

SEQ ID NO: 37244 - DNA, 25 bp, E. coli
gaagaaagaagatgatgtcgtcgtt

SEQ ID NO: 37245 - DNA, 25 bp, E. coli
gaagatgtcgtccttgacgacctgc

SEQ ID NO: 37246 - DNA, 25 bp, E. coli
gtgatttctgcccagcgtgatcaga

SEQ ID NO: 37247 - DNA, 25 bp, E. coli
gtgatttctgccgagcgtgatcaga

SEQ ID NO: 37248 - DNA, 25 bp, E. coli
tggtacgaccagatcaccttgcgga

SEQ ID NO: 37249 - DNA, 25 bp, E. coli
taacacaaaatacacacttcgatgc

SEQ ID NO: 37250 - DNA, 25 bp, E. coli
taacacaaaatagacacttcgatgc

SEQ ID NO: 37251 - DNA, 25 bp, E. coli
cagagctggctgatgttaactccga

SEQ ID NO: 37252 - DNA, 25 bp, E. coli
cagagctggctgttgttaactccga

SEQ ID NO: 37253 - DNA, 25 bp, E. coli
tactatccgcgcgtcgctggaagag

SEQ ID NO: 37254 - DNA, 25 bp, E. coli
tactatccgcgcctcgctggaagag

SEQ ID NO: 37255 - DNA, 25 bp, E. coli
aacagcgcaagtgttccaggagacg

SEQ ID NO: 37256 - DNA, 25 bp, E. coli
aacagcgcaagtcttccaggagacg

SEQ ID NO: 37257 - DNA, 25 bp, E. coli
tttatcacccttaaaccacgcggcg

SEQ ID NO: 37258 - DNA, 25 bp, E. coli
tttatcaccctttaaccacgcggcg

SEQ ID NO: 37259 - DNA, 25 bp, E. coli
tcgatcgcttgcctaaaaaactggc

SEQ ID NO: 37260 - DNA, 25 bp, E. coli
tcgatcgcttgcgtaaaaaactggc

SEQ ID NO: 37261 - DNA, 25 bp, E. coli
cctttacgagagatatgtgcatcca

SEQ ID NO: 37262 - DNA, 25 bp, E. coli
cctttacgagagttatgtgcatcca

SEQ ID NO: 37263 - DNA, 25 bp, E. coli
gcaaagtctgctacccagcgggatg

SEQ ID NO: 37264 - DNA, 25 bp, E. coli
gcaaagtctgcttcccagcgggatg

SEQ ID NO: 37265 - DNA, 25 bp, E. coli
gataatggcgcggagatgaacctta

SEQ ID NO: 37266 - DNA, 25 bp, E. coli
gataatggcgcgcagatgaacctta

SEQ ID NO: 37267 - DNA, 25 bp, E. coli
gattgggaattgacgtgcaagccgc

SEQ ID NO: 37268 - DNA, 25 bp, E. coli
gattgggaattgtcgtgcaagccgc

SEQ ID NO: 37269 - DNA, 25 bp, E. coli
ggtttccctgacgttaacgccgatg

SEQ ID NO: 37270 - DNA, 25 bp, E. coli
ggtttccctgaccttaacgccgatg

SEQ ID NO: 37271 - DNA, 25 bp, E. coli
ggcgaacgctccactgtcggtgaat

SEQ ID NO: 37272 - DNA, 25 bp, E. coli
ggcgaacgctcctctgtcggtgaat

SEQ ID NO: 37273 - DNA, 25 bp, E. coli
cacactttcatggtttaatcaggtg

SEQ ID NO: 37274 - DNA, 25 bp, E. coli
cacactttcatgctttaatcaggtg

SEQ ID NO: 37275 - DNA, 25 bp, E. coli
caggtgattgatttaatgaaaagag

SEQ ID NO: 37276 - DNA, 25 bp, E. coli
caggtgattgatataatgaaaagag

SEQ ID NO: 37277 - DNA, 25 bp, E. coli
tattgtgtatatgtcctaccgggca

SEQ ID NO: 37278 - DNA, 25 bp, E. coli
tttgacttacatgacactttcatgg

SEQ ID NO: 37279 - DNA, 25 bp, E. coli
tttgacttacatcacactttcatgg

SEQ ID NO: 37280 - DNA, 25 bp, E. coli
tattgtgtatatctcctaccgggca

SEQ ID NO: 37281 - DNA, 25 bp, E. coli
ttcacgataatgttagagataatca

SEQ ID NO: 37282 - DNA, 25 bp, E. coli
ttcacgataatgatagagataatca

SEQ ID NO: 37283 - DNA, 25 bp, E. coli
tctcgaatttcaggataatgataga

SEQ ID NO: 37284 - DNA, 25 bp, E. coli
tctcgaatttcacgataatgataga

SEQ ID NO: 37285 - DNA, 25 bp, E. coli
gactacttctcctttcattctcgaa

SEQ ID NO: 37286 - DNA, 25 bp, E. coli
gaaaagagtgtgattgtggatgtat

SEQ ID NO: 37287 - DNA, 25 bp, E. coli
gaaaagagtgtgtttgtggatgtat

SEQ ID NO: 37288 - DNA, 25 bp, E. coli
gactacttctccattcattctcgaa

SEQ ID NO: 37289 - DNA, 25 bp, E. coli
gggcatctgttcttacattaattaa

SEQ ID NO: 37290 - DNA, 25 bp, E. coli
gggcatctgttcatacattaattaa

SEQ ID NO: 37291 - DNA, 25 bp, E. coli
gtcctaccgggcatctgttcttaca

SEQ ID NO: 37292 - DNA, 25 bp, E. coli
gtcctaccgggcttctgttcttaca

SEQ ID NO: 37293 - DNA, 25 bp, E. coli
gatagtatcagttattttgacttac

SEQ ID NO: 37294 - DNA, 25 bp, E. coli
gatagtatcagtaattttgacttac

SEQ ID NO: 37295 - DNA, 25 bp, E. coli
aatcttttctcaagcaccctgacac

SEQ ID NO: 37296 - DNA, 25 bp, E. coli
aatcttttctcatgcaccctgacac

SEQ ID NO: 37297 - DNA, 25 bp, E. coli
cagtgaactaacgagtcgaatgcct

SEQ ID NO: 37298 - DNA, 25 bp, E. coli
cagtgaactaaccagtcgaatgcct

SEQ ID NO: 37299 - DNA, 25 bp, E. coli
agtcgaatgcctgaacacagagagc

SEQ ID NO: 37300 - DNA, 25 bp, E. coli
agtcgaatgcctcaacacagagagc

SEQ ID NO: 37301 - DNA, 25 bp, E. coli
tatccctggtctttgtgctggttgg

SEQ ID NO: 37302 - DNA, 25 bp, E. coli
tatccctggtctatgtgctggttgg

SEQ ID NO: 37303 - DNA, 25 bp, E. coli
tttaaatcttttctcatgcaccctg

SEQ ID NO: 37304 - DNA, 25 bp, E. coli
tttaaatcttttgtcatgcaccctg

SEQ ID NO: 37305 - DNA, 25 bp, E. coli
tagtccttatccgtggtctttgtgc

SEQ ID NO: 37306 - DNA, 25 bp, E. coli
tagtccttatccctggtctttgtgc

SEQ ID NO: 37307 - DNA, 25 bp, E. coli
cctggtctttgtcctggttggacga

SEQ ID NO: 37308 - DNA, 25 bp, E. coli
cctggtctttgtgctggttggacga

SEQ ID NO: 37309 - DNA, 25 bp, E. coli
gaactaaccagtggaatgcctcaac

SEQ ID NO: 37310 - DNA, 25 bp, E. coli
gaactaaccagtcgaatgcctcaac

SEQ ID NO: 37311 - DNA, 25 bp, E. coli
cgtagtccttatgcctggtctttgt

SEQ ID NO: 37312 - DNA, 25 bp, E. coli
cgtagtccttatccctggtctttgt

SEQ ID NO: 37313 - DNA, 25 bp, E. coli
gtctttgtgctggttggacgaattt

SEQ ID NO: 37314 - DNA, 25 bp, E. coli
gtctttgtgctgcttggacgaattt

SEQ ID NO: 37315 - DNA, 25 bp, E. coli
taaccagtcgaatgcctcaacacag

SEQ ID NO: 37316 - DNA, 25 bp, E. coli
taaccagtcgaaagcctcaacacag

SEQ ID NO: 37317 - DNA, 25 bp, E. coli
aaaaacatcatacagcaggccgacg

SEQ ID NO: 37318 - DNA, 25 bp, E. coli
aaaaacatcatagagcaggccgacg

SEQ ID NO: 37319 - DNA, 25 bp, E. coli
tatgaaatcgacaggaagataccgg

SEQ ID NO: 37320 - DNA, 25 bp, E. coli
tagccaggttcagcgcgataaaggg

SEQ ID NO: 37321 - DNA, 25 bp, E. coli
tagccaggttcaccgcgataaaggg

SEQ ID NO: 37322 - DNA, 25 bp, E. coli
tatgaaatcgactggaagataccgg

SEQ ID NO: 37323 - DNA, 25 bp, E. coli
tattccggcaaatacactgacagcg

SEQ ID NO: 37324 - DNA, 25 bp, E. coli
tattccggcaaaaacactgacagcg

SEQ ID NO: 37325 - DNA, 25 bp, E. coli
tcatgcgcatggctggagaagatcc

SEQ ID NO: 37326 - DNA, 25 bp, E. coli
tcatgcgcatgggtggagaagatcc

SEQ ID NO: 37327 - DNA, 25 bp, E. coli
gctgtttttcccgaacgtggcgaca

SEQ ID NO: 37328 - DNA, 25 bp, E. coli
gctgtttttccccaacgtggcgaca

SEQ ID NO: 37329 - DNA, 25 bp, E. coli
gagaagatccgggacagcttaacga

SEQ ID NO: 37330 - DNA, 25 bp, E. coli
gaactggcctgtaaaaacctgggcg

SEQ ID NO: 37331 - DNA, 25 bp, E. coli
gaactggcctgttaaaacctgggcg

SEQ ID NO: 37332 - DNA, 25 bp, E. coli
gagaagatccggcacagcttaacga

SEQ ID NO: 37333 - DNA, 25 bp, E. coli
cattgaagaagtgaccatgtcggcg

SEQ ID NO: 37334 - DNA, 25 bp, E. coli
cattgaagaagtcaccatgtcggcg

SEQ ID NO: 37335 - DNA, 25 bp, E. coli
ggttgccccgcaaacgtcatgatta

SEQ ID NO: 37336 - DNA, 25 bp, E. coli
ggttgccccgcatacgtcatgatta

SEQ ID NO: 37337 - DNA, 25 bp, E. coli
gatccggcgattcagtacgtgcaga

SEQ ID NO: 37338 - DNA, 25 bp, E. coli
gatccggcgattgagtacgtgcaga

SEQ ID NO: 37339 - DNA, 25 bp, E. coli
caaaattgaataaatcgcgcccgga

SEQ ID NO: 37340 - DNA, 25 bp, E. coli
caaaattgaatatatcgcgcccgga

SEQ ID NO: 37341 - DNA, 25 bp, E. coli
tacagcgaacgccagtgatctatga

SEQ ID NO: 37342 - DNA, 25 bp, E. coli
tacagcgaacgcgagtgatctatga

SEQ ID NO: 37343 - DNA, 25 bp, E. coli
tgttaatgctaacgagttgacgctg

SEQ ID NO: 37344 - DNA, 25 bp, E. coli
tgttaatgctaaggagttgacgctg

SEQ ID NO: 37345 - DNA, 25 bp, E. coli
tcgcgcccggagtacataaacagtt

SEQ ID NO: 37346 - DNA, 25 bp, E. coli
tcgcgcccggagaacataaacagtt

SEQ ID NO: 37347 - DNA, 25 bp, E. coli
tctatgatgccagccgcaaagaggc

SEQ ID NO: 37348 - DNA, 25 bp, E. coli
tctatgatgccacccgcaaagaggc

SEQ ID NO: 37349 - DNA, 25 bp, E. coli
gaaagaacgtgaaatgggctgcgat

SEQ ID NO: 37350 - DNA, 25 bp, E. coli
gaaagaacgtgatatgggctgcgat

SEQ ID NO: 37351 - DNA, 25 bp, E. coli
gttacctgtcgcaaacaaaggcgca

SEQ ID NO: 37352 - DNA, 25 bp, E. coli
gatcaatgattaaggcggcagttcc

SEQ ID NO: 37353 - DNA, 25 bp, E. coli
gatcaatgattatggcggcagttcc

SEQ ID NO: 37354 - DNA, 25 bp, E. coli
gttacctgtcgctaacaaaggcgca

SEQ ID NO: 37355 - DNA, 25 bp, E. coli
ggcagttccgggtcagaaactcgtc

SEQ ID NO: 37356 - DNA, 25 bp, E. coli
ggcagttccgggacagaaactcgtc

SEQ ID NO: 37357 - DNA, 25 bp, E. coli
taacctgcctgaaaataaagagtcg

SEQ ID NO: 37358 - DNA, 25 bp, E. coli
taatgttcgtgccattccagcaaag

SEQ ID NO: 37359 - DNA, 25 bp, E. coli
taacctgcctgataataaagagtcg

SEQ ID NO: 37360 - DNA, 25 bp, E. coli
taatgttcgtgcgattccagcaaag

SEQ ID NO: 37361 - DNA, 25 bp, E. coli
taaacccattgtcatggaacgcggt

SEQ ID NO: 37362 - DNA, 25 bp, E. coli
tacacgtatccacggcatcaaagcc

SEQ ID NO: 37363 - DNA, 25 bp, E. coli
taaaaacgtggcaacagagcgcgaa

SEQ ID NO: 37364 - DNA, 25 bp, E. coli
taaacccattgtgatggaacgcggt

SEQ ID NO: 37365 - DNA, 25 bp, E. coli
taaaaacgtggctacagagcgcgaa

SEQ ID NO: 37366 - DNA, 25 bp, E. coli
tacacgtatccagggcatcaaagcc

SEQ ID NO: 37367 - DNA, 25 bp, E. coli
tattgaggtaatccgcgacctgcgc

SEQ ID NO: 37368 - DNA, 25 bp, E. coli
tattgaggtaatgcgcgacctgcgc

SEQ ID NO: 37369 - DNA, 25 bp, E. coli
tgaaactggcgcagaccattgccga

SEQ ID NO: 37370 - DNA, 25 bp, E. coli
tgaaactggcgctgaccattgccga

SEQ ID NO: 37371 - DNA, 25 bp, E. coli
tcgacgaaatgatagccgaagcgct

SEQ ID NO: 37372 - DNA, 25 bp, E. coli
tcgacgaaatgaaagccgaagcgct

SEQ ID NO: 37373 - DNA, 25 bp, E. coli
gcccggtagctcctgatgccaatga

SEQ ID NO: 37374 - DNA, 25 bp, E. coli
gcccggtagctcgtgatgccaatga

SEQ ID NO: 37375 - DNA, 25 bp, E. coli
gcaatatttgcagccaagccgccat

SEQ ID NO: 37376 - DNA, 25 bp, E. coli
gcaatatttgcacccaagccgccat

SEQ ID NO: 37377 - DNA, 25 bp, E. coli
cattctgtctgcgaggaagcctcct

SEQ ID NO: 37378 - DNA, 25 bp, E. coli
cattctgtctgccaggaagcctcct

SEQ ID NO: 37379 - DNA, 25 bp, E. coli
tcaacgttacgtaagcccggatgag

SEQ ID NO: 37380 - DNA, 25 bp, E. coli
tcaacgttacgttagcccggatgag

SEQ ID NO: 37381 - DNA, 25 bp, E. coli
gatgaaaatcaaccttccagcggac

SEQ ID NO: 37382 - DNA, 25 bp, E. coli
gatgaaaatcaagcttccagcggac

SEQ ID NO: 37383 - DNA, 25 bp, E. coli
catgccgacgcctttcatgttgctg

SEQ ID NO: 37384 - DNA, 25 bp, E. coli
catgttgctggtagggtgagtcttt

SEQ ID NO: 37385 - DNA, 25 bp, E. coli
catgccgacgccattcatgttgctg

SEQ ID NO: 37386 - DNA, 25 bp, E. coli
catgttgctggttgggtgagtcttt

SEQ ID NO: 37387 - DNA, 25 bp, E. coli
aaacgtaatcatcctcatgccgacg

SEQ ID NO: 37388 - DNA, 25 bp, E. coli
aaacgtaatcatgctcatgccgacg

SEQ ID NO: 37389 - DNA, 25 bp, E. coli
ttacatgatattccctacctgattg

SEQ ID NO: 37390 - DNA, 25 bp, E. coli
tatgcaactgcatcagcgcattgcc

SEQ ID NO: 37391 - DNA, 25 bp, E. coli
tatgcaactgcaacagcgcattgcc

SEQ ID NO: 37392 - DNA, 25 bp, E. coli
ttacatgatattgcctacctgattg

SEQ ID NO: 37393 - DNA, 25 bp, E. coli
tgttcctggacttttttgcactggg

SEQ ID NO: 37394 - DNA, 25 bp, E. coli
tgttcctggactattttgcactggg

SEQ ID NO: 37395 - DNA, 25 bp, E. coli
gaatgcaaagccatgattcatccgt

SEQ ID NO: 37396 - DNA, 25 bp, E. coli
gaatgcaaagccttgattcatccgt

SEQ ID NO: 37397 - DNA, 25 bp, E. coli
gacatcaaatccacttctgccgagt

SEQ ID NO: 37398 - DNA, 25 bp, E. coli
gacatcaaatcctcttctgccgagt

SEQ ID NO: 37399 - DNA, 25 bp, E. coli
cattgccgggctcgagaaacagctc

SEQ ID NO: 37400 - DNA, 25 bp, E. coli
cattgccgggctggagaaacagctc

SEQ ID NO: 37401 - DNA, 25 bp, E. coli
ggagaaacagctcgccgacatcaaa

SEQ ID NO: 37402 - DNA, 25 bp, E. coli
tggatttgggcctcgctttaccgcc

SEQ ID NO: 37403 - DNA, 25 bp, E. coli
tggatttgggccacgctttaccgcc

SEQ ID NO: 37404 - DNA, 25 bp, E. coli
ggagaaacagctggccgacatcaaa

SEQ ID NO: 37405 - DNA, 25 bp, E. coli
aacgacgttgtcagtcgcgctgcca

SEQ ID NO: 37406 - DNA, 25 bp, E. coli
cagaagggcatttcaatcagcctgg

SEQ ID NO: 37407 - DNA, 25 bp, E. coli
catgcctgttgtaaactgtgagcca

SEQ ID NO: 37408 - DNA, 25 bp, E. coli
catgcctgttgttaactgtgagcca

SEQ ID NO: 37409 - DNA, 25 bp, E. coli
cagaagggcattacaatcagcctgg

SEQ ID NO: 37410 - DNA, 25 bp, E. coli
aacgacgttgtctgtcgcgctgcca

SEQ ID NO: 37411 - DNA, 25 bp, E. coli
tcgcgctgccagtgtactttatgac

SEQ ID NO: 37412 - DNA, 25 bp, E. coli
tcgcgctgccagagtactttatgac

SEQ ID NO: 37413 - DNA, 25 bp, E. coli
tctgcgagacgggttaacatgcctg

SEQ ID NO: 37414 - DNA, 25 bp, E. coli
tctgcgagacggcttaacatgcctg

SEQ ID NO: 37415 - DNA, 25 bp, E. coli
gctgcaataacatctctgcgagacg

SEQ ID NO: 37416 - DNA, 25 bp, E. coli
gctgcaataacaactctgcgagacg

SEQ ID NO: 37417 - DNA, 25 bp, E. coli
cgataacaccgcaaaatggatactt

SEQ ID NO: 37418 - DNA, 25 bp, E. coli
cgataacaccgctaaatggatactt

SEQ ID NO: 37419 - DNA, 25 bp, E. coli
gatactttgtcaaactttcgctgca

SEQ ID NO: 37420 - DNA, 25 bp, E. coli
gatactttgtcatactttcgctgca

SEQ ID NO: 37421 - DNA, 25 bp, E. coli
ggctactcctcatcgacgttgtctg

SEQ ID NO: 37422 - DNA, 25 bp, E. coli
ggctttatgcctgaaacagaagggc

SEQ ID NO: 37423 - DNA, 25 bp, E. coli
ggctttatgcctcaaacagaagggc

SEQ ID NO: 37424 - DNA, 25 bp, E. coli
ggctactcctcaacgacgttgtctg

SEQ ID NO: 37425 - DNA, 25 bp, E. coli
gagccaaagcgtagtttaaccaagg

SEQ ID NO: 37426 - DNA, 25 bp, E. coli
gagccaaagcgttgtttaaccaagg

SEQ ID NO: 37427 - DNA, 25 bp, E. coli
caacggcttgcgtcataaaatccgt

SEQ ID NO: 37428 - DNA, 25 bp, E. coli
caacggcttgcgacataaaatccgt

SEQ ID NO: 37429 - DNA, 25 bp, E. coli
acttgttgaaactcaacaggcgctg

SEQ ID NO: 37430 - DNA, 25 bp, E. coli
acttgttgaaacacaacaggcgctg

SEQ ID NO: 37431 - DNA, 25 bp, E. coli
aaagcttatgccgatttaatcacca

SEQ ID NO: 37432 - DNA, 25 bp, E. coli
aaagcttatgcccatttaatcacca

SEQ ID NO: 37433 - DNA, 25 bp, E. coli
tgggacttgttgaaacacaacaggc

SEQ ID NO: 37434 - DNA, 25 bp, E. coli
tgggacttgttgtaacacaacaggc

SEQ ID NO: 37435 - DNA, 25 bp, E. coli
tgccgatttaatcaccatcgcaggc

SEQ ID NO: 37436 - DNA, 25 bp, E. coli
tgccaacggcttccgtcataaaatc

SEQ ID NO: 37437 - DNA, 25 bp, E. coli
tgccgatttaatgaccatcgcaggc

SEQ ID NO: 37438 - DNA, 25 bp, E. coli
tgccaacggcttgcgtcataaaatc

SEQ ID NO: 37439 - DNA, 25 bp, E. coli
gcgttggcaccatcgccaccggtgt

SEQ ID NO: 37440 - DNA, 25 bp, E. coli
gcgttggcaccaacgccaccggtgt

SEQ ID NO: 37441 - DNA, 25 bp, E. coli
ccggaactggtggaagtattaagcg

SEQ ID NO: 37442 - DNA, 25 bp, E. coli
ccggaactggtgcaagtattaagcg

SEQ ID NO: 37443 - DNA, 25 bp, E. coli
ggtggaagtattaagcgttgacgat

SEQ ID NO: 37444 - DNA, 25 bp, E. coli
ggagctgggacttgttgaaacacaa

SEQ ID NO: 37445 - DNA, 25 bp, E. coli
ggtggaagtatttagcgttgacgat

SEQ ID NO: 37446 - DNA, 25 bp, E. coli
ggagctgggactagttgaaacacaa

SEQ ID NO: 37447 - DNA, 25 bp, E. coli
ggcgaaagcttatgccgatttaatc

SEQ ID NO: 37448 - DNA, 25 bp, E. coli
ggcgaaagcttaagccgatttaatc

SEQ ID NO: 37449 - DNA, 25 bp, E. coli
cgtgaagacgtctgggaaccggatc

SEQ ID NO: 37450 - DNA, 25 bp, E. coli
cgtgaagacgtcagggaaccggatc

SEQ ID NO: 37451 - DNA, 25 bp, E. coli
tactacggcctgtaaaaagatctga

SEQ ID NO: 37452 - DNA, 25 bp, E. coli
tactacggcctgaaaaaagatctga

SEQ ID NO: 37453 - DNA, 25 bp, E. coli
tatggtcagaaattctcctgggccg

SEQ ID NO: 37454 - DNA, 25 bp, E. coli
tatgcgttacgactggaaagcgacc

SEQ ID NO: 37455 - DNA, 25 bp, E. coli
tatggtcagaaaatctcctgggccg

SEQ ID NO: 37456 - DNA, 25 bp, E. coli
tatgcgttacgagtggaaagcgacc

SEQ ID NO: 37457 - DNA, 25 bp, E. coli
ttcgatggcagcaaaaacggcgtct

SEQ ID NO: 37458 - DNA, 25 bp, E. coli
ttcgatggcagctaaaacggcgtct

SEQ ID NO: 37459 - DNA, 25 bp, E. coli
tgtttattcgtatggcctggcacgg

SEQ ID NO: 37460 - DNA, 25 bp, E. coli
tgtttattcgtaaggcctggcacgg

SEQ ID NO: 37461 - DNA, 25 bp, E. coli
tggttcaaactgtcgcacagggata

SEQ ID NO: 37462 - DNA, 25 bp, E. coli
tctaccttccgtggtggcgacaaac

SEQ ID NO: 37463 - DNA, 25 bp, E. coli
tctaccttccgtcgtggcgacaaac

SEQ ID NO: 37464 - DNA, 25 bp, E. coli
tggttcaaactgacgcacagggata

SEQ ID NO: 37465 - DNA, 25 bp, E. coli
taacgtaagcctggataaagcgcgt

SEQ ID NO: 37466 - DNA, 25 bp, E. coli
tcaagtatgagtgggtacagacccg

SEQ ID NO: 37467 - DNA, 25 bp, E. coli
tcaagtatgagtcggtacagacccg

SEQ ID NO: 37468 - DNA, 25 bp, E. coli
taacgtaagcctcgataaagcgcgt

SEQ ID NO: 37469 - DNA, 25 bp, E. coli
gagccaattgctcacggtttccgta

SEQ ID NO: 37470 - DNA, 25 bp, E. coli
gagccaattgctgacggtttccgta

SEQ ID NO: 37471 - DNA, 25 bp, E. coli
tagaaggttcctatcctgaggcact

SEQ ID NO: 37472 - DNA, 25 bp, E. coli
tatgatgtcagtgaaggccgtgcct

SEQ ID NO: 37473 - DNA, 25 bp, E. coli
tagaaggttcctttcctgaggcact

SEQ ID NO: 37474 - DNA, 25 bp, E. coli
tatgatgtcagtcaaggccgtgcct

SEQ ID NO: 37475 - DNA, 25 bp, E. coli
tattttgagcgacatccaggtgcga

SEQ ID NO: 37476 - DNA, 25 bp, E. coli
tattttgagcgagatccaggtgcga

SEQ ID NO: 37477 - DNA, 25 bp, E. coli
tgcctgcctgaggaaagctgagctt

SEQ ID NO: 37478 - DNA, 25 bp, E. coli
tgcctgcctgagcaaagctgagctt

SEQ ID NO: 37479 - DNA, 25 bp, E. coli
tctcttgacgaaatagcggcgttcc

SEQ ID NO: 37480 - DNA, 25 bp, E. coli
tctcttgacgaattagcggcgttcc

SEQ ID NO: 37481 - DNA, 25 bp, E. coli
ccatgataaagtaagggccgctgaa

SEQ ID NO: 37482 - DNA, 25 bp, E. coli
ccatgataaagttagggccgctgaa

SEQ ID NO: 37483 - DNA, 25 bp, E. coli
gctaacggagcatgcaaaagaatct

SEQ ID NO: 37484 - DNA, 25 bp, E. coli
gctaacggagcaagcaaaagaatct

SEQ ID NO: 37485 - DNA, 25 bp, E. coli
gaaacttgcctgagtctggaatccc

SEQ ID NO: 37486 - DNA, 25 bp, E. coli
gaaacttgcctgtgtctggaatccc

SEQ ID NO: 37487 - DNA, 25 bp, E. coli
cgttccggccctttgttaagatgtc

SEQ ID NO: 37488 - DNA, 25 bp, E. coli
cgttccggccctatgttaagatgtc

SEQ ID NO: 37489 - DNA, 25 bp, E. coli
taaccgaacgggtgaagagtctgct

SEQ ID NO: 37490 - DNA, 25 bp, E. coli
taaccgaacgggagaagagtctgct

SEQ ID NO: 37491 - DNA, 25 bp, E. coli
tcacggcgtgatggaatgcaggaac

SEQ ID NO: 37492 - DNA, 25 bp, E. coli
tcacggcgtgatcgaatgcaggaac

SEQ ID NO: 37493 - DNA, 25 bp, E. coli
cagcatactgtcagatacacagcca

SEQ ID NO: 37494 - DNA, 25 bp, E. coli
cagatacacagcgagtaatgctgct

SEQ ID NO: 37495 - DNA, 25 bp, E. coli
cagatacacagccagtaatgctgct

SEQ ID NO: 37496 - DNA, 25 bp, E. coli
cagcatactgtctgatacacagcca

SEQ ID NO: 37497 - DNA, 25 bp, E. coli
atgttacgtcatccctgtggttttg

SEQ ID NO: 37498 - DNA, 25 bp, E. coli
atgttacgtcatgcctgtggttttg

SEQ ID NO: 37499 - DNA, 25 bp, E. coli
tacccgactactacaggattatctg

SEQ ID NO: 37500 - DNA, 25 bp, E. coli
tacccgactacttcaggattatctg

SEQ ID NO: 37501 - DNA, 25 bp, E. coli
tgtcagatacactgccagtaatgct

SEQ ID NO: 37502 - DNA, 25 bp, E. coli
tgtcagatacacagccagtaatgct

SEQ ID NO: 37503 - DNA, 25 bp, E. coli
tctggctgacaaaggtgtcgatacc

SEQ ID NO: 37504 - DNA, 25 bp, E. coli
tctggctgacaatggtgtcgatacc

SEQ ID NO: 37505 - DNA, 25 bp, E. coli
gcctgtggttttcctctggctgaca

SEQ ID NO: 37506 - DNA, 25 bp, E. coli
gcctgtggttttgctctggctgaca

SEQ ID NO: 37507 - DNA, 25 bp, E. coli
gactacttcaggattatctgggtca

SEQ ID NO: 37508 - DNA, 25 bp, E. coli
gactacttcaggtttatctgggtca

SEQ ID NO: 37509 - DNA, 25 bp, E. coli
cgtcatgcctgtcgttttgctctgg

SEQ ID NO: 37510 - DNA, 25 bp, E. coli
cgtcatgcctgtggttttgctctgg

SEQ ID NO: 37511 - DNA, 25 bp, E. coli
cttcaggattatctgggtcatcgaa

SEQ ID NO: 37512 - DNA, 25 bp, E. coli
cttcaggattatgtgggtcatcgaa

SEQ ID NO: 37513 - DNA, 25 bp, E. coli
gtgtcgataccccactacttcagga

SEQ ID NO: 37514 - DNA, 25 bp, E. coli
gtgtcgatacccgactacttcagga

SEQ ID NO: 37515 - DNA, 25 bp, E. coli
tacggagggaaacaatctctagacc

SEQ ID NO: 37516 - DNA, 25 bp, E. coli
tacggagggaaagaatctctagacc

SEQ ID NO: 37517 - DNA, 25 bp, E. coli
aaatcgcaatggacggcgaactgcc

SEQ ID NO: 37518 - DNA, 25 bp, E. coli
aaatcgcaatggtcggcgaactgcc

SEQ ID NO: 37519 - DNA, 25 bp, E. coli
aactgccacccggaggtgctgtgaa

SEQ ID NO: 37520 - DNA, 25 bp, E. coli
aactgccacccgcaggtgctgtgaa

SEQ ID NO: 37521 - DNA, 25 bp, E. coli
tagaccatccttaacgattcagcca

SEQ ID NO: 37522 - DNA, 25 bp, E. coli
tagaccatcctttacgattcagcca

SEQ ID NO: 37523 - DNA, 25 bp, E. coli
ttatcaccatgcgaattaacgaagt

SEQ ID NO: 37524 - DNA, 25 bp, E. coli
ttcgttgagaaacgtgattatcacc

SEQ ID NO: 37525 - DNA, 25 bp, E. coli
ttatcaccatgccaattaacgaagt

SEQ ID NO: 37526 - DNA, 25 bp, E. coli
ttcgttgagaaaggtgattatcacc

SEQ ID NO: 37527 - DNA, 25 bp, E. coli
tcggatctcaagcaaatcgcaatgg

SEQ ID NO: 37528 - DNA, 25 bp, E. coli
tcggatctcaaggaaatcgcaatgg

SEQ ID NO: 37529 - DNA, 25 bp, E. coli
gaatccgagtataaagaggcggtag

SEQ ID NO: 37530 - DNA, 25 bp, E. coli
gaatccgagtattaagaggcggtag

SEQ ID NO: 37531 - DNA, 25 bp, E. coli
gactaatcttgggattcgttgagaa

SEQ ID NO: 37532 - DNA, 25 bp, E. coli
gactaatcttggcattcgttgagaa

SEQ ID NO: 37533 - DNA, 25 bp, E. coli
cccgcaggtgctctgaatccgagta

SEQ ID NO: 37534 - DNA, 25 bp, E. coli
cgattcagccacatttttatgttgc

SEQ ID NO: 37535 - DNA, 25 bp, E. coli
cgattcagccacttttttatgttgc

SEQ ID NO: 37536 - DNA, 25 bp, E. coli
cccgcaggtgctgtgaatccgagta

SEQ ID NO: 37537 - DNA, 25 bp, E. coli
caatataaaagttccactgaccgag

SEQ ID NO: 37538 - DNA, 25 bp, E. coli
caatataaaagtaccactgaccgag

SEQ ID NO: 37539 - DNA, 25 bp, E. coli
ataaaggacggtcgacgtgattgcc

SEQ ID NO: 37540 - DNA, 25 bp, E. coli
ataaaggacggtggacgtgattgcc

SEQ ID NO: 37541 - DNA, 25 bp, E. coli
aaaagttccactcaccgagccacag

SEQ ID NO: 37542 - DNA, 25 bp, E. coli
aaaagttccactgaccgagccacag

SEQ ID NO: 37543 - DNA, 25 bp, E. coli
tattccgggaatgaaactgtcgaag

SEQ ID NO: 37544 - DNA, 25 bp, E. coli
tattccgggaatcaaactgtcgaag

SEQ ID NO: 37545 - DNA, 25 bp, E. coli
tgcataccgcgatggctccggcata

SEQ ID NO: 37546 - DNA, 25 bp, E. coli
tgcataccgcgaaggctccggcata

SEQ ID NO: 37547 - DNA, 25 bp, E. coli
tgcccctgacattctcgatcagttt

SEQ ID NO: 37548 - DNA, 25 bp, E. coli
tgcccctgacatactcgatcagttt

SEQ ID NO: 37549 - DNA, 25 bp, E. coli
gaatcacaccacagcataccgcgat

SEQ ID NO: 37550 - DNA, 25 bp, E. coli
gaatcacaccactgcataccgcgat

SEQ ID NO: 37551 - DNA, 25 bp, E. coli
gagcaacgatggaggacggtaaacc

SEQ ID NO: 37552 - DNA, 25 bp, E. coli
gagcaacgatggtggacggtaaacc

SEQ ID NO: 37553 - DNA, 25 bp, E. coli
cgatggtggacggtaaacctgttat

SEQ ID NO: 37554 - DNA, 25 bp, E. coli
cggtggacgtgattgccgcattcgt

SEQ ID NO: 37555 - DNA, 25 bp, E. coli
cggtggacgtgaatgccgcattcgt

SEQ ID NO: 37556 - DNA, 25 bp, E. coli
cgatggtggacgctaaacctgttat

SEQ ID NO: 37557 - DNA, 25 bp, E. coli
gagccacagaaagccggtatcgcgt

SEQ ID NO: 37558 - DNA, 25 bp, E. coli
gagccacagaaacccggtatcgcgt

SEQ ID NO: 37559 - DNA, 25 bp, E. coli
aattatattctcgagtgtggcccgg

SEQ ID NO: 37560 - DNA, 25 bp, E. coli
aattatattctccagtgtggcccgg

SEQ ID NO: 37561 - DNA, 25 bp, E. coli
agtatcctgatgtgtttcccctgag

SEQ ID NO: 37562 - DNA, 25 bp, E. coli
agtatcctgatgagtttcccctgag

SEQ ID NO: 37563 - DNA, 25 bp, E. coli
ttaacaaaatgtcggatggctccgt

SEQ ID NO: 37564 - DNA, 25 bp, E. coli
ttaacaaaatgtgggatggctccgt

SEQ ID NO: 37565 - DNA, 25 bp, E. coli
ttattaacggaggtgtgaccccggg

SEQ ID NO: 37566 - DNA, 25 bp, E. coli
ttattaacggagctgtgaccccggg

SEQ ID NO: 37567 - DNA, 25 bp, E. coli
tgctgagtccggagaacgaaaaacc

SEQ ID NO: 37568 - DNA, 25 bp, E. coli
tgctgagtccggtgaacgaaaaacc

SEQ ID NO: 37569 - DNA, 25 bp, E. coli
tcatgaacgatttatggaactggcc

SEQ ID NO: 37570 - DNA, 25 bp, E. coli
tcatgaacgattaatggaactggcc

SEQ ID NO: 37571 - DNA, 25 bp, E. coli
tctgtcgtgcagcaaggaaaaacca

SEQ ID NO: 37572 - DNA, 25 bp, E. coli
tctgtcgtgcaggaaggaaaaacca

SEQ ID NO: 37573 - DNA, 25 bp, E. coli
gaataaagaactgcgcaaaggcgcg

SEQ ID NO: 37574 - DNA, 25 bp, E. coli
gaataaagaactccgcaaaggcgcg

SEQ ID NO: 37575 - DNA, 25 bp, E. coli
gaactgaatgcgagctacagccaga

SEQ ID NO: 37576 - DNA, 25 bp, E. coli
gaactgaatgcgtgctacagccaga

SEQ ID NO: 37577 - DNA, 25 bp, E. coli
tcagctttgtggtcagtggcgttca

SEQ ID NO: 37578 - DNA, 25 bp, E. coli
taatggagccccagtaccagcagga

SEQ ID NO: 37579 - DNA, 25 bp, E. coli
tcagctttgtggacagtggcgttca

SEQ ID NO: 37580 - DNA, 25 bp, E. coli
taatggagcccctgtaccagcagga

SEQ ID NO: 37581 - DNA, 25 bp, E. coli
caaaaattcgcgtcgctacgcgtcc

SEQ ID NO: 37582 - DNA, 25 bp, E. coli
caaaaattcgcgacgctacgcgtcc

SEQ ID NO: 37583 - DNA, 25 bp, E. coli
caggcattttcggaacgtgtggaac

SEQ ID NO: 37584 - DNA, 25 bp, E. coli
caggcattttcgcaacgtgtggaac

SEQ ID NO: 37585 - DNA, 25 bp, E. coli
tacgcgtcctcaatagccgtgccat

SEQ ID NO: 37586 - DNA, 25 bp, E. coli
tatgcagtgaacaggaacgggcaca

SEQ ID NO: 37587 - DNA, 25 bp, E. coli
tacgcgtcctcattagccgtgccat

SEQ ID NO: 37588 - DNA, 25 bp, E. coli
tatgcagtgaactggaacgggcaca

SEQ ID NO: 37589 - DNA, 25 bp, E. coli
tatagcgcgtggagcaatgactggc

SEQ ID NO: 37590 - DNA, 25 bp, E. coli
tatagcgcgtggtgcaatgactggc

SEQ ID NO: 37591 - DNA, 25 bp, E. coli
gcgactgggagatgcgacatcatcg

SEQ ID NO: 37592 - DNA, 25 bp, E. coli
gcgactgggagaagcgacatcatcg

SEQ ID NO: 37593 - DNA, 25 bp, E. coli
gaaatgttttttcgcgactgggaga

SEQ ID NO: 37594 - DNA, 25 bp, E. coli
gaaatgttttttggcgactgggaga

SEQ ID NO: 37595 - DNA, 25 bp, E. coli
ccccacgaacggtgaaggatttcag

SEQ ID NO: 37596 - DNA, 25 bp, E. coli
cgcggtattgagcaagcgcaaaatc

SEQ ID NO: 37597 - DNA, 25 bp, E. coli
cgcggtattgaggaagcgcaaaatc

SEQ ID NO: 37598 - DNA, 25 bp, E. coli
ccccacgaacggagaaggatttcag

SEQ ID NO: 37599 - DNA, 25 bp, E. coli
gatgccgaaaactatagcgcgtggt

SEQ ID NO: 37600 - DNA, 25 bp, E. coli
gacctcatgcaacaagatgccgaaa

SEQ ID NO: 37601 - DNA, 25 bp, E. coli
gatgccgaaaacaatagcgcgtggt

SEQ ID NO: 37602 - DNA, 25 bp, E. coli
gacctcatgcaagaagatgccgaaa

SEQ ID NO: 37603 - DNA, 25 bp, E. coli
aacgcgccagtggtttcggctctca

SEQ ID NO: 37604 - DNA, 25 bp, E. coli
aacgcgccagtgctttcggctctca

SEQ ID NO: 37605 - DNA, 25 bp, E. coli
taaaaacgaaatgctgactaatgtc

SEQ ID NO: 37606 - DNA, 25 bp, E. coli
taacaaacgcgcgagtgctttcggc

SEQ ID NO: 37607 - DNA, 25 bp, E. coli
taacaaacgcgccagtgctttcggc

SEQ ID NO: 37608 - DNA, 25 bp, E. coli
tagccacttccctcggcgtggtatg

SEQ ID NO: 37609 - DNA, 25 bp, E. coli
tagccacttcccacggcgtggtatg

SEQ ID NO: 37610 - DNA, 25 bp, E. coli
taaaaacgaaatcctgactaatgtc

SEQ ID NO: 37611 - DNA, 25 bp, E. coli
agtgctttcggcactcacggctgga

SEQ ID NO: 37612 - DNA, 25 bp, E. coli
agtgctttcggctctcacggctgga

SEQ ID NO: 37613 - DNA, 25 bp, E. coli
tgatagccacttcccacggcgtggt

SEQ ID NO: 37614 - DNA, 25 bp, E. coli
tgatagccacttgccacggcgtggt

SEQ ID NO: 37615 - DNA, 25 bp, E. coli
cgcttccgtaactaacgcgccagtg

SEQ ID NO: 37616 - DNA, 25 bp, E. coli
cgcttccgtaacaaacgcgccagtg

SEQ ID NO: 37617 - DNA, 25 bp, E. coli
ctttcggctctcacggctggagcgg

SEQ ID NO: 37618 - DNA, 25 bp, E. coli
ctttcggctctctcggctggagcgg

SEQ ID NO: 37619 - DNA, 25 bp, E. coli
gatatgatagcctcttcccacggcg

SEQ ID NO: 37620 - DNA, 25 bp, E. coli
gatatgatagccacttcccacggcg

SEQ ID NO: 37621 - DNA, 25 bp, E. coli
gtcgatatgatacccacttcccacg

SEQ ID NO: 37622 - DNA, 25 bp, E. coli
tggagcggcggtccggtggatcgtc

SEQ ID NO: 37623 - DNA, 25 bp, E. coli
gtcgatatgatagccacttcccacg

SEQ ID NO: 37624 - DNA, 25 bp, E. coli
tggagcggcggtgcggtggatcgtc

SEQ ID NO: 37625 - DNA, 25 bp, E. coli
caaatggctcaggaagaagggcgct

SEQ ID NO: 37626 - DNA, 25 bp, E. coli
caaatggctcagcaagaagggcgct

SEQ ID NO: 37627 - DNA, 25 bp, E. coli
caggctgttgtcgaccaggctaaac

SEQ ID NO: 37628 - DNA, 25 bp, E. coli
caggctgttgtccaccaggctaaac

SEQ ID NO: 37629 - DNA, 25 bp, E. coli
taaagtctacgatgagatcgacgag

SEQ ID NO: 37630 - DNA, 25 bp, E. coli
taaattagagcgacgccatccgcat

SEQ ID NO: 37631 - DNA, 25 bp, E. coli
taaagtctacgaagagatcgacgag

SEQ ID NO: 37632 - DNA, 25 bp, E. coli
taaattagagcgtcgccatccgcat

SEQ ID NO: 37633 - DNA, 25 bp, E. coli
aaaatccagaaacgttgcgccaacg

SEQ ID NO: 37634 - DNA, 25 bp, E. coli
aaaatccagaaaggttgcgccaacg

SEQ ID NO: 37635 - DNA, 25 bp, E. coli
tgcccgttgggaccaaatcaaaacc

SEQ ID NO: 37636 - DNA, 25 bp, E. coli
tgcccgttgggagcaaatcaaaacc

SEQ ID NO: 37637 - DNA, 25 bp, E. coli
cctcgaaacaatcgaagaagtctgg

SEQ ID NO: 37638 - DNA, 25 bp, E. coli
ccatcgcccgtgtagattttgacga

SEQ ID NO: 37639 - DNA, 25 bp, E. coli
cctcgaaacaatggaagaagtctgg

SEQ ID NO: 37640 - DNA, 25 bp, E. coli
ccatcgcccgtgaagattttgacga

SEQ ID NO: 37641 - DNA, 25 bp, E. coli
gaagtctggcaacaggtaaaacggc

SEQ ID NO: 37642 - DNA, 25 bp, E. coli
gaagtctggcaagaggtaaaacggc

SEQ ID NO: 37643 - DNA, 25 bp, E. coli
cattcggcgctggacgatattcctc

SEQ ID NO: 37644 - DNA, 25 bp, E. coli
cattcggcgctgcacgatattcctc

SEQ ID NO: 37645 - DNA, 25 bp, E. coli
gtttaccggctttaatgcgtgcgca

SEQ ID NO: 37646 - DNA, 25 bp, E. coli
gtttaccggcttaaatgcgtgcgca

SEQ ID NO: 37647 - DNA, 25 bp, E. coli
cattttacagcgtggtccgaaccgt

SEQ ID NO: 37648 - DNA, 25 bp, E. coli
cattttacagcgaggtccgaaccgt

SEQ ID NO: 37649 - DNA, 25 bp, E. coli
tggtggcaacatccgcattaacagc

SEQ ID NO: 37650 - DNA, 25 bp, E. coli
tgtgtcaaccaacatcaacgcaggg

SEQ ID NO: 37651 - DNA, 25 bp, E. coli
tgtgtcaaccaagatcaacgcaggg

SEQ ID NO: 37652 - DNA, 25 bp, E. coli
tggtggcaacatgcgcattaacagc

SEQ ID NO: 37653 - DNA, 25 bp, E. coli
ccaccgctggtgagaaatgcaataa

SEQ ID NO: 37654 - DNA, 25 bp, E. coli
ccaccgctggtgtgaaatgcaataa

SEQ ID NO: 37655 - DNA, 25 bp, E. coli
gcgactcattccagaggagcttgaa

SEQ ID NO: 37656 - DNA, 25 bp, E. coli
gcgactcattcctgaggagcttgaa

SEQ ID NO: 37657 - DNA, 25 bp, E. coli
gaaaaacgttgtgtgtcgcacctaa

SEQ ID NO: 37658 - DNA, 25 bp, E. coli
gaaaaacgttgtctgtcgcacctaa

SEQ ID NO: 37659 - DNA, 25 bp, E. coli
gaaaacgtcaggtcatcatgcaagg

SEQ ID NO: 37660 - DNA, 25 bp, E. coli
gaaaacgtcaggacatcatgcaagg

SEQ ID NO: 37661 - DNA, 25 bp, E. coli
gattctggctgattccggtgaaagg

SEQ ID NO: 37662 - DNA, 25 bp, E. coli
gattctggctgaatccggtgaaagg

SEQ ID NO: 37663 - DNA, 25 bp, E. coli
ggtaatttttgagagccgggccatg

SEQ ID NO: 37664 - DNA, 25 bp, E. coli
ggaggttctcttatcatcgacagga

SEQ ID NO: 37665 - DNA, 25 bp, E. coli
ggtaatttttgacagccgggccatg

SEQ ID NO: 37666 - DNA, 25 bp, E. coli
ggaggttctcttttcatcgacagga

SEQ ID NO: 37667 - DNA, 25 bp, E. coli
taatttgaaggagccaagactgacg

SEQ ID NO: 37668 - DNA, 25 bp, E. coli
taatttgaaggacccaagactgacg

SEQ ID NO: 37669 - DNA, 25 bp, E. coli
caaagctaccttttttcacttcctg

SEQ ID NO: 37670 - DNA, 25 bp, E. coli
caaagctaccttatttcacttcctg

SEQ ID NO: 37671 - DNA, 25 bp, E. coli
catttaccctgtgtgtccatagtga

SEQ ID NO: 37672 - DNA, 25 bp, E. coli
catttaccctgtctgtccatagtga

SEQ ID NO: 37673 - DNA, 25 bp, E. coli
attaatgtagcaccgcctaattgcg

SEQ ID NO: 37674 - DNA, 25 bp, E. coli
attaatgtagcagcgcctaattgcg

SEQ ID NO: 37675 - DNA, 25 bp, E. coli
tatcggaatgcgtgttctggtgaac

SEQ ID NO: 37676 - DNA, 25 bp, E. coli
tatcggaatgcgagttctggtgaac

SEQ ID NO: 37677 - DNA, 25 bp, E. coli
ttcagaccatggtagcaaagctacc

SEQ ID NO: 37678 - DNA, 25 bp, E. coli
ttcagaccatggaagcaaagctacc

SEQ ID NO: 37679 - DNA, 25 bp, E. coli
tttcacttcctgaacatttaccctg

SEQ ID NO: 37680 - DNA, 25 bp, E. coli
tttcacttcctgtacatttaccctg

SEQ ID NO: 37681 - DNA, 25 bp, E. coli
tgttgtgtttgcaattggtctgcga

SEQ ID NO: 37682 - DNA, 25 bp, E. coli
tgttgtgtttgctattggtctgcga

SEQ ID NO: 37683 - DNA, 25 bp, E. coli
tgagccggaacgtaaagttttatcg

SEQ ID NO: 37684 - DNA, 25 bp, E. coli
tgagccggaacgaaaagttttatcg

SEQ ID NO: 37685 - DNA, 25 bp, E. coli
tctgcgattcagaccatggtagcaa

SEQ ID NO: 37686 - DNA, 25 bp, E. coli
tctgcgattcagtccatggtagcaa

SEQ ID NO: 37687 - DNA, 25 bp, E. coli
ccatagtgattattgtagcaccgcc

SEQ ID NO: 37688 - DNA, 25 bp, E. coli
ccatagtgattaatgtagcaccgcc

SEQ ID NO: 37689 - DNA, 25 bp, E. coli
gaacttttggctaacggttgtgatg

SEQ ID NO: 37690 - DNA, 25 bp, E. coli
gaacttttggcttacggttgtgatg

SEQ ID NO: 37691 - DNA, 25 bp, E. coli
cacctgcctgctcttgccgatgatg

SEQ ID NO: 37692 - DNA, 25 bp, E. coli
cacctgcctgctgttgccgatgatg

SEQ ID NO: 37693 - DNA, 25 bp, E. coli
tacgcaagattctggcactcacctg

SEQ ID NO: 37694 - DNA, 25 bp, E. coli
tacgcaagattcaggcactcacctg

SEQ ID NO: 37695 - DNA, 25 bp, E. coli
taaaaagctttaaccctggtcgcag

SEQ ID NO: 37696 - DNA, 25 bp, E. coli
taaaaagctttatccctggtcgcag

SEQ ID NO: 37697 - DNA, 25 bp, E. coli
agttcgaaaccggtcagcgagtgcc

SEQ ID NO: 37698 - DNA, 25 bp, E. coli
agttcgaaaccgctcagcgagtgcc

SEQ ID NO: 37699 - DNA, 25 bp, E. coli
aaagttccgctgaagtggtgctgga

SEQ ID NO: 37700 - DNA, 25 bp, E. coli
aaagttccgctgtagtggtgctgga

SEQ ID NO: 37701 - DNA, 25 bp, E. coli
tagctacaaaacctggaacagcgcg

SEQ ID NO: 37702 - DNA, 25 bp, E. coli
tagctacaaaacgtggaacagcgcg

SEQ ID NO: 37703 - DNA, 25 bp, E. coli
ccattgttaacagcgacgacgcgat

SEQ ID NO: 37704 - DNA, 25 bp, E. coli
ccattgttaacaccgacgacgcgat

SEQ ID NO: 37705 - DNA, 25 bp, E. coli
gcaacatattgcaggtcgcacctct

SEQ ID NO: 37706 - DNA, 25 bp, E. coli
gaagttaccgcacgatcgttaccag

SEQ ID NO: 37707 - DNA, 25 bp, E. coli
gaagttaccgcaggatcgttaccag

SEQ ID NO: 37708 - DNA, 25 bp, E. coli
gcaacatattgctggtcgcacctct

SEQ ID NO: 37709 - DNA, 25 bp, E. coli
gaacagcgcgcacttagtgggaaaa

SEQ ID NO: 37710 - DNA, 25 bp, E. coli
gaacagcgcgcagttagtgggaaaa

SEQ ID NO: 37711 - DNA, 25 bp, E. coli
gatggcttccgcacatcagttcgaa

SEQ ID NO: 37712 - DNA, 25 bp, E. coli
gatggcttccgctcatcagttcgaa

SEQ ID NO: 37713 - DNA, 25 bp, E. coli
caaatatggcaatgctccggaggga

SEQ ID NO: 37714 - DNA, 25 bp, E. coli
caaatatggcaaagctccggaggga

SEQ ID NO: 37715 - DNA, 25 bp, E. coli
aaaactctggagttgtcctggcgca

SEQ ID NO: 37716 - DNA, 25 bp, E. coli
aaaactctggagatgtcctggcgca

SEQ ID NO: 37717 - DNA, 25 bp, E. coli
tgttggccacgcaacactcaggtaa

SEQ ID NO: 37718 - DNA, 25 bp, E. coli
tgttggccacgctacactcaggtaa

SEQ ID NO: 37719 - DNA, 25 bp, E. coli
tgtagagaaaacttccacctggctg

SEQ ID NO: 37720 - DNA, 25 bp, E. coli
tgtagagaaaacatccacctggctg

SEQ ID NO: 37721 - DNA, 25 bp, E. coli
gaaatgattctcactgccggcggta

SEQ ID NO: 37722 - DNA, 25 bp, E. coli
gaaatgattctctctgccggcggta

SEQ ID NO: 37723 - DNA, 25 bp, E. coli
gaacaacgacttctggcacttgacg

SEQ ID NO: 37724 - DNA, 25 bp, E. coli
gaacaacgacttgtggcacttgacg

SEQ ID NO: 37725 - DNA, 25 bp, E. coli
cattaatacgcattggtcgccaggc

SEQ ID NO: 37726 - DNA, 25 bp, E. coli
cattaatacgcaatggtcgccaggc

SEQ ID NO: 37727 - DNA, 25 bp, E. coli
tggttgtaccaattaaagaggcccg

SEQ ID NO: 37728 - DNA, 25 bp, E. coli
tggttgtaccaaataaagaggcccg

SEQ ID NO: 37729 - DNA, 25 bp, E. coli
tcactttgcagagcgactactgggc

SEQ ID NO: 37730 - DNA, 25 bp, E. coli
tcactttgcagaccgactactgggc

SEQ ID NO: 37731 - DNA, 25 bp, E. coli
taagcgactcgagcttcatctgacg

SEQ ID NO: 37732 - DNA, 25 bp, E. coli
taagcgactcgaccttcatctgacg

SEQ ID NO: 37733 - DNA, 25 bp, E. coli
gatgacgaccagcacgatagccttt

SEQ ID NO: 37734 - DNA, 25 bp, E. coli
gatgacgaccaggacgatagccttt

SEQ ID NO: 37735 - DNA, 25 bp, E. coli
acctggctgccaactatcgcccaga

SEQ ID NO: 37736 - DNA, 25 bp, E. coli
acctggctgccatctatcgcccaga

SEQ ID NO: 37737 - DNA, 25 bp, E. coli
tatcgtgcatcgctattttggtccc

SEQ ID NO: 37738 - DNA, 25 bp, E. coli
tatcgtgcatcggtattttggtccc

SEQ ID NO: 37739 - DNA, 25 bp, E. coli
ttgttgattacgttattacgctggg

SEQ ID NO: 37740 - DNA, 25 bp, E. coli
ttgttgattacgatattacgctggg

SEQ ID NO: 37741 - DNA, 25 bp, E. coli
gcgcgctgctgggattagttctgac

SEQ ID NO: 37742 - DNA, 25 bp, E. coli
gcatcgctatttaggtccccatgtt

SEQ ID NO: 37743 - DNA, 25 bp, E. coli
gcatcgctattttggtccccatgtt

SEQ ID NO: 37744 - DNA, 25 bp, E. coli
gcgcgctgctggcattagttctgac

SEQ ID NO: 37745 - DNA, 25 bp, E. coli
gctggcacatcggaaatttttgctg

SEQ ID NO: 37746 - DNA, 25 bp, E. coli
gctggcacatcgcaaatttttgctg

SEQ ID NO: 37747 - DNA, 25 bp, E. coli
gcacctgctggcacatcgcaaattt

SEQ ID NO: 37748 - DNA, 25 bp, E. coli
gcacctgctggctcatcgcaaattt

SEQ ID NO: 37749 - DNA, 25 bp, E. coli
ccgcgttgttgattacgttattacg

SEQ ID NO: 37750 - DNA, 25 bp, E. coli
ccgcgttgttgaatacgttattacg

SEQ ID NO: 37751 - DNA, 25 bp, E. coli
cgttgttaattgagggcgcgctgct

SEQ ID NO: 37752 - DNA, 25 bp, E. coli
cgttgttaattgtgggcgcgctgct

SEQ ID NO: 37753 - DNA, 25 bp, E. coli
ggattagttctgtcgcacctgctgg

SEQ ID NO: 37754 - DNA, 25 bp, E. coli
ggattagttctgacgcacctgctgg

SEQ ID NO: 37755 - DNA, 25 bp, E. coli
tggcatcggcaggtctgcccgcgtt

SEQ ID NO: 37756 - DNA, 25 bp, E. coli
tggcatcggcagctctgcccgcgtt

SEQ ID NO: 37757 - DNA, 25 bp, E. coli
caaacagccggtacggttgaagaga

SEQ ID NO: 37758 - DNA, 25 bp, E. coli
caaacagccggttcggttgaagaga

SEQ ID NO: 37759 - DNA, 25 bp, E. coli
taaaaatgcatttttccgcttgtct

SEQ ID NO: 37760 - DNA, 25 bp, E. coli
taaaaatgcattattccgcttgtct

SEQ ID NO: 37761 - DNA, 25 bp, E. coli
ggttcggttgaacagaaaaatcctg

SEQ ID NO: 37762 - DNA, 25 bp, E. coli
ataatgcgcctcgatcgacacggcg

SEQ ID NO: 37763 - DNA, 25 bp, E. coli
ataatgcgcctccatcgacacggcg

SEQ ID NO: 37764 - DNA, 25 bp, E. coli
ggttcggttgaagagaaaaatcctg

SEQ ID NO: 37765 - DNA, 25 bp, E. coli
ttttccgcttgtgttcctgagccga

SEQ ID NO: 37766 - DNA, 25 bp, E. coli
ttttccgcttgtcttcctgagccga

SEQ ID NO: 37767 - DNA, 25 bp, E. coli
tgtgaatcacttcacacaaacagcc

SEQ ID NO: 37768 - DNA, 25 bp, E. coli
tgtgaatcacttgacacaaacagcc

SEQ ID NO: 37769 - DNA, 25 bp, E. coli
tcctgagccgacaccctataatgcg

SEQ ID NO: 37770 - DNA, 25 bp, E. coli
tcctgagccgactccctataatgcg

SEQ ID NO: 37771 - DNA, 25 bp, E. coli
gcctccatcgactcggcggatgtga

SEQ ID NO: 37772 - DNA, 25 bp, E. coli
gcctccatcgacacggcggatgtga

SEQ ID NO: 37773 - DNA, 25 bp, E. coli
gcatttttccgcttgtcttcctgag

SEQ ID NO: 37774 - DNA, 25 bp, E. coli
gcatttttccgcatgtcttcctgag

SEQ ID NO: 37775 - DNA, 25 bp, E. coli
gacacggcggatgtgaatcacttca

SEQ ID NO: 37776 - DNA, 25 bp, E. coli
gacacggcggatctgaatcacttca

SEQ ID NO: 37777 - DNA, 25 bp, E. coli
gatgagcggttgaaataaaaatgca

SEQ ID NO: 37778 - DNA, 25 bp, E. coli
gatgagcggttgtaataaaaatgca

SEQ ID NO: 37779 - DNA, 25 bp, E. coli
caatggtgctttaatttctgtatat

SEQ ID NO: 37780 - DNA, 25 bp, E. coli
caatggtgcttttatttctgtatat

SEQ ID NO: 37781 - DNA, 25 bp, E. coli
atggcaatggtggttttatttctgt

SEQ ID NO: 37782 - DNA, 25 bp, E. coli
atggcaatggtgcttttatttctgt

SEQ ID NO: 37783 - DNA, 25 bp, E. coli
tatggcaatggtccttttatttctg

SEQ ID NO: 37784 - DNA, 25 bp, E. coli
tatggcaatggtgcttttatttctg

SEQ ID NO: 37785 - DNA, 25 bp, E. coli
tgtatggcaatggtgcttttatttc

SEQ ID NO: 37786 - DNA, 25 bp, E. coli
tgtatggcaatgctgcttttatttc

SEQ ID NO: 37787 - DNA, 25 bp, E. coli
gtatggcaatggtgcttttatttct

SEQ ID NO: 37788 - DNA, 25 bp, E. coli
gtatggcaatggagcttttatttct

SEQ ID NO: 37789 - DNA, 25 bp, E. coli
gcaatggtgcttatatttctgtata

SEQ ID NO: 37790 - DNA, 25 bp, E. coli
gcaatggtgcttttatttctgtata

SEQ ID NO: 37791 - DNA, 25 bp, E. coli
ctgtatggcaatcgtgcttttattt

SEQ ID NO: 37792 - DNA, 25 bp, E. coli
ctgtatggcaatggtgcttttattt

SEQ ID NO: 37793 - DNA, 25 bp, E. coli
ggcaatggtgcttttatttctgtat

SEQ ID NO: 37794 - DNA, 25 bp, E. coli
tggcaatggtgcttttatttctgta

SEQ ID NO: 37795 - DNA, 25 bp, E. coli
ggcaatggtgctattatttctgtat

SEQ ID NO: 37796 - DNA, 25 bp, E. coli
tggcaatggtgcatttatttctgta

SEQ ID NO: 37797 - DNA, 25 bp, E. coli
catcaaccgtggtacgctgcgtaaa

SEQ ID NO: 37798 - DNA, 25 bp, E. coli
catcaaccgtggaacgctgcgtaaa

SEQ ID NO: 37799 - DNA, 25 bp, E. coli
caggatgtgaatcacctctatgagc

SEQ ID NO: 37800 - DNA, 25 bp, E. coli
caggatgtgaatgacctctatgagc

SEQ ID NO: 37801 - DNA, 25 bp, E. coli
tactggctgaagtagaacagcccct

SEQ ID NO: 37802 - DNA, 25 bp, E. coli
tactggctgaagaagaacagcccct

SEQ ID NO: 37803 - DNA, 25 bp, E. coli
acccgtggtaacgagacccgtgctg

SEQ ID NO: 37804 - DNA, 25 bp, E. coli
acccgtggtaaccagacccgtgctg

SEQ ID NO: 37805 - DNA, 25 bp, E. coli
ttcgaacaacgcctaaattctgacg

SEQ ID NO: 37806 - DNA, 25 bp, E. coli
ttcgaacaacgcgtaaattctgacg

SEQ ID NO: 37807 - DNA, 25 bp, E. coli
tgactcggttaaacaggcactgaag

SEQ ID NO: 37808 - DNA, 25 bp, E. coli
tgactcggttaatcaggcactgaag

SEQ ID NO: 37809 - DNA, 25 bp, E. coli
tctgacgtactgtccgtttctaccg

SEQ ID NO: 37810 - DNA, 25 bp, E. coli
tctgacgtactgaccgtttctaccg

SEQ ID NO: 37811 - DNA, 25 bp, E. coli
cctctatgagctggtactggctgaa

SEQ ID NO: 37812 - DNA, 25 bp, E. coli
cctctatgagctcgtactggctgaa

SEQ ID NO: 37813 - DNA, 25 bp, E. coli
gaacagcccctgatggacatggtga

SEQ ID NO: 37814 - DNA, 25 bp, E. coli
gaacagcccctgttggacatggtga

SEQ ID NO: 37815 - DNA, 25 bp, E. coli
gacatggtgatgcaatacacccgtg

SEQ ID NO: 37816 - DNA, 25 bp, E. coli
gacatggtgatggaatacacccgtg

SEQ ID NO: 37817 - DNA, 25 bp, E. coli
taactctcaggatcaggtaacccaa

SEQ ID NO: 37818 - DNA, 25 bp, E. coli
taactctcaggaacaggtaacccaa

SEQ ID NO: 37819 - DNA, 25 bp, E. coli
aactggccgagatataccacacgca

SEQ ID NO: 37820 - DNA, 25 bp, E. coli
agaaataccacaggcagctgctggg

SEQ ID NO: 37821 - DNA, 25 bp, E. coli
agaaataccacacgcagctgctggg

SEQ ID NO: 37822 - DNA, 25 bp, E. coli
aactggccgagaaataccacacgca

SEQ ID NO: 37823 - DNA, 25 bp, E. coli
ttgacattggcacaaaacattccag

SEQ ID NO: 37824 - DNA, 25 bp, E. coli
ttgacattggcagaaaacattccag

SEQ ID NO: 37825 - DNA, 25 bp, E. coli
tgacattcaattgacattggcacaa

SEQ ID NO: 37826 - DNA, 25 bp, E. coli
tgacattcaattcacattggcacaa

SEQ ID NO: 37827 - DNA, 25 bp, E. coli
gaaactggccgacaaataccacacg

SEQ ID NO: 37828 - DNA, 25 bp, E. coli
gacattggcacaaaacattccagta

SEQ ID NO: 37829 - DNA, 25 bp, E. coli
gaaactggccgagaaataccacacg

SEQ ID NO: 37830 - DNA, 25 bp, E. coli
gacattggcacataacattccagta

SEQ ID NO: 37831 - DNA, 25 bp, E. coli
cattcaattgactttggcacaaaac

SEQ ID NO: 37832 - DNA, 25 bp, E. coli
cattcaattgacattggcacaaaac

SEQ ID NO: 37833 - DNA, 25 bp, E. coli
tggccgagaaattccacacgcagct

SEQ ID NO: 37834 - DNA, 25 bp, E. coli
tggccgagaaataccacacgcagct

SEQ ID NO: 37835 - DNA, 25 bp, E. coli
tcaattgacattcgcacaaaacatt

SEQ ID NO: 37836 - DNA, 25 bp, E. coli
tcaattgacattggcacaaaacatt

SEQ ID NO: 37837 - DNA, 25 bp, E. coli
gagaaataccactcgcagctgctgg

SEQ ID NO: 37838 - DNA, 25 bp, E. coli
gagaaataccacacgcagctgctgg

SEQ ID NO: 37839 - DNA, 25 bp, E. coli
gagaaactggccgagaaataccaca

SEQ ID NO: 37840 - DNA, 25 bp, E. coli
gagaaactggcccagaaataccaca

SEQ ID NO: 37841 - DNA, 25 bp, E. coli
caatgcgcgatgtggtgagcaaagt

SEQ ID NO: 37842 - DNA, 25 bp, E. coli
aaggttcgttctggcgtgcgctcag

SEQ ID NO: 37843 - DNA, 25 bp, E. coli
aaggttcgttctcgcgtgcgctcag

SEQ ID NO: 37844 - DNA, 25 bp, E. coli
caatctcgaaacgatgcaagtggtg

SEQ ID NO: 37845 - DNA, 25 bp, E. coli
caatctcgaaaccatgcaagtggtg

SEQ ID NO: 37846 - DNA, 25 bp, E. coli
caatgcgcgatgaggtgagcaaagt

SEQ ID NO: 37847 - DNA, 25 bp, E. coli
caggcgcgtgaatttgccgaggcaa

SEQ ID NO: 37848 - DNA, 25 bp, E. coli
caggcgcgtgaaattgccgaggcaa

SEQ ID NO: 37849 - DNA, 25 bp, E. coli
aaaaatgccttctcgcaggcgttaa

SEQ ID NO: 37850 - DNA, 25 bp, E. coli
aaagtgattgccgattgtggctgcg

SEQ ID NO: 37851 - DNA, 25 bp, E. coli
aaaaatgccttcacgcaggcgttaa

SEQ ID NO: 37852 - DNA, 25 bp, E. coli
aaagtgattgcccattgtggctgcg

SEQ ID NO: 37853 - DNA, 25 bp, E. coli
ttgacgatatcggtcagaaggttcg

SEQ ID NO: 37854 - DNA, 25 bp, E. coli
ttgacgatatcgctcagaaggttcg

SEQ ID NO: 37855 - DNA, 25 bp, E. coli
tcgactaaggatattcagcaaacca

SEQ ID NO: 37856 - DNA, 25 bp, E. coli
tcgactaaggattttcagcaaacca

SEQ ID NO: 37857 - DNA, 25 bp, E. coli
gcgcaaaatattacacgggtcaaag

SEQ ID NO: 37858 - DNA, 25 bp, E. coli
gcggttccggcaatcaatattcaca

SEQ ID NO: 37859 - DNA, 25 bp, E. coli
gcgcaaaatatttcacgggtcaaag

SEQ ID NO: 37860 - DNA, 25 bp, E. coli
gcggttccggcattcaatattcaca

SEQ ID NO: 37861 - DNA, 25 bp, E. coli
gatgatgtgcaagtcaatgaagccg

SEQ ID NO: 37862 - DNA, 25 bp, E. coli
gatgatgtgcaactcaatgaagccg

SEQ ID NO: 37863 - DNA, 25 bp, E. coli
aatttgcgccatcagcggtgagatg

SEQ ID NO: 37864 - DNA, 25 bp, E. coli
aatttgcgccatgagcggtgagatg

SEQ ID NO: 37865 - DNA, 25 bp, E. coli
cacaaaaatgcgtggcgtcttcagg

SEQ ID NO: 37866 - DNA, 25 bp, E. coli
cacaaaaatgcgaggcgtcttcagg

SEQ ID NO: 37867 - DNA, 25 bp, E. coli
cagtcggcgatgcttgttaggccaa

SEQ ID NO: 37868 - DNA, 25 bp, E. coli
cagtcggcgatggttgttaggccaa

SEQ ID NO: 37869 - DNA, 25 bp, E. coli
catagcttaaggtgaggattcctga

SEQ ID NO: 37870 - DNA, 25 bp, E. coli
catagcttaaggagaggattcctga

SEQ ID NO: 37871 - DNA, 25 bp, E. coli
tacgagctattgtagaatttgcgcc

SEQ ID NO: 37872 - DNA, 25 bp, E. coli
tacgagctattgaagaatttgcgcc

SEQ ID NO: 37873 - DNA, 25 bp, E. coli
taaagagagcgaaataatagcggcg

SEQ ID NO: 37874 - DNA, 25 bp, E. coli
taaagagagcgatataatagcggcg

SEQ ID NO: 37875 - DNA, 25 bp, E. coli
tattttaccccgcacgaatcatcgt

SEQ ID NO: 37876 - DNA, 25 bp, E. coli
tattttaccccggacgaatcatcgt

SEQ ID NO: 37877 - DNA, 25 bp, E. coli
tttttgacggctctaagcgctcacg

SEQ ID NO: 37878 - DNA, 25 bp, E. coli
tttttgacggctgtaagcgctcacg

SEQ ID NO: 37879 - DNA, 25 bp, E. coli
tctcaggcattacctgaacggcaga

SEQ ID NO: 37880 - DNA, 25 bp, E. coli
tctcaggcattagctgaacggcaga

SEQ ID NO: 37881 - DNA, 25 bp, E. coli
gctcacgagtgagcctaagcctaga

SEQ ID NO: 37882 - DNA, 25 bp, E. coli
gctcacgagtgaccctaagcctaga

SEQ ID NO: 37883 - DNA, 25 bp, E. coli
taattaatttgttgtcagtcggcga

SEQ ID NO: 37884 - DNA, 25 bp, E. coli
taattaatttgtagtcagtcggcga

SEQ ID NO: 37885 - DNA, 25 bp, E. coli
ataccgtctggctactgacccgtca

SEQ ID NO: 37886 - DNA, 25 bp, E. coli
atggctaacgatagctggagcgggc

SEQ ID NO: 37887 - DNA, 25 bp, E. coli
agccgggatcgcagtgccatgtttg

SEQ ID NO: 37888 - DNA, 25 bp, E. coli
ataccgtctggcaactgacccgtca

SEQ ID NO: 37889 - DNA, 25 bp, E. coli
atggctaacgattgctggagcgggc

SEQ ID NO: 37890 - DNA, 25 bp, E. coli
agccgggatcgctgtgccatgtttg

SEQ ID NO: 37891 - DNA, 25 bp, E. coli
tgcaagcaccggctataccgtctgg

SEQ ID NO: 37892 - DNA, 25 bp, E. coli
tgcaagcaccgggtataccgtctgg

SEQ ID NO: 37893 - DNA, 25 bp, E. coli
tccgccgccggatatgaatattcac

SEQ ID NO: 37894 - DNA, 25 bp, E. coli
tccgccgccggaaatgaatattcac

SEQ ID NO: 37895 - DNA, 25 bp, E. coli
tcggcgatgctttccgccgccggaa

SEQ ID NO: 37896 - DNA, 25 bp, E. coli
tcggcgatgcttaccgccgccggaa

SEQ ID NO: 37897 - DNA, 25 bp, E. coli
gctcaacactttttcgcctcggcga

SEQ ID NO: 37898 - DNA, 25 bp, E. coli
gcgggcaggataaagctcaacactt

SEQ ID NO: 37899 - DNA, 25 bp, E. coli
gctcaacactttatcgcctcggcga

SEQ ID NO: 37900 - DNA, 25 bp, E. coli
gcgggcaggatatagctcaacactt

SEQ ID NO: 37901 - DNA, 25 bp, E. coli
gaaatgaatattgacagcatcaggg

SEQ ID NO: 37902 - DNA, 25 bp, E. coli
gaaatgaatattcacagcatcaggg

SEQ ID NO: 37903 - DNA, 25 bp, E. coli
ccggctataccgactggcaactgac

SEQ ID NO: 37904 - DNA, 25 bp, E. coli
ccggctataccgtctggcaactgac

SEQ ID NO: 37905 - DNA, 25 bp, E. coli
tggagcgggcaggataaagctcaac

SEQ ID NO: 37906 - DNA, 25 bp, E. coli
tggagcgggcagcataaagctcaac

SEQ ID NO: 37907 - DNA, 25 bp, E. coli
tttgtgcaggacagcgtgattgcgc

SEQ ID NO: 37908 - DNA, 25 bp, E. coli
tttgtgcaggactgcgtgattgcgc

SEQ ID NO: 37909 - DNA, 25 bp, E. coli
ttatggtgcgcaacgcctgggcgca

SEQ ID NO: 37910 - DNA, 25 bp, E. coli
ttatggtgcgcatcgcctgggcgca

SEQ ID NO: 37911 - DNA, 25 bp, E. coli
ttccggcggcgctttatggtgcgca

SEQ ID NO: 37912 - DNA, 25 bp, E. coli
ttccggcggcgcattatggtgcgca

SEQ ID NO: 37913 - DNA, 25 bp, E. coli
tggtgacatccggagaagcatttgc

SEQ ID NO: 37914 - DNA, 25 bp, E. coli
tggtgacatccgcagaagcatttgc

SEQ ID NO: 37915 - DNA, 25 bp, E. coli
tgcggctattcccgcggcgcattat

SEQ ID NO: 37916 - DNA, 25 bp, E. coli
tgcggctattccggcggcgcattat

SEQ ID NO: 37917 - DNA, 25 bp, E. coli
gcgcattatggtccgcatcgcctgg

SEQ ID NO: 37918 - DNA, 25 bp, E. coli
gcgcattatggtgcgcatcgcctgg

SEQ ID NO: 37919 - DNA, 25 bp, E. coli
gaatgctggtgagatccgcagaagc

SEQ ID NO: 37920 - DNA, 25 bp, E. coli
gcaggacagcgtgattgcgcatcca

SEQ ID NO: 37921 - DNA, 25 bp, E. coli
gaatgctggtgacatccgcagaagc

SEQ ID NO: 37922 - DNA, 25 bp, E. coli
gcaggacagcgtcattgcgcatcca

SEQ ID NO: 37923 - DNA, 25 bp, E. coli
gacagcgtgattgcgcatccagagt

SEQ ID NO: 37924 - DNA, 25 bp, E. coli
gacagcgtgattccgcatccagagt

SEQ ID NO: 37925 - DNA, 25 bp, E. coli
cgggaatgctggtgacatccgcaga

SEQ ID NO: 37926 - DNA, 25 bp, E. coli
cgggaatgctggagacatccgcaga

SEQ ID NO: 37927 - DNA, 25 bp, E. coli
ggccgcgaggacgtcaggtgctcga

SEQ ID NO: 37928 - DNA, 25 bp, E. coli
ggccgcgaggacctcaggtgctcga

SEQ ID NO: 37929 - DNA, 25 bp, E. coli
aaatagggctatatgccgcgtcttt

SEQ ID NO: 37930 - DNA, 25 bp, E. coli
aaaagatatttattggcggcacaaa

SEQ ID NO: 37931 - DNA, 25 bp, E. coli
aaatagggctatttgccgcgtcttt

SEQ ID NO: 37932 - DNA, 25 bp, E. coli
aaaagatatttaatggcggcacaaa

SEQ ID NO: 37933 - DNA, 25 bp, E. coli
tattggcggcacaaaataaagaaca

SEQ ID NO: 37934 - DNA, 25 bp, E. coli
tatatgccgcgtgttttctggctaa

SEQ ID NO: 37935 - DNA, 25 bp, E. coli
tatatgccgcgtcttttctggctaa

SEQ ID NO: 37936 - DNA, 25 bp, E. coli
tattggcggcactaaataaagaaca

SEQ ID NO: 37937 - DNA, 25 bp, E. coli
tgaatcaggaagttttaacctcacg

SEQ ID NO: 37938 - DNA, 25 bp, E. coli
tgaatcaggaagatttaacctcacg

SEQ ID NO: 37939 - DNA, 25 bp, E. coli
tctggctaatttaatgaaaagatat

SEQ ID NO: 37940 - DNA, 25 bp, E. coli
tctggctaattttatgaaaagatat

SEQ ID NO: 37941 - DNA, 25 bp, E. coli
gaagttttaaccacacgtgctgcga

SEQ ID NO: 37942 - DNA, 25 bp, E. coli
gaagttttaacctcacgtgctgcga

SEQ ID NO: 37943 - DNA, 25 bp, E. coli
ctcacgtgctgccaaatcatcggtg

SEQ ID NO: 37944 - DNA, 25 bp, E. coli
cgcgtcttttctggctaattttatg

SEQ ID NO: 37945 - DNA, 25 bp, E. coli
ctcacgtgctgcgaaatcatcggtg

SEQ ID NO: 37946 - DNA, 25 bp, E. coli
cgcgtcttttctcgctaattttatg

SEQ ID NO: 37947 - DNA, 25 bp, E. coli
tggcggcacaaattaaagaacaatt

SEQ ID NO: 37948 - DNA, 25 bp, E. coli
tggcggcacaaaataaagaacaatt

SEQ ID NO: 37949 - DNA, 25 bp, E. coli
taacctcacgtggtgcgaaatcatc

SEQ ID NO: 37950 - DNA, 25 bp, E. coli
taacctcacgtgctgcgaaatcatc

SEQ ID NO: 37951 - DNA, 25 bp, E. coli
caaaaacggaacgtatgatataggt

SEQ ID NO: 37952 - DNA, 25 bp, E. coli
caaattactgttttgcttccgattg

SEQ ID NO: 37953 - DNA, 25 bp, E. coli
caaattactgttatgcttccgattg

SEQ ID NO: 37954 - DNA, 25 bp, E. coli
caaaaacggaacctatgatataggt

SEQ ID NO: 37955 - DNA, 25 bp, E. coli
cagttggtgcgtataatgcaggtta

SEQ ID NO: 37956 - DNA, 25 bp, E. coli
cagttggtgcgtttaatgcaggtta

SEQ ID NO: 37957 - DNA, 25 bp, E. coli
taaaagcaattgcatggaatgaatc

SEQ ID NO: 37958 - DNA, 25 bp, E. coli
taaaagcaattggatggaatgaatc

SEQ ID NO: 37959 - DNA, 25 bp, E. coli
tccagagggaattcatgggatgcag

SEQ ID NO: 37960 - DNA, 25 bp, E. coli
tccagagggaatacatgggatgcag

SEQ ID NO: 37961 - DNA, 25 bp, E. coli
tcttagcctctatcataaaatccag

SEQ ID NO: 37962 - DNA, 25 bp, E. coli
tcttagcctctaacataaaatccag

SEQ ID NO: 37963 - DNA, 25 bp, E. coli
ccaaatgcagtacaactcagaaggc

SEQ ID NO: 37964 - DNA, 25 bp, E. coli
ccaaatgcagtagaactcagaaggc

SEQ ID NO: 37965 - DNA, 25 bp, E. coli
gaatcaaaatgcaaaagcggaataa

SEQ ID NO: 37966 - DNA, 25 bp, E. coli
gaatcaaaatgctaaagcggaataa

SEQ ID NO: 37967 - DNA, 25 bp, E. coli
gaactcagaaggcaatacgcaatga

SEQ ID NO: 37968 - DNA, 25 bp, E. coli
gaactcagaagggaatacgcaatga

SEQ ID NO: 37969 - DNA, 25 bp, E. coli
gatgcctgtatatacatatctgttg

SEQ ID NO: 37970 - DNA, 25 bp, E. coli
ggttactttaattcaccaaatgcag

SEQ ID NO: 37971 - DNA, 25 bp, E. coli
ggttactttaatacaccaaatgcag

SEQ ID NO: 37972 - DNA, 25 bp, E. coli
gatgcctgtataaacatatctgttg

SEQ ID NO: 37973 - DNA, 25 bp, E. coli
gaaacgtaccctccgtaaacggatg

SEQ ID NO: 37974 - DNA, 25 bp, E. coli
gaaacgtaccctgcgtaaacggatg

SEQ ID NO: 37975 - DNA, 25 bp, E. coli
cagggccgagtcactattgaatacg

SEQ ID NO: 37976 - DNA, 25 bp, E. coli
cagggccgagtctctattgaatacg

SEQ ID NO: 37977 - DNA, 25 bp, E. coli
taaacggatgcacggtgaagccatc

SEQ ID NO: 37978 - DNA, 25 bp, E. coli
taaacggatgcagggtgaagccatc

SEQ ID NO: 37979 - DNA, 25 bp, E. coli
tgatgcttgacctcgttaacgacgg

SEQ ID NO: 37980 - DNA, 25 bp, E. coli
tgatgcttgaccacgttaacgacgg

SEQ ID NO: 37981 - DNA, 25 bp, E. coli
tcgaaacgttccttgctgcggtgcg

SEQ ID NO: 37982 - DNA, 25 bp, E. coli
tcgaaacgttccatgctgcggtgcg

SEQ ID NO: 37983 - DNA, 25 bp, E. coli
tcggcgcagcaatagtcaccggtca

SEQ ID NO: 37984 - DNA, 25 bp, E. coli
tcggcgcagcaaaagtcaccggtca

SEQ ID NO: 37985 - DNA, 25 bp, E. coli
ccttccgcgccgttcaggtgatgaa

SEQ ID NO: 37986 - DNA, 25 bp, E. coli
ccttccgcgccgatcaggtgatgaa

SEQ ID NO: 37987 - DNA, 25 bp, E. coli
gaaatccaacgccaatcagggccga

SEQ ID NO: 37988 - DNA, 25 bp, E. coli
gaaatccaacgcgaatcagggccga

SEQ ID NO: 37989 - DNA, 25 bp, E. coli
gaacagcgttcaactgacggcacca

SEQ ID NO: 37990 - DNA, 25 bp, E. coli
gaacagcgttcatctgacggcacca

SEQ ID NO: 37991 - DNA, 25 bp, E. coli
gatacgccgtgtaagatcaacctga

SEQ ID NO: 37992 - DNA, 25 bp, E. coli
gatacgccgtgttagatcaacctga

SEQ ID NO: 37993 - DNA, 25 bp, E. coli
gatgaccgacatcaacaaagtgttg

SEQ ID NO: 37994 - DNA, 25 bp, E. coli
gatgaccgacatgaacaaagtgttg

SEQ ID NO: 37995 - DNA, 25 bp, E. coli
caccggctggctgccgaatgaacat

SEQ ID NO: 37996 - DNA, 25 bp, E. coli
caccggctggctcccgaatgaacat

SEQ ID NO: 37997 - DNA, 25 bp, E. coli
catcttcttcatggtggcctccaat

SEQ ID NO: 37998 - DNA, 25 bp, E. coli
catcttcttcatcgtggcctccaat

SEQ ID NO: 37999 - DNA, 25 bp, E. coli
attcccaccggcaggctgccgaatg

SEQ ID NO: 38000 - DNA, 25 bp, E. coli
attcccaccggctggctgccgaatg

SEQ ID NO: 38001 - DNA, 25 bp, E. coli
tataacggcattttttattcccacc

SEQ ID NO: 38002 - DNA, 25 bp, E. coli
tataacggcattatttattcccacc

SEQ ID NO: 38003 - DNA, 25 bp, E. coli
tattgcctggggttttataacggca

SEQ ID NO: 38004 - DNA, 25 bp, E. coli
tattgcctggggatttataacggca

SEQ ID NO: 38005 - DNA, 25 bp, E. coli
ttcatggtggcctccaatccaggtc

SEQ ID NO: 38006 - DNA, 25 bp, E. coli
ttcatggtggccaccaatccaggtc

SEQ ID NO: 38007 - DNA, 25 bp, E. coli
gctggctgccgattgaacatttcgc

SEQ ID NO: 38008 - DNA, 25 bp, E. coli
gctggctgccgaatgaacatttcgc

SEQ ID NO: 38009 - DNA, 25 bp, E. coli
cgacaagtcgctcgaaaaacgcata

SEQ ID NO: 38010 - DNA, 25 bp, E. coli
cgacaagtcgctggaaaaacgcata

SEQ ID NO: 38011 - DNA, 25 bp, E. coli
cggtggtctggtcattaaatatatc

SEQ ID NO: 38012 - DNA, 25 bp, E. coli
cggtggtctggtgattaaatatatc

SEQ ID NO: 38013 - DNA, 25 bp, E. coli
gattaaatatatcgacaagtcgctg

SEQ ID NO: 38014 - DNA, 25 bp, E. coli
gattaaatatatggacaagtcgctg

SEQ ID NO: 38015 - DNA, 25 bp, E. coli
gtggcctccaatccaggtcctggtc

SEQ ID NO: 38016 - DNA, 25 bp, E. coli
gtggcctccaatgcaggtcctggtc

SEQ ID NO: 38017 - DNA, 25 bp, E. coli
caacctacgttagcgccagcgtgga

SEQ ID NO: 38018 - DNA, 25 bp, E. coli
caacctacgttaccgccagcgtgga

SEQ ID NO: 38019 - DNA, 25 bp, E. coli
gaatttggtacctcgttgacgaacg

SEQ ID NO: 38020 - DNA, 25 bp, E. coli
gaatttggtaccacgttgacgaacg

SEQ ID NO: 38021 - DNA, 25 bp, E. coli
ttgacgaacgatcatgctacccgcc

SEQ ID NO: 38022 - DNA, 25 bp, E. coli
ttgacgaacgatgatgctacccgcc

SEQ ID NO: 38023 - DNA, 25 bp, E. coli
tggtcacgaccggaacctacgttag

SEQ ID NO: 38024 - DNA, 25 bp, E. coli
gccagcgtggaaattggtaccacgt

SEQ ID NO: 38025 - DNA, 25 bp, E. coli
gccagcgtggaatttggtaccacgt

SEQ ID NO: 38026 - DNA, 25 bp, E. coli
gaacggattcgccaccgaaacgctt

SEQ ID NO: 38027 - DNA, 25 bp, E. coli
gaacggattcgcgaccgaaacgctt

SEQ ID NO: 38028 - DNA, 25 bp, E. coli
cgttgacgaacgatgatgctacccg

SEQ ID NO: 38029 - DNA, 25 bp, E. coli
cgttgacgaacgttgatgctacccg

SEQ ID NO: 38030 - DNA, 25 bp, E. coli
gattcgccaccgtaacgcttaacgc

SEQ ID NO: 38031 - DNA, 25 bp, E. coli
gattcgccaccgaaacgcttaacgc

SEQ ID NO: 38032 - DNA, 25 bp, E. coli
tggtcacgaccgcaacctacgttag

SEQ ID NO: 38033 - DNA, 25 bp, E. coli
tggtaccacgttgacgaacgatgat

SEQ ID NO: 38034 - DNA, 25 bp, E. coli
tggtaccacgttcacgaacgatgat

SEQ ID NO: 38035 - DNA, 25 bp, E. coli
taacgcccaggcctttagcttctga

SEQ ID NO: 38036 - DNA, 25 bp, E. coli
taacgcccaggcgtttagcttctga

SEQ ID NO: 38037 - DNA, 25 bp, E. coli
gatgctacccgcgagaacggattcg

SEQ ID NO: 38038 - DNA, 25 bp, E. coli
gatgctacccgccagaacggattcg

SEQ ID NO: 38039 - DNA, 25 bp, E. coli
atggggtgggttgaagcggctgact

SEQ ID NO: 38040 - DNA, 25 bp, E. coli
atggggtgggttcaagcggctgact

SEQ ID NO: 38041 - DNA, 25 bp, E. coli
tgggttgaagcgcctgacttaattg

SEQ ID NO: 38042 - DNA, 25 bp, E. coli
gcaatcaacgcgtagaccgtaacct

SEQ ID NO: 38043 - DNA, 25 bp, E. coli
gcaatcaacgcgaagaccgtaacct

SEQ ID NO: 38044 - DNA, 25 bp, E. coli
cgcgaagaccgttacctatgacttc

SEQ ID NO: 38045 - DNA, 25 bp, E. coli
cgcgaagaccgtaacctatgacttc

SEQ ID NO: 38046 - DNA, 25 bp, E. coli
ggttgaagcggcagacttaattgtt

SEQ ID NO: 38047 - DNA, 25 bp, E. coli
ggttgaagcggctgacttaattgtt

SEQ ID NO: 38048 - DNA, 25 bp, E. coli
ggggtgggttgaagcggctgactta

SEQ ID NO: 38049 - DNA, 25 bp, E. coli
gggtgggttgaaccggctgacttaa

SEQ ID NO: 38050 - DNA, 25 bp, E. coli
gggttgaagcgggtgacttaattgt

SEQ ID NO: 38051 - DNA, 25 bp, E. coli
gtgggttgaagcggctgacttaatt

SEQ ID NO: 38052 - DNA, 25 bp, E. coli
gtgggttgaagccgctgacttaatt

SEQ ID NO: 38053 - DNA, 25 bp, E. coli
gggttgaagcggctgacttaattgt

SEQ ID NO: 38054 - DNA, 25 bp, E. coli
ggggtgggttgatgcggctgactta

SEQ ID NO: 38055 - DNA, 25 bp, E. coli
gggtgggttgaagcggctgacttaa

SEQ ID NO: 38056 - DNA, 25 bp, E. coli
tgggttgaagcggctgacttaattg

SEQ ID NO: 38057 - DNA, 25 bp, E. coli
tggggtgggttgtagcggctgactt

SEQ ID NO: 38058 - DNA, 25 bp, E. coli
tggggtgggttgaagcggctgactt

SEQ ID NO: 38059 - DNA, 25 bp, E. coli
gttgaagcggctcacttaattgtta

SEQ ID NO: 38060 - DNA, 25 bp, E. coli
gttgaagcggctgacttaattgtta

SEQ ID NO: 38061 - DNA, 25 bp, E. coli
tacacaggctgaggaagaggctacc

SEQ ID NO: 38062 - DNA, 25 bp, E. coli
taaacagcttctggctctgcagcag

SEQ ID NO: 38063 - DNA, 25 bp, E. coli
tacacaggctgacgaagaggctacc

SEQ ID NO: 38064 - DNA, 25 bp, E. coli
taaacagcttctcgctctgcagcag

SEQ ID NO: 38065 - DNA, 25 bp, E. coli
tattcagcaacagatccgacaggcc

SEQ ID NO: 38066 - DNA, 25 bp, E. coli
tattcagcaacacatccgacaggcc

SEQ ID NO: 38067 - DNA, 25 bp, E. coli
ttatgacctcggcaaaaaagcggca

SEQ ID NO: 38068 - DNA, 25 bp, E. coli
ttatgacctcgggaaaaaagcggca

SEQ ID NO: 38069 - DNA, 25 bp, E. coli
ttctgataggtgaactggcccgcgg

SEQ ID NO: 38070 - DNA, 25 bp, E. coli
ttctgataggtgtactggcccgcgg

SEQ ID NO: 38071 - DNA, 25 bp, E. coli
tgaacgttacgagaaagccctggca

SEQ ID NO: 38072 - DNA, 25 bp, E. coli
tgaacgttacgacaaagccctggca

SEQ ID NO: 38073 - DNA, 25 bp, E. coli
gaataacgctgggtaaccgtgccgg

SEQ ID NO: 38074 - DNA, 25 bp, E. coli
gaataacgctggctaaccgtgccgg

SEQ ID NO: 38075 - DNA, 25 bp, E. coli
gaaaatgctgcactgaaccggatga

SEQ ID NO: 38076 - DNA, 25 bp, E. coli
gaaaatgctgcagtgaaccggatga

SEQ ID NO: 38077 - DNA, 25 bp, E. coli
tcaactggctgaagaagagcgcgct

SEQ ID NO: 38078 - DNA, 25 bp, E. coli
taatgccatgcactacgccgatcag

SEQ ID NO: 38079 - DNA, 25 bp, E. coli
tcaactggctgatgaagagcgcgct

SEQ ID NO: 38080 - DNA, 25 bp, E. coli
taatgccatgcagtacgccgatcag

SEQ ID NO: 38081 - DNA, 25 bp, E. coli
gatgaaaagagtgtgctggcccgta

SEQ ID NO: 38082 - DNA, 25 bp, E. coli
gatgaaaagagtctgctggcccgta

SEQ ID NO: 38083 - DNA, 25 bp, E. coli
caatttgttaatcagtacacctcta

SEQ ID NO: 38084 - DNA, 25 bp, E. coli
caatttgttaatgagtacacctcta

SEQ ID NO: 38085 - DNA, 25 bp, E. coli
tatcaatttgttaatcagtacacct

SEQ ID NO: 38086 - DNA, 25 bp, E. coli
tatcaatttgtttatcagtacacct

SEQ ID NO: 38087 - DNA, 25 bp, E. coli
ttgctcttttttggccacgaaatgc

SEQ ID NO: 38088 - DNA, 25 bp, E. coli
ttgctcttttttcgccacgaaatgc

SEQ ID NO: 38089 - DNA, 25 bp, E. coli
tgtgcataaaataggcattgctctt

SEQ ID NO: 38090 - DNA, 25 bp, E. coli
tgtgcataaaattggcattgctctt

SEQ ID NO: 38091 - DNA, 25 bp, E. coli
tctacggtctatgcttttattttct

SEQ ID NO: 38092 - DNA, 25 bp, E. coli
tctacggtctatccttttattttct

SEQ ID NO: 38093 - DNA, 25 bp, E. coli
tcttatatcagacaagattttaatt

SEQ ID NO: 38094 - DNA, 25 bp, E. coli
tcttatatcagagaagattttaatt

SEQ ID NO: 38095 - DNA, 25 bp, E. coli
gcttttattttcatatatcagagaa

SEQ ID NO: 38096 - DNA, 25 bp, E. coli
gcttttattttcttatatcagagaa

SEQ ID NO: 38097 - DNA, 25 bp, E. coli
gcattgctctttattcgccacgaaa

SEQ ID NO: 38098 - DNA, 25 bp, E. coli
gcattgctcttttttcgccacgaaa

SEQ ID NO: 38099 - DNA, 25 bp, E. coli
gaaatgccccccattctacggtcta

SEQ ID NO: 38100 - DNA, 25 bp, E. coli
gaaatgcccccctttctacggtcta

SEQ ID NO: 38101 - DNA, 25 bp, E. coli
ccccattctacgctctatgctttta

SEQ ID NO: 38102 - DNA, 25 bp, E. coli
ccccattctacggtctatgctttta

SEQ ID NO: 38103 - DNA, 25 bp, E. coli
ggcattgctcttatttcgccacgaa

SEQ ID NO: 38104 - DNA, 25 bp, E. coli
ggcattgctcttttttcgccacgaa

SEQ ID NO: 38105 - DNA, 25 bp, E. coli
agatactgctgtcccgactgctgga

SEQ ID NO: 38106 - DNA, 25 bp, E. coli
agatactgctgtgccgactgctgga

SEQ ID NO: 38107 - DNA, 25 bp, E. coli
agttctcgcccgtctcctgttgaaa

SEQ ID NO: 38108 - DNA, 25 bp, E. coli
attacccgggcaggcggccagttct

SEQ ID NO: 38109 - DNA, 25 bp, E. coli
attacccgggcacgcggccagttct

SEQ ID NO: 38110 - DNA, 25 bp, E. coli
agttctcgcccgactcctgttgaaa

SEQ ID NO: 38111 - DNA, 25 bp, E. coli
aacattacctgttttacccgggcag

SEQ ID NO: 38112 - DNA, 25 bp, E. coli
aacattacctgtattacccgggcag

SEQ ID NO: 38113 - DNA, 25 bp, E. coli
ttacctgtattacccgggcaggcgg

SEQ ID NO: 38114 - DNA, 25 bp, E. coli
ttacctgtattagccgggcaggcgg

SEQ ID NO: 38115 - DNA, 25 bp, E. coli
tgaaaacattacctgtattacccgg

SEQ ID NO: 38116 - DNA, 25 bp, E. coli
tgaaaacattacgtgtattacccgg

SEQ ID NO: 38117 - DNA, 25 bp, E. coli
tcgcccgtctccagttgaaatctgg

SEQ ID NO: 38118 - DNA, 25 bp, E. coli
tcgcccgtctcctgttgaaatctgg

SEQ ID NO: 38119 - DNA, 25 bp, E. coli
tctcctgttgaattctggcagatac

SEQ ID NO: 38120 - DNA, 25 bp, E. coli
tctggcagatactgctgtcccgact

SEQ ID NO: 38121 - DNA, 25 bp, E. coli
tctggcagatacagctgtcccgact

SEQ ID NO: 38122 - DNA, 25 bp, E. coli
tctcctgttgaaatctggcagatac

SEQ ID NO: 38123 - DNA, 25 bp, E. coli
ccgtctcctgttcaaatctggcaga

SEQ ID NO: 38124 - DNA, 25 bp, E. coli
gaaatctggcagttactgctgtccc

SEQ ID NO: 38125 - DNA, 25 bp, E. coli
gaaatctggcagatactgctgtccc

SEQ ID NO: 38126 - DNA, 25 bp, E. coli
ccgtctcctgttgaaatctggcaga

SEQ ID NO: 38127 - DNA, 25 bp, E. coli
cactgaaaaactcaaaagcctcggc

SEQ ID NO: 38128 - DNA, 25 bp, E. coli
cactgaaaaactgaaaagcctcggc

SEQ ID NO: 38129 - DNA, 25 bp, E. coli
catgcaaatgatgaaaggcggcggc

SEQ ID NO: 38130 - DNA, 25 bp, E. coli
catgcaaatgatcaaaggcggcggc

SEQ ID NO: 38131 - DNA, 25 bp, E. coli
catggaaatcctagacccgatagcg

SEQ ID NO: 38132 - DNA, 25 bp, E. coli
catggaaatccttgacccgatagcg

SEQ ID NO: 38133 - DNA, 25 bp, E. coli
agttatcccgatggcacgtagtgca

SEQ ID NO: 38134 - DNA, 25 bp, E. coli
agttatcccgatcgcacgtagtgca

SEQ ID NO: 38135 - DNA, 25 bp, E. coli
aaaaaagcagtaggatgggcggcac

SEQ ID NO: 38136 - DNA, 25 bp, E. coli
aaaaaagcagtacgatgggcggcac

SEQ ID NO: 38137 - DNA, 25 bp, E. coli
tgtttgctaaccctggcgcggacgt

SEQ ID NO: 38138 - DNA, 25 bp, E. coli
tgtttgctaaccgtggcgcggacgt

SEQ ID NO: 38139 - DNA, 25 bp, E. coli
tgcgctgattggcacacctgacggt

SEQ ID NO: 38140 - DNA, 25 bp, E. coli
tgcgctgattgggacacctgacggt

SEQ ID NO: 38141 - DNA, 25 bp, E. coli
tcccgctgccagaagaagttatccc

SEQ ID NO: 38142 - DNA, 25 bp, E. coli
tcccgctgccagtagaagttatccc

SEQ ID NO: 38143 - DNA, 25 bp, E. coli
gcacttcagtatcttcagcccggca

SEQ ID NO: 38144 - DNA, 25 bp, E. coli
gcacttcagtatgttcagcccggca

SEQ ID NO: 38145 - DNA, 25 bp, E. coli
ggcgctgacccgtgaaaaaatcatt

SEQ ID NO: 38146 - DNA, 25 bp, E. coli
ggcgctgacccgagaaaaaatcatt

SEQ ID NO: 38147 - DNA, 25 bp, E. coli
gatctcaacgaactcgacagccttg

SEQ ID NO: 38148 - DNA, 25 bp, E. coli
gatctcaacgaagtcgacagccttg

SEQ ID NO: 38149 - DNA, 25 bp, E. coli
aatcgactgggcgatgagctacgcg

SEQ ID NO: 38150 - DNA, 25 bp, E. coli
aatcgactgggccatgagctacgcg

SEQ ID NO: 38151 - DNA, 25 bp, E. coli
tactcccaggagttgcgcaaatcga

SEQ ID NO: 38152 - DNA, 25 bp, E. coli
tactcccaggagatgcgcaaatcga

SEQ ID NO: 38153 - DNA, 25 bp, E. coli
aaaattccagtctccgttgctgccg

SEQ ID NO: 38154 - DNA, 25 bp, E. coli
aaaattccagtcaccgttgctgccg

SEQ ID NO: 38155 - DNA, 25 bp, E. coli
ttgccgtgcaaccattactcccagg

SEQ ID NO: 38156 - DNA, 25 bp, E. coli
ttgccgtgcaacgattactcccagg

SEQ ID NO: 38157 - DNA, 25 bp, E. coli
tgaagccccatgtaatcgagcgcca

SEQ ID NO: 38158 - DNA, 25 bp, E. coli
tgaagccccatgaaatcgagcgcca

SEQ ID NO: 38159 - DNA, 25 bp, E. coli
gcgccatcaggcacaaacgaatcac

SEQ ID NO: 38160 - DNA, 25 bp, E. coli
gcgccatcaggctcaaacgaatcac

SEQ ID NO: 38161 - DNA, 25 bp, E. coli
gaaattgttctgcatctcagggcgg

SEQ ID NO: 38162 - DNA, 25 bp, E. coli
gaaattgttctggatctcagggcgg

SEQ ID NO: 38163 - DNA, 25 bp, E. coli
cgctcgcgcttaactggcaggaaga

SEQ ID NO: 38164 - DNA, 25 bp, E. coli
cgctcgcgcttatctggcaggaaga

SEQ ID NO: 38165 - DNA, 25 bp, E. coli
cggatctgttctcgtttcgcggtca

SEQ ID NO: 38166 - DNA, 25 bp, E. coli
cggatctgttctggtttcgcggtca

SEQ ID NO: 38167 - DNA, 25 bp, E. coli
gttgctgccggaaaaccgcgtcacg

SEQ ID NO: 38168 - DNA, 25 bp, E. coli
gttgctgccggataaccgcgtcacg

SEQ ID NO: 38169 - DNA, 25 bp, E. coli
gagctacgcgctcaatctgctcgcg

SEQ ID NO: 38170 - DNA, 25 bp, E. coli
gagctacgcgctgaatctgctcgcg

SEQ ID NO: 38171 - DNA, 25 bp, E. coli
cactgaatcaggcaacgaaccgggt

SEQ ID NO: 38172 - DNA, 25 bp, E. coli
cactgaatcagggaacgaaccgggt

SEQ ID NO: 38173 - DNA, 25 bp, E. coli
cagatccgccgtcaagtgatgctgg

SEQ ID NO: 38174 - DNA, 25 bp, E. coli
cagatccgccgtgaagtgatgctgg

SEQ ID NO: 38175 - DNA, 25 bp, E. coli
tatgctggataagcggcacgatgcc

SEQ ID NO: 38176 - DNA, 25 bp, E. coli
tatgctggataaccggcacgatgcc

SEQ ID NO: 38177 - DNA, 25 bp, E. coli
tttcagacgcagtacaacaggagac

SEQ ID NO: 38178 - DNA, 25 bp, E. coli
tttcagacgcagaacaacaggagac

SEQ ID NO: 38179 - DNA, 25 bp, E. coli
tgatgtcgtgcacattaaccagcga

SEQ ID NO: 38180 - DNA, 25 bp, E. coli
tgatgtcgtgcagattaaccagcga

SEQ ID NO: 38181 - DNA, 25 bp, E. coli
tccggagacagacatgcagcagatc

SEQ ID NO: 38182 - DNA, 25 bp, E. coli
tccggagacagagatgcagcagatc

SEQ ID NO: 38183 - DNA, 25 bp, E. coli
gaaacggcatccctgcttgtggcga

SEQ ID NO: 38184 - DNA, 25 bp, E. coli
gaaacggcatccgtgcttgtggcga

SEQ ID NO: 38185 - DNA, 25 bp, E. coli
cgaaccgggtgctttatctttcagg

SEQ ID NO: 38186 - DNA, 25 bp, E. coli
cgaaccgggtgcattatctttcagg

SEQ ID NO: 38187 - DNA, 25 bp, E. coli
tggcattcccataccctcaaaggca

SEQ ID NO: 38188 - DNA, 25 bp, E. coli
tggcattcccattccctcaaaggca

SEQ ID NO: 38189 - DNA, 25 bp, E. coli
taaccagcgatatctggaaacggca

SEQ ID NO: 38190 - DNA, 25 bp, E. coli
tcaaaaaagcattcgaaggcgagct

SEQ ID NO: 38191 - DNA, 25 bp, E. coli
taaccagcgataactggaaacggca

SEQ ID NO: 38192 - DNA, 25 bp, E. coli
tcaaaaaagcatacgaaggcgagct

SEQ ID NO: 38193 - DNA, 25 bp, E. coli
cacttatatgcctgtgaccgtaccg

SEQ ID NO: 38194 - DNA, 25 bp, E. coli
cacttatatgccagtgaccgtaccg

SEQ ID NO: 38195 - DNA, 25 bp, E. coli
tatcgatcaccgtggtaagtatctg

SEQ ID NO: 38196 - DNA, 25 bp, E. coli
tatcgatcaccgaggtaagtatctg

SEQ ID NO: 38197 - DNA, 25 bp, E. coli
tggtcgtcacttatatgcctgtgac

SEQ ID NO: 38198 - DNA, 25 bp, E. coli
tggtcgtcacttttatgcctgtgac

SEQ ID NO: 38199 - DNA, 25 bp, E. coli
gccgcgcggctttaatatcgatcac

SEQ ID NO: 38200 - DNA, 25 bp, E. coli
gccgcgcggcttaaatatcgatcac

SEQ ID NO: 38201 - DNA, 25 bp, E. coli
ccagccgcgcggctttaatatcgat

SEQ ID NO: 38202 - DNA, 25 bp, E. coli
ccagccgcgcgggtttaatatcgat

SEQ ID NO: 38203 - DNA, 25 bp, E. coli
gctttaatatcgatcaccgtggtaa

SEQ ID NO: 38204 - DNA, 25 bp, E. coli
gcggctttaataacgatcaccgtgg

SEQ ID NO: 38205 - DNA, 25 bp, E. coli
gctttaatatcgttcaccgtggtaa

SEQ ID NO: 38206 - DNA, 25 bp, E. coli
gcggctttaatatcgatcaccgtgg

SEQ ID NO: 38207 - DNA, 25 bp, E. coli
cccggatggtcgacacttatatgcc

SEQ ID NO: 38208 - DNA, 25 bp, E. coli
cccggatggtcgtcacttatatgcc

SEQ ID NO: 38209 - DNA, 25 bp, E. coli
cttatatgcctgagaccgtaccgcc

SEQ ID NO: 38210 - DNA, 25 bp, E. coli
cttatatgcctgtgaccgtaccgcc

SEQ ID NO: 38211 - DNA, 25 bp, E. coli
ggatggtcgtcacttatatgcctgt

SEQ ID NO: 38212 - DNA, 25 bp, E. coli
ggatggtcgtcagttatatgcctgt

SEQ ID NO: 38213 - DNA, 25 bp, E. coli
tcaccgtggtaactatctgattgcc

SEQ ID NO: 38214 - DNA, 25 bp, E. coli
tcaccgtggtaagtatctgattgcc

SEQ ID NO: 38215 - DNA, 25 bp, E. coli
aacgaacgctgtcacgccatcatcg

SEQ ID NO: 38216 - DNA, 25 bp, E. coli
tacatccgcaagaaactggcaaacg

SEQ ID NO: 38217 - DNA, 25 bp, E. coli
tacatccgcaagtaactggcaaacg

SEQ ID NO: 38218 - DNA, 25 bp, E. coli
aaaagcagtgacgtacatccgcaag

SEQ ID NO: 38219 - DNA, 25 bp, E. coli
aaaagcagtgacctacatccgcaag

SEQ ID NO: 38220 - DNA, 25 bp, E. coli
aacgaacgctgtgacgccatcatcg

SEQ ID NO: 38221 - DNA, 25 bp, E. coli
tattttgattaaaccgagcggctac

SEQ ID NO: 38222 - DNA, 25 bp, E. coli
tattttgattaatccgagcggctac

SEQ ID NO: 38223 - DNA, 25 bp, E. coli
ttgattaaaccgtgcggctacgatg

SEQ ID NO: 38224 - DNA, 25 bp, E. coli
ttgattaaaccgagcggctacgatg

SEQ ID NO: 38225 - DNA, 25 bp, E. coli
tgcgtctgcaatagccaccactgcg

SEQ ID NO: 38226 - DNA, 25 bp, E. coli
tgcgtctgcaattgccaccactgcg

SEQ ID NO: 38227 - DNA, 25 bp, E. coli
gcctgtcagtgccagttattttgat

SEQ ID NO: 38228 - DNA, 25 bp, E. coli
gcctgtcagtgcgagttattttgat

SEQ ID NO: 38229 - DNA, 25 bp, E. coli
gaaaagccgcctctcagtgccagtt

SEQ ID NO: 38230 - DNA, 25 bp, E. coli
gaaagtgtctctcgcggcgctctcc

SEQ ID NO: 38231 - DNA, 25 bp, E. coli
gaaactggcaaaggaacgctgtgac

SEQ ID NO: 38232 - DNA, 25 bp, E. coli
gaaactggcaaacgaacgctgtgac

SEQ ID NO: 38233 - DNA, 25 bp, E. coli
gaaaagccgcctgtcagtgccagtt

SEQ ID NO: 38234 - DNA, 25 bp, E. coli
gaaagtgtctctggcggcgctctcc

SEQ ID NO: 38235 - DNA, 25 bp, E. coli
cggctgagtattttgcgtctgcaat

SEQ ID NO: 38236 - DNA, 25 bp, E. coli
cggctgagtattatgcgtctgcaat

SEQ ID NO: 38237 - DNA, 25 bp, E. coli
aggtattaacgcgagaccccagagg

SEQ ID NO: 38238 - DNA, 25 bp, E. coli
aggtattaacgccagaccccagagg

SEQ ID NO: 38239 - DNA, 25 bp, E. coli
tatctgctctgcgtttcccatgttt

SEQ ID NO: 38240 - DNA, 25 bp, E. coli
tatctgctctgcctttcccatgttt

SEQ ID NO: 38241 - DNA, 25 bp, E. coli
tgttgtacttaccactctcccgtcg

SEQ ID NO: 38242 - DNA, 25 bp, E. coli
tgttgtacttacgactctcccgtcg

SEQ ID NO: 38243 - DNA, 25 bp, E. coli
tccgcccagtcaataggctggttgg

SEQ ID NO: 38244 - DNA, 25 bp, E. coli
tccgcccagtcattaggctggttgg

SEQ ID NO: 38245 - DNA, 25 bp, E. coli
ccattagtgagtggtgttgtactta

SEQ ID NO: 38246 - DNA, 25 bp, E. coli
ccagaggcaaccagcactctgttga

SEQ ID NO: 38247 - DNA, 25 bp, E. coli
ccagaggcaacctgcactctgttga

SEQ ID NO: 38248 - DNA, 25 bp, E. coli
ccattagtgagtcgtgttgtactta

SEQ ID NO: 38249 - DNA, 25 bp, E. coli
gctgtttatcattctggcgttagtc

SEQ ID NO: 38250 - DNA, 25 bp, E. coli
gctgtttatcatactggcgttagtc

SEQ ID NO: 38251 - DNA, 25 bp, E. coli
cgttagtcatcattgccgcgtgggc

SEQ ID NO: 38252 - DNA, 25 bp, E. coli
cgttagtcatcaatgccgcgtgggc

SEQ ID NO: 38253 - DNA, 25 bp, E. coli
tggttgggcgcagcggtaaatccat

SEQ ID NO: 38254 - DNA, 25 bp, E. coli
tggttgggcgcaccggtaaatccat

SEQ ID NO: 38255 - DNA, 25 bp, E. coli
tgggcgctgatgttaaaaggtatta

SEQ ID NO: 38256 - DNA, 25 bp, E. coli
tgggcgctgatgataaaaggtatta

SEQ ID NO: 38257 - DNA, 25 bp, E. coli
tcaatattggctcgaccgtcggccc

SEQ ID NO: 38258 - DNA, 25 bp, E. coli
tcaatattggctggaccgtcggccc

SEQ ID NO: 38259 - DNA, 25 bp, E. coli
cagacaattctgaaaaggagcgaag

SEQ ID NO: 38260 - DNA, 25 bp, E. coli
cagacaattctgtaaaggagcgaag

SEQ ID NO: 38261 - DNA, 25 bp, E. coli
tactgggcgatcctagcaaacagcg

SEQ ID NO: 38262 - DNA, 25 bp, E. coli
taaaggagcgaagatgagtcaggta

SEQ ID NO: 38263 - DNA, 25 bp, E. coli
taaaggagcgaacatgagtcaggta

SEQ ID NO: 38264 - DNA, 25 bp, E. coli
tactgggcgatcgtagcaaacagcg

SEQ ID NO: 38265 - DNA, 25 bp, E. coli
tagcaaacagcggatgaacgaaacg

SEQ ID NO: 38266 - DNA, 25 bp, E. coli
tagcaaacagcgcatgaacgaaacg

SEQ ID NO: 38267 - DNA, 25 bp, E. coli
tttgcgccgctgatccgtttgttac

SEQ ID NO: 38268 - DNA, 25 bp, E. coli
tttgcgccgctgttccgtttgttac

SEQ ID NO: 38269 - DNA, 25 bp, E. coli
ttgctcgcccgtcgatgttactggg

SEQ ID NO: 38270 - DNA, 25 bp, E. coli
ttgaccattgctcgcccgtcgatgt

SEQ ID NO: 38271 - DNA, 25 bp, E. coli
ttgctcgcccgtggatgttactggg

SEQ ID NO: 38272 - DNA, 25 bp, E. coli
ttgaccattgctggcccgtcgatgt

SEQ ID NO: 38273 - DNA, 25 bp, E. coli
tgagtcaggtacagattacaggcgc

SEQ ID NO: 38274 - DNA, 25 bp, E. coli
tgagtcaggtactgattacaggcgc

SEQ ID NO: 38275 - DNA, 25 bp, E. coli
tcaggtactgataacaggcgcaacg

SEQ ID NO: 38276 - DNA, 25 bp, E. coli
tcaggtactgattacaggcgcaacg

SEQ ID NO: 38277 - DNA, 25 bp, E. coli
ccgtcgatgttactgggcgatcgta

SEQ ID NO: 38278 - DNA, 25 bp, E. coli
ccgtcgatgttagtgggcgatcgta

SEQ ID NO: 38279 - DNA, 25 bp, E. coli
cgtggagcgcaacgcagacaattct

SEQ ID NO: 38280 - DNA, 25 bp, E. coli
cgtggagcgcaaggcagacaattct

SEQ ID NO: 38281 - DNA, 25 bp, E. coli
aacgtgcagaaactgccgggcattg

SEQ ID NO: 38282 - DNA, 25 bp, E. coli
cacggtgaaattgaggcggtagatc

SEQ ID NO: 38283 - DNA, 25 bp, E. coli
cacggtgaaattcaggcggtagatc

SEQ ID NO: 38284 - DNA, 25 bp, E. coli
aacgtgcagaaagtgccgggcattg

SEQ ID NO: 38285 - DNA, 25 bp, E. coli
tagtaccgcacgctgaaattgaggc

SEQ ID NO: 38286 - DNA, 25 bp, E. coli
tagtaccgcacggtgaaattgaggc

SEQ ID NO: 38287 - DNA, 25 bp, E. coli
tcccgctggccgatgctcagcaata

SEQ ID NO: 38288 - DNA, 25 bp, E. coli
tcccgctggccgttgctcagcaata

SEQ ID NO: 38289 - DNA, 25 bp, E. coli
tcggcgtggtggattcacttaaact

SEQ ID NO: 38290 - DNA, 25 bp, E. coli
tcggcgtggtggtttcacttaaact

SEQ ID NO: 38291 - DNA, 25 bp, E. coli
cgcattctggcgctagtaccgcacg

SEQ ID NO: 38292 - DNA, 25 bp, E. coli
cgatgctcagcaatatcttgatatg

SEQ ID NO: 38293 - DNA, 25 bp, E. coli
cgatgctcagcattatcttgatatg

SEQ ID NO: 38294 - DNA, 25 bp, E. coli
cgcattctggcggtagtaccgcacg

SEQ ID NO: 38295 - DNA, 25 bp, E. coli
gataacgtgcagaaagtgccgggca

SEQ ID NO: 38296 - DNA, 25 bp, E. coli
ggttatcggcgtggtggtttcactt

SEQ ID NO: 38297 - DNA, 25 bp, E. coli
gataacgtgcagtaagtgccgggca

SEQ ID NO: 38298 - DNA, 25 bp, E. coli
ggttatcggcgtcgtggtttcactt

SEQ ID NO: 38299 - DNA, 25 bp, E. coli
ggagagcggcgcgaatctgcgcgca

SEQ ID NO: 38300 - DNA, 25 bp, E. coli
tggccgatgctcagcaatatcttga

SEQ ID NO: 38301 - DNA, 25 bp, E. coli
ggagagcggcgccaatctgcgcgca

SEQ ID NO: 38302 - DNA, 25 bp, E. coli
tggccgatgctctgcaatatcttga

SEQ ID NO: 38303 - DNA, 25 bp, E. coli
aacggcagtgaatgatctgggcgca

SEQ ID NO: 38304 - DNA, 25 bp, E. coli
tacaccatggaaggagaccagttcg

SEQ ID NO: 38305 - DNA, 25 bp, E. coli
tactgctgcagaagggatccgttgt

SEQ ID NO: 38306 - DNA, 25 bp, E. coli
tactgctgcagatgggatccgttgt

SEQ ID NO: 38307 - DNA, 25 bp, E. coli
tacaccatggaacgagaccagttcg

SEQ ID NO: 38308 - DNA, 25 bp, E. coli
aacggcagtgaaagatctgggcgca

SEQ ID NO: 38309 - DNA, 25 bp, E. coli
taccgtctggcgtcttctgaatggt

SEQ ID NO: 38310 - DNA, 25 bp, E. coli
taccgtctggcgacttctgaatggt

SEQ ID NO: 38311 - DNA, 25 bp, E. coli
cctggccagcggtcttgtgaatatt

SEQ ID NO: 38312 - DNA, 25 bp, E. coli
cctggccagcggacttgtgaatatt

SEQ ID NO: 38313 - DNA, 25 bp, E. coli
gcaggtcgacgatgaataacatcac

SEQ ID NO: 38314 - DNA, 25 bp, E. coli
gcaggtcgacgaagaataacatcac

SEQ ID NO: 38315 - DNA, 25 bp, E. coli
gaaaaacgttatgttccagatggca

SEQ ID NO: 38316 - DNA, 25 bp, E. coli
gaaaaacgttatcttccagatggca

SEQ ID NO: 38317 - DNA, 25 bp, E. coli
ccgttgttacggagccattcaggat

SEQ ID NO: 38318 - DNA, 25 bp, E. coli
ccgttgttacggtgccattcaggat

SEQ ID NO: 38319 - DNA, 25 bp, E. coli
cttatatagcagtagacggtatcga

SEQ ID NO: 38320 - DNA, 25 bp, E. coli
cttatatagcagaagacggtatcga

SEQ ID NO: 38321 - DNA, 25 bp, E. coli
taaggagtggtcaaaacaggatcgt

SEQ ID NO: 38322 - DNA, 25 bp, E. coli
tcaactgaatgaaccggcttaccgc

SEQ ID NO: 38323 - DNA, 25 bp, E. coli
tcaactgaatgatccggcttaccgc

SEQ ID NO: 38324 - DNA, 25 bp, E. coli
taaggagtggtctaaacaggatcgt

SEQ ID NO: 38325 - DNA, 25 bp, E. coli
cagtggtatctgcattgttttggtg

SEQ ID NO: 38326 - DNA, 25 bp, E. coli
cagtggtatctggattgttttggtg

SEQ ID NO: 38327 - DNA, 25 bp, E. coli
taccaccgctaccaaaatccaaatt

SEQ ID NO: 38328 - DNA, 25 bp, E. coli
taccaccgctacgaaaatccaaatt

SEQ ID NO: 38329 - DNA, 25 bp, E. coli
aacaggacatctcccccatttgtga

SEQ ID NO: 38330 - DNA, 25 bp, E. coli
aacaggacatctgccccatttgtga

SEQ ID NO: 38331 - DNA, 25 bp, E. coli
ttatccttaaacaggacatctcccc

SEQ ID NO: 38332 - DNA, 25 bp, E. coli
ttatccttaaactggacatctcccc

SEQ ID NO: 38333 - DNA, 25 bp, E. coli
gctaccaaaatccaaattatcctta

SEQ ID NO: 38334 - DNA, 25 bp, E. coli
gttattttttcttgagtaccagtgg

SEQ ID NO: 38335 - DNA, 25 bp, E. coli
gttattttttctagagtaccagtgg

SEQ ID NO: 38336 - DNA, 25 bp, E. coli
gctaccaaaatcgaaattatcctta

SEQ ID NO: 38337 - DNA, 25 bp, E. coli
cccatttgtgaacacaatatctttg

SEQ ID NO: 38338 - DNA, 25 bp, E. coli
cccatttgtgaagacaatatctttg

SEQ ID NO: 38339 - DNA, 25 bp, E. coli
gtgaacacaataactttgtctttag

SEQ ID NO: 38340 - DNA, 25 bp, E. coli
gtgaacacaatatctttgtctttag

SEQ ID NO: 38341 - DNA, 25 bp, E. coli
tggccttcgtcaaagataataccac

SEQ ID NO: 38342 - DNA, 25 bp, E. coli
tggccttcgtcatagataataccac

SEQ ID NO: 38343 - DNA, 25 bp, E. coli
tcaaagataatagcaccgctaccaa

SEQ ID NO: 38344 - DNA, 25 bp, E. coli
tcaaagataataccaccgctaccaa

SEQ ID NO: 38345 - DNA, 25 bp, E. coli
gagtaccagtggtatctgcattgtt

SEQ ID NO: 38346 - DNA, 25 bp, E. coli
gagtaccagtggaatctgcattgtt

SEQ ID NO: 38347 - DNA, 25 bp, E. coli
caaatattgcagtacattgaaatgc

SEQ ID NO: 38348 - DNA, 25 bp, E. coli
caaatattgcagaacattgaaatgc

SEQ ID NO: 38349 - DNA, 25 bp, E. coli
catattattgatcaggctttacgct

SEQ ID NO: 38350 - DNA, 25 bp, E. coli
catattattgatgaggctttacgct

SEQ ID NO: 38351 - DNA, 25 bp, E. coli
atctcgagagggtggtgttcatgac

SEQ ID NO: 38352 - DNA, 25 bp, E. coli
atctcgagagggaggtgttcatgac

SEQ ID NO: 38353 - DNA, 25 bp, E. coli
ttattaatgacacggaatccgtgct

SEQ ID NO: 38354 - DNA, 25 bp, E. coli
ttattaatgacagggaatccgtgct

SEQ ID NO: 38355 - DNA, 25 bp, E. coli
tgaataattcaaacccagagagatt

SEQ ID NO: 38356 - DNA, 25 bp, E. coli
tgaataattcaatcccagagagatt

SEQ ID NO: 38357 - DNA, 25 bp, E. coli
gctttgtttaaatatctcgagaggg

SEQ ID NO: 38358 - DNA, 25 bp, E. coli
gctttgtttaaaaatctcgagaggg

SEQ ID NO: 38359 - DNA, 25 bp, E. coli
gaaatgcataagactacactaacgg

SEQ ID NO: 38360 - DNA, 25 bp, E. coli
gaaatgcataagtctacactaacgg

SEQ ID NO: 38361 - DNA, 25 bp, E. coli
cgcttgcgtttaaaagatgaaacca

SEQ ID NO: 38362 - DNA, 25 bp, E. coli
cgcttgcgtttataagatgaaacca

SEQ ID NO: 38363 - DNA, 25 bp, E. coli
gattctttctgatctctatctgcaa

SEQ ID NO: 38364 - DNA, 25 bp, E. coli
gattctttctgaactctatctgcaa

SEQ ID NO: 38365 - DNA, 25 bp, E. coli
gacgcatgggtaagttgatagtcat

SEQ ID NO: 38366 - DNA, 25 bp, E. coli
gatgaaaccagtgtgattctttctg

SEQ ID NO: 38367 - DNA, 25 bp, E. coli
gacgcatgggtatgttgatagtcat

SEQ ID NO: 38368 - DNA, 25 bp, E. coli
gatgaaaccagtctgattctttctg

SEQ ID NO: 38369 - DNA, 25 bp, E. coli
tacgatgttaacgatcaacgcctgg

SEQ ID NO: 38370 - DNA, 25 bp, E. coli
tatgccagttatcaatcgccgtggg

SEQ ID NO: 38371 - DNA, 25 bp, E. coli
tacgatgttaaccatcaacgcctgg

SEQ ID NO: 38372 - DNA, 25 bp, E. coli
tagtcggtatactgaaggcaatccc

SEQ ID NO: 38373 - DNA, 25 bp, E. coli
tatgccagttatgaatcgccgtggg

SEQ ID NO: 38374 - DNA, 25 bp, E. coli
tagtcggtatacagaaggcaatccc

SEQ ID NO: 38375 - DNA, 25 bp, E. coli
tatcatcggcaacgtaggtcagggt

SEQ ID NO: 38376 - DNA, 25 bp, E. coli
tatcatcggcaaggtaggtcagggt

SEQ ID NO: 38377 - DNA, 25 bp, E. coli
tgttgtgcaaatgctgcgccctggc

SEQ ID NO: 38378 - DNA, 25 bp, E. coli
tgttgtgcaaatcctgcgccctggc

SEQ ID NO: 38379 - DNA, 25 bp, E. coli
tgaaacagttcagggacaatcggca

SEQ ID NO: 38380 - DNA, 25 bp, E. coli
tgaaacagttcacggacaatcggca

SEQ ID NO: 38381 - DNA, 25 bp, E. coli
gctgatggcacaaaacggacgttct

SEQ ID NO: 38382 - DNA, 25 bp, E. coli
gctgatggcacataacggacgttct

SEQ ID NO: 38383 - DNA, 25 bp, E. coli
gatatcacagtgaaagtccaggcag

SEQ ID NO: 38384 - DNA, 25 bp, E. coli
gatatcacagtgtaagtccaggcag

SEQ ID NO: 38385 - DNA, 25 bp, E. coli
ggtgaatcttacacgaccggcgaga

SEQ ID NO: 38386 - DNA, 25 bp, E. coli
ggtgaatcttactcgaccggcgaga

SEQ ID NO: 38387 - DNA, 25 bp, E. coli
ggcctccgggcataacagtactaat

SEQ ID NO: 38388 - DNA, 25 bp, E. coli
ggcctccgggcaaaacagtactaat

SEQ ID NO: 38389 - DNA, 25 bp, E. coli
tcaacggtgggaaaaacttaggcgc

SEQ ID NO: 38390 - DNA, 25 bp, E. coli
tcaacggtgggataaacttaggcgc

SEQ ID NO: 38391 - DNA, 25 bp, E. coli
ccgcgaactgcctgggtttcgtatt

SEQ ID NO: 38392 - DNA, 25 bp, E. coli
ccgcgaactgccagggtttcgtatt

SEQ ID NO: 38393 - DNA, 25 bp, E. coli
aactgcctgggtttcgtattgaacg

SEQ ID NO: 38394 - DNA, 25 bp, E. coli
actgcctgggttacgtattgaacgg

SEQ ID NO: 38395 - DNA, 25 bp, E. coli
aactgcctgggtatcgtattgaacg

SEQ ID NO: 38396 - DNA, 25 bp, E. coli
actgcctgggtttcgtattgaacgg

SEQ ID NO: 38397 - DNA, 25 bp, E. coli
tattgaacgggtccagcttttcgat

SEQ ID NO: 38398 - DNA, 25 bp, E. coli
tattgaacgggtgcagcttttcgat

SEQ ID NO: 38399 - DNA, 25 bp, E. coli
tgaacgggtgcaccttttcgatatg

SEQ ID NO: 38400 - DNA, 25 bp, E. coli
tgaacgggtgcagcttttcgatatg

SEQ ID NO: 38401 - DNA, 25 bp, E. coli
tgcctgggtttcgtattgaacgggt

SEQ ID NO: 38402 - DNA, 25 bp, E. coli
tgcctgggtttcctattgaacgggt

SEQ ID NO: 38403 - DNA, 25 bp, E. coli
gaactgcctgggattcgtattgaac

SEQ ID NO: 38404 - DNA, 25 bp, E. coli
gaactgcctgggtttcgtattgaac

SEQ ID NO: 38405 - DNA, 25 bp, E. coli
ctgggtttcgtaatgaacgggtgca

SEQ ID NO: 38406 - DNA, 25 bp, E. coli
ctgggtttcgtattgaacgggtgca

SEQ ID NO: 38407 - DNA, 25 bp, E. coli
cgtattgaacggctgcagcttttcg

SEQ ID NO: 38408 - DNA, 25 bp, E. coli
cgtattgaacgggtgcagcttttcg

SEQ ID NO: 38409 - DNA, 25 bp, E. coli
gtttcgtattgatcgggtgcagctt

SEQ ID NO: 38410 - DNA, 25 bp, E. coli
gtttcgtattgaacgggtgcagctt

SEQ ID NO: 38411 - DNA, 25 bp, E. coli
ggtttcgtattgtacgggtgcagct

SEQ ID NO: 38412 - DNA, 25 bp, E. coli
ggtttcgtattgaacgggtgcagct

SEQ ID NO: 38413 - DNA, 25 bp, E. coli
caaacgtagacatctctttgtcggc

SEQ ID NO: 38414 - DNA, 25 bp, E. coli
caaacgtagacaactctttgtcggc

SEQ ID NO: 38415 - DNA, 25 bp, E. coli
catcagtacgctggagaggcgagtt

SEQ ID NO: 38416 - DNA, 25 bp, E. coli
catcagtacgctcgagaggcgagtt

SEQ ID NO: 38417 - DNA, 25 bp, E. coli
taaacagttcgtagcgcatcagtac

SEQ ID NO: 38418 - DNA, 25 bp, E. coli
taaacagttcgttgcgcatcagtac

SEQ ID NO: 38419 - DNA, 25 bp, E. coli
tttgtctttcatcagcagcggcagc

SEQ ID NO: 38420 - DNA, 25 bp, E. coli
tttgtctttcatgagcagcggcagc

SEQ ID NO: 38421 - DNA, 25 bp, E. coli
tccgcgcagtttgttggcgatacta

SEQ ID NO: 38422 - DNA, 25 bp, E. coli
tcgaccgcgtgctgaaactcctgct

SEQ ID NO: 38423 - DNA, 25 bp, E. coli
tccgcgcagtttcttggcgatacta

SEQ ID NO: 38424 - DNA, 25 bp, E. coli
tcgaccgcgtgcagaaactcctgct

SEQ ID NO: 38425 - DNA, 25 bp, E. coli
ccaggtattacggagaaattgttcc

SEQ ID NO: 38426 - DNA, 25 bp, E. coli
ccaggtattacgcagaaattgttcc

SEQ ID NO: 38427 - DNA, 25 bp, E. coli
gaaactcctgcttatgttcctcgtc

SEQ ID NO: 38428 - DNA, 25 bp, E. coli
gaaactcctgctaatgttcctcgtc

SEQ ID NO: 38429 - DNA, 25 bp, E. coli
cgatacaatttaccgtgtccgcgca

SEQ ID NO: 38430 - DNA, 25 bp, E. coli
cgatactatcgcgaccaaaatgctg

SEQ ID NO: 38431 - DNA, 25 bp, E. coli
cgatactatcgccaccaaaatgctg

SEQ ID NO: 38432 - DNA, 25 bp, E. coli
cgatacaatttagcgtgtccgcgca

SEQ ID NO: 38433 - DNA, 25 bp, E. coli
ctttgtcggcttacagcttcaatcg

SEQ ID NO: 38434 - DNA, 25 bp, E. coli
ctttgtcggctttcagcttcaatcg

SEQ ID NO: 38435 - DNA, 25 bp, E. coli
caatttttgtcttatacaggaaccg

SEQ ID NO: 38436 - DNA, 25 bp, E. coli
caatttttgtctaatacaggaaccg

SEQ ID NO: 38437 - DNA, 25 bp, E. coli
attctggcgcttatcccggcatggc

SEQ ID NO: 38438 - DNA, 25 bp, E. coli
tacgattccgggagattccttcctt

SEQ ID NO: 38439 - DNA, 25 bp, E. coli
tacgattccgggtgattccttcctt

SEQ ID NO: 38440 - DNA, 25 bp, E. coli
attctggcgcttttcccggcatggc

SEQ ID NO: 38441 - DNA, 25 bp, E. coli
tgtgatttcagcaacgattccggga

SEQ ID NO: 38442 - DNA, 25 bp, E. coli
tgtgatttcagctacgattccggga

SEQ ID NO: 38443 - DNA, 25 bp, E. coli
tgagatctgcataagcggaaagcgc

SEQ ID NO: 38444 - DNA, 25 bp, E. coli
tgagatctgcattagcggaaagcgc

SEQ ID NO: 38445 - DNA, 25 bp, E. coli
tcccggcatggcttgagatctgcat

SEQ ID NO: 38446 - DNA, 25 bp, E. coli
tcccggcatggcatgagatctgcat

SEQ ID NO: 38447 - DNA, 25 bp, E. coli
tcttgcaccaaatctgcactacgct

SEQ ID NO: 38448 - DNA, 25 bp, E. coli
tcttgcaccaaaactgcactacgct

SEQ ID NO: 38449 - DNA, 25 bp, E. coli
gcggaaagcgcaccaatttttgtct

SEQ ID NO: 38450 - DNA, 25 bp, E. coli
gcggaaagcgcagcaatttttgtct

SEQ ID NO: 38451 - DNA, 25 bp, E. coli
gcactacgctgctcaaatgttgatc

SEQ ID NO: 38452 - DNA, 25 bp, E. coli
gcactacgctgcacaaatgttgatc

SEQ ID NO: 38453 - DNA, 25 bp, E. coli
cgcactcgcgggatttcatttaacg

SEQ ID NO: 38454 - DNA, 25 bp, E. coli
cgcactcgcgggttttcatttaacg

SEQ ID NO: 38455 - DNA, 25 bp, E. coli
taactttaagcctgcattctggcgc

SEQ ID NO: 38456 - DNA, 25 bp, E. coli
taactttaagccagcattctggcgc

SEQ ID NO: 38457 - DNA, 25 bp, E. coli
caactctctttttgtcctgaaaccg

SEQ ID NO: 38458 - DNA, 25 bp, E. coli
caactctcttttagtcctgaaaccg

SEQ ID NO: 38459 - DNA, 25 bp, E. coli
cacttaatagcgaattacaaaaaat

SEQ ID NO: 38460 - DNA, 25 bp, E. coli
cacttaatagcgtattacaaaaaat

SEQ ID NO: 38461 - DNA, 25 bp, E. coli
accagccctggtttacatcggctaa

SEQ ID NO: 38462 - DNA, 25 bp, E. coli
accagccctggtatacatcggctaa

SEQ ID NO: 38463 - DNA, 25 bp, E. coli
aacggcgccgacttctttatatttg

SEQ ID NO: 38464 - DNA, 25 bp, E. coli
aacggcgccgacatctttatatttg

SEQ ID NO: 38465 - DNA, 25 bp, E. coli
tatccggggaaggagtatcagtttg

SEQ ID NO: 38466 - DNA, 25 bp, E. coli
tatccggggaagcagtatcagtttg

SEQ ID NO: 38467 - DNA, 25 bp, E. coli
tgtgcagaaatcacttaatagcgaa

SEQ ID NO: 38468 - DNA, 25 bp, E. coli
tgtgcagaaatctcttaatagcgaa

SEQ ID NO: 38469 - DNA, 25 bp, E. coli
tctctttttgtcgtgaaaccgactt

SEQ ID NO: 38470 - DNA, 25 bp, E. coli
tctctttttgtcctgaaaccgactt

SEQ ID NO: 38471 - DNA, 25 bp, E. coli
tcagtttggcaaagaaatagcggag

SEQ ID NO: 38472 - DNA, 25 bp, E. coli
tcagtttggcaatgaaatagcggag

SEQ ID NO: 38473 - DNA, 25 bp, E. coli
gcgccgacttctatatatttggtca

SEQ ID NO: 38474 - DNA, 25 bp, E. coli
gccctggtttacatcggctaaaggc

SEQ ID NO: 38475 - DNA, 25 bp, E. coli
gccctggtttacttcggctaaaggc

SEQ ID NO: 38476 - DNA, 25 bp, E. coli
gcgccgacttctttatatttggtca

SEQ ID NO: 38477 - DNA, 25 bp, E. coli
gacttctttataattggtcatatga

SEQ ID NO: 38478 - DNA, 25 bp, E. coli
gacttctttatatttggtcatatga

SEQ ID NO: 38479 - DNA, 25 bp, E. coli
acagggcgaacttcgctggaaagga

SEQ ID NO: 38480 - DNA, 25 bp, E. coli
acagggcgaactacgctggaaagga

SEQ ID NO: 38481 - DNA, 25 bp, E. coli
tatggtgaacaggtacagggcgaac

SEQ ID NO: 38482 - DNA, 25 bp, E. coli
tatggtgaacagctacagggcgaac

SEQ ID NO: 38483 - DNA, 25 bp, E. coli
tggtgaacagctacagggcgaacta

SEQ ID NO: 38484 - DNA, 25 bp, E. coli
tggtgaacagcttcagggcgaacta

SEQ ID NO: 38485 - DNA, 25 bp, E. coli
tgaacagctacagggcgaactacgc

SEQ ID NO: 38486 - DNA, 25 bp, E. coli
tgaacagctacacggcgaactacgc

SEQ ID NO: 38487 - DNA, 25 bp, E. coli
gcgaactacgctggaaaggaatggt

SEQ ID NO: 38488 - DNA, 25 bp, E. coli
gcgaactacgctcgaaaggaatggt

SEQ ID NO: 38489 - DNA, 25 bp, E. coli
gctgatgtcccgaactggtggcctg

SEQ ID NO: 38490 - DNA, 25 bp, E. coli
gctgatgtcccgtactggtggcctg

SEQ ID NO: 38491 - DNA, 25 bp, E. coli
cgctgatgtcccgaactggtggcct

SEQ ID NO: 38492 - DNA, 25 bp, E. coli
cgctgatgtccccaactggtggcct

SEQ ID NO: 38493 - DNA, 25 bp, E. coli
cgaactacgctggaaaggaatggtt

SEQ ID NO: 38494 - DNA, 25 bp, E. coli
cgaactacgctgcaaaggaatggtt

SEQ ID NO: 38495 - DNA, 25 bp, E. coli
ctgatgtcccgaactggtggcctgg

SEQ ID NO: 38496 - DNA, 25 bp, E. coli
ctgatgtcccgatctggtggcctgg

SEQ ID NO: 38497 - DNA, 25 bp, E. coli
gtgaacagctacagggcgaactacg

SEQ ID NO: 38498 - DNA, 25 bp, E. coli
ggtgaacagctagagggcgaactac

SEQ ID NO: 38499 - DNA, 25 bp, E. coli
ggtgaacagctacagggcgaactac

SEQ ID NO: 38500 - DNA, 25 bp, E. coli
gtgaacagctactgggcgaactacg

SEQ ID NO: 38501 - DNA, 25 bp, E. coli
caaaactgtcagcaagtgttgcgct

SEQ ID NO: 38502 - DNA, 25 bp, E. coli
caaaactgtcaggaagtgttgcgct

SEQ ID NO: 38503 - DNA, 25 bp, E. coli
cagacagaaattttttgccgccttc

SEQ ID NO: 38504 - DNA, 25 bp, E. coli
cagacagaaattatttgccgccttc

SEQ ID NO: 38505 - DNA, 25 bp, E. coli
tacacgaagccgctgaacgtgcgca

SEQ ID NO: 38506 - DNA, 25 bp, E. coli
tacacgaagccggtgaacgtgcgca

SEQ ID NO: 38507 - DNA, 25 bp, E. coli
tataccctgataaattaaatgatgg

SEQ ID NO: 38508 - DNA, 25 bp, E. coli
tataccctgatatattaaatgatgg

SEQ ID NO: 38509 - DNA, 25 bp, E. coli
tgatatatccgctttagctggcctt

SEQ ID NO: 38510 - DNA, 25 bp, E. coli
tgatatatccgcattagctggcctt

SEQ ID NO: 38511 - DNA, 25 bp, E. coli
tccgcattagctggccttctggcaa

SEQ ID NO: 38512 - DNA, 25 bp, E. coli
tccgcattagctcgccttctggcaa

SEQ ID NO: 38513 - DNA, 25 bp, E. coli
gccgccttcttgaggtataccctga

SEQ ID NO: 38514 - DNA, 25 bp, E. coli
gccgccttcttgtggtataccctga

SEQ ID NO: 38515 - DNA, 25 bp, E. coli
gaacgtgcgcaccagacagaaatta

SEQ ID NO: 38516 - DNA, 25 bp, E. coli
gaacgtgcgcacgagacagaaatta

SEQ ID NO: 38517 - DNA, 25 bp, E. coli
gaagtgttgcgcagtggttaattga

SEQ ID NO: 38518 - DNA, 25 bp, E. coli
gaagtgttgcgctgtggttaattga

SEQ ID NO: 38519 - DNA, 25 bp, E. coli
gaaattacattacacgaagccgctg

SEQ ID NO: 38520 - DNA, 25 bp, E. coli
gaaattacattagacgaagccgctg

SEQ ID NO: 38521 - DNA, 25 bp, E. coli
tggttaattgatcagagagccgaac

SEQ ID NO: 38522 - DNA, 25 bp, E. coli
tggttaattgatgagagagccgaac

SEQ ID NO: 38523 - DNA, 25 bp, E. coli
tatctaacattaatgcggacggctg

SEQ ID NO: 38524 - DNA, 25 bp, E. coli
tatctaacattattgcggacggctg

SEQ ID NO: 38525 - DNA, 25 bp, E. coli
ttcgtgccggcactttttccagagc

SEQ ID NO: 38526 - DNA, 25 bp, E. coli
ttcgtgccggcagtttttccagagc

SEQ ID NO: 38527 - DNA, 25 bp, E. coli
tcggttgcggcaaaaaagtagcggt

SEQ ID NO: 38528 - DNA, 25 bp, E. coli
tcggttgcggcataaaagtagcggt

SEQ ID NO: 38529 - DNA, 25 bp, E. coli
tcatcacgggtgtgaatgccctcta

SEQ ID NO: 38530 - DNA, 25 bp, E. coli
tcatcacgggtgagaatgccctcta

SEQ ID NO: 38531 - DNA, 25 bp, E. coli
tcttgagcaaggactggatgagcat

SEQ ID NO: 38532 - DNA, 25 bp, E. coli
tcttgagcaaggtctggatgagcat

SEQ ID NO: 38533 - DNA, 25 bp, E. coli
gaataaattcctcccgtgttgcagc

SEQ ID NO: 38534 - DNA, 25 bp, E. coli
gaataaattcctgccgtgttgcagc

SEQ ID NO: 38535 - DNA, 25 bp, E. coli
gaacgggtatcaatcaacatctgga

SEQ ID NO: 38536 - DNA, 25 bp, E. coli
gaacgggtatcattcaacatctgga

SEQ ID NO: 38537 - DNA, 25 bp, E. coli
gaaagcatgatacgaatggcgctga

SEQ ID NO: 38538 - DNA, 25 bp, E. coli
gaaagcatgataggaatggcgctga

SEQ ID NO: 38539 - DNA, 25 bp, E. coli
tcaatgcgggcaagttacagccgat

SEQ ID NO: 38540 - DNA, 25 bp, E. coli
tcaatgcgggcatgttacagccgat

SEQ ID NO: 38541 - DNA, 25 bp, E. coli
gatgagcatatgactgccgttcctg

SEQ ID NO: 38542 - DNA, 25 bp, E. coli
gaggaacgtcttaacaccaagctga

SEQ ID NO: 38543 - DNA, 25 bp, E. coli
gaggaacgtctttacaccaagctga

SEQ ID NO: 38544 - DNA, 25 bp, E. coli
gatgagcatatgtctgccgttcctg

SEQ ID NO: 38545 - DNA, 25 bp, E. coli
cagcagtactgttatggagtttcgg

SEQ ID NO: 38546 - DNA, 25 bp, E. coli
cagcagtactgtaatggagtttcgg

SEQ ID NO: 38547 - DNA, 25 bp, E. coli
cataaccgtgtggtggatgctgtgc

SEQ ID NO: 38548 - DNA, 25 bp, E. coli
cataaccgtgtgctggatgctgtgc

SEQ ID NO: 38549 - DNA, 25 bp, E. coli
taaagaaggcgtttcgtgtagcgtt

SEQ ID NO: 38550 - DNA, 25 bp, E. coli
taaagaaggcgtatcgtgtagcgtt

SEQ ID NO: 38551 - DNA, 25 bp, E. coli
tatatggcagtaaggcgtggataaa

SEQ ID NO: 38552 - DNA, 25 bp, E. coli
tatatggcagtatggcgtggataaa

SEQ ID NO: 38553 - DNA, 25 bp, E. coli
ttatgaagacgatattatatggcag

SEQ ID NO: 38554 - DNA, 25 bp, E. coli
ttatgaagacgaaattatatggcag

SEQ ID NO: 38555 - DNA, 25 bp, E. coli
tcctgtatcaggattacggcccggt

SEQ ID NO: 38556 - DNA, 25 bp, E. coli
tcctgtatcaggtttacggcccggt

SEQ ID NO: 38557 - DNA, 25 bp, E. coli
gcgagtcgtgcacgtgtgtttatta

SEQ ID NO: 38558 - DNA, 25 bp, E. coli
gcgagtcgtgcaggtgtgtttatta

SEQ ID NO: 38559 - DNA, 25 bp, E. coli
ggagtttcggaagcataaccgtgtg

SEQ ID NO: 38560 - DNA, 25 bp, E. coli
ggagtttcggaaccataaccgtgtg

SEQ ID NO: 38561 - DNA, 25 bp, E. coli
ggcaggtggttatcagcagtactgt

SEQ ID NO: 38562 - DNA, 25 bp, E. coli
tcgtgtagcgttgcaggaggttaac

SEQ ID NO: 38563 - DNA, 25 bp, E. coli
tcgtgtagcgttccaggaggttaac

SEQ ID NO: 38564 - DNA, 25 bp, E. coli
ggcaggtggttaacagcagtactgt

SEQ ID NO: 38565 - DNA, 25 bp, E. coli
gatgctgtgctgttaacctgtccgg

SEQ ID NO: 38566 - DNA, 25 bp, E. coli
gatgctgtgctgataacctgtccgg

SEQ ID NO: 38567 - DNA, 25 bp, E. coli
tatatttccccaggaaaacgattgc

SEQ ID NO: 38568 - DNA, 25 bp, E. coli
tatatttccccacgaaaacgattgc

SEQ ID NO: 38569 - DNA, 25 bp, E. coli
ttttatcatgcctacggacctgaac

SEQ ID NO: 38570 - DNA, 25 bp, E. coli
ttttatcatgccaacggacctgaac

SEQ ID NO: 38571 - DNA, 25 bp, E. coli
tgcatccggcactgtgtgccgatgc

SEQ ID NO: 38572 - DNA, 25 bp, E. coli
tgcatccggcacagtgtgccgatgc

SEQ ID NO: 38573 - DNA, 25 bp, E. coli
tcgcgcggtgcaaccggcactgtgt

SEQ ID NO: 38574 - DNA, 25 bp, E. coli
tcgcgcggtgcatccggcactgtgt

SEQ ID NO: 38575 - DNA, 25 bp, E. coli
tcttcagatgaatagaatgcggcgg

SEQ ID NO: 38576 - DNA, 25 bp, E. coli
tcttcagatgaaaagaatgcggcgg

SEQ ID NO: 38577 - DNA, 25 bp, E. coli
ccacctttttgctctcattcatata

SEQ ID NO: 38578 - DNA, 25 bp, E. coli
ccacctttttgcactcattcatata

SEQ ID NO: 38579 - DNA, 25 bp, E. coli
gaaaacgattgcattttatcttcag

SEQ ID NO: 38580 - DNA, 25 bp, E. coli
gaaaacgattgctttttatcttcag

SEQ ID NO: 38581 - DNA, 25 bp, E. coli
cttatcaggccttcccactgttttt

SEQ ID NO: 38582 - DNA, 25 bp, E. coli
cttatcaggcctacccactgttttt

SEQ ID NO: 38583 - DNA, 25 bp, E. coli
gttattgtcggaagcgtcgcgcggt

SEQ ID NO: 38584 - DNA, 25 bp, E. coli
gttattgtcggatgcgtcgcgcggt

SEQ ID NO: 38585 - DNA, 25 bp, E. coli
tacccactgtttttacaccgataat

SEQ ID NO: 38586 - DNA, 25 bp, E. coli
tacccactgtttatacaccgataat

SEQ ID NO: 38587 - DNA, 25 bp, E. coli
gacgcgttttatcatgcctacggac

SEQ ID NO: 38588 - DNA, 25 bp, E. coli
gacgcgttttatgatgcctacggac

SEQ ID NO: 38589 - DNA, 25 bp, E. coli
tatcgatgagcaaatttacgcgcgc

SEQ ID NO: 38590 - DNA, 25 bp, E. coli
tatcgatgagcatatttacgcgcgc

SEQ ID NO: 38591 - DNA, 25 bp, E. coli
tgatccctaataagctggaagggcg

SEQ ID NO: 38592 - DNA, 25 bp, E. coli
tgatccctaatatgctggaagggcg

SEQ ID NO: 38593 - DNA, 25 bp, E. coli
tgggtgatagcatgagagatctcta

SEQ ID NO: 38594 - DNA, 25 bp, E. coli
tgggtgatagcaagagagatctcta

SEQ ID NO: 38595 - DNA, 25 bp, E. coli
tgatgttgtcaatgagtatgcgtcg

SEQ ID NO: 38596 - DNA, 25 bp, E. coli
tgatgttgtcaaagagtatgcgtcg

SEQ ID NO: 38597 - DNA, 25 bp, E. coli
tccgctcacggaacttaaccgcgag

SEQ ID NO: 38598 - DNA, 25 bp, E. coli
tcgatattgaacacagcaaggcggt

SEQ ID NO: 38599 - DNA, 25 bp, E. coli
tccgctcacggatcttaaccgcgag

SEQ ID NO: 38600 - DNA, 25 bp, E. coli
tcggaagtcacacaaataagctgcg

SEQ ID NO: 38601 - DNA, 25 bp, E. coli
tcgatattgaactcagcaaggcggt

SEQ ID NO: 38602 - DNA, 25 bp, E. coli
tcggaagtcacagaaataagctgcg

SEQ ID NO: 38603 - DNA, 25 bp, E. coli
gcaaggcggttaataccctgactta

SEQ ID NO: 38604 - DNA, 25 bp, E. coli
gcaaggcggttattaccctgactta

SEQ ID NO: 38605 - DNA, 25 bp, E. coli
taaccgcgagcacaagtggcagatg

SEQ ID NO: 38606 - DNA, 25 bp, E. coli
taatcgccgaatcgatgatggctga

SEQ ID NO: 38607 - DNA, 25 bp, E. coli
taaccgcgagcagaagtggcagatg

SEQ ID NO: 38608 - DNA, 25 bp, E. coli
taagctgcgaagttaagatgatccc

SEQ ID NO: 38609 - DNA, 25 bp, E. coli
taatcgccgaatggatgatggctga

SEQ ID NO: 38610 - DNA, 25 bp, E. coli
taagctgcgaagataagatgatccc

SEQ ID NO: 38611 - DNA, 25 bp, E. coli
cattaaaggtctgttcgccgtgggt

SEQ ID NO: 38612 - DNA, 25 bp, E. coli
aaatatatggaactgggtccacgcg

SEQ ID NO: 38613 - DNA, 25 bp, E. coli
aaagcgtacgttcgcgtcgatccgg

SEQ ID NO: 38614 - DNA, 25 bp, E. coli
aaatatatggaagtgggtccacgcg

SEQ ID NO: 38615 - DNA, 25 bp, E. coli
aacgtacgtcgcttcggcggcatga

SEQ ID NO: 38616 - DNA, 25 bp, E. coli
aaagcgtacgttggcgtcgatccgg

SEQ ID NO: 38617 - DNA, 25 bp, E. coli
aacgtacgtcgcatcggcggcatga

SEQ ID NO: 38618 - DNA, 25 bp, E. coli
tagccataccgtagctgcagaaggg

SEQ ID NO: 38619 - DNA, 25 bp, E. coli
tagccataccgttgctgcagaaggg

SEQ ID NO: 38620 - DNA, 25 bp, E. coli
tatcgttacaactccaacggcggca

SEQ ID NO: 38621 - DNA, 25 bp, E. coli
tatcgttacaacaccaacggcggca

SEQ ID NO: 38622 - DNA, 25 bp, E. coli
tatctgcaagattacggcatgggcc

SEQ ID NO: 38623 - DNA, 25 bp, E. coli
tatctgcaagataacggcatgggcc

SEQ ID NO: 38624 - DNA, 25 bp, E. coli
tgaacatgatggaaggcacgctggt

SEQ ID NO: 38625 - DNA, 25 bp, E. coli
tgaacatgatggtaggcacgctggt

SEQ ID NO: 38626 - DNA, 25 bp, E. coli
tcgcggcctggttgcaatgaacatg

SEQ ID NO: 38627 - DNA, 25 bp, E. coli
tcgcggcctggtagcaatgaacatg

SEQ ID NO: 38628 - DNA, 25 bp, E. coli
cgcgcaggatcaagacagcttcgaa

SEQ ID NO: 38629 - DNA, 25 bp, E. coli
cgcgcaggatcatgacagcttcgaa

SEQ ID NO: 38630 - DNA, 25 bp, E. coli
cattaaaggtctcttcgccgtgggt

SEQ ID NO: 38631 - DNA, 25 bp, E. coli
taagaccggcttccatatgctgcac

SEQ ID NO: 38632 - DNA, 25 bp, E. coli
taagaccggcttgcatatgctgcac

SEQ ID NO: 38633 - DNA, 25 bp, E. coli
agcggcttcgctaatgcacatcatg

SEQ ID NO: 38634 - DNA, 25 bp, E. coli
agcggcttcgcttatgcacatcatg

SEQ ID NO: 38635 - DNA, 25 bp, E. coli
tatgccgcgatgcaactccgtggct

SEQ ID NO: 38636 - DNA, 25 bp, E. coli
tatgccgcgatggaactccgtggct

SEQ ID NO: 38637 - DNA, 25 bp, E. coli
tttcgttgcaataacctatgccgcg

SEQ ID NO: 38638 - DNA, 25 bp, E. coli
tttcgttgcaattacctatgccgcg

SEQ ID NO: 38639 - DNA, 25 bp, E. coli
tgatccttctattgtgccaccgcca

SEQ ID NO: 38640 - DNA, 25 bp, E. coli
tgttacgaatgaagcctcgccgcaa

SEQ ID NO: 38641 - DNA, 25 bp, E. coli
tgttacgaatgatgcctcgccgcaa

SEQ ID NO: 38642 - DNA, 25 bp, E. coli
tgatccttctatagtgccaccgcca

SEQ ID NO: 38643 - DNA, 25 bp, E. coli
tccgtggctggtttcctaaaggtag

SEQ ID NO: 38644 - DNA, 25 bp, E. coli
tgcctggcaaatgaaagcggcttcg

SEQ ID NO: 38645 - DNA, 25 bp, E. coli
tgcctggcaaatcaaagcggcttcg

SEQ ID NO: 38646 - DNA, 25 bp, E. coli
tgcgagaaacacattacaatgcggg

SEQ ID NO: 38647 - DNA, 25 bp, E. coli
tccgtggctggtatcctaaaggtag

SEQ ID NO: 38648 - DNA, 25 bp, E. coli
tgcgagaaacactttacaatgcggg

SEQ ID NO: 38649 - DNA, 25 bp, E. coli
gaaacctgggcaaatataggctact

SEQ ID NO: 38650 - DNA, 25 bp, E. coli
gaaacctgggcatatataggctact

SEQ ID NO: 38651 - DNA, 25 bp, E. coli
gtagtacttatcagctgatgcgaga

SEQ ID NO: 38652 - DNA, 25 bp, E. coli
gtagtacttatctgctgatgcgaga

SEQ ID NO: 38653 - DNA, 25 bp, E. coli
tggcttacagtgcaaaatcgtggag

SEQ ID NO: 38654 - DNA, 25 bp, E. coli
tggcttacagtggaaaatcgtggag

SEQ ID NO: 38655 - DNA, 25 bp, E. coli
caattattaacggagcccaggtcac

SEQ ID NO: 38656 - DNA, 25 bp, E. coli
caattattaacgcagcccaggtcac

SEQ ID NO: 38657 - DNA, 25 bp, E. coli
caggcccagggcgtgacatttgctt

SEQ ID NO: 38658 - DNA, 25 bp, E. coli
caggcccagggcctgacatttgctt

SEQ ID NO: 38659 - DNA, 25 bp, E. coli
tatctctggtcaggccgtgaaaacg

SEQ ID NO: 38660 - DNA, 25 bp, E. coli
tatctctggtcacgccgtgaaaacg

SEQ ID NO: 38661 - DNA, 25 bp, E. coli
tgattcattttgctcgccaggcggc

SEQ ID NO: 38662 - DNA, 25 bp, E. coli
tgattcattttggtcgccaggcggc

SEQ ID NO: 38663 - DNA, 25 bp, E. coli
tgaaaattgatgacgatgccctcgc

SEQ ID NO: 38664 - DNA, 25 bp, E. coli
tgaaaattgatgtcgatgccctcgc

SEQ ID NO: 38665 - DNA, 25 bp, E. coli
taatagaaacgcagggaaccagctt

SEQ ID NO: 38666 - DNA, 25 bp, E. coli
taatagaaacgctgggaaccagctt

SEQ ID NO: 38667 - DNA, 25 bp, E. coli
cctgggaatatatggcaccgcgaga

SEQ ID NO: 38668 - DNA, 25 bp, E. coli
cctgggaatataaggcaccgcgaga

SEQ ID NO: 38669 - DNA, 25 bp, E. coli
gctttacttgggatcggccgcacta

SEQ ID NO: 38670 - DNA, 25 bp, E. coli
gctttacttgggttcggccgcacta

SEQ ID NO: 38671 - DNA, 25 bp, E. coli
gaacatctgttttccgagcaggcga

SEQ ID NO: 38672 - DNA, 25 bp, E. coli
gaaaaacgcttcactacgcggctga

SEQ ID NO: 38673 - DNA, 25 bp, E. coli
gaaaaacgcttctctacgcggctga

SEQ ID NO: 38674 - DNA, 25 bp, E. coli
gaacatctgtttaccgagcaggcga

SEQ ID NO: 38675 - DNA, 25 bp, E. coli
ggttgagcaaacaaccgcagctgat

SEQ ID NO: 38676 - DNA, 25 bp, E. coli
ggttgagcaaactaccgcagctgat

SEQ ID NO: 38677 - DNA, 25 bp, E. coli
cactagcggcagagctgaagacaag

SEQ ID NO: 38678 - DNA, 25 bp, E. coli
cagaaaaggcgcaggagaaagagca

SEQ ID NO: 38679 - DNA, 25 bp, E. coli
cactagcggcagtgctgaagacaag

SEQ ID NO: 38680 - DNA, 25 bp, E. coli
cagaaaaggcgctggagaaagagca

SEQ ID NO: 38681 - DNA, 25 bp, E. coli
tacaaacacagactagtaacagggc

SEQ ID NO: 38682 - DNA, 25 bp, E. coli
taacagggcatctcaaggtagcgat

SEQ ID NO: 38683 - DNA, 25 bp, E. coli
taaagagattgtagacactagcggc

SEQ ID NO: 38684 - DNA, 25 bp, E. coli
tacaaacacagagtagtaacagggc

SEQ ID NO: 38685 - DNA, 25 bp, E. coli
taaagagattgttgacactagcggc

SEQ ID NO: 38686 - DNA, 25 bp, E. coli
cctactggaaacacaactggcgcag

SEQ ID NO: 38687 - DNA, 25 bp, E. coli
cctactggaaactcaactggcgcag

SEQ ID NO: 38688 - DNA, 25 bp, E. coli
gcagttgcagagtcagcaggcagaa

SEQ ID NO: 38689 - DNA, 25 bp, E. coli
gcagcgtttgtcactgaatgtatcc

SEQ ID NO: 38690 - DNA, 25 bp, E. coli
gaagacaagcaataacaggccgaat

SEQ ID NO: 38691 - DNA, 25 bp, E. coli
gcagcgtttgtctctgaatgtatcc

SEQ ID NO: 38692 - DNA, 25 bp, E. coli
gcagttgcagagacagcaggcagaa

SEQ ID NO: 38693 - DNA, 25 bp, E. coli
gaagacaagcaaaaacaggccgaat

SEQ ID NO: 38694 - DNA, 25 bp, E. coli
cgcgcggataagacagcaaatcatc

SEQ ID NO: 38695 - DNA, 25 bp, E. coli
cgcgcggataagtcagcaaatcatc

SEQ ID NO: 38696 - DNA, 25 bp, E. coli
taacagggcatcacaaggtagcgat

SEQ ID NO: 38697 - DNA, 25 bp, E. coli
gatgttgcttcagaaatcgcgcgga

SEQ ID NO: 38698 - DNA, 25 bp, E. coli
gatgttgcttcacaaatcgcgcgga

SEQ ID NO: 38699 - DNA, 25 bp, E. coli
aacctacatataatgcgcgccccgg

SEQ ID NO: 38700 - DNA, 25 bp, E. coli
aacctacatatattgcgcgccccgg

SEQ ID NO: 38701 - DNA, 25 bp, E. coli
tgaatgtttctttccaccctcacgc

SEQ ID NO: 38702 - DNA, 25 bp, E. coli
tgaatgtttcttaccaccctcacgc

SEQ ID NO: 38703 - DNA, 25 bp, E. coli
tcagatgtcgttaaatgggcaaata

SEQ ID NO: 38704 - DNA, 25 bp, E. coli
tcagatgtcgtttaatgggcaaata

SEQ ID NO: 38705 - DNA, 25 bp, E. coli
gccatcgccgatagacagatttcat

SEQ ID NO: 38706 - DNA, 25 bp, E. coli
gcgccccggaagaagtcagatgtcg

SEQ ID NO: 38707 - DNA, 25 bp, E. coli
gcgccccggaagtagtcagatgtcg

SEQ ID NO: 38708 - DNA, 25 bp, E. coli
gccatcgccgattgacagatttcat

SEQ ID NO: 38709 - DNA, 25 bp, E. coli
cccgggctgaacaggctaaaagctg

SEQ ID NO: 38710 - DNA, 25 bp, E. coli
cctcaaattatttcggcggtaaatg

SEQ ID NO: 38711 - DNA, 25 bp, E. coli
cccgggctgaactggctaaaagctg

SEQ ID NO: 38712 - DNA, 25 bp, E. coli
cctcaaattattacggcggtaaatg

SEQ ID NO: 38713 - DNA, 25 bp, E. coli
cggtaaatgattaagccatcgccga

SEQ ID NO: 38714 - DNA, 25 bp, E. coli
cggtaaatgatttagccatcgccga

SEQ ID NO: 38715 - DNA, 25 bp, E. coli
gatttcattttttcggtcaggcacc

SEQ ID NO: 38716 - DNA, 25 bp, E. coli
gatttcatttttacggtcaggcacc

SEQ ID NO: 38717 - DNA, 25 bp, E. coli
taacttgtgtgtttctttccgccct

SEQ ID NO: 38718 - DNA, 25 bp, E. coli
taacttgtgtgtatctttccgccct

SEQ ID NO: 38719 - DNA, 25 bp, E. coli
gagtaaagcgttgggataatctatc

SEQ ID NO: 38720 - DNA, 25 bp, E. coli
gagtaaagcgttcggataatctatc

SEQ ID NO: 38721 - DNA, 25 bp, E. coli
aatctggttggttgcgcgttacaag

SEQ ID NO: 38722 - DNA, 25 bp, E. coli
aatctggttggtagcgcgttacaag

SEQ ID NO: 38723 - DNA, 25 bp, E. coli
caagcaggtgttaaagtttggcgag

SEQ ID NO: 38724 - DNA, 25 bp, E. coli
caagcaggtgtttaagtttggcgag

SEQ ID NO: 38725 - DNA, 25 bp, E. coli
catctggcggcgcttaaggcctatc

SEQ ID NO: 38726 - DNA, 25 bp, E. coli
catctggcggcggttaaggcctatc

SEQ ID NO: 38727 - DNA, 25 bp, E. coli
tacaaggacgcgaaatgctggtaga

SEQ ID NO: 38728 - DNA, 25 bp, E. coli
tacaaggacgcgtaatgctggtaga

SEQ ID NO: 38729 - DNA, 25 bp, E. coli
ataccgggcgcgttctggcactgtt

SEQ ID NO: 38730 - DNA, 25 bp, E. coli
ataccgggcgcgatctggcactgtt

SEQ ID NO: 38731 - DNA, 25 bp, E. coli
tagatgatgtgatcaccgccggaac

SEQ ID NO: 38732 - DNA, 25 bp, E. coli
tagatgatgtgaacaccgccggaac

SEQ ID NO: 38733 - DNA, 25 bp, E. coli
gcttacaaagggttcccgattgcca

SEQ ID NO: 38734 - DNA, 25 bp, E. coli
gcttacaaagggatcccgattgcca

SEQ ID NO: 38735 - DNA, 25 bp, E. coli
gagttcgatctggtgtttggccctg

SEQ ID NO: 38736 - DNA, 25 bp, E. coli
gagttcgatctgctgtttggccctg

SEQ ID NO: 38737 - DNA, 25 bp, E. coli
gaaagacctgattgcttacctggaa

SEQ ID NO: 38738 - DNA, 25 bp, E. coli
gaaagacctgatagcttacctggaa

SEQ ID NO: 38739 - DNA, 25 bp, E. coli
tcaacgccgggctgtttaataccgg

SEQ ID NO: 38740 - DNA, 25 bp, E. coli
tcaacgccgggcagtttaataccgg

SEQ ID NO: 38741 - DNA, 25 bp, E. coli
gacctgccgtacagctttaaccgca

SEQ ID NO: 38742 - DNA, 25 bp, E. coli
gacctgccgtactgctttaaccgca

SEQ ID NO: 38743 - DNA, 25 bp, E. coli
cagctgtggtcgacggagaaatacc

SEQ ID NO: 38744 - DNA, 25 bp, E. coli
cagctgtggtcgtcggagaaatacc

SEQ ID NO: 38745 - DNA, 25 bp, E. coli
taaaggtctggcttatgaacccgca

SEQ ID NO: 38746 - DNA, 25 bp, E. coli
taaaggtctggcatatgaacccgca

SEQ ID NO: 38747 - DNA, 25 bp, E. coli
tatgaaaaccacctacggcatgtcg

SEQ ID NO: 38748 - DNA, 25 bp, E. coli
tatgaaaaccacgtacggcatgtcg

SEQ ID NO: 38749 - DNA, 25 bp, E. coli
tatcaggtacgttctggctcacacg

SEQ ID NO: 38750 - DNA, 25 bp, E. coli
tataaaggtgcttactggcgtcgcg

SEQ ID NO: 38751 - DNA, 25 bp, E. coli
tataaaggtgctaactggcgtcgcg

SEQ ID NO: 38752 - DNA, 25 bp, E. coli
tatcaggtacgtactggctcacacg

SEQ ID NO: 38753 - DNA, 25 bp, E. coli
tgaacccgcaaccaaaggacagtgg

SEQ ID NO: 38754 - DNA, 25 bp, E. coli
tgcactttgatctgtgggtccccaa

SEQ ID NO: 38755 - DNA, 25 bp, E. coli
tgaacccgcaacgaaaggacagtgg

SEQ ID NO: 38756 - DNA, 25 bp, E. coli
tgcactttgatcagtgggtccccaa

SEQ ID NO: 38757 - DNA, 25 bp, E. coli
tcgcacgtctggtagatggcacgct

SEQ ID NO: 38758 - DNA, 25 bp, E. coli
tcgcacgtctggaagatggcacgct

SEQ ID NO: 38759 - DNA, 25 bp, E. coli
ctttaccagttactcggcggcgcgt

SEQ ID NO: 38760 - DNA, 25 bp, E. coli
ctttaccagttagtcggcggcgcgt

SEQ ID NO: 38761 - DNA, 25 bp, E. coli
gataacggctatttgcatccgggag

SEQ ID NO: 38762 - DNA, 25 bp, E. coli
gataacggctatatgcatccgggag

SEQ ID NO: 38763 - DNA, 25 bp, E. coli
gattcaaagccaaccgcgtgcagtg

SEQ ID NO: 38764 - DNA, 25 bp, E. coli
gattcaaagccatccgcgtgcagtg

SEQ ID NO: 38765 - DNA, 25 bp, E. coli
aataagatggcaatacggaatagcc

SEQ ID NO: 38766 - DNA, 25 bp, E. coli
aatggtggcgacaatgcactaggga

SEQ ID NO: 38767 - DNA, 25 bp, E. coli
aataagatggcattacggaatagcc

SEQ ID NO: 38768 - DNA, 25 bp, E. coli
aatggtggcgactatgcactaggga

SEQ ID NO: 38769 - DNA, 25 bp, E. coli
caaacgggcattgtgttctgaaatc

SEQ ID NO: 38770 - DNA, 25 bp, E. coli
caaacgggcattctgttctgaaatc

SEQ ID NO: 38771 - DNA, 25 bp, E. coli
tagaattatccgcaatggtggcgac

SEQ ID NO: 38772 - DNA, 25 bp, E. coli
tagaattatccggaatggtggcgac

SEQ ID NO: 38773 - DNA, 25 bp, E. coli
actgccggaacatccagcaaacggg

SEQ ID NO: 38774 - DNA, 25 bp, E. coli
actgccggaacaaccagcaaacggg

SEQ ID NO: 38775 - DNA, 25 bp, E. coli
ttgctgaccgcataacatttacgcg

SEQ ID NO: 38776 - DNA, 25 bp, E. coli
ttgctgaccgcaaaacatttacgcg

SEQ ID NO: 38777 - DNA, 25 bp, E. coli
tcattgaacagaacaatggatcccc

SEQ ID NO: 38778 - DNA, 25 bp, E. coli
tcattgaacagatcaatggatcccc

SEQ ID NO: 38779 - DNA, 25 bp, E. coli
gactcctgattcaaatgtatgatgg

SEQ ID NO: 38780 - DNA, 25 bp, E. coli
gactcctgattctaatgtatgatgg

SEQ ID NO: 38781 - DNA, 25 bp, E. coli
gaaatccaggcttttgattcaacgt

SEQ ID NO: 38782 - DNA, 25 bp, E. coli
gaaatccaggctattgattcaacgt

SEQ ID NO: 38783 - DNA, 25 bp, E. coli
gattcaacgtcaccgacagatctgc

SEQ ID NO: 38784 - DNA, 25 bp, E. coli
gattcaacgtcagcgacagatctgc

SEQ ID NO: 38785 - DNA, 25 bp, E. coli
gatctgcgctgttaaagaacttgta

SEQ ID NO: 38786 - DNA, 25 bp, E. coli
gatctgcgctgtaaaagaacttgta

SEQ ID NO: 38787 - DNA, 25 bp, E. coli
aattatcagcaaaacctccacgcgg

SEQ ID NO: 38788 - DNA, 25 bp, E. coli
aattatcagcaatacctccacgcgg

SEQ ID NO: 38789 - DNA, 25 bp, E. coli
caaagcattcgtcctccaggcggat

SEQ ID NO: 38790 - DNA, 25 bp, E. coli
caaagcattcgtgctccaggcggat

SEQ ID NO: 38791 - DNA, 25 bp, E. coli
atttataccgaaatgcacgccagcg

SEQ ID NO: 38792 - DNA, 25 bp, E. coli
atttataccgaattgcacgccagcg

SEQ ID NO: 38793 - DNA, 25 bp, E. coli
tatcgtcaatgtctcttcggtggcc

SEQ ID NO: 38794 - DNA, 25 bp, E. coli
tatcgtcaatgtgtcttcggtggcc

SEQ ID NO: 38795 - DNA, 25 bp, E. coli
ttaagtcgaacaaccccatgcagcg

SEQ ID NO: 38796 - DNA, 25 bp, E. coli
ttaagtcgaacatccccatgcagcg

SEQ ID NO: 38797 - DNA, 25 bp, E. coli
tgaacttaataaggcaagccggtgg

SEQ ID NO: 38798 - DNA, 25 bp, E. coli
tgaacttaataacgcaagccggtgg

SEQ ID NO: 38799 - DNA, 25 bp, E. coli
tcttgtttaccctgtgcaccgttga

SEQ ID NO: 38800 - DNA, 25 bp, E. coli
tcttgtttacccagtgcaccgttga

SEQ ID NO: 38801 - DNA, 25 bp, E. coli
gcagagcgaatcaaccgagtacttt

SEQ ID NO: 38802 - DNA, 25 bp, E. coli
gcagagcgaatctaccgagtacttt

SEQ ID NO: 38803 - DNA, 25 bp, E. coli
cgttgaaaacctaaccgcagagcga

SEQ ID NO: 38804 - DNA, 25 bp, E. coli
cgttgaaaaccttaccgcagagcga

SEQ ID NO: 38805 - DNA, 25 bp, E. coli
gataaagcctctaacgtcacgggaa

SEQ ID NO: 38806 - DNA, 25 bp, E. coli
gataaagcctcttacgtcacgggaa

SEQ ID NO: 38807 - DNA, 25 bp, E. coli
ggcgattgataccttaaccaccgga

SEQ ID NO: 38808 - DNA, 25 bp, E. coli
ggcgattgatacgttaaccaccgga

SEQ ID NO: 38809 - DNA, 25 bp, E. coli
atttctgaatcaccgctgccggtta

SEQ ID NO: 38810 - DNA, 25 bp, E. coli
atttctgaatcagcgctgccggtta

SEQ ID NO: 38811 - DNA, 25 bp, E. coli
aaatttctgaatgagcgctgccggt

SEQ ID NO: 38812 - DNA, 25 bp, E. coli
aaatttctgaatcagcgctgccggt

SEQ ID NO: 38813 - DNA, 25 bp, E. coli
tattgaaatttctgaatcagcgctg

SEQ ID NO: 38814 - DNA, 25 bp, E. coli
tattgaaatttcagaatcagcgctg

SEQ ID NO: 38815 - DNA, 25 bp, E. coli
tgaaatttctgattcagcgctgccg

SEQ ID NO: 38816 - DNA, 25 bp, E. coli
tgaaatttctgaatcagcgctgccg

SEQ ID NO: 38817 - DNA, 25 bp, E. coli
tgaatcagcgctcccggttaaacct

SEQ ID NO: 38818 - DNA, 25 bp, E. coli
tgaatcagcgctgccggttaaacct

SEQ ID NO: 38819 - DNA, 25 bp, E. coli
tgcggttgcggtattgaaatttctg

SEQ ID NO: 38820 - DNA, 25 bp, E. coli
tgcggttgcggttttgaaatttctg

SEQ ID NO: 38821 - DNA, 25 bp, E. coli
tctgaatcagcgctgccggttaaac

SEQ ID NO: 38822 - DNA, 25 bp, E. coli
tctgaatcagcggtgccggttaaac

SEQ ID NO: 38823 - DNA, 25 bp, E. coli
gcggtattgaaaattctgaatcagc

SEQ ID NO: 38824 - DNA, 25 bp, E. coli
gcggtattgaaatttctgaatcagc

SEQ ID NO: 38825 - DNA, 25 bp, E. coli
gaaatttctgaatcagcgctgccgg

SEQ ID NO: 38826 - DNA, 25 bp, E. coli
gaaatttctgaaacagcgctgccgg

SEQ ID NO: 38827 - DNA, 25 bp, E. coli
cggttgcggtattgaaatttctgaa

SEQ ID NO: 38828 - DNA, 25 bp, E. coli
cggttgcggtatagaaatttctgaa

SEQ ID NO: 38829 - DNA, 25 bp, E. coli
ggtattgaaatttctgaatcagcgc

SEQ ID NO: 38830 - DNA, 25 bp, E. coli
ggtattgaaattactgaatcagcgc

SEQ ID NO: 38831 - DNA, 25 bp, E. coli
tatcctcaaaaagaacggtggtctg

SEQ ID NO: 38832 - DNA, 25 bp, E. coli
tatcctcaaaaacaacggtggtctg

SEQ ID NO: 38833 - DNA, 25 bp, E. coli
tatcggcagctagggcatttatcgc

SEQ ID NO: 38834 - DNA, 25 bp, E. coli
tatcggcagctacggcatttatcgc

SEQ ID NO: 38835 - DNA, 25 bp, E. coli
ttgggctgaccccaaagaagtgcat

SEQ ID NO: 38836 - DNA, 25 bp, E. coli
ttgggctgacccgaaagaagtgcat

SEQ ID NO: 38837 - DNA, 25 bp, E. coli
tgtcaacaccggtgaagtgctggcg

SEQ ID NO: 38838 - DNA, 25 bp, E. coli
tgtcaacaccggagaagtgctggcg

SEQ ID NO: 38839 - DNA, 25 bp, E. coli
tgcgggaaaactcggtactcaatac

SEQ ID NO: 38840 - DNA, 25 bp, E. coli
tgcgggaaaactgggtactcaatac

SEQ ID NO: 38841 - DNA, 25 bp, E. coli
gccggacggtcggtacatcaataaa

SEQ ID NO: 38842 - DNA, 25 bp, E. coli
gccggacggtcgctacatcaataaa

SEQ ID NO: 38843 - DNA, 25 bp, E. coli
gcgtggttacaacttatctccccgg

SEQ ID NO: 38844 - DNA, 25 bp, E. coli
gcgtggttacaagttatctccccgg

SEQ ID NO: 38845 - DNA, 25 bp, E. coli
gatatttcttcttctgacagccagg

SEQ ID NO: 38846 - DNA, 25 bp, E. coli
gatatttcttctactgacagccagg

SEQ ID NO: 38847 - DNA, 25 bp, E. coli
gataaatggctttccgggcagccgg

SEQ ID NO: 38848 - DNA, 25 bp, E. coli
gataaatggcttaccgggcagccgg

SEQ ID NO: 38849 - DNA, 25 bp, E. coli
tggtctgacatacagagggccacct

SEQ ID NO: 38850 - DNA, 25 bp, E. coli
tggtctgacatagagagggccacct

SEQ ID NO: 38851 - DNA, 25 bp, E. coli
gagtattgatgaacgcctgcaggcg

SEQ ID NO: 38852 - DNA, 25 bp, E. coli
gagtattgatgatcgcctgcaggcg

SEQ ID NO: 38853 - DNA, 25 bp, E. coli
aatgctgatgccgtgttggaactcc

SEQ ID NO: 38854 - DNA, 25 bp, E. coli
aatgctgatgccctgttggaactcc

SEQ ID NO: 38855 - DNA, 25 bp, E. coli
taaatcagggcaagtcggtcgtaaa

SEQ ID NO: 38856 - DNA, 25 bp, E. coli
taaatcagggcatgtcggtcgtaaa

SEQ ID NO: 38857 - DNA, 25 bp, E. coli
ttgtctaaacaagtggattccgggc

SEQ ID NO: 38858 - DNA, 25 bp, E. coli
ttgtctaaacaactggattccgggc

SEQ ID NO: 38859 - DNA, 25 bp, E. coli
tgatgacacgtgaaccgctgacgct

SEQ ID NO: 38860 - DNA, 25 bp, E. coli
tgatgacacgtgtaccgctgacgct

SEQ ID NO: 38861 - DNA, 25 bp, E. coli
tcgtaaaatatcagcgacgctggcc

SEQ ID NO: 38862 - DNA, 25 bp, E. coli
tcgtaaaatatctgcgacgctggcc

SEQ ID NO: 38863 - DNA, 25 bp, E. coli
tctgccagcggtgaaacggatgaaa

SEQ ID NO: 38864 - DNA, 25 bp, E. coli
tctgccagcggtcaaacggatgaaa

SEQ ID NO: 38865 - DNA, 25 bp, E. coli
gaagctttccatcgcgatctgggca

SEQ ID NO: 38866 - DNA, 25 bp, E. coli
gaagctttccatggcgatctgggca

SEQ ID NO: 38867 - DNA, 25 bp, E. coli
gactctggcagaacaaagcgcagca

SEQ ID NO: 38868 - DNA, 25 bp, E. coli
gactctggcagatcaaagcgcagca

SEQ ID NO: 38869 - DNA, 25 bp, E. coli
cgggcagtaccagcgtgtccttaat

SEQ ID NO: 38870 - DNA, 25 bp, E. coli
cgggcagtaccaccgtgtccttaat

SEQ ID NO: 38871 - DNA, 25 bp, E. coli
gtatcaccagcggatgccagggaat

SEQ ID NO: 38872 - DNA, 25 bp, E. coli
gtatcaccagcgcatgccagggaat

SEQ ID NO: 38873 - DNA, 25 bp, E. coli
ggttctctgacatccgctacggctg

SEQ ID NO: 38874 - DNA, 25 bp, E. coli
ggttctctgacaaccgctacggctg

SEQ ID NO: 38875 - DNA, 25 bp, E. coli
aatgcatgatatgaacgtgacgccg

SEQ ID NO: 38876 - DNA, 25 bp, E. coli
aatgcatgatatcaacgtgacgccg

SEQ ID NO: 38877 - DNA, 25 bp, E. coli
caccgttagcgagggtagatgtgaa

SEQ ID NO: 38878 - DNA, 25 bp, E. coli
caccgttagcgacggtagatgtgaa

SEQ ID NO: 38879 - DNA, 25 bp, E. coli
taacggcgaaatccatgatatcaac

SEQ ID NO: 38880 - DNA, 25 bp, E. coli
aaacctcgacgataacggcgaaatg

SEQ ID NO: 38881 - DNA, 25 bp, E. coli
aaacctcgacgaaaacggcgaaatg

SEQ ID NO: 38882 - DNA, 25 bp, E. coli
tgcatcttaacgtaaacctcgacga

SEQ ID NO: 38883 - DNA, 25 bp, E. coli
tgcatcttaacgaaaacctcgacga

SEQ ID NO: 38884 - DNA, 25 bp, E. coli
tccggtcaccgatgaaacaatgatt

SEQ ID NO: 38885 - DNA, 25 bp, E. coli
tccggtcaccgaagaaacaatgatt

SEQ ID NO: 38886 - DNA, 25 bp, E. coli
gacgccgtttatggacgtgatgttg

SEQ ID NO: 38887 - DNA, 25 bp, E. coli
gacgccgtttatcgacgtgatgttg

SEQ ID NO: 38888 - DNA, 25 bp, E. coli
cgatgaaacaatcattacggcgttg

SEQ ID NO: 38889 - DNA, 25 bp, E. coli
cgatgaaacaatgattacggcgttg

SEQ ID NO: 38890 - DNA, 25 bp, E. coli
gttgaatgcgttaaccgaaggcaag

SEQ ID NO: 38891 - DNA, 25 bp, E. coli
gttgaatgcgtttaccgaaggcaag

SEQ ID NO: 38892 - DNA, 25 bp, E. coli
ggtaacgatccggtcaccgatgaaa

SEQ ID NO: 38893 - DNA, 25 bp, E. coli
ggtaacgatccgctcaccgatgaaa

SEQ ID NO: 38894 - DNA, 25 bp, E. coli
tacggcgttgaatgcgttaaccgaa

SEQ ID NO: 38895 - DNA, 25 bp, E. coli
taacggcgaaatgcatgatatcaac

SEQ ID NO: 38896 - DNA, 25 bp, E. coli
tacggcgttgaaagcgttaaccgaa

SEQ ID NO: 38897 - DNA, 25 bp, E. coli
aatctccaaactctgtcgcaaagcg

SEQ ID NO: 38898 - DNA, 25 bp, E. coli
aatctccaaactgtgtcgcaaagcg

SEQ ID NO: 38899 - DNA, 25 bp, E. coli
actgtgtcgcaatgcggttaagcag

SEQ ID NO: 38900 - DNA, 25 bp, E. coli
actgtgtcgcaaagcggttaagcag

SEQ ID NO: 38901 - DNA, 25 bp, E. coli
agaacgtagcgtacagcgaccacta

SEQ ID NO: 38902 - DNA, 25 bp, E. coli
agaacgtagcgttcagcgaccacta

SEQ ID NO: 38903 - DNA, 25 bp, E. coli
aaactgtgtcgcaaagcggttaagc

SEQ ID NO: 38904 - DNA, 25 bp, E. coli
aaactgtgtcgctaagcggttaagc

SEQ ID NO: 38905 - DNA, 25 bp, E. coli
tagcgttcagcgtccactacctgga

SEQ ID NO: 38906 - DNA, 25 bp, E. coli
tagcgttcagcgaccactacctgga

SEQ ID NO: 38907 - DNA, 25 bp, E. coli
tccaaactgtgtcgcaaagcggtta

SEQ ID NO: 38908 - DNA, 25 bp, E. coli
tccaaactgtgtggcaaagcggtta

SEQ ID NO: 38909 - DNA, 25 bp, E. coli
tctccaaactgtctcgcaaagcggt

SEQ ID NO: 38910 - DNA, 25 bp, E. coli
tctccaaactgtgtcgcaaagcggt

SEQ ID NO: 38911 - DNA, 25 bp, E. coli
gaaatctccaaagtgtgtcgcaaag

SEQ ID NO: 38912 - DNA, 25 bp, E. coli
gaaatctccaaactgtgtcgcaaag

SEQ ID NO: 38913 - DNA, 25 bp, E. coli
cgtgaaatctccaaactgtgtcgca

SEQ ID NO: 38914 - DNA, 25 bp, E. coli
cgtgaaatctcctaactgtgtcgca

SEQ ID NO: 38915 - DNA, 25 bp, E. coli
gtagcgttcagcgaccactacctgg

SEQ ID NO: 38916 - DNA, 25 bp, E. coli
gtagcgttcagccaccactacctgg

SEQ ID NO: 38917 - DNA, 25 bp, E. coli
gagcagaacgtaccgttcagcgacc

SEQ ID NO: 38918 - DNA, 25 bp, E. coli
gagcagaacgtagcgttcagcgacc

SEQ ID NO: 38919 - DNA, 25 bp, E. coli
aattaatgttacttattcagcgggc

SEQ ID NO: 38920 - DNA, 25 bp, E. coli
aattaatgttacatattcagcgggc

SEQ ID NO: 38921 - DNA, 25 bp, E. coli
taaaatacgttattataatgaccaa

SEQ ID NO: 38922 - DNA, 25 bp, E. coli
taaaatacgttaatataatgaccaa

SEQ ID NO: 38923 - DNA, 25 bp, E. coli
attaatgttacatattcagcgggct

SEQ ID NO: 38924 - DNA, 25 bp, E. coli
attaatgttacaaattcagcgggct

SEQ ID NO: 38925 - DNA, 25 bp, E. coli
aatacgttaatataatgaccaataa

SEQ ID NO: 38926 - DNA, 25 bp, E. coli
aatacgttaataaaatgaccaataa

SEQ ID NO: 38927 - DNA, 25 bp, E. coli
ttaatgttacattttcagcgggctg

SEQ ID NO: 38928 - DNA, 25 bp, E. coli
ttaatgttacatattcagcgggctg

SEQ ID NO: 38929 - DNA, 25 bp, E. coli
tgaatgttttttgcccgtattgttc

SEQ ID NO: 38930 - DNA, 25 bp, E. coli
tgaatgttttttccccgtattgttc

SEQ ID NO: 38931 - DNA, 25 bp, E. coli
gaatgttttttgcccgtattgttcg

SEQ ID NO: 38932 - DNA, 25 bp, E. coli
gaatgttttttggccgtattgttcg

SEQ ID NO: 38933 - DNA, 25 bp, E. coli
cgttaatataatgaccaataaatat

SEQ ID NO: 38934 - DNA, 25 bp, E. coli
cgttaatataatcaccaataaatat

SEQ ID NO: 38935 - DNA, 25 bp, E. coli
taattaatgttagatattcagcggg

SEQ ID NO: 38936 - DNA, 25 bp, E. coli
taatgttacatattcagcgggctga

SEQ ID NO: 38937 - DNA, 25 bp, E. coli
taatgttacataatcagcgggctga

SEQ ID NO: 38938 - DNA, 25 bp, E. coli
taattaatgttacatattcagcggg

SEQ ID NO: 38939 - DNA, 25 bp, E. coli
gaccaataaatatttttatcatgaa

SEQ ID NO: 38940 - DNA, 25 bp, E. coli
gaccaataaataattttatcatgaa

SEQ ID NO: 38941 - DNA, 25 bp, E. coli
caatcccgtaggctggataagatgc

SEQ ID NO: 38942 - DNA, 25 bp, E. coli
caatcccgtagggtggataagatgc

SEQ ID NO: 38943 - DNA, 25 bp, E. coli
caatcccgtagggtggataagacgc

SEQ ID NO: 38944 - DNA, 25 bp, E. coli
caatcccgtaggctggataagacgc

SEQ ID NO: 38945 - DNA, 25 bp, E. coli
tacatgtgcaatgccgtaggctgga

SEQ ID NO: 38946 - DNA, 25 bp, E. coli
tagttgttatttattggcggatgcg

SEQ ID NO: 38947 - DNA, 25 bp, E. coli
tagttgttattttttggcggatgcg

SEQ ID NO: 38948 - DNA, 25 bp, E. coli
tacatgtgcaatcccgtaggctgga

SEQ ID NO: 38949 - DNA, 25 bp, E. coli
gcctttactccctgttagttgttat

SEQ ID NO: 38950 - DNA, 25 bp, E. coli
agttgttatttattggcggatgcgg

SEQ ID NO: 38951 - DNA, 25 bp, E. coli
gcctttactcccagttagttgttat

SEQ ID NO: 38952 - DNA, 25 bp, E. coli
agttgttatttaatggcggatgcgg

SEQ ID NO: 38953 - DNA, 25 bp, E. coli
taggctggataacatgcggcaagcg

SEQ ID NO: 38954 - DNA, 25 bp, E. coli
taggctggataagatgcggcaagcg

SEQ ID NO: 38955 - DNA, 25 bp, E. coli
tgtgcaatcccgtaggctggataag

SEQ ID NO: 38956 - DNA, 25 bp, E. coli
tgtgcaatcccgaaggctggataag

SEQ ID NO: 38957 - DNA, 25 bp, E. coli
tgcaatcccgtacgctggataagat

SEQ ID NO: 38958 - DNA, 25 bp, E. coli
tgcaatcccgtaggctggataagat

SEQ ID NO: 38959 - DNA, 25 bp, E. coli
tgcaatcccgtaggctggataagac

SEQ ID NO: 38960 - DNA, 25 bp, E. coli
tgcaatcccgtacgctggataagac

SEQ ID NO: 38961 - DNA, 25 bp, E. coli
ccctgttagttgttatttattggcg

SEQ ID NO: 38962 - DNA, 25 bp, E. coli
ccctgttagttgatatttattggcg

SEQ ID NO: 38963 - DNA, 25 bp, E. coli
aattcccttttatgtgcgcctggcg

SEQ ID NO: 38964 - DNA, 25 bp, E. coli
aattcccttttaagtgcgcctggcg

SEQ ID NO: 38965 - DNA, 25 bp, E. coli
cagtatacctatgttcaggcggcga

SEQ ID NO: 38966 - DNA, 25 bp, E. coli
cagtatacctatcttcaggcggcga

SEQ ID NO: 38967 - DNA, 25 bp, E. coli
tatggatgctgaaaggcagtccgct

SEQ ID NO: 38968 - DNA, 25 bp, E. coli
tatggatgctgataggcagtccgct

SEQ ID NO: 38969 - DNA, 25 bp, E. coli
tattggcctgggtgctcaacaaccg

SEQ ID NO: 38970 - DNA, 25 bp, E. coli
tattggcctgggagctcaacaaccg

SEQ ID NO: 38971 - DNA, 25 bp, E. coli
ttttttcaccgtggctggcgacgca

SEQ ID NO: 38972 - DNA, 25 bp, E. coli
ttttttcaccgtcgctggcgacgca

SEQ ID NO: 38973 - DNA, 25 bp, E. coli
tggtactgacaatggcactggctgc

SEQ ID NO: 38974 - DNA, 25 bp, E. coli
tggtactgacaaaggcactggctgc

SEQ ID NO: 38975 - DNA, 25 bp, E. coli
tgatgctaagcgtggaaacgtccgc

SEQ ID NO: 38976 - DNA, 25 bp, E. coli
tgatgctaagcgaggaaacgtccgc

SEQ ID NO: 38977 - DNA, 25 bp, E. coli
gcaccgatgaagtgggacgcgatct

SEQ ID NO: 38978 - DNA, 25 bp, E. coli
gcaccgatgaagagggacgcgatct

SEQ ID NO: 38979 - DNA, 25 bp, E. coli
cgccggattagtcgtggttgccatt

SEQ ID NO: 38980 - DNA, 25 bp, E. coli
cccgaaagcaggaggaaagcagtca

SEQ ID NO: 38981 - DNA, 25 bp, E. coli
cgccggattagtggtggttgccatt

SEQ ID NO: 38982 - DNA, 25 bp, E. coli
cccgaaagcaggtggaaagcagtca

SEQ ID NO: 38983 - DNA, 25 bp, E. coli
ggcgcgtctcgttggcatctgatca

SEQ ID NO: 38984 - DNA, 25 bp, E. coli
ggcgcgtctcgtaggcatctgatca

SEQ ID NO: 38985 - DNA, 25 bp, E. coli
tattcagtcggctgtgctacgcgcc

SEQ ID NO: 38986 - DNA, 25 bp, E. coli
tattcagtcggcagtgctacgcgcc

SEQ ID NO: 38987 - DNA, 25 bp, E. coli
ttatcggccagtgggctatgacgtc

SEQ ID NO: 38988 - DNA, 25 bp, E. coli
ttattcagtcggcagtgctacgcgc

SEQ ID NO: 38989 - DNA, 25 bp, E. coli
ttattcagtcgggagtgctacgcgc

SEQ ID NO: 38990 - DNA, 25 bp, E. coli
ttatcggccagtcggctatgacgtc

SEQ ID NO: 38991 - DNA, 25 bp, E. coli
tcggccagtcgggtatgacgtcaag

SEQ ID NO: 38992 - DNA, 25 bp, E. coli
tcggccagtcggctatgacgtcaag

SEQ ID NO: 38993 - DNA, 25 bp, E. coli
tcagtcggcagtgctacgcgccagg

SEQ ID NO: 38994 - DNA, 25 bp, E. coli
tcagtcggcagtcctacgcgccagg

SEQ ID NO: 38995 - DNA, 25 bp, E. coli
ccagtcggctatcacgtcaaggaca

SEQ ID NO: 38996 - DNA, 25 bp, E. coli
ccagtcggctatgacgtcaaggaca

SEQ ID NO: 38997 - DNA, 25 bp, E. coli
gcagttcgccgacccggtttatcgg

SEQ ID NO: 38998 - DNA, 25 bp, E. coli
gcagttcgccgagccggtttatcgg

SEQ ID NO: 38999 - DNA, 25 bp, E. coli
cggtttatcggccagtcggctatga

SEQ ID NO: 39000 - DNA, 25 bp, E. coli
cggtttatcggcgagtcggctatga

SEQ ID NO: 39001 - DNA, 25 bp, E. coli
gtcggctatgacctcaaggacatag

SEQ ID NO: 39002 - DNA, 25 bp, E. coli
gtcggctatgacgtcaaggacatag

SEQ ID NO: 39003 - DNA, 25 bp, E. coli
gacccggtttatgggccagtcggct

SEQ ID NO: 39004 - DNA, 25 bp, E. coli
gagcagttcgccgacccggtttatc

SEQ ID NO: 39005 - DNA, 25 bp, E. coli
gacccggtttatcggccagtcggct

SEQ ID NO: 39006 - DNA, 25 bp, E. coli
gagcagttcgcccacccggtttatc

SEQ ID NO: 39007 - DNA, 25 bp, E. coli
tatcgttgccaaactggaagccctg

SEQ ID NO: 39008 - DNA, 25 bp, E. coli
tttaccgactgggaacaggttcagg

SEQ ID NO: 39009 - DNA, 25 bp, E. coli
tatcgttgccaatctggaagccctg

SEQ ID NO: 39010 - DNA, 25 bp, E. coli
tttaccgactggcaacaggttcagg

SEQ ID NO: 39011 - DNA, 25 bp, E. coli
tattactcacttcccgaccgggatt

SEQ ID NO: 39012 - DNA, 25 bp, E. coli
tattactcacttgccgaccgggatt

SEQ ID NO: 39013 - DNA, 25 bp, E. coli
tccacgctgctgaaatggcaaaacg

SEQ ID NO: 39014 - DNA, 25 bp, E. coli
tccacgctgctgtaatggcaaaacg

SEQ ID NO: 39015 - DNA, 25 bp, E. coli
tcaggaagatatcgaaaccgcacag

SEQ ID NO: 39016 - DNA, 25 bp, E. coli
tcaggaagatatggaaaccgcacag

SEQ ID NO: 39017 - DNA, 25 bp, E. coli
cattgatactttgcgctcgtcaggg

SEQ ID NO: 39018 - DNA, 25 bp, E. coli
cattgatactttccgctcgtcaggg

SEQ ID NO: 39019 - DNA, 25 bp, E. coli
ctaccgcctggatgaagtgatggaa

SEQ ID NO: 39020 - DNA, 25 bp, E. coli
ctaccgcctggaagaagtgatggaa

SEQ ID NO: 39021 - DNA, 25 bp, E. coli
gtagaaatcatgagcgccagcgagg

SEQ ID NO: 39022 - DNA, 25 bp, E. coli
gattatccaggaacatcaggccgac

SEQ ID NO: 39023 - DNA, 25 bp, E. coli
gattatccaggatcatcaggccgac

SEQ ID NO: 39024 - DNA, 25 bp, E. coli
gtagaaatcatgtgcgccagcgagg

SEQ ID NO: 39025 - DNA, 25 bp, E. coli
ggaagccctgcaagaacgccatgaa

SEQ ID NO: 39026 - DNA, 25 bp, E. coli
ggaagccctgcatgaacgccatgaa

SEQ ID NO: 39027 - DNA, 25 bp, E. coli
gatcctgatgaccaacgtaacgcct

SEQ ID NO: 39028 - DNA, 25 bp, E. coli
gatcctgatgacgaacgtaacgcct

SEQ ID NO: 39029 - DNA, 25 bp, E. coli
cagtgccagttcgtgtaaagttgag

SEQ ID NO: 39030 - DNA, 25 bp, E. coli
cagtgccagttcctgtaaagttgag

SEQ ID NO: 39031 - DNA, 25 bp, E. coli
tatggcggctctaactccgctttta

SEQ ID NO: 39032 - DNA, 25 bp, E. coli
tatccactccttcacaaagcacagt

SEQ ID NO: 39033 - DNA, 25 bp, E. coli
tatggcggctcttactccgctttta

SEQ ID NO: 39034 - DNA, 25 bp, E. coli
tatccactccttgacaaagcacagt

SEQ ID NO: 39035 - DNA, 25 bp, E. coli
tattacctgttgagataacgcctga

SEQ ID NO: 39036 - DNA, 25 bp, E. coli
tatatcgcggcgtcttccggtaaca

SEQ ID NO: 39037 - DNA, 25 bp, E. coli
tattacctgttgtgataacgcctga

SEQ ID NO: 39038 - DNA, 25 bp, E. coli
tatatcgcggcgacttccggtaaca

SEQ ID NO: 39039 - DNA, 25 bp, E. coli
tgtaaagttgagatccgccacggta

SEQ ID NO: 39040 - DNA, 25 bp, E. coli
tgtaaagttgagttccgccacggta

SEQ ID NO: 39041 - DNA, 25 bp, E. coli
tgagcagaaagaccctatggcggct

SEQ ID NO: 39042 - DNA, 25 bp, E. coli
tgagcagaaagagcctatggcggct

SEQ ID NO: 39043 - DNA, 25 bp, E. coli
tcgcggcgtcttgcggtaacaacct

SEQ ID NO: 39044 - DNA, 25 bp, E. coli
tcgcggcgtcttccggtaacaacct

SEQ ID NO: 39045 - DNA, 25 bp, E. coli
cctgttgagatatcgcctgatgagc

SEQ ID NO: 39046 - DNA, 25 bp, E. coli
cctgttgagataacgcctgatgagc

SEQ ID NO: 39047 - DNA, 25 bp, E. coli
cgcctgatgagcagaaagagcctat

SEQ ID NO: 39048 - DNA, 25 bp, E. coli
cgcctgatgagctgaaagagcctat

SEQ ID NO: 39049 - DNA, 25 bp, E. coli
tcacaaagcacagtcagtgccagtt

SEQ ID NO: 39050 - DNA, 25 bp, E. coli
tcacaaagcacactcagtgccagtt

SEQ ID NO: 39051 - DNA, 25 bp, E. coli
caggagagatattcaggtgcacata

SEQ ID NO: 39052 - DNA, 25 bp, E. coli
caggagagatatacaggtgcacata

SEQ ID NO: 39053 - DNA, 25 bp, E. coli
taaatatagtgcagagttcaccctg

SEQ ID NO: 39054 - DNA, 25 bp, E. coli
taaatatagtgctgagttcaccctg

SEQ ID NO: 39055 - DNA, 25 bp, E. coli
gaatttcaatgcatgtggatcgtcg

SEQ ID NO: 39056 - DNA, 25 bp, E. coli
gaatttcaatgcttgtggatcgtcg

SEQ ID NO: 39057 - DNA, 25 bp, E. coli
gaacacaagtcagtatacatgcagt

SEQ ID NO: 39058 - DNA, 25 bp, E. coli
gaacacaagtcactatacatgcagt

SEQ ID NO: 39059 - DNA, 25 bp, E. coli
gataatgtcacatatgcggcaagga

SEQ ID NO: 39060 - DNA, 25 bp, E. coli
gataatgtcacaaatgcggcaagga

SEQ ID NO: 39061 - DNA, 25 bp, E. coli
ggtcattgatgataaaacgcctatt

SEQ ID NO: 39062 - DNA, 25 bp, E. coli
ggtacaatatatcctcctgatggaa

SEQ ID NO: 39063 - DNA, 25 bp, E. coli
ggtttgaacctaatcctgaacgata

SEQ ID NO: 39064 - DNA, 25 bp, E. coli
gggaaatttcaatggcgcaggattc

SEQ ID NO: 39065 - DNA, 25 bp, E. coli
ggtcattgatgaaaaaacgcctatt

SEQ ID NO: 39066 - DNA, 25 bp, E. coli
ggtacaatatatgctcctgatggaa

SEQ ID NO: 39067 - DNA, 25 bp, E. coli
ggtttgaacctattcctgaacgata

SEQ ID NO: 39068 - DNA, 25 bp, E. coli
gggaaatttcaaaggcgcaggattc

SEQ ID NO: 39069 - DNA, 25 bp, E. coli
taatcatcctgcactacttgaggga

SEQ ID NO: 39070 - DNA, 25 bp, E. coli
taatcatcctgctctacttgaggga

SEQ ID NO: 39071 - DNA, 25 bp, E. coli
gatggcgattttacagtcaaccaaa

SEQ ID NO: 39072 - DNA, 25 bp, E. coli
gatggcgatttttcagtcaaccaaa

SEQ ID NO: 39073 - DNA, 25 bp, E. coli
aattatgcgcaaacacccgcactcg

SEQ ID NO: 39074 - DNA, 25 bp, E. coli
aattatgcgcaatcacccgcactcg

SEQ ID NO: 39075 - DNA, 25 bp, E. coli
caagaacatgaaaatgtcacggaag

SEQ ID NO: 39076 - DNA, 25 bp, E. coli
caagaacatgaatatgtcacggaag

SEQ ID NO: 39077 - DNA, 25 bp, E. coli
taaaaacacttcctgttagaccgca

SEQ ID NO: 39078 - DNA, 25 bp, E. coli
aactcacccaggaggtaagttcagg

SEQ ID NO: 39079 - DNA, 25 bp, E. coli
aactcacccaggtggtaagttcagg

SEQ ID NO: 39080 - DNA, 25 bp, E. coli
aaaactgcccgtagtcggtcagtct

SEQ ID NO: 39081 - DNA, 25 bp, E. coli
aaaactgcccgttgtcggtcagtct

SEQ ID NO: 39082 - DNA, 25 bp, E. coli
ttagaccgcaagaacatgaaaatgt

SEQ ID NO: 39083 - DNA, 25 bp, E. coli
ttagaccgcaagtacatgaaaatgt

SEQ ID NO: 39084 - DNA, 25 bp, E. coli
tgtcacggaagatgtgaaataaacc

SEQ ID NO: 39085 - DNA, 25 bp, E. coli
tgtcacggaagaagtgaaataaacc

SEQ ID NO: 39086 - DNA, 25 bp, E. coli
tgaaataaacctcaactcacccagg

SEQ ID NO: 39087 - DNA, 25 bp, E. coli
tgaaataaacctgaactcacccagg

SEQ ID NO: 39088 - DNA, 25 bp, E. coli
gatcaactatccaggtaataaaaaa

SEQ ID NO: 39089 - DNA, 25 bp, E. coli
gtcggtcagtctaaatgacgttaaa

SEQ ID NO: 39090 - DNA, 25 bp, E. coli
gtgaacccctgatcaactatcctgg

SEQ ID NO: 39091 - DNA, 25 bp, E. coli
gtgaacccctgaacaactatcctgg

SEQ ID NO: 39092 - DNA, 25 bp, E. coli
gtcggtcagtcttaatgacgttaaa

SEQ ID NO: 39093 - DNA, 25 bp, E. coli
taaaaacacttcgtgttagaccgca

SEQ ID NO: 39094 - DNA, 25 bp, E. coli
gatcaactatcctggtaataaaaaa

SEQ ID NO: 39095 - DNA, 25 bp, E. coli
caccagtaactctctttttgtcaag

SEQ ID NO: 39096 - DNA, 25 bp, E. coli
caggcggtttttagttgctggtccg

SEQ ID NO: 39097 - DNA, 25 bp, E. coli
caggcggttttttgttgctggtccg

SEQ ID NO: 39098 - DNA, 25 bp, E. coli
caccagtaactcactttttgtcaag

SEQ ID NO: 39099 - DNA, 25 bp, E. coli
cagtaactctctttttgtcaagcaa

SEQ ID NO: 39100 - DNA, 25 bp, E. coli
cagtaactctctatttgtcaagcaa

SEQ ID NO: 39101 - DNA, 25 bp, E. coli
taccgtagtaatccaagcgcgtctc

SEQ ID NO: 39102 - DNA, 25 bp, E. coli
taccgtagtaatgcaagcgcgtctc

SEQ ID NO: 39103 - DNA, 25 bp, E. coli
tatttagcgtataatcgacaccggc

SEQ ID NO: 39104 - DNA, 25 bp, E. coli
tatttagcgtattatcgacaccggc

SEQ ID NO: 39105 - DNA, 25 bp, E. coli
tgttcggtaataaaataacctggct

SEQ ID NO: 39106 - DNA, 25 bp, E. coli
tgttcggtaatataataacctggct

SEQ ID NO: 39107 - DNA, 25 bp, E. coli
tccagcaggttgtattaccgtagta

SEQ ID NO: 39108 - DNA, 25 bp, E. coli
tccagcaggttgaattaccgtagta

SEQ ID NO: 39109 - DNA, 25 bp, E. coli
tcagcggagacaatactcgccagta

SEQ ID NO: 39110 - DNA, 25 bp, E. coli
cctggcttattagtccgaattcaga

SEQ ID NO: 39111 - DNA, 25 bp, E. coli
cctggcttattactccgaattcaga

SEQ ID NO: 39112 - DNA, 25 bp, E. coli
ccagcaggttgagttgtgttacatg

SEQ ID NO: 39113 - DNA, 25 bp, E. coli
ccagcaggttgacttgtgttacatg

SEQ ID NO: 39114 - DNA, 25 bp, E. coli
tcagcggagacattactcgccagta

SEQ ID NO: 39115 - DNA, 25 bp, E. coli
taatgcaagcgcgtctcagcggaga

SEQ ID NO: 39116 - DNA, 25 bp, E. coli
taatgcaagcgcctctcagcggaga

SEQ ID NO: 39117 - DNA, 25 bp, E. coli
aatttcagccagagcctcgtccatt

SEQ ID NO: 39118 - DNA, 25 bp, E. coli
aatttcagccagtgcctcgtccatt

SEQ ID NO: 39119 - DNA, 25 bp, E. coli
acccacatgctgaactgcacctggg

SEQ ID NO: 39120 - DNA, 25 bp, E. coli
acccacatgctgtactgcacctggg

SEQ ID NO: 39121 - DNA, 25 bp, E. coli
acatgctgtactccacctgggccat

SEQ ID NO: 39122 - DNA, 25 bp, E. coli
acatgctgtactgcacctgggccat

SEQ ID NO: 39123 - DNA, 25 bp, E. coli
tgtactgcacctgggccatgtaagc

SEQ ID NO: 39124 - DNA, 25 bp, E. coli
tgtactgcacctcggccatgtaagc

SEQ ID NO: 39125 - DNA, 25 bp, E. coli
tgctgtactgcacctgggccatgta

SEQ ID NO: 39126 - DNA, 25 bp, E. coli
tgctgtactgcagctgggccatgta

SEQ ID NO: 39127 - DNA, 25 bp, E. coli
tcagccagtgcctcgtccatttttt

SEQ ID NO: 39128 - DNA, 25 bp, E. coli
tcagccagtgccacgtccatttttt

SEQ ID NO: 39129 - DNA, 25 bp, E. coli
tcatagttggcaaagtaccaggcat

SEQ ID NO: 39130 - DNA, 25 bp, E. coli
tcatagttggcatagtaccaggcat

SEQ ID NO: 39131 - DNA, 25 bp, E. coli
gccagtgcctcgtccattttttcga

SEQ ID NO: 39132 - DNA, 25 bp, E. coli
gccagtgcctcgaccattttttcga

SEQ ID NO: 39133 - DNA, 25 bp, E. coli
cgtccattttttcgatgaactccgg

SEQ ID NO: 39134 - DNA, 25 bp, E. coli
cgtccattttttggatgaactccgg

SEQ ID NO: 39135 - DNA, 25 bp, E. coli
ggtcatagttgggaaagtaccaggc

SEQ ID NO: 39136 - DNA, 25 bp, E. coli
ggtcatagttggcaaagtaccaggc

SEQ ID NO: 39137 - DNA, 25 bp, E. coli
tccattttttcgttgaactccggca

SEQ ID NO: 39138 - DNA, 25 bp, E. coli
tccattttttcgatgaactccggca

SEQ ID NO: 39139 - DNA, 25 bp, E. coli
cactggaagcagtgccgatagcaat

SEQ ID NO: 39140 - DNA, 25 bp, E. coli
cactggaagcagagccgatagcaat

SEQ ID NO: 39141 - DNA, 25 bp, E. coli
cactattaccagagaacgcgcggag

SEQ ID NO: 39142 - DNA, 25 bp, E. coli
cactattaccagtgaacgcgcggag

SEQ ID NO: 39143 - DNA, 25 bp, E. coli
taaaacatatgcagatggctggaac

SEQ ID NO: 39144 - DNA, 25 bp, E. coli
tactgagcgaatccctgaaaagagc

SEQ ID NO: 39145 - DNA, 25 bp, E. coli
tactgagcgaatgcctgaaaagagc

SEQ ID NO: 39146 - DNA, 25 bp, E. coli
taaaacatatgctgatggctggaac

SEQ ID NO: 39147 - DNA, 25 bp, E. coli
tattccgcacgctatctcggaggca

SEQ ID NO: 39148 - DNA, 25 bp, E. coli
tattccgcacgcaatctcggaggca

SEQ ID NO: 39149 - DNA, 25 bp, E. coli
ttccggcgcggacgtatagcagtta

SEQ ID NO: 39150 - DNA, 25 bp, E. coli
ttccggcgcggaggtatagcagtta

SEQ ID NO: 39151 - DNA, 25 bp, E. coli
tgaatatcgatagcgaggctgggcc

SEQ ID NO: 39152 - DNA, 25 bp, E. coli
tgaatatcgataccgaggctgggcc

SEQ ID NO: 39153 - DNA, 25 bp, E. coli
tcggcgcacgattacaagtcttcag

SEQ ID NO: 39154 - DNA, 25 bp, E. coli
tcggcgcacgataacaagtcttcag

SEQ ID NO: 39155 - DNA, 25 bp, E. coli
ccgataactctggatggctggataa

SEQ ID NO: 39156 - DNA, 25 bp, E. coli
ccgataactctgcatggctggataa

SEQ ID NO: 39157 - DNA, 25 bp, E. coli
gatcttaggcaaccaacccactgga

SEQ ID NO: 39158 - DNA, 25 bp, E. coli
gatcttaggcaagcaacccactgga

SEQ ID NO: 39159 - DNA, 25 bp, E. coli
taatgtgtttcgtatcgcgctggca

SEQ ID NO: 39160 - DNA, 25 bp, E. coli
taatgtgtttcgaatcgcgctggca

SEQ ID NO: 39161 - DNA, 25 bp, E. coli
catcaacgttcgtcgggtgcgcatt

SEQ ID NO: 39162 - DNA, 25 bp, E. coli
catcaacgttcgacgggtgcgcatt

SEQ ID NO: 39163 - DNA, 25 bp, E. coli
taccaagtttcgttgccacactggg

SEQ ID NO: 39164 - DNA, 25 bp, E. coli
taccaagtttcgatgccacactggg

SEQ ID NO: 39165 - DNA, 25 bp, E. coli
tgaagttccgctcgcggtggcgtgc

SEQ ID NO: 39166 - DNA, 25 bp, E. coli
tgaagttccgctggcggtggcgtgc

SEQ ID NO: 39167 - DNA, 25 bp, E. coli
tgcggcatcaacgttcgtcgggtgc

SEQ ID NO: 39168 - DNA, 25 bp, E. coli
tgcgcggcgtgtataatgtaccaag

SEQ ID NO: 39169 - DNA, 25 bp, E. coli
tgcggcatcaaccttcgtcgggtgc

SEQ ID NO: 39170 - DNA, 25 bp, E. coli
tgcgcggcgtgtttaatgtaccaag

SEQ ID NO: 39171 - DNA, 25 bp, E. coli
ggtcgcggttccctgttcggtacat

SEQ ID NO: 39172 - DNA, 25 bp, E. coli
ggtcgcggttccgtgttcggtacat

SEQ ID NO: 39173 - DNA, 25 bp, E. coli
gcggttccctgtacggtacattgct

SEQ ID NO: 39174 - DNA, 25 bp, E. coli
gcggttccctgttcggtacattgct

SEQ ID NO: 39175 - DNA, 25 bp, E. coli
ccctgttcggtacattgcttggtgt

SEQ ID NO: 39176 - DNA, 25 bp, E. coli
ccctgttcggtagattgcttggtgt

SEQ ID NO: 39177 - DNA, 25 bp, E. coli
cgcggcgtgtttaatgtaccaagtt

SEQ ID NO: 39178 - DNA, 25 bp, E. coli
cgcggcgtgttttatgtaccaagtt

SEQ ID NO: 39179 - DNA, 25 bp, E. coli
cattgcttggtgtgctggtgattac

SEQ ID NO: 39180 - DNA, 25 bp, E. coli
cattgcttggtgagctggtgattac

SEQ ID NO: 39181 - DNA, 25 bp, E. coli
taatgtaccaagtttcgttgccaca

SEQ ID NO: 39182 - DNA, 25 bp, E. coli
taatgtaccaagattcgttgccaca

SEQ ID NO: 39183 - DNA, 25 bp, E. coli
caaatggaggctatgataaagaaac

SEQ ID NO: 39184 - DNA, 25 bp, E. coli
caaatggaggctttgataaagaaac

SEQ ID NO: 39185 - DNA, 25 bp, E. coli
catctgaacagtaaagacagttcga

SEQ ID NO: 39186 - DNA, 25 bp, E. coli
catctgaacagttaagacagttcga

SEQ ID NO: 39187 - DNA, 25 bp, E. coli
tccgcgtgaactggacgaacaacaa

SEQ ID NO: 39188 - DNA, 25 bp, E. coli
tccgcgtgaactcgacgaacaacaa

SEQ ID NO: 39189 - DNA, 25 bp, E. coli
gctatctgggatcccgaaatcgcgc

SEQ ID NO: 39190 - DNA, 25 bp, E. coli
gctatctgggatgccgaaatcgcgc

SEQ ID NO: 39191 - DNA, 25 bp, E. coli
gcacttgctgcacatattaccgacg

SEQ ID NO: 39192 - DNA, 25 bp, E. coli
gcacttgctgcagatattaccgacg

SEQ ID NO: 39193 - DNA, 25 bp, E. coli
gaatcttggcaacctatctgggatg

SEQ ID NO: 39194 - DNA, 25 bp, E. coli
gaatcttggcaagctatctgggatg

SEQ ID NO: 39195 - DNA, 25 bp, E. coli
gacagttcgataagcattgctctac

SEQ ID NO: 39196 - DNA, 25 bp, E. coli
gacagttcgatatgcattgctctac

SEQ ID NO: 39197 - DNA, 25 bp, E. coli
gaaatcgcgcccgaaatggaggctt

SEQ ID NO: 39198 - DNA, 25 bp, E. coli
gacattaaatgtattccgcgtgaac

SEQ ID NO: 39199 - DNA, 25 bp, E. coli
gacattaaatgttttccgcgtgaac

SEQ ID NO: 39200 - DNA, 25 bp, E. coli
gaaatcgcgccccaaatggaggctt

SEQ ID NO: 39201 - DNA, 25 bp, E. coli
cgaacaacaaaaagcagcacttgct

SEQ ID NO: 39202 - DNA, 25 bp, E. coli
cgaacaacaaaatgcagcacttgct

SEQ ID NO: 39203 - DNA, 25 bp, E. coli
gattcaaccagaatcttggcaagct

SEQ ID NO: 39204 - DNA, 25 bp, E. coli
gattcaaccagattcttggcaagct

SEQ ID NO: 39205 - DNA, 25 bp, E. coli
caaaaagtgaagaggtaatggctgc

SEQ ID NO: 39206 - DNA, 25 bp, E. coli
caaaaagtgaagtggtaatggctgc

SEQ ID NO: 39207 - DNA, 25 bp, E. coli
taaaaccatcggctcagaagattag

SEQ ID NO: 39208 - DNA, 25 bp, E. coli
taaagatgaggtcaaacgagaagcc

SEQ ID NO: 39209 - DNA, 25 bp, E. coli
taaaaccatcgggtcagaagattag

SEQ ID NO: 39210 - DNA, 25 bp, E. coli
tgttaaaaaccccactcacattgcg

SEQ ID NO: 39211 - DNA, 25 bp, E. coli
tgttaaaaacccgactcacattgcg

SEQ ID NO: 39212 - DNA, 25 bp, E. coli
tctggttccagatgcatgagggact

SEQ ID NO: 39213 - DNA, 25 bp, E. coli
tctggttccagaagcatgagggact

SEQ ID NO: 39214 - DNA, 25 bp, E. coli
gccattcgagaattattaggtgcgg

SEQ ID NO: 39215 - DNA, 25 bp, E. coli
gccattcgagaaatattaggtgcgg

SEQ ID NO: 39216 - DNA, 25 bp, E. coli
gcgccgtcgcctacattccgagata

SEQ ID NO: 39217 - DNA, 25 bp, E. coli
gcgccgtcgccttcattccgagata

SEQ ID NO: 39218 - DNA, 25 bp, E. coli
gaagacttttttcaacctgtggcac

SEQ ID NO: 39219 - DNA, 25 bp, E. coli
gaagacttttttgaacctgtggcac

SEQ ID NO: 39220 - DNA, 25 bp, E. coli
gaaaggcgtgcttttcggatatcta

SEQ ID NO: 39221 - DNA, 25 bp, E. coli
gaaaggcgtgctattcggatatcta

SEQ ID NO: 39222 - DNA, 25 bp, E. coli
tcacaggactgatcgcatatcaagc

SEQ ID NO: 39223 - DNA, 25 bp, E. coli
taaagatgaggtgaaacgagaagcc

SEQ ID NO: 39224 - DNA, 25 bp, E. coli
tagaccgtttttctatgccattcga

SEQ ID NO: 39225 - DNA, 25 bp, E. coli
tagaccgtttttgtatgccattcga

SEQ ID NO: 39226 - DNA, 25 bp, E. coli
tcacaggactgaacgcatatcaagc

SEQ ID NO: 39227 - DNA, 25 bp, E. coli
cagtctggtcgtaatggctcggcca

SEQ ID NO: 39228 - DNA, 25 bp, E. coli
cagtctggtcgttatggctcggcca

SEQ ID NO: 39229 - DNA, 25 bp, E. coli
tattgaaggtctagagagcggtgaa

SEQ ID NO: 39230 - DNA, 25 bp, E. coli
tatcgcagcagataggaagcaaaaa

SEQ ID NO: 39231 - DNA, 25 bp, E. coli
tatcgcagcagaaaggaagcaaaaa

SEQ ID NO: 39232 - DNA, 25 bp, E. coli
tattgaaggtcttgagagcggtgaa

SEQ ID NO: 39233 - DNA, 25 bp, E. coli
ttacctcagtaaccgttggcgaaca

SEQ ID NO: 39234 - DNA, 25 bp, E. coli
ttattacccggaaggtccagtctgg

SEQ ID NO: 39235 - DNA, 25 bp, E. coli
ttacctcagtaagcgttggcgaaca

SEQ ID NO: 39236 - DNA, 25 bp, E. coli
ttattacccggatggtccagtctgg

SEQ ID NO: 39237 - DNA, 25 bp, E. coli
tgcgttcggcacttcgtctattgga

SEQ ID NO: 39238 - DNA, 25 bp, E. coli
tgcgttcggcacatcgtctattgga

SEQ ID NO: 39239 - DNA, 25 bp, E. coli
ggctcggccagtcaagtaatgcgtt

SEQ ID NO: 39240 - DNA, 25 bp, E. coli
ggctcggccagtgaagtaatgcgtt

SEQ ID NO: 39241 - DNA, 25 bp, E. coli
gaatccagggatcaagctgtcagaa

SEQ ID NO: 39242 - DNA, 25 bp, E. coli
gaatccagggatgaagctgtcagaa

SEQ ID NO: 39243 - DNA, 25 bp, E. coli
ctattggaacaacaagaatccaggg

SEQ ID NO: 39244 - DNA, 25 bp, E. coli
cggtgaaagttcgatgacgcttcgt

SEQ ID NO: 39245 - DNA, 25 bp, E. coli
cggtgaaagttccatgacgcttcgt

SEQ ID NO: 39246 - DNA, 25 bp, E. coli
ctattggaacaagaagaatccaggg

SEQ ID NO: 39247 - DNA, 25 bp, E. coli
gacgcttcgtgatatcgcagcagaa

SEQ ID NO: 39248 - DNA, 25 bp, E. coli
gacgcttcgtgaaatcgcagcagaa

SEQ ID NO: 39249 - DNA, 25 bp, E. coli
cataaaaatgtcaaagtccgtgcgg

SEQ ID NO: 39250 - DNA, 25 bp, E. coli
cataaaaatgtctaagtccgtgcgg

SEQ ID NO: 39251 - DNA, 25 bp, E. coli
tactgctggcatacgtgggacaaag

SEQ ID NO: 39252 - DNA, 25 bp, E. coli
tactgaacggcgaacgtgacaggct

SEQ ID NO: 39253 - DNA, 25 bp, E. coli
taaatcagagccaacccgaaaggtc

SEQ ID NO: 39254 - DNA, 25 bp, E. coli
tactgctggcattcgtgggacaaag

SEQ ID NO: 39255 - DNA, 25 bp, E. coli
taaatcagagcctacccgaaaggtc

SEQ ID NO: 39256 - DNA, 25 bp, E. coli
tactgaacggcgtacgtgacaggct

SEQ ID NO: 39257 - DNA, 25 bp, E. coli
aacagggctgcgtcaatctgctggc

SEQ ID NO: 39258 - DNA, 25 bp, E. coli
aacagggctgcgacaatctgctggc

SEQ ID NO: 39259 - DNA, 25 bp, E. coli
tatgctgagaggacgttatgcgccg

SEQ ID NO: 39260 - DNA, 25 bp, E. coli
tatgctgagaggtcgttatgcgccg

SEQ ID NO: 39261 - DNA, 25 bp, E. coli
tatcgtgcggcggataatgaaaccg

SEQ ID NO: 39262 - DNA, 25 bp, E. coli
tatcgtgcggcgcataatgaaaccg

SEQ ID NO: 39263 - DNA, 25 bp, E. coli
cctatgcgctggagaatgaacctac

SEQ ID NO: 39264 - DNA, 25 bp, E. coli
cctatgcgctggtgaatgaacctac

SEQ ID NO: 39265 - DNA, 25 bp, E. coli
cattaactattatcgcgccgcaggt

SEQ ID NO: 39266 - DNA, 25 bp, E. coli
cattaactattaacgcgccgcaggt

SEQ ID NO: 39267 - DNA, 25 bp, E. coli
ggaatcgcgtaatgccaaaggccct

SEQ ID NO: 39268 - DNA, 25 bp, E. coli
ggaatcgcgtaaagccaaaggccct

SEQ ID NO: 39269 - DNA, 25 bp, E. coli
tcagcctgtggagtaaaaccgggtt

SEQ ID NO: 39270 - DNA, 25 bp, E. coli
tcagcctgtggactaaaaccgggtt

SEQ ID NO: 39271 - DNA, 25 bp, E. coli
caaattgccgtgctgataacttacc

SEQ ID NO: 39272 - DNA, 25 bp, E. coli
caaattgccgtggtgataacttacc

SEQ ID NO: 39273 - DNA, 25 bp, E. coli
caggagtctggtggtcatagtgtca

SEQ ID NO: 39274 - DNA, 25 bp, E. coli
caggagtctggtcgtcatagtgtca

SEQ ID NO: 39275 - DNA, 25 bp, E. coli
taaatcccggttggcaatgctacac

SEQ ID NO: 39276 - DNA, 25 bp, E. coli
taaatcccggttcgcaatgctacac

SEQ ID NO: 39277 - DNA, 25 bp, E. coli
tatgtcagcacatgaaaaggtcggt

SEQ ID NO: 39278 - DNA, 25 bp, E. coli
tatgtcagcacaagaaaaggtcggt

SEQ ID NO: 39279 - DNA, 25 bp, E. coli
tttatgcgggtttgccagggcaagc

SEQ ID NO: 39280 - DNA, 25 bp, E. coli
tttatgcgggttagccagggcaagc

SEQ ID NO: 39281 - DNA, 25 bp, E. coli
tgtcaggcgggaacgaaaaagaact

SEQ ID NO: 39282 - DNA, 25 bp, E. coli
tgtcaggcgggatcgaaaaagaact

SEQ ID NO: 39283 - DNA, 25 bp, E. coli
gaacaatcatcattagctggcgact

SEQ ID NO: 39284 - DNA, 25 bp, E. coli
gaacaatcatcaatagctggcgact

SEQ ID NO: 39285 - DNA, 25 bp, E. coli
cattactgctgactgcatgcgccca

SEQ ID NO: 39286 - DNA, 25 bp, E. coli
cattactgctgagtgcatgcgccca

SEQ ID NO: 39287 - DNA, 25 bp, E. coli
gattattgagttacgacgctgccag

SEQ ID NO: 39288 - DNA, 25 bp, E. coli
gattattgagtttcgacgctgccag

SEQ ID NO: 39289 - DNA, 25 bp, E. coli
ggcgactggttagtgacccctaaag

SEQ ID NO: 39290 - DNA, 25 bp, E. coli
ggcgactggttactgacccctaaag

SEQ ID NO: 39291 - DNA, 25 bp, E. coli
gacgctgccagtgagaaaattgcca

SEQ ID NO: 39292 - DNA, 25 bp, E. coli
gacgctgccagtcagaaaattgcca

SEQ ID NO: 39293 - DNA, 25 bp, E. coli
caaagtggcaattacgcatagtttc

SEQ ID NO: 39294 - DNA, 25 bp, E. coli
caaagtggcaataacgcatagtttc

SEQ ID NO: 39295 - DNA, 25 bp, E. coli
ttaagcgcacgatacacagaaatca

SEQ ID NO: 39296 - DNA, 25 bp, E. coli
ttaagcgcacgaaacacagaaatca

SEQ ID NO: 39297 - DNA, 25 bp, E. coli
tgtacggtacttgatggaacagagt

SEQ ID NO: 39298 - DNA, 25 bp, E. coli
tgtacggtacttcatggaacagagt

SEQ ID NO: 39299 - DNA, 25 bp, E. coli
tctgattacagaaggcaaagtggca

SEQ ID NO: 39300 - DNA, 25 bp, E. coli
tctgattacagatggcaaagtggca

SEQ ID NO: 39301 - DNA, 25 bp, E. coli
gcatagtttccccataaagacgcga

SEQ ID NO: 39302 - DNA, 25 bp, E. coli
gcatagtttcccgataaagacgcga

SEQ ID NO: 39303 - DNA, 25 bp, E. coli
gcgacatcccgcttaaggcattttt

SEQ ID NO: 39304 - DNA, 25 bp, E. coli
gcgacatcccgcataaggcattttt

SEQ ID NO: 39305 - DNA, 25 bp, E. coli
gaagcgtgagactcgattaagcgca

SEQ ID NO: 39306 - DNA, 25 bp, E. coli
gaagcgtgagacacgattaagcgca

SEQ ID NO: 39307 - DNA, 25 bp, E. coli
gataaagacgcgttagcgacatccc

SEQ ID NO: 39308 - DNA, 25 bp, E. coli
gataaagacgcgatagcgacatccc

SEQ ID NO: 39309 - DNA, 25 bp, E. coli
gggacaatttgctcactgaagcgtg

SEQ ID NO: 39310 - DNA, 25 bp, E. coli
gggacaatttgcacactgaagcgtg

SEQ ID NO: 39311 - DNA, 25 bp, E. coli
ggaacagagtttttgaccttgcgaa

SEQ ID NO: 39312 - DNA, 25 bp, E. coli
ggaacagagtttatgaccttgcgaa

SEQ ID NO: 39313 - DNA, 25 bp, E. coli
gaccttgcgaatcgtgatgtctgtt

SEQ ID NO: 39314 - DNA, 25 bp, E. coli
gaccttgcgaatggtgatgtctgtt

SEQ ID NO: 39315 - DNA, 25 bp, E. coli
caagttaagtttgtcgctgccagcg

SEQ ID NO: 39316 - DNA, 25 bp, E. coli
caagttaagtttctcgctgccagcg

SEQ ID NO: 39317 - DNA, 25 bp, E. coli
taaatatgtcggtattggcctgctg

SEQ ID NO: 39318 - DNA, 25 bp, E. coli
taaatatgtcggaattggcctgctg

SEQ ID NO: 39319 - DNA, 25 bp, E. coli
attatctccgcgtaaggccagacgg

SEQ ID NO: 39320 - DNA, 25 bp, E. coli
attatctccgcgaaaggccagacgg

SEQ ID NO: 39321 - DNA, 25 bp, E. coli
tatcgaaaggaagaagtcaatgcgc

SEQ ID NO: 39322 - DNA, 25 bp, E. coli
tatcgaaaggaacaagtcaatgcgc

SEQ ID NO: 39323 - DNA, 25 bp, E. coli
tgggtaacgtgggtaatcaactgct

SEQ ID NO: 39324 - DNA, 25 bp, E. coli
tgggtaacgtggctaatcaactgct

SEQ ID NO: 39325 - DNA, 25 bp, E. coli
tgctggcgaagcgtctggaagatca

SEQ ID NO: 39326 - DNA, 25 bp, E. coli
tgccagcggataagaccgaccagag

SEQ ID NO: 39327 - DNA, 25 bp, E. coli
tgctggcgaagcctctggaagatca

SEQ ID NO: 39328 - DNA, 25 bp, E. coli
tgccagcggatatgaccgaccagag

SEQ ID NO: 39329 - DNA, 25 bp, E. coli
gaaagcagtcatggtcatcatgggc

SEQ ID NO: 39330 - DNA, 25 bp, E. coli
gaaagcagtcatcgtcatcatgggc

SEQ ID NO: 39331 - DNA, 25 bp, E. coli
gggaatcccgtctacctgcttgatg

SEQ ID NO: 39332 - DNA, 25 bp, E. coli
gggaatcccgtcaacctgcttgatg

SEQ ID NO: 39333 - DNA, 25 bp, E. coli
tggaagatcagcaacgtagccgcga

SEQ ID NO: 39334 - DNA, 25 bp, E. coli
tggaagatcagctacgtagccgcga

SEQ ID NO: 39335 - DNA, 25 bp, E. coli
taacatgcatgtctggtccgacgcc

SEQ ID NO: 39336 - DNA, 25 bp, E. coli
taacatgcatgtgtggtccgacgcc

SEQ ID NO: 39337 - DNA, 25 bp, E. coli
cactgtgatgagttcgatgacgagc

SEQ ID NO: 39338 - DNA, 25 bp, E. coli
cactgtgatgagatcgatgacgagc

SEQ ID NO: 39339 - DNA, 25 bp, E. coli
catcgacgttcagtgtgatgagatc

SEQ ID NO: 39340 - DNA, 25 bp, E. coli
catcgacgttcactgtgatgagatc

SEQ ID NO: 39341 - DNA, 25 bp, E. coli
taactgcgctgatagcaatgctgga

SEQ ID NO: 39342 - DNA, 25 bp, E. coli
tacccatgtcgatgtttcggatgca

SEQ ID NO: 39343 - DNA, 25 bp, E. coli
tacccatgtcgaagtttcggatgca

SEQ ID NO: 39344 - DNA, 25 bp, E. coli
tgtttcggatgcaacgctaactgcg

SEQ ID NO: 39345 - DNA, 25 bp, E. coli
tgtttcggatgctacgctaactgcg

SEQ ID NO: 39346 - DNA, 25 bp, E. coli
gccattgatgcgcaatccggcgtga

SEQ ID NO: 39347 - DNA, 25 bp, E. coli
gccattgatgcggaatccggcgtga

SEQ ID NO: 39348 - DNA, 25 bp, E. coli
gcaatccggcgtgatgcccataact

SEQ ID NO: 39349 - DNA, 25 bp, E. coli
gcaatccggcgtcatgcccataact

SEQ ID NO: 39350 - DNA, 25 bp, E. coli
cgagcagtcgcggtttgtcgaaacc

SEQ ID NO: 39351 - DNA, 25 bp, E. coli
cgagcagtcgcgctttgtcgaaacc

SEQ ID NO: 39352 - DNA, 25 bp, E. coli
cggcgtgatgccgataactgaaaac

SEQ ID NO: 39353 - DNA, 25 bp, E. coli
cggcgtgatgcccataactgaaaac

SEQ ID NO: 39354 - DNA, 25 bp, E. coli
gatcgatgacgaccagtcgcgcttt

SEQ ID NO: 39355 - DNA, 25 bp, E. coli
taactgcgctgaaagcaatgctgga

SEQ ID NO: 39356 - DNA, 25 bp, E. coli
gatgcaacgctatctgcgctgaaag

SEQ ID NO: 39357 - DNA, 25 bp, E. coli
gatcgatgacgagcagtcgcgcttt

SEQ ID NO: 39358 - DNA, 25 bp, E. coli
gatgcaacgctaactgcgctgaaag

SEQ ID NO: 39359 - DNA, 25 bp, E. coli
caccgaccaggttgtattatgcaaa

SEQ ID NO: 39360 - DNA, 25 bp, E. coli
caccgaccaggtagtattatgcaaa

SEQ ID NO: 39361 - DNA, 25 bp, E. coli
taaagtcgcattaacggcgctgaat

SEQ ID NO: 39362 - DNA, 25 bp, E. coli
taaagtcgcatttacggcgctgaat

SEQ ID NO: 39363 - DNA, 25 bp, E. coli
tttccgcaggatgttcaccgaccag

SEQ ID NO: 39364 - DNA, 25 bp, E. coli
tttccgcaggatcttcaccgaccag

SEQ ID NO: 39365 - DNA, 25 bp, E. coli
tttctgcgcgctaccgatttcaacg

SEQ ID NO: 39366 - DNA, 25 bp, E. coli
tttctgcgcgcttccgatttcaacg

SEQ ID NO: 39367 - DNA, 25 bp, E. coli
tgtattatgcaatcagcctctgaga

SEQ ID NO: 39368 - DNA, 25 bp, E. coli
tgtattatgcaaacagcctctgaga

SEQ ID NO: 39369 - DNA, 25 bp, E. coli
tgataccgggcagctacgcaatttt

SEQ ID NO: 39370 - DNA, 25 bp, E. coli
tgataccgggcacctacgcaatttt

SEQ ID NO: 39371 - DNA, 25 bp, E. coli
gcctctgagataggaaaaattgtgg

SEQ ID NO: 39372 - DNA, 25 bp, E. coli
gcctctgagatacgaaaaattgtgg

SEQ ID NO: 39373 - DNA, 25 bp, E. coli
gctacgcaatttactttccgcagga

SEQ ID NO: 39374 - DNA, 25 bp, E. coli
gctacgcaattttctttccgcagga

SEQ ID NO: 39375 - DNA, 25 bp, E. coli
gctaccgatttcaacgccctggagc

SEQ ID NO: 39376 - DNA, 25 bp, E. coli
gctaccgatttctacgccctggagc

SEQ ID NO: 39377 - DNA, 25 bp, E. coli
cgaaaaattgtgcttaaagtcgcat

SEQ ID NO: 39378 - DNA, 25 bp, E. coli
cgaaaaattgtggttaaagtcgcat

SEQ ID NO: 39379 - DNA, 25 bp, E. coli
taaccacacgcgaagcggtggtaaa

SEQ ID NO: 39380 - DNA, 25 bp, E. coli
taaccacacgcgtagcggtggtaaa

SEQ ID NO: 39381 - DNA, 25 bp, E. coli
tactatcgtttaggtgcgctgaatg

SEQ ID NO: 39382 - DNA, 25 bp, E. coli
tactatcgtttacgtgcgctgaatg

SEQ ID NO: 39383 - DNA, 25 bp, E. coli
tactagtaaacaagaagttagcctc

SEQ ID NO: 39384 - DNA, 25 bp, E. coli
tactagtaaacatgaagttagcctc

SEQ ID NO: 39385 - DNA, 25 bp, E. coli
taggccaacgcatttcatatagccg

SEQ ID NO: 39386 - DNA, 25 bp, E. coli
taggccaacgcaattcatatagccg

SEQ ID NO: 39387 - DNA, 25 bp, E. coli
tgacactgcgtctatcgaacacatt

SEQ ID NO: 39388 - DNA, 25 bp, E. coli
tgacactgcgtcaatcgaacacatt

SEQ ID NO: 39389 - DNA, 25 bp, E. coli
gccgttgataccaaatgtgattaca

SEQ ID NO: 39390 - DNA, 25 bp, E. coli
ccagtgtggcgttcagtaagataaa

SEQ ID NO: 39391 - DNA, 25 bp, E. coli
ccagtgtggcgtacagtaagataaa

SEQ ID NO: 39392 - DNA, 25 bp, E. coli
gcgccctgaattctggtaaaaaaca

SEQ ID NO: 39393 - DNA, 25 bp, E. coli
gcgccctgaattgtggtaaaaaaca

SEQ ID NO: 39394 - DNA, 25 bp, E. coli
gccgttgatacctaatgtgattaca

SEQ ID NO: 39395 - DNA, 25 bp, E. coli
gctgaatgaatctgcgccctgaatt

SEQ ID NO: 39396 - DNA, 25 bp, E. coli
gctgaatgaatcagcgccctgaatt

SEQ ID NO: 39397 - DNA, 25 bp, E. coli
gaacacatttttggccagtgtggcg

SEQ ID NO: 39398 - DNA, 25 bp, E. coli
gaacacatttttcgccagtgtggcg

SEQ ID NO: 39399 - DNA, 25 bp, E. coli
cattccatgctaatataggccaacg

SEQ ID NO: 39400 - DNA, 25 bp, E. coli
cattccatgctattataggccaacg

SEQ ID NO: 39401 - DNA, 25 bp, E. coli
gataaagccgctacgcattccatgc

SEQ ID NO: 39402 - DNA, 25 bp, E. coli
gataaagccgcttcgcattccatgc

SEQ ID NO: 39403 - DNA, 25 bp, E. coli
aatcggttggtttaatgacgcagcc

SEQ ID NO: 39404 - DNA, 25 bp, E. coli
aatcggttggttaaatgacgcagcc

SEQ ID NO: 39405 - DNA, 25 bp, E. coli
caggcggtgagcagtaacgataatc

SEQ ID NO: 39406 - DNA, 25 bp, E. coli
caggcggtgagctgtaacgataatc

SEQ ID NO: 39407 - DNA, 25 bp, E. coli
aaaacggtctttgtgatcggtggcg

SEQ ID NO: 39408 - DNA, 25 bp, E. coli
aaaacggtctttctgatcggtggcg

SEQ ID NO: 39409 - DNA, 25 bp, E. coli
taccgttgctggacgtactgctggt

SEQ ID NO: 39410 - DNA, 25 bp, E. coli
taccgttgctggtcgtactgctggt

SEQ ID NO: 39411 - DNA, 25 bp, E. coli
tcatcacccagaccgtggaggtcga

SEQ ID NO: 39412 - DNA, 25 bp, E. coli
tctggtattggtcagtacaccgtgg

SEQ ID NO: 39413 - DNA, 25 bp, E. coli
tctggtattggtgagtacaccgtgg

SEQ ID NO: 39414 - DNA, 25 bp, E. coli
tcatcacccagagcgtggaggtcga

SEQ ID NO: 39415 - DNA, 25 bp, E. coli
gatcggtggcgctaaagatgtgcct

SEQ ID NO: 39416 - DNA, 25 bp, E. coli
gatcggtggcgcaaaagatgtgcct

SEQ ID NO: 39417 - DNA, 25 bp, E. coli
tggcggaagtgtccagccgtttcaa

SEQ ID NO: 39418 - DNA, 25 bp, E. coli
tggagcgtttacgaccagagcaggt

SEQ ID NO: 39419 - DNA, 25 bp, E. coli
tggagcgtttaccaccagagcaggt

SEQ ID NO: 39420 - DNA, 25 bp, E. coli
tggcggaagtgtgcagccgtttcaa

SEQ ID NO: 39421 - DNA, 25 bp, E. coli
gacgctactgaaacacaggcggtga

SEQ ID NO: 39422 - DNA, 25 bp, E. coli
gaggtcgtcgcgttctcaagtccga

SEQ ID NO: 39423 - DNA, 25 bp, E. coli
gacgctactgaatcacaggcggtga

SEQ ID NO: 39424 - DNA, 25 bp, E. coli
gaggtcgtcgcgatctcaagtccga

SEQ ID NO: 39425 - DNA, 25 bp, E. coli
caccatctgggacgaatgggccgat

SEQ ID NO: 39426 - DNA, 25 bp, E. coli
caccatctgggaggaatgggccgat

SEQ ID NO: 39427 - DNA, 25 bp, E. coli
catatgatggcgcagcagtgcgatc

SEQ ID NO: 39428 - DNA, 25 bp, E. coli
catatgatggcggagcagtgcgatc

SEQ ID NO: 39429 - DNA, 25 bp, E. coli
tttcagcgtggatcgtaggcgaact

SEQ ID NO: 39430 - DNA, 25 bp, E. coli
tttcagcgtggaacgtaggcgaact

SEQ ID NO: 39431 - DNA, 25 bp, E. coli
tgtatggtaaactgtggcgcgcctg

SEQ ID NO: 39432 - DNA, 25 bp, E. coli
tgtatggtaaacagtggcgcgcctg

SEQ ID NO: 39433 - DNA, 25 bp, E. coli
tgaaccagctgaaaaacgacccgga

SEQ ID NO: 39434 - DNA, 25 bp, E. coli
tgaaccagctgataaacgacccgga

SEQ ID NO: 39435 - DNA, 25 bp, E. coli
tctatgtggcagtcggcaaactctc

SEQ ID NO: 39436 - DNA, 25 bp, E. coli
tctatgtggcagacggcaaactctc

SEQ ID NO: 39437 - DNA, 25 bp, E. coli
gccagctttatctgcgctcctgtga

SEQ ID NO: 39438 - DNA, 25 bp, E. coli
gccagctttatcagcgctcctgtga

SEQ ID NO: 39439 - DNA, 25 bp, E. coli
gactaccgtttccaagactttgaga

SEQ ID NO: 39440 - DNA, 25 bp, E. coli
gactaccgtttcgaagactttgaga

SEQ ID NO: 39441 - DNA, 25 bp, E. coli
cgtccgctgccgtagttgattatca

SEQ ID NO: 39442 - DNA, 25 bp, E. coli
cgtccgctgccgaagttgattatca

SEQ ID NO: 39443 - DNA, 25 bp, E. coli
ggcacacagaaatacgaccgtaccg

SEQ ID NO: 39444 - DNA, 25 bp, E. coli
ggcacacagaaaaacgaccgtaccg

SEQ ID NO: 39445 - DNA, 25 bp, E. coli
gatggattcccggtggtgacaacta

SEQ ID NO: 39446 - DNA, 25 bp, E. coli
gatggattcccgctggtgacaacta

SEQ ID NO: 39447 - DNA, 25 bp, E. coli
taaacgctcgccgtatcgtgtcacg

SEQ ID NO: 39448 - DNA, 25 bp, E. coli
taaacgctcgccctatcgtgtcacg

SEQ ID NO: 39449 - DNA, 25 bp, E. coli
agaaggaacctggatcacgcgtggc

SEQ ID NO: 39450 - DNA, 25 bp, E. coli
agaaggaacctgcatcacgcgtggc

SEQ ID NO: 39451 - DNA, 25 bp, E. coli
tatctcaatcaattgcgcctcggac

SEQ ID NO: 39452 - DNA, 25 bp, E. coli
tatctcaatcaaatgcgcctcggac

SEQ ID NO: 39453 - DNA, 25 bp, E. coli
tgtggcgagtccatgttcagccgga

SEQ ID NO: 39454 - DNA, 25 bp, E. coli
tgtggcgagtccttgttcagccgga

SEQ ID NO: 39455 - DNA, 25 bp, E. coli
tgccaggtcctttacgatcacacag

SEQ ID NO: 39456 - DNA, 25 bp, E. coli
tgccaggtccttaacgatcacacag

SEQ ID NO: 39457 - DNA, 25 bp, E. coli
tcaggtcattgaaggctgtgccagc

SEQ ID NO: 39458 - DNA, 25 bp, E. coli
tcaggtcattgatggctgtgccagc

SEQ ID NO: 39459 - DNA, 25 bp, E. coli
gcgcggtgctatcgccagaatcact

SEQ ID NO: 39460 - DNA, 25 bp, E. coli
gccagcgatcgccaagaaggaacct

SEQ ID NO: 39461 - DNA, 25 bp, E. coli
gccagcgatcgcgaagaaggaacct

SEQ ID NO: 39462 - DNA, 25 bp, E. coli
gcgcggtgctatggccagaatcact

SEQ ID NO: 39463 - DNA, 25 bp, E. coli
gaatcactgcatttcagccgtagta

SEQ ID NO: 39464 - DNA, 25 bp, E. coli
gaatcactgcatatcagccgtagta

SEQ ID NO: 39465 - DNA, 25 bp, E. coli
cattacgtgagcgtaacggcctgct

SEQ ID NO: 39466 - DNA, 25 bp, E. coli
cattacgtgagcctaacggcctgct

SEQ ID NO: 39467 - DNA, 25 bp, E. coli
gtggcccagggatcgctattttgtg

SEQ ID NO: 39468 - DNA, 25 bp, E. coli
gtggcccagggaacgctattttgtg

SEQ ID NO: 39469 - DNA, 25 bp, E. coli
caccattgatcggattgcagttcga

SEQ ID NO: 39470 - DNA, 25 bp, E. coli
caccattgatcgcattgcagttcga

SEQ ID NO: 39471 - DNA, 25 bp, E. coli
tacagccttcctgaaacgctgacgg

SEQ ID NO: 39472 - DNA, 25 bp, E. coli
tacagccttcctcaaacgctgacgg

SEQ ID NO: 39473 - DNA, 25 bp, E. coli
agataagaaccattcagcagaacgg

SEQ ID NO: 39474 - DNA, 25 bp, E. coli
agataagaaccaatcagcagaacgg

SEQ ID NO: 39475 - DNA, 25 bp, E. coli
acatatcgcactggaggctcatact

SEQ ID NO: 39476 - DNA, 25 bp, E. coli
acatatcgcactcgaggctcatact

SEQ ID NO: 39477 - DNA, 25 bp, E. coli
tgcatacgcaccattgatcgcattg

SEQ ID NO: 39478 - DNA, 25 bp, E. coli
tgcatacgcacctttgatcgcattg

SEQ ID NO: 39479 - DNA, 25 bp, E. coli
tcccgtgcagataagaaccattcag

SEQ ID NO: 39480 - DNA, 25 bp, E. coli
tccggtgtggcaggtggagctgtcg

SEQ ID NO: 39481 - DNA, 25 bp, E. coli
tcccgtgcagattagaaccattcag

SEQ ID NO: 39482 - DNA, 25 bp, E. coli
tccggtgtggcacgtggagctgtcg

SEQ ID NO: 39483 - DNA, 25 bp, E. coli
gcattgcagttcgatatttcaccct

SEQ ID NO: 39484 - DNA, 25 bp, E. coli
gcattgcagttccatatttcaccct

SEQ ID NO: 39485 - DNA, 25 bp, E. coli
ctggtctgctggctcttcccgtgca

SEQ ID NO: 39486 - DNA, 25 bp, E. coli
ctggtctgctgggtcttcccgtgca

SEQ ID NO: 39487 - DNA, 25 bp, E. coli
tggctcttcccgagcagataagaac

SEQ ID NO: 39488 - DNA, 25 bp, E. coli
tggctcttcccgtgcagataagaac

SEQ ID NO: 39489 - DNA, 25 bp, E. coli
gaggctcatactattgactctgtaa

SEQ ID NO: 39490 - DNA, 25 bp, E. coli
gaggctcatacttttgactctgtaa

SEQ ID NO: 39491 - DNA, 25 bp, E. coli
taaaagcggcgcaacgactgaaaga

SEQ ID NO: 39492 - DNA, 25 bp, E. coli
taaaagcggcgctacgactgaaaga

SEQ ID NO: 39493 - DNA, 25 bp, E. coli
tatctggtcaacgtcgcggtactga

SEQ ID NO: 39494 - DNA, 25 bp, E. coli
tacgcggcgatgtgaaagccctttt

SEQ ID NO: 39495 - DNA, 25 bp, E. coli
tacgcggcgatgagaaagccctttt

SEQ ID NO: 39496 - DNA, 25 bp, E. coli
tatcagcaagaacccgtggatgcca

SEQ ID NO: 39497 - DNA, 25 bp, E. coli
tatcagcaagaagccgtggatgcca

SEQ ID NO: 39498 - DNA, 25 bp, E. coli
tatctggtcaacctcgcggtactga

SEQ ID NO: 39499 - DNA, 25 bp, E. coli
tttaccaacaaattgtcgggcgcgg

SEQ ID NO: 39500 - DNA, 25 bp, E. coli
tttaccaacaaaatgtcgggcgcgg

SEQ ID NO: 39501 - DNA, 25 bp, E. coli
tctacgcgccggtagttggtacacc

SEQ ID NO: 39502 - DNA, 25 bp, E. coli
tctacgcgccggaagttggtacacc

SEQ ID NO: 39503 - DNA, 25 bp, E. coli
cctattacgatgaagacggcgcgga

SEQ ID NO: 39504 - DNA, 25 bp, E. coli
cctattacgatgtagacggcgcgga

SEQ ID NO: 39505 - DNA, 25 bp, E. coli
gctaaagcgcaaagagagccacggt

SEQ ID NO: 39506 - DNA, 25 bp, E. coli
gctaaagcgcaatgagagccacggt

SEQ ID NO: 39507 - DNA, 25 bp, E. coli
cattatcacggcttggtacgcggcg

SEQ ID NO: 39508 - DNA, 25 bp, E. coli
cattatcacggcatggtacgcggcg

SEQ ID NO: 39509 - DNA, 25 bp, E. coli
gatttcagccgcatgcaggcacaga

SEQ ID NO: 39510 - DNA, 25 bp, E. coli
gatttcagccgcttgcaggcacaga

SEQ ID NO: 39511 - DNA, 25 bp, E. coli
gaccgccgacgggacattgattgaa

SEQ ID NO: 39512 - DNA, 25 bp, E. coli
gaccgccgacggcacattgattgaa

SEQ ID NO: 39513 - DNA, 25 bp, E. coli
caaagacgctggcgttttgagcctg

SEQ ID NO: 39514 - DNA, 25 bp, E. coli
caaagacgctggggttttgagcctg

SEQ ID NO: 39515 - DNA, 25 bp, E. coli
catcaccaccgtattcgccctctgt

SEQ ID NO: 39516 - DNA, 25 bp, E. coli
catcaccaccgttttcgccctctgt

SEQ ID NO: 39517 - DNA, 25 bp, E. coli
atcaccaccgtaatcgccctctgtg

SEQ ID NO: 39518 - DNA, 25 bp, E. coli
accgtattcgccgtctgtgccgtgg

SEQ ID NO: 39519 - DNA, 25 bp, E. coli
accgtattcgccctctgtgccgtgg

SEQ ID NO: 39520 - DNA, 25 bp, E. coli
atcaccaccgtattcgccctctgtg

SEQ ID NO: 39521 - DNA, 25 bp, E. coli
tgaaagcccgcatgtactggaagaa

SEQ ID NO: 39522 - DNA, 25 bp, E. coli
tgaaagcccgcaagtactggaagaa

SEQ ID NO: 39523 - DNA, 25 bp, E. coli
tcaccaccgtattcgccctctgtgc

SEQ ID NO: 39524 - DNA, 25 bp, E. coli
tcaccaccgtatacgccctctgtgc

SEQ ID NO: 39525 - DNA, 25 bp, E. coli
gcatcaccaccgaattcgccctctg

SEQ ID NO: 39526 - DNA, 25 bp, E. coli
gcatcaccaccgtattcgccctctg

SEQ ID NO: 39527 - DNA, 25 bp, E. coli
gcaaagacgctgccgttttgagcct

SEQ ID NO: 39528 - DNA, 25 bp, E. coli
gcaaagacgctggcgttttgagcct

SEQ ID NO: 39529 - DNA, 25 bp, E. coli
cggcaaagacgcaggcgttttgagc

SEQ ID NO: 39530 - DNA, 25 bp, E. coli
cggcaaagacgctggcgttttgagc

SEQ ID NO: 39531 - DNA, 25 bp, E. coli
ggcaaagacgctcgcgttttgagcc

SEQ ID NO: 39532 - DNA, 25 bp, E. coli
ggcatcaccaccgtattcgccctct

SEQ ID NO: 39533 - DNA, 25 bp, E. coli
ggcatcaccaccctattcgccctct

SEQ ID NO: 39534 - DNA, 25 bp, E. coli
ggcaaagacgctggcgttttgagcc

SEQ ID NO: 39535 - DNA, 25 bp, E. coli
aagatgtctttctggcgcaatcggc

SEQ ID NO: 39536 - DNA, 25 bp, E. coli
caattatgatggctgggtcgccgcc

SEQ ID NO: 39537 - DNA, 25 bp, E. coli
caattatgatgggtgggtcgccgcc

SEQ ID NO: 39538 - DNA, 25 bp, E. coli
aagatgtctttcaggcgcaatcggc

SEQ ID NO: 39539 - DNA, 25 bp, E. coli
tatggcataaccctgacacaactgg

SEQ ID NO: 39540 - DNA, 25 bp, E. coli
tatggcataaccgtgacacaactgg

SEQ ID NO: 39541 - DNA, 25 bp, E. coli
tatcaggctttgagcgatgcggctc

SEQ ID NO: 39542 - DNA, 25 bp, E. coli
tattgccggaatccgctcaacgctg

SEQ ID NO: 39543 - DNA, 25 bp, E. coli
tattgccggaatgcgctcaacgctg

SEQ ID NO: 39544 - DNA, 25 bp, E. coli
tatcaggctttgtgcgatgcggctc

SEQ ID NO: 39545 - DNA, 25 bp, E. coli
tgtggcatatgcgaactggaccggc

SEQ ID NO: 39546 - DNA, 25 bp, E. coli
tgtggcatatgccaactggaccggc

SEQ ID NO: 39547 - DNA, 25 bp, E. coli
tccattagcgggaattaaacagggc

SEQ ID NO: 39548 - DNA, 25 bp, E. coli
tccattagcgggtattaaacagggc

SEQ ID NO: 39549 - DNA, 25 bp, E. coli
cgatgttgcagacaaaacggcgact

SEQ ID NO: 39550 - DNA, 25 bp, E. coli
cgatgttgcagagaaaacggcgact

SEQ ID NO: 39551 - DNA, 25 bp, E. coli
ggatgaattacacgcccagacgcgt

SEQ ID NO: 39552 - DNA, 25 bp, E. coli
ggatgaattacaggcccagacgcgt

SEQ ID NO: 39553 - DNA, 25 bp, E. coli
ggaaaacgtctacaacatggcggca

SEQ ID NO: 39554 - DNA, 25 bp, E. coli
ggaaaacgtctagaacatggcggca

SEQ ID NO: 39555 - DNA, 25 bp, E. coli
tcaacgctggagcaatatcaggcgc

SEQ ID NO: 39556 - DNA, 25 bp, E. coli
tcaacgctggaggaatatcaggcgc

SEQ ID NO: 39557 - DNA, 25 bp, E. coli
aacgccgtttatgagacttgtgcaa

SEQ ID NO: 39558 - DNA, 25 bp, E. coli
caaaacgccgttaatcagacttgtg

SEQ ID NO: 39559 - DNA, 25 bp, E. coli
caaaacgccgtttatcagacttgtg

SEQ ID NO: 39560 - DNA, 25 bp, E. coli
acaaagccaaaaggccgtttatcag

SEQ ID NO: 39561 - DNA, 25 bp, E. coli
aacgccgtttatcagacttgtgcaa

SEQ ID NO: 39562 - DNA, 25 bp, E. coli
aaacgccgtttaacagacttgtgca

SEQ ID NO: 39563 - DNA, 25 bp, E. coli
acaaagccaaaacgccgtttatcag

SEQ ID NO: 39564 - DNA, 25 bp, E. coli
aaacgccgtttatcagacttgtgca

SEQ ID NO: 39565 - DNA, 25 bp, E. coli
tatcagacttgtgcaactctggcag

SEQ ID NO: 39566 - DNA, 25 bp, E. coli
tatcagacttgtccaactctggcag

SEQ ID NO: 39567 - DNA, 25 bp, E. coli
tttatcagacttctgcaactctggc

SEQ ID NO: 39568 - DNA, 25 bp, E. coli
tttatcagacttgtgcaactctggc

SEQ ID NO: 39569 - DNA, 25 bp, E. coli
tgatgaacggttcagggatattggg

SEQ ID NO: 39570 - DNA, 25 bp, E. coli
tgatgaacggttgagggatattggg

SEQ ID NO: 39571 - DNA, 25 bp, E. coli
tcacgaaaacaaagccaaaacgccg

SEQ ID NO: 39572 - DNA, 25 bp, E. coli
gccaaaacgccgtttatcagacttg

SEQ ID NO: 39573 - DNA, 25 bp, E. coli
gccaaaacgccgattatcagacttg

SEQ ID NO: 39574 - DNA, 25 bp, E. coli
ccgtttatcagacttgtgcaactct

SEQ ID NO: 39575 - DNA, 25 bp, E. coli
ccgtttatcagagttgtgcaactct

SEQ ID NO: 39576 - DNA, 25 bp, E. coli
cgccgtttatcagacttgtgcaact

SEQ ID NO: 39577 - DNA, 25 bp, E. coli
cgccgtttatcacacttgtgcaact

SEQ ID NO: 39578 - DNA, 25 bp, E. coli
tcacgaaaacaatgccaaaacgccg

SEQ ID NO: 39579 - DNA, 25 bp, E. coli
caatatattgcagcatcctcgtagg

SEQ ID NO: 39580 - DNA, 25 bp, E. coli
caatatattgcaccatcctcgtagg

SEQ ID NO: 39581 - DNA, 25 bp, E. coli
catacgtaaaaatgggcgatcttgc

SEQ ID NO: 39582 - DNA, 25 bp, E. coli
catacgtaaaaaagggcgatcttgc

SEQ ID NO: 39583 - DNA, 25 bp, E. coli
taaaaaagggcgttcttgcgaccgc

SEQ ID NO: 39584 - DNA, 25 bp, E. coli
taaaaaagggcgatcttgcgaccgc

SEQ ID NO: 39585 - DNA, 25 bp, E. coli
ctacaaaatcgcataaattcaatat

SEQ ID NO: 39586 - DNA, 25 bp, E. coli
ctacaaaatcgcttaaattcaatat

SEQ ID NO: 39587 - DNA, 25 bp, E. coli
tattgcaccatcctcgtaggcctga

SEQ ID NO: 39588 - DNA, 25 bp, E. coli
tattgcaccatcgtcgtaggcctga

SEQ ID NO: 39589 - DNA, 25 bp, E. coli
tgtttgtcatacctaaaaaagggcg

SEQ ID NO: 39590 - DNA, 25 bp, E. coli
tgtttgtcatacgtaaaaaagggcg

SEQ ID NO: 39591 - DNA, 25 bp, E. coli
tgggatttccttgagctactcagtt

SEQ ID NO: 39592 - DNA, 25 bp, E. coli
tgggatttccttcagctactcagtt

SEQ ID NO: 39593 - DNA, 25 bp, E. coli
gacaaagtgttcgttgtttttgccg

SEQ ID NO: 39594 - DNA, 25 bp, E. coli
gacaaagtgttccttgtttttgccg

SEQ ID NO: 39595 - DNA, 25 bp, E. coli
ggcaattctgtgattgtcatacgta

SEQ ID NO: 39596 - DNA, 25 bp, E. coli
ggcgatcttgcgtccgccctttttt

SEQ ID NO: 39597 - DNA, 25 bp, E. coli
ggcaattctgtgtttgtcatacgta

SEQ ID NO: 39598 - DNA, 25 bp, E. coli
ggcgatcttgcgaccgccctttttt

SEQ ID NO: 39599 - DNA, 25 bp, E. coli
gagctactcagtttgttgacaaagt

SEQ ID NO: 39600 - DNA, 25 bp, E. coli
gagctactcagtatgttgacaaagt

SEQ ID NO: 39601 - DNA, 25 bp, E. coli
aattgtaaaaatagtgaagggagcg

SEQ ID NO: 39602 - DNA, 25 bp, E. coli
aagggagcgggatctatagaaagct

SEQ ID NO: 39603 - DNA, 25 bp, E. coli
aattgtaaaaattgtgaagggagcg

SEQ ID NO: 39604 - DNA, 25 bp, E. coli
aagggagcgggaactatagaaagct

SEQ ID NO: 39605 - DNA, 25 bp, E. coli
caccggaggttataaatcttgcgga

SEQ ID NO: 39606 - DNA, 25 bp, E. coli
caccggaggttaaaaatcttgcgga

SEQ ID NO: 39607 - DNA, 25 bp, E. coli
ataataaaggcacccgaaagcgcct

SEQ ID NO: 39608 - DNA, 25 bp, E. coli
ataataaaggcagccgaaagcgcct

SEQ ID NO: 39609 - DNA, 25 bp, E. coli
tacctcagtaataaacgctaacgct

SEQ ID NO: 39610 - DNA, 25 bp, E. coli
tacctcagtaattaacgctaacgct

SEQ ID NO: 39611 - DNA, 25 bp, E. coli
tttaaagagtgagcagaagaatatc

SEQ ID NO: 39612 - DNA, 25 bp, E. coli
tttaaagagtgaccagaagaatatc

SEQ ID NO: 39613 - DNA, 25 bp, E. coli
tgaatgccattttatcaccggaggt

SEQ ID NO: 39614 - DNA, 25 bp, E. coli
tgaatgccatttaatcaccggaggt

SEQ ID NO: 39615 - DNA, 25 bp, E. coli
tctcttattaacgagctgaatgcca

SEQ ID NO: 39616 - DNA, 25 bp, E. coli
tctcttattaaccagctgaatgcca

SEQ ID NO: 39617 - DNA, 25 bp, E. coli
cccgaaagcgccattatgtttctga

SEQ ID NO: 39618 - DNA, 25 bp, E. coli
cccgaaagcgcctttatgtttctga

SEQ ID NO: 39619 - DNA, 25 bp, E. coli
tcactggaaatattaaaggcacccg

SEQ ID NO: 39620 - DNA, 25 bp, E. coli
tattaatttttatgggtttcactgg

SEQ ID NO: 39621 - DNA, 25 bp, E. coli
tattaatttttaagggtttcactgg

SEQ ID NO: 39622 - DNA, 25 bp, E. coli
tcactggaaataataaaggcacccg

SEQ ID NO: 39623 - DNA, 25 bp, E. coli
cacgtcatattcatggactggacca

SEQ ID NO: 39624 - DNA, 25 bp, E. coli
cacgtcatattcttggactggacca

SEQ ID NO: 39625 - DNA, 25 bp, E. coli
caggcacgtcatattcttggactgg

SEQ ID NO: 39626 - DNA, 25 bp, E. coli
catattcttggactggaccataaaa

SEQ ID NO: 39627 - DNA, 25 bp, E. coli
catattcttggagtggaccataaaa

SEQ ID NO: 39628 - DNA, 25 bp, E. coli
caggcacgtcattttcttggactgg

SEQ ID NO: 39629 - DNA, 25 bp, E. coli
agttaccgaaggagacaaatccagc

SEQ ID NO: 39630 - DNA, 25 bp, E. coli
agttaccgaaggtgacaaatccagc

SEQ ID NO: 39631 - DNA, 25 bp, E. coli
tgaaatcgaaccgtcaggcacgtca

SEQ ID NO: 39632 - DNA, 25 bp, E. coli
tgaaatcgaaccctcaggcacgtca

SEQ ID NO: 39633 - DNA, 25 bp, E. coli
tctaaccagcgcaaaatagttaccg

SEQ ID NO: 39634 - DNA, 25 bp, E. coli
tctaaccagcgctaaatagttaccg

SEQ ID NO: 39635 - DNA, 25 bp, E. coli
gcgcaaaatagttaccgaaggtgac

SEQ ID NO: 39636 - DNA, 25 bp, E. coli
gcgcaaaatagtaaccgaaggtgac

SEQ ID NO: 39637 - DNA, 25 bp, E. coli
ccgtcaggcacgtcatattcttgga

SEQ ID NO: 39638 - DNA, 25 bp, E. coli
cgaaccgtcagggacgtcatattct

SEQ ID NO: 39639 - DNA, 25 bp, E. coli
ccgtcaggcacgacatattcttgga

SEQ ID NO: 39640 - DNA, 25 bp, E. coli
ccagcgcaaaattgttaccgaaggt

SEQ ID NO: 39641 - DNA, 25 bp, E. coli
cgaaccgtcaggcacgtcatattct

SEQ ID NO: 39642 - DNA, 25 bp, E. coli
ccagcgcaaaatagttaccgaaggt

SEQ ID NO: 39643 - DNA, 25 bp, E. coli
cgtcatattcttggactggaccata

SEQ ID NO: 39644 - DNA, 25 bp, E. coli
cgtcatattcttcgactggaccata

SEQ ID NO: 39645 - DNA, 25 bp, E. coli
catcccaatgcaagccgataccgta

SEQ ID NO: 39646 - DNA, 25 bp, E. coli
catcccaatgcatgccgataccgta

SEQ ID NO: 39647 - DNA, 25 bp, E. coli
attattgatgctcacggatttcgcc

SEQ ID NO: 39648 - DNA, 25 bp, E. coli
attattgatgctgacggatttcgcc

SEQ ID NO: 39649 - DNA, 25 bp, E. coli
attgtatggcgtccgtagctcagag

SEQ ID NO: 39650 - DNA, 25 bp, E. coli
attgtatggcgtgcgtagctcagag

SEQ ID NO: 39651 - DNA, 25 bp, E. coli
tatgcggatgctgcgagagctcatc

SEQ ID NO: 39652 - DNA, 25 bp, E. coli
tatgcggatgctccgagagctcatc

SEQ ID NO: 39653 - DNA, 25 bp, E. coli
ttgatgctgacgcatttcgcctggc

SEQ ID NO: 39654 - DNA, 25 bp, E. coli
ttgatgctgacggatttcgcctggc

SEQ ID NO: 39655 - DNA, 25 bp, E. coli
tgctgacggatttcgcctggcaggc

SEQ ID NO: 39656 - DNA, 25 bp, E. coli
tgctgacggattacgcctggcaggc

SEQ ID NO: 39657 - DNA, 25 bp, E. coli
tgcgagagctcatcccaatgcatgc

SEQ ID NO: 39658 - DNA, 25 bp, E. coli
tgcgagagctcaacccaatgcatgc

SEQ ID NO: 39659 - DNA, 25 bp, E. coli
gcgtagctcagagcggatgcagttt

SEQ ID NO: 39660 - DNA, 25 bp, E. coli
gcgtagctcagaccggatgcagttt

SEQ ID NO: 39661 - DNA, 25 bp, E. coli
gagagctcatccgaatgcatgccga

SEQ ID NO: 39662 - DNA, 25 bp, E. coli
gagagctcatcccaatgcatgccga

SEQ ID NO: 39663 - DNA, 25 bp, E. coli
gagctcatcccaatgcatgccgata

SEQ ID NO: 39664 - DNA, 25 bp, E. coli
gagctcatcccattgcatgccgata

SEQ ID NO: 39665 - DNA, 25 bp, E. coli
gatgctgcgagacctcatcccaatg

SEQ ID NO: 39666 - DNA, 25 bp, E. coli
gatgctgcgagagctcatcccaatg

SEQ ID NO: 39667 - DNA, 25 bp, E. coli
caagtggcgaaaatcgtatcaaaga

SEQ ID NO: 39668 - DNA, 25 bp, E. coli
caagtggcgaaattcgtatcaaaga

SEQ ID NO: 39669 - DNA, 25 bp, E. coli
atatggtaagataccagggcaaggg

SEQ ID NO: 39670 - DNA, 25 bp, E. coli
atatggtaagattccagggcaaggg

SEQ ID NO: 39671 - DNA, 25 bp, E. coli
aaatatggtaagttaccagggcaag

SEQ ID NO: 39672 - DNA, 25 bp, E. coli
aaaatcgtatcatagaatgatccag

SEQ ID NO: 39673 - DNA, 25 bp, E. coli
aaaatcgtatcaaagaatgatccag

SEQ ID NO: 39674 - DNA, 25 bp, E. coli
aaaagtgtggtgtaaatatggtaag

SEQ ID NO: 39675 - DNA, 25 bp, E. coli
aaatatggtaagataccagggcaag

SEQ ID NO: 39676 - DNA, 25 bp, E. coli
aaaagtgtggtgaaaatatggtaag

SEQ ID NO: 39677 - DNA, 25 bp, E. coli
tgatccagatactaaaaaagtgtgg

SEQ ID NO: 39678 - DNA, 25 bp, E. coli
tgatccagatacaaaaaaagtgtgg

SEQ ID NO: 39679 - DNA, 25 bp, E. coli
ccagggaacaagtggcgaaaatcgt

SEQ ID NO: 39680 - DNA, 25 bp, E. coli
ccagggaacaagaggcgaaaatcgt

SEQ ID NO: 39681 - DNA, 25 bp, E. coli
ggaacaagtggcgaaaatcgtatca

SEQ ID NO: 39682 - DNA, 25 bp, E. coli
ggtgaaattaatgttacgcattatt

SEQ ID NO: 39683 - DNA, 25 bp, E. coli
ggtgaaattaatcttacgcattatt

SEQ ID NO: 39684 - DNA, 25 bp, E. coli
tggcgaaaatcgaatcaaagaatga

SEQ ID NO: 39685 - DNA, 25 bp, E. coli
tggcgaaaatcgtatcaaagaatga

SEQ ID NO: 39686 - DNA, 25 bp, E. coli
ggaacaagtggccaaaatcgtatca

SEQ ID NO: 39687 - DNA, 25 bp, E. coli
tcaaagaatgatccagatacaaaaa

SEQ ID NO: 39688 - DNA, 25 bp, E. coli
tcaaagaatgatgcagatacaaaaa

SEQ ID NO: 39689 - DNA, 25 bp, E. coli
cagaataccctagtggatgacggcg

SEQ ID NO: 39690 - DNA, 25 bp, E. coli
cagaataccctactggatgacggcg

SEQ ID NO: 39691 - DNA, 25 bp, E. coli
aaatgtcggaaagagcaacctcggg

SEQ ID NO: 39692 - DNA, 25 bp, E. coli
aaatgtcggaaacagcaacctcggg

SEQ ID NO: 39693 - DNA, 25 bp, E. coli
taccaatatgtgcacagggacggac

SEQ ID NO: 39694 - DNA, 25 bp, E. coli
taccaatatgtggacagggacggac

SEQ ID NO: 39695 - DNA, 25 bp, E. coli
tattgatggcacttccggtcaggcc

SEQ ID NO: 39696 - DNA, 25 bp, E. coli
tattgatggcacatccggtcaggcc

SEQ ID NO: 39697 - DNA, 25 bp, E. coli
tgctgttgcaaatagtaactccccg

SEQ ID NO: 39698 - DNA, 25 bp, E. coli
tgctgttgcaaaaagtaactccccg

SEQ ID NO: 39699 - DNA, 25 bp, E. coli
gaaggcggccctgattctgacaact

SEQ ID NO: 39700 - DNA, 25 bp, E. coli
gaatggcgccaccacagaagaaggt

SEQ ID NO: 39701 - DNA, 25 bp, E. coli
gaatggcgccacgacagaagaaggt

SEQ ID NO: 39702 - DNA, 25 bp, E. coli
gaagggccctgattaccacactgaa

SEQ ID NO: 39703 - DNA, 25 bp, E. coli
gaagggccctgaataccacactgaa

SEQ ID NO: 39704 - DNA, 25 bp, E. coli
gaaggcggccctcattctgacaact

SEQ ID NO: 39705 - DNA, 25 bp, E. coli
gaacacagctcagtaaaggcgccag

SEQ ID NO: 39706 - DNA, 25 bp, E. coli
gaacacagctcactaaaggcgccag

SEQ ID NO: 39707 - DNA, 25 bp, E. coli
gattaatggtggacaggcaaccggc

SEQ ID NO: 39708 - DNA, 25 bp, E. coli
gataatcagacgtcaccgaatgccg

SEQ ID NO: 39709 - DNA, 25 bp, E. coli
gataatcagacgacaccgaatgccg

SEQ ID NO: 39710 - DNA, 25 bp, E. coli
gattaatggtggtcaggcaaccggc

SEQ ID NO: 39711 - DNA, 25 bp, E. coli
caagtatcccgtgtgctgaatttta

SEQ ID NO: 39712 - DNA, 25 bp, E. coli
caagtatcccgtctgctgaatttta

SEQ ID NO: 39713 - DNA, 25 bp, E. coli
attctccgcagtgaaagccgctggc

SEQ ID NO: 39714 - DNA, 25 bp, E. coli
attctccgcagtcaaagccgctggc

SEQ ID NO: 39715 - DNA, 25 bp, E. coli
aaaggaaattgtaggtgcagatcgc

SEQ ID NO: 39716 - DNA, 25 bp, E. coli
aaaggaaattgttggtgcagatcgc

SEQ ID NO: 39717 - DNA, 25 bp, E. coli
tatgaatgcgcagaaaattaacggt

SEQ ID NO: 39718 - DNA, 25 bp, E. coli
tatgaatgcgcacaaaattaacggt

SEQ ID NO: 39719 - DNA, 25 bp, E. coli
tgcgtgaaaaagcttacaccacggg

SEQ ID NO: 39720 - DNA, 25 bp, E. coli
tgcgtgaaaaaggttacaccacggg

SEQ ID NO: 39721 - DNA, 25 bp, E. coli
tgcagatcgcgttattaccgatgaa

SEQ ID NO: 39722 - DNA, 25 bp, E. coli
tgcagatcgcgtaattaccgatgaa

SEQ ID NO: 39723 - DNA, 25 bp, E. coli
tccggcagcggtcgtaaaactcggt

SEQ ID NO: 39724 - DNA, 25 bp, E. coli
tccggcagcggtggtaaaactcggt

SEQ ID NO: 39725 - DNA, 25 bp, E. coli
tccgccaccgaacgtgggctggaaa

SEQ ID NO: 39726 - DNA, 25 bp, E. coli
tccgccaccgaaggtgggctggaaa

SEQ ID NO: 39727 - DNA, 25 bp, E. coli
gctggaaaacgccttgcgtgaaaaa

SEQ ID NO: 39728 - DNA, 25 bp, E. coli
gcgattgtcgacgagctaaaggaaa

SEQ ID NO: 39729 - DNA, 25 bp, E. coli
gcgattgtcgaccagctaaaggaaa

SEQ ID NO: 39730 - DNA, 25 bp, E. coli
gctggaaaacgcgttgcgtgaaaaa

SEQ ID NO: 39731 - DNA, 25 bp, E. coli
gatggcaccgtcacacgcattaaaa

SEQ ID NO: 39732 - DNA, 25 bp, E. coli
gatggcaccgtctcacgcattaaaa

SEQ ID NO: 39733 - DNA, 25 bp, E. coli
accagcccgccgtaaaagagagaga

SEQ ID NO: 39734 - DNA, 25 bp, E. coli
accagcccgccgaaaaagagagaga

SEQ ID NO: 39735 - DNA, 25 bp, E. coli
tacccacagcgtcatatagatcgca

SEQ ID NO: 39736 - DNA, 25 bp, E. coli
tatctgtgagaatcccatggaagag

SEQ ID NO: 39737 - DNA, 25 bp, E. coli
tacccacagcgtgatatagatcgca

SEQ ID NO: 39738 - DNA, 25 bp, E. coli
tatctgtgagaaacccatggaagag

SEQ ID NO: 39739 - DNA, 25 bp, E. coli
tttaaaacagcgttgacagaagcca

SEQ ID NO: 39740 - DNA, 25 bp, E. coli
tttaaaacagcgatgacagaagcca

SEQ ID NO: 39741 - DNA, 25 bp, E. coli
gccataaaataaccaaccgaacgtt

SEQ ID NO: 39742 - DNA, 25 bp, E. coli
gccataaaataagcaaccgaacgtt

SEQ ID NO: 39743 - DNA, 25 bp, E. coli
gcgtattgggaaggataaactctca

SEQ ID NO: 39744 - DNA, 25 bp, E. coli
gcgtattgggaacgataaactctca

SEQ ID NO: 39745 - DNA, 25 bp, E. coli
gaattctccgaagccgggaaggata

SEQ ID NO: 39746 - DNA, 25 bp, E. coli
gaattctccgaacccgggaaggata

SEQ ID NO: 39747 - DNA, 25 bp, E. coli
gaaataaaaagatctgacaccgcga

SEQ ID NO: 39748 - DNA, 25 bp, E. coli
gaaattacgataagaaacgcgggca

SEQ ID NO: 39749 - DNA, 25 bp, E. coli
gaaacgcgggcagagttatcaccag

SEQ ID NO: 39750 - DNA, 25 bp, E. coli
gaacgttcgttcgagcgtattggga

SEQ ID NO: 39751 - DNA, 25 bp, E. coli
gaaataaaaagaactgacaccgcga

SEQ ID NO: 39752 - DNA, 25 bp, E. coli
gaacgttcgttccagcgtattggga

SEQ ID NO: 39753 - DNA, 25 bp, E. coli
gaaattacgatatgaaacgcgggca

SEQ ID NO: 39754 - DNA, 25 bp, E. coli
gaaacgcgggcacagttatcaccag

SEQ ID NO: 39755 - DNA, 25 bp, E. coli
cacgtagttttttgatcgccaaagc

SEQ ID NO: 39756 - DNA, 25 bp, E. coli
cacgtagtttttagatcgccaaagc

SEQ ID NO: 39757 - DNA, 25 bp, E. coli
taaacaaaagcattatatggcaggc

SEQ ID NO: 39758 - DNA, 25 bp, E. coli
taaacaaaagcaatatatggcaggc

SEQ ID NO: 39759 - DNA, 25 bp, E. coli
cacgaaaaactggacttacgcaaca

SEQ ID NO: 39760 - DNA, 25 bp, E. coli
cacgaaaaactgcacttacgcaaca

SEQ ID NO: 39761 - DNA, 25 bp, E. coli
aaaaccttggcatgagtgggctgac

SEQ ID NO: 39762 - DNA, 25 bp, E. coli
aaaaccttggcaagagtgggctgac

SEQ ID NO: 39763 - DNA, 25 bp, E. coli
tatgtgggaccttcaaaaccttggc

SEQ ID NO: 39764 - DNA, 25 bp, E. coli
tatgtgggacctacaaaaccttggc

SEQ ID NO: 39765 - DNA, 25 bp, E. coli
tgaatggtggcataatcgagcctcg

SEQ ID NO: 39766 - DNA, 25 bp, E. coli
tgaatggtggcaaaatcgagcctcg

SEQ ID NO: 39767 - DNA, 25 bp, E. coli
gccaaagcagctactccgtggagta

SEQ ID NO: 39768 - DNA, 25 bp, E. coli
gccaaagcagcttctccgtggagta

SEQ ID NO: 39769 - DNA, 25 bp, E. coli
gctattgaaatgatgcgtgacccag

SEQ ID NO: 39770 - DNA, 25 bp, E. coli
gctattgaaatgttgcgtgacccag

SEQ ID NO: 39771 - DNA, 25 bp, E. coli
gaaattgccgcagttgtagctgaaa

SEQ ID NO: 39772 - DNA, 25 bp, E. coli
gaaattgccgcacttgtagctgaaa

SEQ ID NO: 39773 - DNA, 25 bp, E. coli
taatccagtcaatgatgacaccgtg

SEQ ID NO: 39774 - DNA, 25 bp, E. coli
taatccagtcaaagatgacaccgtg

SEQ ID NO: 39775 - DNA, 25 bp, E. coli
taagctgaagtctttaccaagcacg

SEQ ID NO: 39776 - DNA, 25 bp, E. coli
taagctgaagtcattaccaagcacg

SEQ ID NO: 39777 - DNA, 25 bp, E. coli
tgtataccaaagtccaggaggcact

SEQ ID NO: 39778 - DNA, 25 bp, E. coli
tgtataccaaagaccaggaggcact

SEQ ID NO: 39779 - DNA, 25 bp, E. coli
tcgcaaccggttctgtggatcacac

SEQ ID NO: 39780 - DNA, 25 bp, E. coli
tcgcaaccggttgtgtggatcacac

SEQ ID NO: 39781 - DNA, 25 bp, E. coli
tcgtcaccgctgtagagatggcgct

SEQ ID NO: 39782 - DNA, 25 bp, E. coli
tcgtcaccgctgaagagatggcgct

SEQ ID NO: 39783 - DNA, 25 bp, E. coli
gctgaaacagaaacaaaccggcctg

SEQ ID NO: 39784 - DNA, 25 bp, E. coli
gctgaaacagaatcaaaccggcctg

SEQ ID NO: 39785 - DNA, 25 bp, E. coli
gaagcgcttagctatacccctggcg

SEQ ID NO: 39786 - DNA, 25 bp, E. coli
gaagcgcttagcaatacccctggcg

SEQ ID NO: 39787 - DNA, 25 bp, E. coli
gaaatatgtgccagaagatcgccca

SEQ ID NO: 39788 - DNA, 25 bp, E. coli
gaaatatgtgcctgaagatcgccca

SEQ ID NO: 39789 - DNA, 25 bp, E. coli
gactttgattttcgcgctcacccga

SEQ ID NO: 39790 - DNA, 25 bp, E. coli
gaacccgtggcggatctaatactta

SEQ ID NO: 39791 - DNA, 25 bp, E. coli
gaacccgtggcgcatctaatactta

SEQ ID NO: 39792 - DNA, 25 bp, E. coli
gactttgattttggcgctcacccga

SEQ ID NO: 39793 - DNA, 25 bp, E. coli
gtaaactacctgttcgacaacggcg

SEQ ID NO: 39794 - DNA, 25 bp, E. coli
gtaaactacctgatcgacaacggcg

SEQ ID NO: 39795 - DNA, 25 bp, E. coli
taataacctgatcgcggatccgaac

SEQ ID NO: 39796 - DNA, 25 bp, E. coli
taataacctgatggcggatccgaac

SEQ ID NO: 39797 - DNA, 25 bp, E. coli
gagtccatgtttaagtatcccgcag

SEQ ID NO: 39798 - DNA, 25 bp, E. coli
gagtccatgttttagtatcccgcag

SEQ ID NO: 39799 - DNA, 25 bp, E. coli
caatgccaatggtgacatctttggt

SEQ ID NO: 39800 - DNA, 25 bp, E. coli
caatgccaatggagacatctttggt

SEQ ID NO: 39801 - DNA, 25 bp, E. coli
cacaaatggatattggcggcgctat

SEQ ID NO: 39802 - DNA, 25 bp, E. coli
cacaaatggataatggcggcgctat

SEQ ID NO: 39803 - DNA, 25 bp, E. coli
catctttggtggatggttaatgtca

SEQ ID NO: 39804 - DNA, 25 bp, E. coli
catctttggtggttggttaatgtca

SEQ ID NO: 39805 - DNA, 25 bp, E. coli
atgcccgccgataccaatgccaatg

SEQ ID NO: 39806 - DNA, 25 bp, E. coli
atgcccgccgattccaatgccaatg

SEQ ID NO: 39807 - DNA, 25 bp, E. coli
aatgactttctttcggccggttgcg

SEQ ID NO: 39808 - DNA, 25 bp, E. coli
aatgactttcttacggccggttgcg

SEQ ID NO: 39809 - DNA, 25 bp, E. coli
tatgcacgctgtctccagaaaggga

SEQ ID NO: 39810 - DNA, 25 bp, E. coli
tatgcacgctgtgtccagaaaggga

SEQ ID NO: 39811 - DNA, 25 bp, E. coli
tatttaagtatgtcgcggttgatcc

SEQ ID NO: 39812 - DNA, 25 bp, E. coli
tatttaagtatgacgcggttgatcc

SEQ ID NO: 39813 - DNA, 25 bp, E. coli
gatgtggtgtgcagctatgcacgct

SEQ ID NO: 39814 - DNA, 25 bp, E. coli
gatgtggtgtgctgctatgcacgct

SEQ ID NO: 39815 - DNA, 25 bp, E. coli
ccctcagggcgaacttgttttacgt

SEQ ID NO: 39816 - DNA, 25 bp, E. coli
ccctcagggcgatcttgttttacgt

SEQ ID NO: 39817 - DNA, 25 bp, E. coli
ctacaacacatatcgtccctcaggg

SEQ ID NO: 39818 - DNA, 25 bp, E. coli
ctacaacacataacgtccctcaggg

SEQ ID NO: 39819 - DNA, 25 bp, E. coli
gttttacgtactttagccatgcccg

SEQ ID NO: 39820 - DNA, 25 bp, E. coli
gttttacgtactatagccatgcccg

SEQ ID NO: 39821 - DNA, 25 bp, E. coli
cagagaaagcacagagtgtgacgtc

SEQ ID NO: 39822 - DNA, 25 bp, E. coli
cagagaaagcactgagtgtgacgtc

SEQ ID NO: 39823 - DNA, 25 bp, E. coli
tacctgtgtggtcaccgattcggca

SEQ ID NO: 39824 - DNA, 25 bp, E. coli
tacctgtgtggtgaccgattcggca

SEQ ID NO: 39825 - DNA, 25 bp, E. coli
ttcggcagagaatgcacagagtgtg

SEQ ID NO: 39826 - DNA, 25 bp, E. coli
ttcggcagagaaagcacagagtgtg

SEQ ID NO: 39827 - DNA, 25 bp, E. coli
tgaccgattcgggagagaaagcaca

SEQ ID NO: 39828 - DNA, 25 bp, E. coli
tgaccgattcggcagagaaagcaca

SEQ ID NO: 39829 - DNA, 25 bp, E. coli
gccaggtgcgcagtccgctgatgcg

SEQ ID NO: 39830 - DNA, 25 bp, E. coli
gccaggtgcgcactccgctgatgcg

SEQ ID NO: 39831 - DNA, 25 bp, E. coli
gaaatatacctgtgtggtgaccgat

SEQ ID NO: 39832 - DNA, 25 bp, E. coli
gaaatatacctgagtggtgaccgat

SEQ ID NO: 39833 - DNA, 25 bp, E. coli
gaaagcacagagagtgacgtctgtt

SEQ ID NO: 39834 - DNA, 25 bp, E. coli
gaaagcacagagtgtgacgtctgtt

SEQ ID NO: 39835 - DNA, 25 bp, E. coli
cgctgatgcgggcaaatatacctgt

SEQ ID NO: 39836 - DNA, 25 bp, E. coli
cgattcggcagagaaagcacagagt

SEQ ID NO: 39837 - DNA, 25 bp, E. coli
cgctgatgcggggaaatatacctgt

SEQ ID NO: 39838 - DNA, 25 bp, E. coli
cgattcggcagacaaagcacagagt

SEQ ID NO: 39839 - DNA, 25 bp, E. coli
gagtgtgacgtctgttgaatgcacc

SEQ ID NO: 39840 - DNA, 25 bp, E. coli
gagtgtgacgtcagttgaatgcacc

SEQ ID NO: 39841 - DNA, 25 bp, E. coli
gacgtctgttgaatgcaccgtgaca

SEQ ID NO: 39842 - DNA, 25 bp, E. coli
gacgtctgttgattgcaccgtgaca

SEQ ID NO: 39843 - DNA, 25 bp, E. coli
taaactggaaaacctgcgcgatcgt

SEQ ID NO: 39844 - DNA, 25 bp, E. coli
taaactggaaaagctgcgcgatcgt

SEQ ID NO: 39845 - DNA, 25 bp, E. coli
tagatgcggatcagcgcgcggctat

SEQ ID NO: 39846 - DNA, 25 bp, E. coli
tagatgcggatctgcgcgcggctat

SEQ ID NO: 39847 - DNA, 25 bp, E. coli
tgagctcgcccaccgtattaagatg

SEQ ID NO: 39848 - DNA, 25 bp, E. coli
tgagctcgcccagcgtattaagatg

SEQ ID NO: 39849 - DNA, 25 bp, E. coli
tcatcggtaagatgctgcgccagcg

SEQ ID NO: 39850 - DNA, 25 bp, E. coli
tcatcggtaagaagctgcgccagcg

SEQ ID NO: 39851 - DNA, 25 bp, E. coli
gacgttcccggtgatgacatcgaag

SEQ ID NO: 39852 - DNA, 25 bp, E. coli
gaaaaacgcgctggataagatcccg

SEQ ID NO: 39853 - DNA, 25 bp, E. coli
gaaaaacgcgctcgataagatcccg

SEQ ID NO: 39854 - DNA, 25 bp, E. coli
gacgttcccggtcatgacatcgaag

SEQ ID NO: 39855 - DNA, 25 bp, E. coli
cgccagttgcagctcatcggtaaga

SEQ ID NO: 39856 - DNA, 25 bp, E. coli
cgccagttgcaggtcatcggtaaga

SEQ ID NO: 39857 - DNA, 25 bp, E. coli
gtattaagatggaaggtcgccgccg

SEQ ID NO: 39858 - DNA, 25 bp, E. coli
gtattaagatggtaggtcgccgccg

SEQ ID NO: 39859 - DNA, 25 bp, E. coli
taagcagcccgaagactggctcgac

SEQ ID NO: 39860 - DNA, 25 bp, E. coli
taagcagcccgatgactggctcgac

SEQ ID NO: 39861 - DNA, 25 bp, E. coli
gatgccgatcgtcagcaactgcgta

SEQ ID NO: 39862 - DNA, 25 bp, E. coli
gagaaagaagggtataagccgccga

SEQ ID NO: 39863 - DNA, 25 bp, E. coli
gagaaagaagggaataagccgccga

SEQ ID NO: 39864 - DNA, 25 bp, E. coli
gatgccgatcgtgagcaactgcgta

SEQ ID NO: 39865 - DNA, 25 bp, E. coli
cactggatatgtggatgcgttcgca

SEQ ID NO: 39866 - DNA, 25 bp, E. coli
cactggatatgtcgatgcgttcgca

SEQ ID NO: 39867 - DNA, 25 bp, E. coli
tacgctacgtgaaggccagacactg

SEQ ID NO: 39868 - DNA, 25 bp, E. coli
tatggttgggctgctaccggatcac

SEQ ID NO: 39869 - DNA, 25 bp, E. coli
taccagcggcgagttattgattgac

SEQ ID NO: 39870 - DNA, 25 bp, E. coli
taccagcggcgacttattgattgac

SEQ ID NO: 39871 - DNA, 25 bp, E. coli
tacgctacgtgatggccagacactg

SEQ ID NO: 39872 - DNA, 25 bp, E. coli
tatggttgggctcctaccggatcac

SEQ ID NO: 39873 - DNA, 25 bp, E. coli
tttcgtcgtcagaccgtagaagcgg

SEQ ID NO: 39874 - DNA, 25 bp, E. coli
tttcgtcgtcagtccgtagaagcgg

SEQ ID NO: 39875 - DNA, 25 bp, E. coli
tgttacccagcatatcggaatgatg

SEQ ID NO: 39876 - DNA, 25 bp, E. coli
tgttacccagcaaatcggaatgatg

SEQ ID NO: 39877 - DNA, 25 bp, E. coli
tgatgaagcacattagcgaccaggt

SEQ ID NO: 39878 - DNA, 25 bp, E. coli
tgcatgaactcaccaaacggctgat

SEQ ID NO: 39879 - DNA, 25 bp, E. coli
tgcatgaactcagcaaacggctgat

SEQ ID NO: 39880 - DNA, 25 bp, E. coli
tgatgaagcacaatagcgaccaggt

SEQ ID NO: 39881 - DNA, 25 bp, E. coli
tcattattgccgttgaagccctcgc

SEQ ID NO: 39882 - DNA, 25 bp, E. coli
tcattattgccgatgaagccctcgc

SEQ ID NO: 39883 - DNA, 25 bp, E. coli
gaacagcgtcgcaaacagattattg

SEQ ID NO: 39884 - DNA, 25 bp, E. coli
gaacagcgtcgctaacagattattg

SEQ ID NO: 39885 - DNA, 25 bp, E. coli
tggattttccacagcgcctgaacac

SEQ ID NO: 39886 - DNA, 25 bp, E. coli
tggattttccactgcgcctgaacac

SEQ ID NO: 39887 - DNA, 25 bp, E. coli
aaacagtctgacttaccgaaaagga

SEQ ID NO: 39888 - DNA, 25 bp, E. coli
aaacagacgattgtatgcctgggat

SEQ ID NO: 39889 - DNA, 25 bp, E. coli
aaacagtctgacataccgaaaagga

SEQ ID NO: 39890 - DNA, 25 bp, E. coli
aaacagacgattctatgcctgggat

SEQ ID NO: 39891 - DNA, 25 bp, E. coli
ttcagccttaaacataacggtgccg

SEQ ID NO: 39892 - DNA, 25 bp, E. coli
tatcaggtgctttcatcaaaaaatg

SEQ ID NO: 39893 - DNA, 25 bp, E. coli
tatcaggtgcttacatcaaaaaatg

SEQ ID NO: 39894 - DNA, 25 bp, E. coli
ttcagccttaaagataacggtgccg

SEQ ID NO: 39895 - DNA, 25 bp, E. coli
tgatagcctgttaactttgagggag

SEQ ID NO: 39896 - DNA, 25 bp, E. coli
tgttacccaggaacagacacaataa

SEQ ID NO: 39897 - DNA, 25 bp, E. coli
tgttacccaggatcagacacaataa

SEQ ID NO: 39898 - DNA, 25 bp, E. coli
tgatagcctgtttactttgagggag

SEQ ID NO: 39899 - DNA, 25 bp, E. coli
tcgttgcgcaactcagattgataaa

SEQ ID NO: 39900 - DNA, 25 bp, E. coli
tcgttgcgcaacacagattgataaa

SEQ ID NO: 39901 - DNA, 25 bp, E. coli
gataagtttcttatcagtttcagcc

SEQ ID NO: 39902 - DNA, 25 bp, E. coli
gattaaaggttatattcaccaggcg

SEQ ID NO: 39903 - DNA, 25 bp, E. coli
gataagtttcttttcagtttcagcc

SEQ ID NO: 39904 - DNA, 25 bp, E. coli
gattggatttcgaattatgatagcc

SEQ ID NO: 39905 - DNA, 25 bp, E. coli
gattaaaggttaaattcaccaggcg

SEQ ID NO: 39906 - DNA, 25 bp, E. coli
gattggatttcgtattatgatagcc

SEQ ID NO: 39907 - DNA, 25 bp, E. coli
taacggtgccgaatatacaatgaca

SEQ ID NO: 39908 - DNA, 25 bp, E. coli
taacggtgccgattatacaatgaca

SEQ ID NO: 39909 - DNA, 25 bp, E. coli
caccggagcaggcacgttttctgag

SEQ ID NO: 39910 - DNA, 25 bp, E. coli
caccggagcagggacgttttctgag

SEQ ID NO: 39911 - DNA, 25 bp, E. coli
ttttggcttgatcacacaccggagc

SEQ ID NO: 39912 - DNA, 25 bp, E. coli
ttttggcttgatgacacaccggagc

SEQ ID NO: 39913 - DNA, 25 bp, E. coli
tgtttgggacctcgcttattccgcg

SEQ ID NO: 39914 - DNA, 25 bp, E. coli
tgtttgggacctggcttattccgcg

SEQ ID NO: 39915 - DNA, 25 bp, E. coli
tcctgcgcgtgatagcagaaacgtt

SEQ ID NO: 39916 - DNA, 25 bp, E. coli
tcctgcgcgtgaaagcagaaacgtt

SEQ ID NO: 39917 - DNA, 25 bp, E. coli
gctgacattactcgcggcgggcatt

SEQ ID NO: 39918 - DNA, 25 bp, E. coli
gctgacattactggcggcgggcatt

SEQ ID NO: 39919 - DNA, 25 bp, E. coli
gcagaccgacgtcgcacatcattaa

SEQ ID NO: 39920 - DNA, 25 bp, E. coli
gcagaccgacgtggcacatcattaa

SEQ ID NO: 39921 - DNA, 25 bp, E. coli
gaacggcgtaatgtcgcagcgctga

SEQ ID NO: 39922 - DNA, 25 bp, E. coli
gaacggcgtaatctcgcagcgctga

SEQ ID NO: 39923 - DNA, 25 bp, E. coli
cattggtattggtctgtccgggctg

SEQ ID NO: 39924 - DNA, 25 bp, E. coli
cattggtattggactgtccgggctg

SEQ ID NO: 39925 - DNA, 25 bp, E. coli
gattaattttcttcctgccgaccca

SEQ ID NO: 39926 - DNA, 25 bp, E. coli
gattaattttctacctgccgaccca

SEQ ID NO: 39927 - DNA, 25 bp, E. coli
tcaactggcaagagaagaacaacag

SEQ ID NO: 39928 - DNA, 25 bp, E. coli
tcaactggcaagtgaagaacaacag

SEQ ID NO: 39929 - DNA, 25 bp, E. coli
gaccattcaggtcgcggtttacgga

SEQ ID NO: 39930 - DNA, 25 bp, E. coli
gaccattcaggtggcggtttacgga

SEQ ID NO: 39931 - DNA, 25 bp, E. coli
caaagggattattacgatatggcac

SEQ ID NO: 39932 - DNA, 25 bp, E. coli
caaagggattataacgatatggcac

SEQ ID NO: 39933 - DNA, 25 bp, E. coli
caggtgttttaatggtagcagctca

SEQ ID NO: 39934 - DNA, 25 bp, E. coli
caggtgttttaaaggtagcagctca

SEQ ID NO: 39935 - DNA, 25 bp, E. coli
aatttaacggtctgtccgcacgcta

SEQ ID NO: 39936 - DNA, 25 bp, E. coli
aatttaacggtcagtccgcacgcta

SEQ ID NO: 39937 - DNA, 25 bp, E. coli
aaccagagttgctaatcaaagggcg

SEQ ID NO: 39938 - DNA, 25 bp, E. coli
aaccagagttgcaaatcaaagggcg

SEQ ID NO: 39939 - DNA, 25 bp, E. coli
tatggcacgagtaaacctgttgaca

SEQ ID NO: 39940 - DNA, 25 bp, E. coli
tatggcacgagttaacctgttgaca

SEQ ID NO: 39941 - DNA, 25 bp, E. coli
tagcagctcatgctgtgttatccag

SEQ ID NO: 39942 - DNA, 25 bp, E. coli
tagcagctcatggtgtgttatccag

SEQ ID NO: 39943 - DNA, 25 bp, E. coli
tcgatttatgtaaaaccgaccagta

SEQ ID NO: 39944 - DNA, 25 bp, E. coli
tcgatttatgtataaccgaccagta

SEQ ID NO: 39945 - DNA, 25 bp, E. coli
tcagctaagaaagaaaaccagagtt

SEQ ID NO: 39946 - DNA, 25 bp, E. coli
tcagctaagaaacaaaaccagagtt

SEQ ID NO: 39947 - DNA, 25 bp, E. coli
gaattagcagaagcatcaacagtaa

SEQ ID NO: 39948 - DNA, 25 bp, E. coli
gaattagcagaaccatcaacagtaa

SEQ ID NO: 39949 - DNA, 25 bp, E. coli
cgcacgctataaccagattgttcag

SEQ ID NO: 39950 - DNA, 25 bp, E. coli
cgcacgctataagcagattgttcag

SEQ ID NO: 39951 - DNA, 25 bp, E. coli
tcaaagggcgaacacaacggcatgt

SEQ ID NO: 39952 - DNA, 25 bp, E. coli
tcaaagggcgaagacaacggcatgt

SEQ ID NO: 39953 - DNA, 25 bp, E. coli
caactcagggatgaagtcgatcgca

SEQ ID NO: 39954 - DNA, 25 bp, E. coli
aaccatatcaggtgaagccgggcga

SEQ ID NO: 39955 - DNA, 25 bp, E. coli
aaccatatcaggagaagccgggcga

SEQ ID NO: 39956 - DNA, 25 bp, E. coli
aaccgcgatcgccagcgtaagctga

SEQ ID NO: 39957 - DNA, 25 bp, E. coli
caactcagggatcaagtcgatcgca

SEQ ID NO: 39958 - DNA, 25 bp, E. coli
tacacatatgcacgatgaagcagcc

SEQ ID NO: 39959 - DNA, 25 bp, E. coli
tacacatatgcaggatgaagcagcc

SEQ ID NO: 39960 - DNA, 25 bp, E. coli
aaccgcgatcgcgagcgtaagctga

SEQ ID NO: 39961 - DNA, 25 bp, E. coli
tatatgaatgaaccccagctggcgc

SEQ ID NO: 39962 - DNA, 25 bp, E. coli
tatatgaatgaagcccagctggcgc

SEQ ID NO: 39963 - DNA, 25 bp, E. coli
ttcgcgaaaaacagatggctggcta

SEQ ID NO: 39964 - DNA, 25 bp, E. coli
ttcagcctcgaagtgcgtaaccgcg

SEQ ID NO: 39965 - DNA, 25 bp, E. coli
ttcgcgaaaaactgatggctggcta

SEQ ID NO: 39966 - DNA, 25 bp, E. coli
ttcagcctcgaactgcgtaaccgcg

SEQ ID NO: 39967 - DNA, 25 bp, E. coli
tgcagcccaggaagaagagttcagc

SEQ ID NO: 39968 - DNA, 25 bp, E. coli
tgcagcccaggatgaagagttcagc

SEQ ID NO: 39969 - DNA, 25 bp, E. coli
gcatcgactgcaaaacgctggctga

SEQ ID NO: 39970 - DNA, 25 bp, E. coli
gcatcgactgcataacgctggctga

SEQ ID NO: 39971 - DNA, 25 bp, E. coli
gaagcatggcgtaatcaactcaggg

SEQ ID NO: 39972 - DNA, 25 bp, E. coli
gaagcatggcgttatcaactcaggg

SEQ ID NO: 39973 - DNA, 25 bp, E. coli
gatcaaaaagatcgagaagacgctg

SEQ ID NO: 39974 - DNA, 25 bp, E. coli
gatcaaaaagatggagaagacgctg

SEQ ID NO: 39975 - DNA, 25 bp, E. coli
tattatgctggctgtttatatcggc

SEQ ID NO: 39976 - DNA, 25 bp, E. coli
tatcagcggatacaagacaatgcgc

SEQ ID NO: 39977 - DNA, 25 bp, E. coli
tatcagcggatagaagacaatgcgc

SEQ ID NO: 39978 - DNA, 25 bp, E. coli
tattatgctggcagtttatatcggc

SEQ ID NO: 39979 - DNA, 25 bp, E. coli
ttattttactgatcgccttcgcgcc

SEQ ID NO: 39980 - DNA, 25 bp, E. coli
ttattttactgaacgccttcgcgcc

SEQ ID NO: 39981 - DNA, 25 bp, E. coli
tcagggagttagacgaaaaacggca

SEQ ID NO: 39982 - DNA, 25 bp, E. coli
tcagggagttagtcgaaaaacggca

SEQ ID NO: 39983 - DNA, 25 bp, E. coli
gccaccatcctgacgattattatgc

SEQ ID NO: 39984 - DNA, 25 bp, E. coli
gccaccatcctgtcgattattatgc

SEQ ID NO: 39985 - DNA, 25 bp, E. coli
gctgaatccgaagaccagcgtcaca

SEQ ID NO: 39986 - DNA, 25 bp, E. coli
gctgaatccgaacaccagcgtcaca

SEQ ID NO: 39987 - DNA, 25 bp, E. coli
gcaacggtttgcgaccatcctgtcg

SEQ ID NO: 39988 - DNA, 25 bp, E. coli
gaagtcctgcatcaggtacaagcat

SEQ ID NO: 39989 - DNA, 25 bp, E. coli
gaagtcctgcatgaggtacaagcat

SEQ ID NO: 39990 - DNA, 25 bp, E. coli
gcaacggtttgccaccatcctgtcg

SEQ ID NO: 39991 - DNA, 25 bp, E. coli
gaacaccagcgtcacacgcggtatt

SEQ ID NO: 39992 - DNA, 25 bp, E. coli
gacaatgcgcatatcagggagttag

SEQ ID NO: 39993 - DNA, 25 bp, E. coli
gaacaccagcgtgacacgcggtatt

SEQ ID NO: 39994 - DNA, 25 bp, E. coli
gacaatgcgcatttcagggagttag

SEQ ID NO: 39995 - DNA, 25 bp, E. coli
ggcgaacggcgaattcgaccgtctt

SEQ ID NO: 39996 - DNA, 25 bp, E. coli
ggcgaacggcgatttcgaccgtctt

SEQ ID NO: 39997 - DNA, 25 bp, E. coli
cacggtttttatagcctgggcacgc

SEQ ID NO: 39998 - DNA, 25 bp, E. coli
cacggtttttattgcctgggcacgc

SEQ ID NO: 39999 - DNA, 25 bp, E. coli
ttacagtcgcgttgccgtggttcgg

SEQ ID NO: 40000 - DNA, 25 bp, E. coli
ttacagtcgcgtagccgtggttcgg

SEQ ID NO: 40001 - DNA, 25 bp, E. coli
tgcacattttataggcggcgctggt

SEQ ID NO: 40002 - DNA, 25 bp, E. coli
tgcacattttattggcggcgctggt

SEQ ID NO: 40003 - DNA, 25 bp, E. coli
tgccgaaggttcagccaacgactgg

SEQ ID NO: 40004 - DNA, 25 bp, E. coli
tgccgaaggttctgccaacgactgg

SEQ ID NO: 40005 - DNA, 25 bp, E. coli
tctctgtctcgaacgctgaaatggg

SEQ ID NO: 40006 - DNA, 25 bp, E. coli
tctctgtctcgatcgctgaaatggg

SEQ ID NO: 40007 - DNA, 25 bp, E. coli
gctattgtcgcgtaagccgtcgcca

SEQ ID NO: 40008 - DNA, 25 bp, E. coli
gctattgtcgcgaaagccgtcgcca

SEQ ID NO: 40009 - DNA, 25 bp, E. coli
cgctgctgggctttctcggcgaaca

SEQ ID NO: 40010 - DNA, 25 bp, E. coli
cgctgctgggctatctcggcgaaca

SEQ ID NO: 40011 - DNA, 25 bp, E. coli
cctgttaatggcgtcctgggcaacc

SEQ ID NO: 40012 - DNA, 25 bp, E. coli
cctgttaatggcctcctgggcaacc

SEQ ID NO: 40013 - DNA, 25 bp, E. coli
ggcaatccctgagggtacgggcaaa

SEQ ID NO: 40014 - DNA, 25 bp, E. coli
ggcaatccctgacggtacgggcaaa

SEQ ID NO: 40015 - DNA, 25 bp, E. coli
taagtctggcacactggctgacatc

SEQ ID NO: 40016 - DNA, 25 bp, E. coli
taatgcattgaatcgccgaacctgg

SEQ ID NO: 40017 - DNA, 25 bp, E. coli
taagtctggcactctggctgacatc

SEQ ID NO: 40018 - DNA, 25 bp, E. coli
taatgcattgaaacgccgaacctgg

SEQ ID NO: 40019 - DNA, 25 bp, E. coli
catttaacccgggagatgttcagcc

SEQ ID NO: 40020 - DNA, 25 bp, E. coli
catttaacccggcagatgttcagcc

SEQ ID NO: 40021 - DNA, 25 bp, E. coli
taaaagcgcggaaattcagacgcca

SEQ ID NO: 40022 - DNA, 25 bp, E. coli
taaaagcgcggatattcagacgcca

SEQ ID NO: 40023 - DNA, 25 bp, E. coli
tttctgacgcgtcgttagccgatgc

SEQ ID NO: 40024 - DNA, 25 bp, E. coli
tattctgttgagagcggcgattacc

SEQ ID NO: 40025 - DNA, 25 bp, E. coli
tattctgttgagtgcggcgattacc

SEQ ID NO: 40026 - DNA, 25 bp, E. coli
tttctgacgcgtggttagccgatgc

SEQ ID NO: 40027 - DNA, 25 bp, E. coli
tgttcagccgaacgcgcgtattctg

SEQ ID NO: 40028 - DNA, 25 bp, E. coli
tgttcagccgaaggcgcgtattctg

SEQ ID NO: 40029 - DNA, 25 bp, E. coli
gcgttggcggcttgcgcagataaaa

SEQ ID NO: 40030 - DNA, 25 bp, E. coli
gctatccagcaaccgaatgtctccg

SEQ ID NO: 40031 - DNA, 25 bp, E. coli
gcgattaccgtgtatgacaaactgg

SEQ ID NO: 40032 - DNA, 25 bp, E. coli
gcgttggcggctagcgcagataaaa

SEQ ID NO: 40033 - DNA, 25 bp, E. coli
gcgattaccgtgaatgacaaactgg

SEQ ID NO: 40034 - DNA, 25 bp, E. coli
gctatccagcaagcgaatgtctccg

SEQ ID NO: 40035 - DNA, 25 bp, E. coli
ccgttcagccggtgatcaaccaggg

SEQ ID NO: 40036 - DNA, 25 bp, E. coli
ccgttcagccggagatcaaccaggg

SEQ ID NO: 40037 - DNA, 25 bp, E. coli
ggtaaacagtcaccattcagctttg

SEQ ID NO: 40038 - DNA, 25 bp, E. coli
ggtaaacagtcagcattcagctttg

SEQ ID NO: 40039 - DNA, 25 bp, E. coli
gatccgtcagaatgtcgcactgccg

SEQ ID NO: 40040 - DNA, 25 bp, E. coli
gatccgtcagaaagtcgcactgccg

SEQ ID NO: 40041 - DNA, 25 bp, E. coli
aatcaagatagaggtacgctgctgc

SEQ ID NO: 40042 - DNA, 25 bp, E. coli
aatcaagatagacgtacgctgctgc

SEQ ID NO: 40043 - DNA, 25 bp, E. coli
cacggtagttcgtgcggaatatccg

SEQ ID NO: 40044 - DNA, 25 bp, E. coli
cacggtagttcgagcggaatatccg

SEQ ID NO: 40045 - DNA, 25 bp, E. coli
tactgctgtacagcacggtagttcg

SEQ ID NO: 40046 - DNA, 25 bp, E. coli
tactgcctgcatcaacgttatctta

SEQ ID NO: 40047 - DNA, 25 bp, E. coli
tactgctgtacaccacggtagttcg

SEQ ID NO: 40048 - DNA, 25 bp, E. coli
tactgcctgcatgaacgttatctta

SEQ ID NO: 40049 - DNA, 25 bp, E. coli
tattctcggcgtactgctgtacagc

SEQ ID NO: 40050 - DNA, 25 bp, E. coli
tattctcggcgttctgctgtacagc

SEQ ID NO: 40051 - DNA, 25 bp, E. coli
tgcgtaaccgtaagcaggaagttgc

SEQ ID NO: 40052 - DNA, 25 bp, E. coli
tgcgtaaccgtatgcaggaagttgc

SEQ ID NO: 40053 - DNA, 25 bp, E. coli
tgtattcccgattatttccctggtg

SEQ ID NO: 40054 - DNA, 25 bp, E. coli
tgtattcccgataatttccctggtg

SEQ ID NO: 40055 - DNA, 25 bp, E. coli
tcattatggtgttctggattggcgc

SEQ ID NO: 40056 - DNA, 25 bp, E. coli
tcattatggtgtactggattggcgc

SEQ ID NO: 40057 - DNA, 25 bp, E. coli
gaatatccggatatcggctctaact

SEQ ID NO: 40058 - DNA, 25 bp, E. coli
gaatatccggatttcggctctaact

SEQ ID NO: 40059 - DNA, 25 bp, E. coli
gattggcgcgaagatgcgtaaccgt

SEQ ID NO: 40060 - DNA, 25 bp, E. coli
gattggcgcgaacatgcgtaaccgt

SEQ ID NO: 40061 - DNA, 25 bp, E. coli
ggctctaacttcttcccggcagtac

SEQ ID NO: 40062 - DNA, 25 bp, E. coli
ggctctaacttcatcccggcagtac

SEQ ID NO: 40063 - DNA, 25 bp, E. coli
cagaatggtacgactcaccagaaat

SEQ ID NO: 40064 - DNA, 25 bp, E. coli
cagaatggtacgtctcaccagaaat

SEQ ID NO: 40065 - DNA, 25 bp, E. coli
ccgggatggatatcaccgcggaacg

SEQ ID NO: 40066 - DNA, 25 bp, E. coli
ccgtcgcgtggatgcggtgatggcc

SEQ ID NO: 40067 - DNA, 25 bp, E. coli
ccgggatggataacaccgcggaacg

SEQ ID NO: 40068 - DNA, 25 bp, E. coli
ccgtcgcgtggaagcggtgatggcc

SEQ ID NO: 40069 - DNA, 25 bp, E. coli
gcggaacgtgaaaagcaggtactgt

SEQ ID NO: 40070 - DNA, 25 bp, E. coli
gcggaacgtgaatagcaggtactgt

SEQ ID NO: 40071 - DNA, 25 bp, E. coli
ccgcggaacgtgaaaagcaggtact

SEQ ID NO: 40072 - DNA, 25 bp, E. coli
ccgcggaacgtgtaaagcaggtact

SEQ ID NO: 40073 - DNA, 25 bp, E. coli
cgtacagaatggaacgactcaccag

SEQ ID NO: 40074 - DNA, 25 bp, E. coli
cgtacagaatggtacgactcaccag

SEQ ID NO: 40075 - DNA, 25 bp, E. coli
gtcggcgtacagaatggtacgactc

SEQ ID NO: 40076 - DNA, 25 bp, E. coli
gtcggcgtacagtatggtacgactc

SEQ ID NO: 40077 - DNA, 25 bp, E. coli
gatatcaccgcggaacgtgaaaagc

SEQ ID NO: 40078 - DNA, 25 bp, E. coli
gatatcaccgcgcaacgtgaaaagc

SEQ ID NO: 40079 - DNA, 25 bp, E. coli
tggaagcggtgatggccgggatgga

SEQ ID NO: 40080 - DNA, 25 bp, E. coli
tggaagcggtgaaggccgggatgga

SEQ ID NO: 40081 - DNA, 25 bp, E. coli
tggtacgactcagcagaaattcatt

SEQ ID NO: 40082 - DNA, 25 bp, E. coli
tggtacgactcaccagaaattcatt

SEQ ID NO: 40083 - DNA, 25 bp, E. coli
tcaccgcggaacgtgaaaagcaggt

SEQ ID NO: 40084 - DNA, 25 bp, E. coli
tcaccgcggaacctgaaaagcaggt

SEQ ID NO: 40085 - DNA, 25 bp, E. coli
caagtttctcctagtggccagccgg

SEQ ID NO: 40086 - DNA, 25 bp, E. coli
caagtttctccttgtggccagccgg

SEQ ID NO: 40087 - DNA, 25 bp, E. coli
taaaaacagccgtagtgccacgttc

SEQ ID NO: 40088 - DNA, 25 bp, E. coli
taaaaacagccgaagtgccacgttc

SEQ ID NO: 40089 - DNA, 25 bp, E. coli
aaacagcggattacaaagcgcgggc

SEQ ID NO: 40090 - DNA, 25 bp, E. coli
aaacagcggatttcaaagcgcgggc

SEQ ID NO: 40091 - DNA, 25 bp, E. coli
ttgatggatcaatcaaatctgccgg

SEQ ID NO: 40092 - DNA, 25 bp, E. coli
ttgatggatcaaacaaatctgccgg

SEQ ID NO: 40093 - DNA, 25 bp, E. coli
tgcatgacggcaaccattatccggg

SEQ ID NO: 40094 - DNA, 25 bp, E. coli
tgcatgacggcatccattatccggg

SEQ ID NO: 40095 - DNA, 25 bp, E. coli
tgcctggcccggtaagcataatgag

SEQ ID NO: 40096 - DNA, 25 bp, E. coli
tgcctggcccggaaagcataatgag

SEQ ID NO: 40097 - DNA, 25 bp, E. coli
cctgatgatgggacataacggccag

SEQ ID NO: 40098 - DNA, 25 bp, E. coli
cctgatgatgggtcataacggccag

SEQ ID NO: 40099 - DNA, 25 bp, E. coli
gcataatgagcctgggttcgcaggt

SEQ ID NO: 40100 - DNA, 25 bp, E. coli
gctgaacgtacttaccctggcggga

SEQ ID NO: 40101 - DNA, 25 bp, E. coli
gctgaacgtactaaccctggcggga

SEQ ID NO: 40102 - DNA, 25 bp, E. coli
gcataatgagccagggttcgcaggt

SEQ ID NO: 40103 - DNA, 25 bp, E. coli
gaataatttctaaaacgcggaggcg

SEQ ID NO: 40104 - DNA, 25 bp, E. coli
gaataatttctataacgcggaggcg

SEQ ID NO: 40105 - DNA, 25 bp, E. coli
gggttgccacaatcagcaccggtct

SEQ ID NO: 40106 - DNA, 25 bp, E. coli
gggttgccacaaacagcaccggtct

SEQ ID NO: 40107 - DNA, 25 bp, E. coli
aattaccggcgcagatgatgaaagc

SEQ ID NO: 40108 - DNA, 25 bp, E. coli
aattaccggcgctgatgatgaaagc

SEQ ID NO: 40109 - DNA, 25 bp, E. coli
tacgcctggtgctgaaaagaaaatg

SEQ ID NO: 40110 - DNA, 25 bp, E. coli
tacgcctggtgcagaaaagaaaatg

SEQ ID NO: 40111 - DNA, 25 bp, E. coli
ttatcacccggcaggctaacggacg

SEQ ID NO: 40112 - DNA, 25 bp, E. coli
ttatcacccggctggctaacggacg

SEQ ID NO: 40113 - DNA, 25 bp, E. coli
tgaaagccatgacgcatcagttacg

SEQ ID NO: 40114 - DNA, 25 bp, E. coli
tgaaagccatgaggcatcagttacg

SEQ ID NO: 40115 - DNA, 25 bp, E. coli
tctggatgcaattgatcgccgtgcc

SEQ ID NO: 40116 - DNA, 25 bp, E. coli
tctggatgcaatagatcgccgtgcc

SEQ ID NO: 40117 - DNA, 25 bp, E. coli
ggcacgaccggaaaaggtttacgca

SEQ ID NO: 40118 - DNA, 25 bp, E. coli
ggcacgaccggataaggtttacgca

SEQ ID NO: 40119 - DNA, 25 bp, E. coli
gcaataaaaggtgtggcgcaggcca

SEQ ID NO: 40120 - DNA, 25 bp, E. coli
gcaataaaaggtctggcgcaggcca

SEQ ID NO: 40121 - DNA, 25 bp, E. coli
gaaaacggcctcttcagttgccagg

SEQ ID NO: 40122 - DNA, 25 bp, E. coli
gaaaacggcctcatcagttgccagg

SEQ ID NO: 40123 - DNA, 25 bp, E. coli
ctttgaacgtgatcgggaccggatg

SEQ ID NO: 40124 - DNA, 25 bp, E. coli
ctttgaacgtgaacgggaccggatg

SEQ ID NO: 40125 - DNA, 25 bp, E. coli
gtgaagattacgtctgccggaccgc

SEQ ID NO: 40126 - DNA, 25 bp, E. coli
gtgaagattacgactgccggaccgc

SEQ ID NO: 40127 - DNA, 25 bp, E. coli
gaccgctggcagtaacctttgaacg

SEQ ID NO: 40128 - DNA, 25 bp, E. coli
gaccgctggcagaaacctttgaacg

SEQ ID NO: 40129 - DNA, 25 bp, E. coli
tacagagcctgatagaaaagctgct

SEQ ID NO: 40130 - DNA, 25 bp, E. coli
tacagagcctgaaagaaaagctgct

SEQ ID NO: 40131 - DNA, 25 bp, E. coli
tatacctggaaccatattcgacaaa

SEQ ID NO: 40132 - DNA, 25 bp, E. coli
tatgatagtcacgacgaagaggtcg

SEQ ID NO: 40133 - DNA, 25 bp, E. coli
tatacctggaacgatattcgacaaa

SEQ ID NO: 40134 - DNA, 25 bp, E. coli
tatcgaagtactggaatatacctgg

SEQ ID NO: 40135 - DNA, 25 bp, E. coli
tatgatagtcaccacgaagaggtcg

SEQ ID NO: 40136 - DNA, 25 bp, E. coli
tatcgaagtactcgaatatacctgg

SEQ ID NO: 40137 - DNA, 25 bp, E. coli
tgataccagcaacgtacagagcctg

SEQ ID NO: 40138 - DNA, 25 bp, E. coli
tgatttctcagaacttccgccacag

SEQ ID NO: 40139 - DNA, 25 bp, E. coli
tgataccagcaaggtacagagcctg

SEQ ID NO: 40140 - DNA, 25 bp, E. coli
tgatttctcagatcttccgccacag

SEQ ID NO: 40141 - DNA, 25 bp, E. coli
tcgataatatcgtcaaggccgcggg

SEQ ID NO: 40142 - DNA, 25 bp, E. coli
tccgccacagaaagccattgagaaa

SEQ ID NO: 40143 - DNA, 25 bp, E. coli
tccgccacagaatgccattgagaaa

SEQ ID NO: 40144 - DNA, 25 bp, E. coli
tcgacaaaaagaaaaggcccttgat

SEQ ID NO: 40145 - DNA, 25 bp, E. coli
tcgacaaaaagataaggcccttgat

SEQ ID NO: 40146 - DNA, 25 bp, E. coli
tcgataatatcgacaaggccgcggg

SEQ ID NO: 40147 - DNA, 25 bp, E. coli
gaatttgccgaaaatggttacgaag

SEQ ID NO: 40148 - DNA, 25 bp, E. coli
gaatttgccgaatatggttacgaag

SEQ ID NO: 40149 - DNA, 25 bp, E. coli
gaaaagctgctgttatgcgcggtta

SEQ ID NO: 40150 - DNA, 25 bp, E. coli
gaaaagctgctgatatgcgcggtta

SEQ ID NO: 40151 - DNA, 25 bp, E. coli
catcattgatgtcgatatccccgga

SEQ ID NO: 40152 - DNA, 25 bp, E. coli
catcattgatgtggatatccccgga

SEQ ID NO: 40153 - DNA, 25 bp, E. coli
tatccccggagttaacggtatccag

SEQ ID NO: 40154 - DNA, 25 bp, E. coli
tatccccggagtaaacggtatccag

SEQ ID NO: 40155 - DNA, 25 bp, E. coli
tatcattgcggcaattgaagctgca

SEQ ID NO: 40156 - DNA, 25 bp, E. coli
tatcattgcggctattgaagctgca

SEQ ID NO: 40157 - DNA, 25 bp, E. coli
ttcgcacaacgttacaaaatcggct

SEQ ID NO: 40158 - DNA, 25 bp, E. coli
ttcgcacaacgtaacaaaatcggct

SEQ ID NO: 40159 - DNA, 25 bp, E. coli
tgaagctgcaaaaaatggctactgc

SEQ ID NO: 40160 - DNA, 25 bp, E. coli
tgaagctgcaaataatggctactgc

SEQ ID NO: 40161 - DNA, 25 bp, E. coli
tcagcgggtggaaacacttaagcct

SEQ ID NO: 40162 - DNA, 25 bp, E. coli
tcagcgggtggatacacttaagcct

SEQ ID NO: 40163 - DNA, 25 bp, E. coli
cgggaaacattgtgctgatgctggc

SEQ ID NO: 40164 - DNA, 25 bp, E. coli
cgggaaacattgagctgatgctggc

SEQ ID NO: 40165 - DNA, 25 bp, E. coli
tggatctttacagattcgcacaacg

SEQ ID NO: 40166 - DNA, 25 bp, E. coli
tggaagtttaacctccgaccagcaa

SEQ ID NO: 40167 - DNA, 25 bp, E. coli
tggaagtttaacgtccgaccagcaa

SEQ ID NO: 40168 - DNA, 25 bp, E. coli
tggatctttacacattcgcacaacg

SEQ ID NO: 40169 - DNA, 25 bp, E. coli
gatgaccatcctcttgctatcgcag

SEQ ID NO: 40170 - DNA, 25 bp, E. coli
gatgctggcgcttatggtttcgtga

SEQ ID NO: 40171 - DNA, 25 bp, E. coli
gatgctggcgctaatggtttcgtga

SEQ ID NO: 40172 - DNA, 25 bp, E. coli
gatgaccatcctgttgctatcgcag

SEQ ID NO: 40173 - DNA, 25 bp, E. coli
caaatttacccatcatgcagcgcgt

SEQ ID NO: 40174 - DNA, 25 bp, E. coli
caaatttacccaacatgcagcgcgt

SEQ ID NO: 40175 - DNA, 25 bp, E. coli
catctgatgacctgtggatcgagag

SEQ ID NO: 40176 - DNA, 25 bp, E. coli
catctgatgaccagtggatcgagag

SEQ ID NO: 40177 - DNA, 25 bp, E. coli
tatccgatgcggtatttaccatcgc

SEQ ID NO: 40178 - DNA, 25 bp, E. coli
tatccgatgcggaatttaccatcgc

SEQ ID NO: 40179 - DNA, 25 bp, E. coli
tatattcgtcccatatccgatgcgg

SEQ ID NO: 40180 - DNA, 25 bp, E. coli
tatattcgtcccttatccgatgcgg

SEQ ID NO: 40181 - DNA, 25 bp, E. coli
tggtacatgggctaatatattcgtc

SEQ ID NO: 40182 - DNA, 25 bp, E. coli
tggtacatgggcaaatatattcgtc

SEQ ID NO: 40183 - DNA, 25 bp, E. coli
gcgcagcgttcttctctgttggtcg

SEQ ID NO: 40184 - DNA, 25 bp, E. coli
gcgatccaacaaatacacaccacgg

SEQ ID NO: 40185 - DNA, 25 bp, E. coli
gcgatccaacaattacacaccacgg

SEQ ID NO: 40186 - DNA, 25 bp, E. coli
gcgcagcgttctactctgttggtcg

SEQ ID NO: 40187 - DNA, 25 bp, E. coli
cggtatttaccaacgcatctgatga

SEQ ID NO: 40188 - DNA, 25 bp, E. coli
cggtatttaccatcgcatctgatga

SEQ ID NO: 40189 - DNA, 25 bp, E. coli
gatcgagagtttagcgatccaacaa

SEQ ID NO: 40190 - DNA, 25 bp, E. coli
gatcgagagttttgcgatccaacaa

SEQ ID NO: 40191 - DNA, 25 bp, E. coli
ggctacccgattcgcgcagcgttct

SEQ ID NO: 40192 - DNA, 25 bp, E. coli
ggctacccgattggcgcagcgttct

SEQ ID NO: 40193 - DNA, 25 bp, E. coli
tacacaccacgggaaatttacccaa

SEQ ID NO: 40194 - DNA, 25 bp, E. coli
tacacaccacggcaaatttacccaa

SEQ ID NO: 40195 - DNA, 25 bp, E. coli
catgagtacagctccaaagaaggcg

SEQ ID NO: 40196 - DNA, 25 bp, E. coli
catgagtacagcaccaaagaaggcg

SEQ ID NO: 40197 - DNA, 25 bp, E. coli
taaagacgtgctggcttcccgtgga

SEQ ID NO: 40198 - DNA, 25 bp, E. coli
tacagccctgtgcagcgtattgcct

SEQ ID NO: 40199 - DNA, 25 bp, E. coli
taaagacgtgctcgcttcccgtgga

SEQ ID NO: 40200 - DNA, 25 bp, E. coli
tacagccctgtggagcgtattgcct

SEQ ID NO: 40201 - DNA, 25 bp, E. coli
tgacccttgagcgtttagagcgtgg

SEQ ID NO: 40202 - DNA, 25 bp, E. coli
tgctctcatcgatgccgggttgcgc

SEQ ID NO: 40203 - DNA, 25 bp, E. coli
tgatgtcgaaatcgtcaagccgcag

SEQ ID NO: 40204 - DNA, 25 bp, E. coli
tgctctcatcgaagccgggttgcgc

SEQ ID NO: 40205 - DNA, 25 bp, E. coli
tgacccttgagcctttagagcgtgg

SEQ ID NO: 40206 - DNA, 25 bp, E. coli
tgatgtcgaaatggtcaagccgcag

SEQ ID NO: 40207 - DNA, 25 bp, E. coli
tcctgctcaacctgaaagggctggc

SEQ ID NO: 40208 - DNA, 25 bp, E. coli
tcctgctcaaccagaaagggctggc

SEQ ID NO: 40209 - DNA, 25 bp, E. coli
tcattcggaagaagatgagcgccca

SEQ ID NO: 40210 - DNA, 25 bp, E. coli
tcattcggaagatgatgagcgccca

SEQ ID NO: 40211 - DNA, 25 bp, E. coli
gctgcgccctgtagacgatctggaa

SEQ ID NO: 40212 - DNA, 25 bp, E. coli
gctgcgccctgttgacgatctggaa

SEQ ID NO: 40213 - DNA, 25 bp, E. coli
gtatcaaagttctgcgcggtcgtgg

SEQ ID NO: 40214 - DNA, 25 bp, E. coli
gtatcaaagttcagcgcggtcgtgg

SEQ ID NO: 40215 - DNA, 25 bp, E. coli
gaggttgagctcgttaaaacgccta

SEQ ID NO: 40216 - DNA, 25 bp, E. coli
gaggttgagctccttaaaacgccta

SEQ ID NO: 40217 - DNA, 25 bp, E. coli
aaccttgtggcgttgttaaaagacg

SEQ ID NO: 40218 - DNA, 25 bp, E. coli
aatatgcagagataacaggtatccc

SEQ ID NO: 40219 - DNA, 25 bp, E. coli
aaccttgtggcgatgttaaaagacg

SEQ ID NO: 40220 - DNA, 25 bp, E. coli
aatatgcagagaaaacaggtatccc

SEQ ID NO: 40221 - DNA, 25 bp, E. coli
caaaaagatgttcgctgacggtcga

SEQ ID NO: 40222 - DNA, 25 bp, E. coli
caaacgcgccaaaatggaaaagcct

SEQ ID NO: 40223 - DNA, 25 bp, E. coli
caaacgcgccaatatggaaaagcct

SEQ ID NO: 40224 - DNA, 25 bp, E. coli
caaaaagatgttggctgacggtcga

SEQ ID NO: 40225 - DNA, 25 bp, E. coli
caggtatccctcataatacatgcaa

SEQ ID NO: 40226 - DNA, 25 bp, E. coli
caggtatccctcttaatacatgcaa

SEQ ID NO: 40227 - DNA, 25 bp, E. coli
taaaagacgcttaggctaacagcta

SEQ ID NO: 40228 - DNA, 25 bp, E. coli
tgtcaggtataaccatcaatatcaa

SEQ ID NO: 40229 - DNA, 25 bp, E. coli
tgtcaggtataagcatcaatatcaa

SEQ ID NO: 40230 - DNA, 25 bp, E. coli
ccatcaatatcattgtgaatgcccc

SEQ ID NO: 40231 - DNA, 25 bp, E. coli
cctatgtatccctgcagaaatatgc

SEQ ID NO: 40232 - DNA, 25 bp, E. coli
cctatgtatcccagcagaaatatgc

SEQ ID NO: 40233 - DNA, 25 bp, E. coli
ccatcaatatcaatgtgaatgcccc

SEQ ID NO: 40234 - DNA, 25 bp, E. coli
gaaaagcctgaagtaaaccttgtgg

SEQ ID NO: 40235 - DNA, 25 bp, E. coli
gaaaagcctgaactaaaccttgtgg

SEQ ID NO: 40236 - DNA, 25 bp, E. coli
gtcgaattattatccgccccaaacg

SEQ ID NO: 40237 - DNA, 25 bp, E. coli
gtcgaattattaaccgccccaaacg

SEQ ID NO: 40238 - DNA, 25 bp, E. coli
taaaagacgctttggctaacagcta

SEQ ID NO: 40239 - DNA, 25 bp, E. coli
aagttattccactgtcgccaggcca

SEQ ID NO: 40240 - DNA, 25 bp, E. coli
aagttattccacagtcgccaggcca

SEQ ID NO: 40241 - DNA, 25 bp, E. coli
tatctgtcgcttagcaggacatctt

SEQ ID NO: 40242 - DNA, 25 bp, E. coli
tatctgtcgctttgcaggacatctt

SEQ ID NO: 40243 - DNA, 25 bp, E. coli
ttcacatttctagagcgtcgcccaa

SEQ ID NO: 40244 - DNA, 25 bp, E. coli
ttcacatttctacagcgtcgcccaa

SEQ ID NO: 40245 - DNA, 25 bp, E. coli
tgtcgccaggccatacctatgggat

SEQ ID NO: 40246 - DNA, 25 bp, E. coli
tgtcgccaggccttacctatgggat

SEQ ID NO: 40247 - DNA, 25 bp, E. coli
tcgctttgcaggtcatctttcacat

SEQ ID NO: 40248 - DNA, 25 bp, E. coli
tcgctttgcaggacatctttcacat

SEQ ID NO: 40249 - DNA, 25 bp, E. coli
ccatacctatgggatgtttatggaa

SEQ ID NO: 40250 - DNA, 25 bp, E. coli
ccatacctatggcatgtttatggaa

SEQ ID NO: 40251 - DNA, 25 bp, E. coli
gctttaaagagtaaactgagtcgta

SEQ ID NO: 40252 - DNA, 25 bp, E. coli
gctttaaagagttaactgagtcgta

SEQ ID NO: 40253 - DNA, 25 bp, E. coli
ccggttatgagtacgcccgtgaaat

SEQ ID NO: 40254 - DNA, 25 bp, E. coli
ccggttatgagttcgcccgtgaaat

SEQ ID NO: 40255 - DNA, 25 bp, E. coli
ggaacgctttaaagagttaactgag

SEQ ID NO: 40256 - DNA, 25 bp, E. coli
ggaacgctttaatgagttaactgag

SEQ ID NO: 40257 - DNA, 25 bp, E. coli
ggacatctttcacatttctacagcg

SEQ ID NO: 40258 - DNA, 25 bp, E. coli
ggacatctttcagatttctacagcg

SEQ ID NO: 40259 - DNA, 25 bp, E. coli
gatgttcaaagttattccactgtcg

SEQ ID NO: 40260 - DNA, 25 bp, E. coli
gatgttcaaagtaattccactgtcg

SEQ ID NO: 40261 - DNA, 25 bp, E. coli
catgcacgtcatcgcaaagagagca

SEQ ID NO: 40262 - DNA, 25 bp, E. coli
catgcacgtcatggcaaagagagca

SEQ ID NO: 40263 - DNA, 25 bp, E. coli
tatggacgggctatcgtaatgccca

SEQ ID NO: 40264 - DNA, 25 bp, E. coli
tatggacgggctttcgtaatgccca

SEQ ID NO: 40265 - DNA, 25 bp, E. coli
tcgcactgactgttgacacgctggt

SEQ ID NO: 40266 - DNA, 25 bp, E. coli
tccgtgacggaaatgaacggctggc

SEQ ID NO: 40267 - DNA, 25 bp, E. coli
tccgtgacggaattgaacggctggc

SEQ ID NO: 40268 - DNA, 25 bp, E. coli
tcgcactgactgatgacacgctggt

SEQ ID NO: 40269 - DNA, 25 bp, E. coli
tccgcgatggcgtcatgttaaaaac

SEQ ID NO: 40270 - DNA, 25 bp, E. coli
tccgcgatggcgacatgttaaaaac

SEQ ID NO: 40271 - DNA, 25 bp, E. coli
tcatcgaactggaacgtgaagagca

SEQ ID NO: 40272 - DNA, 25 bp, E. coli
tcatcgaactggtacgtgaagagca

SEQ ID NO: 40273 - DNA, 25 bp, E. coli
gaaaaaatcggtttgccgctactgg

SEQ ID NO: 40274 - DNA, 25 bp, E. coli
gacatttttgatggtgaagcgcgct

SEQ ID NO: 40275 - DNA, 25 bp, E. coli
gacatttttgatcgtgaagcgcgct

SEQ ID NO: 40276 - DNA, 25 bp, E. coli
gaaaaaatcggtatgccgctactgg

SEQ ID NO: 40277 - DNA, 25 bp, E. coli
cattctgttctgaaaacggcccgca

SEQ ID NO: 40278 - DNA, 25 bp, E. coli
cattctgttctgtaaacggcccgca

SEQ ID NO: 40279 - DNA, 25 bp, E. coli
gattcgctggatcctaatgagctgg

SEQ ID NO: 40280 - DNA, 25 bp, E. coli
gattcgctggatgctaatgagctgg

SEQ ID NO: 40281 - DNA, 25 bp, E. coli
taacgaaggcgtgttcaccgctgca

SEQ ID NO: 40282 - DNA, 25 bp, E. coli
taacgaaggcgtcttcaccgctgca

SEQ ID NO: 40283 - DNA, 25 bp, E. coli
aaagtacgtgagttgctgctgagca

SEQ ID NO: 40284 - DNA, 25 bp, E. coli
aaagtacgtgagatgctgctgagca

SEQ ID NO: 40285 - DNA, 25 bp, E. coli
aaagcaggcgcgaggtacagctaca

SEQ ID NO: 40286 - DNA, 25 bp, E. coli
aaagcaggcgcgtggtacagctaca

SEQ ID NO: 40287 - DNA, 25 bp, E. coli
taccggtggtaacgcgctgaaattc

SEQ ID NO: 40288 - DNA, 25 bp, E. coli
taccggtggtaaggcgctgaaattc

SEQ ID NO: 40289 - DNA, 25 bp, E. coli
tatcgtcgttgactccgtggcggca

SEQ ID NO: 40290 - DNA, 25 bp, E. coli
tatcgtcgttgagtccgtggcggca

SEQ ID NO: 40291 - DNA, 25 bp, E. coli
tttatcgatgctcaacacgcgctgg

SEQ ID NO: 40292 - DNA, 25 bp, E. coli
tttatcgatgctgaacacgcgctgg

SEQ ID NO: 40293 - DNA, 25 bp, E. coli
tcatgcgcctggctgaagaccgttc

SEQ ID NO: 40294 - DNA, 25 bp, E. coli
tcatgcgcctgggtgaagaccgttc

SEQ ID NO: 40295 - DNA, 25 bp, E. coli
gctggacccaatctacgcacgtaaa

SEQ ID NO: 40296 - DNA, 25 bp, E. coli
gctggacccaatgtacgcacgtaaa

SEQ ID NO: 40297 - DNA, 25 bp, E. coli
gaattccagatcgtctacggcgaag

SEQ ID NO: 40298 - DNA, 25 bp, E. coli
gaattccagatcctctacggcgaag

SEQ ID NO: 40299 - DNA, 25 bp, E. coli
gaaatcggcgacactcacatgggcc

SEQ ID NO: 40300 - DNA, 25 bp, E. coli
gaaatcggcgactctcacatgggcc

SEQ ID NO: 40301 - DNA, 25 bp, E. coli
cccgcgtgaaagtggtgaagaacaa

SEQ ID NO: 40302 - DNA, 25 bp, E. coli
cccgcgtgaaagaggtgaagaacaa

SEQ ID NO: 40303 - DNA, 25 bp, E. coli
taacctgaagcactccaacacgctg

SEQ ID NO: 40304 - DNA, 25 bp, E. coli
taacctgaagcagtccaacacgctg

SEQ ID NO: 40305 - DNA, 25 bp, E. coli
cagcagaacctgtatacccggatgg

SEQ ID NO: 40306 - DNA, 25 bp, E. coli
cagcagaacctgaatacccggatgg

SEQ ID NO: 40307 - DNA, 25 bp, E. coli
atttccgatgacaggtgtctggcgg

SEQ ID NO: 40308 - DNA, 25 bp, E. coli
agtgctccagccagtgagtcgaatg

SEQ ID NO: 40309 - DNA, 25 bp, E. coli
atgcgcgagagtgctccagccagtg

SEQ ID NO: 40310 - DNA, 25 bp, E. coli
atgcgcgagagtcctccagccagtg

SEQ ID NO: 40311 - DNA, 25 bp, E. coli
atttccgatgactggtgtctggcgg

SEQ ID NO: 40312 - DNA, 25 bp, E. coli
agaacctgaatagccggatggcctg

SEQ ID NO: 40313 - DNA, 25 bp, E. coli
agtgctccagcctgtgagtcgaatg

SEQ ID NO: 40314 - DNA, 25 bp, E. coli
agaacctgaatacccggatggcctg

SEQ ID NO: 40315 - DNA, 25 bp, E. coli
ttccgatgactggtgtctggcggcc

SEQ ID NO: 40316 - DNA, 25 bp, E. coli
ttccgatgactgctgtctggcggcc

SEQ ID NO: 40317 - DNA, 25 bp, E. coli
tgactggtgtctcgcggccgtcgct

SEQ ID NO: 40318 - DNA, 25 bp, E. coli
tgactggtgtctggcggccgtcgct

SEQ ID NO: 40319 - DNA, 25 bp, E. coli
gcagaacctgaatacccggatggcc

SEQ ID NO: 40320 - DNA, 25 bp, E. coli
gcagaacctgaaaacccggatggcc

SEQ ID NO: 40321 - DNA, 25 bp, E. coli
gacagcagaaccagaatacccggat

SEQ ID NO: 40322 - DNA, 25 bp, E. coli
gacagcagaacctgaatacccggat

SEQ ID NO: 40323 - DNA, 25 bp, E. coli
gagagtgctccagccagtgagtcga

SEQ ID NO: 40324 - DNA, 25 bp, E. coli
gagtgctccagccagtgagtcgaat

SEQ ID NO: 40325 - DNA, 25 bp, E. coli
gagtgctccagcgagtgagtcgaat

SEQ ID NO: 40326 - DNA, 25 bp, E. coli
gagagtgctccacccagtgagtcga

SEQ ID NO: 40327 - DNA, 25 bp, E. coli
aatgccacggcttccttcactcttg

SEQ ID NO: 40328 - DNA, 25 bp, E. coli
aatgccacggctaccttcactcttg

SEQ ID NO: 40329 - DNA, 25 bp, E. coli
cacgctttggctgcggatagcacga

SEQ ID NO: 40330 - DNA, 25 bp, E. coli
cacttgaaaatagggtgtcagcggc

SEQ ID NO: 40331 - DNA, 25 bp, E. coli
cacttgaaaatacggtgtcagcggc

SEQ ID NO: 40332 - DNA, 25 bp, E. coli
cacgctttggctccggatagcacga

SEQ ID NO: 40333 - DNA, 25 bp, E. coli
aacgcggcgaaggaatttaacaaca

SEQ ID NO: 40334 - DNA, 25 bp, E. coli
aacgcggcgaagcaatttaacaaca

SEQ ID NO: 40335 - DNA, 25 bp, E. coli
ccggctaatggccacacaggtgcct

SEQ ID NO: 40336 - DNA, 25 bp, E. coli
ccggctaatggcgacacaggtgcct

SEQ ID NO: 40337 - DNA, 25 bp, E. coli
gcacgattactaaccgcggctatgt

SEQ ID NO: 40338 - DNA, 25 bp, E. coli
gaatacagcttctgaatgagcagca

SEQ ID NO: 40339 - DNA, 25 bp, E. coli
gaatacagcttcagaatgagcagca

SEQ ID NO: 40340 - DNA, 25 bp, E. coli
gcacgattactatccgcggctatgt

SEQ ID NO: 40341 - DNA, 25 bp, E. coli
cgtattttgctgacaccctgtggta

SEQ ID NO: 40342 - DNA, 25 bp, E. coli
cgtattttgctgtcaccctgtggta

SEQ ID NO: 40343 - DNA, 25 bp, E. coli
gttgatctgatgcaaaacgcggcga

SEQ ID NO: 40344 - DNA, 25 bp, E. coli
gttgatctgatggaaaacgcggcga

SEQ ID NO: 40345 - DNA, 25 bp, E. coli
ggcgttgcagatagccacaatgcca

SEQ ID NO: 40346 - DNA, 25 bp, E. coli
ggcgttgcagattgccacaatgcca

SEQ ID NO: 40347 - DNA, 25 bp, E. coli
gtagtgtggccgctgaatcaaccaa

SEQ ID NO: 40348 - DNA, 25 bp, E. coli
gtagtgtggccggtgaatcaaccaa

SEQ ID NO: 40349 - DNA, 25 bp, E. coli
caaagagcagttgacgtgtgcacga

SEQ ID NO: 40350 - DNA, 25 bp, E. coli
caaagagcagttcacgtgtgcacga

SEQ ID NO: 40351 - DNA, 25 bp, E. coli
cttttgggagatcccgttgccaaac

SEQ ID NO: 40352 - DNA, 25 bp, E. coli
cttttgggagatgccgttgccaaac

SEQ ID NO: 40353 - DNA, 25 bp, E. coli
taaagcgactctattgggagatgcc

SEQ ID NO: 40354 - DNA, 25 bp, E. coli
taaagcgactcttttgggagatgcc

SEQ ID NO: 40355 - DNA, 25 bp, E. coli
aaagatcctaatgacaagcctgagt

SEQ ID NO: 40356 - DNA, 25 bp, E. coli
aaagatcctaatcacaagcctgagt

SEQ ID NO: 40357 - DNA, 25 bp, E. coli
tgggcgcgcatccaaagagcagttc

SEQ ID NO: 40358 - DNA, 25 bp, E. coli
tgggcgcgcatcgaaagagcagttc

SEQ ID NO: 40359 - DNA, 25 bp, E. coli
tgagagtgataaagcgactcttttg

SEQ ID NO: 40360 - DNA, 25 bp, E. coli
tgagagtgataatgcgactcttttg

SEQ ID NO: 40361 - DNA, 25 bp, E. coli
gcgcatccaaagtgcagttcacgtg

SEQ ID NO: 40362 - DNA, 25 bp, E. coli
gcgcatccaaagagcagttcacgtg

SEQ ID NO: 40363 - DNA, 25 bp, E. coli
gactcttttgggtgatgccgttgcc

SEQ ID NO: 40364 - DNA, 25 bp, E. coli
gactcttttgggagatgccgttgcc

SEQ ID NO: 40365 - DNA, 25 bp, E. coli
cgatgccgcaggagatatcgtttca

SEQ ID NO: 40366 - DNA, 25 bp, E. coli
cgatgccgcaggtgatatcgtttca

SEQ ID NO: 40367 - DNA, 25 bp, E. coli
cgtgtgcacgatgccgcaggagata

SEQ ID NO: 40368 - DNA, 25 bp, E. coli
cgtgtgcacgatcccgcaggagata

SEQ ID NO: 40369 - DNA, 25 bp, E. coli
tcacaagcctgacttggtttttgcg

SEQ ID NO: 40370 - DNA, 25 bp, E. coli
tcacaagcctgagttggtttttgcg

SEQ ID NO: 40371 - DNA, 25 bp, E. coli
aacgcctgggcttaatctatatatg

SEQ ID NO: 40372 - DNA, 25 bp, E. coli
agaagtaacgtcaccattggttgca

SEQ ID NO: 40373 - DNA, 25 bp, E. coli
agaagtaacgtctccattggttgca

SEQ ID NO: 40374 - DNA, 25 bp, E. coli
agttcaactggatatataacgcctg

SEQ ID NO: 40375 - DNA, 25 bp, E. coli
agttcaactggaaatataacgcctg

SEQ ID NO: 40376 - DNA, 25 bp, E. coli
aacgcctgggctaaatctatatatg

SEQ ID NO: 40377 - DNA, 25 bp, E. coli
tttagagggtattttcaatcacggc

SEQ ID NO: 40378 - DNA, 25 bp, E. coli
tttagagggtatattcaatcacggc

SEQ ID NO: 40379 - DNA, 25 bp, E. coli
tgttggccctcatagtactccctat

SEQ ID NO: 40380 - DNA, 25 bp, E. coli
tgttggccctcaaagtactccctat

SEQ ID NO: 40381 - DNA, 25 bp, E. coli
tccatctatggcgagggtttcacaa

SEQ ID NO: 40382 - DNA, 25 bp, E. coli
tccatctatggccagggtttcacaa

SEQ ID NO: 40383 - DNA, 25 bp, E. coli
tctcagttggcataaggtagtggct

SEQ ID NO: 40384 - DNA, 25 bp, E. coli
tctcagttggcaaaaggtagtggct

SEQ ID NO: 40385 - DNA, 25 bp, E. coli
cattggttgcataaattgtggcggc

SEQ ID NO: 40386 - DNA, 25 bp, E. coli
cattggttgcattaattgtggcggc

SEQ ID NO: 40387 - DNA, 25 bp, E. coli
gattcattttcctgagtggttgcca

SEQ ID NO: 40388 - DNA, 25 bp, E. coli
gattcattttccagagtggttgcca

SEQ ID NO: 40389 - DNA, 25 bp, E. coli
taaattctgttactgttggccctca

SEQ ID NO: 40390 - DNA, 25 bp, E. coli
tcaatcacggctttcagaagtaacg

SEQ ID NO: 40391 - DNA, 25 bp, E. coli
taaattctgttagtgttggccctca

SEQ ID NO: 40392 - DNA, 25 bp, E. coli
tcaatcacggctatcagaagtaacg

SEQ ID NO: 40393 - DNA, 25 bp, E. coli
cattttatgaaagcgaccggttcga

SEQ ID NO: 40394 - DNA, 25 bp, E. coli
cagtttattgagcaaccggtgccga

SEQ ID NO: 40395 - DNA, 25 bp, E. coli
cagtttattgaggaaccggtgccga

SEQ ID NO: 40396 - DNA, 25 bp, E. coli
cattttatgaaaccgaccggttcga

SEQ ID NO: 40397 - DNA, 25 bp, E. coli
tatgctaaccatattgcccgacgga

SEQ ID NO: 40398 - DNA, 25 bp, E. coli
tactgaaaaatatgcgtgccgccac

SEQ ID NO: 40399 - DNA, 25 bp, E. coli
tatgctaaccattttgcccgacgga

SEQ ID NO: 40400 - DNA, 25 bp, E. coli
tacgccgtagccaggaactgttggg

SEQ ID NO: 40401 - DNA, 25 bp, E. coli
tactgaaaaataagcgtgccgccac

SEQ ID NO: 40402 - DNA, 25 bp, E. coli
tacgccgtagcctggaactgttggg

SEQ ID NO: 40403 - DNA, 25 bp, E. coli
tttaaatctcacatcggcgtcagcc

SEQ ID NO: 40404 - DNA, 25 bp, E. coli
tttaaatctcacttcggcgtcagcc

SEQ ID NO: 40405 - DNA, 25 bp, E. coli
tgattatttgcggtgaaaagccggg

SEQ ID NO: 40406 - DNA, 25 bp, E. coli
tgattatttgcgctgaaaagccggg

SEQ ID NO: 40407 - DNA, 25 bp, E. coli
gactctgccgatcggttttccgtaa

SEQ ID NO: 40408 - DNA, 25 bp, E. coli
gactctgccgatgggttttccgtaa

SEQ ID NO: 40409 - DNA, 25 bp, E. coli
cgagtaatgatgtgtcgccgcacat

SEQ ID NO: 40410 - DNA, 25 bp, E. coli
cgagtaatgatgagtcgccgcacat

SEQ ID NO: 40411 - DNA, 25 bp, E. coli
gatccagtcagtagcccgttgagcg

SEQ ID NO: 40412 - DNA, 25 bp, E. coli
gatccagtcagttgcccgttgagcg

SEQ ID NO: 40413 - DNA, 25 bp, E. coli
gatgaacgcataaacctcctgctgg

SEQ ID NO: 40414 - DNA, 25 bp, E. coli
gatgaacgcatatacctcctgctgg

SEQ ID NO: 40415 - DNA, 25 bp, E. coli
attaccgtgacatcgcgctcaccta

SEQ ID NO: 40416 - DNA, 25 bp, E. coli
attaccgtgacaacgcgctcaccta

SEQ ID NO: 40417 - DNA, 25 bp, E. coli
acaggcgaatgccaccattactgac

SEQ ID NO: 40418 - DNA, 25 bp, E. coli
aaaccattaccgagacaacgcgctc

SEQ ID NO: 40419 - DNA, 25 bp, E. coli
acaggcgaatgcgaccattactgac

SEQ ID NO: 40420 - DNA, 25 bp, E. coli
aaaccattaccgtgacaacgcgctc

SEQ ID NO: 40421 - DNA, 25 bp, E. coli
aacaaaccattagcgtgacaacgcg

SEQ ID NO: 40422 - DNA, 25 bp, E. coli
aacaaaccattaccgtgacaacgcg

SEQ ID NO: 40423 - DNA, 25 bp, E. coli
tgacaacgcgctgacctacaaagcg

SEQ ID NO: 40424 - DNA, 25 bp, E. coli
tgacaacgcgctcacctacaaagcg

SEQ ID NO: 40425 - DNA, 25 bp, E. coli
gctggaacaggccaatgccaccatt

SEQ ID NO: 40426 - DNA, 25 bp, E. coli
gctggaacaggcgaatgccaccatt

SEQ ID NO: 40427 - DNA, 25 bp, E. coli
gaacaggcgaatcccaccattactg

SEQ ID NO: 40428 - DNA, 25 bp, E. coli
gaacaggcgaatgccaccattactg

SEQ ID NO: 40429 - DNA, 25 bp, E. coli
cgtgacaacgcgctcacctacaaag

SEQ ID NO: 40430 - DNA, 25 bp, E. coli
ctggaacaggcgtatgccaccatta

SEQ ID NO: 40431 - DNA, 25 bp, E. coli
ctggaacaggcgaatgccaccatta

SEQ ID NO: 40432 - DNA, 25 bp, E. coli
cgtgacaacgcggtcacctacaaag

SEQ ID NO: 40433 - DNA, 25 bp, E. coli
ggaacaggcgaaagccaccattact

SEQ ID NO: 40434 - DNA, 25 bp, E. coli
ggaacaggcgaatgccaccattact

SEQ ID NO: 40435 - DNA, 25 bp, E. coli
tggaacaggcgattgccaccattac

SEQ ID NO: 40436 - DNA, 25 bp, E. coli
tggaacaggcgaatgccaccattac

SEQ ID NO: 40437 - DNA, 25 bp, E. coli
caaagaaggtctgaacggtgccgtc

SEQ ID NO: 40438 - DNA, 25 bp, E. coli
caaagaaggtctcaacggtgccgtc

SEQ ID NO: 40439 - DNA, 25 bp, E. coli
cacagggattcagtatcgttatgcg

SEQ ID NO: 40440 - DNA, 25 bp, E. coli
cacagggattcactatcgttatgcg

SEQ ID NO: 40441 - DNA, 25 bp, E. coli
catgacgatatgatcctttacggga

SEQ ID NO: 40442 - DNA, 25 bp, E. coli
catgacgatatgttcctttacggga

SEQ ID NO: 40443 - DNA, 25 bp, E. coli
atatctggaactcgaaggcggcgct

SEQ ID NO: 40444 - DNA, 25 bp, E. coli
atatctggaactggaaggcggcgct

SEQ ID NO: 40445 - DNA, 25 bp, E. coli
tttgatcgtgatcccacctacgcgg

SEQ ID NO: 40446 - DNA, 25 bp, E. coli
tttgatcgtgatgccacctacgcgg

SEQ ID NO: 40447 - DNA, 25 bp, E. coli
tcttgactggacaagcagaaccact

SEQ ID NO: 40448 - DNA, 25 bp, E. coli
tcttgactggactagcagaaccact

SEQ ID NO: 40449 - DNA, 25 bp, E. coli
gaaccactgagaaatcgtcgaccaa

SEQ ID NO: 40450 - DNA, 25 bp, E. coli
gacactctcttcagtattggcgata

SEQ ID NO: 40451 - DNA, 25 bp, E. coli
gaaccactgagatatcgtcgaccaa

SEQ ID NO: 40452 - DNA, 25 bp, E. coli
gacactctcttctgtattggcgata

SEQ ID NO: 40453 - DNA, 25 bp, E. coli
gaccaaacctattataccggcgata

SEQ ID NO: 40454 - DNA, 25 bp, E. coli
cgcactttggtggaatgcaacttca

SEQ ID NO: 40455 - DNA, 25 bp, E. coli
cgcactttggtgcaatgcaacttca

SEQ ID NO: 40456 - DNA, 25 bp, E. coli
gaccaaacctataataccggcgata

SEQ ID NO: 40457 - DNA, 25 bp, E. coli
gatcgtcatgataaaccgggtagcg

SEQ ID NO: 40458 - DNA, 25 bp, E. coli
gatcgtcatgattaaccgggtagcg

SEQ ID NO: 40459 - DNA, 25 bp, E. coli
aacgtcgcggatcgttctgaagccc

SEQ ID NO: 40460 - DNA, 25 bp, E. coli
tactttgggatggaaccgcaggcaa

SEQ ID NO: 40461 - DNA, 25 bp, E. coli
tactttgggatgcaaccgcaggcaa

SEQ ID NO: 40462 - DNA, 25 bp, E. coli
aacgtcgcggatggttctgaagccc

SEQ ID NO: 40463 - DNA, 25 bp, E. coli
tatgtacgtaccaacgacagcggct

SEQ ID NO: 40464 - DNA, 25 bp, E. coli
tatgtacgtacctacgacagcggct

SEQ ID NO: 40465 - DNA, 25 bp, E. coli
tggtatcggcctcaacacgctggtt

SEQ ID NO: 40466 - DNA, 25 bp, E. coli
tctcaattgtacgacctgcagcagg

SEQ ID NO: 40467 - DNA, 25 bp, E. coli
tctcaattgtaccacctgcagcagg

SEQ ID NO: 40468 - DNA, 25 bp, E. coli
cctacatcgaggaaaacggtgcggg

SEQ ID NO: 40469 - DNA, 25 bp, E. coli
ccaacgcgcagggtaaagacagtgt

SEQ ID NO: 40470 - DNA, 25 bp, E. coli
cctacatcgaggtaaacggtgcggg

SEQ ID NO: 40471 - DNA, 25 bp, E. coli
ccaacgcgcaggctaaagacagtgt

SEQ ID NO: 40472 - DNA, 25 bp, E. coli
gaaattatgagcttcgccctcggtg

SEQ ID NO: 40473 - DNA, 25 bp, E. coli
gaaattatgagcatcgccctcggtg

SEQ ID NO: 40474 - DNA, 25 bp, E. coli
tggtatcggcctgaacacgctggtt

SEQ ID NO: 40475 - DNA, 25 bp, E. coli
tggcggcagttacaacaacgtcggt

SEQ ID NO: 40476 - DNA, 25 bp, E. coli
tggcggcagttagaacaacgtcggt

SEQ ID NO: 40477 - DNA, 25 bp, E. coli
taacgtcggtgaagctctggcagcc

SEQ ID NO: 40478 - DNA, 25 bp, E. coli
taacgcgctgctgtgggatgaagac

SEQ ID NO: 40479 - DNA, 25 bp, E. coli
taacgtcggtgatgctctggcagcc

SEQ ID NO: 40480 - DNA, 25 bp, E. coli
taacgcgctgctctgggatgaagac

SEQ ID NO: 40481 - DNA, 25 bp, E. coli
aatactggcagctgtcgcaacggct

SEQ ID NO: 40482 - DNA, 25 bp, E. coli
aatactggcagcagtcgcaacggct

SEQ ID NO: 40483 - DNA, 25 bp, E. coli
tatttacgtgaacatgccaactggc

SEQ ID NO: 40484 - DNA, 25 bp, E. coli
tatttacgtgaagatgccaactggc

SEQ ID NO: 40485 - DNA, 25 bp, E. coli
gccaggcgcgggactatttgctcta

SEQ ID NO: 40486 - DNA, 25 bp, E. coli
gccaggcgcgggtctatttgctcta

SEQ ID NO: 40487 - DNA, 25 bp, E. coli
gcttcaaaaactcaacgggcgagtg

SEQ ID NO: 40488 - DNA, 25 bp, E. coli
gctttctttggcctgcgcaataccg

SEQ ID NO: 40489 - DNA, 25 bp, E. coli
gctttctttggcgtgcgcaataccg

SEQ ID NO: 40490 - DNA, 25 bp, E. coli
gctggcccgaagacgaaatgagcga

SEQ ID NO: 40491 - DNA, 25 bp, E. coli
gcttcaaaaactgaacgggcgagtg

SEQ ID NO: 40492 - DNA, 25 bp, E. coli
gctggcccgaagtcgaaatgagcga

SEQ ID NO: 40493 - DNA, 25 bp, E. coli
gcaataccgcatgggccgggcatat

SEQ ID NO: 40494 - DNA, 25 bp, E. coli
gcaataccgcatcggccgggcatat

SEQ ID NO: 40495 - DNA, 25 bp, E. coli
gaagactccggctttgtcagcaagg

SEQ ID NO: 40496 - DNA, 25 bp, E. coli
gaagactccggcattgtcagcaagg

SEQ ID NO: 40497 - DNA, 25 bp, E. coli
gaaaacacaacgtggttatacgctg

SEQ ID NO: 40498 - DNA, 25 bp, E. coli
gaaaacacaacgaggttatacgctg

SEQ ID NO: 40499 - DNA, 25 bp, E. coli
gattgaaacgctcgtcgcgatgctg

SEQ ID NO: 40500 - DNA, 25 bp, E. coli
gattgaaacgctggtcgcgatgctg

SEQ ID NO: 40501 - DNA, 25 bp, E. coli
tggcataaccgcgaccacagtatca

SEQ ID NO: 40502 - DNA, 25 bp, E. coli
tggcataaccgccaccacagtatca

SEQ ID NO: 40503 - DNA, 25 bp, E. coli
caagttcatcagactaaggattgag

SEQ ID NO: 40504 - DNA, 25 bp, E. coli
caagttcatcagtctaaggattgag

SEQ ID NO: 40505 - DNA, 25 bp, E. coli
caccaagtgaaatgaaacgaaaggc

SEQ ID NO: 40506 - DNA, 25 bp, E. coli
caccaagtgaaaagaaacgaaaggc

SEQ ID NO: 40507 - DNA, 25 bp, E. coli
aacgcccgacgtgaagttcatcaga

SEQ ID NO: 40508 - DNA, 25 bp, E. coli
aacgcccgacgtcaagttcatcaga

SEQ ID NO: 40509 - DNA, 25 bp, E. coli
agtttgctccttaattgggccttca

SEQ ID NO: 40510 - DNA, 25 bp, E. coli
agtttgctcctttattgggccttca

SEQ ID NO: 40511 - DNA, 25 bp, E. coli
aagtgaaagcgacaacgcccgacgt

SEQ ID NO: 40512 - DNA, 25 bp, E. coli
aagtgaaagcgagaacgcccgacgt

SEQ ID NO: 40513 - DNA, 25 bp, E. coli
tggtgaccgcaacgccggataaagc

SEQ ID NO: 40514 - DNA, 25 bp, E. coli
tccgacctacagatggtgaccgcaa

SEQ ID NO: 40515 - DNA, 25 bp, E. coli
tccgacctacagttggtgaccgcaa

SEQ ID NO: 40516 - DNA, 25 bp, E. coli
tttctttcaacgttcacaaatttcg

SEQ ID NO: 40517 - DNA, 25 bp, E. coli
tttctttcaacgatcacaaatttcg

SEQ ID NO: 40518 - DNA, 25 bp, E. coli
gaaacgaaaggcaagtgaaagcgac

SEQ ID NO: 40519 - DNA, 25 bp, E. coli
gaaacgaaaggctagtgaaagcgac

SEQ ID NO: 40520 - DNA, 25 bp, E. coli
cgttttgatctgagcagcggtgtcg

SEQ ID NO: 40521 - DNA, 25 bp, E. coli
cgttttgatctgtgcagcggtgtcg

SEQ ID NO: 40522 - DNA, 25 bp, E. coli
tggtgaccgcaaggccggataaagc

SEQ ID NO: 40523 - DNA, 25 bp, E. coli
taatcaacgaaacacatcaccaagt

SEQ ID NO: 40524 - DNA, 25 bp, E. coli
taatcaacgaaagacatcaccaagt

SEQ ID NO: 40525 - DNA, 25 bp, E. coli
cagtactggtttccacaggtgccgg

SEQ ID NO: 40526 - DNA, 25 bp, E. coli
cagtactggtttgcacaggtgccgg

SEQ ID NO: 40527 - DNA, 25 bp, E. coli
tattctttctgcagcgaactccggg

SEQ ID NO: 40528 - DNA, 25 bp, E. coli
tattctttctgctgcgaactccggg

SEQ ID NO: 40529 - DNA, 25 bp, E. coli
tttactggctgagctggaccgtggc

SEQ ID NO: 40530 - DNA, 25 bp, E. coli
ttattccgatgcaggatggctcgcc

SEQ ID NO: 40531 - DNA, 25 bp, E. coli
ttattccgatgctggatggctcgcc

SEQ ID NO: 40532 - DNA, 25 bp, E. coli
tttactggctgacctggaccgtggc

SEQ ID NO: 40533 - DNA, 25 bp, E. coli
tgaattacattatcgcgcgccgtgg

SEQ ID NO: 40534 - DNA, 25 bp, E. coli
tgaattacattaacgcgcgccgtgg

SEQ ID NO: 40535 - DNA, 25 bp, E. coli
tcgccgtcatctgcaacaaggtaag

SEQ ID NO: 40536 - DNA, 25 bp, E. coli
tcgccgtcatctccaacaaggtaag

SEQ ID NO: 40537 - DNA, 25 bp, E. coli
tcatttccaccagtggagcggcggg

SEQ ID NO: 40538 - DNA, 25 bp, E. coli
tcatttccaccactggagcggcggg

SEQ ID NO: 40539 - DNA, 25 bp, E. coli
gattcgtactaccatcgcgcgactg

SEQ ID NO: 40540 - DNA, 25 bp, E. coli
gattcgtactacgatcgcgcgactg

SEQ ID NO: 40541 - DNA, 25 bp, E. coli
ggttctcgctggacaaagtggtcac

SEQ ID NO: 40542 - DNA, 25 bp, E. coli
ggttctcgctggtcaaagtggtcac

SEQ ID NO: 40543 - DNA, 25 bp, E. coli
ggttcgagctttaccgccgctggat

SEQ ID NO: 40544 - DNA, 25 bp, E. coli
ggttcgagcttttccgccgctggat

SEQ ID NO: 40545 - DNA, 25 bp, E. coli
taatatcacggcagaaggctggttc

SEQ ID NO: 40546 - DNA, 25 bp, E. coli
taatatcacggctgaaggctggttc

SEQ ID NO: 40547 - DNA, 25 bp, E. coli
aagcttcaggcagccgccgttatct

SEQ ID NO: 40548 - DNA, 25 bp, E. coli
aagcttcaggcacccgccgttatct

SEQ ID NO: 40549 - DNA, 25 bp, E. coli
caaaagtagccatattgcttcaggc

SEQ ID NO: 40550 - DNA, 25 bp, E. coli
caaaagtagccaaattgcttcaggc

SEQ ID NO: 40551 - DNA, 25 bp, E. coli
tacagtgagtccagtttcggacttc

SEQ ID NO: 40552 - DNA, 25 bp, E. coli
tacagtgagtcctgtttcggacttc

SEQ ID NO: 40553 - DNA, 25 bp, E. coli
aaagaaacattccagaacttccgca

SEQ ID NO: 40554 - DNA, 25 bp, E. coli
aaagaaacattcgagaacttccgca

SEQ ID NO: 40555 - DNA, 25 bp, E. coli
tttaatcaactgtagctgaacccgt

SEQ ID NO: 40556 - DNA, 25 bp, E. coli
tttaatcaactgaagctgaacccgt

SEQ ID NO: 40557 - DNA, 25 bp, E. coli
tcagcactgccaaaacttgtcacat

SEQ ID NO: 40558 - DNA, 25 bp, E. coli
tcagcactgccataacttgtcacat

SEQ ID NO: 40559 - DNA, 25 bp, E. coli
gccgctccgactactatactgaata

SEQ ID NO: 40560 - DNA, 25 bp, E. coli
gcttcaggcaccatcagttcaccat

SEQ ID NO: 40561 - DNA, 25 bp, E. coli
gcttcaggcaccttcagttcaccat

SEQ ID NO: 40562 - DNA, 25 bp, E. coli
gccgctccgacttctatactgaata

SEQ ID NO: 40563 - DNA, 25 bp, E. coli
gaaaacgccaacataagagaaacct

SEQ ID NO: 40564 - DNA, 25 bp, E. coli
gaaaacgccaacttaagagaaacct

SEQ ID NO: 40565 - DNA, 25 bp, E. coli
gtcaaaattcttggccaccagtcag

SEQ ID NO: 40566 - DNA, 25 bp, E. coli
gtcaaaattcttcgccaccagtcag

SEQ ID NO: 40567 - DNA, 25 bp, E. coli
ttacccttcctctacaaaatagctg

SEQ ID NO: 40568 - DNA, 25 bp, E. coli
ttacccttcctcaacaaaatagctg

SEQ ID NO: 40569 - DNA, 25 bp, E. coli
aagccagaacatcaccaagacagga

SEQ ID NO: 40570 - DNA, 25 bp, E. coli
caattgtggctttcctcttatctgg

SEQ ID NO: 40571 - DNA, 25 bp, E. coli
aatcaaaggcggaaatcgcacgtca

SEQ ID NO: 40572 - DNA, 25 bp, E. coli
aatcaaaggcggtaatcgcacgtca

SEQ ID NO: 40573 - DNA, 25 bp, E. coli
aagccagaacatgaccaagacagga

SEQ ID NO: 40574 - DNA, 25 bp, E. coli
caattgtggcttacctcttatctgg

SEQ ID NO: 40575 - DNA, 25 bp, E. coli
cataaacagcctatatcaagccgcc

SEQ ID NO: 40576 - DNA, 25 bp, E. coli
cataaacagcctttatcaagccgcc

SEQ ID NO: 40577 - DNA, 25 bp, E. coli
aaaaaattgcatcaggagccgtcaa

SEQ ID NO: 40578 - DNA, 25 bp, E. coli
aaaaaattgcatgaggagccgtcaa

SEQ ID NO: 40579 - DNA, 25 bp, E. coli
tcgcacgtcattacaaagtccaacc

SEQ ID NO: 40580 - DNA, 25 bp, E. coli
tcgcacgtcatttcaaagtccaacc

SEQ ID NO: 40581 - DNA, 25 bp, E. coli
tgccgcaatggaaatgaaggtagct

SEQ ID NO: 40582 - DNA, 25 bp, E. coli
tgccgcaatggatatgaaggtagct

SEQ ID NO: 40583 - DNA, 25 bp, E. coli
tctggaaatgcttcggagcctagtt

SEQ ID NO: 40584 - DNA, 25 bp, E. coli
tctggaaatgctacggagcctagtt

SEQ ID NO: 40585 - DNA, 25 bp, E. coli
gccgcctctgatgaaaaaagagcaa

SEQ ID NO: 40586 - DNA, 25 bp, E. coli
gccgcctctgatcaaaaaagagcaa

SEQ ID NO: 40587 - DNA, 25 bp, E. coli
gagcctagttggcttgatcatgacg

SEQ ID NO: 40588 - DNA, 25 bp, E. coli
gacgttcgtgcctacattgccgcaa

SEQ ID NO: 40589 - DNA, 25 bp, E. coli
gagcctagttgggttgatcatgacg

SEQ ID NO: 40590 - DNA, 25 bp, E. coli
gacgttcgtgccaacattgccgcaa

SEQ ID NO: 40591 - DNA, 25 bp, E. coli
caatttttcgttatcaacaagcgcg

SEQ ID NO: 40592 - DNA, 25 bp, E. coli
aagcgcggcgcgttgccgcttactc

SEQ ID NO: 40593 - DNA, 25 bp, E. coli
caatttttcgttttcaacaagcgcg

SEQ ID NO: 40594 - DNA, 25 bp, E. coli
tactcaagaagatagaattatgacg

SEQ ID NO: 40595 - DNA, 25 bp, E. coli
tagccgcaatttatcgttttcaaca

SEQ ID NO: 40596 - DNA, 25 bp, E. coli
tagccgcaatttttcgttttcaaca

SEQ ID NO: 40597 - DNA, 25 bp, E. coli
tactcaagaagaaagaattatgacg

SEQ ID NO: 40598 - DNA, 25 bp, E. coli
aagcgcggcgcgatgccgcttactc

SEQ ID NO: 40599 - DNA, 25 bp, E. coli
aagaaagaattaagacgttgtctcc

SEQ ID NO: 40600 - DNA, 25 bp, E. coli
aagaaagaattatgacgttgtctcc

SEQ ID NO: 40601 - DNA, 25 bp, E. coli
ttttcgttttcatcaagcgcggcgc

SEQ ID NO: 40602 - DNA, 25 bp, E. coli
ttcgttttcaacaagcgcggcgcga

SEQ ID NO: 40603 - DNA, 25 bp, E. coli
ttttcgttttcaacaagcgcggcgc

SEQ ID NO: 40604 - DNA, 25 bp, E. coli
ttcgttttcaactagcgcggcgcga

SEQ ID NO: 40605 - DNA, 25 bp, E. coli
gccgcttactcaagaagaaagaatt

SEQ ID NO: 40606 - DNA, 25 bp, E. coli
gccgcttactcatgaagaaagaatt

SEQ ID NO: 40607 - DNA, 25 bp, E. coli
gcgcgatgccgcatactcaagaaga

SEQ ID NO: 40608 - DNA, 25 bp, E. coli
gcgcgatgccgcttactcaagaaga

SEQ ID NO: 40609 - DNA, 25 bp, E. coli
cgttttcaacaaccgcggcgcgatg

SEQ ID NO: 40610 - DNA, 25 bp, E. coli
cgttttcaacaagcgcggcgcgatg

(The sequence listing continues in the following parts.)

What is claimed is:

1. An array comprising a plurality of nucleic acid probes, wherein the plurality of nucleic acid probes of the array comprises each of the sequences listed in SEQ ID Nos. 1-224,976, and wherein each probe in the plurality of nucleic acid probes consists of one of the sequences listed in SEQ ID Nos. 1-224,976.

2. The array of claim 1 further comprising at least one probe that is the perfect complement of one of the sequences listed in SEQ ID Nos. 1-224,976.

3. The array of claim 1 wherein said plurality of nucleic acid probes is attached to a solid support.

4. The array of claim 1 wherein each probe is attached to the array in a different localized area that is determinable.

5. The array of claim 1 wherein the array comprises a plurality of beads wherein the probes are attached to the beads and the probes on a bead consist of one of the sequences listed in SEQ ID Nos. 1-224,976.

6. The array of claim 1 wherein the array consists of a single contiguous solid support.

7. A method of monitoring gene expression levels in a biological sample comprising *E. coli* nucleic acid, comprising:
    isolating nucleic acid derived from the sample;
    labeling the nucleic acid;
    hybridizing the labeled nucleic acid to an array comprising a plurality of nucleic acid probes, wherein the plurality of nucleic acid probes of the array comprises each of the sequences listed in SEQ ID Nos. 1-224,976 and, wherein each probe in the plurality of nucleic acid probes consists of one of the sequences listed in SEQ ID Nos. 1-224,976; and
    detecting a hybridization pattern, wherein the intensity of signal resulting from hybridization to probes on the array is used to monitor gene expression levels.

8. The method of claim 7 wherein said monitoring gene expression levels comprises comparing gene expression levels of nucleic acids derived from two or more different samples and further comprises the step of:
    comparing said hybridization patterns between said nucleic acids derived from said two or more different samples.

9. The method of claim 7 wherein the labeled nucleic acid hybridized to the array consists essentially of DNA.

10. The method of claim 7 wherein the labeled nucleic acid hybridized to the array consists essentially of RNA that is complementary to the target mRNA.

11. The method of claim 7 wherein the labeled nucleic acid hybridized to the array consists essentially of RNA that is in the sense orientation relative to the target mRNA.

12. The method of claim 7 wherein the labeled nucleic acid is hybridized to the array in a single reaction.

13. A method of monitoring gene expression in a bacterial sample, comprising:
    isolating nucleic acid derived from the bacterial sample;
    labeling the nucleic acid with a detectable label;
    hybridizing the labeled nucleic acid to an array comprising a plurality of nucleic acid probes, wherein the plurality of nucleic acid probes of the array comprises each of the sequences listed in SEQ ID Nos. 1-224,976, and wherein each probe in the plurality of nucleic acid probes consists of one of the sequences listed in SEQ ID Nos. 1-224,976; and
    detecting a hybridization pattern; and analyzing the hybridization pattern to determine a relative expression level of at least 100 genes.

14. A method of identifying a bacterial sample as being from a strain selected from the group of strains consisting of K12, O 157:H7-EDL933, O 157:H7 Sakai or CFT073 comprising:
    obtaining a labeled nucleic acid sample derived from the bacterial sample;
    hybridizing the labeled nucleic acid sample to an array comprising a plurality of nucleic acid probes, wherein the plurality of nucleic acid probes of the array comprises each of the sequences listed in SEQ ID Nos. 1-224,976, and wherein each probe in the plurality of nucleic acid probes consists of one of the sequences listed in SEQ ID Nos. 1-224,976; and
    identifying the bacterial sample as being *E. coli* strain K12 if the sample hybridizes to probes to *E. coli* strain K12; *E. coli* strain O 157:H7-EDL933 if the sample hybridizes to probes to *E coli* strain O 157:H7-EDL933; *E. coli* strain O 157:H7 Sakai if the sample hybridizes to probes to *E. coli* strain O 157:H7 Sakai, and *E. coli* strain CFT073 if the sample hybridizes to probes to *E. coli* strain CFT073.

* * * * *